United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 73

SEQ ID NO: 3323585 - RNA, 23 nt, Human
ugcuuuuuaauauugauaugcuu

SEQ ID NO: 3323586 - RNA, 17 nt, Human
ugcuuuuggucugugug

SEQ ID NO: 3323587 - RNA, 18 nt, Human
ugcuuuuggucuguguga

SEQ ID NO: 3323588 - RNA, 21 nt, Human
uggaaauuuguuauaaugaau

SEQ ID NO: 3323589 - RNA, 23 nt, Human
uggaaauuuguuauaaugaauga

SEQ ID NO: 3323590 - RNA, 15 nt, Human
uggaagacagcucuu

SEQ ID NO: 3323591 - RNA, 16 nt, Human
uggaagacagcucuua

SEQ ID NO: 3323592 - RNA, 22 nt, Human
agcuugaggguugggcuggugu

SEQ ID NO: 3323593 - RNA, 23 nt, Human
agcuugaccgugaggccagagac

SEQ ID NO: 3323594 - RNA, 19 nt, Human
agcuugaccgugaggccag

SEQ ID NO: 3323595 - RNA, 22 nt, Human
agcuugaccgugaggccagaga

SEQ ID NO: 3323596 - RNA, 20 nt, Human
agcuugaccgugaggccaga

SEQ ID NO: 3323597 - RNA, 21 nt, Human
agcuuguaaauagcucaggug

SEQ ID NO: 3323598 - RNA, 14 nt, Human
aggaaaagcugcug

SEQ ID NO: 3323599 - RNA, 14 nt, Human
ugcgguccacccag

SEQ ID NO: 3323600 - RNA, 15 nt, Human
ugcgguccacccagg

SEQ ID NO: 3323601 - RNA, 11 nt, Human
ugcuacacacu

SEQ ID NO: 3323602 - RNA, 20 nt, Human
agcuuaaaggggcuagagug

SEQ ID NO: 3323603 - RNA, 13 nt, Human
ugcuaucuccccc

SEQ ID NO: 3323604 - RNA, 17 nt, Human
ugcuaucucccccagcc

SEQ ID NO: 3323605 - RNA, 14 nt, Human
ugcuaucuccccca

SEQ ID NO: 3323606 - RNA, 14 nt, Human
ugcucugcugacag

SEQ ID NO: 3323607 - RNA, 15 nt, Human
ugcucugcugacaga

SEQ ID NO: 3323608 - RNA, 20 nt, Human
ugcuccagcuguucagcugg

SEQ ID NO: 3323609 - RNA, 21 nt, Human
ugcuccagcuguucagcuggu

SEQ ID NO: 3323610 - RNA, 23 nt, Human
aggaaaggcuccaggagcagcca

SEQ ID NO: 3323611 - RNA, 15 nt, Human
aggaagcucagggcc

SEQ ID NO: 3323612 - RNA, 12 nt, Human
aggaagcucagg

SEQ ID NO: 3323613 - RNA, 14 nt, Human
aggaagcucagggc

SEQ ID NO: 3323614 - RNA, 13 nt, Human
aggaagcucaggg

SEQ ID NO: 3323615 - RNA, 12 nt, Human
ugccucagccuc

SEQ ID NO: 3323616 - RNA, 13 nt, Human
ugccucagccucc

SEQ ID NO: 3323617 - RNA, 12 nt, Human
ugccgcagcccu

SEQ ID NO: 3323618 - RNA, 18 nt, Human
ugcccuuaccugccagga

SEQ ID NO: 3323619 - RNA, 14 nt, Human
agcugccagccgag

SEQ ID NO: 3323620 - RNA, 20 nt, Human
agcugccagccgagauagcc

SEQ ID NO: 3323621 - RNA, 16 nt, Human
agcucuguccugggag

SEQ ID NO: 3323622 - RNA, 21 nt, Human
agcucuguccugggagugagc

SEQ ID NO: 3323623 - RNA, 13 nt, Human
agcucccaggcau

SEQ ID NO: 3323624 - RNA, 13 nt, Human
agcuccuucuguc

SEQ ID NO: 3323625 - RNA, 15 nt, Human
agcuccuucuguccu

SEQ ID NO: 3323626 - RNA, 23 nt, Human
agcucccaggcauuccccaggag

SEQ ID NO: 3323627 - RNA, 14 nt, Human
agcucuguccuggg

SEQ ID NO: 3323628 - RNA, 17 nt, Human
agcucugguccauagag

SEQ ID NO: 3323629 - RNA, 12 nt, Human
agcucuggucca

SEQ ID NO: 3323630 - RNA, 16 nt, Human
agcuccuucuguccua

SEQ ID NO: 3323631 - RNA, 21 nt, Human
agcuccuucuguccuacucug

SEQ ID NO: 3323632 - RNA, 16 nt, Human
agcucucuccucccuu

SEQ ID NO: 3323633 - RNA, 21 nt, Human
ugccuuacccucauguucuua

SEQ ID NO: 3323634 - RNA, 16 nt, Human
ugccuuggggacaaga

SEQ ID NO: 3323635 - RNA, 20 nt, Human
ugccuuacccucauguucuu

SEQ ID NO: 3323636 - RNA, 17 nt, Human
ugccuguugggccagga

SEQ ID NO: 3323637 - RNA, 16 nt, Human
ugccuguugggccagg

SEQ ID NO: 3323638 - RNA, 21 nt, Human
ugccuguucagcuccagcuca

SEQ ID NO: 3323639 - RNA, 19 nt, Human
agcuguuacugucuucagu

SEQ ID NO: 3323640 - RNA, 20 nt, Human
agcugggacuacaggcaccc

SEQ ID NO: 3323641 - RNA, 23 nt, Human
agcugggacuacaggcacccacc

SEQ ID NO: 3323642 - RNA, 16 nt, Human
agcugggacuacaggu

SEQ ID NO: 3323643 - RNA, 20 nt, Human
agcugggguggggaccucag

SEQ ID NO: 3323644 - RNA, 23 nt, Human
agcugggguggggaccucaggcc

SEQ ID NO: 3323645 - RNA, 22 nt, Human
agcugggguggggaccucaggc

SEQ ID NO: 3323646 - RNA, 19 nt, Human
agcugggacuacaggcacc

SEQ ID NO: 3323647 - RNA, 14 nt, Human
agcuguuacugucu

SEQ ID NO: 3323648 - RNA, 18 nt, Human
agcuguuacugucuucag

SEQ ID NO: 3323649 - RNA, 17 nt, Human
agcugugcucuggacag

SEQ ID NO: 3323650 - RNA, 18 nt, Human
agcugugcucuggacagg

SEQ ID NO: 3323651 - RNA, 23 nt, Human
agcugugcucuggacaggcaugu

SEQ ID NO: 3323652 - RNA, 16 nt, Human
agcugcuugggcuuca

SEQ ID NO: 3323653 - RNA, 18 nt, Human
agcugccuguucagcucc

SEQ ID NO: 3323654 - RNA, 14 nt, Human
agcugccuguucag

SEQ ID NO: 3323655 - RNA, 16 nt, Human
agcugccuguucagcu

SEQ ID NO: 3323656 - RNA, 20 nt, Human
ugccuggauggggcugcacc

SEQ ID NO: 3323657 - RNA, 17 nt, Human
ugccuggauggggcugc

SEQ ID NO: 3323658 - RNA, 16 nt, Human
ugccuggauggggcug

SEQ ID NO: 3323659 - RNA, 14 nt, Human
ugccucagccuccc

SEQ ID NO: 3323660 - RNA, 18 nt, Human
ugccucugccucugacac

SEQ ID NO: 3323661 - RNA, 20 nt, Human
ugccucugccucugacacac

SEQ ID NO: 3323662 - RNA, 17 nt, Human
ugccucugccucugaca

SEQ ID NO: 3323663 - RNA, 20 nt, Human
ugccugcccaggccccugcc

SEQ ID NO: 3323664 - RNA, 22 nt, Human
ugccugcccaggccccugccac

SEQ ID NO: 3323665 - RNA, 23 nt, Human
ugccugcccaggccccugccacc

SEQ ID NO: 3323666 - RNA, 17 nt, Human
agccacggccaggccag

SEQ ID NO: 3323667 - RNA, 18 nt, Human
agccacggccaggccaga

SEQ ID NO: 3323668 - RNA, 13 nt, Human
ugcaaaccaucau

SEQ ID NO: 3323669 - RNA, 12 nt, Human
ugcaaaccauca

SEQ ID NO: 3323670 - RNA, 18 nt, Human
ugcaaaccaucauugaaa

SEQ ID NO: 3323671 - RNA, 21 nt, Human
ugcaaaggguaucaggugcug

SEQ ID NO: 3323672 - RNA, 20 nt, Human
ugcaaaguaucccuacugua

SEQ ID NO: 3323673 - RNA, 15 nt, Human
ugcaaggucauuuuu

SEQ ID NO: 3323674 - RNA, 12 nt, Human
agcccaggccuc

SEQ ID NO: 3323675 - RNA, 15 nt, Human
ugcacuccagccugg

SEQ ID NO: 3323676 - RNA, 16 nt, Human
ugcacuccagccuggg

SEQ ID NO: 3323677 - RNA, 14 nt, Human
ugcacuccagccug

SEQ ID NO: 3323678 - RNA, 16 nt, Human
ugcaccggcuggccug

SEQ ID NO: 3323679 - RNA, 15 nt, Human
ugcaccggcuggccu

SEQ ID NO: 3323680 - RNA, 14 nt, Human
ugcaccggcuggcc

SEQ ID NO: 3323681 - RNA, 15 nt, Human
ugcaccacugcacuc

SEQ ID NO: 3323682 - RNA, 13 nt, Human
ugcaccagcccuu

SEQ ID NO: 3323683 - RNA, 21 nt, Human
ugcaccacugcacuccagccu

SEQ ID NO: 3323684 - RNA, 14 nt, Human
agccccgaggccuu

SEQ ID NO: 3323685 - RNA, 19 nt, Human
agcccaggccuccuacagc

SEQ ID NO: 3323686 - RNA, 14 nt, Human
agcccaggccuccu

SEQ ID NO: 3323687 - RNA, 22 nt, Human
agccccuggaugcagccucaca

SEQ ID NO: 3323688 - RNA, 14 nt, Human
agccccuucugacc

SEQ ID NO: 3323689 - RNA, 16 nt, Human
agccccuucugaccca

SEQ ID NO: 3323690 - RNA, 15 nt, Human
agccccuucugaccc

SEQ ID NO: 3323691 - RNA, 15 nt, Human
agcccgggcucugcc

SEQ ID NO: 3323692 - RNA, 14 nt, Human
agcccgggcucugc

SEQ ID NO: 3323693 - RNA, 13 nt, Human
agcccgggcucug

SEQ ID NO: 3323694 - RNA, 19 nt, Human
agcccugcagagggcacag

SEQ ID NO: 3323695 - RNA, 16 nt, Human
agcccugcagagggca

SEQ ID NO: 3323696 - RNA, 15 nt, Human
agcccugcagagggc

SEQ ID NO: 3323697 - RNA, 14 nt, Human
agcccugcagaggg

SEQ ID NO: 3323698 - RNA, 16 nt, Human
agcccgggcucugccu

SEQ ID NO: 3323699 - RNA, 22 nt, Human
ugccagccgagauagccaaggc

SEQ ID NO: 3323700 - RNA, 17 nt, Human
ugccagccgagauagcc

SEQ ID NO: 3323701 - RNA, 14 nt, Human
ugccaaugggagcu

SEQ ID NO: 3323702 - RNA, 13 nt, Human
ugccaauggacua

SEQ ID NO: 3323703 - RNA, 16 nt, Human
ugcauuuaaaagauac

SEQ ID NO: 3323704 - RNA, 17 nt, Human
agccugugccucuggga

SEQ ID NO: 3323705 - RNA, 18 nt, Human
agccugugccucugggac

SEQ ID NO: 3323706 - RNA, 22 nt, Human
agcgcccaguuggguggaugcc

SEQ ID NO: 3323707 - RNA, 19 nt, Human
agccuugaccauucuccac

SEQ ID NO: 3323708 - RNA, 18 nt, Human
agccuugaccauucucca

SEQ ID NO: 3323709 - RNA, 21 nt, Human
agccuugaccauucuccaccu

SEQ ID NO: 3323710 - RNA, 19 nt, Human
agccuugcggaagguucua

SEQ ID NO: 3323711 - RNA, 23 nt, Human
agccuugaacuuugaccucugca

SEQ ID NO: 3323712 - RNA, 20 nt, Human
agccuuagaagucacacagu

SEQ ID NO: 3323713 - RNA, 14 nt, Human
ugcauaccacuuuu

SEQ ID NO: 3323714 - RNA, 16 nt, Human
ugcauaccacuuuugu

SEQ ID NO: 3323715 - RNA, 20 nt, Human
ugcauaccacuuuuguucuu

SEQ ID NO: 3323716 - RNA, 18 nt, Human
ugcauaccacuuuuguuc

SEQ ID NO: 3323717 - RNA, 17 nt, Human
ugcaucguuucaucuuc

SEQ ID NO: 3323718 - RNA, 18 nt, Human
ugcaugcugucccuuacg

SEQ ID NO: 3323719 - RNA, 16 nt, Human
ugcaugcugucccuua

SEQ ID NO: 3323720 - RNA, 21 nt, Human
ugcaugcugucccuuacguga

SEQ ID NO: 3323721 - RNA, 19 nt, Human
ugcaugcugucccuuacgu

SEQ ID NO: 3323722 - RNA, 13 nt, Human
agccuccugcccu

SEQ ID NO: 3323723 - RNA, 18 nt, Human
agccuccugcccuuaccu

SEQ ID NO: 3323724 - RNA, 14 nt, Human
agccuccugcccuu

SEQ ID NO: 3323725 - RNA, 12 nt, Human
ugcagacaggca

SEQ ID NO: 3323726 - RNA, 13 nt, Human
ugcagacaggcaa

SEQ ID NO: 3323727 - RNA, 21 nt, Human
ugcagacaggcaagcaccucc

SEQ ID NO: 3323728 - RNA, 18 nt, Human
ugcagccucacaguccuu

SEQ ID NO: 3323729 - RNA, 21 nt, Human
ugcagccucacaguccuuacc

SEQ ID NO: 3323730 - RNA, 17 nt, Human
ugcagccucacaguccu

SEQ ID NO: 3323731 - RNA, 22 nt, Human
ugauggggcccugccuccuuug

SEQ ID NO: 3323732 - RNA, 19 nt, Human
ugauguuuuccaugagucc

SEQ ID NO: 3323733 - RNA, 18 nt, Human
ugauguuuuaaggaugcu

SEQ ID NO: 3323734 - RNA, 17 nt, Human
ugauguuuuccaugagu

SEQ ID NO: 3323735 - RNA, 21 nt, Human
ugauguuuuaaggaugcuugu

SEQ ID NO: 3323736 - RNA, 16 nt, Human
agccacggccaggcca

SEQ ID NO: 3323737 - RNA, 20 nt, Human
ugauuaaccacuucagcuga

SEQ ID NO: 3323738 - RNA, 17 nt, Human
ugauuaaauucuugcaa

SEQ ID NO: 3323739 - RNA, 16 nt, Human
ugauuaaauucuugca

SEQ ID NO: 3323740 - RNA, 13 nt, Human
ugauuaaauucuu

SEQ ID NO: 3323741 - RNA, 23 nt, Human
ugaugaaaugaggucagagccug

SEQ ID NO: 3323742 - RNA, 19 nt, Human
ugaugaucuuugcagacag

SEQ ID NO: 3323743 - RNA, 20 nt, Human
ugaugaucuuugcagacagg

SEQ ID NO: 3323744 - RNA, 14 nt, Human
ugaucuaggaagac

SEQ ID NO: 3323745 - RNA, 22 nt, Human
ugaugaaaugaggucagagccu

SEQ ID NO: 3323746 - RNA, 21 nt, Human
ugaugggcaacccccagccug

SEQ ID NO: 3323747 - RNA, 22 nt, Human
ugaugggcaacccccagccugc

SEQ ID NO: 3323748 - RNA, 13 nt, Human
ugauggggcccug

SEQ ID NO: 3323749 - RNA, 21 nt, Human
ugaugaucuuugcagacaggc

SEQ ID NO: 3323750 - RNA, 16 nt, Human
ugauccucccaccuca

SEQ ID NO: 3323751 - RNA, 13 nt, Human
ugaucuaggaaga

SEQ ID NO: 3323752 - RNA, 19 nt, Human
ugauccucccaccucagcc

SEQ ID NO: 3323753 - RNA, 20 nt, Human
ugauccucccaccucagccu

SEQ ID NO: 3323754 - RNA, 18 nt, Human
ugauccucccaccucagc

SEQ ID NO: 3323755 - RNA, 21 nt, Human
agcauauucaggaagcucagg

SEQ ID NO: 3323756 - RNA, 19 nt, Human
agcauauucaggaagcuca

SEQ ID NO: 3323757 - RNA, 17 nt, Human
agcauauucaggaagcu

SEQ ID NO: 3323758 - RNA, 15 nt, Human
ugaucacggcucacu

SEQ ID NO: 3323759 - RNA, 13 nt, Human
ugaucacggcuca

SEQ ID NO: 3323760 - RNA, 14 nt, Human
ugaucacggcucac

SEQ ID NO: 3323761 - RNA, 23 nt, Human
agcaucaggccaggcccucugcc

SEQ ID NO: 3323762 - RNA, 21 nt, Human
agcaucaggccaggcccucug

SEQ ID NO: 3323763 - RNA, 22 nt, Human
agcaucaggccaggcccucugc

SEQ ID NO: 3323764 - RNA, 16 nt, Human
agcauauucaggaagc

SEQ ID NO: 3323765 - RNA, 13 nt, Human
agcauggcugcca

SEQ ID NO: 3323766 - RNA, 19 nt, Human
agcauggcugccaauggga

SEQ ID NO: 3323767 - RNA, 22 nt, Human
agcauuuugcuaaaugugaaug

SEQ ID NO: 3323768 - RNA, 15 nt, Human
agcauuuugcuaaau

SEQ ID NO: 3323769 - RNA, 20 nt, Human
agcagggagggcuucugcca

SEQ ID NO: 3323770 - RNA, 13 nt, Human
agcagggcucagc

SEQ ID NO: 3323771 - RNA, 14 nt, Human
agcagggcucagcg

SEQ ID NO: 3323772 - RNA, 15 nt, Human
agcagggcucagcgg

SEQ ID NO: 3323773 - RNA, 22 nt, Human
agcagggcucagcggggacagc

SEQ ID NO: 3323774 - RNA, 13 nt, Human
agcagggaaacag

SEQ ID NO: 3323775 - RNA, 14 nt, Human
agcagggaaacagc

SEQ ID NO: 3323776 - RNA, 15 nt, Human
agcagggaaacagcu

SEQ ID NO: 3323777 - RNA, 23 nt, Human
agcaggcucucaggccagcugcu

SEQ ID NO: 3323778 - RNA, 22 nt, Human
agcaggcucucaggccagcugc

SEQ ID NO: 3323779 - RNA, 21 nt, Human
agcaggcucucaggccagcug

SEQ ID NO: 3323780 - RNA, 19 nt, Human
agcaggcucucaggccagc

SEQ ID NO: 3323781 - RNA, 18 nt, Human
agcaggcucucaggccag

SEQ ID NO: 3323782 - RNA, 17 nt, Human
agcaggcucucaggcca

SEQ ID NO: 3323783 - RNA, 16 nt, Human
agcaggcucucaggcc

SEQ ID NO: 3323784 - RNA, 15 nt, Human
agcaggcucucaggc

SEQ ID NO: 3323785 - RNA, 14 nt, Human
agcaggcucucagg

SEQ ID NO: 3323786 - RNA, 13 nt, Human
agcaggcucucag

SEQ ID NO: 3323787 - RNA, 17 nt, Human
agcaggcucgggcuccc

SEQ ID NO: 3323788 - RNA, 17 nt, Human
ugacccaugcugcccug

SEQ ID NO: 3323789 - RNA, 19 nt, Human
ugacccaugcugcccugug

SEQ ID NO: 3323790 - RNA, 18 nt, Human
ugacccaugcugcccugu

SEQ ID NO: 3323791 - RNA, 20 nt, Human
ugacccaugcugcccuguga

SEQ ID NO: 3323792 - RNA, 16 nt, Human
agcagcagggagggcu

SEQ ID NO: 3323793 - RNA, 11 nt, Human
agcagccacau

SEQ ID NO: 3323794 - RNA, 13 nt, Human
agcaggacaugga

SEQ ID NO: 3323795 - RNA, 15 nt, Human
ugauacaaugcugug

SEQ ID NO: 3323796 - RNA, 14 nt, Human
ugauacaaugcugu

SEQ ID NO: 3323797 - RNA, 21 nt, Human
ugagugggggaucacagccuc

SEQ ID NO: 3323798 - RNA, 18 nt, Human
ugaguucauacccuguua

SEQ ID NO: 3323799 - RNA, 18 nt, Human
ugagucaccaagcccagu

SEQ ID NO: 3323800 - RNA, 20 nt, Human
ugaguacguugugcauuugg

SEQ ID NO: 3323801 - RNA, 14 nt, Human
ugagugagcaugcc

SEQ ID NO: 3323802 - RNA, 14 nt, Human
ugagugccuuacac

SEQ ID NO: 3323803 - RNA, 13 nt, Human
ugagugccuuaca

SEQ ID NO: 3323804 - RNA, 17 nt, Human
ugagugcagcucuggag

SEQ ID NO: 3323805 - RNA, 19 nt, Human
agcauaaaaauuagccaag

SEQ ID NO: 3323806 - RNA, 23 nt, Human
agcauaaaaauuagccaagugug

SEQ ID NO: 3323807 - RNA, 19 nt, Human
ugaguacguugugcauuug

SEQ ID NO: 3323808 - RNA, 18 nt, Human
ugaguacguugugcauuu

SEQ ID NO: 3323809 - RNA, 17 nt, Human
ugaguacguugugcauu

SEQ ID NO: 3323810 - RNA, 16 nt, Human
ugaguacguugugcau

SEQ ID NO: 3323811 - RNA, 18 nt, Human
auuguuuucaguguacau

SEQ ID NO: 3323812 - RNA, 19 nt, Human
auuguuuucaguguacaug

SEQ ID NO: 3323813 - RNA, 17 nt, Human
auuguuuucaguguaca

SEQ ID NO: 3323814 - RNA, 22 nt, Human
auuuacaacugggggaggguga

SEQ ID NO: 3323815 - RNA, 17 nt, Human
auuuacuucuuauacau

SEQ ID NO: 3323816 - RNA, 19 nt, Human
auuuacuucuuauacauuu

SEQ ID NO: 3323817 - RNA, 20 nt, Human
auuuacuucuuauacauuug

SEQ ID NO: 3323818 - RNA, 14 nt, Human
auuucccaaagcag

SEQ ID NO: 3323819 - RNA, 17 nt, Human
auuuccguuaaaauacc

SEQ ID NO: 3323820 - RNA, 21 nt, Human
auuugaggucuguucuuucca

SEQ ID NO: 3323821 - RNA, 21 nt, Human
auuuggugguuucagaaaugu

SEQ ID NO: 3323822 - RNA, 15 nt, Human
auuugagcagggcuc

SEQ ID NO: 3323823 - RNA, 15 nt, Human
auuugaggucuguuc

SEQ ID NO: 3323824 - RNA, 18 nt, Human
auuugaggucuguucuuu

SEQ ID NO: 3323825 - RNA, 17 nt, Human
auuugaggucuguucuu

SEQ ID NO: 3323826 - RNA, 22 nt, Human
auuggcuagagguucaaagaua

SEQ ID NO: 3323827 - RNA, 20 nt, Human
auuggcuagagguucaaaga

SEQ ID NO: 3323828 - RNA, 19 nt, Human
auuggcuagagguucaaag

SEQ ID NO: 3323829 - RNA, 23 nt, Human
auuggcuagagguucaaagauau

SEQ ID NO: 3323830 - RNA, 16 nt, Human
auugcaacaggcuggg

SEQ ID NO: 3323831 - RNA, 19 nt, Human
auugcaacaggcugggcuu

SEQ ID NO: 3323832 - RNA, 12 nt, Human
auugcaccacug

SEQ ID NO: 3323833 - RNA, 17 nt, Human
auugcaacaggcugggc

SEQ ID NO: 3323834 - RNA, 18 nt, Human
auugcaacaggcugggcu

SEQ ID NO: 3323835 - RNA, 18 nt, Human
uuuuaaaaaacugcugac

SEQ ID NO: 3323836 - RNA, 19 nt, Human
auguuacauaagauaaaug

SEQ ID NO: 3323837 - RNA, 20 nt, Human
auguuacauaagauaaaugu

SEQ ID NO: 3323838 - RNA, 21 nt, Human
uuuuagacccuauugcugcuu

SEQ ID NO: 3323839 - RNA, 17 nt, Human
uuuuagaguugauacua

SEQ ID NO: 3323840 - RNA, 12 nt, Human
auguugaaagau

SEQ ID NO: 3323841 - RNA, 20 nt, Human
auguucuuucacccuuuucu

SEQ ID NO: 3323842 - RNA, 13 nt, Human
auguugcccaggc

SEQ ID NO: 3323843 - RNA, 18 nt, Human
auguugaaagaucaaaag

SEQ ID NO: 3323844 - RNA, 14 nt, Human
auguugcccaggca

SEQ ID NO: 3323845 - RNA, 15 nt, Human
auguugcccaggcag

SEQ ID NO: 3323846 - RNA, 19 nt, Human
uuuuauggcuuuugugcau

SEQ ID NO: 3323847 - RNA, 18 nt, Human
uuuuauggcuuuugugca

SEQ ID NO: 3323848 - RNA, 15 nt, Human
uuuuaguagagacag

SEQ ID NO: 3323849 - RNA, 12 nt, Human
uuuuauuaaauu

SEQ ID NO: 3323850 - RNA, 21 nt, Human
uuuuauggcuuuugugcauua

SEQ ID NO: 3323851 - RNA, 23 nt, Human
uuuucuacucgaguuacagacaa

SEQ ID NO: 3323852 - RNA, 16 nt, Human
auguuggccaggcugg

SEQ ID NO: 3323853 - RNA, 13 nt, Human
uuuucuguucuuu

SEQ ID NO: 3323854 - RNA, 17 nt, Human
auguuggccaggcuggu

SEQ ID NO: 3323855 - RNA, 19 nt, Human
auuaaaacacaacaucuuu

SEQ ID NO: 3323856 - RNA, 23 nt, Human
auuaaaaaucucaaauuucuaaa

SEQ ID NO: 3323857 - RNA, 22 nt, Human
auuaaaaaucucaaauuucuaa

SEQ ID NO: 3323858 - RNA, 19 nt, Human
uuugcuggggccgaaagaa

SEQ ID NO: 3323859 - RNA, 22 nt, Human
uuugcuggggccgaaagaacag

SEQ ID NO: 3323860 - RNA, 22 nt, Human
uuuggauuggaugaauuccaaa

SEQ ID NO: 3323861 - RNA, 22 nt, Human
uuugggguacccacugcucugg

SEQ ID NO: 3323862 - RNA, 21 nt, Human
uuugggguacccacugcucug

SEQ ID NO: 3323863 - RNA, 13 nt, Human
uuuggcugcugaa

SEQ ID NO: 3323864 - RNA, 12 nt, Human
uuuggcugcuga

SEQ ID NO: 3323865 - RNA, 18 nt, Human
uuugaccucugcagcaau

SEQ ID NO: 3323866 - RNA, 13 nt, Human
uuugagacagagu

SEQ ID NO: 3323867 - RNA, 14 nt, Human
uuugauccaagcug

SEQ ID NO: 3323868 - RNA, 15 nt, Human
uuugauccaagcugg

SEQ ID NO: 3323869 - RNA, 15 nt, Human
uuugauucagacagc

SEQ ID NO: 3323870 - RNA, 23 nt, Human
uuugauuaaauucuugcaaagua

SEQ ID NO: 3323871 - RNA, 23 nt, Human
uuucccucccuuccucuuuccau

SEQ ID NO: 3323872 - RNA, 21 nt, Human
uuugaccucugcagcaauaaa

SEQ ID NO: 3323873 - RNA, 19 nt, Human
uuugaccucugcagcaaua

SEQ ID NO: 3323874 - RNA, 14 nt, Human
uuugacaaggggca

SEQ ID NO: 3323875 - RNA, 12 nt, Human
auguaucaauga

SEQ ID NO: 3323876 - RNA, 17 nt, Human
auguccaagaagcccag

SEQ ID NO: 3323877 - RNA, 16 nt, Human
auguccaagaagccca

SEQ ID NO: 3323878 - RNA, 14 nt, Human
augugagacugguu

SEQ ID NO: 3323879 - RNA, 13 nt, Human
augugagaccauu

SEQ ID NO: 3323880 - RNA, 16 nt, Human
uuuguaauuuuuuuau

SEQ ID NO: 3323881 - RNA, 14 nt, Human
uuuguacagacaac

SEQ ID NO: 3323882 - RNA, 16 nt, Human
uuuguuucugaaaggg

SEQ ID NO: 3323883 - RNA, 14 nt, Human
uuuguuucugaaag

SEQ ID NO: 3323884 - RNA, 22 nt, Human
uuugugcauuaucuagauacug

SEQ ID NO: 3323885 - RNA, 19 nt, Human
uuugugcauuaucuagaua

SEQ ID NO: 3323886 - RNA, 22 nt, Human
uuugugauacaaugcugugccc

SEQ ID NO: 3323887 - RNA, 15 nt, Human
uuugugauacaaugc

SEQ ID NO: 3323888 - RNA, 14 nt, Human
uuugucuuaaaaag

SEQ ID NO: 3323889 - RNA, 13 nt, Human
uuugucuuaaaaa

SEQ ID NO: 3323890 - RNA, 23 nt, Human
uuugucuuaaaaaguggaaaaau

SEQ ID NO: 3323891 - RNA, 16 nt, Human
uuugugauacaaugcu

SEQ ID NO: 3323892 - RNA, 17 nt, Human
auucccaagcucugcuc

SEQ ID NO: 3323893 - RNA, 22 nt, Human
auuccccaggaggccagccuug

SEQ ID NO: 3323894 - RNA, 20 nt, Human
auuccccaggaggccagccu

SEQ ID NO: 3323895 - RNA, 19 nt, Human
auuccccaggaggccagcc

SEQ ID NO: 3323896 - RNA, 18 nt, Human
auucccaagcucugcucc

SEQ ID NO: 3323897 - RNA, 19 nt, Human
auucccaagcucugcuccu

SEQ ID NO: 3323898 - RNA, 18 nt, Human
auuaaguacuauguauca

SEQ ID NO: 3323899 - RNA, 16 nt, Human
auuaaguacuauguau

SEQ ID NO: 3323900 - RNA, 19 nt, Human
auuaaguacuauguaucaa

SEQ ID NO: 3323901 - RNA, 13 nt, Human
auuaaggaagaca

SEQ ID NO: 3323902 - RNA, 16 nt, Human
uuuuguuuuugucuua

SEQ ID NO: 3323903 - RNA, 21 nt, Human
uuuuguuccacaaguuaaaua

SEQ ID NO: 3323904 - RNA, 23 nt, Human
uuuuuauacauaaacaagaccac

SEQ ID NO: 3323905 - RNA, 23 nt, Human
uuuugugcauuaucuagauacug

SEQ ID NO: 3323906 - RNA, 14 nt, Human
auuacuucugcuac

SEQ ID NO: 3323907 - RNA, 12 nt, Human
auuacuucugcu

SEQ ID NO: 3323908 - RNA, 13 nt, Human
auuacuucugcua

SEQ ID NO: 3323909 - RNA, 19 nt, Human
auaggaacuuaaauaaugu

SEQ ID NO: 3323910 - RNA, 17 nt, Human
uucacauauugauuucc

SEQ ID NO: 3323911 - RNA, 22 nt, Human
uucaccacaugugcacaugcac

SEQ ID NO: 3323912 - RNA, 15 nt, Human
uucaaggauccugag

SEQ ID NO: 3323913 - RNA, 21 nt, Human
uucaaggauccugagccagau

SEQ ID NO: 3323914 - RNA, 19 nt, Human
uucaaggauccugagccag

SEQ ID NO: 3323915 - RNA, 18 nt, Human
uucaaggauccugagcca

SEQ ID NO: 3323916 - RNA, 16 nt, Human
uucaaggauccugagc

SEQ ID NO: 3323917 - RNA, 17 nt, Human
uucaaaauaaaaaugag

SEQ ID NO: 3323918 - RNA, 19 nt, Human
auagcucaggugucccugc

SEQ ID NO: 3323919 - RNA, 22 nt, Human
auagcucaggugucccugcacu

SEQ ID NO: 3323920 - RNA, 20 nt, Human
auagcucaggugucccugca

SEQ ID NO: 3323921 - RNA, 21 nt, Human
auagcucaggugucccugcac

SEQ ID NO: 3323922 - RNA, 12 nt, Human
auagcugggacu

SEQ ID NO: 3323923 - RNA, 13 nt, Human
auaagauaaaugu

SEQ ID NO: 3323924 - RNA, 17 nt, Human
auaagauaaaugugcug

SEQ ID NO: 3323925 - RNA, 18 nt, Human
auagccugccucuucucu

SEQ ID NO: 3323926 - RNA, 17 nt, Human
auagcugggacuacagg

SEQ ID NO: 3323927 - RNA, 22 nt, Human
auagcuggucuuauuuguaaag

SEQ ID NO: 3323928 - RNA, 23 nt, Human
auagcuggucuuauuuguaaagc

SEQ ID NO: 3323929 - RNA, 14 nt, Human
uuauuuaaauuuua

SEQ ID NO: 3323930 - RNA, 18 nt, Human
uuauuuaaugaaagacug

SEQ ID NO: 3323931 - RNA, 22 nt, Human
uuauuuaaugaaagacuguaca

SEQ ID NO: 3323932 - RNA, 16 nt, Human
uuauuuaguuccuuga

SEQ ID NO: 3323933 - RNA, 14 nt, Human
auaugucaagccau

SEQ ID NO: 3323934 - RNA, 20 nt, Human
auaugauuuaaaucagccgu

SEQ ID NO: 3323935 - RNA, 22 nt, Human
auaucugaaaauguauguguaa

SEQ ID NO: 3323936 - RNA, 16 nt, Human
uucauauuuacuucuu

SEQ ID NO: 3323937 - RNA, 21 nt, Human
uucauauuuacuucuuauaca

SEQ ID NO: 3323938 - RNA, 14 nt, Human
uucaguaauaacuc

SEQ ID NO: 3323939 - RNA, 18 nt, Human
uucaucauccuaagcuau

SEQ ID NO: 3323940 - RNA, 21 nt, Human
uucaucauccuaagcuauuca

SEQ ID NO: 3323941 - RNA, 17 nt, Human
uucagaucucuaacuuc

SEQ ID NO: 3323942 - RNA, 19 nt, Human
uucagccaagaauucuuaa

SEQ ID NO: 3323943 - RNA, 14 nt, Human
uucagccaagaauu

SEQ ID NO: 3323944 - RNA, 16 nt, Human
auauaggaacuuaaau

SEQ ID NO: 3323945 - RNA, 17 nt, Human
auauugcugauggugca

SEQ ID NO: 3323946 - RNA, 17 nt, Human
auauuguuuucagugua

SEQ ID NO: 3323947 - RNA, 20 nt, Human
auauuguuuucaguguacau

SEQ ID NO: 3323948 - RNA, 18 nt, Human
auauguuuuaagaggcag

SEQ ID NO: 3323949 - RNA, 20 nt, Human
auauguuuuaagaggcaggg

SEQ ID NO: 3323950 - RNA, 22 nt, Human
auauuaagaaagacuaucuaaa

SEQ ID NO: 3323951 - RNA, 24 nt, Human
auauuaagaaagacuaucuaaaug

SEQ ID NO: 3323952 - RNA, 22 nt, Human
auauuaaggaagacaaugugaa

SEQ ID NO: 3323953 - RNA, 16 nt, Human
auauucuguuggccag

SEQ ID NO: 3323954 - RNA, 22 nt, Human
auauugauuuccguuaaaauac

SEQ ID NO: 3323955 - RNA, 21 nt, Human
auauugauuuccguuaaaaua

SEQ ID NO: 3323956 - RNA, 19 nt, Human
auauugauuuccguuaaaa

SEQ ID NO: 3323957 - RNA, 22 nt, Human
aucacggcucacugcagccuca

SEQ ID NO: 3323958 - RNA, 19 nt, Human
aucacggcucacugcagcc

SEQ ID NO: 3323959 - RNA, 18 nt, Human
aucaaguauuauaccuuu

SEQ ID NO: 3323960 - RNA, 14 nt, Human
aucaaguauuauac

SEQ ID NO: 3323961 - RNA, 13 nt, Human
aucaaguauuaua

SEQ ID NO: 3323962 - RNA, 14 nt, Human
uuccuucagugccu

SEQ ID NO: 3323963 - RNA, 11 nt, Human
uuccuucagug

SEQ ID NO: 3323964 - RNA, 17 nt, Human
uuccuguucccaugaga

SEQ ID NO: 3323965 - RNA, 11 nt, Human
uuccugugucu

SEQ ID NO: 3323966 - RNA, 15 nt, Human
uuccuaauccucuag

SEQ ID NO: 3323967 - RNA, 13 nt, Human
uuccuaauccucu

SEQ ID NO: 3323968 - RNA, 13 nt, Human
aucauugaaaucu

SEQ ID NO: 3323969 - RNA, 15 nt, Human
aucauugaaaucuuu

SEQ ID NO: 3323970 - RNA, 14 nt, Human
aucauugaaaucuu

SEQ ID NO: 3323971 - RNA, 16 nt, Human
aucagcacgauuucug

SEQ ID NO: 3323972 - RNA, 15 nt, Human
aucagcacgauuucu

SEQ ID NO: 3323973 - RNA, 18 nt, Human
aucagcacgauuucuguu

SEQ ID NO: 3323974 - RNA, 17 nt, Human
aucagcacgauuucugu

SEQ ID NO: 3323975 - RNA, 13 nt, Human
uucuaggccuggg

SEQ ID NO: 3323976 - RNA, 23 nt, Human
uucucagaaucucaaauaacuaa

SEQ ID NO: 3323977 - RNA, 13 nt, Human
uucucagaaucuc

SEQ ID NO: 3323978 - RNA, 19 nt, Human
uucucagaaucucaaauaa

SEQ ID NO: 3323979 - RNA, 22 nt, Human
uucucagaaucucaaauaacua

SEQ ID NO: 3323980 - RNA, 15 nt, Human
auccagguucagcuu

SEQ ID NO: 3323981 - RNA, 16 nt, Human
auccagguucagcuug

SEQ ID NO: 3323982 - RNA, 16 nt, Human
aucccauaugccuggg

SEQ ID NO: 3323983 - RNA, 23 nt, Human
uucugccgcagcccugcagaggg

SEQ ID NO: 3323984 - RNA, 16 nt, Human
uucugccgcagcccug

SEQ ID NO: 3323985 - RNA, 10 nt, Human
uucugggaca

SEQ ID NO: 3323986 - RNA, 11 nt, Human
uucugggacac

SEQ ID NO: 3323987 - RNA, 22 nt, Human
uucugggacacaguucaauucu

SEQ ID NO: 3323988 - RNA, 23 nt, Human
uucugaacuuggcgcugccccug

SEQ ID NO: 3323989 - RNA, 19 nt, Human
aucauugaaaucuuuuugc

SEQ ID NO: 3323990 - RNA, 15 nt, Human
uucugaaagggacgc

SEQ ID NO: 3323991 - RNA, 17 nt, Human
uuggugucgggcaugac

SEQ ID NO: 3323992 - RNA, 19 nt, Human
uuggugucgggcaugacac

SEQ ID NO: 3323993 - RNA, 18 nt, Human
uuggugucgggcaugaca

SEQ ID NO: 3323994 - RNA, 14 nt, Human
uugguuuguaaauu

SEQ ID NO: 3323995 - RNA, 19 nt, Human
uuggugguuucagaaaugu

SEQ ID NO: 3323996 - RNA, 18 nt, Human
uuggugguuucagaaaug

SEQ ID NO: 3323997 - RNA, 18 nt, Human
augaaugucagugugacu

SEQ ID NO: 3323998 - RNA, 16 nt, Human
augaaugucaguguga

SEQ ID NO: 3323999 - RNA, 17 nt, Human
augaaugaaacauuuug

SEQ ID NO: 3324000 - RNA, 23 nt, Human
augaaccacaucuugcucugcug

SEQ ID NO: 3324001 - RNA, 22 nt, Human
augaaccacaucuugcucugcu

SEQ ID NO: 3324002 - RNA, 12 nt, Human
aucugucauuug

SEQ ID NO: 3324003 - RNA, 17 nt, Human
aucugucauuugagcag

SEQ ID NO: 3324004 - RNA, 15 nt, Human
aucuugcucugcuga

SEQ ID NO: 3324005 - RNA, 16 nt, Human
aucuugcucugcugac

SEQ ID NO: 3324006 - RNA, 13 nt, Human
aucuugcucugcu

SEQ ID NO: 3324007 - RNA, 14 nt, Human
aucuugcucugcug

SEQ ID NO: 3324008 - RNA, 20 nt, Human
uugcuuugugauuuuuguaa

SEQ ID NO: 3324009 - RNA, 17 nt, Human
uuggaaaauaaauuauu

SEQ ID NO: 3324010 - RNA, 15 nt, Human
uugcuuugugauuuu

SEQ ID NO: 3324011 - RNA, 23 nt, Human
uugauguucuuucacccuuuucu

SEQ ID NO: 3324012 - RNA, 20 nt, Human
uugauuaaauucuugcaaag

SEQ ID NO: 3324013 - RNA, 16 nt, Human
uugauuaaauucuugc

SEQ ID NO: 3324014 - RNA, 15 nt, Human
uugauuaaauucuug

SEQ ID NO: 3324015 - RNA, 16 nt, Human
aucucacacaugagca

SEQ ID NO: 3324016 - RNA, 18 nt, Human
aucucuugagccugggag

SEQ ID NO: 3324017 - RNA, 23 nt, Human
aucucacacaugagcaucaggcc

SEQ ID NO: 3324018 - RNA, 17 nt, Human
aucucaaauuucuaaau

SEQ ID NO: 3324019 - RNA, 16 nt, Human
aucucaaauuucuaaa

SEQ ID NO: 3324020 - RNA, 21 nt, Human
uugcaccacugcacuccagcc

SEQ ID NO: 3324021 - RNA, 18 nt, Human
uugcaccacugcacucca

SEQ ID NO: 3324022 - RNA, 12 nt, Human
uugcaugaggcu

SEQ ID NO: 3324023 - RNA, 14 nt, Human
uugcaugaggcuag

SEQ ID NO: 3324024 - RNA, 13 nt, Human
uugcccaggcagg

SEQ ID NO: 3324025 - RNA, 14 nt, Human
uugcccaggcaggu

SEQ ID NO: 3324026 - RNA, 16 nt, Human
uugcccaggcaggucu

SEQ ID NO: 3324027 - RNA, 18 nt, Human
uugcccaggcaggucuug

SEQ ID NO: 3324028 - RNA, 11 nt, Human
uugcccaggcu

SEQ ID NO: 3324029 - RNA, 12 nt, Human
uugcccaggcug

SEQ ID NO: 3324030 - RNA, 14 nt, Human
uugcccaggcuggc

SEQ ID NO: 3324031 - RNA, 23 nt, Human
uugcccaggcuggcgugcagugg

SEQ ID NO: 3324032 - RNA, 11 nt, Human
uugcccaggca

SEQ ID NO: 3324033 - RNA, 16 nt, Human
uugacaucaacugcau

SEQ ID NO: 3324034 - RNA, 13 nt, Human
uugacaucaacug

SEQ ID NO: 3324035 - RNA, 19 nt, Human
uugacaggauuauuggaaa

SEQ ID NO: 3324036 - RNA, 10 nt, Human
uugacagggc

SEQ ID NO: 3324037 - RNA, 12 nt, Human
uugacagggcac

SEQ ID NO: 3324038 - RNA, 11 nt, Human
uugagacagag

SEQ ID NO: 3324039 - RNA, 12 nt, Human
uugagcagggcu

SEQ ID NO: 3324040 - RNA, 16 nt, Human
uugagcagggcucagc

SEQ ID NO: 3324041 - RNA, 23 nt, Human
aucucaaauaacuaaaagguaug

SEQ ID NO: 3324042 - RNA, 14 nt, Human
aucucaaauuucua

SEQ ID NO: 3324043 - RNA, 14 nt, Human
aucucaaauaacua

SEQ ID NO: 3324044 - RNA, 21 nt, Human
aucucaaauaacuaaaaggua

SEQ ID NO: 3324045 - RNA, 19 nt, Human
aucuagauacuguaucaug

SEQ ID NO: 3324046 - RNA, 19 nt, Human
aucuaggaagacuuuggaa

SEQ ID NO: 3324047 - RNA, 18 nt, Human
aucuaggaagacuuugga

SEQ ID NO: 3324048 - RNA, 17 nt, Human
aucuaggaagacuuugg

SEQ ID NO: 3324049 - RNA, 11 nt, Human
uugagugccuu

SEQ ID NO: 3324050 - RNA, 21 nt, Human
uugagugcugucuccauguuu

SEQ ID NO: 3324051 - RNA, 17 nt, Human
uugauacuacaguuugu

SEQ ID NO: 3324052 - RNA, 15 nt, Human
uugauacuacaguuu

SEQ ID NO: 3324053 - RNA, 20 nt, Human
aucuaauauguaacaagcca

SEQ ID NO: 3324054 - RNA, 23 nt, Human
aucuaauauguaacaagccaccc

SEQ ID NO: 3324055 - RNA, 18 nt, Human
aucuagauacuguaucau

SEQ ID NO: 3324056 - RNA, 19 nt, Human
uuguucuugguuuguaaau

SEQ ID NO: 3324057 - RNA, 17 nt, Human
uuguucuugguuuguaa

SEQ ID NO: 3324058 - RNA, 23 nt, Human
augcacuuuguucuggcucuucc

SEQ ID NO: 3324059 - RNA, 21 nt, Human
augcacuuuguucuggcucuu

SEQ ID NO: 3324060 - RNA, 11 nt, Human
uuuaaaugcac

SEQ ID NO: 3324061 - RNA, 16 nt, Human
uuuaaugaaagacugu

SEQ ID NO: 3324062 - RNA, 22 nt, Human
uuuaaggaugcuuguacauaau

SEQ ID NO: 3324063 - RNA, 21 nt, Human
uuuaaggaugcuuguacauaa

SEQ ID NO: 3324064 - RNA, 20 nt, Human
uuuaaggaugcuuguacaua

SEQ ID NO: 3324065 - RNA, 19 nt, Human
uuuaaggaugcuuguacau

SEQ ID NO: 3324066 - RNA, 21 nt, Human
uuuaagcuguuacugucuuca

SEQ ID NO: 3324067 - RNA, 12 nt, Human
uuuaagagaaau

SEQ ID NO: 3324068 - RNA, 19 nt, Human
augaggucagagccugcag

SEQ ID NO: 3324069 - RNA, 20 nt, Human
augaggucagagccugcagu

SEQ ID NO: 3324070 - RNA, 16 nt, Human
augaggucagagccug

SEQ ID NO: 3324071 - RNA, 18 nt, Human
augaggucagagccugca

SEQ ID NO: 3324072 - RNA, 15 nt, Human
augaggucagagccu

SEQ ID NO: 3324073 - RNA, 13 nt, Human
augaguccccugu

SEQ ID NO: 3324074 - RNA, 21 nt, Human
uugucauauaagauucauauu

SEQ ID NO: 3324075 - RNA, 17 nt, Human
uugucacacacuuuggc

SEQ ID NO: 3324076 - RNA, 15 nt, Human
uuguccccgacccuu

SEQ ID NO: 3324077 - RNA, 20 nt, Human
uuguccccaccgcagacagg

SEQ ID NO: 3324078 - RNA, 18 nt, Human
uuguccccaccgcagaca

SEQ ID NO: 3324079 - RNA, 18 nt, Human
uugugaggaagccgcugg

SEQ ID NO: 3324080 - RNA, 17 nt, Human
uugugaggaagccgcug

SEQ ID NO: 3324081 - RNA, 20 nt, Human
uugugauacaaugcugugcc

SEQ ID NO: 3324082 - RNA, 19 nt, Human
uugugauacaaugcugugc

SEQ ID NO: 3324083 - RNA, 13 nt, Human
uugugaggaagcc

SEQ ID NO: 3324084 - RNA, 20 nt, Human
augcgugcauaccacuuuug

SEQ ID NO: 3324085 - RNA, 22 nt, Human
augcgugcauaccacuuuuguu

SEQ ID NO: 3324086 - RNA, 15 nt, Human
augccucucucaggc

SEQ ID NO: 3324087 - RNA, 14 nt, Human
augccucucucagg

SEQ ID NO: 3324088 - RNA, 13 nt, Human
augccucucucag

SEQ ID NO: 3324089 - RNA, 17 nt, Human
augcccagccccuucug

SEQ ID NO: 3324090 - RNA, 15 nt, Human
augcccagccccuuc

SEQ ID NO: 3324091 - RNA, 16 nt, Human
augcccagccccuucu

SEQ ID NO: 3324092 - RNA, 21 nt, Human
augccaugaggaacaaggcaa

SEQ ID NO: 3324093 - RNA, 21 nt, Human
uuuaaugaaagacuguacaaa

SEQ ID NO: 3324094 - RNA, 14 nt, Human
uuuacuucuuauac

SEQ ID NO: 3324095 - RNA, 13 nt, Human
uuuacuucuuaua

SEQ ID NO: 3324096 - RNA, 11 nt, Human
uuuacuuaaac

SEQ ID NO: 3324097 - RNA, 16 nt, Human
uuuacugcagcuuugu

SEQ ID NO: 3324098 - RNA, 18 nt, Human
uuuaccugaagucuuugu

SEQ ID NO: 3324099 - RNA, 12 nt, Human
uuucaaacuuua

SEQ ID NO: 3324100 - RNA, 16 nt, Human
uuucccuauuagagaa

SEQ ID NO: 3324101 - RNA, 12 nt, Human
uuucagaaaugu

SEQ ID NO: 3324102 - RNA, 11 nt, Human
uuucagaaaug

SEQ ID NO: 3324103 - RNA, 19 nt, Human
augcuggcuguuggcuggg

SEQ ID NO: 3324104 - RNA, 20 nt, Human
augcuggcuguuggcugggg

SEQ ID NO: 3324105 - RNA, 18 nt, Human
auggaagacagcucuuau

SEQ ID NO: 3324106 - RNA, 17 nt, Human
auggaagacagcucuua

SEQ ID NO: 3324107 - RNA, 20 nt, Human
augcuucucacugccaugcc

SEQ ID NO: 3324108 - RNA, 16 nt, Human
augcuucucacugcca

SEQ ID NO: 3324109 - RNA, 14 nt, Human
uuuaucagaauucu

SEQ ID NO: 3324110 - RNA, 14 nt, Human
augcuccuggccca

SEQ ID NO: 3324111 - RNA, 18 nt, Human
augcuggcuguuggcugg

SEQ ID NO: 3324112 - RNA, 17 nt, Human
aaaacacauuuuucuua

SEQ ID NO: 3324113 - RNA, 19 nt, Human
aaaacacuguucucugccc

SEQ ID NO: 3324114 - RNA, 11 nt, Human
aaaagaaaaag

SEQ ID NO: 3324115 - RNA, 21 nt, Human
aaaaucagccugcuccagcug

SEQ ID NO: 3324116 - RNA, 17 nt, Human
aaaaucagccugcucca

SEQ ID NO: 3324117 - RNA, 13 nt, Human
aaaaucagccugc

SEQ ID NO: 3324118 - RNA, 14 nt, Human
aaaauaaaacuuuu

SEQ ID NO: 3324119 - RNA, 16 nt, Human
aaagccuccuccagcc

SEQ ID NO: 3324120 - RNA, 20 nt, Human
aaagauauuuugcuuuguga

SEQ ID NO: 3324121 - RNA, 23 nt, Human
aaacugauuuuuuuuuccuucag

SEQ ID NO: 3324122 - RNA, 22 nt, Human
aaacugauuuuuuuuuccuuca

SEQ ID NO: 3324123 - RNA, 23 nt, Human
aaacucuuaaaacccaagugccu

SEQ ID NO: 3324124 - RNA, 12 nt, Human
aaacucuuaaaa

SEQ ID NO: 3324125 - RNA, 16 nt, Human
aaacccagcucugguc

SEQ ID NO: 3324126 - RNA, 12 nt, Human
aaacccagcucu

SEQ ID NO: 3324127 - RNA, 16 nt, Human
aaaccgccaaggcugg

SEQ ID NO: 3324128 - RNA, 15 nt, Human
aaaccgccaaggcug

SEQ ID NO: 3324129 - RNA, 16 nt, Human
aaaaucucaaauuucu

SEQ ID NO: 3324130 - RNA, 15 nt, Human
aaaaucucaaauuuc

SEQ ID NO: 3324131 - RNA, 18 nt, Human
aaaaucucaaauuucuaa

SEQ ID NO: 3324132 - RNA, 19 nt, Human
aaaucucaaauuucuaaau

SEQ ID NO: 3324133 - RNA, 14 nt, Human
aaaucuuuuugcuu

SEQ ID NO: 3324134 - RNA, 13 nt, Human
aaaucuuuuugcu

SEQ ID NO: 3324135 - RNA, 19 nt, Human
aaaugcuguaacuuucuga

SEQ ID NO: 3324136 - RNA, 20 nt, Human
aaaggaugcccaaagaugca

SEQ ID NO: 3324137 - RNA, 14 nt, Human
aaaggaugcacaga

SEQ ID NO: 3324138 - RNA, 22 nt, Human
aacauggccuuugcuugaaaga

SEQ ID NO: 3324139 - RNA, 11 nt, Human
aacaggcagau

SEQ ID NO: 3324140 - RNA, 23 nt, Human
aaauucuucuccacuuucuagcc

SEQ ID NO: 3324141 - RNA, 15 nt, Human
aaauucuugcaaagu

SEQ ID NO: 3324142 - RNA, 23 nt, Human
aacauggccuuugcuugaaagaa

SEQ ID NO: 3324143 - RNA, 23 nt, Human
aaccuuuugagugccuuacacaa

SEQ ID NO: 3324144 - RNA, 16 nt, Human
aaccuuuugagugccu

SEQ ID NO: 3324145 - RNA, 19 nt, Human
aaugaugccaugaggaaca

SEQ ID NO: 3324146 - RNA, 20 nt, Human
aaugaugccaugaggaacaa

SEQ ID NO: 3324147 - RNA, 21 nt, Human
aaugaaagacuguacaaagua

SEQ ID NO: 3324148 - RNA, 18 nt, Human
aaugaaagacuguacaaa

SEQ ID NO: 3324149 - RNA, 20 nt, Human
aaugaaagacuguacaaagu

SEQ ID NO: 3324150 - RNA, 21 nt, Human
aaucaccgaaaacguggcugc

SEQ ID NO: 3324151 - RNA, 23 nt, Human
aaucaccgaaaacguggcugcuu

SEQ ID NO: 3324152 - RNA, 15 nt, Human
aaucaccgaaaacgu

SEQ ID NO: 3324153 - RNA, 23 nt, Human
aauauguggaguucaucuugaau

SEQ ID NO: 3324154 - RNA, 13 nt, Human
aauauuaagaaag

SEQ ID NO: 3324155 - RNA, 14 nt, Human
aauaaagcagcguu

SEQ ID NO: 3324156 - RNA, 22 nt, Human
aauaaugugaaacuggauuaaa

SEQ ID NO: 3324157 - RNA, 17 nt, Human
aauaaugugaaacugga

SEQ ID NO: 3324158 - RNA, 16 nt, Human
aauaaugugaaacugg

SEQ ID NO: 3324159 - RNA, 12 nt, Human
aagugcugggau

SEQ ID NO: 3324160 - RNA, 22 nt, Human
aagugcugcauuuaaaagauac

SEQ ID NO: 3324161 - RNA, 14 nt, Human
aagugcugcauuua

SEQ ID NO: 3324162 - RNA, 20 nt, Human
aagaguaggaagacuuugga

SEQ ID NO: 3324163 - RNA, 17 nt, Human
aagacuuuuccaacccu

SEQ ID NO: 3324164 - RNA, 12 nt, Human
aagacuuuucuu

SEQ ID NO: 3324165 - RNA, 21 nt, Human
aagacuuuuccaacccucauc

SEQ ID NO: 3324166 - RNA, 19 nt, Human
aagacuuuucuuucagcca

SEQ ID NO: 3324167 - RNA, 13 nt, Human
aagagaaaaaaua

SEQ ID NO: 3324168 - RNA, 17 nt, Human
aagaccacguuucuaaa

SEQ ID NO: 3324169 - RNA, 15 nt, Human
aagaccacguuucua

SEQ ID NO: 3324170 - RNA, 23 nt, Human
aagacagauacuccuccaagguu

SEQ ID NO: 3324171 - RNA, 19 nt, Human
aagacaaugugaaaagaaa

SEQ ID NO: 3324172 - RNA, 22 nt, Human
aagacaaugacuuacuguacau

SEQ ID NO: 3324173 - RNA, 20 nt, Human
aagacaaugugaaaagaaaa

SEQ ID NO: 3324174 - RNA, 14 nt, Human
aagcggcuggcagc

SEQ ID NO: 3324175 - RNA, 15 nt, Human
aagcgugagccacug

SEQ ID NO: 3324176 - RNA, 14 nt, Human
aagauaaaugugcu

SEQ ID NO: 3324177 - RNA, 21 nt, Human
aagauaauauuaaggaagaca

SEQ ID NO: 3324178 - RNA, 19 nt, Human
aagauaauauuaaggaaga

SEQ ID NO: 3324179 - RNA, 17 nt, Human
aagauacaguuacucag

SEQ ID NO: 3324180 - RNA, 19 nt, Human
aagcugcacccucaggcag

SEQ ID NO: 3324181 - RNA, 13 nt, Human
aagcugcacccuc

SEQ ID NO: 3324182 - RNA, 15 nt, Human
aaggcaaggcuguca

SEQ ID NO: 3324183 - RNA, 13 nt, Human
aaggcaaggcugu

SEQ ID NO: 3324184 - RNA, 23 nt, Human
acaggcacccaccaucaugucug

SEQ ID NO: 3324185 - RNA, 23 nt, Human
acagugagucgaggacagggagg

SEQ ID NO: 3324186 - RNA, 14 nt, Human
acaggcaaugcugg

SEQ ID NO: 3324187 - RNA, 15 nt, Human
acaggcaaugcuggc

SEQ ID NO: 3324188 - RNA, 16 nt, Human
acaggcaaugcuggcu

SEQ ID NO: 3324189 - RNA, 14 nt, Human
acaggcacccacca

SEQ ID NO: 3324190 - RNA, 17 nt, Human
acaggcaaugcuggcug

SEQ ID NO: 3324191 - RNA, 19 nt, Human
acagcucuucuccaggcug

SEQ ID NO: 3324192 - RNA, 20 nt, Human
acagcucuucuccaggcugu

SEQ ID NO: 3324193 - RNA, 18 nt, Human
acagcucuucuccaggcu

SEQ ID NO: 3324194 - RNA, 20 nt, Human
acauacaggaagguagaaau

SEQ ID NO: 3324195 - RNA, 16 nt, Human
acauacaauuccaaac

SEQ ID NO: 3324196 - RNA, 23 nt, Human
acaugcacagcuaacauggaagu

SEQ ID NO: 3324197 - RNA, 13 nt, Human
acaugcacgugug

SEQ ID NO: 3324198 - RNA, 20 nt, Human
acaugccucucucaggccaa

SEQ ID NO: 3324199 - RNA, 17 nt, Human
accaacgucugugccau

SEQ ID NO: 3324200 - RNA, 14 nt, Human
accaacgucugugc

SEQ ID NO: 3324201 - RNA, 18 nt, Human
accacgcuggaccuugaa

SEQ ID NO: 3324202 - RNA, 14 nt, Human
accacgcuggaccu

SEQ ID NO: 3324203 - RNA, 16 nt, Human
accacgcuggaccuug

SEQ ID NO: 3324204 - RNA, 14 nt, Human
accacguuucuaaa

SEQ ID NO: 3324205 - RNA, 13 nt, Human
accacguuucuaa

SEQ ID NO: 3324206 - RNA, 12 nt, Human
accaagcccagu

SEQ ID NO: 3324207 - RNA, 12 nt, Human
accagagcugcc

SEQ ID NO: 3324208 - RNA, 13 nt, Human
accagagcugcca

SEQ ID NO: 3324209 - RNA, 16 nt, Human
accagagcugccaccu

SEQ ID NO: 3324210 - RNA, 14 nt, Human
accagagcugccac

SEQ ID NO: 3324211 - RNA, 13 nt, Human
acaccagagccca

SEQ ID NO: 3324212 - RNA, 18 nt, Human
acaccagagcccaccuug

SEQ ID NO: 3324213 - RNA, 23 nt, Human
acaccagagcccaccuuggcuca

SEQ ID NO: 3324214 - RNA, 13 nt, Human
acacagcucuucu

SEQ ID NO: 3324215 - RNA, 18 nt, Human
acacagcucuucuccagg

SEQ ID NO: 3324216 - RNA, 14 nt, Human
acacagcucuucuc

SEQ ID NO: 3324217 - RNA, 16 nt, Human
acacagcucuucucca

SEQ ID NO: 3324218 - RNA, 15 nt, Human
acaaggcaaggcugu

SEQ ID NO: 3324219 - RNA, 19 nt, Human
acaaggcaaggcugucaau

SEQ ID NO: 3324220 - RNA, 17 nt, Human
acaaggcaaggcuguca

SEQ ID NO: 3324221 - RNA, 16 nt, Human
acaaggcaaggcuguc

SEQ ID NO: 3324222 - RNA, 15 nt, Human
acaaguuaaauaaau

SEQ ID NO: 3324223 - RNA, 19 nt, Human
aauuaugaguuauuuuuau

SEQ ID NO: 3324224 - RNA, 18 nt, Human
aauucuguuuuucuaggc

SEQ ID NO: 3324225 - RNA, 14 nt, Human
aauucuguuuuucu

SEQ ID NO: 3324226 - RNA, 22 nt, Human
aauuguaaggaaugauuaauua

SEQ ID NO: 3324227 - RNA, 16 nt, Human
aauuguaaggaaugau

SEQ ID NO: 3324228 - RNA, 21 nt, Human
aauucucauuugucacacacu

SEQ ID NO: 3324229 - RNA, 15 nt, Human
aauucucuuauccaa

SEQ ID NO: 3324230 - RNA, 17 nt, Human
aauucucuaguuugauu

SEQ ID NO: 3324231 - RNA, 15 nt, Human
aauucucuaguuuga

SEQ ID NO: 3324232 - RNA, 14 nt, Human
aauucuacuuugag

SEQ ID NO: 3324233 - RNA, 19 nt, Human
aauucucagaaucucaaau

SEQ ID NO: 3324234 - RNA, 17 nt, Human
aauuucccaaagcagug

SEQ ID NO: 3324235 - RNA, 15 nt, Human
aauuucccaaagcag

SEQ ID NO: 3324236 - RNA, 22 nt, Human
acucccaucugugaaaggaaag

SEQ ID NO: 3324237 - RNA, 15 nt, Human
acucuacagaggcca

SEQ ID NO: 3324238 - RNA, 23 nt, Human
acugaugggcaacccccagccug

SEQ ID NO: 3324239 - RNA, 19 nt, Human
acugauuuuuuuuuccuuc

SEQ ID NO: 3324240 - RNA, 18 nt, Human
acugauuuuuuuuuccuu

SEQ ID NO: 3324241 - RNA, 17 nt, Human
acugauuuuuuuuuccu

SEQ ID NO: 3324242 - RNA, 16 nt, Human
acugauuuuuuuuucc

SEQ ID NO: 3324243 - RNA, 17 nt, Human
acugacauuguuggcca

SEQ ID NO: 3324244 - RNA, 18 nt, Human
acugacauuguuggccaa

SEQ ID NO: 3324245 - RNA, 23 nt, Human
acugaauuucuuuugccguuauu

SEQ ID NO: 3324246 - RNA, 12 nt, Human
acugaauuucuu

SEQ ID NO: 3324247 - RNA, 19 nt, Human
acuguuucaaacuuuacua

SEQ ID NO: 3324248 - RNA, 18 nt, Human
acuguuucaaacuuuacu

SEQ ID NO: 3324249 - RNA, 15 nt, Human
acuguuucaaacuuu

SEQ ID NO: 3324250 - RNA, 13 nt, Human
acuguuucaaacu

SEQ ID NO: 3324251 - RNA, 23 nt, Human
acuuggggggcugaggugggagg

SEQ ID NO: 3324252 - RNA, 20 nt, Human
acugcuuuuggucuguguga

SEQ ID NO: 3324253 - RNA, 14 nt, Human
acugccaugccagc

SEQ ID NO: 3324254 - RNA, 17 nt, Human
acugugccaugugccag

SEQ ID NO: 3324255 - RNA, 18 nt, Human
acugugccaugugccagg

SEQ ID NO: 3324256 - RNA, 16 nt, Human
acugugccaugugcca

SEQ ID NO: 3324257 - RNA, 16 nt, Human
acccugugauggggcc

SEQ ID NO: 3324258 - RNA, 16 nt, Human
acccuggggagaaagu

SEQ ID NO: 3324259 - RNA, 23 nt, Human
acccucaucaccaacgucugugc

SEQ ID NO: 3324260 - RNA, 23 nt, Human
acccuggcacuauaauguaagcu

SEQ ID NO: 3324261 - RNA, 13 nt, Human
acccucaucacca

SEQ ID NO: 3324262 - RNA, 16 nt, Human
acccucaggcaggugg

SEQ ID NO: 3324263 - RNA, 15 nt, Human
acccucaggcaggug

SEQ ID NO: 3324264 - RNA, 14 nt, Human
acccucaggcaggu

SEQ ID NO: 3324265 - RNA, 13 nt, Human
acccucaggcagg

SEQ ID NO: 3324266 - RNA, 13 nt, Human
acccuauugcugc

SEQ ID NO: 3324267 - RNA, 19 nt, Human
acccuauugcugcuugagg

SEQ ID NO: 3324268 - RNA, 14 nt, Human
acccuauugcugcu

SEQ ID NO: 3324269 - RNA, 18 nt, Human
accgugaggccagagaca

SEQ ID NO: 3324270 - RNA, 19 nt, Human
accggcuggccuggccccu

SEQ ID NO: 3324271 - RNA, 23 nt, Human
accgugaggccagagacacaagc

SEQ ID NO: 3324272 - RNA, 12 nt, Human
accucagccucc

SEQ ID NO: 3324273 - RNA, 11 nt, Human
accucagccuc

SEQ ID NO: 3324274 - RNA, 12 nt, Human
accgggcacuca

SEQ ID NO: 3324275 - RNA, 14 nt, Human
accgggcacucaga

SEQ ID NO: 3324276 - RNA, 20 nt, Human
accgggccacagagaaagua

SEQ ID NO: 3324277 - RNA, 16 nt, Human
accgggcacucagaag

SEQ ID NO: 3324278 - RNA, 20 nt, Human
acccugugauggggcccugc

SEQ ID NO: 3324279 - RNA, 19 nt, Human
acccugugauggggcccug

SEQ ID NO: 3324280 - RNA, 17 nt, Human
acccugugauggggccc

SEQ ID NO: 3324281 - RNA, 11 nt, Human
accucaggccu

SEQ ID NO: 3324282 - RNA, 20 nt, Human
accucaggugauccacccac

SEQ ID NO: 3324283 - RNA, 21 nt, Human
accucaggugauccacccacc

SEQ ID NO: 3324284 - RNA, 12 nt, Human
accucugccuga

SEQ ID NO: 3324285 - RNA, 20 nt, Human
accucugccugaagucacac

SEQ ID NO: 3324286 - RNA, 19 nt, Human
accugccaggaagccagca

SEQ ID NO: 3324287 - RNA, 15 nt, Human
accugccccucaacu

SEQ ID NO: 3324288 - RNA, 12 nt, Human
accugccccuca

SEQ ID NO: 3324289 - RNA, 22 nt, Human
accugccaggaagccagcaggc

SEQ ID NO: 3324290 - RNA, 21 nt, Human
accugccaggaagccagcagg

SEQ ID NO: 3324291 - RNA, 23 nt, Human
accugccaggaagccagcaggcu

SEQ ID NO: 3324292 - RNA, 18 nt, Human
acuaauggggcggugaga

SEQ ID NO: 3324293 - RNA, 17 nt, Human
acggacacucaaaagcu

SEQ ID NO: 3324294 - RNA, 19 nt, Human
acggaauaguuggcuagga

SEQ ID NO: 3324295 - RNA, 15 nt, Human
acggaauaguuggcu

SEQ ID NO: 3324296 - RNA, 13 nt, Human
acgucugugccau

SEQ ID NO: 3324297 - RNA, 12 nt, Human
acgucugugcca

SEQ ID NO: 3324298 - RNA, 19 nt, Human
acgcugugcugcccugccc

SEQ ID NO: 3324299 - RNA, 22 nt, Human
acgcugugcugcccugcccacc

SEQ ID NO: 3324300 - RNA, 19 nt, Human
acgauuucuguuuagauaa

SEQ ID NO: 3324301 - RNA, 23 nt, Human
acgauuucuguuuagauaauaca

SEQ ID NO: 3324302 - RNA, 20 nt, Human
acgauuucuguuuagauaau

SEQ ID NO: 3324303 - RNA, 18 nt, Human
auauuuuuuucuuuucuu

SEQ ID NO: 3324304 - RNA, 19 nt, Human
aucaaagagguuuuaaaaa

SEQ ID NO: 3324305 - RNA, 20 nt, Human
aucaaaagguuaauaaagua

SEQ ID NO: 3324306 - RNA, 14 nt, Human
auagcacagacccu

SEQ ID NO: 3324307 - RNA, 20 nt, Human
aucaugacaaagacugagua

SEQ ID NO: 3324308 - RNA, 23 nt, Human
aucauccacugugccaugugcca

SEQ ID NO: 3324309 - RNA, 15 nt, Human
aucauccuaagcuau

SEQ ID NO: 3324310 - RNA, 21 nt, Human
auccacugugccaugugccag

SEQ ID NO: 3324311 - RNA, 22 nt, Human
aucuaggaagacuuuggaaaga

SEQ ID NO: 3324312 - RNA, 21 nt, Human
augggaaugaaugucagugug

SEQ ID NO: 3324313 - RNA, 18 nt, Human
auggcuuuugugcauuau

SEQ ID NO: 3324314 - RNA, 20 nt, Human
augcuucuucagagacuccu

SEQ ID NO: 3324315 - RNA, 17 nt, Human
augcuucuucagagacu

SEQ ID NO: 3324316 - RNA, 14 nt, Human
augcuucuucagag

SEQ ID NO: 3324317 - RNA, 15 nt, Human
augcucugcauguua

SEQ ID NO: 3324318 - RNA, 18 nt, Human
augcucugcauguuacau

SEQ ID NO: 3324319 - RNA, 19 nt, Human
augcucugcauguuacaua

SEQ ID NO: 3324320 - RNA, 16 nt, Human
augcuuugaucccuuc

SEQ ID NO: 3324321 - RNA, 21 nt, Human
augccugguggcagcugcggu

SEQ ID NO: 3324322 - RNA, 11 nt, Human
augccuggugg

SEQ ID NO: 3324323 - RNA, 12 nt, Human
augccugguggc

SEQ ID NO: 3324324 - RNA, 13 nt, Human
augccugguggca

SEQ ID NO: 3324325 - RNA, 19 nt, Human
augccugguggcagcugcg

SEQ ID NO: 3324326 - RNA, 18 nt, Human
augccugguggcagcugc

SEQ ID NO: 3324327 - RNA, 23 nt, Human
aucuaggaagacuuuggaaagag

SEQ ID NO: 3324328 - RNA, 23 nt, Human
augaagcauuuacuuuguguuca

SEQ ID NO: 3324329 - RNA, 12 nt, Human
augaaagacugu

SEQ ID NO: 3324330 - RNA, 21 nt, Human
augaaguaauaugcacacauu

SEQ ID NO: 3324331 - RNA, 14 nt, Human
augaaguaauaugc

SEQ ID NO: 3324332 - RNA, 23 nt, Human
augaaguaauaugcacacauuuu

SEQ ID NO: 3324333 - RNA, 21 nt, Human
augagccucagcauccuggca

SEQ ID NO: 3324334 - RNA, 19 nt, Human
augagccucagcauccugg

SEQ ID NO: 3324335 - RNA, 11 nt, Human
augagccuggc

SEQ ID NO: 3324336 - RNA, 13 nt, Human
augaccuuucaau

SEQ ID NO: 3324337 - RNA, 15 nt, Human
augaccuuucaauag

SEQ ID NO: 3324338 - RNA, 22 nt, Human
augaggcauuuguuugaacuga

SEQ ID NO: 3324339 - RNA, 15 nt, Human
aguacuggagaaaau

SEQ ID NO: 3324340 - RNA, 20 nt, Human
aguacuucuccacccugcuc

SEQ ID NO: 3324341 - RNA, 19 nt, Human
aguacuucuccacccugcu

SEQ ID NO: 3324342 - RNA, 21 nt, Human
aguacuucuccacccugcucu

SEQ ID NO: 3324343 - RNA, 17 nt, Human
aguaacuuacuuaggug

SEQ ID NO: 3324344 - RNA, 21 nt, Human
aguaaaugggggugcauuuga

SEQ ID NO: 3324345 - RNA, 20 nt, Human
aguaaaugggggugcauuug

SEQ ID NO: 3324346 - RNA, 19 nt, Human
aguaaaugggggugcauuu

SEQ ID NO: 3324347 - RNA, 18 nt, Human
aguaaaugggggugcauu

SEQ ID NO: 3324348 - RNA, 19 nt, Human
agugauccucccaccucag

SEQ ID NO: 3324349 - RNA, 20 nt, Human
agugauccucccaccucagc

SEQ ID NO: 3324350 - RNA, 22 nt, Human
agugauccucccaccucagccu

SEQ ID NO: 3324351 - RNA, 19 nt, Human
agugauucuccugccucag

SEQ ID NO: 3324352 - RNA, 18 nt, Human
agugauucuccugccuca

SEQ ID NO: 3324353 - RNA, 20 nt, Human
agugauucuccugccucagc

SEQ ID NO: 3324354 - RNA, 17 nt, Human
agugauucuccugccuc

SEQ ID NO: 3324355 - RNA, 18 nt, Human
agugccuuauggaacacu

SEQ ID NO: 3324356 - RNA, 22 nt, Human
agugccuuauggaacacucuga

SEQ ID NO: 3324357 - RNA, 21 nt, Human
agugccuuauggaacacucug

SEQ ID NO: 3324358 - RNA, 20 nt, Human
agugccuuauggaacacucu

SEQ ID NO: 3324359 - RNA, 19 nt, Human
agugccuuauggaacacuc

SEQ ID NO: 3324360 - RNA, 14 nt, Human
agugacagaggcag

SEQ ID NO: 3324361 - RNA, 16 nt, Human
agugacagaggcagcc

SEQ ID NO: 3324362 - RNA, 19 nt, Human
agugacagaggcagcccca

SEQ ID NO: 3324363 - RNA, 18 nt, Human
aguccuuaccagcagagc

SEQ ID NO: 3324364 - RNA, 16 nt, Human
aguccuuaccagcaga

SEQ ID NO: 3324365 - RNA, 21 nt, Human
agucugauucccaagcucugc

SEQ ID NO: 3324366 - RNA, 22 nt, Human
agucugauucccaagcucugcu

SEQ ID NO: 3324367 - RNA, 20 nt, Human
agucugauucccaagcucug

SEQ ID NO: 3324368 - RNA, 18 nt, Human
agucuggaaugcaguggu

SEQ ID NO: 3324369 - RNA, 16 nt, Human
agucgaggacagggag

SEQ ID NO: 3324370 - RNA, 18 nt, Human
agucuggcccuuccuuuu

SEQ ID NO: 3324371 - RNA, 15 nt, Human
auacaccacuacauu

SEQ ID NO: 3324372 - RNA, 12 nt, Human
auaauguuaaca

SEQ ID NO: 3324373 - RNA, 17 nt, Human
auacaaugcugugcccu

SEQ ID NO: 3324374 - RNA, 23 nt, Human
auacaaugcugugcccuaaagug

SEQ ID NO: 3324375 - RNA, 21 nt, Human
auaaagaugagugagcaugcc

SEQ ID NO: 3324376 - RNA, 17 nt, Human
auacaccacuacauucu

SEQ ID NO: 3324377 - RNA, 11 nt, Human
aguuugcaguu

SEQ ID NO: 3324378 - RNA, 14 nt, Human
aguuugauuaaauu

SEQ ID NO: 3324379 - RNA, 22 nt, Human
aguuguuagugugucuuagugu

SEQ ID NO: 3324380 - RNA, 17 nt, Human
aguuguuagugugucuu

SEQ ID NO: 3324381 - RNA, 17 nt, Human
aguugaaaaacagcuga

SEQ ID NO: 3324382 - RNA, 17 nt, Human
aguugaagacagagcua

SEQ ID NO: 3324383 - RNA, 16 nt, Human
aguugaagacagagcu

SEQ ID NO: 3324384 - RNA, 18 nt, Human
aguugaaaaacagcugag

SEQ ID NO: 3324385 - RNA, 21 nt, Human
aguuccaccaucaagccacca

SEQ ID NO: 3324386 - RNA, 18 nt, Human
aguuccaccaucaagcca

SEQ ID NO: 3324387 - RNA, 14 nt, Human
aguucauacccugu

SEQ ID NO: 3324388 - RNA, 17 nt, Human
agcgauucuucugcuuc

SEQ ID NO: 3324389 - RNA, 19 nt, Human
agcgauucuucugcuucag

SEQ ID NO: 3324390 - RNA, 15 nt, Human
agcgauucuucugcu

SEQ ID NO: 3324391 - RNA, 20 nt, Human
agcuaacauggaaguacuau

SEQ ID NO: 3324392 - RNA, 19 nt, Human
agcuaacauggaaguacua

SEQ ID NO: 3324393 - RNA, 13 nt, Human
agcuaaugggaca

SEQ ID NO: 3324394 - RNA, 14 nt, Human
agcuaaugggacac

SEQ ID NO: 3324395 - RNA, 13 nt, Human
agcucaccagccc

SEQ ID NO: 3324396 - RNA, 14 nt, Human
agcucaccagcccc

SEQ ID NO: 3324397 - RNA, 20 nt, Human
agcucaccagccccagugcc

SEQ ID NO: 3324398 - RNA, 21 nt, Human
agcucaccagccccagugccc

SEQ ID NO: 3324399 - RNA, 20 nt, Human
agccugggaggucaaggcug

SEQ ID NO: 3324400 - RNA, 18 nt, Human
agccugggcaaugugaua

SEQ ID NO: 3324401 - RNA, 14 nt, Human
agccuggacccugu

SEQ ID NO: 3324402 - RNA, 21 nt, Human
agcuuuguuuguugucagcug

SEQ ID NO: 3324403 - RNA, 15 nt, Human
aggaaguacuggaga

SEQ ID NO: 3324404 - RNA, 11 nt, Human
aggaaguacug

SEQ ID NO: 3324405 - RNA, 14 nt, Human
aggaagguagaaau

SEQ ID NO: 3324406 - RNA, 23 nt, Human
aggaacaaggcaaggcugucaau

SEQ ID NO: 3324407 - RNA, 12 nt, Human
aggaacacuccu

SEQ ID NO: 3324408 - RNA, 23 nt, Human
aggaacuuaaauaaugugaaacu

SEQ ID NO: 3324409 - RNA, 15 nt, Human
aggaacacuccuuca

SEQ ID NO: 3324410 - RNA, 22 nt, Human
agcugccuguucagcuccagcu

SEQ ID NO: 3324411 - RNA, 15 nt, Human
agcuggucccacuca

SEQ ID NO: 3324412 - RNA, 15 nt, Human
agcugacuuuucugu

SEQ ID NO: 3324413 - RNA, 22 nt, Human
agcucaccagccccagugccca

SEQ ID NO: 3324414 - RNA, 23 nt, Human
agcucaccagccccagugcccac

SEQ ID NO: 3324415 - RNA, 14 nt, Human
aggaggucucuaag

SEQ ID NO: 3324416 - RNA, 19 nt, Human
aggaaguacuggagaaaau

SEQ ID NO: 3324417 - RNA, 15 nt, Human
aggaggucucuaaga

SEQ ID NO: 3324418 - RNA, 12 nt, Human
aggagugagcac

SEQ ID NO: 3324419 - RNA, 14 nt, Human
aggagugagcacua

SEQ ID NO: 3324420 - RNA, 13 nt, Human
aggcagauacagg

SEQ ID NO: 3324421 - RNA, 14 nt, Human
aggcagccaggcca

SEQ ID NO: 3324422 - RNA, 16 nt, Human
aggcagccaggccaca

SEQ ID NO: 3324423 - RNA, 15 nt, Human
aggcagccaggccac

SEQ ID NO: 3324424 - RNA, 24 nt, Human
aggcaugugaugagaggaaaucac

SEQ ID NO: 3324425 - RNA, 23 nt, Human
aggcaugugaugagaggaaauca

SEQ ID NO: 3324426 - RNA, 12 nt, Human
aggccagcugcu

SEQ ID NO: 3324427 - RNA, 23 nt, Human
aggcauuccccaggaggccagcc

SEQ ID NO: 3324428 - RNA, 22 nt, Human
aggcauuccccaggaggccagc

SEQ ID NO: 3324429 - RNA, 21 nt, Human
aggcauuccccaggaggccag

SEQ ID NO: 3324430 - RNA, 20 nt, Human
aggcauguucucugaggaca

SEQ ID NO: 3324431 - RNA, 22 nt, Human
aggcauguucucugaggacacu

SEQ ID NO: 3324432 - RNA, 14 nt, Human
aggccaugggccuc

SEQ ID NO: 3324433 - RNA, 16 nt, Human
aggccaugggccuccu

SEQ ID NO: 3324434 - RNA, 15 nt, Human
aggcccucugcccac

SEQ ID NO: 3324435 - RNA, 17 nt, Human
aggcccucugcccacuc

SEQ ID NO: 3324436 - RNA, 23 nt, Human
aggccaggcccucugcccacucc

SEQ ID NO: 3324437 - RNA, 19 nt, Human
aggccaggcccucugccca

SEQ ID NO: 3324438 - RNA, 18 nt, Human
aggccaggcccucugccc

SEQ ID NO: 3324439 - RNA, 17 nt, Human
aggccaggcccucugcc

SEQ ID NO: 3324440 - RNA, 16 nt, Human
aggccaggcccucugc

SEQ ID NO: 3324441 - RNA, 16 nt, Human
aggccagcugcuuggg

SEQ ID NO: 3324442 - RNA, 14 nt, Human
aggccagcugcuug

SEQ ID NO: 3324443 - RNA, 13 nt, Human
aggccagcugcuu

SEQ ID NO: 3324444 - RNA, 18 nt, Human
agggccuggccugagcug

SEQ ID NO: 3324445 - RNA, 14 nt, Human
agggccuggcucag

SEQ ID NO: 3324446 - RNA, 13 nt, Human
agggccuggcuca

SEQ ID NO: 3324447 - RNA, 18 nt, Human
agggccuggcucaggugg

SEQ ID NO: 3324448 - RNA, 23 nt, Human
aggcuguaucccaugagccucag

SEQ ID NO: 3324449 - RNA, 19 nt, Human
aggcugcagugagccgaga

SEQ ID NO: 3324450 - RNA, 17 nt, Human
aggcugcagugagccga

SEQ ID NO: 3324451 - RNA, 12 nt, Human
aggcugucaauu

SEQ ID NO: 3324452 - RNA, 24 nt, Human
aggcuguaucccaugagccucagc

SEQ ID NO: 3324453 - RNA, 20 nt, Human
aggcccucugcccacucccu

SEQ ID NO: 3324454 - RNA, 19 nt, Human
aggcccucugcccacuccc

SEQ ID NO: 3324455 - RNA, 20 nt, Human
agagggucugaggaauccag

SEQ ID NO: 3324456 - RNA, 23 nt, Human
agaggggguggccucccaacuca

SEQ ID NO: 3324457 - RNA, 20 nt, Human
agauagccaaggccaaagga

SEQ ID NO: 3324458 - RNA, 15 nt, Human
agaguugaagacaga

SEQ ID NO: 3324459 - RNA, 14 nt, Human
agaguugaagacag

SEQ ID NO: 3324460 - RNA, 13 nt, Human
agaguugaagaca

SEQ ID NO: 3324461 - RNA, 19 nt, Human
agcaaauucuguuuuucua

SEQ ID NO: 3324462 - RNA, 17 nt, Human
agauugcaacaggcugg

SEQ ID NO: 3324463 - RNA, 16 nt, Human
agauugcaccacugca

SEQ ID NO: 3324464 - RNA, 16 nt, Human
agauucuuuccugagg

SEQ ID NO: 3324465 - RNA, 15 nt, Human
agauucuuuccugag

SEQ ID NO: 3324466 - RNA, 16 nt, Human
agauugcaacaggcug

SEQ ID NO: 3324467 - RNA, 18 nt, Human
agaucucuaacuucacca

SEQ ID NO: 3324468 - RNA, 18 nt, Human
agaugacaucugucuagg

SEQ ID NO: 3324469 - RNA, 22 nt, Human
agaugggugcuuggaggaagga

SEQ ID NO: 3324470 - RNA, 20 nt, Human
agaugggugcuuggaggaag

SEQ ID NO: 3324471 - RNA, 14 nt, Human
agauucuuuccuga

SEQ ID NO: 3324472 - RNA, 20 nt, Human
agccagauuucacucuccuu

SEQ ID NO: 3324473 - RNA, 17 nt, Human
agccagauuucacucuc

SEQ ID NO: 3324474 - RNA, 14 nt, Human
agccagauuucacu

SEQ ID NO: 3324475 - RNA, 13 nt, Human
agcccaccuuggc

SEQ ID NO: 3324476 - RNA, 23 nt, Human
agcccaccccucaacaccucugc

SEQ ID NO: 3324477 - RNA, 19 nt, Human
agcccacgcccccacuggu

SEQ ID NO: 3324478 - RNA, 15 nt, Human
agcccacgcccccac

SEQ ID NO: 3324479 - RNA, 18 nt, Human
agcccacgcccccacugg

SEQ ID NO: 3324480 - RNA, 17 nt, Human
agcccacgcccccacug

SEQ ID NO: 3324481 - RNA, 21 nt, Human
agccagcaggcucucaggcca

SEQ ID NO: 3324482 - RNA, 22 nt, Human
agccagcaggcucucaggccag

SEQ ID NO: 3324483 - RNA, 23 nt, Human
agccagcaggcucucaggccagc

SEQ ID NO: 3324484 - RNA, 16 nt, Human
agcaucuaugugagac

SEQ ID NO: 3324485 - RNA, 16 nt, Human
agcagccuggacccug

SEQ ID NO: 3324486 - RNA, 20 nt, Human
agcagccuggacccugugga

SEQ ID NO: 3324487 - RNA, 19 nt, Human
agcagcguuucuaugacac

SEQ ID NO: 3324488 - RNA, 18 nt, Human
agcagcguuucuaugaca

SEQ ID NO: 3324489 - RNA, 16 nt, Human
agcagugcaugcuguc

SEQ ID NO: 3324490 - RNA, 13 nt, Human
agcagugcaugcu

SEQ ID NO: 3324491 - RNA, 17 nt, Human
agcagugcaugcugucc

SEQ ID NO: 3324492 - RNA, 20 nt, Human
agcacagacccugcccugug

SEQ ID NO: 3324493 - RNA, 21 nt, Human
agcacagacccugcccugugg

SEQ ID NO: 3324494 - RNA, 20 nt, Human
agcacuaaggugugcucuga

SEQ ID NO: 3324495 - RNA, 18 nt, Human
agaaccaaaaagaggcua

SEQ ID NO: 3324496 - RNA, 17 nt, Human
agaaccaaaaagaggcu

SEQ ID NO: 3324497 - RNA, 21 nt, Human
agaagagauugugguuucauu

SEQ ID NO: 3324498 - RNA, 15 nt, Human
agaagagaaugcaca

SEQ ID NO: 3324499 - RNA, 21 nt, Human
agaaccaaaaagaggcuaugu

SEQ ID NO: 3324500 - RNA, 17 nt, Human
agaagucuuagauguau

SEQ ID NO: 3324501 - RNA, 19 nt, Human
agaagucuuagauguauau

SEQ ID NO: 3324502 - RNA, 14 nt, Human
agaagucacacagu

SEQ ID NO: 3324503 - RNA, 17 nt, Human
agaaucucaaauaacua

SEQ ID NO: 3324504 - RNA, 18 nt, Human
agaaugcucuuuacuuca

SEQ ID NO: 3324505 - RNA, 22 nt, Human
agaaugcacaaacagaggccgc

SEQ ID NO: 3324506 - RNA, 23 nt, Human
agaaugcacaaacagaggccgcc

SEQ ID NO: 3324507 - RNA, 18 nt, Human
agagcccacgcccccacu

SEQ ID NO: 3324508 - RNA, 19 nt, Human
agagagcaagacgcugugc

SEQ ID NO: 3324509 - RNA, 11 nt, Human
agagagcaaga

SEQ ID NO: 3324510 - RNA, 17 nt, Human
agagcccacgcccccac

SEQ ID NO: 3324511 - RNA, 18 nt, Human
agagaaaguacuucucca

SEQ ID NO: 3324512 - RNA, 16 nt, Human
agacucuuuggacacu

SEQ ID NO: 3324513 - RNA, 20 nt, Human
agacaaugugaaaagaaaaa

SEQ ID NO: 3324514 - RNA, 23 nt, Human
agacaaugacuuacuguacauga

SEQ ID NO: 3324515 - RNA, 17 nt, Human
agacgcugugcugcccu

SEQ ID NO: 3324516 - RNA, 19 nt, Human
agacgcugugcugcccugc

SEQ ID NO: 3324517 - RNA, 18 nt, Human
agacgcugugcugcccug

SEQ ID NO: 3324518 - RNA, 23 nt, Human
agacagcccgggcucugccuccc

SEQ ID NO: 3324519 - RNA, 22 nt, Human
agacagcccgggcucugccucc

SEQ ID NO: 3324520 - RNA, 21 nt, Human
agacagcccgggcucugccuc

SEQ ID NO: 3324521 - RNA, 23 nt, Human
agaccaucccugaaggccccgcc

SEQ ID NO: 3324522 - RNA, 14 nt, Human
agaccacguuucua

SEQ ID NO: 3324523 - RNA, 19 nt, Human
cacagcucuucuccaggcu

SEQ ID NO: 3324524 - RNA, 20 nt, Human
cacagcucuucuccaggcug

SEQ ID NO: 3324525 - RNA, 17 nt, Human
cacaggaucagucugau

SEQ ID NO: 3324526 - RNA, 14 nt, Human
cacaggcccggcuc

SEQ ID NO: 3324527 - RNA, 22 nt, Human
cacaguccuuaccagcagagca

SEQ ID NO: 3324528 - RNA, 23 nt, Human
cacaguccuuaccagcagagcac

SEQ ID NO: 3324529 - RNA, 19 nt, Human
cacaggcagguccaggguu

SEQ ID NO: 3324530 - RNA, 18 nt, Human
cacagcucuucuccaggc

SEQ ID NO: 3324531 - RNA, 22 nt, Human
cacacggacacucaaaagcugg

SEQ ID NO: 3324532 - RNA, 21 nt, Human
cacaugagcaucaggccaggc

SEQ ID NO: 3324533 - RNA, 20 nt, Human
cacaugagcaucaggccagg

SEQ ID NO: 3324534 - RNA, 19 nt, Human
cacaugagcaucaggccag

SEQ ID NO: 3324535 - RNA, 18 nt, Human
cacaugagcaucaggcca

SEQ ID NO: 3324536 - RNA, 17 nt, Human
cacaugagcaucaggcc

SEQ ID NO: 3324537 - RNA, 13 nt, Human
cacaugagcauca

SEQ ID NO: 3324538 - RNA, 21 nt, Human
cacaugccucucucaggccaa

SEQ ID NO: 3324539 - RNA, 20 nt, Human
cacaugccucucucaggcca

SEQ ID NO: 3324540 - RNA, 17 nt, Human
cacauguccaagaagcc

SEQ ID NO: 3324541 - RNA, 16 nt, Human
cacauguccaagaagc

SEQ ID NO: 3324542 - RNA, 18 nt, Human
cacaugcacgugugugca

SEQ ID NO: 3324543 - RNA, 20 nt, Human
cacaugcaaggucauuuuuu

SEQ ID NO: 3324544 - RNA, 19 nt, Human
cacaugcaaggucauuuuu

SEQ ID NO: 3324545 - RNA, 17 nt, Human
cacaugcaaggucauuu

SEQ ID NO: 3324546 - RNA, 18 nt, Human
caccaucaugucuggcua

SEQ ID NO: 3324547 - RNA, 15 nt, Human
caccaucaugucugg

SEQ ID NO: 3324548 - RNA, 17 nt, Human
caccaucaugucuggcu

SEQ ID NO: 3324549 - RNA, 24 nt, Human
caccaucaagccaccaacauacuc

SEQ ID NO: 3324550 - RNA, 19 nt, Human
caccaucaagccaccaaca

SEQ ID NO: 3324551 - RNA, 17 nt, Human
caccaucaagccaccaa

SEQ ID NO: 3324552 - RNA, 16 nt, Human
caccaucaagccacca

SEQ ID NO: 3324553 - RNA, 13 nt, Human
caccaucaagcca

SEQ ID NO: 3324554 - RNA, 15 nt, Human
caccaucaagccacc

SEQ ID NO: 3324555 - RNA, 14 nt, Human
caccaucaagccac

SEQ ID NO: 3324556 - RNA, 21 nt, Human
caccauauuaccacagacaua

SEQ ID NO: 3324557 - RNA, 12 nt, Human
caccaagcccag

SEQ ID NO: 3324558 - RNA, 13 nt, Human
caccaagcccagu

SEQ ID NO: 3324559 - RNA, 17 nt, Human
caccaacgucugugcca

SEQ ID NO: 3324560 - RNA, 16 nt, Human
caccaacgucugugcc

SEQ ID NO: 3324561 - RNA, 22 nt, Human
cacauguccaagaagcccagga

SEQ ID NO: 3324562 - RNA, 21 nt, Human
cacauguccaagaagcccagg

SEQ ID NO: 3324563 - RNA, 19 nt, Human
cacauguccaagaagccca

SEQ ID NO: 3324564 - RNA, 18 nt, Human
cacauguccaagaagccc

SEQ ID NO: 3324565 - RNA, 17 nt, Human
caccagagcccaccuug

SEQ ID NO: 3324566 - RNA, 18 nt, Human
caccagagcccaccuugg

SEQ ID NO: 3324567 - RNA, 20 nt, Human
caccagagcccaccuuggcu

SEQ ID NO: 3324568 - RNA, 22 nt, Human
caccagagcccaccuuggcuca

SEQ ID NO: 3324569 - RNA, 15 nt, Human
caccagagcccaccu

SEQ ID NO: 3324570 - RNA, 19 nt, Human
caccacacccagcccacuu

SEQ ID NO: 3324571 - RNA, 17 nt, Human
caccacacccagcccac

SEQ ID NO: 3324572 - RNA, 14 nt, Human
caccaccucuuugg

SEQ ID NO: 3324573 - RNA, 17 nt, Human
cacaaagguagcuuuuc

SEQ ID NO: 3324574 - RNA, 14 nt, Human
caaugcacuuuguu

SEQ ID NO: 3324575 - RNA, 18 nt, Human
caaugguuuucuugugug

SEQ ID NO: 3324576 - RNA, 17 nt, Human
cacaaacgggcucagca

SEQ ID NO: 3324577 - RNA, 15 nt, Human
cacaaacagaggccg

SEQ ID NO: 3324578 - RNA, 21 nt, Human
cacacagaggcugccucuccc

SEQ ID NO: 3324579 - RNA, 14 nt, Human
cacacacuuuggcu

SEQ ID NO: 3324580 - RNA, 15 nt, Human
cacacaccagagccc

SEQ ID NO: 3324581 - RNA, 16 nt, Human
cacacaccagagccca

SEQ ID NO: 3324582 - RNA, 20 nt, Human
cacacaccagagcccaccuu

SEQ ID NO: 3324583 - RNA, 17 nt, Human
cacaccgggcacucaga

SEQ ID NO: 3324584 - RNA, 14 nt, Human
cacacccagcccac

SEQ ID NO: 3324585 - RNA, 20 nt, Human
cacacccagcccacuucugc

SEQ ID NO: 3324586 - RNA, 13 nt, Human
cacacagcucugu

SEQ ID NO: 3324587 - RNA, 14 nt, Human
cacacagcucuguc

SEQ ID NO: 3324588 - RNA, 15 nt, Human
cacacagcucugucc

SEQ ID NO: 3324589 - RNA, 21 nt, Human
cacaccagagcccaccuuggc

SEQ ID NO: 3324590 - RNA, 22 nt, Human
cacaccagagcccaccuuggcu

SEQ ID NO: 3324591 - RNA, 13 nt, Human
cacacccagccca

SEQ ID NO: 3324592 - RNA, 20 nt, Human
caaugcaaaccaucauugaa

SEQ ID NO: 3324593 - RNA, 23 nt, Human
caaugcaaaccaucauugaaauc

SEQ ID NO: 3324594 - RNA, 14 nt, Human
caaugcacugacau

SEQ ID NO: 3324595 - RNA, 13 nt, Human
caaugcacuuugu

SEQ ID NO: 3324596 - RNA, 14 nt, Human
caaugauggucacc

SEQ ID NO: 3324597 - RNA, 22 nt, Human
caaugcaaaccaucauugaaau

SEQ ID NO: 3324598 - RNA, 21 nt, Human
caaugcaaaccaucauugaaa

SEQ ID NO: 3324599 - RNA, 13 nt, Human
caaugaccuuuca

SEQ ID NO: 3324600 - RNA, 14 nt, Human
caaugaccuuucaa

SEQ ID NO: 3324601 - RNA, 13 nt, Human
caaugauggucac

SEQ ID NO: 3324602 - RNA, 16 nt, Human
caaugaccuuucaaua

SEQ ID NO: 3324603 - RNA, 15 nt, Human
caaugaccuuucaau

SEQ ID NO: 3324604 - RNA, 14 nt, Human
caacaggcugggcu

SEQ ID NO: 3324605 - RNA, 13 nt, Human
caacaggcugggc

SEQ ID NO: 3324606 - RNA, 17 nt, Human
caacaggcugggcuuca

SEQ ID NO: 3324607 - RNA, 15 nt, Human
caacauacucccauc

SEQ ID NO: 3324608 - RNA, 14 nt, Human
caacauacucccau

SEQ ID NO: 3324609 - RNA, 17 nt, Human
caaccugauugugucuc

SEQ ID NO: 3324610 - RNA, 16 nt, Human
caaccugauugugucu

SEQ ID NO: 3324611 - RNA, 21 nt, Human
caaccugauugugucucuugg

SEQ ID NO: 3324612 - RNA, 19 nt, Human
caaccugauugugucucuu

SEQ ID NO: 3324613 - RNA, 17 nt, Human
caacugcaucaagaugu

SEQ ID NO: 3324614 - RNA, 23 nt, Human
caacugcaucaagaugugacaug

SEQ ID NO: 3324615 - RNA, 20 nt, Human
caacugcaucaagaugugac

SEQ ID NO: 3324616 - RNA, 23 nt, Human
caagacccuuguggucccacccc

SEQ ID NO: 3324617 - RNA, 22 nt, Human
caagacgcugugcugcccugcc

SEQ ID NO: 3324618 - RNA, 21 nt, Human
caagacgcugugcugcccugc

SEQ ID NO: 3324619 - RNA, 20 nt, Human
caagacgcugugcugcccug

SEQ ID NO: 3324620 - RNA, 19 nt, Human
caagacgcugugcugcccu

SEQ ID NO: 3324621 - RNA, 13 nt, Human
caagaccuucucc

SEQ ID NO: 3324622 - RNA, 12 nt, Human
caagagggucug

SEQ ID NO: 3324623 - RNA, 16 nt, Human
caagagggucugagga

SEQ ID NO: 3324624 - RNA, 17 nt, Human
caagagggucugaggaa

SEQ ID NO: 3324625 - RNA, 17 nt, Human
caagagcccaggccucc

SEQ ID NO: 3324626 - RNA, 14 nt, Human
caaggcugucaauu

SEQ ID NO: 3324627 - RNA, 13 nt, Human
caaggcugucaau

SEQ ID NO: 3324628 - RNA, 21 nt, Human
caaggcugggggaagaagcuc

SEQ ID NO: 3324629 - RNA, 18 nt, Human
caaggcugggggaagaag

SEQ ID NO: 3324630 - RNA, 13 nt, Human
caaggauccugag

SEQ ID NO: 3324631 - RNA, 16 nt, Human
caaggauccugagcca

SEQ ID NO: 3324632 - RNA, 15 nt, Human
caaggauccugagcc

SEQ ID NO: 3324633 - RNA, 14 nt, Human
caaggauccugagc

SEQ ID NO: 3324634 - RNA, 14 nt, Human
caagugagacccug

SEQ ID NO: 3324635 - RNA, 23 nt, Human
caagugaaaaaggaggaagagaa

SEQ ID NO: 3324636 - RNA, 22 nt, Human
caagugaaaaaggaggaagaga

SEQ ID NO: 3324637 - RNA, 19 nt, Human
caagugaaaaaggaggaag

SEQ ID NO: 3324638 - RNA, 19 nt, Human
caagugauucuccugccuc

SEQ ID NO: 3324639 - RNA, 18 nt, Human
caagugauucuccugccu

SEQ ID NO: 3324640 - RNA, 15 nt, Human
caagugagacccugu

SEQ ID NO: 3324641 - RNA, 20 nt, Human
caagugauucuccugccuca

SEQ ID NO: 3324642 - RNA, 21 nt, Human
caaggggaauguuugccucug

SEQ ID NO: 3324643 - RNA, 15 nt, Human
caagggccuggccug

SEQ ID NO: 3324644 - RNA, 14 nt, Human
caagggccuggccu

SEQ ID NO: 3324645 - RNA, 13 nt, Human
caagggccuggcc

SEQ ID NO: 3324646 - RNA, 23 nt, Human
caaggggaauguuugccucugcc

SEQ ID NO: 3324647 - RNA, 21 nt, Human
caaagagguuuuaaaaaaauc

SEQ ID NO: 3324648 - RNA, 14 nt, Human
caaagagguuuuaa

SEQ ID NO: 3324649 - RNA, 20 nt, Human
caaaggguaucaggugcugc

SEQ ID NO: 3324650 - RNA, 21 nt, Human
caaaggguaucaggugcugcc

SEQ ID NO: 3324651 - RNA, 19 nt, Human
caaaggguaucaggugcug

SEQ ID NO: 3324652 - RNA, 23 nt, Human
caaaggguaucaggugcugccau

SEQ ID NO: 3324653 - RNA, 17 nt, Human
caaaguggugagaggca

SEQ ID NO: 3324654 - RNA, 16 nt, Human
caaaguggugagaggc

SEQ ID NO: 3324655 - RNA, 20 nt, Human
caaaggagauuggaaggaac

SEQ ID NO: 3324656 - RNA, 14 nt, Human
caaaggagauugga

SEQ ID NO: 3324657 - RNA, 20 nt, Human
caacaggcugggcuucagug

SEQ ID NO: 3324658 - RNA, 13 nt, Human
gggauagagagag

SEQ ID NO: 3324659 - RNA, 21 nt, Human
gggauaugauuuaaaucagcc

SEQ ID NO: 3324660 - RNA, 16 nt, Human
gggauccuccaggugc

SEQ ID NO: 3324661 - RNA, 15 nt, Human
gggauccuccaggug

SEQ ID NO: 3324662 - RNA, 20 nt, Human
gggcaacccccagccugcua

SEQ ID NO: 3324663 - RNA, 18 nt, Human
gggcaacccuggugacca

SEQ ID NO: 3324664 - RNA, 23 nt, Human
gggauccuggaguucugguuccu

SEQ ID NO: 3324665 - RNA, 17 nt, Human
gggagugacagaggcag

SEQ ID NO: 3324666 - RNA, 18 nt, Human
gggagugacagaggcagc

SEQ ID NO: 3324667 - RNA, 11 nt, Human
gggagugagcu

SEQ ID NO: 3324668 - RNA, 14 nt, Human
gggagugagcuggu

SEQ ID NO: 3324669 - RNA, 17 nt, Human
gggaggugggauccucc

SEQ ID NO: 3324670 - RNA, 16 nt, Human
gggaggugaccccagg

SEQ ID NO: 3324671 - RNA, 17 nt, Human
gggcagguugguggggg

SEQ ID NO: 3324672 - RNA, 11 nt, Human
gggcagagcag

SEQ ID NO: 3324673 - RNA, 20 nt, Human
gggcacucagaagacacuga

SEQ ID NO: 3324674 - RNA, 14 nt, Human
gggcagaaggaaga

SEQ ID NO: 3324675 - RNA, 18 nt, Human
gggcagaaggaagacuuc

SEQ ID NO: 3324676 - RNA, 16 nt, Human
gggcacagggucucua

SEQ ID NO: 3324677 - RNA, 13 nt, Human
gggcacagggucu

SEQ ID NO: 3324678 - RNA, 16 nt, Human
gggcacucagaagaca

SEQ ID NO: 3324679 - RNA, 19 nt, Human
gggcacucagaagacacug

SEQ ID NO: 3324680 - RNA, 21 nt, Human
gggcacagaaaauggaagaca

SEQ ID NO: 3324681 - RNA, 20 nt, Human
gggcacagaaaauggaagac

SEQ ID NO: 3324682 - RNA, 18 nt, Human
gggcacagaaaauggaag

SEQ ID NO: 3324683 - RNA, 23 nt, Human
gggcacaccgggcacucagaaga

SEQ ID NO: 3324684 - RNA, 13 nt, Human
gggccuggcuccc

SEQ ID NO: 3324685 - RNA, 17 nt, Human
gggccuggcucaggugg

SEQ ID NO: 3324686 - RNA, 18 nt, Human
gggccuggccugagcugg

SEQ ID NO: 3324687 - RNA, 14 nt, Human
gggccuggccugag

SEQ ID NO: 3324688 - RNA, 12 nt, Human
gggccuggccug

SEQ ID NO: 3324689 - RNA, 13 nt, Human
gggccuggccuga

SEQ ID NO: 3324690 - RNA, 13 nt, Human
gggcccugccucc

SEQ ID NO: 3324691 - RNA, 12 nt, Human
gggcaugacacg

SEQ ID NO: 3324692 - RNA, 17 nt, Human
gggcccagagagggugg

SEQ ID NO: 3324693 - RNA, 16 nt, Human
gggccacagagaaagu

SEQ ID NO: 3324694 - RNA, 23 nt, Human
gggccacagagaaaguacuucuc

SEQ ID NO: 3324695 - RNA, 16 nt, Human
gggaaggauacaaaag

SEQ ID NO: 3324696 - RNA, 23 nt, Human
gggaaggauacaaaagcauguga

SEQ ID NO: 3324697 - RNA, 21 nt, Human
gggaaggauacaaaagcaugu

SEQ ID NO: 3324698 - RNA, 17 nt, Human
gggaagggggcugggac

SEQ ID NO: 3324699 - RNA, 16 nt, Human
gggaagggggcuggga

SEQ ID NO: 3324700 - RNA, 14 nt, Human
gggaagggggcugg

SEQ ID NO: 3324701 - RNA, 17 nt, Human
gggacuacaggcaccca

SEQ ID NO: 3324702 - RNA, 15 nt, Human
gggaccucaggccug

SEQ ID NO: 3324703 - RNA, 13 nt, Human
gggaccucaggcc

SEQ ID NO: 3324704 - RNA, 12 nt, Human
gggaccucaggc

SEQ ID NO: 3324705 - RNA, 21 nt, Human
ggcuuggggaccagagcugcc

SEQ ID NO: 3324706 - RNA, 19 nt, Human
ggcuuggggaccagagcug

SEQ ID NO: 3324707 - RNA, 10 nt, Human
ggcuuuugug

SEQ ID NO: 3324708 - RNA, 17 nt, Human
ggcugggcucccuuccc

SEQ ID NO: 3324709 - RNA, 12 nt, Human
ggcugggcuuca

SEQ ID NO: 3324710 - RNA, 15 nt, Human
ggcuuaaaacaacac

SEQ ID NO: 3324711 - RNA, 13 nt, Human
ggcugggcuucag

SEQ ID NO: 3324712 - RNA, 17 nt, Human
ggcugggcuucaguggc

SEQ ID NO: 3324713 - RNA, 21 nt, Human
ggcuuagucacugagacagcc

SEQ ID NO: 3324714 - RNA, 15 nt, Human
ggcuuagucacugag

SEQ ID NO: 3324715 - RNA, 15 nt, Human
ggcugaggugggagg

SEQ ID NO: 3324716 - RNA, 13 nt, Human
ggcugagguggga

SEQ ID NO: 3324717 - RNA, 20 nt, Human
ggccccugcccggcugcgga

SEQ ID NO: 3324718 - RNA, 17 nt, Human
ggcucugccucccauca

SEQ ID NO: 3324719 - RNA, 16 nt, Human
ggccccugcccggcug

SEQ ID NO: 3324720 - RNA, 17 nt, Human
ggccccugcccggcugc

SEQ ID NO: 3324721 - RNA, 18 nt, Human
ggcugcaaaggguaucag

SEQ ID NO: 3324722 - RNA, 22 nt, Human
ggcugcaaaggguaucaggugc

SEQ ID NO: 3324723 - RNA, 23 nt, Human
ggcugcaaaggguaucaggugcu

SEQ ID NO: 3324724 - RNA, 24 nt, Human
ggcugcaaaggguaucaggugcug

SEQ ID NO: 3324725 - RNA, 17 nt, Human
ggcugcaccggcuggcc

SEQ ID NO: 3324726 - RNA, 19 nt, Human
ggcugcaccggcuggccug

SEQ ID NO: 3324727 - RNA, 18 nt, Human
ggcugcaccggcuggccu

SEQ ID NO: 3324728 - RNA, 22 nt, Human
ggcugcuucaaggauccugagc

SEQ ID NO: 3324729 - RNA, 12 nt, Human
ggcugcuucaag

SEQ ID NO: 3324730 - RNA, 11 nt, Human
ggcugcuucaa

SEQ ID NO: 3324731 - RNA, 12 nt, Human
ggcugcagggag

SEQ ID NO: 3324732 - RNA, 13 nt, Human
ggcugcagggagu

SEQ ID NO: 3324733 - RNA, 14 nt, Human
ggcugcugaaggcu

SEQ ID NO: 3324734 - RNA, 17 nt, Human
ggcugcugaaggcucga

SEQ ID NO: 3324735 - RNA, 15 nt, Human
ggcugcugaaggcuc

SEQ ID NO: 3324736 - RNA, 18 nt, Human
ggcugcugaaggcucgag

SEQ ID NO: 3324737 - RNA, 13 nt, Human
ggcugcugaaggc

SEQ ID NO: 3324738 - RNA, 23 nt, Human
ggcugggagagccuuccaggggu

SEQ ID NO: 3324739 - RNA, 20 nt, Human
ggcugggagagccuuccagg

SEQ ID NO: 3324740 - RNA, 14 nt, Human
ggcugggcagagga

SEQ ID NO: 3324741 - RNA, 13 nt, Human
ggcugggcagagg

SEQ ID NO: 3324742 - RNA, 19 nt, Human
ggcugggcagaggaaagca

SEQ ID NO: 3324743 - RNA, 15 nt, Human
ggcugggcagaggaa

SEQ ID NO: 3324744 - RNA, 18 nt, Human
ggcugggagagccuucca

SEQ ID NO: 3324745 - RNA, 19 nt, Human
ggcugggagagccuuccag

SEQ ID NO: 3324746 - RNA, 21 nt, Human
ggcugcuucaaggauccugag

SEQ ID NO: 3324747 - RNA, 23 nt, Human
ggcugcuucaaggauccugagcc

SEQ ID NO: 3324748 - RNA, 21 nt, Human
gguuacccaguuagcucucaa

SEQ ID NO: 3324749 - RNA, 13 nt, Human
gguuauggagagg

SEQ ID NO: 3324750 - RNA, 17 nt, Human
gguuaggcauuguggga

SEQ ID NO: 3324751 - RNA, 13 nt, Human
gguucaaagauau

SEQ ID NO: 3324752 - RNA, 21 nt, Human
gguucaaagauauuuugcuuu

SEQ ID NO: 3324753 - RNA, 13 nt, Human
gguugagguuuca

SEQ ID NO: 3324754 - RNA, 16 nt, Human
gguggugaccucugcc

SEQ ID NO: 3324755 - RNA, 14 nt, Human
gguggugaccucug

SEQ ID NO: 3324756 - RNA, 15 nt, Human
gguggugaccucugc

SEQ ID NO: 3324757 - RNA, 19 nt, Human
ggugucaccugaagacuca

SEQ ID NO: 3324758 - RNA, 19 nt, Human
ggugucaagagggucugag

SEQ ID NO: 3324759 - RNA, 17 nt, Human
ggugucaagagggucug

SEQ ID NO: 3324760 - RNA, 18 nt, Human
ggugguuuucuguucuuu

SEQ ID NO: 3324761 - RNA, 15 nt, Human
ggugguuuucuguuc

SEQ ID NO: 3324762 - RNA, 21 nt, Human
ggugguuauggagaggguguc

SEQ ID NO: 3324763 - RNA, 18 nt, Human
ggugguuucagaaaugug

SEQ ID NO: 3324764 - RNA, 17 nt, Human
ggugguuucagaaaugu

SEQ ID NO: 3324765 - RNA, 20 nt, Human
ggugcuaucucccccagccc

SEQ ID NO: 3324766 - RNA, 19 nt, Human
ggugcuaucucccccagcc

SEQ ID NO: 3324767 - RNA, 17 nt, Human
ggugcuaucucccccag

SEQ ID NO: 3324768 - RNA, 16 nt, Human
ggugcuaucuccccca

SEQ ID NO: 3324769 - RNA, 15 nt, Human
ggugagaagcagagg

SEQ ID NO: 3324770 - RNA, 16 nt, Human
ggugagaggggaacag

SEQ ID NO: 3324771 - RNA, 15 nt, Human
ggugcugccauccag

SEQ ID NO: 3324772 - RNA, 19 nt, Human
gguggcagugggagcugcc

SEQ ID NO: 3324773 - RNA, 22 nt, Human
gguggcagugggagcugccugu

SEQ ID NO: 3324774 - RNA, 16 nt, Human
gguggcagugggagcu

SEQ ID NO: 3324775 - RNA, 22 nt, Human
gguggccucccaacucacccca

SEQ ID NO: 3324776 - RNA, 23 nt, Human
gguggccucccaacucaccccag

SEQ ID NO: 3324777 - RNA, 16 nt, Human
ggucucacucugucgc

SEQ ID NO: 3324778 - RNA, 22 nt, Human
ggucucacucugucgcccaguc

SEQ ID NO: 3324779 - RNA, 23 nt, Human
ggucucacucugucgcccagucu

SEQ ID NO: 3324780 - RNA, 14 nt, Human
ggucccaccccaca

SEQ ID NO: 3324781 - RNA, 17 nt, Human
ggucccaccccacacac

SEQ ID NO: 3324782 - RNA, 21 nt, Human
ggugacagagugagacucugu

SEQ ID NO: 3324783 - RNA, 14 nt, Human
ggucugacccacug

SEQ ID NO: 3324784 - RNA, 22 nt, Human
ggugaccagcaccaucucuccu

SEQ ID NO: 3324785 - RNA, 21 nt, Human
ggugaccucugccugaaguca

SEQ ID NO: 3324786 - RNA, 16 nt, Human
ggggcaacccugguga

SEQ ID NO: 3324787 - RNA, 17 nt, Human
ggggcugaggugggagg

SEQ ID NO: 3324788 - RNA, 22 nt, Human
gggcuuggggaccagagcugcc

SEQ ID NO: 3324789 - RNA, 16 nt, Human
ggggaaaaucagccug

SEQ ID NO: 3324790 - RNA, 19 nt, Human
ggggaaaaucagccugcuc

SEQ ID NO: 3324791 - RNA, 17 nt, Human
ggggaaaaucagccugc

SEQ ID NO: 3324792 - RNA, 21 nt, Human
ggggaaaaucagccugcucca

SEQ ID NO: 3324793 - RNA, 22 nt, Human
gggggaggugggauccuccagg

SEQ ID NO: 3324794 - RNA, 22 nt, Human
ggggcugcaccggcuggccugg

SEQ ID NO: 3324795 - RNA, 21 nt, Human
ggggcugcaccggcuggccug

SEQ ID NO: 3324796 - RNA, 12 nt, Human
ggggcugcaccg

SEQ ID NO: 3324797 - RNA, 19 nt, Human
ggggcugaggugggaggau

SEQ ID NO: 3324798 - RNA, 12 nt, Human
gggguggccucc

SEQ ID NO: 3324799 - RNA, 17 nt, Human
gggguggggaccucagg

SEQ ID NO: 3324800 - RNA, 12 nt, Human
gggucugaggaa

SEQ ID NO: 3324801 - RNA, 21 nt, Human
gggucugaggaauccagaccc

SEQ ID NO: 3324802 - RNA, 12 nt, Human
gggucucacucu

SEQ ID NO: 3324803 - RNA, 14 nt, Human
gggucucacucugu

SEQ ID NO: 3324804 - RNA, 17 nt, Human
ggguaagugagagaggg

SEQ ID NO: 3324805 - RNA, 16 nt, Human
ggucccaccccacaca

SEQ ID NO: 3324806 - RNA, 15 nt, Human
ggucccaccccacac

SEQ ID NO: 3324807 - RNA, 16 nt, Human
gguacuuguggacaca

SEQ ID NO: 3324808 - RNA, 17 nt, Human
gguacuuguggacacag

SEQ ID NO: 3324809 - RNA, 22 nt, Human
gguagaaauaucugaaaaugua

SEQ ID NO: 3324810 - RNA, 11 nt, Human
gguacccacug

SEQ ID NO: 3324811 - RNA, 13 nt, Human
gguacccacugcu

SEQ ID NO: 3324812 - RNA, 22 nt, Human
gguagaagcccuucuaccuucc

SEQ ID NO: 3324813 - RNA, 23 nt, Human
gguagaaauaucugaaaauguau

SEQ ID NO: 3324814 - RNA, 12 nt, Human
ggguucuaccca

SEQ ID NO: 3324815 - RNA, 23 nt, Human
ggguucaagcgauucuucugcuu

SEQ ID NO: 3324816 - RNA, 22 nt, Human
ggguucaagcgauucuucugcu

SEQ ID NO: 3324817 - RNA, 19 nt, Human
gggugacagagcaagugag

SEQ ID NO: 3324818 - RNA, 17 nt, Human
gggugaagugaagacaa

SEQ ID NO: 3324819 - RNA, 16 nt, Human
ggaucacagccucuga

SEQ ID NO: 3324820 - RNA, 12 nt, Human
ggagugagcugg

SEQ ID NO: 3324821 - RNA, 14 nt, Human
ggagugagcugguu

SEQ ID NO: 3324822 - RNA, 21 nt, Human
ggagugaguugauagcacaga

SEQ ID NO: 3324823 - RNA, 17 nt, Human
ggagugacagaggcagc

SEQ ID NO: 3324824 - RNA, 18 nt, Human
ggagugacagaggcagcc

SEQ ID NO: 3324825 - RNA, 19 nt, Human
ggagugacagaggcagccc

SEQ ID NO: 3324826 - RNA, 21 nt, Human
ggagugacagaggcagcccca

SEQ ID NO: 3324827 - RNA, 15 nt, Human
ggagggcuccagaca

SEQ ID NO: 3324828 - RNA, 14 nt, Human
ggagggcuccagac

SEQ ID NO: 3324829 - RNA, 17 nt, Human
ggagggcuccagacaca

SEQ ID NO: 3324830 - RNA, 20 nt, Human
ggagucccaccuuggcugca

SEQ ID NO: 3324831 - RNA, 11 nt, Human
ggagugacaga

SEQ ID NO: 3324832 - RNA, 16 nt, Human
ggagugacagaggcag

SEQ ID NO: 3324833 - RNA, 13 nt, Human
ggagggcuccaga

SEQ ID NO: 3324834 - RNA, 12 nt, Human
ggagggcuccag

SEQ ID NO: 3324835 - RNA, 21 nt, Human
ggaggaucucuugagccuggg

SEQ ID NO: 3324836 - RNA, 17 nt, Human
ggaggaucucuugagcc

SEQ ID NO: 3324837 - RNA, 23 nt, Human
ggaggaucacuugaguccagaag

SEQ ID NO: 3324838 - RNA, 20 nt, Human
ggaagccagcaggcucucag

SEQ ID NO: 3324839 - RNA, 21 nt, Human
ggagaccccuuggggagcagg

SEQ ID NO: 3324840 - RNA, 21 nt, Human
ggagagcuagcagcagggagg

SEQ ID NO: 3324841 - RNA, 17 nt, Human
ggagagcuagcagcagg

SEQ ID NO: 3324842 - RNA, 15 nt, Human
ggagaggggcacagg

SEQ ID NO: 3324843 - RNA, 20 nt, Human
ggagauuuacaacuggggga

SEQ ID NO: 3324844 - RNA, 20 nt, Human
ggagcaaaaucgaugcagug

SEQ ID NO: 3324845 - RNA, 13 nt, Human
ggccaugggccuc

SEQ ID NO: 3324846 - RNA, 21 nt, Human
ggccccucagggucccuggug

SEQ ID NO: 3324847 - RNA, 20 nt, Human
ggccccucagggucccuggu

SEQ ID NO: 3324848 - RNA, 19 nt, Human
ggccccucagggucccugg

SEQ ID NO: 3324849 - RNA, 16 nt, Human
ggccccucaggguccc

SEQ ID NO: 3324850 - RNA, 17 nt, Human
ggccccugccacccugg

SEQ ID NO: 3324851 - RNA, 18 nt, Human
ggccccugccacccuggg

SEQ ID NO: 3324852 - RNA, 13 nt, Human
ggccccugcccgg

SEQ ID NO: 3324853 - RNA, 13 nt, Human
ggccccugccacc

SEQ ID NO: 3324854 - RNA, 16 nt, Human
ggccccugccacccug

SEQ ID NO: 3324855 - RNA, 12 nt, Human
ggccccugccac

SEQ ID NO: 3324856 - RNA, 15 nt, Human
ggcagguuggugggg

SEQ ID NO: 3324857 - RNA, 23 nt, Human
ggcauguucucugaggacacuaa

SEQ ID NO: 3324858 - RNA, 22 nt, Human
ggccaccugcggugcuaucucc

SEQ ID NO: 3324859 - RNA, 16 nt, Human
ggccaccugcggugcu

SEQ ID NO: 3324860 - RNA, 17 nt, Human
ggccacaagacccuugu

SEQ ID NO: 3324861 - RNA, 16 nt, Human
ggccacaagacccuug

SEQ ID NO: 3324862 - RNA, 15 nt, Human
ggcauuccccaggag

SEQ ID NO: 3324863 - RNA, 11 nt, Human
ggccacuguga

SEQ ID NO: 3324864 - RNA, 16 nt, Human
ggccaggagccuccug

SEQ ID NO: 3324865 - RNA, 14 nt, Human
ggccaggagccucc

SEQ ID NO: 3324866 - RNA, 16 nt, Human
ggccacugugaagaga

SEQ ID NO: 3324867 - RNA, 14 nt, Human
ggccaggccagagg

SEQ ID NO: 3324868 - RNA, 16 nt, Human
ggccaggccagaggga

SEQ ID NO: 3324869 - RNA, 11 nt, Human
ggccaggcugg

SEQ ID NO: 3324870 - RNA, 18 nt, Human
ggcaacugcauuggcuuu

SEQ ID NO: 3324871 - RNA, 15 nt, Human
ggcaaggcugucaau

SEQ ID NO: 3324872 - RNA, 19 nt, Human
ggcaacugcauuggcuuug

SEQ ID NO: 3324873 - RNA, 19 nt, Human
ggcaacccccagccugcua

SEQ ID NO: 3324874 - RNA, 21 nt, Human
ggaucagucugauucccaagc

SEQ ID NO: 3324875 - RNA, 16 nt, Human
ggcaaggcugucaauu

SEQ ID NO: 3324876 - RNA, 15 nt, Human
ggcacccggccccug

SEQ ID NO: 3324877 - RNA, 16 nt, Human
ggcacccggccccugc

SEQ ID NO: 3324878 - RNA, 12 nt, Human
ggcagagcagag

SEQ ID NO: 3324879 - RNA, 16 nt, Human
ggcagagcagagacca

SEQ ID NO: 3324880 - RNA, 15 nt, Human
ggcagagcagagacc

SEQ ID NO: 3324881 - RNA, 20 nt, Human
ggcagagcagagaccauccc

SEQ ID NO: 3324882 - RNA, 17 nt, Human
ggcagaggaaagcaaag

SEQ ID NO: 3324883 - RNA, 21 nt, Human
ggcagaguugaagacagagcu

SEQ ID NO: 3324884 - RNA, 23 nt, Human
ggcagauacaggaaaagcugcug

SEQ ID NO: 3324885 - RNA, 23 nt, Human
ggcagaguugaagacagagcuac

SEQ ID NO: 3324886 - RNA, 21 nt, Human
ggcagcucaccucucccuugg

SEQ ID NO: 3324887 - RNA, 18 nt, Human
ggcagcucaccucucccu

SEQ ID NO: 3324888 - RNA, 22 nt, Human
ggcagcucaccucucccuugga

SEQ ID NO: 3324889 - RNA, 16 nt, Human
ggcagcucaccucucc

SEQ ID NO: 3324890 - RNA, 21 nt, Human
ggcagcuugaggguugggcug

SEQ ID NO: 3324891 - RNA, 17 nt, Human
ggcagcuugaggguugg

SEQ ID NO: 3324892 - RNA, 19 nt, Human
ggcagcugcgguccaccca

SEQ ID NO: 3324893 - RNA, 13 nt, Human
ggcagguccaggg

SEQ ID NO: 3324894 - RNA, 23 nt, Human
ggcaggucuugaacuccuggccu

SEQ ID NO: 3324895 - RNA, 21 nt, Human
gcuggaccuugaacuggguac

SEQ ID NO: 3324896 - RNA, 16 nt, Human
gcuggaccuugaacug

SEQ ID NO: 3324897 - RNA, 18 nt, Human
gcuggaccuugaacuggg

SEQ ID NO: 3324898 - RNA, 17 nt, Human
gcugcuugggcuucauc

SEQ ID NO: 3324899 - RNA, 20 nt, Human
gcugggacaugggaaagggg

SEQ ID NO: 3324900 - RNA, 19 nt, Human
gcugggacuacagguguga

SEQ ID NO: 3324901 - RNA, 13 nt, Human
gcugggacuacag

SEQ ID NO: 3324902 - RNA, 18 nt, Human
gcugggacuacaggcacc

SEQ ID NO: 3324903 - RNA, 19 nt, Human
gcugggacuacaggcaccc

SEQ ID NO: 3324904 - RNA, 20 nt, Human
gcugggacuacaggcaccca

SEQ ID NO: 3324905 - RNA, 16 nt, Human
gcugcgguccacccag

SEQ ID NO: 3324906 - RNA, 14 nt, Human
gcugcccugugagu

SEQ ID NO: 3324907 - RNA, 12 nt, Human
gcugcccuguga

SEQ ID NO: 3324908 - RNA, 11 nt, Human
gcugcccugug

SEQ ID NO: 3324909 - RNA, 23 nt, Human
gcugcuucaaggauccugagcca

SEQ ID NO: 3324910 - RNA, 22 nt, Human
gcugcuucaaggauccugagcc

SEQ ID NO: 3324911 - RNA, 21 nt, Human
gcugcuucaaggauccugagc

SEQ ID NO: 3324912 - RNA, 16 nt, Human
gcugcuugggcuucau

SEQ ID NO: 3324913 - RNA, 13 nt, Human
gcugcuucaagga

SEQ ID NO: 3324914 - RNA, 17 nt, Human
gcugcgguccacccagg

SEQ ID NO: 3324915 - RNA, 18 nt, Human
gcugcgguccacccagga

SEQ ID NO: 3324916 - RNA, 21 nt, Human
gcugggaugauuggagggggg

SEQ ID NO: 3324917 - RNA, 17 nt, Human
gcugggcuucaguggca

SEQ ID NO: 3324918 - RNA, 22 nt, Human
gcugggagagccuuccaggggu

SEQ ID NO: 3324919 - RNA, 19 nt, Human
gcugggagagccuuccagg

SEQ ID NO: 3324920 - RNA, 18 nt, Human
gcugggagagccuuccag

SEQ ID NO: 3324921 - RNA, 17 nt, Human
gcugggagagccuucca

SEQ ID NO: 3324922 - RNA, 13 nt, Human
gcugggagagccu

SEQ ID NO: 3324923 - RNA, 12 nt, Human
gcugggagagcc

SEQ ID NO: 3324924 - RNA, 19 nt, Human
gcugggggccucagugcca

SEQ ID NO: 3324925 - RNA, 20 nt, Human
gcugggggccucagugccac

SEQ ID NO: 3324926 - RNA, 15 nt, Human
gcuggucccacucag

SEQ ID NO: 3324927 - RNA, 19 nt, Human
gcuggucccacucagucca

SEQ ID NO: 3324928 - RNA, 12 nt, Human
gcuggggccagu

SEQ ID NO: 3324929 - RNA, 23 nt, Human
gcugggggaagaagcucucuccu

SEQ ID NO: 3324930 - RNA, 18 nt, Human
gcugggcuucaguggcag

SEQ ID NO: 3324931 - RNA, 22 nt, Human
gcugguucaggguuggccccug

SEQ ID NO: 3324932 - RNA, 16 nt, Human
gcugucaauuacagga

SEQ ID NO: 3324933 - RNA, 15 nt, Human
gcugguucaggguug

SEQ ID NO: 3324934 - RNA, 21 nt, Human
gcugguuagagguucccuuug

SEQ ID NO: 3324935 - RNA, 16 nt, Human
gcuggugucaccugaa

SEQ ID NO: 3324936 - RNA, 18 nt, Human
gcuggugucaccugaaga

SEQ ID NO: 3324937 - RNA, 14 nt, Human
gcuggucccacuca

SEQ ID NO: 3324938 - RNA, 17 nt, Human
gcugucuccauguuuga

SEQ ID NO: 3324939 - RNA, 19 nt, Human
gcugucccuuacgugaguc

SEQ ID NO: 3324940 - RNA, 21 nt, Human
gcugucccuuacgugaguccu

SEQ ID NO: 3324941 - RNA, 23 nt, Human
gcugucaauuacaggaaguacug

SEQ ID NO: 3324942 - RNA, 22 nt, Human
gcugucaauuacaggaaguacu

SEQ ID NO: 3324943 - RNA, 19 nt, Human
gcugucaauuacaggaagu

SEQ ID NO: 3324944 - RNA, 17 nt, Human
gcugucaauuacaggaa

SEQ ID NO: 3324945 - RNA, 15 nt, Human
gcuuggaggaaggaa

SEQ ID NO: 3324946 - RNA, 14 nt, Human
gcuuggaggaagga

SEQ ID NO: 3324947 - RNA, 13 nt, Human
gcuuggaggaagg

SEQ ID NO: 3324948 - RNA, 22 nt, Human
gcuugaggguugggcugguguc

SEQ ID NO: 3324949 - RNA, 21 nt, Human
gcuuccagugaggcucugccc

SEQ ID NO: 3324950 - RNA, 20 nt, Human
gcuuccagugaggcucugcc

SEQ ID NO: 3324951 - RNA, 19 nt, Human
gcuuccagugaggcucugc

SEQ ID NO: 3324952 - RNA, 18 nt, Human
gcuuccagugaggcucug

SEQ ID NO: 3324953 - RNA, 14 nt, Human
gcuuuuacuuaaac

SEQ ID NO: 3324954 - RNA, 13 nt, Human
ggaaaaauagccu

SEQ ID NO: 3324955 - RNA, 14 nt, Human
ggaaaaacugauuu

SEQ ID NO: 3324956 - RNA, 15 nt, Human
ggaaaaauagccugc

SEQ ID NO: 3324957 - RNA, 19 nt, Human
ggaacagacuggaagcaca

SEQ ID NO: 3324958 - RNA, 20 nt, Human
ggaacagacuggaagcacag

SEQ ID NO: 3324959 - RNA, 17 nt, Human
ggaacagacuggaagca

SEQ ID NO: 3324960 - RNA, 15 nt, Human
ggaaaaucagccugc

SEQ ID NO: 3324961 - RNA, 14 nt, Human
ggaaaauaaauuau

SEQ ID NO: 3324962 - RNA, 13 nt, Human
ggaagagccuugc

SEQ ID NO: 3324963 - RNA, 17 nt, Human
ggaagcacagcuucauu

SEQ ID NO: 3324964 - RNA, 17 nt, Human
ggaagcacaugccucuc

SEQ ID NO: 3324965 - RNA, 15 nt, Human
ggaagcacaugccuc

SEQ ID NO: 3324966 - RNA, 14 nt, Human
ggaagcacaugccu

SEQ ID NO: 3324967 - RNA, 13 nt, Human
ggaagcacaugcc

SEQ ID NO: 3324968 - RNA, 14 nt, Human
ggaagccagcaggc

SEQ ID NO: 3324969 - RNA, 13 nt, Human
ggaagccagcagg

SEQ ID NO: 3324970 - RNA, 18 nt, Human
ggaagccagcaggcucuc

SEQ ID NO: 3324971 - RNA, 17 nt, Human
ggaagccagcaggcucu

SEQ ID NO: 3324972 - RNA, 16 nt, Human
ggaagccagcaggcuc

SEQ ID NO: 3324973 - RNA, 15 nt, Human
ggaagccagcaggcu

SEQ ID NO: 3324974 - RNA, 23 nt, Human
ggaagcacaugccucucucaggc

SEQ ID NO: 3324975 - RNA, 22 nt, Human
ggaagcacaugccucucucagg

SEQ ID NO: 3324976 - RNA, 21 nt, Human
ggaagcacaugccucucucag

SEQ ID NO: 3324977 - RNA, 23 nt, Human
gccccuggcagccccuguucugg

SEQ ID NO: 3324978 - RNA, 17 nt, Human
gccccuggcagccccug

SEQ ID NO: 3324979 - RNA, 18 nt, Human
gccccucagggucccugg

SEQ ID NO: 3324980 - RNA, 21 nt, Human
gccccucagggucccuggugg

SEQ ID NO: 3324981 - RNA, 19 nt, Human
gccccucagggucccuggu

SEQ ID NO: 3324982 - RNA, 22 nt, Human
gccccgaggccuucucugaagg

SEQ ID NO: 3324983 - RNA, 14 nt, Human
gccccgcccaggcu

SEQ ID NO: 3324984 - RNA, 15 nt, Human
gccccauucugccug

SEQ ID NO: 3324985 - RNA, 23 nt, Human
gccccgaggccuucucugaagga

SEQ ID NO: 3324986 - RNA, 22 nt, Human
gccccauucugccugcccaggc

SEQ ID NO: 3324987 - RNA, 23 nt, Human
gccccauucugccugcccaggcc

SEQ ID NO: 3324988 - RNA, 19 nt, Human
gccccuucugacccaugcu

SEQ ID NO: 3324989 - RNA, 12 nt, Human
gcccggcuccag

SEQ ID NO: 3324990 - RNA, 13 nt, Human
gcccggcuccagg

SEQ ID NO: 3324991 - RNA, 14 nt, Human
gcccggcuccaggc

SEQ ID NO: 3324992 - RNA, 12 nt, Human
gcccgggcucug

SEQ ID NO: 3324993 - RNA, 18 nt, Human
gcccgggcucugccuccc

SEQ ID NO: 3324994 - RNA, 15 nt, Human
gcccgggcucugccu

SEQ ID NO: 3324995 - RNA, 14 nt, Human
gcccgggcucugcc

SEQ ID NO: 3324996 - RNA, 13 nt, Human
gcccgggcucugc

SEQ ID NO: 3324997 - RNA, 20 nt, Human
gcccgggcucugccucccau

SEQ ID NO: 3324998 - RNA, 19 nt, Human
gcccgggcucugccuccca

SEQ ID NO: 3324999 - RNA, 22 nt, Human
gcccucugcccacucccugcaa

SEQ ID NO: 3325000 - RNA, 19 nt, Human
gcccucugcccacucccug

SEQ ID NO: 3325001 - RNA, 13 nt, Human
gcccaggccuccu

SEQ ID NO: 3325002 - RNA, 11 nt, Human
gcccaggcugg

SEQ ID NO: 3325003 - RNA, 18 nt, Human
gcccaggccuccuacagc

SEQ ID NO: 3325004 - RNA, 16 nt, Human
gcccaggaaaggcucc

SEQ ID NO: 3325005 - RNA, 15 nt, Human
gcccaggaaaggcuc

SEQ ID NO: 3325006 - RNA, 12 nt, Human
gcccaggaaagg

SEQ ID NO: 3325007 - RNA, 22 nt, Human
gcccagucuggaaugcaguggu

SEQ ID NO: 3325008 - RNA, 20 nt, Human
gcccagucuggaaugcagug

SEQ ID NO: 3325009 - RNA, 16 nt, Human
gcccaggcuggcgugc

SEQ ID NO: 3325010 - RNA, 14 nt, Human
gcccaggcuggcgu

SEQ ID NO: 3325011 - RNA, 15 nt, Human
gcccaggcuggcgug

SEQ ID NO: 3325012 - RNA, 23 nt, Human
gccccauccucuguacagagccc

SEQ ID NO: 3325013 - RNA, 17 nt, Human
gccccauucugccugcc

SEQ ID NO: 3325014 - RNA, 18 nt, Human
gccccauucugccugccc

SEQ ID NO: 3325015 - RNA, 20 nt, Human
gccccauucugccugcccag

SEQ ID NO: 3325016 - RNA, 21 nt, Human
gccccauucugccugcccagg

SEQ ID NO: 3325017 - RNA, 15 nt, Human
gccccagugcccaca

SEQ ID NO: 3325018 - RNA, 16 nt, Human
gccccagugcccacag

SEQ ID NO: 3325019 - RNA, 17 nt, Human
gccccagugcccacagg

SEQ ID NO: 3325020 - RNA, 17 nt, Human
gccauuucuuccacaag

SEQ ID NO: 3325021 - RNA, 22 nt, Human
gccauuucuuccacaagagccc

SEQ ID NO: 3325022 - RNA, 20 nt, Human
gccauuucuuccacaagagc

SEQ ID NO: 3325023 - RNA, 16 nt, Human
gcccaaagaugcagcc

SEQ ID NO: 3325024 - RNA, 15 nt, Human
gcccaaagaugcagc

SEQ ID NO: 3325025 - RNA, 15 nt, Human
gcccaccccucaaca

SEQ ID NO: 3325026 - RNA, 19 nt, Human
gcccacaggaucagucuga

SEQ ID NO: 3325027 - RNA, 13 nt, Human
gcccacaggauca

SEQ ID NO: 3325028 - RNA, 18 nt, Human
gcccacaggaucagucug

SEQ ID NO: 3325029 - RNA, 15 nt, Human
gccaggaagccagca

SEQ ID NO: 3325030 - RNA, 18 nt, Human
gccaggaagccagcaggc

SEQ ID NO: 3325031 - RNA, 17 nt, Human
gccaggaagccagcagg

SEQ ID NO: 3325032 - RNA, 19 nt, Human
gccaggaagccagcaggcu

SEQ ID NO: 3325033 - RNA, 17 nt, Human
gccaggggaaaaucagc

SEQ ID NO: 3325034 - RNA, 22 nt, Human
gccaggggaaaaucagccugcu

SEQ ID NO: 3325035 - RNA, 21 nt, Human
gccaggggaaaaucagccugc

SEQ ID NO: 3325036 - RNA, 23 nt, Human
gccaggggaaaaucagccugcuc

SEQ ID NO: 3325037 - RNA, 19 nt, Human
gccauccagguucagcuug

SEQ ID NO: 3325038 - RNA, 20 nt, Human
gccauccagguucagcuugu

SEQ ID NO: 3325039 - RNA, 16 nt, Human
gccaucccagccccaa

SEQ ID NO: 3325040 - RNA, 15 nt, Human
gccaucccagcccca

SEQ ID NO: 3325041 - RNA, 14 nt, Human
gccaucccagcccc

SEQ ID NO: 3325042 - RNA, 13 nt, Human
gccaucccagccc

SEQ ID NO: 3325043 - RNA, 14 nt, Human
gccauccagguuca

SEQ ID NO: 3325044 - RNA, 17 nt, Human
gccaucccagccccaau

SEQ ID NO: 3325045 - RNA, 16 nt, Human
gccacggccaggccag

SEQ ID NO: 3325046 - RNA, 20 nt, Human
gccacuauuguuagucucuu

SEQ ID NO: 3325047 - RNA, 21 nt, Human
gccacuauuguuagucucuug

SEQ ID NO: 3325048 - RNA, 12 nt, Human
gccaaaggaagc

SEQ ID NO: 3325049 - RNA, 14 nt, Human
gccacggccaggcc

SEQ ID NO: 3325050 - RNA, 15 nt, Human
gccacggccaggcca

SEQ ID NO: 3325051 - RNA, 17 nt, Human
gccacugcaccgggcca

SEQ ID NO: 3325052 - RNA, 18 nt, Human
gccacugcaccgggccac

SEQ ID NO: 3325053 - RNA, 15 nt, Human
gccagagacacaagc

SEQ ID NO: 3325054 - RNA, 12 nt, Human
gccagagacaca

SEQ ID NO: 3325055 - RNA, 17 nt, Human
gccagagggagugacag

SEQ ID NO: 3325056 - RNA, 18 nt, Human
gccagagggagugacaga

SEQ ID NO: 3325057 - RNA, 17 nt, Human
gccagauucuuuccuga

SEQ ID NO: 3325058 - RNA, 19 nt, Human
gccagagggagugacagag

SEQ ID NO: 3325059 - RNA, 20 nt, Human
gccagagggagugacagagg

SEQ ID NO: 3325060 - RNA, 16 nt, Human
gccagauucuuuccug

SEQ ID NO: 3325061 - RNA, 12 nt, Human
gccagccuugac

SEQ ID NO: 3325062 - RNA, 20 nt, Human
gccagccgagauagccaagg

SEQ ID NO: 3325063 - RNA, 22 nt, Human
gccagccuugaccauucuccac

SEQ ID NO: 3325064 - RNA, 21 nt, Human
gccagccuugaccauucucca

SEQ ID NO: 3325065 - RNA, 20 nt, Human
gccagccuugaccauucucc

SEQ ID NO: 3325066 - RNA, 14 nt, Human
gccagccuugacca

SEQ ID NO: 3325067 - RNA, 15 nt, Human
gccagcugcuugggc

SEQ ID NO: 3325068 - RNA, 14 nt, Human
gccagcugcuuggg

SEQ ID NO: 3325069 - RNA, 13 nt, Human
gccuuuggcuuca

SEQ ID NO: 3325070 - RNA, 21 nt, Human
gccuuccaggggugggacacc

SEQ ID NO: 3325071 - RNA, 16 nt, Human
gccugguggcagcugc

SEQ ID NO: 3325072 - RNA, 17 nt, Human
gccugguggcagcugcg

SEQ ID NO: 3325073 - RNA, 14 nt, Human
gccugguggcagcu

SEQ ID NO: 3325074 - RNA, 15 nt, Human
gccugguggcagcug

SEQ ID NO: 3325075 - RNA, 20 nt, Human
gccuuauggaacacucugag

SEQ ID NO: 3325076 - RNA, 23 nt, Human
gccuuauggaacacucugagacu

SEQ ID NO: 3325077 - RNA, 22 nt, Human
gccuuauggaacacucugagac

SEQ ID NO: 3325078 - RNA, 21 nt, Human
gccuuauggaacacucugaga

SEQ ID NO: 3325079 - RNA, 20 nt, Human
gccuuagaagucacacagua

SEQ ID NO: 3325080 - RNA, 19 nt, Human
gccuuacccucauguucuu

SEQ ID NO: 3325081 - RNA, 14 nt, Human
gcgcugccccuggc

SEQ ID NO: 3325082 - RNA, 20 nt, Human
gcgccuacaggagugagcac

SEQ ID NO: 3325083 - RNA, 21 nt, Human
gcgccuacaggagugagcacu

SEQ ID NO: 3325084 - RNA, 18 nt, Human
gcgccuacaggagugagc

SEQ ID NO: 3325085 - RNA, 18 nt, Human
gcggggacagcuccuucu

SEQ ID NO: 3325086 - RNA, 19 nt, Human
gcggggacagcuccuucug

SEQ ID NO: 3325087 - RNA, 23 nt, Human
gcggacagccacggccaggccag

SEQ ID NO: 3325088 - RNA, 16 nt, Human
gcggacagccacggcc

SEQ ID NO: 3325089 - RNA, 19 nt, Human
gcggacagccacggccagg

SEQ ID NO: 3325090 - RNA, 23 nt, Human
gcggggacagcuccuucuguccu

SEQ ID NO: 3325091 - RNA, 20 nt, Human
gcgguccacccaggagcccc

SEQ ID NO: 3325092 - RNA, 23 nt, Human
gcgguccacccaggagccccgag

SEQ ID NO: 3325093 - RNA, 22 nt, Human
gcuagacgagcaggcuucuucc

SEQ ID NO: 3325094 - RNA, 21 nt, Human
gcuagacgagcaggcuucuuc

SEQ ID NO: 3325095 - RNA, 14 nt, Human
gcuaacauggaagu

SEQ ID NO: 3325096 - RNA, 18 nt, Human
gcuaacauggaaguacua

SEQ ID NO: 3325097 - RNA, 17 nt, Human
gcuaacauggaaguacu

SEQ ID NO: 3325098 - RNA, 15 nt, Human
gcgugagccacugca

SEQ ID NO: 3325099 - RNA, 14 nt, Human
gcgugagccacugc

SEQ ID NO: 3325100 - RNA, 22 nt, Human
gcuacacaggggaaaagaggag

SEQ ID NO: 3325101 - RNA, 16 nt, Human
gccgagauagccaagg

SEQ ID NO: 3325102 - RNA, 23 nt, Human
gcccuucucuccagccccuggau

SEQ ID NO: 3325103 - RNA, 13 nt, Human
gcccuucucucca

SEQ ID NO: 3325104 - RNA, 13 nt, Human
gccgcagcccugc

SEQ ID NO: 3325105 - RNA, 17 nt, Human
gccgagauagccaaggc

SEQ ID NO: 3325106 - RNA, 15 nt, Human
gccgcagcccugcag

SEQ ID NO: 3325107 - RNA, 17 nt, Human
gccgcagcccugcagag

SEQ ID NO: 3325108 - RNA, 16 nt, Human
gccgcagcccugcaga

SEQ ID NO: 3325109 - RNA, 23 nt, Human
gccgucuaccugaggggccucuu

SEQ ID NO: 3325110 - RNA, 22 nt, Human
gccgucuaccugaggggccucu

SEQ ID NO: 3325111 - RNA, 20 nt, Human
gccgucuaccugaggggccu

SEQ ID NO: 3325112 - RNA, 18 nt, Human
gccgucuaccugaggggc

SEQ ID NO: 3325113 - RNA, 22 nt, Human
gccucaagugauucuccugccu

SEQ ID NO: 3325114 - RNA, 24 nt, Human
gccucaagugauucuccugccuca

SEQ ID NO: 3325115 - RNA, 18 nt, Human
gccucagcauccuggcac

SEQ ID NO: 3325116 - RNA, 17 nt, Human
gccucagcauccuggca

SEQ ID NO: 3325117 - RNA, 21 nt, Human
gccucagcauccuggcacccg

SEQ ID NO: 3325118 - RNA, 17 nt, Human
gccucccaucacccgcu

SEQ ID NO: 3325119 - RNA, 12 nt, Human
gccucagccucc

SEQ ID NO: 3325120 - RNA, 14 nt, Human
gccucagccuccca

SEQ ID NO: 3325121 - RNA, 20 nt, Human
gccucccgaguagcugggac

SEQ ID NO: 3325122 - RNA, 20 nt, Human
gccucccgaauagcugggac

SEQ ID NO: 3325123 - RNA, 21 nt, Human
gccucccgaguagcugggacu

SEQ ID NO: 3325124 - RNA, 23 nt, Human
gccucccgaguagcugggacuac

SEQ ID NO: 3325125 - RNA, 18 nt, Human
gccucccgaauagcuggg

SEQ ID NO: 3325126 - RNA, 19 nt, Human
gccucccgaauagcuggga

SEQ ID NO: 3325127 - RNA, 15 nt, Human
gccucucccaucacu

SEQ ID NO: 3325128 - RNA, 15 nt, Human
gccucugacacacag

SEQ ID NO: 3325129 - RNA, 16 nt, Human
gccucugcacuccccu

SEQ ID NO: 3325130 - RNA, 20 nt, Human
gccucugcacuccccugcug

SEQ ID NO: 3325131 - RNA, 19 nt, Human
gccucugcacuccccugcu

SEQ ID NO: 3325132 - RNA, 18 nt, Human
gccucugcacuccccugc

SEQ ID NO: 3325133 - RNA, 17 nt, Human
gccucugcacuccccug

SEQ ID NO: 3325134 - RNA, 15 nt, Human
gccucugcacucccc

SEQ ID NO: 3325135 - RNA, 21 nt, Human
gccucugcacuccccugcugg

SEQ ID NO: 3325136 - RNA, 11 nt, Human
gccugcccagg

SEQ ID NO: 3325137 - RNA, 14 nt, Human
gccuggacccugug

SEQ ID NO: 3325138 - RNA, 12 nt, Human
gcagaaggaaga

SEQ ID NO: 3325139 - RNA, 14 nt, Human
gcagaaggaagacu

SEQ ID NO: 3325140 - RNA, 13 nt, Human
gcagaaggaagac

SEQ ID NO: 3325141 - RNA, 14 nt, Human
gcacugggcuuggg

SEQ ID NO: 3325142 - RNA, 23 nt, Human
gcacugggcuuggggaccagagc

SEQ ID NO: 3325143 - RNA, 22 nt, Human
gcacugggcuuggggaccagag

SEQ ID NO: 3325144 - RNA, 17 nt, Human
gcacuaaggugugcucu

SEQ ID NO: 3325145 - RNA, 18 nt, Human
gcacuaaggugugcucug

SEQ ID NO: 3325146 - RNA, 19 nt, Human
gcacagcuaacauggaagu

SEQ ID NO: 3325147 - RNA, 14 nt, Human
gcaaugaccuuuca

SEQ ID NO: 3325148 - RNA, 13 nt, Human
gcaaugaccuuuc

SEQ ID NO: 3325149 - RNA, 16 nt, Human
gcacagcuucauuucc

SEQ ID NO: 3325150 - RNA, 22 nt, Human
gcacaugccucucucaggccaa

SEQ ID NO: 3325151 - RNA, 14 nt, Human
gcacccggccccug

SEQ ID NO: 3325152 - RNA, 15 nt, Human
gcacccggccccugc

SEQ ID NO: 3325153 - RNA, 17 nt, Human
gcacccggccccugcug

SEQ ID NO: 3325154 - RNA, 14 nt, Human
gcaccuccugccuc

SEQ ID NO: 3325155 - RNA, 15 nt, Human
gcaccuccugccucg

SEQ ID NO: 3325156 - RNA, 19 nt, Human
gcaccacugcacuccagcc

SEQ ID NO: 3325157 - RNA, 20 nt, Human
gcagcagggagggcuucugc

SEQ ID NO: 3325158 - RNA, 19 nt, Human
gcagccucaaccuccuggg

SEQ ID NO: 3325159 - RNA, 20 nt, Human
gcagccucaaccuccugggc

SEQ ID NO: 3325160 - RNA, 21 nt, Human
gcagccucaaccuccugggcu

SEQ ID NO: 3325161 - RNA, 22 nt, Human
gcagccucaaccuccugggcua

SEQ ID NO: 3325162 - RNA, 14 nt, Human
gcagccuggacccu

SEQ ID NO: 3325163 - RNA, 17 nt, Human
gcagaguugaagacaga

SEQ ID NO: 3325164 - RNA, 16 nt, Human
gcagaguugaagacag

SEQ ID NO: 3325165 - RNA, 19 nt, Human
gcagaguugaagacagagc

SEQ ID NO: 3325166 - RNA, 19 nt, Human
gcagagaaugaaagggccc

SEQ ID NO: 3325167 - RNA, 20 nt, Human
gcagagaaugaaagggccca

SEQ ID NO: 3325168 - RNA, 21 nt, Human
gcagagaaugaaagggcccag

SEQ ID NO: 3325169 - RNA, 21 nt, Human
gcagagaauucucuuauccaa

SEQ ID NO: 3325170 - RNA, 22 nt, Human
gcagagaaugaaagggcccaga

SEQ ID NO: 3325171 - RNA, 23 nt, Human
gcagagaaugaaagggcccagag

SEQ ID NO: 3325172 - RNA, 15 nt, Human
gcagagaccaucccu

SEQ ID NO: 3325173 - RNA, 14 nt, Human
gcagagaccauccc

SEQ ID NO: 3325174 - RNA, 17 nt, Human
gcagagaccaucccuga

SEQ ID NO: 3325175 - RNA, 15 nt, Human
gcagaguugaagaca

SEQ ID NO: 3325176 - RNA, 17 nt, Human
gcagugggagcugccug

SEQ ID NO: 3325177 - RNA, 18 nt, Human
gcagugggagcugccugu

SEQ ID NO: 3325178 - RNA, 21 nt, Human
gcaucaagaugugacauguuu

SEQ ID NO: 3325179 - RNA, 20 nt, Human
gcauauucaggaagcucagg

SEQ ID NO: 3325180 - RNA, 18 nt, Human
gcauauucaggaagcuca

SEQ ID NO: 3325181 - RNA, 17 nt, Human
gcauauucaggaagcuc

SEQ ID NO: 3325182 - RNA, 15 nt, Human
gcauauucaggaagc

SEQ ID NO: 3325183 - RNA, 20 nt, Human
gcaggauucuuccucccucc

SEQ ID NO: 3325184 - RNA, 16 nt, Human
gcagggagggcuucug

SEQ ID NO: 3325185 - RNA, 12 nt, Human
gcagggcucagc

SEQ ID NO: 3325186 - RNA, 23 nt, Human
gcagugcuuccaaggauggacca

SEQ ID NO: 3325187 - RNA, 16 nt, Human
gcagugggagcugccu

SEQ ID NO: 3325188 - RNA, 15 nt, Human
gcagugggagcugcc

SEQ ID NO: 3325189 - RNA, 19 nt, Human
gccaaacucaccugccccu

SEQ ID NO: 3325190 - RNA, 21 nt, Human
gccaaacucaccugccccuca

SEQ ID NO: 3325191 - RNA, 14 nt, Human
gccaaaggaagcac

SEQ ID NO: 3325192 - RNA, 20 nt, Human
gccaaaggaagcacaugccu

SEQ ID NO: 3325193 - RNA, 16 nt, Human
gccaaaggaagcacau

SEQ ID NO: 3325194 - RNA, 22 nt, Human
gcauuuugcuaaaugugaauga

SEQ ID NO: 3325195 - RNA, 12 nt, Human
gcauuccccacu

SEQ ID NO: 3325196 - RNA, 23 nt, Human
gcauuugcugaauacagaggcaa

SEQ ID NO: 3325197 - RNA, 17 nt, Human
gcauuugcugaauacag

SEQ ID NO: 3325198 - RNA, 21 nt, Human
gcauuuggugguuucagaaau

SEQ ID NO: 3325199 - RNA, 22 nt, Human
gcauguucucugaggacacuaa

SEQ ID NO: 3325200 - RNA, 17 nt, Human
gcauguuugugauugac

SEQ ID NO: 3325201 - RNA, 15 nt, Human
gcaugccuggauggg

SEQ ID NO: 3325202 - RNA, 15 nt, Human
gcaugcugucccuua

SEQ ID NO: 3325203 - RNA, 22 nt, Human
gcaugccuggauggggcugcac

SEQ ID NO: 3325204 - RNA, 17 nt, Human
gcaugccuggauggggc

SEQ ID NO: 3325205 - RNA, 15 nt, Human
gcaucaggccaggcc

SEQ ID NO: 3325206 - RNA, 13 nt, Human
gcaucaggccagg

SEQ ID NO: 3325207 - RNA, 17 nt, Human
gcaucaggccaggcccu

SEQ ID NO: 3325208 - RNA, 16 nt, Human
gcaucaggccaggccc

SEQ ID NO: 3325209 - RNA, 23 nt, Human
gcaugaaguaauaugcacacauu

SEQ ID NO: 3325210 - RNA, 18 nt, Human
gauguucuagcauggcug

SEQ ID NO: 3325211 - RNA, 15 nt, Human
gauucccaagcucug

SEQ ID NO: 3325212 - RNA, 17 nt, Human
gauucagacagcugccu

SEQ ID NO: 3325213 - RNA, 14 nt, Human
gauucagacagcug

SEQ ID NO: 3325214 - RNA, 13 nt, Human
gauucagacagcu

SEQ ID NO: 3325215 - RNA, 13 nt, Human
gauuacaagcgug

SEQ ID NO: 3325216 - RNA, 15 nt, Human
gauugcaacaggcug

SEQ ID NO: 3325217 - RNA, 17 nt, Human
gauugcaacaggcuggg

SEQ ID NO: 3325218 - RNA, 16 nt, Human
gauugcaacaggcugg

SEQ ID NO: 3325219 - RNA, 22 nt, Human
gauucuuuccugaggcugggcu

SEQ ID NO: 3325220 - RNA, 20 nt, Human
gauucuuuccugaggcuggg

SEQ ID NO: 3325221 - RNA, 16 nt, Human
gauucccaagcucugc

SEQ ID NO: 3325222 - RNA, 17 nt, Human
gauucccaagcucugcu

SEQ ID NO: 3325223 - RNA, 19 nt, Human
gauucuuuccugaggcugg

SEQ ID NO: 3325224 - RNA, 19 nt, Human
gauuuguuaaugauagcua

SEQ ID NO: 3325225 - RNA, 21 nt, Human
gauuucuguuuagauaauaca

SEQ ID NO: 3325226 - RNA, 22 nt, Human
gauuucuguuuagauaauacac

SEQ ID NO: 3325227 - RNA, 18 nt, Human
gcaagcaccuccugccuc

SEQ ID NO: 3325228 - RNA, 20 nt, Human
gcaagcaccuccugccucga

SEQ ID NO: 3325229 - RNA, 15 nt, Human
gcaagcaccuccugc

SEQ ID NO: 3325230 - RNA, 16 nt, Human
gcaagcaccuccugcc

SEQ ID NO: 3325231 - RNA, 17 nt, Human
gcaauccugcaagaaca

SEQ ID NO: 3325232 - RNA, 13 nt, Human
gcaaggcugucaa

SEQ ID NO: 3325233 - RNA, 14 nt, Human
gcaaggucauuuuu

SEQ ID NO: 3325234 - RNA, 18 nt, Human
gcaaggcugucaauuaca

SEQ ID NO: 3325235 - RNA, 14 nt, Human
gcaaggcugucaau

SEQ ID NO: 3325236 - RNA, 18 nt, Human
gcaacugcauuggcuuug

SEQ ID NO: 3325237 - RNA, 16 nt, Human
gcaaaccaucauugaa

SEQ ID NO: 3325238 - RNA, 21 nt, Human
gcaaaccaucauugaaaucuu

SEQ ID NO: 3325239 - RNA, 20 nt, Human
gcaaaccaucauugaaaucu

SEQ ID NO: 3325240 - RNA, 19 nt, Human
gcaaaccaucauugaaauc

SEQ ID NO: 3325241 - RNA, 17 nt, Human
gcaaaccaucauugaaa

SEQ ID NO: 3325242 - RNA, 15 nt, Human
gcaaaccaucauuga

SEQ ID NO: 3325243 - RNA, 12 nt, Human
gauaauacacca

SEQ ID NO: 3325244 - RNA, 24 nt, Human
gauaauacaccacuacauucuguu

SEQ ID NO: 3325245 - RNA, 23 nt, Human
gauaauacaccacuacauucugu

SEQ ID NO: 3325246 - RNA, 23 nt, Human
gaucacggcucacugcagccuca

SEQ ID NO: 3325247 - RNA, 20 nt, Human
gaucacggcucacugcagcc

SEQ ID NO: 3325248 - RNA, 14 nt, Human
gaucacagccucug

SEQ ID NO: 3325249 - RNA, 20 nt, Human
gauagugucccacggugccu

SEQ ID NO: 3325250 - RNA, 18 nt, Human
gauauaugcucugcaugu

SEQ ID NO: 3325251 - RNA, 16 nt, Human
gauacaaaagcaugug

SEQ ID NO: 3325252 - RNA, 12 nt, Human
gauccugagcca

SEQ ID NO: 3325253 - RNA, 20 nt, Human
gaucuaggaagacuuuggaa

SEQ ID NO: 3325254 - RNA, 20 nt, Human
gaucuggguucacugcaacc

SEQ ID NO: 3325255 - RNA, 18 nt, Human
gaucuaggaagacuuugg

SEQ ID NO: 3325256 - RNA, 14 nt, Human
gaucuaggaagacu

SEQ ID NO: 3325257 - RNA, 13 nt, Human
gaucuaggaagac

SEQ ID NO: 3325258 - RNA, 13 nt, Human
gaucauccacugu

SEQ ID NO: 3325259 - RNA, 12 nt, Human
gauccuccaggu

SEQ ID NO: 3325260 - RNA, 16 nt, Human
gauccucccaccucag

SEQ ID NO: 3325261 - RNA, 14 nt, Human
gauccuccaggugc

SEQ ID NO: 3325262 - RNA, 21 nt, Human
gauccucccaccucagccucc

SEQ ID NO: 3325263 - RNA, 17 nt, Human
gauccucccaccucagc

SEQ ID NO: 3325264 - RNA, 19 nt, Human
gaugcagccucacaguccu

SEQ ID NO: 3325265 - RNA, 14 nt, Human
gaugccugguggca

SEQ ID NO: 3325266 - RNA, 14 nt, Human
gaugcagugcuucc

SEQ ID NO: 3325267 - RNA, 15 nt, Human
gaugccugguggcag

SEQ ID NO: 3325268 - RNA, 16 nt, Human
gaugccugguggcagc

SEQ ID NO: 3325269 - RNA, 18 nt, Human
gaugaccuugaaugaugc

SEQ ID NO: 3325270 - RNA, 23 nt, Human
gaugagaaauaaaguuucuguug

SEQ ID NO: 3325271 - RNA, 14 nt, Human
gaugcaccagcccu

SEQ ID NO: 3325272 - RNA, 14 nt, Human
gaugagaggaaauc

SEQ ID NO: 3325273 - RNA, 15 nt, Human
gaugcaccagcccuu

SEQ ID NO: 3325274 - RNA, 23 nt, Human
gaugcaccagcccuuagcaggga

SEQ ID NO: 3325275 - RNA, 22 nt, Human
gaucuucuguggguuucuaaag

SEQ ID NO: 3325276 - RNA, 19 nt, Human
gaucuucuuuauaauucua

SEQ ID NO: 3325277 - RNA, 15 nt, Human
gaugaaaugagguca

SEQ ID NO: 3325278 - RNA, 21 nt, Human
gaugaaaugaggucagagccu

SEQ ID NO: 3325279 - RNA, 22 nt, Human
gaccagacaccuugacagggca

SEQ ID NO: 3325280 - RNA, 21 nt, Human
gaccagacaccuugacagggc

SEQ ID NO: 3325281 - RNA, 16 nt, Human
gaccacguuucuaaag

SEQ ID NO: 3325282 - RNA, 21 nt, Human
gaccagagcugccaccugccu

SEQ ID NO: 3325283 - RNA, 23 nt, Human
gaccagacaccuugacagggcac

SEQ ID NO: 3325284 - RNA, 19 nt, Human
gaccagagcugccaccugc

SEQ ID NO: 3325285 - RNA, 21 nt, Human
gaccagcaccaucucuccucc

SEQ ID NO: 3325286 - RNA, 20 nt, Human
gaccagcaccaucucuccuc

SEQ ID NO: 3325287 - RNA, 18 nt, Human
gaccacaaaacuuuucua

SEQ ID NO: 3325288 - RNA, 12 nt, Human
gacccacugcuu

SEQ ID NO: 3325289 - RNA, 18 nt, Human
gacccaugcugcccugug

SEQ ID NO: 3325290 - RNA, 20 nt, Human
gacccaugcugcccugugag

SEQ ID NO: 3325291 - RNA, 19 nt, Human
gacccaugcugcccuguga

SEQ ID NO: 3325292 - RNA, 17 nt, Human
gacccaugcugcccugu

SEQ ID NO: 3325293 - RNA, 22 nt, Human
gacccugcccugugggccccca

SEQ ID NO: 3325294 - RNA, 20 nt, Human
gacccugcccugugggcccc

SEQ ID NO: 3325295 - RNA, 17 nt, Human
gacccugcccugugggc

SEQ ID NO: 3325296 - RNA, 16 nt, Human
gacccugaggcccaga

SEQ ID NO: 3325297 - RNA, 12 nt, Human
gacccugaggcc

SEQ ID NO: 3325298 - RNA, 11 nt, Human
gacccugaggc

SEQ ID NO: 3325299 - RNA, 10 nt, Human
gacccugagg

SEQ ID NO: 3325300 - RNA, 16 nt, Human
gacaucaacugcauca

SEQ ID NO: 3325301 - RNA, 23 nt, Human
gacaucaacugcaucaagaugug

SEQ ID NO: 3325302 - RNA, 22 nt, Human
gacaguuaagagaaaugagcuu

SEQ ID NO: 3325303 - RNA, 24 nt, Human
gacagggcacaccgggcacucaga

SEQ ID NO: 3325304 - RNA, 22 nt, Human
gacaggcauguucucugaggac

SEQ ID NO: 3325305 - RNA, 13 nt, Human
gacaggcaagcac

SEQ ID NO: 3325306 - RNA, 17 nt, Human
gacaggcaagcaccucc

SEQ ID NO: 3325307 - RNA, 18 nt, Human
gacaggcaagcaccuccu

SEQ ID NO: 3325308 - RNA, 23 nt, Human
gacaggcaaugcuggcuguuggc

SEQ ID NO: 3325309 - RNA, 20 nt, Human
gacaggcauguucucugagg

SEQ ID NO: 3325310 - RNA, 21 nt, Human
gacaggcauguucucugagga

SEQ ID NO: 3325311 - RNA, 20 nt, Human
gacaggcaagcaccuccugc

SEQ ID NO: 3325312 - RNA, 18 nt, Human
gacaggcaaugcuggcug

SEQ ID NO: 3325313 - RNA, 19 nt, Human
gacaggcaaugcuggcugu

SEQ ID NO: 3325314 - RNA, 17 nt, Human
gacagacacaggcccgg

SEQ ID NO: 3325315 - RNA, 16 nt, Human
gacacuagaagauuuu

SEQ ID NO: 3325316 - RNA, 20 nt, Human
gacagacacaggcccggcuc

SEQ ID NO: 3325317 - RNA, 22 nt, Human
gacagacacaggcccggcucca

SEQ ID NO: 3325318 - RNA, 21 nt, Human
gacacuaaccacgcuggaccu

SEQ ID NO: 3325319 - RNA, 22 nt, Human
gacacgaauauugcugauggug

SEQ ID NO: 3325320 - RNA, 18 nt, Human
gaauuucccaaagcagug

SEQ ID NO: 3325321 - RNA, 16 nt, Human
gaauuucccaaagcag

SEQ ID NO: 3325322 - RNA, 22 nt, Human
gaauuucccaaagcagugcaug

SEQ ID NO: 3325323 - RNA, 14 nt, Human
gacagagucucacu

SEQ ID NO: 3325324 - RNA, 23 nt, Human
gacagaggcagccccauucugcc

SEQ ID NO: 3325325 - RNA, 21 nt, Human
gacagagucucacuguugccc

SEQ ID NO: 3325326 - RNA, 16 nt, Human
gacagagugagacucu

SEQ ID NO: 3325327 - RNA, 20 nt, Human
gacagagcuacacaggggaa

SEQ ID NO: 3325328 - RNA, 12 nt, Human
gacuacaggcac

SEQ ID NO: 3325329 - RNA, 18 nt, Human
gacuacaggcacccacca

SEQ ID NO: 3325330 - RNA, 13 nt, Human
gacuacaggcacc

SEQ ID NO: 3325331 - RNA, 15 nt, Human
gacuacaggcaccca

SEQ ID NO: 3325332 - RNA, 20 nt, Human
gacuccugcaggcagccagg

SEQ ID NO: 3325333 - RNA, 19 nt, Human
gacuccugcaggcagccag

SEQ ID NO: 3325334 - RNA, 18 nt, Human
gacuccugcaggcagcca

SEQ ID NO: 3325335 - RNA, 15 nt, Human
gacucuacagaggcc

SEQ ID NO: 3325336 - RNA, 21 nt, Human
gacucuacagaggccaugggc

SEQ ID NO: 3325337 - RNA, 16 nt, Human
gacugaauuucuuuug

SEQ ID NO: 3325338 - RNA, 23 nt, Human
gacuggccaagguuuggggaaga

SEQ ID NO: 3325339 - RNA, 23 nt, Human
gacuuacuguacaugaaaacaca

SEQ ID NO: 3325340 - RNA, 18 nt, Human
gacuuacuguacaugaaa

SEQ ID NO: 3325341 - RNA, 12 nt, Human
gacuuacuguac

SEQ ID NO: 3325342 - RNA, 16 nt, Human
gacuuacuguacauga

SEQ ID NO: 3325343 - RNA, 15 nt, Human
gacuuacuguacaug

SEQ ID NO: 3325344 - RNA, 20 nt, Human
gacuucaucccucuggggcu

SEQ ID NO: 3325345 - RNA, 12 nt, Human
gacuucaucccu

SEQ ID NO: 3325346 - RNA, 23 nt, Human
gacggagucccaccuuggcugca

SEQ ID NO: 3325347 - RNA, 13 nt, Human
gacggagucccac

SEQ ID NO: 3325348 - RNA, 21 nt, Human
gacgcugugcugcccugccca

SEQ ID NO: 3325349 - RNA, 22 nt, Human
gacgcugugcugcccugcccac

SEQ ID NO: 3325350 - RNA, 19 nt, Human
gaccuuucaauaggaaaaa

SEQ ID NO: 3325351 - RNA, 11 nt, Human
gaccuuucaau

SEQ ID NO: 3325352 - RNA, 22 nt, Human
gaccuuuaagagaaaugagcug

SEQ ID NO: 3325353 - RNA, 14 nt, Human
gacguguuaugacu

SEQ ID NO: 3325354 - RNA, 11 nt, Human
gacguguuaug

SEQ ID NO: 3325355 - RNA, 23 nt, Human
gacuaacuugucuuuggacccug

SEQ ID NO: 3325356 - RNA, 16 nt, Human
gacuaacuugucuuug

SEQ ID NO: 3325357 - RNA, 19 nt, Human
gacccuugccgucuaccug

SEQ ID NO: 3325358 - RNA, 23 nt, Human
gacccuugccgucuaccugaggg

SEQ ID NO: 3325359 - RNA, 20 nt, Human
gacccuugccgucuaccuga

SEQ ID NO: 3325360 - RNA, 14 nt, Human
gaccuucuccuuca

SEQ ID NO: 3325361 - RNA, 16 nt, Human
gaccuucuccuucacc

SEQ ID NO: 3325362 - RNA, 15 nt, Human
gaccuucuccuucac

SEQ ID NO: 3325363 - RNA, 14 nt, Human
gaccuugaacuggg

SEQ ID NO: 3325364 - RNA, 21 nt, Human
gaccuucuccuucaccuuugu

SEQ ID NO: 3325365 - RNA, 20 nt, Human
gaccuucuccuucaccuuug

SEQ ID NO: 3325366 - RNA, 15 nt, Human
gaacacucugagacu

SEQ ID NO: 3325367 - RNA, 14 nt, Human
gaacacucugagac

SEQ ID NO: 3325368 - RNA, 13 nt, Human
gaacacucugaga

SEQ ID NO: 3325369 - RNA, 18 nt, Human
gaaccuuuugagugccuu

SEQ ID NO: 3325370 - RNA, 21 nt, Human
gaaccuuuugagugccuuaca

SEQ ID NO: 3325371 - RNA, 19 nt, Human
gaaccuuuugagugccuua

SEQ ID NO: 3325372 - RNA, 22 nt, Human
gaaccuuuugagugccuuacac

SEQ ID NO: 3325373 - RNA, 20 nt, Human
gaagauaauauuaaggaaga

SEQ ID NO: 3325374 - RNA, 17 nt, Human
gaagcauuuacuuugug

SEQ ID NO: 3325375 - RNA, 23 nt, Human
gaagcccaggaaaggcuccagga

SEQ ID NO: 3325376 - RNA, 23 nt, Human
gaagcccuucuaccuuccugcaa

SEQ ID NO: 3325377 - RNA, 16 nt, Human
gaagcccaggaaaggc

SEQ ID NO: 3325378 - RNA, 15 nt, Human
gaagcccaggaaagg

SEQ ID NO: 3325379 - RNA, 13 nt, Human
gaagcccaggaaa

SEQ ID NO: 3325380 - RNA, 22 nt, Human
gaagccagcaggcucucaggcc

SEQ ID NO: 3325381 - RNA, 21 nt, Human
gaagccagcaggcucucaggc

SEQ ID NO: 3325382 - RNA, 19 nt, Human
gaagccagcaggcucucag

SEQ ID NO: 3325383 - RNA, 20 nt, Human
gaagccagcaggcucucagg

SEQ ID NO: 3325384 - RNA, 19 nt, Human
gaagagaaugcacaaacag

SEQ ID NO: 3325385 - RNA, 17 nt, Human
gaagacuuuggaaagag

SEQ ID NO: 3325386 - RNA, 14 nt, Human
gaagacuuuggaaa

SEQ ID NO: 3325387 - RNA, 20 nt, Human
gaagacuuuucuuucagcca

SEQ ID NO: 3325388 - RNA, 19 nt, Human
gaagacuucaucccucugg

SEQ ID NO: 3325389 - RNA, 13 nt, Human
gaagacuuuggaa

SEQ ID NO: 3325390 - RNA, 11 nt, Human
gaagacuuugg

SEQ ID NO: 3325391 - RNA, 23 nt, Human
gaacuuugaccucugcagcaaua

SEQ ID NO: 3325392 - RNA, 20 nt, Human
gaaguuucugccgcagcccu

SEQ ID NO: 3325393 - RNA, 15 nt, Human
gaagucuuagaugua

SEQ ID NO: 3325394 - RNA, 21 nt, Human
gaaguuucugccgcagcccug

SEQ ID NO: 3325395 - RNA, 15 nt, Human
gaagggggcugggac

SEQ ID NO: 3325396 - RNA, 14 nt, Human
gaagcggcuggcag

SEQ ID NO: 3325397 - RNA, 19 nt, Human
gaagggggcugggacaugg

SEQ ID NO: 3325398 - RNA, 16 nt, Human
gaagggggcugggaca

SEQ ID NO: 3325399 - RNA, 18 nt, Human
gaaguacuauaauuuacc

SEQ ID NO: 3325400 - RNA, 15 nt, Human
gaaguacuggagaaa

SEQ ID NO: 3325401 - RNA, 21 nt, Human
gaaguaauaugcacacauuuu

SEQ ID NO: 3325402 - RNA, 22 nt, Human
gaaguaauaugcacacauuuuu

SEQ ID NO: 3325403 - RNA, 13 nt, Human
gaauaccuguccc

SEQ ID NO: 3325404 - RNA, 15 nt, Human
gaauaccuguccccc

SEQ ID NO: 3325405 - RNA, 23 nt, Human
gaauagcugggacuacaggugug

SEQ ID NO: 3325406 - RNA, 22 nt, Human
gaauagcugggacuacaggugu

SEQ ID NO: 3325407 - RNA, 20 nt, Human
gaaguuugagaucagccugg

SEQ ID NO: 3325408 - RNA, 14 nt, Human
gaauaacauguaau

SEQ ID NO: 3325409 - RNA, 18 nt, Human
gaauaacauguaauuaag

SEQ ID NO: 3325410 - RNA, 19 nt, Human
gaauaacauguaauuaagu

SEQ ID NO: 3325411 - RNA, 21 nt, Human
gaauacagaggcaacugcauu

SEQ ID NO: 3325412 - RNA, 17 nt, Human
gaauaauacaguaucuc

SEQ ID NO: 3325413 - RNA, 19 nt, Human
gaauucucuaguuugauua

SEQ ID NO: 3325414 - RNA, 14 nt, Human
gaauugaaaaacca

SEQ ID NO: 3325415 - RNA, 21 nt, Human
gaaugucagugugacugaucu

SEQ ID NO: 3325416 - RNA, 20 nt, Human
gaaugucagugugacugauc

SEQ ID NO: 3325417 - RNA, 17 nt, Human
gaauucucagaaucuca

SEQ ID NO: 3325418 - RNA, 17 nt, Human
gaauucucuaguuugau

SEQ ID NO: 3325419 - RNA, 15 nt, Human
gaauuucccaaagca

SEQ ID NO: 3325420 - RNA, 22 nt, Human
gaauuguaaggaaugauuaauu

SEQ ID NO: 3325421 - RNA, 15 nt, Human
gaauuguaaggaaug

SEQ ID NO: 3325422 - RNA, 11 nt, Human
gaaugcagugg

SEQ ID NO: 3325423 - RNA, 22 nt, Human
gaaugaaccacaucuugcucug

SEQ ID NO: 3325424 - RNA, 18 nt, Human
gaaugaaccacaucuugc

SEQ ID NO: 3325425 - RNA, 23 nt, Human
gaaugaaccacaucuugcucugc

SEQ ID NO: 3325426 - RNA, 14 nt, Human
gaaugucaguguga

SEQ ID NO: 3325427 - RNA, 13 nt, Human
gaaugucagugug

SEQ ID NO: 3325428 - RNA, 22 nt, Human
gaaugguuuucaaaauaaaaau

SEQ ID NO: 3325429 - RNA, 14 nt, Human
cuugcaugaggcua

SEQ ID NO: 3325430 - RNA, 13 nt, Human
cuugcaugaggcu

SEQ ID NO: 3325431 - RNA, 20 nt, Human
cuuggaagcuccgcuuucua

SEQ ID NO: 3325432 - RNA, 14 nt, Human
cuuggaagcuccgc

SEQ ID NO: 3325433 - RNA, 20 nt, Human
cuugcuucaaccccaugaga

SEQ ID NO: 3325434 - RNA, 17 nt, Human
cuugcucugcugacaga

SEQ ID NO: 3325435 - RNA, 22 nt, Human
cuugcucugcugacagacacag

SEQ ID NO: 3325436 - RNA, 21 nt, Human
cuugcagacucuacagaggcc

SEQ ID NO: 3325437 - RNA, 20 nt, Human
cuugcagacucuacagaggc

SEQ ID NO: 3325438 - RNA, 15 nt, Human
cuugcaauggcagcc

SEQ ID NO: 3325439 - RNA, 16 nt, Human
cuugcaauggcagccu

SEQ ID NO: 3325440 - RNA, 17 nt, Human
cuugcaauggcagccuu

SEQ ID NO: 3325441 - RNA, 18 nt, Human
cuugcaauggcagccuug

SEQ ID NO: 3325442 - RNA, 19 nt, Human
cuugaguugauucagcucu

SEQ ID NO: 3325443 - RNA, 18 nt, Human
cuugaguugauucagcuc

SEQ ID NO: 3325444 - RNA, 20 nt, Human
cuugaguugauucagcucug

SEQ ID NO: 3325445 - RNA, 15 nt, Human
cuugaggguugggcu

SEQ ID NO: 3325446 - RNA, 15 nt, Human
cuugagccugggagg

SEQ ID NO: 3325447 - RNA, 12 nt, Human
cuugagccuggg

SEQ ID NO: 3325448 - RNA, 15 nt, Human
cuugguuuguaaauu

SEQ ID NO: 3325449 - RNA, 14 nt, Human
cuugguuuguaaau

SEQ ID NO: 3325450 - RNA, 20 nt, Human
cuugggccacugugaagaga

SEQ ID NO: 3325451 - RNA, 18 nt, Human
cuugggccacugugaaga

SEQ ID NO: 3325452 - RNA, 15 nt, Human
cuuguggucccaccc

SEQ ID NO: 3325453 - RNA, 19 nt, Human
cuuguggucccaccccaca

SEQ ID NO: 3325454 - RNA, 16 nt, Human
cuuguggucccacccc

SEQ ID NO: 3325455 - RNA, 16 nt, Human
cuuguuaagauaguua

SEQ ID NO: 3325456 - RNA, 17 nt, Human
cuuuaccuuuuuuauac

SEQ ID NO: 3325457 - RNA, 20 nt, Human
cuuuaccuuuuuuauacaua

SEQ ID NO: 3325458 - RNA, 19 nt, Human
cuuuaccuuuuuuauacau

SEQ ID NO: 3325459 - RNA, 15 nt, Human
cuuuagcgcccaguu

SEQ ID NO: 3325460 - RNA, 13 nt, Human
cuuucugaaauaa

SEQ ID NO: 3325461 - RNA, 23 nt, Human
cuuugggaggccaaggugggagg

SEQ ID NO: 3325462 - RNA, 23 nt, Human
cuuugugaggaagccgcuggggc

SEQ ID NO: 3325463 - RNA, 13 nt, Human
cuuuguggcuucc

SEQ ID NO: 3325464 - RNA, 19 nt, Human
cuuugugaggaagccgcug

SEQ ID NO: 3325465 - RNA, 12 nt, Human
cuuugugauuuu

SEQ ID NO: 3325466 - RNA, 21 nt, Human
cuuuguucuggcucuuccagg

SEQ ID NO: 3325467 - RNA, 16 nt, Human
cuuuguucuggcucuu

SEQ ID NO: 3325468 - RNA, 15 nt, Human
cuuuguucuggcucu

SEQ ID NO: 3325469 - RNA, 12 nt, Human
cuuuggaaagac

SEQ ID NO: 3325470 - RNA, 23 nt, Human
cuuuggaaagacuuuuccaaccc

SEQ ID NO: 3325471 - RNA, 14 nt, Human
cuuugcuugaaaga

SEQ ID NO: 3325472 - RNA, 19 nt, Human
gaaaacaugcuacacacug

SEQ ID NO: 3325473 - RNA, 16 nt, Human
cuuuuuuagaguugau

SEQ ID NO: 3325474 - RNA, 19 nt, Human
gaaaacacuguucucugcc

SEQ ID NO: 3325475 - RNA, 18 nt, Human
gaaaacacuguucucugc

SEQ ID NO: 3325476 - RNA, 21 nt, Human
gaaaacacuguucucugcccu

SEQ ID NO: 3325477 - RNA, 20 nt, Human
gaaaacacuguucucugccc

SEQ ID NO: 3325478 - RNA, 18 nt, Human
gaaaacaugcuacacacu

SEQ ID NO: 3325479 - RNA, 16 nt, Human
gaaaacaugcuacaca

SEQ ID NO: 3325480 - RNA, 20 nt, Human
cuuuguuuguugucagcuga

SEQ ID NO: 3325481 - RNA, 21 nt, Human
cuuuguuuguugucagcugaa

SEQ ID NO: 3325482 - RNA, 23 nt, Human
cuuuucuguccgagcuuugaaaa

SEQ ID NO: 3325483 - RNA, 15 nt, Human
cuuuucuguuugcua

SEQ ID NO: 3325484 - RNA, 20 nt, Human
cuuuuguucuugguuuguaa

SEQ ID NO: 3325485 - RNA, 22 nt, Human
cuuuuguucuugguuuguaaau

SEQ ID NO: 3325486 - RNA, 15 nt, Human
cuuacgugaguccug

SEQ ID NO: 3325487 - RNA, 13 nt, Human
cuuacuguacaug

SEQ ID NO: 3325488 - RNA, 16 nt, Human
cuuacuguacaugaaa

SEQ ID NO: 3325489 - RNA, 11 nt, Human
cuuagacaguc

SEQ ID NO: 3325490 - RNA, 19 nt, Human
cuuagacagucccugccaa

SEQ ID NO: 3325491 - RNA, 18 nt, Human
cuuagacagucccugcca

SEQ ID NO: 3325492 - RNA, 17 nt, Human
cuuagacagucccugcc

SEQ ID NO: 3325493 - RNA, 15 nt, Human
cuuagaagucacaca

SEQ ID NO: 3325494 - RNA, 14 nt, Human
cuuagacagucccu

SEQ ID NO: 3325495 - RNA, 16 nt, Human
cuuagacagucccugc

SEQ ID NO: 3325496 - RNA, 15 nt, Human
cuuagacagucccug

SEQ ID NO: 3325497 - RNA, 17 nt, Human
cuuagguuggcaaaaag

SEQ ID NO: 3325498 - RNA, 14 nt, Human
cuuaaucuaaaugg

SEQ ID NO: 3325499 - RNA, 14 nt, Human
cuuaacuucacaua

SEQ ID NO: 3325500 - RNA, 12 nt, Human
cuuaacuucaca

SEQ ID NO: 3325501 - RNA, 22 nt, Human
cuuaacuucacauauugauuuc

SEQ ID NO: 3325502 - RNA, 17 nt, Human
cuuaacuucacauauug

SEQ ID NO: 3325503 - RNA, 16 nt, Human
cuuaacuucacauauu

SEQ ID NO: 3325504 - RNA, 15 nt, Human
cuuaacuucacauau

SEQ ID NO: 3325505 - RNA, 17 nt, Human
cuguuuucucuugagag

SEQ ID NO: 3325506 - RNA, 23 nt, Human
cuguuuguuucugaaagggacgc

SEQ ID NO: 3325507 - RNA, 21 nt, Human
cuguuuguuucugaaagggac

SEQ ID NO: 3325508 - RNA, 14 nt, Human
cuguuuucucuuga

SEQ ID NO: 3325509 - RNA, 13 nt, Human
cuguuuucucuug

SEQ ID NO: 3325510 - RNA, 18 nt, Human
cuguuuguuucugaaagg

SEQ ID NO: 3325511 - RNA, 12 nt, Human
cuguuuagauaa

SEQ ID NO: 3325512 - RNA, 21 nt, Human
cuucgggaggucgaggcagga

SEQ ID NO: 3325513 - RNA, 20 nt, Human
cuucgggaggucgaggcagg

SEQ ID NO: 3325514 - RNA, 13 nt, Human
cuucgcuccugug

SEQ ID NO: 3325515 - RNA, 14 nt, Human
cuucgcuccugugu

SEQ ID NO: 3325516 - RNA, 15 nt, Human
cuucgcuccuguguc

SEQ ID NO: 3325517 - RNA, 17 nt, Human
cuucuccaggcuguauc

SEQ ID NO: 3325518 - RNA, 14 nt, Human
cuucuccaggcugu

SEQ ID NO: 3325519 - RNA, 14 nt, Human
cuucuccacccugc

SEQ ID NO: 3325520 - RNA, 15 nt, Human
cuucuccacccugcu

SEQ ID NO: 3325521 - RNA, 19 nt, Human
cuucuccuucaccuuuguc

SEQ ID NO: 3325522 - RNA, 22 nt, Human
cuucuccuucaccuuugucccc

SEQ ID NO: 3325523 - RNA, 18 nt, Human
cuucugcuucagccuccc

SEQ ID NO: 3325524 - RNA, 13 nt, Human
cuucugcuucagc

SEQ ID NO: 3325525 - RNA, 16 nt, Human
cuucugcuucagccuc

SEQ ID NO: 3325526 - RNA, 17 nt, Human
cuucugcuucagccucc

SEQ ID NO: 3325527 - RNA, 21 nt, Human
cuucugccauauucuguuggc

SEQ ID NO: 3325528 - RNA, 15 nt, Human
cuucugccauauucu

SEQ ID NO: 3325529 - RNA, 17 nt, Human
cuucugccauauucugu

SEQ ID NO: 3325530 - RNA, 11 nt, Human
cuucagcugac

SEQ ID NO: 3325531 - RNA, 18 nt, Human
cuucauuuccugugucuu

SEQ ID NO: 3325532 - RNA, 13 nt, Human
cuucagugccuua

SEQ ID NO: 3325533 - RNA, 12 nt, Human
cuucagugccuu

SEQ ID NO: 3325534 - RNA, 11 nt, Human
cuucagugccu

SEQ ID NO: 3325535 - RNA, 23 nt, Human
cuuccacaagagcccaggccucc

SEQ ID NO: 3325536 - RNA, 22 nt, Human
cuuccacaagagcccaggccuc

SEQ ID NO: 3325537 - RNA, 24 nt, Human
cuuccaggggugggacacccugug

SEQ ID NO: 3325538 - RNA, 22 nt, Human
cuuccaggggugggacacccug

SEQ ID NO: 3325539 - RNA, 21 nt, Human
cuuccaggggugggacacccu

SEQ ID NO: 3325540 - RNA, 14 nt, Human
cuuccagugaggcu

SEQ ID NO: 3325541 - RNA, 15 nt, Human
cuuccagugaggcuc

SEQ ID NO: 3325542 - RNA, 22 nt, Human
cucugcaagaauugaagcagga

SEQ ID NO: 3325543 - RNA, 16 nt, Human
cucugaggacacuaac

SEQ ID NO: 3325544 - RNA, 23 nt, Human
cucugcccuccaagaccuucucc

SEQ ID NO: 3325545 - RNA, 16 nt, Human
cucugcccuccaagac

SEQ ID NO: 3325546 - RNA, 15 nt, Human
cucugcccuccaaga

SEQ ID NO: 3325547 - RNA, 14 nt, Human
cucugcccuccaag

SEQ ID NO: 3325548 - RNA, 14 nt, Human
cucugccucugaca

SEQ ID NO: 3325549 - RNA, 22 nt, Human
cucuggacaggcauguucucug

SEQ ID NO: 3325550 - RNA, 22 nt, Human
cucucaggccagcugcuugggc

SEQ ID NO: 3325551 - RNA, 23 nt, Human
cucucaggccagcugcuugggcu

SEQ ID NO: 3325552 - RNA, 13 nt, Human
cucucccaucacu

SEQ ID NO: 3325553 - RNA, 20 nt, Human
cucucccaucacuucccuac

SEQ ID NO: 3325554 - RNA, 14 nt, Human
cucucccaucacuu

SEQ ID NO: 3325555 - RNA, 18 nt, Human
cucucccaucacuucccu

SEQ ID NO: 3325556 - RNA, 12 nt, Human
cucuccagcccc

SEQ ID NO: 3325557 - RNA, 13 nt, Human
cucuccagccccu

SEQ ID NO: 3325558 - RNA, 18 nt, Human
cucuccuguaccucuuga

SEQ ID NO: 3325559 - RNA, 17 nt, Human
cucuccuguaccucuug

SEQ ID NO: 3325560 - RNA, 22 nt, Human
cucuccuguaccucuugagccu

SEQ ID NO: 3325561 - RNA, 13 nt, Human
cucuccuguaccu

SEQ ID NO: 3325562 - RNA, 15 nt, Human
cucuccuguaccucu

SEQ ID NO: 3325563 - RNA, 14 nt, Human
cucuccuguaccuc

SEQ ID NO: 3325564 - RNA, 14 nt, Human
cucucucacuccuu

SEQ ID NO: 3325565 - RNA, 12 nt, Human
cucucucaggcc

SEQ ID NO: 3325566 - RNA, 16 nt, Human
cucucucacuccuuga

SEQ ID NO: 3325567 - RNA, 15 nt, Human
cucucucacuccuug

SEQ ID NO: 3325568 - RNA, 19 nt, Human
cugaagacucauucuucug

SEQ ID NO: 3325569 - RNA, 21 nt, Human
cugaagacucauucuucugua

SEQ ID NO: 3325570 - RNA, 15 nt, Human
cugaacuuggcgcug

SEQ ID NO: 3325571 - RNA, 21 nt, Human
cugaacuuggcgcugccccug

SEQ ID NO: 3325572 - RNA, 16 nt, Human
cugaacuuggcgcugc

SEQ ID NO: 3325573 - RNA, 21 nt, Human
cugaaccuggguaacuaggga

SEQ ID NO: 3325574 - RNA, 18 nt, Human
cucuuugggccuggcucc

SEQ ID NO: 3325575 - RNA, 19 nt, Human
cucuuuggucuacacugug

SEQ ID NO: 3325576 - RNA, 16 nt, Human
cugaauacagaggcaa

SEQ ID NO: 3325577 - RNA, 14 nt, Human
cugaagucacacag

SEQ ID NO: 3325578 - RNA, 15 nt, Human
cugaagucacacagu

SEQ ID NO: 3325579 - RNA, 24 nt, Human
cugaagucuuuguacagacaacaa

SEQ ID NO: 3325580 - RNA, 11 nt, Human
cugacccacug

SEQ ID NO: 3325581 - RNA, 17 nt, Human
cugacauuguuggccaa

SEQ ID NO: 3325582 - RNA, 20 nt, Human
cugacaggcaaugcuggcug

SEQ ID NO: 3325583 - RNA, 16 nt, Human
cugacaggcaaugcug

SEQ ID NO: 3325584 - RNA, 17 nt, Human
cugacaggcaaugcugg

SEQ ID NO: 3325585 - RNA, 18 nt, Human
cugacaggcaaugcuggc

SEQ ID NO: 3325586 - RNA, 19 nt, Human
cugacaggcaaugcuggcu

SEQ ID NO: 3325587 - RNA, 11 nt, Human
cugacaggcaa

SEQ ID NO: 3325588 - RNA, 21 nt, Human
cugacagacacaggcccggcu

SEQ ID NO: 3325589 - RNA, 19 nt, Human
cugacagacacaggcccgg

SEQ ID NO: 3325590 - RNA, 12 nt, Human
cucuucuccagg

SEQ ID NO: 3325591 - RNA, 23 nt, Human
cucuuccaggcugggagagccuu

SEQ ID NO: 3325592 - RNA, 21 nt, Human
cucuuccaggcugggagagcc

SEQ ID NO: 3325593 - RNA, 22 nt, Human
cucuuccaggcugggagagccu

SEQ ID NO: 3325594 - RNA, 13 nt, Human
cucuuaaaaccca

SEQ ID NO: 3325595 - RNA, 24 nt, Human
cucuuaaaacccaagugccuuagc

SEQ ID NO: 3325596 - RNA, 19 nt, Human
cucuggcagcucagagagg

SEQ ID NO: 3325597 - RNA, 18 nt, Human
cucuggcagcucagagag

SEQ ID NO: 3325598 - RNA, 17 nt, Human
cucuggcagcucagaga

SEQ ID NO: 3325599 - RNA, 16 nt, Human
cucuggcagcucagag

SEQ ID NO: 3325600 - RNA, 17 nt, Human
cucuuucuauuguuucu

SEQ ID NO: 3325601 - RNA, 18 nt, Human
cucuuuggacacucacac

SEQ ID NO: 3325602 - RNA, 15 nt, Human
cucuuuggacacuca

SEQ ID NO: 3325603 - RNA, 17 nt, Human
cucuuuccaucuacccu

SEQ ID NO: 3325604 - RNA, 17 nt, Human
cucuugguccugcugca

SEQ ID NO: 3325605 - RNA, 19 nt, Human
cucuugguccugcugcagu

SEQ ID NO: 3325606 - RNA, 18 nt, Human
cucuugguccugcugcag

SEQ ID NO: 3325607 - RNA, 16 nt, Human
cucuugaccucaggug

SEQ ID NO: 3325608 - RNA, 13 nt, Human
cucuugaccucag

SEQ ID NO: 3325609 - RNA, 15 nt, Human
cucuugaccucaggu

SEQ ID NO: 3325610 - RNA, 14 nt, Human
cucccuuccucuuu

SEQ ID NO: 3325611 - RNA, 13 nt, Human
cucccuuccucuu

SEQ ID NO: 3325612 - RNA, 17 nt, Human
cucccuuggauuguccc

SEQ ID NO: 3325613 - RNA, 23 nt, Human
cucccuucccaccucucucacuc

SEQ ID NO: 3325614 - RNA, 10 nt, Human
cucccuuccu

SEQ ID NO: 3325615 - RNA, 18 nt, Human
cucccaucucacacauga

SEQ ID NO: 3325616 - RNA, 15 nt, Human
cucccaucucacaca

SEQ ID NO: 3325617 - RNA, 14 nt, Human
cucccaucucacac

SEQ ID NO: 3325618 - RNA, 12 nt, Human
cuccugcaggca

SEQ ID NO: 3325619 - RNA, 14 nt, Human
cuccugcaggcagc

SEQ ID NO: 3325620 - RNA, 13 nt, Human
cuccugcaggcag

SEQ ID NO: 3325621 - RNA, 14 nt, Human
cuccucagaucuuc

SEQ ID NO: 3325622 - RNA, 12 nt, Human
cuccucagaucu

SEQ ID NO: 3325623 - RNA, 21 nt, Human
cuccuucaccuuuguccccac

SEQ ID NO: 3325624 - RNA, 19 nt, Human
cuccuucaccuuugucccc

SEQ ID NO: 3325625 - RNA, 16 nt, Human
cuccuucaccuuuguc

SEQ ID NO: 3325626 - RNA, 14 nt, Human
cuccuucaccuuug

SEQ ID NO: 3325627 - RNA, 15 nt, Human
cuccugugucuugca

SEQ ID NO: 3325628 - RNA, 23 nt, Human
cuccugugucuugcaauggcagc

SEQ ID NO: 3325629 - RNA, 11 nt, Human
cuccugugugu

SEQ ID NO: 3325630 - RNA, 22 nt, Human
cuccugcaggcagccaggccac

SEQ ID NO: 3325631 - RNA, 21 nt, Human
cuccugcaggcagccaggcca

SEQ ID NO: 3325632 - RNA, 15 nt, Human
cuccugcaggcagcc

SEQ ID NO: 3325633 - RNA, 21 nt, Human
cuccuugaaaacacuguucuc

SEQ ID NO: 3325634 - RNA, 11 nt, Human
cuccuucuucc

SEQ ID NO: 3325635 - RNA, 16 nt, Human
cucgaacuggcugcaa

SEQ ID NO: 3325636 - RNA, 13 nt, Human
cuccuucaccuuu

SEQ ID NO: 3325637 - RNA, 14 nt, Human
cuccuucuguccua

SEQ ID NO: 3325638 - RNA, 15 nt, Human
cuccuucuguccuac

SEQ ID NO: 3325639 - RNA, 20 nt, Human
cuccuucuguccuacucugu

SEQ ID NO: 3325640 - RNA, 20 nt, Human
cucgaguuacagacaaagcg

SEQ ID NO: 3325641 - RNA, 16 nt, Human
cucgaguuacagacaa

SEQ ID NO: 3325642 - RNA, 15 nt, Human
cucgcgacaaugcaa

SEQ ID NO: 3325643 - RNA, 13 nt, Human
cucgcgacaaugc

SEQ ID NO: 3325644 - RNA, 21 nt, Human
cucauuagcauuuugcuaaau

SEQ ID NO: 3325645 - RNA, 13 nt, Human
cucauucuucugu

SEQ ID NO: 3325646 - RNA, 14 nt, Human
cucauucuucugua

SEQ ID NO: 3325647 - RNA, 12 nt, Human
cucauucuucug

SEQ ID NO: 3325648 - RNA, 16 nt, Human
cucauugaccugaggc

SEQ ID NO: 3325649 - RNA, 23 nt, Human
cucauucuucuguacgucugaca

SEQ ID NO: 3325650 - RNA, 15 nt, Human
cucauugaccugagg

SEQ ID NO: 3325651 - RNA, 13 nt, Human
cucauugaccuga

SEQ ID NO: 3325652 - RNA, 17 nt, Human
cucaggugucccugcac

SEQ ID NO: 3325653 - RNA, 18 nt, Human
cucaggugucccugcacu

SEQ ID NO: 3325654 - RNA, 19 nt, Human
cucaggugucccugcacuu

SEQ ID NO: 3325655 - RNA, 18 nt, Human
cucauaguaugguggcug

SEQ ID NO: 3325656 - RNA, 19 nt, Human
cucauaguaugguggcugg

SEQ ID NO: 3325657 - RNA, 23 nt, Human
cuaaaagguaugcaaucaaaucu

SEQ ID NO: 3325658 - RNA, 12 nt, Human
cucagggucccu

SEQ ID NO: 3325659 - RNA, 15 nt, Human
cucaggugucccugc

SEQ ID NO: 3325660 - RNA, 16 nt, Human
cucaggugucccugca

SEQ ID NO: 3325661 - RNA, 23 nt, Human
cucagguggggucacucuggcag

SEQ ID NO: 3325662 - RNA, 22 nt, Human
cucagguggggucacucuggca

SEQ ID NO: 3325663 - RNA, 11 nt, Human
cuccaggcucc

SEQ ID NO: 3325664 - RNA, 19 nt, Human
cuccagcuguucagcuggu

SEQ ID NO: 3325665 - RNA, 18 nt, Human
cuccagcuguucagcugg

SEQ ID NO: 3325666 - RNA, 13 nt, Human
cuccagcuguuca

SEQ ID NO: 3325667 - RNA, 14 nt, Human
cuccaugugggcua

SEQ ID NO: 3325668 - RNA, 15 nt, Human
cucccaggcauuccc

SEQ ID NO: 3325669 - RNA, 21 nt, Human
cucccaaggggcccaaauucu

SEQ ID NO: 3325670 - RNA, 22 nt, Human
cucccaaggggcccaaauucuu

SEQ ID NO: 3325671 - RNA, 22 nt, Human
cucccaggcauuccccaggagg

SEQ ID NO: 3325672 - RNA, 21 nt, Human
cucccaggcauuccccaggag

SEQ ID NO: 3325673 - RNA, 20 nt, Human
cucccaggcauuccccagga

SEQ ID NO: 3325674 - RNA, 19 nt, Human
cucccaggcauuccccagg

SEQ ID NO: 3325675 - RNA, 17 nt, Human
cucccaggcauucccca

SEQ ID NO: 3325676 - RNA, 11 nt, Human
cuccacccugc

SEQ ID NO: 3325677 - RNA, 21 nt, Human
cuccaccugccagggacagag

SEQ ID NO: 3325678 - RNA, 18 nt, Human
cuccaccugccagggaca

SEQ ID NO: 3325679 - RNA, 17 nt, Human
cuccaccugccagggac

SEQ ID NO: 3325680 - RNA, 15 nt, Human
cuccaccugccaggg

SEQ ID NO: 3325681 - RNA, 12 nt, Human
cuccacccugcu

SEQ ID NO: 3325682 - RNA, 19 nt, Human
cuccagcucaccagcccca

SEQ ID NO: 3325683 - RNA, 20 nt, Human
cuccagcucaccagccccag

SEQ ID NO: 3325684 - RNA, 16 nt, Human
cuggccagaugcacca

SEQ ID NO: 3325685 - RNA, 17 nt, Human
cuggcacugcuuccagu

SEQ ID NO: 3325686 - RNA, 16 nt, Human
cuggcacugcuuccag

SEQ ID NO: 3325687 - RNA, 15 nt, Human
cuggcacugcuucca

SEQ ID NO: 3325688 - RNA, 21 nt, Human
cuggccagaugcaccagcccu

SEQ ID NO: 3325689 - RNA, 17 nt, Human
cuggccagaugcaccag

SEQ ID NO: 3325690 - RNA, 18 nt, Human
cuggccagaugcaccagc

SEQ ID NO: 3325691 - RNA, 19 nt, Human
cuggccagaugcaccagcc

SEQ ID NO: 3325692 - RNA, 20 nt, Human
cuggccagaugcaccagccc

SEQ ID NO: 3325693 - RNA, 13 nt, Human
cuggcccacugca

SEQ ID NO: 3325694 - RNA, 12 nt, Human
cuggcccacugc

SEQ ID NO: 3325695 - RNA, 17 nt, Human
cuggccuagcauacgua

SEQ ID NO: 3325696 - RNA, 23 nt, Human
cuggccuagcauacguacacauu

SEQ ID NO: 3325697 - RNA, 14 nt, Human
cuggccuagcauac

SEQ ID NO: 3325698 - RNA, 14 nt, Human
cuggcacugcuucc

SEQ ID NO: 3325699 - RNA, 13 nt, Human
cuggcacugcuuc

SEQ ID NO: 3325700 - RNA, 23 nt, Human
cuggcacuauaauguaagcucua

SEQ ID NO: 3325701 - RNA, 22 nt, Human
cuggcacuauaauguaagcucu

SEQ ID NO: 3325702 - RNA, 15 nt, Human
cuggauggggcugca

SEQ ID NO: 3325703 - RNA, 16 nt, Human
cuggauggggcugcac

SEQ ID NO: 3325704 - RNA, 23 nt, Human
cuggauuaaacuuaaucuaaaug

SEQ ID NO: 3325705 - RNA, 13 nt, Human
cuggauuaaacuu

SEQ ID NO: 3325706 - RNA, 14 nt, Human
cuggaagcacagcu

SEQ ID NO: 3325707 - RNA, 18 nt, Human
cuggaagcacagcuucau

SEQ ID NO: 3325708 - RNA, 15 nt, Human
cuggaagcacagcuu

SEQ ID NO: 3325709 - RNA, 14 nt, Human
cuggaaugcagugg

SEQ ID NO: 3325710 - RNA, 15 nt, Human
cuggaaugcaguggu

SEQ ID NO: 3325711 - RNA, 18 nt, Human
cugggaggucaaggcugc

SEQ ID NO: 3325712 - RNA, 16 nt, Human
cugggagugagcuggu

SEQ ID NO: 3325713 - RNA, 13 nt, Human
cugggagugagcu

SEQ ID NO: 3325714 - RNA, 12 nt, Human
cugggagugagc

SEQ ID NO: 3325715 - RNA, 20 nt, Human
cugggcaaugugauaaaacc

SEQ ID NO: 3325716 - RNA, 13 nt, Human
cuggccugagcug

SEQ ID NO: 3325717 - RNA, 17 nt, Human
cuggcucuuccaggcug

SEQ ID NO: 3325718 - RNA, 19 nt, Human
cuggcucuuccaggcuggg

SEQ ID NO: 3325719 - RNA, 18 nt, Human
cuggcucuuccaggcugg

SEQ ID NO: 3325720 - RNA, 19 nt, Human
cuggcuguuggcugggggc

SEQ ID NO: 3325721 - RNA, 21 nt, Human
cuggcuggguggcaccagcag

SEQ ID NO: 3325722 - RNA, 18 nt, Human
cuggcuguuggcuggggg

SEQ ID NO: 3325723 - RNA, 20 nt, Human
cuggcuguuggcugggggcc

SEQ ID NO: 3325724 - RNA, 19 nt, Human
cugguggcagugggagcug

SEQ ID NO: 3325725 - RNA, 23 nt, Human
cugguggcagugggagcugccug

SEQ ID NO: 3325726 - RNA, 19 nt, Human
cuggguucuacccaggugc

SEQ ID NO: 3325727 - RNA, 13 nt, Human
cuggguuggaggg

SEQ ID NO: 3325728 - RNA, 17 nt, Human
cugguccauagagagca

SEQ ID NO: 3325729 - RNA, 15 nt, Human
cugguccauagagag

SEQ ID NO: 3325730 - RNA, 15 nt, Human
cuggucccacucagu

SEQ ID NO: 3325731 - RNA, 18 nt, Human
cuggucccacucagucca

SEQ ID NO: 3325732 - RNA, 14 nt, Human
cuggucccacucag

SEQ ID NO: 3325733 - RNA, 18 nt, Human
cugguccauagagagcaa

SEQ ID NO: 3325734 - RNA, 21 nt, Human
cugggcuucaguggcagcugc

SEQ ID NO: 3325735 - RNA, 22 nt, Human
cugggcuucaguggcagcugcu

SEQ ID NO: 3325736 - RNA, 13 nt, Human
cugggcuugggga

SEQ ID NO: 3325737 - RNA, 20 nt, Human
cugggcuuggggaccagagc

SEQ ID NO: 3325738 - RNA, 17 nt, Human
cugggcuuggggaccag

SEQ ID NO: 3325739 - RNA, 18 nt, Human
cugggcuucaguggcagc

SEQ ID NO: 3325740 - RNA, 17 nt, Human
cugggcuucaguggcag

SEQ ID NO: 3325741 - RNA, 19 nt, Human
cugggcuucaguggcagcu

SEQ ID NO: 3325742 - RNA, 20 nt, Human
cugggcuucaguggcagcug

SEQ ID NO: 3325743 - RNA, 19 nt, Human
cuggguacuuguggacaca

SEQ ID NO: 3325744 - RNA, 21 nt, Human
cuggguacuuguggacacagc

SEQ ID NO: 3325745 - RNA, 23 nt, Human
cuggguacuuguggacacagcuc

SEQ ID NO: 3325746 - RNA, 20 nt, Human
cuggguacuuguggacacag

SEQ ID NO: 3325747 - RNA, 23 nt, Human
cugggguggggaccucaggccug

SEQ ID NO: 3325748 - RNA, 22 nt, Human
cugggguggggaccucaggccu

SEQ ID NO: 3325749 - RNA, 21 nt, Human
cugggguggggaccucaggcc

SEQ ID NO: 3325750 - RNA, 13 nt, Human
cugggggccucag

SEQ ID NO: 3325751 - RNA, 17 nt, Human
cugggggccucagugcc

SEQ ID NO: 3325752 - RNA, 19 nt, Human
cugggguggggaccucagg

SEQ ID NO: 3325753 - RNA, 18 nt, Human
cugggguggggaccucag

SEQ ID NO: 3325754 - RNA, 17 nt, Human
cugggguggggaccuca

SEQ ID NO: 3325755 - RNA, 16 nt, Human
cugcaccggcuggccu

SEQ ID NO: 3325756 - RNA, 14 nt, Human
cugcacuugcagac

SEQ ID NO: 3325757 - RNA, 16 nt, Human
cugcacuugcagacuc

SEQ ID NO: 3325758 - RNA, 19 nt, Human
cugcaccggcuggccuggc

SEQ ID NO: 3325759 - RNA, 18 nt, Human
cugcaccggcuggccugg

SEQ ID NO: 3325760 - RNA, 17 nt, Human
cugcaccggcuggccug

SEQ ID NO: 3325761 - RNA, 22 nt, Human
cugcagggaguccgaaagggac

SEQ ID NO: 3325762 - RNA, 22 nt, Human
cugcagccucaaccuccugggc

SEQ ID NO: 3325763 - RNA, 19 nt, Human
cugcagccucaaccuccug

SEQ ID NO: 3325764 - RNA, 20 nt, Human
cugcagccucaaccuccugg

SEQ ID NO: 3325765 - RNA, 11 nt, Human
cugcagccuca

SEQ ID NO: 3325766 - RNA, 16 nt, Human
cugcacaagcugcacc

SEQ ID NO: 3325767 - RNA, 15 nt, Human
cugcacaagcugcac

SEQ ID NO: 3325768 - RNA, 14 nt, Human
cugcacaagcugca

SEQ ID NO: 3325769 - RNA, 13 nt, Human
cugcacaagcugc

SEQ ID NO: 3325770 - RNA, 18 nt, Human
cugcacccucaggcaggu

SEQ ID NO: 3325771 - RNA, 16 nt, Human
cugcacccucaggcag

SEQ ID NO: 3325772 - RNA, 17 nt, Human
cugcacccucaggcagg

SEQ ID NO: 3325773 - RNA, 22 nt, Human
cugauucccaagcucugcuccu

SEQ ID NO: 3325774 - RNA, 19 nt, Human
cugauucccaagcucugcu

SEQ ID NO: 3325775 - RNA, 20 nt, Human
cugauucccaagcucugcuc

SEQ ID NO: 3325776 - RNA, 17 nt, Human
cugauucccaagcucug

SEQ ID NO: 3325777 - RNA, 18 nt, Human
cugauucccaagcucugc

SEQ ID NO: 3325778 - RNA, 15 nt, Human
cugauucccaagcuc

SEQ ID NO: 3325779 - RNA, 13 nt, Human
cugauaaagauga

SEQ ID NO: 3325780 - RNA, 16 nt, Human
cugagucugaaggcug

SEQ ID NO: 3325781 - RNA, 15 nt, Human
cugagucugaaggcu

SEQ ID NO: 3325782 - RNA, 14 nt, Human
cugagucugaaggc

SEQ ID NO: 3325783 - RNA, 13 nt, Human
cugagucugaagg

SEQ ID NO: 3325784 - RNA, 13 nt, Human
cugccucagccuc

SEQ ID NO: 3325785 - RNA, 13 nt, Human
cugccugcccagg

SEQ ID NO: 3325786 - RNA, 14 nt, Human
cugccugcccaggc

SEQ ID NO: 3325787 - RNA, 23 nt, Human
cugccuguugggccaggagccuc

SEQ ID NO: 3325788 - RNA, 23 nt, Human
cugccugaagucacacagugagu

SEQ ID NO: 3325789 - RNA, 13 nt, Human
cugccucuucucu

SEQ ID NO: 3325790 - RNA, 14 nt, Human
cugcuccagcuguu

SEQ ID NO: 3325791 - RNA, 16 nt, Human
cugcgguccacccagg

SEQ ID NO: 3325792 - RNA, 21 nt, Human
cugcggaaugaaccacaucuu

SEQ ID NO: 3325793 - RNA, 15 nt, Human
cugcgguccacccag

SEQ ID NO: 3325794 - RNA, 20 nt, Human
cugcggaaugaaccacaucu

SEQ ID NO: 3325795 - RNA, 18 nt, Human
cugcuccucuccccagca

SEQ ID NO: 3325796 - RNA, 16 nt, Human
cugcuccucuccccag

SEQ ID NO: 3325797 - RNA, 17 nt, Human
cugcuccucuccccagc

SEQ ID NO: 3325798 - RNA, 14 nt, Human
cugccacccugggg

SEQ ID NO: 3325799 - RNA, 15 nt, Human
cugccacccugggga

SEQ ID NO: 3325800 - RNA, 16 nt, Human
cugccacccuggggag

SEQ ID NO: 3325801 - RNA, 20 nt, Human
cugccacccuggggagaaag

SEQ ID NO: 3325802 - RNA, 19 nt, Human
cugccaugccagcuuaucu

SEQ ID NO: 3325803 - RNA, 17 nt, Human
cugccaugccagcuuau

SEQ ID NO: 3325804 - RNA, 15 nt, Human
cugccaugccagcuu

SEQ ID NO: 3325805 - RNA, 18 nt, Human
cugccaggaagccagcag

SEQ ID NO: 3325806 - RNA, 16 nt, Human
cugccaggaagccagc

SEQ ID NO: 3325807 - RNA, 15 nt, Human
cugccaggaagccag

SEQ ID NO: 3325808 - RNA, 19 nt, Human
cugccagccgagauagcca

SEQ ID NO: 3325809 - RNA, 20 nt, Human
cugcccggcaggguccuaga

SEQ ID NO: 3325810 - RNA, 16 nt, Human
cugccccuggcagccc

SEQ ID NO: 3325811 - RNA, 15 nt, Human
cugccccuggcagcc

SEQ ID NO: 3325812 - RNA, 14 nt, Human
cugccccuggcagc

SEQ ID NO: 3325813 - RNA, 16 nt, Human
cugccauuucugagau

SEQ ID NO: 3325814 - RNA, 16 nt, Human
cugcccugcccaccug

SEQ ID NO: 3325815 - RNA, 15 nt, Human
cugcccugcccaccu

SEQ ID NO: 3325816 - RNA, 14 nt, Human
cugcccugcccacc

SEQ ID NO: 3325817 - RNA, 13 nt, Human
cugcccugcccac

SEQ ID NO: 3325818 - RNA, 11 nt, Human
cugcccggcug

SEQ ID NO: 3325819 - RNA, 15 nt, Human
cugcccggcugcgga

SEQ ID NO: 3325820 - RNA, 19 nt, Human
cugcccuccaagaccuucu

SEQ ID NO: 3325821 - RNA, 12 nt, Human
ccuucagugccu

SEQ ID NO: 3325822 - RNA, 14 nt, Human
ccuucagugccuua

SEQ ID NO: 3325823 - RNA, 13 nt, Human
ccuucagugccuu

SEQ ID NO: 3325824 - RNA, 19 nt, Human
ccuucagugccuuauggaa

SEQ ID NO: 3325825 - RNA, 15 nt, Human
ccuucagugccuuau

SEQ ID NO: 3325826 - RNA, 20 nt, Human
ccuucagugccuuauggaac

SEQ ID NO: 3325827 - RNA, 14 nt, Human
ccuuccucuuucca

SEQ ID NO: 3325828 - RNA, 18 nt, Human
ccuuccaggggugggaca

SEQ ID NO: 3325829 - RNA, 16 nt, Human
ccuuccagggguggga

SEQ ID NO: 3325830 - RNA, 15 nt, Human
ccuuccagggguggg

SEQ ID NO: 3325831 - RNA, 17 nt, Human
ccuuagacagucccugc

SEQ ID NO: 3325832 - RNA, 16 nt, Human
ccuuagacagucccug

SEQ ID NO: 3325833 - RNA, 19 nt, Human
ccuuagacagucccugcca

SEQ ID NO: 3325834 - RNA, 18 nt, Human
ccuuagacagucccugcc

SEQ ID NO: 3325835 - RNA, 21 nt, Human
ccuuagacagucccugccaau

SEQ ID NO: 3325836 - RNA, 14 nt, Human
ccuuagacaguccc

SEQ ID NO: 3325837 - RNA, 20 nt, Human
ccuuaccucggugccuuccu

SEQ ID NO: 3325838 - RNA, 13 nt, Human
ccuuaccagcaga

SEQ ID NO: 3325839 - RNA, 19 nt, Human
ccuuacccucauguucuua

SEQ ID NO: 3325840 - RNA, 16 nt, Human
ccuuaccagcagagca

SEQ ID NO: 3325841 - RNA, 15 nt, Human
ccuuaccagcagagc

SEQ ID NO: 3325842 - RNA, 14 nt, Human
ccuuaccagcagag

SEQ ID NO: 3325843 - RNA, 11 nt, Human
ccuuuggcuuc

SEQ ID NO: 3325844 - RNA, 15 nt, Human
ccuugaaaacacugu

SEQ ID NO: 3325845 - RNA, 13 nt, Human
ccuucgcuccugu

SEQ ID NO: 3325846 - RNA, 14 nt, Human
ccuucgcuccugug

SEQ ID NO: 3325847 - RNA, 15 nt, Human
ccuucgcuccugugu

SEQ ID NO: 3325848 - RNA, 14 nt, Human
ccuugaacugggua

SEQ ID NO: 3325849 - RNA, 22 nt, Human
ccuugaaaacacuguucucugc

SEQ ID NO: 3325850 - RNA, 21 nt, Human
ccuugaaaacacuguucucug

SEQ ID NO: 3325851 - RNA, 19 nt, Human
ccuugaaaacacuguucuc

SEQ ID NO: 3325852 - RNA, 16 nt, Human
ccuugaacuggguacu

SEQ ID NO: 3325853 - RNA, 17 nt, Human
ccuugaacuuugaccuc

SEQ ID NO: 3325854 - RNA, 17 nt, Human
ccuugaaugaugccaug

SEQ ID NO: 3325855 - RNA, 20 nt, Human
ccuugaguugauucagcucu

SEQ ID NO: 3325856 - RNA, 21 nt, Human
ccuugaccauucuccaccugc

SEQ ID NO: 3325857 - RNA, 23 nt, Human
ccuugaguugauucagcucugca

SEQ ID NO: 3325858 - RNA, 22 nt, Human
ccuugaguugauucagcucugc

SEQ ID NO: 3325859 - RNA, 19 nt, Human
ccuuggauuguccccgacc

SEQ ID NO: 3325860 - RNA, 15 nt, Human
ccuugacagggcaca

SEQ ID NO: 3325861 - RNA, 17 nt, Human
ccuugacagggcacacc

SEQ ID NO: 3325862 - RNA, 20 nt, Human
ccuugaccauucuccaccug

SEQ ID NO: 3325863 - RNA, 19 nt, Human
ccuugaccauucuccaccu

SEQ ID NO: 3325864 - RNA, 14 nt, Human
ccuugacagggcac

SEQ ID NO: 3325865 - RNA, 13 nt, Human
ccuugacagggca

SEQ ID NO: 3325866 - RNA, 14 nt, Human
ccuggacccugugg

SEQ ID NO: 3325867 - RNA, 13 nt, Human
ccuggacccugug

SEQ ID NO: 3325868 - RNA, 14 nt, Human
ccuggcaugggaau

SEQ ID NO: 3325869 - RNA, 17 nt, Human
ccuggcaugggaaugaa

SEQ ID NO: 3325870 - RNA, 16 nt, Human
ccuggcaugggaauga

SEQ ID NO: 3325871 - RNA, 16 nt, Human
ccuggcagccccuguu

SEQ ID NO: 3325872 - RNA, 14 nt, Human
ccuggcagccccug

SEQ ID NO: 3325873 - RNA, 21 nt, Human
ccuggcacugcuuccagugag

SEQ ID NO: 3325874 - RNA, 17 nt, Human
ccuggcacugcuuccag

SEQ ID NO: 3325875 - RNA, 20 nt, Human
ccuggcacugcuuccaguga

SEQ ID NO: 3325876 - RNA, 12 nt, Human
ccugggcagaag

SEQ ID NO: 3325877 - RNA, 14 nt, Human
ccugggcagaagga

SEQ ID NO: 3325878 - RNA, 20 nt, Human
ccugggaggucaaggcugca

SEQ ID NO: 3325879 - RNA, 20 nt, Human
ccugggaucccucauccuca

SEQ ID NO: 3325880 - RNA, 16 nt, Human
ccugggaucccucauc

SEQ ID NO: 3325881 - RNA, 18 nt, Human
ccuggcaugggaaugaau

SEQ ID NO: 3325882 - RNA, 14 nt, Human
ccuggccccucagg

SEQ ID NO: 3325883 - RNA, 12 nt, Human
ccugcuccagcu

SEQ ID NO: 3325884 - RNA, 22 nt, Human
ccugcuccagcuguucagcugg

SEQ ID NO: 3325885 - RNA, 14 nt, Human
ccugcuccagcugu

SEQ ID NO: 3325886 - RNA, 13 nt, Human
ccugcuccagcug

SEQ ID NO: 3325887 - RNA, 18 nt, Human
ccugcaacaccuuguuuc

SEQ ID NO: 3325888 - RNA, 16 nt, Human
ccugcaaccugauugu

SEQ ID NO: 3325889 - RNA, 19 nt, Human
ccugcaacaccuuguuucc

SEQ ID NO: 3325890 - RNA, 23 nt, Human
ccugcgucucauacucaccucac

SEQ ID NO: 3325891 - RNA, 19 nt, Human
ccugcugguucaggguugg

SEQ ID NO: 3325892 - RNA, 13 nt, Human
ccugcugguucag

SEQ ID NO: 3325893 - RNA, 21 nt, Human
ccugcuggguguggcgcagca

SEQ ID NO: 3325894 - RNA, 23 nt, Human
ccuguagagugggagcugagugg

SEQ ID NO: 3325895 - RNA, 19 nt, Human
ccuguagagugggagcuga

SEQ ID NO: 3325896 - RNA, 21 nt, Human
ccuguagagugggagcugagu

SEQ ID NO: 3325897 - RNA, 20 nt, Human
ccuguaauccuagcacuuug

SEQ ID NO: 3325898 - RNA, 12 nt, Human
ccuguaccucuu

SEQ ID NO: 3325899 - RNA, 18 nt, Human
ccugguggcagcucaccu

SEQ ID NO: 3325900 - RNA, 17 nt, Human
ccugguggcagcucacc

SEQ ID NO: 3325901 - RNA, 16 nt, Human
ccugguggcagcucac

SEQ ID NO: 3325902 - RNA, 14 nt, Human
ccugguggcagcuc

SEQ ID NO: 3325903 - RNA, 12 nt, Human
ccugguggcagc

SEQ ID NO: 3325904 - RNA, 13 nt, Human
ccugguggcagcu

SEQ ID NO: 3325905 - RNA, 17 nt, Human
ccugugauggggcccug

SEQ ID NO: 3325906 - RNA, 19 nt, Human
ccugugauggggcccugcc

SEQ ID NO: 3325907 - RNA, 18 nt, Human
ccugugauggggcccugc

SEQ ID NO: 3325908 - RNA, 22 nt, Human
ccugugauggggcccugccucc

SEQ ID NO: 3325909 - RNA, 21 nt, Human
ccugugauggggcccugccuc

SEQ ID NO: 3325910 - RNA, 20 nt, Human
ccugugauggggcccugccu

SEQ ID NO: 3325911 - RNA, 15 nt, Human
ccugugccucuggga

SEQ ID NO: 3325912 - RNA, 17 nt, Human
ccugugccucugggacu

SEQ ID NO: 3325913 - RNA, 18 nt, Human
ccuguccccgcacugggc

SEQ ID NO: 3325914 - RNA, 16 nt, Human
ccugucccccugacaa

SEQ ID NO: 3325915 - RNA, 17 nt, Human
ccugucccccugacaac

SEQ ID NO: 3325916 - RNA, 20 nt, Human
ccugugaguacuacaguccu

SEQ ID NO: 3325917 - RNA, 18 nt, Human
cggcuggccuggccccuc

SEQ ID NO: 3325918 - RNA, 14 nt, Human
cggcuggccuggcc

SEQ ID NO: 3325919 - RNA, 16 nt, Human
cggcuggccuggcccc

SEQ ID NO: 3325920 - RNA, 15 nt, Human
cggcuggccuggccc

SEQ ID NO: 3325921 - RNA, 20 nt, Human
cgggaggauguucugggaca

SEQ ID NO: 3325922 - RNA, 16 nt, Human
cgggaggucgaggcag

SEQ ID NO: 3325923 - RNA, 17 nt, Human
cgggaggucgaggcagg

SEQ ID NO: 3325924 - RNA, 15 nt, Human
cgggcaugacacgaa

SEQ ID NO: 3325925 - RNA, 12 nt, Human
cgggcaugacac

SEQ ID NO: 3325926 - RNA, 15 nt, Human
cggacagccacggcc

SEQ ID NO: 3325927 - RNA, 16 nt, Human
cggacagccacggcca

SEQ ID NO: 3325928 - RNA, 18 nt, Human
cggacagccacggccagg

SEQ ID NO: 3325929 - RNA, 20 nt, Human
cggaaugaaccacaucuugc

SEQ ID NO: 3325930 - RNA, 13 nt, Human
cgcuccugugucu

SEQ ID NO: 3325931 - RNA, 21 nt, Human
cgauucuucugcuucagccuc

SEQ ID NO: 3325932 - RNA, 13 nt, Human
cgauucuucugcu

SEQ ID NO: 3325933 - RNA, 19 nt, Human
cgauucuucugcuucagcc

SEQ ID NO: 3325934 - RNA, 19 nt, Human
cgaucuggguucacugcaa

SEQ ID NO: 3325935 - RNA, 23 nt, Human
cgcacuucgggaggucgaggcag

SEQ ID NO: 3325936 - RNA, 12 nt, Human
cgauuucuguuu

SEQ ID NO: 3325937 - RNA, 15 nt, Human
ccuuuguauucucuc

SEQ ID NO: 3325938 - RNA, 20 nt, Human
ccuuuguauucucuccugua

SEQ ID NO: 3325939 - RNA, 18 nt, Human
ccuuuguauucucuccug

SEQ ID NO: 3325940 - RNA, 18 nt, Human
cgaggccuucucugaagg

SEQ ID NO: 3325941 - RNA, 19 nt, Human
cgaggccuucucugaagga

SEQ ID NO: 3325942 - RNA, 13 nt, Human
cgaggacagggag

SEQ ID NO: 3325943 - RNA, 12 nt, Human
cgaggacaggga

SEQ ID NO: 3325944 - RNA, 13 nt, Human
ccuuuaagagaaa

SEQ ID NO: 3325945 - RNA, 20 nt, Human
ccuuguggucccaccccaca

SEQ ID NO: 3325946 - RNA, 19 nt, Human
ccuuguggucccaccccac

SEQ ID NO: 3325947 - RNA, 16 nt, Human
ccuuguggucccaccc

SEQ ID NO: 3325948 - RNA, 12 nt, Human
ccuuggcugcag

SEQ ID NO: 3325949 - RNA, 13 nt, Human
ccuuggcugcagg

SEQ ID NO: 3325950 - RNA, 16 nt, Human
ccuuugcuugaaagaa

SEQ ID NO: 3325951 - RNA, 23 nt, Human
ccuuugacgccaucccagcccca

SEQ ID NO: 3325952 - RNA, 16 nt, Human
cgcgugcacacaccag

SEQ ID NO: 3325953 - RNA, 19 nt, Human
cgcgugcacacaccagagc

SEQ ID NO: 3325954 - RNA, 20 nt, Human
cgcgugcacacaccagagcc

SEQ ID NO: 3325955 - RNA, 16 nt, Human
cgcuaagagggaggga

SEQ ID NO: 3325956 - RNA, 15 nt, Human
cgcuaagagggaggg

SEQ ID NO: 3325957 - RNA, 14 nt, Human
cgcuaagagggagg

SEQ ID NO: 3325958 - RNA, 14 nt, Human
cgcagacaggacca

SEQ ID NO: 3325959 - RNA, 13 nt, Human
cgcagacaggacc

SEQ ID NO: 3325960 - RNA, 15 nt, Human
cgcccccacugguga

SEQ ID NO: 3325961 - RNA, 15 nt, Human
cgcgacaaugcaaac

SEQ ID NO: 3325962 - RNA, 17 nt, Human
cgcgacaaugcaaacca

SEQ ID NO: 3325963 - RNA, 16 nt, Human
cgcgacaaugcaaacc

SEQ ID NO: 3325964 - RNA, 23 nt, Human
cggugcuaucucccccagcccca

SEQ ID NO: 3325965 - RNA, 22 nt, Human
cggugcuaucucccccagcccc

SEQ ID NO: 3325966 - RNA, 20 nt, Human
cgugcacacaccagagccca

SEQ ID NO: 3325967 - RNA, 21 nt, Human
cgugcacacaccagagcccac

SEQ ID NO: 3325968 - RNA, 22 nt, Human
cgugcaguggugcgaucugggu

SEQ ID NO: 3325969 - RNA, 22 nt, Human
cgugcacacaccagagcccacc

SEQ ID NO: 3325970 - RNA, 18 nt, Human
cgugcauaccacuuuugu

SEQ ID NO: 3325971 - RNA, 14 nt, Human
cgugcauaccacuu

SEQ ID NO: 3325972 - RNA, 19 nt, Human
cgugcauaccacuuuuguu

SEQ ID NO: 3325973 - RNA, 14 nt, Human
cguccccugucccc

SEQ ID NO: 3325974 - RNA, 11 nt, Human
cguccccuguc

SEQ ID NO: 3325975 - RNA, 14 nt, Human
cgucuaccugaggg

SEQ ID NO: 3325976 - RNA, 13 nt, Human
cgucugacaggca

SEQ ID NO: 3325977 - RNA, 15 nt, Human
cguggcugcuucaag

SEQ ID NO: 3325978 - RNA, 14 nt, Human
cguggcugcuucaa

SEQ ID NO: 3325979 - RNA, 12 nt, Human
cguggcugcuuc

SEQ ID NO: 3325980 - RNA, 21 nt, Human
cguuucuaaaggcuaccuuug

SEQ ID NO: 3325981 - RNA, 19 nt, Human
cguuucuaaaggcuaccuu

SEQ ID NO: 3325982 - RNA, 20 nt, Human
cguuucuaugacacaugcaa

SEQ ID NO: 3325983 - RNA, 17 nt, Human
ccucuuaugggcugggu

SEQ ID NO: 3325984 - RNA, 19 nt, Human
ccucuuuggucuacacugu

SEQ ID NO: 3325985 - RNA, 22 nt, Human
ccucuuuggucuacacugugcu

SEQ ID NO: 3325986 - RNA, 15 nt, Human
ccugaagucacacag

SEQ ID NO: 3325987 - RNA, 13 nt, Human
ccugaaggccccg

SEQ ID NO: 3325988 - RNA, 16 nt, Human
ccugaagucacacagu

SEQ ID NO: 3325989 - RNA, 17 nt, Human
ccugaagucacacagug

SEQ ID NO: 3325990 - RNA, 14 nt, Human
ccucuuaugggcug

SEQ ID NO: 3325991 - RNA, 16 nt, Human
ccucuuaugggcuggg

SEQ ID NO: 3325992 - RNA, 15 nt, Human
ccucuuaugggcugg

SEQ ID NO: 3325993 - RNA, 14 nt, Human
ccucuuagaaaaac

SEQ ID NO: 3325994 - RNA, 23 nt, Human
ccucuguacagagcccacgcccc

SEQ ID NO: 3325995 - RNA, 18 nt, Human
ccucuguacagagcccac

SEQ ID NO: 3325996 - RNA, 17 nt, Human
ccucuguacagagccca

SEQ ID NO: 3325997 - RNA, 16 nt, Human
ccucuguacagagccc

SEQ ID NO: 3325998 - RNA, 15 nt, Human
ccucuguacagagcc

SEQ ID NO: 3325999 - RNA, 14 nt, Human
ccucuguacagagc

SEQ ID NO: 3326000 - RNA, 14 nt, Human
ccugaggcccuucu

SEQ ID NO: 3326001 - RNA, 14 nt, Human
ccugaugcuucuuc

SEQ ID NO: 3326002 - RNA, 22 nt, Human
ccugaugcuucuucagagacuc

SEQ ID NO: 3326003 - RNA, 18 nt, Human
ccugaugcuucuucagag

SEQ ID NO: 3326004 - RNA, 17 nt, Human
ccugaugcuucuucaga

SEQ ID NO: 3326005 - RNA, 23 nt, Human
ccugauugugucucuugguccug

SEQ ID NO: 3326006 - RNA, 19 nt, Human
ccugauugugucucuuggu

SEQ ID NO: 3326007 - RNA, 23 nt, Human
ccugaggcccuucucuccagccc

SEQ ID NO: 3326008 - RNA, 22 nt, Human
ccugaggcccuucucuccagcc

SEQ ID NO: 3326009 - RNA, 21 nt, Human
ccugaggcccuucucuccagc

SEQ ID NO: 3326010 - RNA, 20 nt, Human
ccugaggcccuucucuccag

SEQ ID NO: 3326011 - RNA, 19 nt, Human
ccugaggcccuucucucca

SEQ ID NO: 3326012 - RNA, 17 nt, Human
ccugaggcccuucucuc

SEQ ID NO: 3326013 - RNA, 16 nt, Human
ccugaggcccuucucu

SEQ ID NO: 3326014 - RNA, 16 nt, Human
ccugacaacacucauu

SEQ ID NO: 3326015 - RNA, 15 nt, Human
ccugacaacacucau

SEQ ID NO: 3326016 - RNA, 14 nt, Human
ccugacaacacuca

SEQ ID NO: 3326017 - RNA, 12 nt, Human
ccugacaacacu

SEQ ID NO: 3326018 - RNA, 13 nt, Human
ccugaggcccaga

SEQ ID NO: 3326019 - RNA, 12 nt, Human
ccugaggcccag

SEQ ID NO: 3326020 - RNA, 13 nt, Human
ccuccugugugug

SEQ ID NO: 3326021 - RNA, 15 nt, Human
ccuccugugugugcg

SEQ ID NO: 3326022 - RNA, 22 nt, Human
ccuccugugugugcgccuacag

SEQ ID NO: 3326023 - RNA, 13 nt, Human
ccuccugggcuaa

SEQ ID NO: 3326024 - RNA, 16 nt, Human
ccucccucccucuuuc

SEQ ID NO: 3326025 - RNA, 13 nt, Human
ccucccucuuucc

SEQ ID NO: 3326026 - RNA, 13 nt, Human
ccucccucccucu

SEQ ID NO: 3326027 - RNA, 15 nt, Human
ccucccucccucuuu

SEQ ID NO: 3326028 - RNA, 16 nt, Human
ccucagcauccuggca

SEQ ID NO: 3326029 - RNA, 17 nt, Human
ccucagcauccuggcac

SEQ ID NO: 3326030 - RNA, 14 nt, Human
ccucagcauccugg

SEQ ID NO: 3326031 - RNA, 14 nt, Human
ccucagggucccug

SEQ ID NO: 3326032 - RNA, 11 nt, Human
ccucaggccug

SEQ ID NO: 3326033 - RNA, 10 nt, Human
ccucaggccu

SEQ ID NO: 3326034 - RNA, 21 nt, Human
ccucaggccugggggcugggc

SEQ ID NO: 3326035 - RNA, 14 nt, Human
ccucaggccugggg

SEQ ID NO: 3326036 - RNA, 16 nt, Human
ccucaggugagaagca

SEQ ID NO: 3326037 - RNA, 22 nt, Human
ccucagggucccugguggcagc

SEQ ID NO: 3326038 - RNA, 22 nt, Human
ccucaggugauccacccaccuc

SEQ ID NO: 3326039 - RNA, 22 nt, Human
ccucaggugagaagcagaggaa

SEQ ID NO: 3326040 - RNA, 17 nt, Human
ccucaggugauccaccc

SEQ ID NO: 3326041 - RNA, 19 nt, Human
ccucaggugauccacccac

SEQ ID NO: 3326042 - RNA, 15 nt, Human
ccucagucuggcccu

SEQ ID NO: 3326043 - RNA, 23 nt, Human
ccuccugugugugcgccuacagg

SEQ ID NO: 3326044 - RNA, 12 nt, Human
ccucucccauca

SEQ ID NO: 3326045 - RNA, 16 nt, Human
ccucugacacacagcu

SEQ ID NO: 3326046 - RNA, 15 nt, Human
ccucugacacacagc

SEQ ID NO: 3326047 - RNA, 23 nt, Human
ccucugaaaaccaauguucucuc

SEQ ID NO: 3326048 - RNA, 12 nt, Human
ccucugggacug

SEQ ID NO: 3326049 - RNA, 17 nt, Human
ccucugacacacagcuc

SEQ ID NO: 3326050 - RNA, 15 nt, Human
ccucugcacaagcug

SEQ ID NO: 3326051 - RNA, 11 nt, Human
ccucugcacaa

SEQ ID NO: 3326052 - RNA, 19 nt, Human
ccucugcacaagcugcacc

SEQ ID NO: 3326053 - RNA, 17 nt, Human
ccucugcacaagcugca

SEQ ID NO: 3326054 - RNA, 20 nt, Human
ccucugcacaagcugcaccc

SEQ ID NO: 3326055 - RNA, 21 nt, Human
ccucugcacuccccugcuggg

SEQ ID NO: 3326056 - RNA, 20 nt, Human
ccucugcacuccccugcugg

SEQ ID NO: 3326057 - RNA, 19 nt, Human
ccucugcacuccccugcug

SEQ ID NO: 3326058 - RNA, 14 nt, Human
ccucugcacucccc

SEQ ID NO: 3326059 - RNA, 22 nt, Human
ccucugcacuccccugcugggu

SEQ ID NO: 3326060 - RNA, 19 nt, Human
ccucugcagcaauaaagca

SEQ ID NO: 3326061 - RNA, 13 nt, Human
ccggcuggccugg

SEQ ID NO: 3326062 - RNA, 15 nt, Human
ccgggcacucagaag

SEQ ID NO: 3326063 - RNA, 12 nt, Human
ccggcuggccug

SEQ ID NO: 3326064 - RNA, 14 nt, Human
ccgcuggggccagu

SEQ ID NO: 3326065 - RNA, 23 nt, Human
ccgcuuucuacccagcgagcccu

SEQ ID NO: 3326066 - RNA, 17 nt, Human
ccucaccuuucccaucu

SEQ ID NO: 3326067 - RNA, 15 nt, Human
ccucaccccacugug

SEQ ID NO: 3326068 - RNA, 22 nt, Human
ccucacaguccuuaccagcaga

SEQ ID NO: 3326069 - RNA, 20 nt, Human
ccucacaguccuuaccagca

SEQ ID NO: 3326070 - RNA, 12 nt, Human
ccucaccccacu

SEQ ID NO: 3326071 - RNA, 23 nt, Human
ccucaagugauucuccugccuca

SEQ ID NO: 3326072 - RNA, 17 nt, Human
ccucacaguccuuacca

SEQ ID NO: 3326073 - RNA, 19 nt, Human
cccuuuuuuggcugcugaa

SEQ ID NO: 3326074 - RNA, 22 nt, Human
ccgagauagccaaggccaaagg

SEQ ID NO: 3326075 - RNA, 19 nt, Human
ccgagauagccaaggccaa

SEQ ID NO: 3326076 - RNA, 18 nt, Human
ccgagauagccaaggcca

SEQ ID NO: 3326077 - RNA, 17 nt, Human
ccgagaaggaagccucc

SEQ ID NO: 3326078 - RNA, 18 nt, Human
cccuuuuuuggcugcuga

SEQ ID NO: 3326079 - RNA, 17 nt, Human
cccuuuuuuggcugcug

SEQ ID NO: 3326080 - RNA, 13 nt, Human
cccuuuucuguuu

SEQ ID NO: 3326081 - RNA, 11 nt, Human
cccuuuuccuu

SEQ ID NO: 3326082 - RNA, 18 nt, Human
ccgagaucacgccacugc

SEQ ID NO: 3326083 - RNA, 17 nt, Human
ccgaggccuucucugaa

SEQ ID NO: 3326084 - RNA, 18 nt, Human
cccuugccgucuaccuga

SEQ ID NO: 3326085 - RNA, 17 nt, Human
cccuugccgucuaccug

SEQ ID NO: 3326086 - RNA, 20 nt, Human
cccuuugacgccaucccagc

SEQ ID NO: 3326087 - RNA, 18 nt, Human
cccuuguggucccacccc

SEQ ID NO: 3326088 - RNA, 16 nt, Human
cccuuguggucccacc

SEQ ID NO: 3326089 - RNA, 14 nt, Human
cccuugugguccca

SEQ ID NO: 3326090 - RNA, 18 nt, Human
cccuuggggagcaggcuc

SEQ ID NO: 3326091 - RNA, 18 nt, Human
cccugugggcccccaaau

SEQ ID NO: 3326092 - RNA, 15 nt, Human
cccuguuuguuucug

SEQ ID NO: 3326093 - RNA, 15 nt, Human
cccugugggccccca

SEQ ID NO: 3326094 - RNA, 16 nt, Human
cccugugggcccccaa

SEQ ID NO: 3326095 - RNA, 17 nt, Human
ccccucagggucccugg

SEQ ID NO: 3326096 - RNA, 20 nt, Human
ccccucagggucccuggugg

SEQ ID NO: 3326097 - RNA, 18 nt, Human
ccccucagggucccuggu

SEQ ID NO: 3326098 - RNA, 15 nt, Human
cccugguggcagugg

SEQ ID NO: 3326099 - RNA, 16 nt, Human
cccugguggcaguggg

SEQ ID NO: 3326100 - RNA, 19 nt, Human
cccugguggcagugggagc

SEQ ID NO: 3326101 - RNA, 16 nt, Human
ccccucagggucccug

SEQ ID NO: 3326102 - RNA, 22 nt, Human
ccccaggaggccagccuugacc

SEQ ID NO: 3326103 - RNA, 21 nt, Human
ccccaggaggccagccuugac

SEQ ID NO: 3326104 - RNA, 15 nt, Human
ccccaggaggccagc

SEQ ID NO: 3326105 - RNA, 14 nt, Human
ccccaggaggccag

SEQ ID NO: 3326106 - RNA, 13 nt, Human
ccccaggaggcca

SEQ ID NO: 3326107 - RNA, 13 nt, Human
ccccacuggugac

SEQ ID NO: 3326108 - RNA, 12 nt, Human
ccccacugguga

SEQ ID NO: 3326109 - RNA, 12 nt, Human
cccccagcccca

SEQ ID NO: 3326110 - RNA, 21 nt, Human
cccccgcugucagccauuccu

SEQ ID NO: 3326111 - RNA, 12 nt, Human
cauuuaaaagau

SEQ ID NO: 3326112 - RNA, 16 nt, Human
cauuuaaaagauacag

SEQ ID NO: 3326113 - RNA, 15 nt, Human
cauuuaaaagauaca

SEQ ID NO: 3326114 - RNA, 12 nt, Human
cauuuccugugu

SEQ ID NO: 3326115 - RNA, 13 nt, Human
cauuuccuguguc

SEQ ID NO: 3326116 - RNA, 17 nt, Human
cauuguuggccaaagcc

SEQ ID NO: 3326117 - RNA, 18 nt, Human
cauuguuggccaaagcca

SEQ ID NO: 3326118 - RNA, 15 nt, Human
cacccaagggccugg

SEQ ID NO: 3326119 - RNA, 14 nt, Human
cacccaagggccug

SEQ ID NO: 3326120 - RNA, 13 nt, Human
cacccaagggccu

SEQ ID NO: 3326121 - RNA, 17 nt, Human
ccaaacucaccugcccc

SEQ ID NO: 3326122 - RNA, 14 nt, Human
cauuugcuccuuuc

SEQ ID NO: 3326123 - RNA, 13 nt, Human
cauuugcuccuuu

SEQ ID NO: 3326124 - RNA, 22 nt, Human
cauuuguuugaacugauaaaga

SEQ ID NO: 3326125 - RNA, 20 nt, Human
cauuuguuugaacugauaaa

SEQ ID NO: 3326126 - RNA, 17 nt, Human
cauuuguuugaacugau

SEQ ID NO: 3326127 - RNA, 16 nt, Human
cauuugagcagggcuc

SEQ ID NO: 3326128 - RNA, 20 nt, Human
cauuugagcagggcucagcg

SEQ ID NO: 3326129 - RNA, 17 nt, Human
cauuugagcagggcuca

SEQ ID NO: 3326130 - RNA, 18 nt, Human
cauuugagcagggcucag

SEQ ID NO: 3326131 - RNA, 20 nt, Human
cauuugaaaauuuugauguu

SEQ ID NO: 3326132 - RNA, 22 nt, Human
cauuugaaaauuuugauguuuu

SEQ ID NO: 3326133 - RNA, 14 nt, Human
ccaagcucccaggc

SEQ ID NO: 3326134 - RNA, 17 nt, Human
ccaaggccaaaggaagc

SEQ ID NO: 3326135 - RNA, 22 nt, Human
ccaagcucccaggcauucccca

SEQ ID NO: 3326136 - RNA, 16 nt, Human
ccaagcucccaggcau

SEQ ID NO: 3326137 - RNA, 15 nt, Human
ccaagcucccaggca

SEQ ID NO: 3326138 - RNA, 20 nt, Human
ccaagucaagugaaaaagga

SEQ ID NO: 3326139 - RNA, 13 nt, Human
ccaaggugggagg

SEQ ID NO: 3326140 - RNA, 23 nt, Human
ccaagguuuggggaagaacgaag

SEQ ID NO: 3326141 - RNA, 15 nt, Human
ccaagggccuggccu

SEQ ID NO: 3326142 - RNA, 16 nt, Human
ccaaggccaaaggaag

SEQ ID NO: 3326143 - RNA, 21 nt, Human
ccaaggccaaaggaagcacau

SEQ ID NO: 3326144 - RNA, 18 nt, Human
ccaaggccaaaggaagca

SEQ ID NO: 3326145 - RNA, 18 nt, Human
ccaagggccuggccugag

SEQ ID NO: 3326146 - RNA, 16 nt, Human
ccaagggccuggccug

SEQ ID NO: 3326147 - RNA, 19 nt, Human
ccaagggccuggccugagc

SEQ ID NO: 3326148 - RNA, 22 nt, Human
ccaaggggaauguuugccucug

SEQ ID NO: 3326149 - RNA, 18 nt, Human
ccaaaguacacuguuuca

SEQ ID NO: 3326150 - RNA, 15 nt, Human
ccaaaguacacuguu

SEQ ID NO: 3326151 - RNA, 22 nt, Human
ccaacauacucccaucugugaa

SEQ ID NO: 3326152 - RNA, 21 nt, Human
ccaacauacucccaucuguga

SEQ ID NO: 3326153 - RNA, 16 nt, Human
ccaacauacucccauc

SEQ ID NO: 3326154 - RNA, 20 nt, Human
ccaacauacucccaucugug

SEQ ID NO: 3326155 - RNA, 19 nt, Human
ccaacauacucccaucugu

SEQ ID NO: 3326156 - RNA, 18 nt, Human
ccaacauacucccaucug

SEQ ID NO: 3326157 - RNA, 17 nt, Human
ccaacauacucccaucu

SEQ ID NO: 3326158 - RNA, 23 nt, Human
ccaaaggaagcacaugccucucu

SEQ ID NO: 3326159 - RNA, 15 nt, Human
ccaaaggaagcacau

SEQ ID NO: 3326160 - RNA, 21 nt, Human
ccaaagcuaggccuggccaga

SEQ ID NO: 3326161 - RNA, 16 nt, Human
ccaaagcuaggccugg

SEQ ID NO: 3326162 - RNA, 17 nt, Human
ccaaagcuaggccuggc

SEQ ID NO: 3326163 - RNA, 15 nt, Human
ccaaagcuaggccug

SEQ ID NO: 3326164 - RNA, 19 nt, Human
ccaaagcagugcaugcugu

SEQ ID NO: 3326165 - RNA, 19 nt, Human
ccaaagccaaagcuaggcc

SEQ ID NO: 3326166 - RNA, 23 nt, Human
ccaaagcagugcaugcugucccu

SEQ ID NO: 3326167 - RNA, 22 nt, Human
ccaaagccuccuccagccgcca

SEQ ID NO: 3326168 - RNA, 17 nt, Human
ccaaagccuccuccagc

SEQ ID NO: 3326169 - RNA, 20 nt, Human
ccaaacucaccugccccuca

SEQ ID NO: 3326170 - RNA, 20 nt, Human
ccaagaagcccaggaaaggc

SEQ ID NO: 3326171 - RNA, 19 nt, Human
ccaagaagcccaggaaagg

SEQ ID NO: 3326172 - RNA, 12 nt, Human
ccaacccucauc

SEQ ID NO: 3326173 - RNA, 15 nt, Human
ccaagaagcccagga

SEQ ID NO: 3326174 - RNA, 21 nt, Human
ccacacccagcccacuucugc

SEQ ID NO: 3326175 - RNA, 22 nt, Human
ccacacccagcccacuucugcc

SEQ ID NO: 3326176 - RNA, 20 nt, Human
ccacacccagcccacuucug

SEQ ID NO: 3326177 - RNA, 15 nt, Human
ccacacccagcccac

SEQ ID NO: 3326178 - RNA, 16 nt, Human
ccacaggaucagucug

SEQ ID NO: 3326179 - RNA, 16 nt, Human
ccacaugugcacaugc

SEQ ID NO: 3326180 - RNA, 16 nt, Human
ccacauuccugaugcu

SEQ ID NO: 3326181 - RNA, 19 nt, Human
ccacaucuugcucugcuga

SEQ ID NO: 3326182 - RNA, 18 nt, Human
ccacaucuugcucugcug

SEQ ID NO: 3326183 - RNA, 17 nt, Human
ccacaucuugcucugcu

SEQ ID NO: 3326184 - RNA, 21 nt, Human
ccaccaacauacucccaucug

SEQ ID NO: 3326185 - RNA, 21 nt, Human
ccacccaggagccccgaggcc

SEQ ID NO: 3326186 - RNA, 23 nt, Human
ccacccaggagccccgaggccuu

SEQ ID NO: 3326187 - RNA, 17 nt, Human
ccacccccacccaaggg

SEQ ID NO: 3326188 - RNA, 23 nt, Human
ccacugcacuccagccuggguga

SEQ ID NO: 3326189 - RNA, 14 nt, Human
ccacuucagcugac

SEQ ID NO: 3326190 - RNA, 13 nt, Human
ccacuucagcuga

SEQ ID NO: 3326191 - RNA, 22 nt, Human
ccagaaguuugagaucagccug

SEQ ID NO: 3326192 - RNA, 23 nt, Human
ccagaaguuugagaucagccugg

SEQ ID NO: 3326193 - RNA, 19 nt, Human
ccagaauuucccaaagcag

SEQ ID NO: 3326194 - RNA, 12 nt, Human
ccagaauuuccc

SEQ ID NO: 3326195 - RNA, 18 nt, Human
ccagaauuucccaaagca

SEQ ID NO: 3326196 - RNA, 21 nt, Human
ccagaauuucccaaagcagug

SEQ ID NO: 3326197 - RNA, 21 nt, Human
ccagacaccuugacagggcac

SEQ ID NO: 3326198 - RNA, 20 nt, Human
ccagacaccuugacagggca

SEQ ID NO: 3326199 - RNA, 15 nt, Human
ccaccccacacacgc

SEQ ID NO: 3326200 - RNA, 16 nt, Human
ccacgcuggagugcag

SEQ ID NO: 3326201 - RNA, 13 nt, Human
ccacgcuggagug

SEQ ID NO: 3326202 - RNA, 15 nt, Human
ccacccccacccaag

SEQ ID NO: 3326203 - RNA, 18 nt, Human
ccacgcuggagugcagug

SEQ ID NO: 3326204 - RNA, 16 nt, Human
ccacggccaggccaga

SEQ ID NO: 3326205 - RNA, 18 nt, Human
ccacggccaggccagagg

SEQ ID NO: 3326206 - RNA, 23 nt, Human
ccacggccaggccagagggagug

SEQ ID NO: 3326207 - RNA, 17 nt, Human
ccacuacauucuguuaa

SEQ ID NO: 3326208 - RNA, 16 nt, Human
ccacuacauucuguua

SEQ ID NO: 3326209 - RNA, 14 nt, Human
ccacuacauucugu

SEQ ID NO: 3326210 - RNA, 15 nt, Human
ccacuacauucuguu

SEQ ID NO: 3326211 - RNA, 11 nt, Human
ccacuacauuc

SEQ ID NO: 3326212 - RNA, 20 nt, Human
cccaaaacucuccucugcug

SEQ ID NO: 3326213 - RNA, 22 nt, Human
ccauuuugggguacccacugcu

SEQ ID NO: 3326214 - RNA, 20 nt, Human
ccauuuugggguacccacug

SEQ ID NO: 3326215 - RNA, 23 nt, Human
ccauuuuggauucuuauggacaa

SEQ ID NO: 3326216 - RNA, 15 nt, Human
cccaaagaugcagcc

SEQ ID NO: 3326217 - RNA, 12 nt, Human
cccaaagaugca

SEQ ID NO: 3326218 - RNA, 21 nt, Human
ccauucugccugcccaggccc

SEQ ID NO: 3326219 - RNA, 14 nt, Human
ccauucuccaccug

SEQ ID NO: 3326220 - RNA, 19 nt, Human
ccauucugccugcccaggc

SEQ ID NO: 3326221 - RNA, 20 nt, Human
ccauucugccugcccaggcc

SEQ ID NO: 3326222 - RNA, 16 nt, Human
ccauucugccugccca

SEQ ID NO: 3326223 - RNA, 17 nt, Human
ccauucuccaccugcca

SEQ ID NO: 3326224 - RNA, 17 nt, Human
ccauucugccugcccag

SEQ ID NO: 3326225 - RNA, 18 nt, Human
ccauucugccugcccagg

SEQ ID NO: 3326226 - RNA, 16 nt, Human
ccauucuccaccugcc

SEQ ID NO: 3326227 - RNA, 15 nt, Human
ccauucuccaccugc

SEQ ID NO: 3326228 - RNA, 14 nt, Human
ccauggacuuuguu

SEQ ID NO: 3326229 - RNA, 13 nt, Human
ccauggacuuugu

SEQ ID NO: 3326230 - RNA, 18 nt, Human
ccaugauguuuuccauga

SEQ ID NO: 3326231 - RNA, 21 nt, Human
ccaugauuaaccacuucagcu

SEQ ID NO: 3326232 - RNA, 19 nt, Human
ccaugauuaaccacuucag

SEQ ID NO: 3326233 - RNA, 13 nt, Human
ccaugcugcccug

SEQ ID NO: 3326234 - RNA, 11 nt, Human
ccaugcugccc

SEQ ID NO: 3326235 - RNA, 14 nt, Human
ccaugcugcccugu

SEQ ID NO: 3326236 - RNA, 22 nt, Human
ccaucauugaaaucuuuuugcu

SEQ ID NO: 3326237 - RNA, 17 nt, Human
ccaucauugaaaucuuu

SEQ ID NO: 3326238 - RNA, 19 nt, Human
ccauccucuguacagagcc

SEQ ID NO: 3326239 - RNA, 12 nt, Human
ccauccucugua

SEQ ID NO: 3326240 - RNA, 17 nt, Human
ccagugaggcucugccc

SEQ ID NO: 3326241 - RNA, 20 nt, Human
ccagugaggcucugcccuug

SEQ ID NO: 3326242 - RNA, 19 nt, Human
ccagugaggcucugcccuu

SEQ ID NO: 3326243 - RNA, 18 nt, Human
ccagugaggcucugcccu

SEQ ID NO: 3326244 - RNA, 20 nt, Human
ccauccucuguacagagccc

SEQ ID NO: 3326245 - RNA, 23 nt, Human
ccaguaaaugggggugcauuuga

SEQ ID NO: 3326246 - RNA, 14 nt, Human
ccagguucagcuug

SEQ ID NO: 3326247 - RNA, 19 nt, Human
ccaggugcuaggaacacuc

SEQ ID NO: 3326248 - RNA, 20 nt, Human
ccaggcuguaucccaugagc

SEQ ID NO: 3326249 - RNA, 14 nt, Human
ccaggcuggucuca

SEQ ID NO: 3326250 - RNA, 19 nt, Human
ccaggcuggucucaaacuc

SEQ ID NO: 3326251 - RNA, 13 nt, Human
ccaggaggccagc

SEQ ID NO: 3326252 - RNA, 12 nt, Human
ccaggaggccag

SEQ ID NO: 3326253 - RNA, 12 nt, Human
ccaggagccucc

SEQ ID NO: 3326254 - RNA, 18 nt, Human
ccaggagccuccugcccu

SEQ ID NO: 3326255 - RNA, 14 nt, Human
ccaggagccuccug

SEQ ID NO: 3326256 - RNA, 13 nt, Human
ccaggagccuccu

SEQ ID NO: 3326257 - RNA, 22 nt, Human
ccaggcauuccccaggaggcca

SEQ ID NO: 3326258 - RNA, 23 nt, Human
ccaggcauuccccaggaggccag

SEQ ID NO: 3326259 - RNA, 24 nt, Human
ccaggcauuccccaggaggccagc

SEQ ID NO: 3326260 - RNA, 14 nt, Human
ccaggcauucccca

SEQ ID NO: 3326261 - RNA, 13 nt, Human
ccaggcauggugg

SEQ ID NO: 3326262 - RNA, 15 nt, Human
ccaggagccccgagg

SEQ ID NO: 3326263 - RNA, 16 nt, Human
ccaggagcagccacau

SEQ ID NO: 3326264 - RNA, 15 nt, Human
ccaggagcagccaca

SEQ ID NO: 3326265 - RNA, 11 nt, Human
ccagcucuggu

SEQ ID NO: 3326266 - RNA, 13 nt, Human
ccagcucuggucc

SEQ ID NO: 3326267 - RNA, 12 nt, Human
ccagcucugguc

SEQ ID NO: 3326268 - RNA, 14 nt, Human
ccagcgagcccugg

SEQ ID NO: 3326269 - RNA, 13 nt, Human
ccagcgagcccug

SEQ ID NO: 3326270 - RNA, 15 nt, Human
ccagcgagcccuggu

SEQ ID NO: 3326271 - RNA, 16 nt, Human
ccagcgagcccuggug

SEQ ID NO: 3326272 - RNA, 22 nt, Human
ccagagcccaccuuggcucaag

SEQ ID NO: 3326273 - RNA, 16 nt, Human
ccagagcccaccuugg

SEQ ID NO: 3326274 - RNA, 20 nt, Human
ccagccuugaccauucucca

SEQ ID NO: 3326275 - RNA, 19 nt, Human
ccagccuugaccauucucc

SEQ ID NO: 3326276 - RNA, 23 nt, Human
ccagcugcuugggcuucauccuc

SEQ ID NO: 3326277 - RNA, 20 nt, Human
ccagcugcuugggcuucauc

SEQ ID NO: 3326278 - RNA, 22 nt, Human
ccagcucugguccauagagagc

SEQ ID NO: 3326279 - RNA, 21 nt, Human
ccagcucugguccauagagag

SEQ ID NO: 3326280 - RNA, 17 nt, Human
ccagcucugguccauag

SEQ ID NO: 3326281 - RNA, 14 nt, Human
ccagcucuggucca

SEQ ID NO: 3326282 - RNA, 22 nt, Human
ccaggaagccagcaggcucuca

SEQ ID NO: 3326283 - RNA, 20 nt, Human
ccaggaagccagcaggcucu

SEQ ID NO: 3326284 - RNA, 17 nt, Human
cccaagggccuggccug

SEQ ID NO: 3326285 - RNA, 23 nt, Human
cccaaauggaaaugggcagagca

SEQ ID NO: 3326286 - RNA, 23 nt, Human
cccaagggccuggccugagcugg

SEQ ID NO: 3326287 - RNA, 19 nt, Human
cccaagggccuggccugag

SEQ ID NO: 3326288 - RNA, 18 nt, Human
cccaagggccuggccuga

SEQ ID NO: 3326289 - RNA, 23 nt, Human
cccaaugcacuuuguucuggcuc

SEQ ID NO: 3326290 - RNA, 20 nt, Human
cccagauugcaacaggcugg

SEQ ID NO: 3326291 - RNA, 21 nt, Human
cccagauugcaacaggcuggg

SEQ ID NO: 3326292 - RNA, 22 nt, Human
cccagauugcaacaggcugggc

SEQ ID NO: 3326293 - RNA, 16 nt, Human
cccagcaagugagagc

SEQ ID NO: 3326294 - RNA, 18 nt, Human
cccagcaagugagagcug

SEQ ID NO: 3326295 - RNA, 18 nt, Human
cccagagggccugcaagg

SEQ ID NO: 3326296 - RNA, 20 nt, Human
cccagagggccugcaaggga

SEQ ID NO: 3326297 - RNA, 11 nt, Human
cccagccccuu

SEQ ID NO: 3326298 - RNA, 19 nt, Human
cccagcaagugagagcugg

SEQ ID NO: 3326299 - RNA, 20 nt, Human
cccagcaagugagagcuggg

SEQ ID NO: 3326300 - RNA, 21 nt, Human
cccagcaagugagagcugggu

SEQ ID NO: 3326301 - RNA, 22 nt, Human
cccagcaagugagagcugggug

SEQ ID NO: 3326302 - RNA, 12 nt, Human
cccagccugcua

SEQ ID NO: 3326303 - RNA, 19 nt, Human
cccagcgagcccugguggc

SEQ ID NO: 3326304 - RNA, 23 nt, Human
cccagcgagcccugguggcagug

SEQ ID NO: 3326305 - RNA, 17 nt, Human
cccagcgagcccuggug

SEQ ID NO: 3326306 - RNA, 18 nt, Human
cccagcgagcccuggugg

SEQ ID NO: 3326307 - RNA, 15 nt, Human
cccagcgagcccugg

SEQ ID NO: 3326308 - RNA, 22 nt, Human
cccaggugcuaggaacacuccu

SEQ ID NO: 3326309 - RNA, 23 nt, Human
cccaggugcuaggaacacuccuu

SEQ ID NO: 3326310 - RNA, 20 nt, Human
cccagucuggaaugcagugg

SEQ ID NO: 3326311 - RNA, 13 nt, Human
cccagugcccaca

SEQ ID NO: 3326312 - RNA, 18 nt, Human
cccaggccuccuacagcu

SEQ ID NO: 3326313 - RNA, 17 nt, Human
cccaggccuccuacagc

SEQ ID NO: 3326314 - RNA, 18 nt, Human
cccaggcauuccccagga

SEQ ID NO: 3326315 - RNA, 21 nt, Human
cccaggcauuccccaggaggc

SEQ ID NO: 3326316 - RNA, 20 nt, Human
cccaggcauuccccaggagg

SEQ ID NO: 3326317 - RNA, 23 nt, Human
cccaggcauuccccaggaggcca

SEQ ID NO: 3326318 - RNA, 22 nt, Human
cccaggcauuccccaggaggcc

SEQ ID NO: 3326319 - RNA, 11 nt, Human
cccaggccccu

SEQ ID NO: 3326320 - RNA, 16 nt, Human
cccaggccccugccac

SEQ ID NO: 3326321 - RNA, 18 nt, Human
cccaggccccugccaccc

SEQ ID NO: 3326322 - RNA, 21 nt, Human
cccaggccccugccacccugg

SEQ ID NO: 3326323 - RNA, 22 nt, Human
cccaggccccugccacccuggg

SEQ ID NO: 3326324 - RNA, 21 nt, Human
cccaggagccccgaggccuuc

SEQ ID NO: 3326325 - RNA, 18 nt, Human
cccaggagccccgaggcc

SEQ ID NO: 3326326 - RNA, 22 nt, Human
cccaggaggccagccuugacca

SEQ ID NO: 3326327 - RNA, 18 nt, Human
cccaggaggccagccuug

SEQ ID NO: 3326328 - RNA, 11 nt, Human
cccaggcaggu

SEQ ID NO: 3326329 - RNA, 13 nt, Human
cccaggcaggucu

SEQ ID NO: 3326330 - RNA, 17 nt, Human
ccccaggaggccagccu

SEQ ID NO: 3326331 - RNA, 15 nt, Human
cccagugcccacagg

SEQ ID NO: 3326332 - RNA, 20 nt, Human
cccagugcccacaggaucag

SEQ ID NO: 3326333 - RNA, 17 nt, Human
cccagugccgagaagga

SEQ ID NO: 3326334 - RNA, 18 nt, Human
cccagugccgagaaggaa

SEQ ID NO: 3326335 - RNA, 16 nt, Human
cccaugcugcccugug

SEQ ID NO: 3326336 - RNA, 15 nt, Human
cccaugcugcccugu

SEQ ID NO: 3326337 - RNA, 17 nt, Human
cccaugcugcccuguga

SEQ ID NO: 3326338 - RNA, 20 nt, Human
ccccacccaagggccuggcc

SEQ ID NO: 3326339 - RNA, 14 nt, Human
ccccacccaagggc

SEQ ID NO: 3326340 - RNA, 21 nt, Human
ccccaaauggaaaugggcaga

SEQ ID NO: 3326341 - RNA, 22 nt, Human
ccccaaauggaaaugggcagag

SEQ ID NO: 3326342 - RNA, 16 nt, Human
uugggaggccauuugu

SEQ ID NO: 3326343 - RNA, 22 nt, Human
uuggcuuuggguugcaggaccu

SEQ ID NO: 3326344 - RNA, 16 nt, Human
uuggguggaugccugg

SEQ ID NO: 3326345 - RNA, 21 nt, Human
uuggcugggggccucagugcc

SEQ ID NO: 3326346 - RNA, 22 nt, Human
uuggcugggggccucagugcca

SEQ ID NO: 3326347 - RNA, 18 nt, Human
uuggcugggggccucagu

SEQ ID NO: 3326348 - RNA, 16 nt, Human
uuggcugcugaaggcu

SEQ ID NO: 3326349 - RNA, 14 nt, Human
uuggccaggcuggu

SEQ ID NO: 3326350 - RNA, 24 nt, Human
uuggccaaagccaaagcuaggccu

SEQ ID NO: 3326351 - RNA, 13 nt, Human
uuggcauucccca

SEQ ID NO: 3326352 - RNA, 16 nt, Human
uuggucccccuuccau

SEQ ID NO: 3326353 - RNA, 22 nt, Human
uuggucccccuuccauggacuu

SEQ ID NO: 3326354 - RNA, 12 nt, Human
uugguccugcug

SEQ ID NO: 3326355 - RNA, 13 nt, Human
uuguacagacaac

SEQ ID NO: 3326356 - RNA, 12 nt, Human
uuguacagacaa

SEQ ID NO: 3326357 - RNA, 21 nt, Human
uuguauucucuccuguaccuc

SEQ ID NO: 3326358 - RNA, 14 nt, Human
uuguagagccaggg

SEQ ID NO: 3326359 - RNA, 15 nt, Human
uuguagagccagggu

SEQ ID NO: 3326360 - RNA, 23 nt, Human
uugcccacgcuggagugcaguga

SEQ ID NO: 3326361 - RNA, 13 nt, Human
uugccagucaccc

SEQ ID NO: 3326362 - RNA, 18 nt, Human
uugccagucaccccggcc

SEQ ID NO: 3326363 - RNA, 11 nt, Human
uugccucugcc

SEQ ID NO: 3326364 - RNA, 14 nt, Human
uugccucugccucu

SEQ ID NO: 3326365 - RNA, 16 nt, Human
uugccucugccucuga

SEQ ID NO: 3326366 - RNA, 18 nt, Human
uugccucugccucugaca

SEQ ID NO: 3326367 - RNA, 19 nt, Human
uugcugauggugcaaugac

SEQ ID NO: 3326368 - RNA, 20 nt, Human
uugcugauggugcaaugacc

SEQ ID NO: 3326369 - RNA, 22 nt, Human
uugcugauggugcaaugaccuu

SEQ ID NO: 3326370 - RNA, 20 nt, Human
uugcuggggccgaaagaaca

SEQ ID NO: 3326371 - RNA, 23 nt, Human
uuggaaagaguaggaagacuuug

SEQ ID NO: 3326372 - RNA, 19 nt, Human
uuggaaggaacguccccug

SEQ ID NO: 3326373 - RNA, 11 nt, Human
uuggaaggaac

SEQ ID NO: 3326374 - RNA, 17 nt, Human
uuggcaaaaaggcagga

SEQ ID NO: 3326375 - RNA, 19 nt, Human
uugaagacuuuucuuucag

SEQ ID NO: 3326376 - RNA, 17 nt, Human
uugaagacagagcuaca

SEQ ID NO: 3326377 - RNA, 20 nt, Human
uugaacuuugaccucugcag

SEQ ID NO: 3326378 - RNA, 22 nt, Human
uugaacuuugaccucugcagca

SEQ ID NO: 3326379 - RNA, 19 nt, Human
uugaacucuucaaucucuu

SEQ ID NO: 3326380 - RNA, 16 nt, Human
uugaacugauaaagau

SEQ ID NO: 3326381 - RNA, 18 nt, Human
uucuuuauaauucuacuu

SEQ ID NO: 3326382 - RNA, 21 nt, Human
uugaaaacacuguucucugcc

SEQ ID NO: 3326383 - RNA, 19 nt, Human
uugaaaacacuguucucug

SEQ ID NO: 3326384 - RNA, 21 nt, Human
uucuguccgagcuuugaaaau

SEQ ID NO: 3326385 - RNA, 17 nt, Human
uucuguccgagcuuuga

SEQ ID NO: 3326386 - RNA, 17 nt, Human
uucuguccuacucugug

SEQ ID NO: 3326387 - RNA, 23 nt, Human
uucuguggguuucuaaagcugcc

SEQ ID NO: 3326388 - RNA, 19 nt, Human
uucuuauuuaaugaaagac

SEQ ID NO: 3326389 - RNA, 23 nt, Human
uucuuauuuaaugaaagacugua

SEQ ID NO: 3326390 - RNA, 16 nt, Human
uucuugguuuguaaau

SEQ ID NO: 3326391 - RNA, 13 nt, Human
uucuugguuugua

SEQ ID NO: 3326392 - RNA, 18 nt, Human
uucuugguuuguaaauua

SEQ ID NO: 3326393 - RNA, 17 nt, Human
uucuugguuuguaaauu

SEQ ID NO: 3326394 - RNA, 23 nt, Human
uucuugguuuguaaauuaacuuu

SEQ ID NO: 3326395 - RNA, 20 nt, Human
uugauagcacagacccugcc

SEQ ID NO: 3326396 - RNA, 19 nt, Human
uugauagcacagacccugc

SEQ ID NO: 3326397 - RNA, 20 nt, Human
uugacgccaucccagcccca

SEQ ID NO: 3326398 - RNA, 22 nt, Human
uugaccugaggcccuucucucc

SEQ ID NO: 3326399 - RNA, 19 nt, Human
uugaccugaggcccuucuc

SEQ ID NO: 3326400 - RNA, 12 nt, Human
uugaccugaggc

SEQ ID NO: 3326401 - RNA, 22 nt, Human
uugacgccaucccagccccaau

SEQ ID NO: 3326402 - RNA, 14 nt, Human
uugacgccauccca

SEQ ID NO: 3326403 - RNA, 15 nt, Human
uugaccucaggugau

SEQ ID NO: 3326404 - RNA, 16 nt, Human
uugaccucugcagcaa

SEQ ID NO: 3326405 - RNA, 17 nt, Human
uugaccgugaggccaga

SEQ ID NO: 3326406 - RNA, 21 nt, Human
uugaccgugaggccagagaca

SEQ ID NO: 3326407 - RNA, 20 nt, Human
uugaccgugaggccagagac

SEQ ID NO: 3326408 - RNA, 16 nt, Human
uugcagacaggcaagc

SEQ ID NO: 3326409 - RNA, 21 nt, Human
uugauagcacagacccugccc

SEQ ID NO: 3326410 - RNA, 18 nt, Human
uugauagcacagacccug

SEQ ID NO: 3326411 - RNA, 14 nt, Human
uugcaacaggcugg

SEQ ID NO: 3326412 - RNA, 17 nt, Human
uugcaacaggcugggcu

SEQ ID NO: 3326413 - RNA, 18 nt, Human
uugauuuccguuaaaaua

SEQ ID NO: 3326414 - RNA, 17 nt, Human
uuccaugaguccccugu

SEQ ID NO: 3326415 - RNA, 11 nt, Human
uucaucuugaa

SEQ ID NO: 3326416 - RNA, 20 nt, Human
uucaucuuccaacucaaacu

SEQ ID NO: 3326417 - RNA, 12 nt, Human
uucaucuugaau

SEQ ID NO: 3326418 - RNA, 19 nt, Human
uucauuuaggugaggaagc

SEQ ID NO: 3326419 - RNA, 18 nt, Human
uucauuuaggugaggaag

SEQ ID NO: 3326420 - RNA, 18 nt, Human
uucagugccuuauggaac

SEQ ID NO: 3326421 - RNA, 21 nt, Human
uucagugccuuauggaacacu

SEQ ID NO: 3326422 - RNA, 19 nt, Human
uucagugccuuauggaaca

SEQ ID NO: 3326423 - RNA, 23 nt, Human
uucauaaugacuuaagcacacuu

SEQ ID NO: 3326424 - RNA, 13 nt, Human
uucauaaugacuu

SEQ ID NO: 3326425 - RNA, 19 nt, Human
uucaggaagcucagggccu

SEQ ID NO: 3326426 - RNA, 17 nt, Human
uucaggaagcucagggc

SEQ ID NO: 3326427 - RNA, 20 nt, Human
uucaggaagcucagggccug

SEQ ID NO: 3326428 - RNA, 15 nt, Human
uucaggaagcucagg

SEQ ID NO: 3326429 - RNA, 23 nt, Human
uucagcuccagcucaccagcccc

SEQ ID NO: 3326430 - RNA, 24 nt, Human
uucagcucugcaagaauugaagca

SEQ ID NO: 3326431 - RNA, 17 nt, Human
uucagcucugcaagaau

SEQ ID NO: 3326432 - RNA, 16 nt, Human
uucaggaagcucaggg

SEQ ID NO: 3326433 - RNA, 17 nt, Human
uucagcugacuuuucug

SEQ ID NO: 3326434 - RNA, 18 nt, Human
uucagcugcauacaguuu

SEQ ID NO: 3326435 - RNA, 15 nt, Human
uucagagacuccugc

SEQ ID NO: 3326436 - RNA, 22 nt, Human
uucagcuccagcucaccagccc

SEQ ID NO: 3326437 - RNA, 14 nt, Human
uucacucuccuugg

SEQ ID NO: 3326438 - RNA, 18 nt, Human
uucaauucucauuuguca

SEQ ID NO: 3326439 - RNA, 14 nt, Human
uuacgugaguccug

SEQ ID NO: 3326440 - RNA, 13 nt, Human
uuacgugaguccu

SEQ ID NO: 3326441 - RNA, 13 nt, Human
uucaaagauauuu

SEQ ID NO: 3326442 - RNA, 18 nt, Human
uucuaaaggcuaccuuug

SEQ ID NO: 3326443 - RNA, 17 nt, Human
uucuaaaggcuaccuuu

SEQ ID NO: 3326444 - RNA, 17 nt, Human
uucuaaagcugccagcc

SEQ ID NO: 3326445 - RNA, 16 nt, Human
uucuaaaggcuaccuu

SEQ ID NO: 3326446 - RNA, 15 nt, Human
uuccuucagugccuu

SEQ ID NO: 3326447 - RNA, 19 nt, Human
uuccuucagugccuuaugg

SEQ ID NO: 3326448 - RNA, 16 nt, Human
uuccuucagugccuua

SEQ ID NO: 3326449 - RNA, 23 nt, Human
uuccuucagugccuuauggaaca

SEQ ID NO: 3326450 - RNA, 19 nt, Human
uuccuucauucaacccacc

SEQ ID NO: 3326451 - RNA, 19 nt, Human
uucccuuugacgccauccc

SEQ ID NO: 3326452 - RNA, 22 nt, Human
uuccccacuugagaauuacccu

SEQ ID NO: 3326453 - RNA, 23 nt, Human
uuccucauaguaugguggcuggg

SEQ ID NO: 3326454 - RNA, 12 nt, Human
uuccucccuccc

SEQ ID NO: 3326455 - RNA, 19 nt, Human
uuccucccucccucuuucc

SEQ ID NO: 3326456 - RNA, 21 nt, Human
uuccucccucccucuuucccu

SEQ ID NO: 3326457 - RNA, 22 nt, Human
uuccucccucccucuuucccuc

SEQ ID NO: 3326458 - RNA, 17 nt, Human
uucuaugacacaugcaa

SEQ ID NO: 3326459 - RNA, 16 nt, Human
uucuaugacacaugca

SEQ ID NO: 3326460 - RNA, 14 nt, Human
uucuauuguuucuu

SEQ ID NO: 3326461 - RNA, 17 nt, Human
uucucugcccuccaaga

SEQ ID NO: 3326462 - RNA, 20 nt, Human
uucucugaggacacuaacca

SEQ ID NO: 3326463 - RNA, 21 nt, Human
uucugacccugcuucaaauau

SEQ ID NO: 3326464 - RNA, 21 nt, Human
uucugacccaugcugcccugu

SEQ ID NO: 3326465 - RNA, 20 nt, Human
uucugacccaugcugcccug

SEQ ID NO: 3326466 - RNA, 18 nt, Human
uucugacccaugcugccc

SEQ ID NO: 3326467 - RNA, 16 nt, Human
uucugacccaugcugc

SEQ ID NO: 3326468 - RNA, 11 nt, Human
uucuccaggcu

SEQ ID NO: 3326469 - RNA, 13 nt, Human
uucuccacccugc

SEQ ID NO: 3326470 - RNA, 16 nt, Human
uucuccaagcaggaca

SEQ ID NO: 3326471 - RNA, 22 nt, Human
uucucuccuguaccucuugagc

SEQ ID NO: 3326472 - RNA, 18 nt, Human
uucucuccagccccugga

SEQ ID NO: 3326473 - RNA, 16 nt, Human
uucucuccagccccug

SEQ ID NO: 3326474 - RNA, 18 nt, Human
uuuuaucgucacugcuua

SEQ ID NO: 3326475 - RNA, 15 nt, Human
uuuucacaguucucu

SEQ ID NO: 3326476 - RNA, 19 nt, Human
uuuuccaugaguccccugu

SEQ ID NO: 3326477 - RNA, 18 nt, Human
uuuuccaugaguccccug

SEQ ID NO: 3326478 - RNA, 15 nt, Human
uuuuccuucagugcc

SEQ ID NO: 3326479 - RNA, 17 nt, Human
uuuucuugcaugaggcu

SEQ ID NO: 3326480 - RNA, 14 nt, Human
uuuucuucucccuc

SEQ ID NO: 3326481 - RNA, 18 nt, Human
uuugccauguuggccagg

SEQ ID NO: 3326482 - RNA, 14 nt, Human
uuugcagacaggca

SEQ ID NO: 3326483 - RNA, 15 nt, Human
uuugagcagggcuca

SEQ ID NO: 3326484 - RNA, 22 nt, Human
uuugaggucuguucuuuccaaa

SEQ ID NO: 3326485 - RNA, 17 nt, Human
uuugaggucuguucuuu

SEQ ID NO: 3326486 - RNA, 16 nt, Human
uuuguugucagcugaa

SEQ ID NO: 3326487 - RNA, 21 nt, Human
uuuguccccaccgcagacagg

SEQ ID NO: 3326488 - RNA, 13 nt, Human
uuuguccccaccg

SEQ ID NO: 3326489 - RNA, 19 nt, Human
uuuggugguuucagaaaug

SEQ ID NO: 3326490 - RNA, 15 nt, Human
uuuguaaauuaacuu

SEQ ID NO: 3326491 - RNA, 17 nt, Human
uuuguaaauuaacuuuu

SEQ ID NO: 3326492 - RNA, 16 nt, Human
uuuguaaauuaacuuu

SEQ ID NO: 3326493 - RNA, 15 nt, Human
uuuacuuuguguuca

SEQ ID NO: 3326494 - RNA, 21 nt, Human
uuuaucgucacugcuuaacuu

SEQ ID NO: 3326495 - RNA, 16 nt, Human
uuuauaaacuuuaccu

SEQ ID NO: 3326496 - RNA, 16 nt, Human
uuuaucgucacugcuu

SEQ ID NO: 3326497 - RNA, 14 nt, Human
uuuauaaacuuuac

SEQ ID NO: 3326498 - RNA, 19 nt, Human
uuuauuuaguuccuugagu

SEQ ID NO: 3326499 - RNA, 16 nt, Human
uuuauugucaaagugg

SEQ ID NO: 3326500 - RNA, 14 nt, Human
uuuauugucaaagu

SEQ ID NO: 3326501 - RNA, 17 nt, Human
uuucuaaagcugccagc

SEQ ID NO: 3326502 - RNA, 14 nt, Human
uuucuaaagcugcc

SEQ ID NO: 3326503 - RNA, 14 nt, Human
uuucuaaaggcuac

SEQ ID NO: 3326504 - RNA, 21 nt, Human
uuuccucuuuggucuacacug

SEQ ID NO: 3326505 - RNA, 15 nt, Human
uuucuagccagagga

SEQ ID NO: 3326506 - RNA, 15 nt, Human
uuuccaaaguacacu

SEQ ID NO: 3326507 - RNA, 12 nt, Human
uuuccaaaguac

SEQ ID NO: 3326508 - RNA, 13 nt, Human
uuuccaggaaggc

SEQ ID NO: 3326509 - RNA, 15 nt, Human
uuucagccaagaauu

SEQ ID NO: 3326510 - RNA, 22 nt, Human
uuucauugcugggcuugucugu

SEQ ID NO: 3326511 - RNA, 19 nt, Human
uuucaauaggaaaaacuga

SEQ ID NO: 3326512 - RNA, 22 nt, Human
uuucaauaggaaaaacugauuu

SEQ ID NO: 3326513 - RNA, 20 nt, Human
uuucaauaggaaaaacugau

SEQ ID NO: 3326514 - RNA, 17 nt, Human
uuuuuuccuucagugcc

SEQ ID NO: 3326515 - RNA, 12 nt, Human
uuuuuuacuaau

SEQ ID NO: 3326516 - RNA, 16 nt, Human
uguguagggcgggagg

SEQ ID NO: 3326517 - RNA, 14 nt, Human
uguucagcuccagc

SEQ ID NO: 3326518 - RNA, 15 nt, Human
uguucagcuccagcu

SEQ ID NO: 3326519 - RNA, 16 nt, Human
uguucagcuccagcuc

SEQ ID NO: 3326520 - RNA, 22 nt, Human
uguucagcuccagcucaccagc

SEQ ID NO: 3326521 - RNA, 11 nt, Human
uguucagcugg

SEQ ID NO: 3326522 - RNA, 16 nt, Human
uguuacugucuucagu

SEQ ID NO: 3326523 - RNA, 15 nt, Human
uguuacugucuucag

SEQ ID NO: 3326524 - RNA, 19 nt, Human
uguuacauaagauaaaugu

SEQ ID NO: 3326525 - RNA, 13 nt, Human
uguuacauuuuua

SEQ ID NO: 3326526 - RNA, 22 nt, Human
uguuacauuuuuaagugcugca

SEQ ID NO: 3326527 - RNA, 14 nt, Human
uguuggccaggcug

SEQ ID NO: 3326528 - RNA, 15 nt, Human
uguuggccaaagcca

SEQ ID NO: 3326529 - RNA, 11 nt, Human
uguuggccagg

SEQ ID NO: 3326530 - RNA, 14 nt, Human
uguucuuucuggcu

SEQ ID NO: 3326531 - RNA, 18 nt, Human
uguucugacccugcuuca

SEQ ID NO: 3326532 - RNA, 19 nt, Human
uguucucugcccuccaaga

SEQ ID NO: 3326533 - RNA, 15 nt, Human
uguucugacccugcu

SEQ ID NO: 3326534 - RNA, 11 nt, Human
uguugaaagau

SEQ ID NO: 3326535 - RNA, 20 nt, Human
uguucuuuccaaaguacacu

SEQ ID NO: 3326536 - RNA, 22 nt, Human
uguucuuucuggcuaugcauuu

SEQ ID NO: 3326537 - RNA, 20 nt, Human
uguucuuucuggcuaugcau

SEQ ID NO: 3326538 - RNA, 13 nt, Human
uguucucugagga

SEQ ID NO: 3326539 - RNA, 16 nt, Human
uguucucugaggacac

SEQ ID NO: 3326540 - RNA, 18 nt, Human
uguucucugaggacacua

SEQ ID NO: 3326541 - RNA, 16 nt, Human
uguucucugcccucca

SEQ ID NO: 3326542 - RNA, 22 nt, Human
uuacauuuuuaagugcugcauu

SEQ ID NO: 3326543 - RNA, 21 nt, Human
uuacauuuuuaagugcugcau

SEQ ID NO: 3326544 - RNA, 20 nt, Human
uuacauuuuuaagugcugca

SEQ ID NO: 3326545 - RNA, 20 nt, Human
uuacgguuuuccagguuuaa

SEQ ID NO: 3326546 - RNA, 20 nt, Human
uuaccuuuuuuauacauaaa

SEQ ID NO: 3326547 - RNA, 19 nt, Human
uuaccuuuuuuauacauaa

SEQ ID NO: 3326548 - RNA, 22 nt, Human
uuaccuuuuuuauacauaaaca

SEQ ID NO: 3326549 - RNA, 17 nt, Human
uuaaugucacaggcagg

SEQ ID NO: 3326550 - RNA, 18 nt, Human
uuaaugucacaggcaggu

SEQ ID NO: 3326551 - RNA, 22 nt, Human
uuaaggaugcuuguacauaaug

SEQ ID NO: 3326552 - RNA, 21 nt, Human
uuaaggaagacaaugugaaaa

SEQ ID NO: 3326553 - RNA, 20 nt, Human
uuaaggaugcuuguacauaa

SEQ ID NO: 3326554 - RNA, 19 nt, Human
uuaaggaugcuuguacaua

SEQ ID NO: 3326555 - RNA, 18 nt, Human
uuaaggaugcuuguacau

SEQ ID NO: 3326556 - RNA, 17 nt, Human
uuaaggaugcuuguaca

SEQ ID NO: 3326557 - RNA, 20 nt, Human
uuaaacuuaaucuaaaugga

SEQ ID NO: 3326558 - RNA, 18 nt, Human
uuaaacuuaaucuaaaug

SEQ ID NO: 3326559 - RNA, 16 nt, Human
uuaaacuuaaucuaaa

SEQ ID NO: 3326560 - RNA, 11 nt, Human
uuaaaugcacc

SEQ ID NO: 3326561 - RNA, 16 nt, Human
uuaaaugcaccuggaa

SEQ ID NO: 3326562 - RNA, 18 nt, Human
uuaaaugcaccuggaaua

SEQ ID NO: 3326563 - RNA, 17 nt, Human
uuaaaugcaccuggaau

SEQ ID NO: 3326564 - RNA, 18 nt, Human
uuaaaugcccagccccuu

SEQ ID NO: 3326565 - RNA, 17 nt, Human
uuaaaugcccagccccu

SEQ ID NO: 3326566 - RNA, 16 nt, Human
uguuuguugucagcug

SEQ ID NO: 3326567 - RNA, 17 nt, Human
uguuuguugucagcuga

SEQ ID NO: 3326568 - RNA, 15 nt, Human
uguuuccuggcacug

SEQ ID NO: 3326569 - RNA, 22 nt, Human
uguuuccuggcacugcuuccag

SEQ ID NO: 3326570 - RNA, 21 nt, Human
uguuuccuggcacugcuucca

SEQ ID NO: 3326571 - RNA, 20 nt, Human
uguuuccuggcacugcuucc

SEQ ID NO: 3326572 - RNA, 13 nt, Human
uguuuuugucuua

SEQ ID NO: 3326573 - RNA, 22 nt, Human
ugugggcuaguugggcuuccuc

SEQ ID NO: 3326574 - RNA, 12 nt, Human
ugugggaagggg

SEQ ID NO: 3326575 - RNA, 15 nt, Human
uguggacacagcucu

SEQ ID NO: 3326576 - RNA, 12 nt, Human
uguggagaagcg

SEQ ID NO: 3326577 - RNA, 14 nt, Human
uguggacacagcuc

SEQ ID NO: 3326578 - RNA, 13 nt, Human
uguggacacagcu

SEQ ID NO: 3326579 - RNA, 16 nt, Human
ugugcacaugcacgug

SEQ ID NO: 3326580 - RNA, 22 nt, Human
ugugcacaugcacgugugugca

SEQ ID NO: 3326581 - RNA, 13 nt, Human
ugugccucuggga

SEQ ID NO: 3326582 - RNA, 15 nt, Human
ugugccucugggacu

SEQ ID NO: 3326583 - RNA, 16 nt, Human
ugugccucugggacug

SEQ ID NO: 3326584 - RNA, 17 nt, Human
ugugccucugggacugg

SEQ ID NO: 3326585 - RNA, 20 nt, Human
ugugcgugcauguguguuca

SEQ ID NO: 3326586 - RNA, 14 nt, Human
ugugaaaggaaaga

SEQ ID NO: 3326587 - RNA, 13 nt, Human
ugugaaaggaaag

SEQ ID NO: 3326588 - RNA, 18 nt, Human
ugucuuuggacccugagg

SEQ ID NO: 3326589 - RNA, 17 nt, Human
ugucuuuggacccugag

SEQ ID NO: 3326590 - RNA, 22 nt, Human
ugucuuuggacccugaggccca

SEQ ID NO: 3326591 - RNA, 19 nt, Human
ugucuuuggacccugaggc

SEQ ID NO: 3326592 - RNA, 16 nt, Human
ugucuuuuuucacuac

SEQ ID NO: 3326593 - RNA, 21 nt, Human
ugugacaaggauugcuacugu

SEQ ID NO: 3326594 - RNA, 18 nt, Human
ugugaguacuacaguccu

SEQ ID NO: 3326595 - RNA, 23 nt, Human
ugugaguacuacaguccucccau

SEQ ID NO: 3326596 - RNA, 20 nt, Human
ugugaguacuacaguccucc

SEQ ID NO: 3326597 - RNA, 19 nt, Human
ugugaguacuacaguccuc

SEQ ID NO: 3326598 - RNA, 21 nt, Human
ugugauacaaugcugugcccu

SEQ ID NO: 3326599 - RNA, 17 nt, Human
uguaaauuaacuuuuau

SEQ ID NO: 3326600 - RNA, 16 nt, Human
uguaaauuaacuuuua

SEQ ID NO: 3326601 - RNA, 15 nt, Human
uguaaauuaacuuuu

SEQ ID NO: 3326602 - RNA, 14 nt, Human
uguaaauuaacuuu

SEQ ID NO: 3326603 - RNA, 13 nt, Human
uguaaauuaacuu

SEQ ID NO: 3326604 - RNA, 14 nt, Human
uguaccucuugagc

SEQ ID NO: 3326605 - RNA, 22 nt, Human
uguaccucuugagccuugaacu

SEQ ID NO: 3326606 - RNA, 23 nt, Human
uguaccucuugagccuugaacuu

SEQ ID NO: 3326607 - RNA, 14 nt, Human
uguagagugggagc

SEQ ID NO: 3326608 - RNA, 17 nt, Human
uguacgucugacaggca

SEQ ID NO: 3326609 - RNA, 16 nt, Human
uguacgucugacaggc

SEQ ID NO: 3326610 - RNA, 20 nt, Human
ugucagugugacugaucucu

SEQ ID NO: 3326611 - RNA, 12 nt, Human
ugucagugugac

SEQ ID NO: 3326612 - RNA, 16 nt, Human
uguaucccaugagccu

SEQ ID NO: 3326613 - RNA, 19 nt, Human
uguaucccaugagccucag

SEQ ID NO: 3326614 - RNA, 23 nt, Human
uguaucccaugagccucagcauc

SEQ ID NO: 3326615 - RNA, 15 nt, Human
ugcgugcauaccacu

SEQ ID NO: 3326616 - RNA, 19 nt, Human
ugcuaggaacacuccuuca

SEQ ID NO: 3326617 - RNA, 17 nt, Human
ugcuaggaacacuccuu

SEQ ID NO: 3326618 - RNA, 16 nt, Human
ugcuaggaacacuccu

SEQ ID NO: 3326619 - RNA, 18 nt, Human
ugcuccucuccccagcaa

SEQ ID NO: 3326620 - RNA, 19 nt, Human
ugcuccucuccccagcaag

SEQ ID NO: 3326621 - RNA, 15 nt, Human
ugcugcaguugccag

SEQ ID NO: 3326622 - RNA, 23 nt, Human
ugcugauggugcaaugaccuuuc

SEQ ID NO: 3326623 - RNA, 20 nt, Human
ugcugauggugcaaugaccu

SEQ ID NO: 3326624 - RNA, 18 nt, Human
ugcugauggugcaaugac

SEQ ID NO: 3326625 - RNA, 15 nt, Human
ugcugacagacacag

SEQ ID NO: 3326626 - RNA, 23 nt, Human
ugcugagucugaaggcuggguuc

SEQ ID NO: 3326627 - RNA, 16 nt, Human
ugcugacagacacagg

SEQ ID NO: 3326628 - RNA, 21 nt, Human
ugcugaaggcucgagcaugcc

SEQ ID NO: 3326629 - RNA, 23 nt, Human
ugcugaauacagaggcaacugca

SEQ ID NO: 3326630 - RNA, 18 nt, Human
ugcugaauacagaggcaa

SEQ ID NO: 3326631 - RNA, 17 nt, Human
ugcugaaugguuuucaa

SEQ ID NO: 3326632 - RNA, 18 nt, Human
ugcugaaugguuuucaaa

SEQ ID NO: 3326633 - RNA, 22 nt, Human
ugcugaaugguuuucaaaauaa

SEQ ID NO: 3326634 - RNA, 19 nt, Human
ugcuccuggcccacugcau

SEQ ID NO: 3326635 - RNA, 21 nt, Human
ugcggugcuaucucccccagc

SEQ ID NO: 3326636 - RNA, 23 nt, Human
ugcggugcuaucucccccagccc

SEQ ID NO: 3326637 - RNA, 21 nt, Human
ugccuggauggggcugcaccg

SEQ ID NO: 3326638 - RNA, 22 nt, Human
ugccuuauggaacacucugaga

SEQ ID NO: 3326639 - RNA, 21 nt, Human
ugccuuauggaacacucugag

SEQ ID NO: 3326640 - RNA, 20 nt, Human
ugccuuauggaacacucuga

SEQ ID NO: 3326641 - RNA, 18 nt, Human
ugccuuauggaacacucu

SEQ ID NO: 3326642 - RNA, 23 nt, Human
ugcccaggcuggcgugcaguggu

SEQ ID NO: 3326643 - RNA, 11 nt, Human
ugcccagcccc

SEQ ID NO: 3326644 - RNA, 22 nt, Human
ugccugaagucacacagugagu

SEQ ID NO: 3326645 - RNA, 18 nt, Human
ugccugaagucacacagu

SEQ ID NO: 3326646 - RNA, 17 nt, Human
ugccugaagucacacag

SEQ ID NO: 3326647 - RNA, 14 nt, Human
ugccucugggacug

SEQ ID NO: 3326648 - RNA, 18 nt, Human
ugccuccuuugugaggaa

SEQ ID NO: 3326649 - RNA, 17 nt, Human
ugccuccuuugugagga

SEQ ID NO: 3326650 - RNA, 16 nt, Human
ugccuccuuugugagg

SEQ ID NO: 3326651 - RNA, 19 nt, Human
ugcacuuuguucuggcucu

SEQ ID NO: 3326652 - RNA, 18 nt, Human
ugcacuuuguucuggcuc

SEQ ID NO: 3326653 - RNA, 15 nt, Human
ugcacuuuguucugg

SEQ ID NO: 3326654 - RNA, 21 nt, Human
ugcacuugcagacucuacaga

SEQ ID NO: 3326655 - RNA, 16 nt, Human
ugcacuugcagacucu

SEQ ID NO: 3326656 - RNA, 16 nt, Human
ugcacguacacacaca

SEQ ID NO: 3326657 - RNA, 16 nt, Human
ugcagcaauaaagcag

SEQ ID NO: 3326658 - RNA, 15 nt, Human
ugcagcaauaaagca

SEQ ID NO: 3326659 - RNA, 14 nt, Human
ugcagcaauaaagc

SEQ ID NO: 3326660 - RNA, 18 nt, Human
ugcaggaccucaggugag

SEQ ID NO: 3326661 - RNA, 16 nt, Human
ugcaggaccucaggug

SEQ ID NO: 3326662 - RNA, 15 nt, Human
ugcaggaccucaggu

SEQ ID NO: 3326663 - RNA, 14 nt, Human
ugcaggaccucagg

SEQ ID NO: 3326664 - RNA, 23 nt, Human
ugcacagcuaacauggaaguacu

SEQ ID NO: 3326665 - RNA, 20 nt, Human
ugcacagcuaacauggaagu

SEQ ID NO: 3326666 - RNA, 18 nt, Human
ugcacagcuaacauggaa

SEQ ID NO: 3326667 - RNA, 20 nt, Human
ugaagucuuuguacagacaa

SEQ ID NO: 3326668 - RNA, 17 nt, Human
ugaagucuuuguacaga

SEQ ID NO: 3326669 - RNA, 22 nt, Human
ugaagucuuuguacagacaaca

SEQ ID NO: 3326670 - RNA, 17 nt, Human
ugcacagcuaacaugga

SEQ ID NO: 3326671 - RNA, 23 nt, Human
ugcacagaguuguuacauuuuua

SEQ ID NO: 3326672 - RNA, 20 nt, Human
ugcacagaguuguuacauuu

SEQ ID NO: 3326673 - RNA, 22 nt, Human
ugcacagaguuguuacauuuuu

SEQ ID NO: 3326674 - RNA, 21 nt, Human
ugcacagaguuguuacauuuu

SEQ ID NO: 3326675 - RNA, 18 nt, Human
ugcaggcagccaggccac

SEQ ID NO: 3326676 - RNA, 17 nt, Human
ugcaggcagccaggcca

SEQ ID NO: 3326677 - RNA, 16 nt, Human
ugcaggcagccaggcc

SEQ ID NO: 3326678 - RNA, 15 nt, Human
ugcaggcagccaggc

SEQ ID NO: 3326679 - RNA, 15 nt, Human
ugcaucguuucaucu

SEQ ID NO: 3326680 - RNA, 10 nt, Human
ugcccagccc

SEQ ID NO: 3326681 - RNA, 14 nt, Human
ugcccaccuggccu

SEQ ID NO: 3326682 - RNA, 18 nt, Human
ugcccaccuggccucugc

SEQ ID NO: 3326683 - RNA, 17 nt, Human
ugcccaccuggccucug

SEQ ID NO: 3326684 - RNA, 15 nt, Human
ugcccaccuggccuc

SEQ ID NO: 3326685 - RNA, 22 nt, Human
ugccagggacagaggggguggc

SEQ ID NO: 3326686 - RNA, 11 nt, Human
ugccagggaca

SEQ ID NO: 3326687 - RNA, 24 nt, Human
ugccagguuuuuggucugacccac

SEQ ID NO: 3326688 - RNA, 14 nt, Human
ugccagucaccccg

SEQ ID NO: 3326689 - RNA, 12 nt, Human
uggaagacagcu

SEQ ID NO: 3326690 - RNA, 11 nt, Human
uggaagacagc

SEQ ID NO: 3326691 - RNA, 15 nt, Human
uggaaaauaaauuau

SEQ ID NO: 3326692 - RNA, 16 nt, Human
uggaaaauaaauuauu

SEQ ID NO: 3326693 - RNA, 14 nt, Human
uggaagacagcucu

SEQ ID NO: 3326694 - RNA, 16 nt, Human
ugcuucuucagagacu

SEQ ID NO: 3326695 - RNA, 18 nt, Human
ugcuuccagugaggcucu

SEQ ID NO: 3326696 - RNA, 16 nt, Human
ugcuuccagugaggcu

SEQ ID NO: 3326697 - RNA, 20 nt, Human
ugcuuccagugaggcucugc

SEQ ID NO: 3326698 - RNA, 19 nt, Human
ugcuuccagugaggcucug

SEQ ID NO: 3326699 - RNA, 18 nt, Human
uggcacugcuuccaguga

SEQ ID NO: 3326700 - RNA, 16 nt, Human
uggcacugcuuccagu

SEQ ID NO: 3326701 - RNA, 14 nt, Human
uggcacugcuucca

SEQ ID NO: 3326702 - RNA, 14 nt, Human
uggaugccuggugg

SEQ ID NO: 3326703 - RNA, 19 nt, Human
uggcagcugcgguccaccc

SEQ ID NO: 3326704 - RNA, 21 nt, Human
uggcagcugcgguccacccag

SEQ ID NO: 3326705 - RNA, 22 nt, Human
uggcagcugcgguccacccagg

SEQ ID NO: 3326706 - RNA, 13 nt, Human
uggcagugggagc

SEQ ID NO: 3326707 - RNA, 14 nt, Human
uggcagugggagcu

SEQ ID NO: 3326708 - RNA, 15 nt, Human
uggcagugggagcug

SEQ ID NO: 3326709 - RNA, 16 nt, Human
uggcagugggagcugc

SEQ ID NO: 3326710 - RNA, 19 nt, Human
uggcagugggagcugccug

SEQ ID NO: 3326711 - RNA, 20 nt, Human
uggcagugggagcugccugu

SEQ ID NO: 3326712 - RNA, 22 nt, Human
uggaggcaugugaugagaggaa

SEQ ID NO: 3326713 - RNA, 12 nt, Human
uggacaggcaug

SEQ ID NO: 3326714 - RNA, 16 nt, Human
uggacaggcauguucu

SEQ ID NO: 3326715 - RNA, 16 nt, Human
ugggacaugggaaagg

SEQ ID NO: 3326716 - RNA, 23 nt, Human
ugggagcugccuguucagcucca

SEQ ID NO: 3326717 - RNA, 22 nt, Human
ugggaaugaaugucagugugac

SEQ ID NO: 3326718 - RNA, 21 nt, Human
ugggaaugaaugucaguguga

SEQ ID NO: 3326719 - RNA, 14 nt, Human
uggcugggggccuc

SEQ ID NO: 3326720 - RNA, 22 nt, Human
uggcugguuagagguucccuuu

SEQ ID NO: 3326721 - RNA, 22 nt, Human
uggcgugcaguggugcgaucug

SEQ ID NO: 3326722 - RNA, 14 nt, Human
uggcgcugccccug

SEQ ID NO: 3326723 - RNA, 22 nt, Human
uggcucagguggggucacucug

SEQ ID NO: 3326724 - RNA, 20 nt, Human
uggcucagguggggucacuc

SEQ ID NO: 3326725 - RNA, 16 nt, Human
uggcucuuccaggcug

SEQ ID NO: 3326726 - RNA, 12 nt, Human
uggcugggggcc

SEQ ID NO: 3326727 - RNA, 15 nt, Human
uggcucuuccaggcu

SEQ ID NO: 3326728 - RNA, 13 nt, Human
uggcucuuccagg

SEQ ID NO: 3326729 - RNA, 17 nt, Human
ugggguggggaccucag

SEQ ID NO: 3326730 - RNA, 23 nt, Human
uggguucaagcgauucuucugcu

SEQ ID NO: 3326731 - RNA, 16 nt, Human
uggguucacugcaacc

SEQ ID NO: 3326732 - RNA, 21 nt, Human
ugggugucaagagggucugag

SEQ ID NO: 3326733 - RNA, 23 nt, Human
ugggugucaagagggucugagga

SEQ ID NO: 3326734 - RNA, 17 nt, Human
ugggcuucaguggcagc

SEQ ID NO: 3326735 - RNA, 20 nt, Human
ugggcuucaguggcagcugc

SEQ ID NO: 3326736 - RNA, 19 nt, Human
ugggcuuggggaccagagc

SEQ ID NO: 3326737 - RNA, 16 nt, Human
uggggcagcuugaggg

SEQ ID NO: 3326738 - RNA, 21 nt, Human
ugggcuuggggaccagagcug

SEQ ID NO: 3326739 - RNA, 13 nt, Human
uggggcagcuuga

SEQ ID NO: 3326740 - RNA, 18 nt, Human
ugggcuucaguggcagcu

SEQ ID NO: 3326741 - RNA, 19 nt, Human
ugggcuucaguggcagcug

SEQ ID NO: 3326742 - RNA, 24 nt, Human
ugggagcugccuguucagcuccag

SEQ ID NO: 3326743 - RNA, 14 nt, Human
ugggccuccugugu

SEQ ID NO: 3326744 - RNA, 16 nt, Human
ugggccuccugugugu

SEQ ID NO: 3326745 - RNA, 15 nt, Human
guuuagauaauacac

SEQ ID NO: 3326746 - RNA, 18 nt, Human
gguuggcaaaaaggcagg

SEQ ID NO: 3326747 - RNA, 21 nt, Human
gguuggccccugcccggcugc

SEQ ID NO: 3326748 - RNA, 18 nt, Human
guuucagaaauguguuau

SEQ ID NO: 3326749 - RNA, 14 nt, Human
guuucagaaaugug

SEQ ID NO: 3326750 - RNA, 20 nt, Human
guuuccuggcacugcuucca

SEQ ID NO: 3326751 - RNA, 16 nt, Human
guuuccuggcacugcu

SEQ ID NO: 3326752 - RNA, 22 nt, Human
guuuccuggcacugcuuccagu

SEQ ID NO: 3326753 - RNA, 21 nt, Human
guuuccuggcacugcuuccag

SEQ ID NO: 3326754 - RNA, 22 nt, Human
guuugauuaaauucuugcaaag

SEQ ID NO: 3326755 - RNA, 19 nt, Human
guuugauuaaauucuugca

SEQ ID NO: 3326756 - RNA, 17 nt, Human
guuugauuaaauucuug

SEQ ID NO: 3326757 - RNA, 17 nt, Human
guuuguaaauuaacuuu

SEQ ID NO: 3326758 - RNA, 19 nt, Human
guuuguaaauuaacuuuua

SEQ ID NO: 3326759 - RNA, 16 nt, Human
guuucuaaagcugcca

SEQ ID NO: 3326760 - RNA, 15 nt, Human
guuucuaaagcugcc

SEQ ID NO: 3326761 - RNA, 14 nt, Human
guuucuaaagcugc

SEQ ID NO: 3326762 - RNA, 18 nt, Human
guuugagaucagccuggg

SEQ ID NO: 3326763 - RNA, 16 nt, Human
guuugaaccaagaacu

SEQ ID NO: 3326764 - RNA, 23 nt, Human
uaaaaaacugcugacuguuuucu

SEQ ID NO: 3326765 - RNA, 20 nt, Human
uaaaaaacugcugacuguuu

SEQ ID NO: 3326766 - RNA, 22 nt, Human
uaaaaaugagguacucuccugg

SEQ ID NO: 3326767 - RNA, 13 nt, Human
guuuuccugaaga

SEQ ID NO: 3326768 - RNA, 16 nt, Human
guuuucaguguacaug

SEQ ID NO: 3326769 - RNA, 17 nt, Human
guuuucaguguacaugg

SEQ ID NO: 3326770 - RNA, 19 nt, Human
guuuucucuugagagggug

SEQ ID NO: 3326771 - RNA, 12 nt, Human
guuuucucuuga

SEQ ID NO: 3326772 - RNA, 23 nt, Human
guuuuuauggcuuuugugcauua

SEQ ID NO: 3326773 - RNA, 22 nt, Human
guuuuuauggcuuuugugcauu

SEQ ID NO: 3326774 - RNA, 19 nt, Human
guuuuuauggcuuuugugc

SEQ ID NO: 3326775 - RNA, 13 nt, Human
uaaaguuucuguu

SEQ ID NO: 3326776 - RNA, 20 nt, Human
uaaaguguauuuuuuuacua

SEQ ID NO: 3326777 - RNA, 23 nt, Human
uaaaguguauuuuuuuacuaaua

SEQ ID NO: 3326778 - RNA, 22 nt, Human
uaaaguguauuuuuuuacuaau

SEQ ID NO: 3326779 - RNA, 21 nt, Human
uaaaguguauuuuuuuacuaa

SEQ ID NO: 3326780 - RNA, 19 nt, Human
uaaaucagccguguaacca

SEQ ID NO: 3326781 - RNA, 19 nt, Human
uaaacuuaaucuaaaugga

SEQ ID NO: 3326782 - RNA, 18 nt, Human
uaaacuuaaucuaaaugg

SEQ ID NO: 3326783 - RNA, 13 nt, Human
uaaacuuaaucua

SEQ ID NO: 3326784 - RNA, 14 nt, Human
uaaacuuaaucuaa

SEQ ID NO: 3326785 - RNA, 22 nt, Human
uaaacuuuaccuuuuuuauaca

SEQ ID NO: 3326786 - RNA, 16 nt, Human
uaaacuuuaccuuuuu

SEQ ID NO: 3326787 - RNA, 18 nt, Human
uaaacaagaccacguuuc

SEQ ID NO: 3326788 - RNA, 23 nt, Human
uaaacaagaccacguuucuaaag

SEQ ID NO: 3326789 - RNA, 13 nt, Human
uaacagaaaugua

SEQ ID NO: 3326790 - RNA, 15 nt, Human
uaacagaaauguaca

SEQ ID NO: 3326791 - RNA, 14 nt, Human
uaacagaaauguac

SEQ ID NO: 3326792 - RNA, 12 nt, Human
uaacagaaaugu

SEQ ID NO: 3326793 - RNA, 20 nt, Human
uaacuuuuauaaacuuuacc

SEQ ID NO: 3326794 - RNA, 19 nt, Human
uaaccagcagaaaugccuu

SEQ ID NO: 3326795 - RNA, 16 nt, Human
uaaccagcagaaaugc

SEQ ID NO: 3326796 - RNA, 14 nt, Human
uaaccagcagaaau

SEQ ID NO: 3326797 - RNA, 19 nt, Human
uaacaggcagauacaggaa

SEQ ID NO: 3326798 - RNA, 19 nt, Human
uaaggaugcuuguacauaa

SEQ ID NO: 3326799 - RNA, 18 nt, Human
uaaggaugcuuguacaua

SEQ ID NO: 3326800 - RNA, 23 nt, Human
uaaggaugcuuguacauaaugcg

SEQ ID NO: 3326801 - RNA, 22 nt, Human
uaaggaugcuuguacauaaugc

SEQ ID NO: 3326802 - RNA, 21 nt, Human
uaaggaugcuuguacauaaug

SEQ ID NO: 3326803 - RNA, 20 nt, Human
uaaggaugcuuguacauaau

SEQ ID NO: 3326804 - RNA, 22 nt, Human
uaagaggcagggucucacucug

SEQ ID NO: 3326805 - RNA, 22 nt, Human
uaagaaccuuuugagugccuua

SEQ ID NO: 3326806 - RNA, 24 nt, Human
uaagaaagacuaucuaaauguuga

SEQ ID NO: 3326807 - RNA, 19 nt, Human
uaacuuuuauaaacuuuac

SEQ ID NO: 3326808 - RNA, 22 nt, Human
uaacuuuuauaaacuuuaccuu

SEQ ID NO: 3326809 - RNA, 21 nt, Human
uaacuuuuauaaacuuuaccu

SEQ ID NO: 3326810 - RNA, 23 nt, Human
uaagagggagggagggcuccaga

SEQ ID NO: 3326811 - RNA, 22 nt, Human
uaagagggagggagggcuccag

SEQ ID NO: 3326812 - RNA, 12 nt, Human
uaagagggaggg

SEQ ID NO: 3326813 - RNA, 14 nt, Human
uaagauaaaugugc

SEQ ID NO: 3326814 - RNA, 16 nt, Human
uaagauaaaugugcug

SEQ ID NO: 3326815 - RNA, 17 nt, Human
uaagauaaaugugcuga

SEQ ID NO: 3326816 - RNA, 11 nt, Human
uaaucuaaaug

SEQ ID NO: 3326817 - RNA, 20 nt, Human
uaauccucuaggaggucucu

SEQ ID NO: 3326818 - RNA, 21 nt, Human
uaauaguucagguaacaggca

SEQ ID NO: 3326819 - RNA, 22 nt, Human
uaauugacaggauuauuggaaa

SEQ ID NO: 3326820 - RNA, 20 nt, Human
uaauugacaggauuauugga

SEQ ID NO: 3326821 - RNA, 18 nt, Human
uaauucuuagcucauucu

SEQ ID NO: 3326822 - RNA, 17 nt, Human
uaauuaaaacacaacau

SEQ ID NO: 3326823 - RNA, 20 nt, Human
uaauuaaguacuauguauca

SEQ ID NO: 3326824 - RNA, 14 nt, Human
uaaugcgugcauac

SEQ ID NO: 3326825 - RNA, 22 nt, Human
uaauuugugauacaaugcugug

SEQ ID NO: 3326826 - RNA, 19 nt, Human
uaauuugugauacaaugcu

SEQ ID NO: 3326827 - RNA, 14 nt, Human
uaauuugugauaca

SEQ ID NO: 3326828 - RNA, 18 nt, Human
uaauuugugauacaaugc

SEQ ID NO: 3326829 - RNA, 15 nt, Human
uaauuugugauacaa

SEQ ID NO: 3326830 - RNA, 15 nt, Human
uacugaggugcuaug

SEQ ID NO: 3326831 - RNA, 17 nt, Human
uacucccaucugugaaa

SEQ ID NO: 3326832 - RNA, 16 nt, Human
uacucccaucugugaa

SEQ ID NO: 3326833 - RNA, 14 nt, Human
uacucccaucugug

SEQ ID NO: 3326834 - RNA, 12 nt, Human
uacucccaucug

SEQ ID NO: 3326835 - RNA, 12 nt, Human
uacucaccucac

SEQ ID NO: 3326836 - RNA, 14 nt, Human
uacucaccucaccc

SEQ ID NO: 3326837 - RNA, 20 nt, Human
uacuacaguuuguuaguaug

SEQ ID NO: 3326838 - RNA, 22 nt, Human
uacucagaauucucuaguuuga

SEQ ID NO: 3326839 - RNA, 16 nt, Human
uacucagaauucucua

SEQ ID NO: 3326840 - RNA, 19 nt, Human
uacuaaccagcagaaaugc

SEQ ID NO: 3326841 - RNA, 17 nt, Human
uacuaaccagcagaaau

SEQ ID NO: 3326842 - RNA, 18 nt, Human
uacuaaccagcagaaaug

SEQ ID NO: 3326843 - RNA, 22 nt, Human
uacuaauaaaauuuaaaagucu

SEQ ID NO: 3326844 - RNA, 17 nt, Human
uacuaauagacaauuua

SEQ ID NO: 3326845 - RNA, 15 nt, Human
uacuaauagacaauu

SEQ ID NO: 3326846 - RNA, 17 nt, Human
uacuacaguccucccau

SEQ ID NO: 3326847 - RNA, 12 nt, Human
uacuacaguccu

SEQ ID NO: 3326848 - RNA, 22 nt, Human
uacccaucccauaugccugggc

SEQ ID NO: 3326849 - RNA, 18 nt, Human
uaccuuuuuuauacauaa

SEQ ID NO: 3326850 - RNA, 20 nt, Human
uaccuuuuuuauacauaaac

SEQ ID NO: 3326851 - RNA, 19 nt, Human
uaccuuuuuuauacauaaa

SEQ ID NO: 3326852 - RNA, 20 nt, Human
uaccuuuguauucucuccug

SEQ ID NO: 3326853 - RNA, 15 nt, Human
uagaaauauaauuga

SEQ ID NO: 3326854 - RNA, 20 nt, Human
uagaaauaucugaaaaugua

SEQ ID NO: 3326855 - RNA, 21 nt, Human
uagaaauaucugaaaauguau

SEQ ID NO: 3326856 - RNA, 23 nt, Human
uagaaauaucugaaaauguaugu

SEQ ID NO: 3326857 - RNA, 21 nt, Human
uacuguaucaugacaaagacu

SEQ ID NO: 3326858 - RNA, 19 nt, Human
uacuuguggacacagcucu

SEQ ID NO: 3326859 - RNA, 15 nt, Human
uacuuguggacacag

SEQ ID NO: 3326860 - RNA, 18 nt, Human
uacuuguggacacagcuc

SEQ ID NO: 3326861 - RNA, 14 nt, Human
uacuuguggacaca

SEQ ID NO: 3326862 - RNA, 22 nt, Human
uacauaagauaaaugugcugaa

SEQ ID NO: 3326863 - RNA, 17 nt, Human
uacauaagauaaaugug

SEQ ID NO: 3326864 - RNA, 18 nt, Human
uacauaagauaaaugugc

SEQ ID NO: 3326865 - RNA, 19 nt, Human
uacauaagauaaaugugcu

SEQ ID NO: 3326866 - RNA, 23 nt, Human
uacaguuacucagaauucucuag

SEQ ID NO: 3326867 - RNA, 19 nt, Human
uacaguuacucagaauucu

SEQ ID NO: 3326868 - RNA, 23 nt, Human
uaccauuuugggguacccacugc

SEQ ID NO: 3326869 - RNA, 13 nt, Human
uaccacagacaua

SEQ ID NO: 3326870 - RNA, 15 nt, Human
uacccacccccaccc

SEQ ID NO: 3326871 - RNA, 12 nt, Human
uacccaccccca

SEQ ID NO: 3326872 - RNA, 23 nt, Human
uacccacccccacccaagggccu

SEQ ID NO: 3326873 - RNA, 19 nt, Human
uacccacccccacccaagg

SEQ ID NO: 3326874 - RNA, 17 nt, Human
uacccacccccacccaa

SEQ ID NO: 3326875 - RNA, 11 nt, Human
uacccacugcu

SEQ ID NO: 3326876 - RNA, 12 nt, Human
uacccacugcuc

SEQ ID NO: 3326877 - RNA, 13 nt, Human
uacccacugcucu

SEQ ID NO: 3326878 - RNA, 14 nt, Human
uacccacugcucug

SEQ ID NO: 3326879 - RNA, 16 nt, Human
uacccagcgagcccug

SEQ ID NO: 3326880 - RNA, 18 nt, Human
uacccagcgagcccuggu

SEQ ID NO: 3326881 - RNA, 22 nt, Human
uacccaggugcuaggaacacuc

SEQ ID NO: 3326882 - RNA, 16 nt, Human
uacaggcacccaccau

SEQ ID NO: 3326883 - RNA, 19 nt, Human
uacaggaaaagcugcugac

SEQ ID NO: 3326884 - RNA, 23 nt, Human
uacagcuugaccgugaggccaga

SEQ ID NO: 3326885 - RNA, 17 nt, Human
uacaggaaaagcugcug

SEQ ID NO: 3326886 - RNA, 18 nt, Human
uacaggaaaagcugcuga

SEQ ID NO: 3326887 - RNA, 22 nt, Human
uacagcuugaccgugaggccag

SEQ ID NO: 3326888 - RNA, 21 nt, Human
uacagcuugaccgugaggcca

SEQ ID NO: 3326889 - RNA, 13 nt, Human
uacacuuuaugca

SEQ ID NO: 3326890 - RNA, 18 nt, Human
uacacuguuucaaacuuu

SEQ ID NO: 3326891 - RNA, 17 nt, Human
uacacuguuucaaacuu

SEQ ID NO: 3326892 - RNA, 24 nt, Human
uacagcaaggagauuuacaacugg

SEQ ID NO: 3326893 - RNA, 22 nt, Human
uacacacugcauguuugugauu

SEQ ID NO: 3326894 - RNA, 14 nt, Human
uacacuguuucaaa

SEQ ID NO: 3326895 - RNA, 17 nt, Human
uacacaaugguuuucuu

SEQ ID NO: 3326896 - RNA, 21 nt, Human
uacacaaugguuuucuugugu

SEQ ID NO: 3326897 - RNA, 21 nt, Human
uacacacacacgcgugcacac

SEQ ID NO: 3326898 - RNA, 15 nt, Human
uacacacacauacac

SEQ ID NO: 3326899 - RNA, 17 nt, Human
uacacacugcauguuug

SEQ ID NO: 3326900 - RNA, 12 nt, Human
uagauguauaua

SEQ ID NO: 3326901 - RNA, 18 nt, Human
uagauaauacaccacuac

SEQ ID NO: 3326902 - RNA, 19 nt, Human
uagcagagaaugaaagggc

SEQ ID NO: 3326903 - RNA, 23 nt, Human
uagcagagaaugaaagggcccag

SEQ ID NO: 3326904 - RNA, 16 nt, Human
uagcacuuugggaggc

SEQ ID NO: 3326905 - RNA, 21 nt, Human
uagagguucaaagauauuuug

SEQ ID NO: 3326906 - RNA, 16 nt, Human
uagagguucaaagaua

SEQ ID NO: 3326907 - RNA, 19 nt, Human
uagagguucaaagauauuu

SEQ ID NO: 3326908 - RNA, 16 nt, Human
uagagagagaccacuu

SEQ ID NO: 3326909 - RNA, 11 nt, Human
uagagacaggg

SEQ ID NO: 3326910 - RNA, 13 nt, Human
uaggccuggccag

SEQ ID NO: 3326911 - RNA, 14 nt, Human
uaggccuggccaga

SEQ ID NO: 3326912 - RNA, 15 nt, Human
uaggaagguuaaugu

SEQ ID NO: 3326913 - RNA, 21 nt, Human
uaggaacuuaaauaaugugaa

SEQ ID NO: 3326914 - RNA, 17 nt, Human
uaggaacacuccuucac

SEQ ID NO: 3326915 - RNA, 14 nt, Human
uaggaacacuccuu

SEQ ID NO: 3326916 - RNA, 13 nt, Human
uaggaacacuccu

SEQ ID NO: 3326917 - RNA, 13 nt, Human
uaggaagacuuug

SEQ ID NO: 3326918 - RNA, 15 nt, Human
uaggaagacuuugga

SEQ ID NO: 3326919 - RNA, 14 nt, Human
uaggaagacuuugg

SEQ ID NO: 3326920 - RNA, 17 nt, Human
uaggaagacuuuggaaa

SEQ ID NO: 3326921 - RNA, 16 nt, Human
uaggaagacuuuggaa

SEQ ID NO: 3326922 - RNA, 21 nt, Human
uagcucuaggagggcuggcaa

SEQ ID NO: 3326923 - RNA, 22 nt, Human
uagcucauucuccuuguguuac

SEQ ID NO: 3326924 - RNA, 18 nt, Human
uagcugggacuacaggug

SEQ ID NO: 3326925 - RNA, 20 nt, Human
uagcugggacuacaggcacc

SEQ ID NO: 3326926 - RNA, 19 nt, Human
uagcugggacuacaggcac

SEQ ID NO: 3326927 - RNA, 11 nt, Human
uagcugggacu

SEQ ID NO: 3326928 - RNA, 14 nt, Human
uagcccaaaaccaa

SEQ ID NO: 3326929 - RNA, 16 nt, Human
uagccuaggugacaga

SEQ ID NO: 3326930 - RNA, 16 nt, Human
uaucaugacaaagacu

SEQ ID NO: 3326931 - RNA, 19 nt, Human
uaucgucacugcuuaacuu

SEQ ID NO: 3326932 - RNA, 16 nt, Human
uaucgucacugcuuaa

SEQ ID NO: 3326933 - RNA, 15 nt, Human
uaucuaaauguugaa

SEQ ID NO: 3326934 - RNA, 13 nt, Human
uaguuucuccaag

SEQ ID NO: 3326935 - RNA, 12 nt, Human
uaguuugcaguu

SEQ ID NO: 3326936 - RNA, 23 nt, Human
uaguuugauuaaauucuugcaaa

SEQ ID NO: 3326937 - RNA, 15 nt, Human
uaguggauguucuga

SEQ ID NO: 3326938 - RNA, 17 nt, Human
uauaauucuacuuugag

SEQ ID NO: 3326939 - RNA, 14 nt, Human
uauaauguaagcuc

SEQ ID NO: 3326940 - RNA, 19 nt, Human
uauaauguaagcucuacug

SEQ ID NO: 3326941 - RNA, 20 nt, Human
uauaauguaagcucuacuga

SEQ ID NO: 3326942 - RNA, 18 nt, Human
uauaaugaaugaaacauu

SEQ ID NO: 3326943 - RNA, 20 nt, Human
uauaaugaaugaaacauuuu

SEQ ID NO: 3326944 - RNA, 21 nt, Human
uaguuugauuaaauucuugca

SEQ ID NO: 3326945 - RNA, 14 nt, Human
ucuggcuaugcauu

SEQ ID NO: 3326946 - RNA, 17 nt, Human
ucuggcucuuccaggcu

SEQ ID NO: 3326947 - RNA, 16 nt, Human
ucuggcucuuccaggc

SEQ ID NO: 3326948 - RNA, 15 nt, Human
ucuggcucuuccagg

SEQ ID NO: 3326949 - RNA, 12 nt, Human
ucugggacacag

SEQ ID NO: 3326950 - RNA, 23 nt, Human
ucuguacagagcccacgccccca

SEQ ID NO: 3326951 - RNA, 22 nt, Human
ucugugucagguggggcagcuu

SEQ ID NO: 3326952 - RNA, 23 nt, Human
ucuguggguuucuaaagcugcca

SEQ ID NO: 3326953 - RNA, 19 nt, Human
ucuguccgagcuuugaaaa

SEQ ID NO: 3326954 - RNA, 22 nt, Human
ucuguggguuucuaaagcugcc

SEQ ID NO: 3326955 - RNA, 17 nt, Human
ucuguacgucugacagg

SEQ ID NO: 3326956 - RNA, 18 nt, Human
ucuuaaaaaguggaaaaa

SEQ ID NO: 3326957 - RNA, 16 nt, Human
ucuugaacuccuggcc

SEQ ID NO: 3326958 - RNA, 17 nt, Human
ucuugaacuccuggccu

SEQ ID NO: 3326959 - RNA, 18 nt, Human
ucuugaacuccuggccuc

SEQ ID NO: 3326960 - RNA, 13 nt, Human
ucuucuccaggcu

SEQ ID NO: 3326961 - RNA, 14 nt, Human
ucuucuccaggcug

SEQ ID NO: 3326962 - RNA, 12 nt, Human
ucuucuccaggc

SEQ ID NO: 3326963 - RNA, 21 nt, Human
ucuugaauuguaaggaaugau

SEQ ID NO: 3326964 - RNA, 17 nt, Human
ucuugaauuguaaggaa

SEQ ID NO: 3326965 - RNA, 12 nt, Human
ucuugcucugcu

SEQ ID NO: 3326966 - RNA, 13 nt, Human
ucuugcucugcug

SEQ ID NO: 3326967 - RNA, 11 nt, Human
ucuugcucugc

SEQ ID NO: 3326968 - RNA, 21 nt, Human
ucuucuccacuuucuagccag

SEQ ID NO: 3326969 - RNA, 19 nt, Human
ucuucuccacuuucuagcc

SEQ ID NO: 3326970 - RNA, 14 nt, Human
ucuuccaggcuggg

SEQ ID NO: 3326971 - RNA, 21 nt, Human
ucuuccacaagagcccaggcc

SEQ ID NO: 3326972 - RNA, 16 nt, Human
ucuucaguaagccgug

SEQ ID NO: 3326973 - RNA, 15 nt, Human
ucuucaguaagccgu

SEQ ID NO: 3326974 - RNA, 13 nt, Human
ucuuaaaaagugg

SEQ ID NO: 3326975 - RNA, 14 nt, Human
ucuuagugugugca

SEQ ID NO: 3326976 - RNA, 16 nt, Human
ucuuaguggauguucu

SEQ ID NO: 3326977 - RNA, 15 nt, Human
ucuuauacauuugau

SEQ ID NO: 3326978 - RNA, 14 nt, Human
ucuuauacauuuga

SEQ ID NO: 3326979 - RNA, 12 nt, Human
ugaaaggaaaga

SEQ ID NO: 3326980 - RNA, 17 nt, Human
ugaaaggaaagaggcuc

SEQ ID NO: 3326981 - RNA, 19 nt, Human
ugaaaugaggucagagccu

SEQ ID NO: 3326982 - RNA, 20 nt, Human
ugaaaugaggucagagccug

SEQ ID NO: 3326983 - RNA, 23 nt, Human
ugaaaugaggucagagccugcag

SEQ ID NO: 3326984 - RNA, 21 nt, Human
ugaaaugaggucagagccugc

SEQ ID NO: 3326985 - RNA, 22 nt, Human
ugaaaugaggucagagccugca

SEQ ID NO: 3326986 - RNA, 15 nt, Human
ugaaagggcccagag

SEQ ID NO: 3326987 - RNA, 16 nt, Human
ugaaagggcccagaga

SEQ ID NO: 3326988 - RNA, 17 nt, Human
ugaaagggcccagagag

SEQ ID NO: 3326989 - RNA, 17 nt, Human
ugaaaucuuuuugcuuu

SEQ ID NO: 3326990 - RNA, 22 nt, Human
ugaaaagaaaaaugagccuggc

SEQ ID NO: 3326991 - RNA, 16 nt, Human
ucuuuuugcuuugcuu

SEQ ID NO: 3326992 - RNA, 19 nt, Human
ucuuuugccguuauuaaaa

SEQ ID NO: 3326993 - RNA, 17 nt, Human
ucuuuugccguuauuaa

SEQ ID NO: 3326994 - RNA, 19 nt, Human
ugaaccacaucuugcucug

SEQ ID NO: 3326995 - RNA, 18 nt, Human
ugaacucuucaaucucuu

SEQ ID NO: 3326996 - RNA, 20 nt, Human
ugaaccacaucuugcucugc

SEQ ID NO: 3326997 - RNA, 21 nt, Human
ugaaccacaucuugcucugcu

SEQ ID NO: 3326998 - RNA, 15 nt, Human
ugaacucuucaaucu

SEQ ID NO: 3326999 - RNA, 15 nt, Human
ugaacugauaaagau

SEQ ID NO: 3327000 - RNA, 13 nt, Human
ugaacugauaaag

SEQ ID NO: 3327001 - RNA, 21 nt, Human
ugaaggcucgagcaugccugg

SEQ ID NO: 3327002 - RNA, 20 nt, Human
ugaaggcucgagcaugccug

SEQ ID NO: 3327003 - RNA, 14 nt, Human
ugaagacuuuucuu

SEQ ID NO: 3327004 - RNA, 22 nt, Human
ugaagacuuuucuuucagccaa

SEQ ID NO: 3327005 - RNA, 17 nt, Human
ugaagacuuuucuuuca

SEQ ID NO: 3327006 - RNA, 19 nt, Human
ugaacuggguacuugugga

SEQ ID NO: 3327007 - RNA, 12 nt, Human
ugaacuugguuc

SEQ ID NO: 3327008 - RNA, 14 nt, Human
ugaacuuggcgcug

SEQ ID NO: 3327009 - RNA, 13 nt, Human
ugaagacagagcu

SEQ ID NO: 3327010 - RNA, 16 nt, Human
ugaagacagagcuaca

SEQ ID NO: 3327011 - RNA, 14 nt, Human
ugaagacagagcua

SEQ ID NO: 3327012 - RNA, 16 nt, Human
ucugaaaauguaugug

SEQ ID NO: 3327013 - RNA, 15 nt, Human
ucucuuuucaaaaca

SEQ ID NO: 3327014 - RNA, 16 nt, Human
ucucuuuucaaaacau

SEQ ID NO: 3327015 - RNA, 14 nt, Human
ucugaaaauguaug

SEQ ID NO: 3327016 - RNA, 23 nt, Human
ucugaaaauguauguguaaguau

SEQ ID NO: 3327017 - RNA, 13 nt, Human
ucugaaagggacg

SEQ ID NO: 3327018 - RNA, 14 nt, Human
ucugacccaugcug

SEQ ID NO: 3327019 - RNA, 15 nt, Human
ucugacccacugcuu

SEQ ID NO: 3327020 - RNA, 20 nt, Human
ucugaacuuggcgcugcccc

SEQ ID NO: 3327021 - RNA, 24 nt, Human
ucugagaucaaaacgguuuuacug

SEQ ID NO: 3327022 - RNA, 18 nt, Human
ucugacccaugcugcccu

SEQ ID NO: 3327023 - RNA, 17 nt, Human
ucugacccaugcugccc

SEQ ID NO: 3327024 - RNA, 16 nt, Human
ucugacccaugcugcc

SEQ ID NO: 3327025 - RNA, 15 nt, Human
ucugacccaugcugc

SEQ ID NO: 3327026 - RNA, 19 nt, Human
ucugcacaagcugcacccu

SEQ ID NO: 3327027 - RNA, 14 nt, Human
ucugcacaagcugc

SEQ ID NO: 3327028 - RNA, 21 nt, Human
ucugauucccaagcucugcuc

SEQ ID NO: 3327029 - RNA, 23 nt, Human
ucugauucccaagcucugcuccu

SEQ ID NO: 3327030 - RNA, 16 nt, Human
ucugaggaauccagac

SEQ ID NO: 3327031 - RNA, 17 nt, Human
ucugaggaauccagacc

SEQ ID NO: 3327032 - RNA, 20 nt, Human
ucugaggacacuaaccacgc

SEQ ID NO: 3327033 - RNA, 23 nt, Human
ucugaggacacuaaccacgcugg

SEQ ID NO: 3327034 - RNA, 14 nt, Human
ucucccccagcccc

SEQ ID NO: 3327035 - RNA, 17 nt, Human
ucucccccagccccauc

SEQ ID NO: 3327036 - RNA, 15 nt, Human
ucucccccagcccca

SEQ ID NO: 3327037 - RNA, 20 nt, Human
ucucccccagccccauccuc

SEQ ID NO: 3327038 - RNA, 18 nt, Human
ucucccccagccccaucc

SEQ ID NO: 3327039 - RNA, 13 nt, Human
ucucccccagccc

SEQ ID NO: 3327040 - RNA, 22 nt, Human
ucucccccagccccauccucug

SEQ ID NO: 3327041 - RNA, 22 nt, Human
ucuccugccucagccucccaaa

SEQ ID NO: 3327042 - RNA, 19 nt, Human
ucuccugccucagccuccc

SEQ ID NO: 3327043 - RNA, 16 nt, Human
ucucuaguuugauuaa

SEQ ID NO: 3327044 - RNA, 19 nt, Human
ucucuaguuugauuaaauu

SEQ ID NO: 3327045 - RNA, 18 nt, Human
ucucuaguuugauuaaau

SEQ ID NO: 3327046 - RNA, 15 nt, Human
ucucuacaaaaagca

SEQ ID NO: 3327047 - RNA, 13 nt, Human
ucucugaggacac

SEQ ID NO: 3327048 - RNA, 14 nt, Human
ucuacacugugcug

SEQ ID NO: 3327049 - RNA, 12 nt, Human
ucuacacugugc

SEQ ID NO: 3327050 - RNA, 15 nt, Human
ucuacacugugcuga

SEQ ID NO: 3327051 - RNA, 18 nt, Human
ucuacugaggugcuaugu

SEQ ID NO: 3327052 - RNA, 19 nt, Human
ucuacugaggugcuauguu

SEQ ID NO: 3327053 - RNA, 19 nt, Human
ucuagggaaaaaccagcgu

SEQ ID NO: 3327054 - RNA, 22 nt, Human
ucuagggaaaaaccagcgugug

SEQ ID NO: 3327055 - RNA, 22 nt, Human
ucuacugaggugcuauguucuu

SEQ ID NO: 3327056 - RNA, 16 nt, Human
ucuaacuucaccauau

SEQ ID NO: 3327057 - RNA, 15 nt, Human
ucuaacuucaccaua

SEQ ID NO: 3327058 - RNA, 22 nt, Human
ucuaaaucuccaaaauaaaacu

SEQ ID NO: 3327059 - RNA, 18 nt, Human
ucucaaauuucuaaaucu

SEQ ID NO: 3327060 - RNA, 22 nt, Human
ucucaaacucuugaccucaggu

SEQ ID NO: 3327061 - RNA, 13 nt, Human
ucucaaacucuug

SEQ ID NO: 3327062 - RNA, 21 nt, Human
ucucaaacucuugaccucagg

SEQ ID NO: 3327063 - RNA, 17 nt, Human
ucucacuguugcccagg

SEQ ID NO: 3327064 - RNA, 17 nt, Human
ucucagaaucucaaaua

SEQ ID NO: 3327065 - RNA, 21 nt, Human
ucucagaaucucaaauaacua

SEQ ID NO: 3327066 - RNA, 18 nt, Human
ucucacuguugcccaggc

SEQ ID NO: 3327067 - RNA, 19 nt, Human
ucucacuguugcccaggcu

SEQ ID NO: 3327068 - RNA, 20 nt, Human
ucucacuguugcccaggcug

SEQ ID NO: 3327069 - RNA, 21 nt, Human
ucucacuguugcccaggcugg

SEQ ID NO: 3327070 - RNA, 18 nt, Human
ucucacucugucgcccag

SEQ ID NO: 3327071 - RNA, 16 nt, Human
ucucacucugucgccc

SEQ ID NO: 3327072 - RNA, 17 nt, Human
ucucacucugucgccca

SEQ ID NO: 3327073 - RNA, 19 nt, Human
uccuucuguccuacucugu

SEQ ID NO: 3327074 - RNA, 12 nt, Human
uccuucuguccu

SEQ ID NO: 3327075 - RNA, 15 nt, Human
uccugguguggaaga

SEQ ID NO: 3327076 - RNA, 17 nt, Human
uccuggcccacugcauc

SEQ ID NO: 3327077 - RNA, 22 nt, Human
uccuggcaugggaaugaauguc

SEQ ID NO: 3327078 - RNA, 10 nt, Human
ucccucccuu

SEQ ID NO: 3327079 - RNA, 23 nt, Human
ucgcugugucagcauagaaguaa

SEQ ID NO: 3327080 - RNA, 17 nt, Human
ucgaguuacagacaaag

SEQ ID NO: 3327081 - RNA, 15 nt, Human
ucgaguuacagacaa

SEQ ID NO: 3327082 - RNA, 13 nt, Human
uccaccugccagg

SEQ ID NO: 3327083 - RNA, 18 nt, Human
uccagcucaccagcccca

SEQ ID NO: 3327084 - RNA, 12 nt, Human
uccaccugccag

SEQ ID NO: 3327085 - RNA, 14 nt, Human
uccacaagagccca

SEQ ID NO: 3327086 - RNA, 22 nt, Human
uccaagcaggacauggacaagg

SEQ ID NO: 3327087 - RNA, 19 nt, Human
uccaagaagcccaggaaag

SEQ ID NO: 3327088 - RNA, 22 nt, Human
uccaagaagcccaggaaaggcu

SEQ ID NO: 3327089 - RNA, 20 nt, Human
uccaagaagcccaggaaagg

SEQ ID NO: 3327090 - RNA, 17 nt, Human
uccaaaauaaaacuuuu

SEQ ID NO: 3327091 - RNA, 16 nt, Human
uccaaaauaaaacuuu

SEQ ID NO: 3327092 - RNA, 13 nt, Human
ucauaaugacuua

SEQ ID NO: 3327093 - RNA, 13 nt, Human
ucauacccacccc

SEQ ID NO: 3327094 - RNA, 24 nt, Human
ucagucugauucccaagcucugcu

SEQ ID NO: 3327095 - RNA, 15 nt, Human
ucagucuggcccuuc

SEQ ID NO: 3327096 - RNA, 23 nt, Human
ucagucugauucccaagcucugc

SEQ ID NO: 3327097 - RNA, 23 nt, Human
ucagugguuggcaauuguuucaa

SEQ ID NO: 3327098 - RNA, 13 nt, Human
ucagugugacuga

SEQ ID NO: 3327099 - RNA, 17 nt, Human
ucagugugacugaucuc

SEQ ID NO: 3327100 - RNA, 15 nt, Human
ucauacccaccccca

SEQ ID NO: 3327101 - RNA, 14 nt, Human
ucauacccaccccc

SEQ ID NO: 3327102 - RNA, 20 nt, Human
ucauacccacccccacccaa

SEQ ID NO: 3327103 - RNA, 16 nt, Human
ucauuaggugugacug

SEQ ID NO: 3327104 - RNA, 21 nt, Human
ucauuaggugugacugaauuu

SEQ ID NO: 3327105 - RNA, 18 nt, Human
ucauuaggugugacugaa

SEQ ID NO: 3327106 - RNA, 13 nt, Human
uccauggacuuug

SEQ ID NO: 3327107 - RNA, 15 nt, Human
uccauggacuuuguu

SEQ ID NO: 3327108 - RNA, 14 nt, Human
uccauggacuuugu

SEQ ID NO: 3327109 - RNA, 21 nt, Human
ucccaaagugcugggauuaca

SEQ ID NO: 3327110 - RNA, 23 nt, Human
uccagcucaccagccccagugcc

SEQ ID NO: 3327111 - RNA, 13 nt, Human
ucccaacucaccc

SEQ ID NO: 3327112 - RNA, 16 nt, Human
ucccaacucaccccag

SEQ ID NO: 3327113 - RNA, 15 nt, Human
ucccaacucacccca

SEQ ID NO: 3327114 - RNA, 14 nt, Human
ucccaacucacccc

SEQ ID NO: 3327115 - RNA, 17 nt, Human
ucccaagcucugcuccu

SEQ ID NO: 3327116 - RNA, 12 nt, Human
ucccaagcucug

SEQ ID NO: 3327117 - RNA, 13 nt, Human
ucccaagcucugc

SEQ ID NO: 3327118 - RNA, 14 nt, Human
ucccaagcucugcu

SEQ ID NO: 3327119 - RNA, 15 nt, Human
ucccaagcucugcuc

SEQ ID NO: 3327120 - RNA, 13 nt, Human
ucccaccucagcc

SEQ ID NO: 3327121 - RNA, 14 nt, Human
ucccaccucagccu

SEQ ID NO: 3327122 - RNA, 15 nt, Human
ucccaccucagccuc

SEQ ID NO: 3327123 - RNA, 21 nt, Human
ucccaggcauuccccaggagg

SEQ ID NO: 3327124 - RNA, 20 nt, Human
ucccaggcauuccccaggag

SEQ ID NO: 3327125 - RNA, 19 nt, Human
ucccaggcauuccccagga

SEQ ID NO: 3327126 - RNA, 22 nt, Human
ucccaggcauuccccaggaggc

SEQ ID NO: 3327127 - RNA, 23 nt, Human
ucccaucucacacaugagcauca

SEQ ID NO: 3327128 - RNA, 20 nt, Human
ucccaucucacacaugagca

SEQ ID NO: 3327129 - RNA, 22 nt, Human
uccccacuugagaauuacccuu

SEQ ID NO: 3327130 - RNA, 19 nt, Human
uccccuguagagugggagc

SEQ ID NO: 3327131 - RNA, 24 nt, Human
uccccugcuggguguggcgcagca

SEQ ID NO: 3327132 - RNA, 23 nt, Human
uccccuguccccgcacugggcuu

SEQ ID NO: 3327133 - RNA, 22 nt, Human
uccccuguagagugggagcuga

SEQ ID NO: 3327134 - RNA, 21 nt, Human
uccccugcuggguguggcgca

SEQ ID NO: 3327135 - RNA, 20 nt, Human
uccccugcuggguguggcgc

SEQ ID NO: 3327136 - RNA, 15 nt, Human
uccccugcugggugu

SEQ ID NO: 3327137 - RNA, 14 nt, Human
uccccugcugggug

SEQ ID NO: 3327138 - RNA, 15 nt, Human
ucccucccucuuucc

SEQ ID NO: 3327139 - RNA, 17 nt, Human
ucccucccucuuucccu

SEQ ID NO: 3327140 - RNA, 15 nt, Human
ucccuacuguaauuu

SEQ ID NO: 3327141 - RNA, 21 nt, Human
ucccccuuccauggacuuugu

SEQ ID NO: 3327142 - RNA, 20 nt, Human
uccccgcacugggcuugggg

SEQ ID NO: 3327143 - RNA, 22 nt, Human
ucccccagccccauccucugua

SEQ ID NO: 3327144 - RNA, 11 nt, Human
ucacaggcagg

SEQ ID NO: 3327145 - RNA, 21 nt, Human
ucacacaugagcaucaggcca

SEQ ID NO: 3327146 - RNA, 22 nt, Human
ucacacagugagucgaggacag

SEQ ID NO: 3327147 - RNA, 23 nt, Human
ucacacagugagucgaggacagg

SEQ ID NO: 3327148 - RNA, 19 nt, Human
ucaauuacaggaaguacug

SEQ ID NO: 3327149 - RNA, 21 nt, Human
ucacacaguauuacuucugcu

SEQ ID NO: 3327150 - RNA, 22 nt, Human
ucacacaguauuacuucugcua

SEQ ID NO: 3327151 - RNA, 13 nt, Human
ucacacagugagu

SEQ ID NO: 3327152 - RNA, 13 nt, Human
ucaauaggaaaaa

SEQ ID NO: 3327153 - RNA, 14 nt, Human
ucaaugcacugaca

SEQ ID NO: 3327154 - RNA, 14 nt, Human
ucaauaggaaaaac

SEQ ID NO: 3327155 - RNA, 18 nt, Human
ucaaugcacugacauugu

SEQ ID NO: 3327156 - RNA, 18 nt, Human
ucaauuacaggaaguacu

SEQ ID NO: 3327157 - RNA, 13 nt, Human
ucaauuacaggaa

SEQ ID NO: 3327158 - RNA, 19 nt, Human
ucaaggauccugagccaga

SEQ ID NO: 3327159 - RNA, 18 nt, Human
ucaaggauccugagccag

SEQ ID NO: 3327160 - RNA, 22 nt, Human
ucaagugauucuccugccucag

SEQ ID NO: 3327161 - RNA, 17 nt, Human
ucaaggauccugagcca

SEQ ID NO: 3327162 - RNA, 21 nt, Human
ucaagugauucuccugccuca

SEQ ID NO: 3327163 - RNA, 20 nt, Human
ucaaggauccugagccagau

SEQ ID NO: 3327164 - RNA, 16 nt, Human
ucaagcgauucuucug

SEQ ID NO: 3327165 - RNA, 21 nt, Human
ucaagcgauucuucugcuuca

SEQ ID NO: 3327166 - RNA, 13 nt, Human
ucaaccuccuggg

SEQ ID NO: 3327167 - RNA, 22 nt, Human
ucaaacucuugaccucagguga

SEQ ID NO: 3327168 - RNA, 13 nt, Human
ucaaacuuuacua

SEQ ID NO: 3327169 - RNA, 15 nt, Human
ucaaacuuuacuaug

SEQ ID NO: 3327170 - RNA, 16 nt, Human
ucaaacuuuacuaugg

SEQ ID NO: 3327171 - RNA, 14 nt, Human
ucaaacucuuaaaa

SEQ ID NO: 3327172 - RNA, 22 nt, Human
ucaaaacgguuuuacugcagcu

SEQ ID NO: 3327173 - RNA, 15 nt, Human
uauuuuuuuacuaau

SEQ ID NO: 3327174 - RNA, 20 nt, Human
uaucugaaaauguaugugua

SEQ ID NO: 3327175 - RNA, 14 nt, Human
uaucugaaaaugua

SEQ ID NO: 3327176 - RNA, 15 nt, Human
uaucugaaaauguau

SEQ ID NO: 3327177 - RNA, 23 nt, Human
uauuuauuaaaugcccagccccu

SEQ ID NO: 3327178 - RNA, 14 nt, Human
ucagacagcugccu

SEQ ID NO: 3327179 - RNA, 20 nt, Human
ucagacagcugccugggauc

SEQ ID NO: 3327180 - RNA, 19 nt, Human
ucagacagcugccugggau

SEQ ID NO: 3327181 - RNA, 18 nt, Human
ucagacagcugccuggga

SEQ ID NO: 3327182 - RNA, 17 nt, Human
ucagacagcugccuggg

SEQ ID NO: 3327183 - RNA, 16 nt, Human
ucagacagcugccugg

SEQ ID NO: 3327184 - RNA, 15 nt, Human
ucagacagcugccug

SEQ ID NO: 3327185 - RNA, 18 nt, Human
ucagcacgauuucuguuu

SEQ ID NO: 3327186 - RNA, 19 nt, Human
ucagcacgauuucuguuua

SEQ ID NO: 3327187 - RNA, 19 nt, Human
ucacucugucgcccagucu

SEQ ID NO: 3327188 - RNA, 12 nt, Human
ucacucugucgc

SEQ ID NO: 3327189 - RNA, 16 nt, Human
ucacucugucgcccag

SEQ ID NO: 3327190 - RNA, 18 nt, Human
ucacugcuuaacuucaca

SEQ ID NO: 3327191 - RNA, 17 nt, Human
ucacugcuuaacuucac

SEQ ID NO: 3327192 - RNA, 15 nt, Human
ucacugcuuaacuuc

SEQ ID NO: 3327193 - RNA, 16 nt, Human
ucacgccacugcacua

SEQ ID NO: 3327194 - RNA, 13 nt, Human
ucacgccacugca

SEQ ID NO: 3327195 - RNA, 14 nt, Human
ucacgccacugcac

SEQ ID NO: 3327196 - RNA, 19 nt, Human
ucacgccuguaauccuagc

SEQ ID NO: 3327197 - RNA, 20 nt, Human
ucacgccuguaauccuagca

SEQ ID NO: 3327198 - RNA, 22 nt, Human
ucaccuuuguccccaccgcaga

SEQ ID NO: 3327199 - RNA, 18 nt, Human
ucaccuuuguccccaccg

SEQ ID NO: 3327200 - RNA, 17 nt, Human
ucaccuuuguccccacc

SEQ ID NO: 3327201 - RNA, 15 nt, Human
ucaccuuugucccca

SEQ ID NO: 3327202 - RNA, 14 nt, Human
ucaccuuugucccc

SEQ ID NO: 3327203 - RNA, 12 nt, Human
ucaccuuugucc

SEQ ID NO: 3327204 - RNA, 14 nt, Human
ucaccuuucccauc

SEQ ID NO: 3327205 - RNA, 19 nt, Human
ucacaggcagguccagggu

SEQ ID NO: 3327206 - RNA, 12 nt, Human
ucacaggcaggu

SEQ ID NO: 3327207 - RNA, 15 nt, Human
ucacaggcaggucca

SEQ ID NO: 3327208 - RNA, 14 nt, Human
ucacggaagagccu

SEQ ID NO: 3327209 - RNA, 17 nt, Human
ucacggaagagccuugc

SEQ ID NO: 3327210 - RNA, 16 nt, Human
ucacggaagagccuug

SEQ ID NO: 3327211 - RNA, 13 nt, Human
ucacggcucacug

SEQ ID NO: 3327212 - RNA, 15 nt, Human
ucacggcucacugca

SEQ ID NO: 3327213 - RNA, 20 nt, Human
ucacggcucacugcagccuc

SEQ ID NO: 3327214 - RNA, 13 nt, Human
ucacuccuugaaa

SEQ ID NO: 3327215 - RNA, 22 nt, Human
ucacucuggcagcucagagagg

SEQ ID NO: 3327216 - RNA, 20 nt, Human
ucacucuggcagcucagaga

SEQ ID NO: 3327217 - RNA, 19 nt, Human
ucacucuggcagcucagag

SEQ ID NO: 3327218 - RNA, 18 nt, Human
ucacucuggcagcucaga

SEQ ID NO: 3327219 - RNA, 17 nt, Human
ucacucuggcagcucag

SEQ ID NO: 3327220 - RNA, 16 nt, Human
ucacucuggcagcuca

SEQ ID NO: 3327221 - RNA, 15 nt, Human
ucacucuggcagcuc

SEQ ID NO: 3327222 - RNA, 14 nt, Human
ucacucuggcagcu

SEQ ID NO: 3327223 - RNA, 23 nt, Human
ucacucuccuuggugucgggcau

SEQ ID NO: 3327224 - RNA, 13 nt, Human
ucacucuggcagc

SEQ ID NO: 3327225 - RNA, 12 nt, Human
ucacucuggcag

SEQ ID NO: 3327226 - RNA, 14 nt, Human
ucacucuccuuggu

SEQ ID NO: 3327227 - RNA, 12 nt, Human
ucacucuccuug

SEQ ID NO: 3327228 - RNA, 18 nt, West Nile virus
cuagagguuagaggagac

SEQ ID NO: 3327229 - RNA, 19 nt, West Nile virus
gcuaugguguuaaccaggg

SEQ ID NO: 3327230 - RNA, 13 nt, West Nile virus
acauagguggcug

SEQ ID NO: 3327231 - RNA, 18 nt, West Nile virus
accccaggaggacugggu

SEQ ID NO: 3327232 - RNA, 22 nt, West Nile virus
accccgcguaaaaaagugcacg

SEQ ID NO: 3327233 - RNA, 17 nt, West Nile virus
cgucucggaaggaggac

SEQ ID NO: 3327234 - RNA, 19 nt, West Nile virus
cagccacacggcacagugc

SEQ ID NO: 3327235 - RNA, 14 nt, West Nile virus
cauagguggcuggu

SEQ ID NO: 3327236 - RNA, 17 nt, West Nile virus
uuagccucaaagcccag

SEQ ID NO: 3327237 - RNA, 15 nt, West Nile virus
aaggacuagagguua

SEQ ID NO: 3327238 - RNA, 19 nt, West Nile virus
ccacgugcuuuagccucaa

SEQ ID NO: 3327239 - RNA, 15 nt, West Nile virus
cacguaagcccucag

SEQ ID NO: 3327240 - RNA, 13 nt, West Nile virus
agaccccgugcca

SEQ ID NO: 3327241 - RNA, 14 nt, West Nile virus
guguuaaccaggga

SEQ ID NO: 3327242 - RNA, 13 nt, West Nile virus
ccagguggacugg

SEQ ID NO: 3327243 - RNA, 20 nt, West Nile virus
gccagauuaaugcugccacc

SEQ ID NO: 3327244 - RNA, 20 nt, West Nile virus
cgcguaaaaaagugcacggc

SEQ ID NO: 3327245 - RNA, 20 nt, West Nile virus
ccugcggcucaaccccagga

SEQ ID NO: 3327246 - RNA, 22 nt, West Nile virus
ugcggcucaaccccaggaggac

SEQ ID NO: 3327247 - RNA, 21 nt, West Nile virus
uugagaauggaagucaggcca

SEQ ID NO: 3327248 - RNA, 14 nt, West Nile virus
gugucagaccacac

SEQ ID NO: 3327249 - RNA, 22 nt, West Nile virus
gcggcucaaccccaggaggacu

SEQ ID NO: 3327250 - RNA, 13 nt, West Nile virus
aaccccaggagga

SEQ ID NO: 3327251 - RNA, 23 nt, West Nile virus
cugccugcggcucaaccccagga

SEQ ID NO: 3327252 - RNA, 11 nt, West Nile virus
accaaagcugc

SEQ ID NO: 3327253 - RNA, 17 nt, West Nile virus
uaaccagggagaaggga

SEQ ID NO: 3327254 - RNA, 22 nt, West Nile virus
agugccccagguggacuggguu

SEQ ID NO: 3327255 - RNA, 17 nt, West Nile virus
cauagguggcugguggu

SEQ ID NO: 3327256 - RNA, 15 nt, West Nile virus
cacacggcacagugc

SEQ ID NO: 3327257 - RNA, 22 nt, West Nile virus
gcccaacuuggcugaagcugua

SEQ ID NO: 3327258 - RNA, 15 nt, West Nile virus
uguaagccaagggaa

SEQ ID NO: 3327259 - RNA, 22 nt, West Nile virus
gccauaacccuggcuauggugu

SEQ ID NO: 3327260 - RNA, 23 nt, West Nile virus
acggcccaacuuggcugaagcug

SEQ ID NO: 3327261 - RNA, 15 nt, West Nile virus
cugcgauagugcccc

SEQ ID NO: 3327262 - RNA, 20 nt, West Nile virus
ccccgcguaaaaaagugcac

SEQ ID NO: 3327263 - RNA, 22 nt, West Nile virus
aggacuagagguuagaggagac

SEQ ID NO: 3327264 - RNA, 19 nt, West Nile virus
auuuauugagaauggaagu

SEQ ID NO: 3327265 - RNA, 16 nt, West Nile virus
acacuuuaaugugcca

SEQ ID NO: 3327266 - RNA, 21 nt, West Nile virus
ccagauuaaugcugccaccgg

SEQ ID NO: 3327267 - RNA, 13 nt, West Nile virus
caaccccaggagg

SEQ ID NO: 3327268 - RNA, 19 nt, West Nile virus
gagguuagaggagaccccg

SEQ ID NO: 3327269 - RNA, 14 nt, West Nile virus
cagguggacugggu

SEQ ID NO: 3327270 - RNA, 16 nt, West Nile virus
cgauagugccccaggu

SEQ ID NO: 3327271 - RNA, 21 nt, West Nile virus
cugcacaaccagccacacggc

SEQ ID NO: 3327272 - RNA, 15 nt, West Nile virus
ugaccaaagcugcga

SEQ ID NO: 3327273 - RNA, 22 nt, West Nile virus
gcuguaagccaagggaaggacu

SEQ ID NO: 3327274 - RNA, 15 nt, West Nile virus
ucucggaaggaggac

SEQ ID NO: 3327275 - RNA, 20 nt, West Nile virus
aggccagauuaaugcugcca

SEQ ID NO: 3327276 - RNA, 18 nt, West Nile virus
ccaagggaaggacuagag

SEQ ID NO: 3327277 - RNA, 13 nt, West Nile virus
aagggaaggacua

SEQ ID NO: 3327278 - RNA, 20 nt, West Nile virus
ccacacuuuaaugugccacu

SEQ ID NO: 3327279 - RNA, 20 nt, West Nile virus
ccacgcggccauaacccugg

SEQ ID NO: 3327280 - RNA, 12 nt, West Nile virus
ugcagucugcga

SEQ ID NO: 3327281 - RNA, 18 nt, West Nile virus
acuagagguuagaggaga

SEQ ID NO: 3327282 - RNA, 16 nt, West Nile virus
agagguuagaggagac

SEQ ID NO: 3327283 - RNA, 20 nt, West Nile virus
ccagggagaagggacuagag

SEQ ID NO: 3327284 - RNA, 18 nt, West Nile virus
aggagaccccgugccaaa

SEQ ID NO: 3327285 - RNA, 16 nt, West Nile virus
cacuuuaaugugccac

SEQ ID NO: 3327286 - RNA, 19 nt, West Nile virus
gauccacguaagcccucag

SEQ ID NO: 3327287 - RNA, 16 nt, West Nile virus
agccucaaagcccagu

SEQ ID NO: 3327288 - RNA, 15 nt, West Nile virus
agaagggacuagagg

SEQ ID NO: 3327289 - RNA, 19 nt, West Nile virus
agaggagaccccgcguaaa

SEQ ID NO: 3327290 - RNA, 20 nt, West Nile virus
agucugcgauagugccccag

SEQ ID NO: 3327291 - RNA, 13 nt, West Nile virus
cccagguggacug

SEQ ID NO: 3327292 - RNA, 18 nt, West Nile virus
cgauagugccccaggugg

SEQ ID NO: 3327293 - RNA, 20 nt, West Nile virus
uugaguagacggugcugccu

SEQ ID NO: 3327294 - RNA, 22 nt, West Nile virus
ggacuagagguuagaggagacc

SEQ ID NO: 3327295 - RNA, 16 nt, West Nile virus
gauagugccccaggug

SEQ ID NO: 3327296 - RNA, 19 nt, West Nile virus
cacacuuuaaugugccacu

SEQ ID NO: 3327297 - RNA, 19 nt, West Nile virus
agucugcgauagugcccca

SEQ ID NO: 3327298 - RNA, 16 nt, West Nile virus
cagauuaaugcugcca

SEQ ID NO: 3327299 - RNA, 13 nt, West Nile virus
uagagguuagagg

SEQ ID NO: 3327300 - RNA, 22 nt, West Nile virus
agcuguaagccaagggaaggac

SEQ ID NO: 3327301 - RNA, 13 nt, West Nile virus
acaaccagccaca

SEQ ID NO: 3327302 - RNA, 15 nt, West Nile virus
auuaaugcugccacc

SEQ ID NO: 3327303 - RNA, 17 nt, West Nile virus
acugggugaccaaagcu

SEQ ID NO: 3327304 - RNA, 19 nt, West Nile virus
acuuggcugaagcuguaag

SEQ ID NO: 3327305 - RNA, 17 nt, West Nile virus
cggaaggaggaccccac

SEQ ID NO: 3327306 - RNA, 15 nt, West Nile virus
cugggauagacuagg

SEQ ID NO: 3327307 - RNA, 22 nt, West Nile virus
gugcagucugcgauagugcccc

SEQ ID NO: 3327308 - RNA, 14 nt, West Nile virus
ugcggcucaacccc

SEQ ID NO: 3327309 - RNA, 22 nt, West Nile virus
ucaggccagauuaaugcugcca

SEQ ID NO: 3327310 - RNA, 20 nt, West Nile virus
cacucugcggagagugcagu

SEQ ID NO: 3327311 - RNA, 21 nt, West Nile virus
augugccacucugcggagagu

SEQ ID NO: 3327312 - RNA, 16 nt, West Nile virus
cucaaccccaggagga

SEQ ID NO: 3327313 - RNA, 22 nt, West Nile virus
agucaggccagauuaaugcugc

SEQ ID NO: 3327314 - RNA, 15 nt, West Nile virus
guguuaaccagggag

SEQ ID NO: 3327315 - RNA, 20 nt, West Nile virus
aagggaaggacuagagguua

SEQ ID NO: 3327316 - RNA, 18 nt, West Nile virus
aggccagauuaaugcugc

SEQ ID NO: 3327317 - RNA, 16 nt, West Nile virus
aagggacuagagguua

SEQ ID NO: 3327318 - RNA, 17 nt, West Nile virus
aaccccaggaggacugg

SEQ ID NO: 3327319 - RNA, 14 nt, West Nile virus
agggagaagggacu

SEQ ID NO: 3327320 - RNA, 15 nt, West Nile virus
cagguggacuggguu

SEQ ID NO: 3327321 - RNA, 15 nt, West Nile virus
agugccccaggugga

SEQ ID NO: 3327322 - RNA, 21 nt, West Nile virus
agaaccgucucggaaggagga

SEQ ID NO: 3327323 - RNA, 13 nt, West Nile virus
cuagaacacagga

SEQ ID NO: 3327324 - RNA, 16 nt, West Nile virus
ccacguaagcccucag

SEQ ID NO: 3327325 - RNA, 20 nt, West Nile virus
uggcuaugguguuaaccagg

SEQ ID NO: 3327326 - RNA, 15 nt, West Nile virus
caggaggacugggug

SEQ ID NO: 3327327 - RNA, 19 nt, West Nile virus
ugauccacguaagcccuca

SEQ ID NO: 3327328 - RNA, 15 nt, West Nile virus
cucaaagcccagugu

SEQ ID NO: 3327329 - RNA, 21 nt, West Nile virus
cuagagguuagaggagacccc

SEQ ID NO: 3327330 - RNA, 19 nt, West Nile virus
gcauauugacaccugggau

SEQ ID NO: 3327331 - RNA, 23 nt, West Nile virus
cuuggcugaagcuguaagccaag

SEQ ID NO: 3327332 - RNA, 17 nt, West Nile virus
gccccacgcggccauaa

SEQ ID NO: 3327333 - RNA, 21 nt, West Nile virus
agaccacacuuuaaugugcca

SEQ ID NO: 3327334 - RNA, 20 nt, West Nile virus
aguugaguagacggugcugc

SEQ ID NO: 3327335 - RNA, 15 nt, West Nile virus
agggacuagagguua

SEQ ID NO: 3327336 - RNA, 14 nt, West Nile virus
gcgauagugcccca

SEQ ID NO: 3327337 - RNA, 16 nt, West Nile virus
cuguaagccaagggaa

SEQ ID NO: 3327338 - RNA, 14 nt, West Nile virus
ggcucaaccccagg

SEQ ID NO: 3327339 - RNA, 21 nt, West Nile virus
gugaccaaagcugcgagguga

SEQ ID NO: 3327340 - RNA, 18 nt, West Nile virus
ucugcgauagugccccag

SEQ ID NO: 3327341 - RNA, 15 nt, West Nile virus
cgugcuuuagccuca

SEQ ID NO: 3327342 - RNA, 23 nt, West Nile virus
agaccacacuuuaaugugccacu

SEQ ID NO: 3327343 - RNA, 17 nt, West Nile virus
augcugccaccggaagu

SEQ ID NO: 3327344 - RNA, 16 nt, West Nile virus
ggcccaacuuggcuga

SEQ ID NO: 3327345 - RNA, 16 nt, West Nile virus
ccacacggcacagugc

SEQ ID NO: 3327346 - RNA, 14 nt, West Nile virus
ccacucugcggaga

SEQ ID NO: 3327347 - RNA, 15 nt, West Nile virus
cauauugacaccugg

SEQ ID NO: 3327348 - RNA, 21 nt, West Nile virus
ccagccacacggcacagugcg

SEQ ID NO: 3327349 - RNA, 16 nt, West Nile virus
auagugccccaggugg

SEQ ID NO: 3327350 - RNA, 15 nt, West Nile virus
cucaaccccaggagg

SEQ ID NO: 3327351 - RNA, 16 nt, West Nile virus
ugauccacguaagccc

SEQ ID NO: 3327352 - RNA, 19 nt, West Nile virus
cugcgauagugccccaggu

SEQ ID NO: 3327353 - RNA, 13 nt, West Nile virus
gcugccaccggaa

SEQ ID NO: 3327354 - RNA, 13 nt, West Nile virus
agguggacugggu

SEQ ID NO: 3327355 - RNA, 15 nt, West Nile virus
cggcucaaccccagg

SEQ ID NO: 3327356 - RNA, 18 nt, West Nile virus
cugcgauagugccccagg

SEQ ID NO: 3327357 - RNA, 13 nt, West Nile virus
gucucggaaggag

SEQ ID NO: 3327358 - RNA, 13 nt, West Nile virus
ucgccccacgcgg

SEQ ID NO: 3327359 - RNA, 13 nt, West Nile virus
agagguuagagga

SEQ ID NO: 3327360 - RNA, 18 nt, West Nile virus
cugcggcucaaccccagg

SEQ ID NO: 3327361 - RNA, 21 nt, West Nile virus
ugcggcucaaccccaggagga

SEQ ID NO: 3327362 - RNA, 20 nt, West Nile virus
cggcucaaccccaggaggac

SEQ ID NO: 3327363 - RNA, 18 nt, West Nile virus
guaagccaagggaaggac

SEQ ID NO: 3327364 - RNA, 23 nt, West Nile virus
gaccccgcguaaaaaagugcacg

SEQ ID NO: 3327365 - RNA, 15 nt, West Nile virus
ccuggcuaugguguu

SEQ ID NO: 3327366 - RNA, 17 nt, West Nile virus
ggugcuagaacacagga

SEQ ID NO: 3327367 - RNA, 13 nt, West Nile virus
caaccagccacac

SEQ ID NO: 3327368 - RNA, 14 nt, West Nile virus
caggaggacugggu

SEQ ID NO: 3327369 - RNA, 14 nt, West Nile virus
ugcuagaacacagg

SEQ ID NO: 3327370 - RNA, 15 nt, West Nile virus
auugacaccugggau

SEQ ID NO: 3327371 - RNA, 13 nt, West Nile virus
gcggcucaacccc

SEQ ID NO: 3327372 - RNA, 19 nt, West Nile virus
gccgacauagguggcuggu

SEQ ID NO: 3327373 - RNA, 13 nt, West Nile virus
cucggaaggagga

SEQ ID NO: 3327374 - RNA, 21 nt, West Nile virus
gccagauuaaugcugccaccg

SEQ ID NO: 3327375 - RNA, 21 nt, West Nile virus
gucugcgauagugccccaggu

SEQ ID NO: 3327376 - RNA, 16 nt, West Nile virus
uagagguuagaggaga

SEQ ID NO: 3327377 - RNA, 22 nt, West Nile virus
cagucugcgauagugccccagg

SEQ ID NO: 3327378 - RNA, 18 nt, West Nile virus
agugccccagguggacug

SEQ ID NO: 3327379 - RNA, 20 nt, West Nile virus
ggacuagagguuagaggaga

SEQ ID NO: 3327380 - RNA, 23 nt, West Nile virus
cagucugcgauagugccccaggu

SEQ ID NO: 3327381 - RNA, 14 nt, West Nile virus
gcggccauaacccu

SEQ ID NO: 3327382 - RNA, 19 nt, West Nile virus
cgacauagguggcuggugg

SEQ ID NO: 3327383 - RNA, 19 nt, West Nile virus
uuaaccagggagaagggac

SEQ ID NO: 3327384 - RNA, 15 nt, West Nile virus
ccagugucagaccac

SEQ ID NO: 3327385 - RNA, 13 nt, West Nile virus
accccgugccaaa

SEQ ID NO: 3327386 - RNA, 17 nt, West Nile virus
cacaaccagccacacgg

SEQ ID NO: 3327387 - RNA, 13 nt, West Nile virus
gacggugcugccu

SEQ ID NO: 3327388 - RNA, 22 nt, West Nile virus
cuguaagccaagggaaggacua

SEQ ID NO: 3327389 - RNA, 21 nt, West Nile virus
cacggcccaacuuggcugaag

SEQ ID NO: 3327390 - RNA, 14 nt, West Nile virus
gauuaaugcugcca

SEQ ID NO: 3327391 - RNA, 14 nt, West Nile virus
uaagccaagggaag

SEQ ID NO: 3327392 - RNA, 17 nt, West Nile virus
cacacggcacagugcgc

SEQ ID NO: 3327393 - RNA, 16 nt, West Nile virus
cggcucaaccccagga

SEQ ID NO: 3327394 - RNA, 23 nt, West Nile virus
caaagcccagugucagaccacac

SEQ ID NO: 3327395 - RNA, 19 nt, West Nile virus
cugaagcuguaagccaagg

SEQ ID NO: 3327396 - RNA, 14 nt, West Nile virus
gcuguaagccaagg

SEQ ID NO: 3327397 - RNA, 16 nt, West Nile virus
cugaagcuguaagcca

SEQ ID NO: 3327398 - RNA, 14 nt, West Nile virus
agacggugcugccu

SEQ ID NO: 3327399 - RNA, 13 nt, West Nile virus
ccaggaggacugg

SEQ ID NO: 3327400 - RNA, 22 nt, West Nile virus
gacauagguggcugguggugcu

SEQ ID NO: 3327401 - RNA, 16 nt, West Nile virus
ccucaaagcccagugu

SEQ ID NO: 3327402 - RNA, 18 nt, West Nile virus
cagcauauugacaccugg

SEQ ID NO: 3327403 - RNA, 14 nt, West Nile virus
ucucggaaggagga

SEQ ID NO: 3327404 - RNA, 23 nt, West Nile virus
ggggaucuucugcucugcacaac

SEQ ID NO: 3327405 - RNA, 22 nt, West Nile virus
cucaaagcccagugucagacca

SEQ ID NO: 3327406 - RNA, 23 nt, West Nile virus
uggcuaugguguuaaccagggag

SEQ ID NO: 3327407 - RNA, 11 nt, West Nile virus
cggugcugccu

SEQ ID NO: 3327408 - RNA, 22 nt, West Nile virus
cagcauauugacaccugggaua

SEQ ID NO: 3327409 - RNA, 19 nt, West Nile virus
ccagauuaaugcugccacc

SEQ ID NO: 3327410 - RNA, 19 nt, West Nile virus
cacggcccaacuuggcuga

SEQ ID NO: 3327411 - RNA, 16 nt, West Nile virus
agggaaggacuagagg

SEQ ID NO: 3327412 - RNA, 21 nt, West Nile virus
ugccugcggcucaaccccagg

SEQ ID NO: 3327413 - RNA, 21 nt, West Nile virus
auuaaugcugccaccggaagu

SEQ ID NO: 3327414 - RNA, 23 nt, West Nile virus
agggacuagagguuagaggagac

SEQ ID NO: 3327415 - RNA, 21 nt, West Nile virus
gccugcggcucaaccccagga

SEQ ID NO: 3327416 - RNA, 17 nt, West Nile virus
cuagagguuagaggaga

SEQ ID NO: 3327417 - RNA, 17 nt, West Nile virus
aguguaaauaggauuua

SEQ ID NO: 3327418 - RNA, 12 nt, West Nile virus
cucaaccccagg

SEQ ID NO: 3327419 - RNA, 19 nt, West Nile virus
gagaagggacuagagguua

SEQ ID NO: 3327420 - RNA, 17 nt, West Nile virus
aaccagggagaagggac

SEQ ID NO: 3327421 - RNA, 18 nt, West Nile virus
caagggaaggacuagagg

SEQ ID NO: 3327422 - RNA, 20 nt, West Nile virus
gucugcgauagugccccagg

SEQ ID NO: 3327423 - RNA, 10 nt, West Nile virus
ccgugccaaa

SEQ ID NO: 3327424 - RNA, 15 nt, West Nile virus
ucaaccccaggagga

SEQ ID NO: 3327425 - RNA, 20 nt, West Nile virus
ugcucugcacaaccagccac

SEQ ID NO: 3327426 - RNA, 20 nt, West Nile virus
ggcugguggugcuagaacac

SEQ ID NO: 3327427 - RNA, 14 nt, Human
aaaaacacaaaagu

SEQ ID NO: 3327428 - RNA, 15 nt, Human
aaaaacugauuuuuu

SEQ ID NO: 3327429 - RNA, 14 nt, Human
aaaaacauggccuu

SEQ ID NO: 3327430 - RNA, 13 nt, Human
aaaaacugauuuu

SEQ ID NO: 3327431 - RNA, 12 nt, Human
aaaaagaggcua

SEQ ID NO: 3327432 - RNA, 12 nt, Human
aaaacacauuuu

SEQ ID NO: 3327433 - RNA, 17 nt, Human
aucuugaagacuuuucu

SEQ ID NO: 3327434 - RNA, 14 nt, Human
aucuucuuuauaau

SEQ ID NO: 3327435 - RNA, 17 nt, Human
aucuucuuuauaauucu

SEQ ID NO: 3327436 - RNA, 22 nt, Human
aucucucgugauugauaagaac

SEQ ID NO: 3327437 - RNA, 19 nt, Human
aucuuccaacucaaacucu

SEQ ID NO: 3327438 - RNA, 13 nt, Human
augagccuggcaa

SEQ ID NO: 3327439 - RNA, 14 nt, Human
augagccuggcaag

SEQ ID NO: 3327440 - RNA, 12 nt, Human
augacccagugg

SEQ ID NO: 3327441 - RNA, 12 nt, Human
augacuccagaa

SEQ ID NO: 3327442 - RNA, 16 nt, Human
augacuccagaauuuc

SEQ ID NO: 3327443 - RNA, 17 nt, Human
augacuccagaauuucc

SEQ ID NO: 3327444 - RNA, 12 nt, Human
augagccuggca

SEQ ID NO: 3327445 - RNA, 11 nt, Human
aucagccuggg

SEQ ID NO: 3327446 - RNA, 20 nt, Human
aucagccugggcaaugugau

SEQ ID NO: 3327447 - RNA, 21 nt, Human
aucagccugggcaaugugaua

SEQ ID NO: 3327448 - RNA, 12 nt, Human
aucagcugcuac

SEQ ID NO: 3327449 - RNA, 23 nt, Human
aucagcugcuacuacuccuguag

SEQ ID NO: 3327450 - RNA, 13 nt, Human
aucagcugcuacu

SEQ ID NO: 3327451 - RNA, 20 nt, Human
aucagccugcuccagcuguu

SEQ ID NO: 3327452 - RNA, 19 nt, Human
aucauggagguuugaagau

SEQ ID NO: 3327453 - RNA, 16 nt, Human
auccacccaccucagc

SEQ ID NO: 3327454 - RNA, 20 nt, Human
auccacccaccucagccucc

SEQ ID NO: 3327455 - RNA, 18 nt, Human
auccacccaccucagccu

SEQ ID NO: 3327456 - RNA, 18 nt, Human
auccucauacccaccccc

SEQ ID NO: 3327457 - RNA, 17 nt, Human
auccucauacccacccc

SEQ ID NO: 3327458 - RNA, 19 nt, Human
auccucauacccaccccca

SEQ ID NO: 3327459 - RNA, 22 nt, Human
auccucauacccacccccaccc

SEQ ID NO: 3327460 - RNA, 15 nt, Human
aucccuacuguaauu

SEQ ID NO: 3327461 - RNA, 13 nt, Human
auccuccaggugc

SEQ ID NO: 3327462 - RNA, 14 nt, Human
auccuccaggugca

SEQ ID NO: 3327463 - RNA, 19 nt, Human
auccuccaggugcacaagc

SEQ ID NO: 3327464 - RNA, 22 nt, Human
auccuccaggugcacaagcucc

SEQ ID NO: 3327465 - RNA, 11 nt, Human
auccuccucag

SEQ ID NO: 3327466 - RNA, 13 nt, Human
aucgaugcagugc

SEQ ID NO: 3327467 - RNA, 21 nt, Human
augccuggauggggcugcacc

SEQ ID NO: 3327468 - RNA, 23 nt, Human
augccuggauggggcugcaccgg

SEQ ID NO: 3327469 - RNA, 14 nt, Human
augccugguggcag

SEQ ID NO: 3327470 - RNA, 17 nt, Human
augccugggcagaagga

SEQ ID NO: 3327471 - RNA, 17 nt, Human
augccugguggcagcug

SEQ ID NO: 3327472 - RNA, 16 nt, Human
augccugguggcagcu

SEQ ID NO: 3327473 - RNA, 15 nt, Human
augccugguggcagc

SEQ ID NO: 3327474 - RNA, 18 nt, Human
augcauuugaaaauuuug

SEQ ID NO: 3327475 - RNA, 10 nt, Human
augcauuuga

SEQ ID NO: 3327476 - RNA, 12 nt, Human
augcauuugaaa

SEQ ID NO: 3327477 - RNA, 20 nt, Human
augcaugaaguaauaugcac

SEQ ID NO: 3327478 - RNA, 23 nt, Human
augcaugaaguaauaugcacaca

SEQ ID NO: 3327479 - RNA, 17 nt, Human
augcacacauuuuuuaa

SEQ ID NO: 3327480 - RNA, 19 nt, Human
augcacacauuuuuuaaau

SEQ ID NO: 3327481 - RNA, 22 nt, Human
augcacacauuuuuuaaaugca

SEQ ID NO: 3327482 - RNA, 23 nt, Human
augcacagaguuguuacauuuuu

SEQ ID NO: 3327483 - RNA, 14 nt, Human
augcacagcuaaca

SEQ ID NO: 3327484 - RNA, 21 nt, Human
augcacagcuaacauggaagu

SEQ ID NO: 3327485 - RNA, 15 nt, Human
augcacacauuuuuu

SEQ ID NO: 3327486 - RNA, 23 nt, Human
auggcugccaaugggagcucaug

SEQ ID NO: 3327487 - RNA, 15 nt, Human
augggaaugaauguc

SEQ ID NO: 3327488 - RNA, 22 nt, Human
augcuucuucagagacuccugc

SEQ ID NO: 3327489 - RNA, 19 nt, Human
auggaaaugggcagagcag

SEQ ID NO: 3327490 - RNA, 20 nt, Human
auggaaaugggcagagcaga

SEQ ID NO: 3327491 - RNA, 16 nt, Human
augucacaggcagguc

SEQ ID NO: 3327492 - RNA, 14 nt, Human
augucacaggcagg

SEQ ID NO: 3327493 - RNA, 15 nt, Human
augucacaggcaggu

SEQ ID NO: 3327494 - RNA, 15 nt, Human
auggucggaaaacau

SEQ ID NO: 3327495 - RNA, 17 nt, Human
auguaagcucuacugag

SEQ ID NO: 3327496 - RNA, 14 nt, Human
auguucuuaauucu

SEQ ID NO: 3327497 - RNA, 22 nt, Human
auguucugacccugcuucaaau

SEQ ID NO: 3327498 - RNA, 15 nt, Human
auguucuuaauucuu

SEQ ID NO: 3327499 - RNA, 20 nt, Human
auguucuuaguggauguucu

SEQ ID NO: 3327500 - RNA, 17 nt, Human
auguucucugaggacac

SEQ ID NO: 3327501 - RNA, 18 nt, Human
auguucucugaggacacu

SEQ ID NO: 3327502 - RNA, 18 nt, Human
auguuuuaagaggcaggg

SEQ ID NO: 3327503 - RNA, 16 nt, Human
auguuuuaagaggcag

SEQ ID NO: 3327504 - RNA, 14 nt, Human
auuaaaugcccagc

SEQ ID NO: 3327505 - RNA, 15 nt, Human
auuaaaugcccagcc

SEQ ID NO: 3327506 - RNA, 13 nt, Human
auuaaauucuugc

SEQ ID NO: 3327507 - RNA, 16 nt, Human
auuaaaugcccagccc

SEQ ID NO: 3327508 - RNA, 11 nt, Human
auuaaauuaug

SEQ ID NO: 3327509 - RNA, 14 nt, Human
auguguaaguauuc

SEQ ID NO: 3327510 - RNA, 20 nt, Human
augugggcuaguugggcuuc

SEQ ID NO: 3327511 - RNA, 20 nt, Human
agucaagugaaaaaggagga

SEQ ID NO: 3327512 - RNA, 16 nt, Human
agucaagugaaaaagg

SEQ ID NO: 3327513 - RNA, 13 nt, Human
aguuguuacauuu

SEQ ID NO: 3327514 - RNA, 15 nt, Human
aguuguuacauuuuu

SEQ ID NO: 3327515 - RNA, 16 nt, Human
aguuguuacauuuuua

SEQ ID NO: 3327516 - RNA, 17 nt, Human
aguuacagacaaagcgu

SEQ ID NO: 3327517 - RNA, 18 nt, Human
aguuacagacaaagcgug

SEQ ID NO: 3327518 - RNA, 23 nt, Human
agugugacaaggauugcuacugu

SEQ ID NO: 3327519 - RNA, 18 nt, Human
auaaugugaaacuggauu

SEQ ID NO: 3327520 - RNA, 19 nt, Human
auaaugugaaacuggauua

SEQ ID NO: 3327521 - RNA, 21 nt, Human
auaaugugaaacuggauuaaa

SEQ ID NO: 3327522 - RNA, 12 nt, Human
auaccugucccc

SEQ ID NO: 3327523 - RNA, 15 nt, Human
auaguaugguggcug

SEQ ID NO: 3327524 - RNA, 16 nt, Human
auauacgaacaaaaca

SEQ ID NO: 3327525 - RNA, 14 nt, Human
auauucaggaagcu

SEQ ID NO: 3327526 - RNA, 16 nt, Human
auauucaggaagcuca

SEQ ID NO: 3327527 - RNA, 13 nt, Human
auauucaggaagc

SEQ ID NO: 3327528 - RNA, 16 nt, Human
auaugcuuauacacuu

SEQ ID NO: 3327529 - RNA, 14 nt, Human
auaugcuuauacac

SEQ ID NO: 3327530 - RNA, 19 nt, Human
auaugcuuauacacuuaca

SEQ ID NO: 3327531 - RNA, 22 nt, Human
auaugccugggcagaaggaaga

SEQ ID NO: 3327532 - RNA, 17 nt, Human
agguaaggaauaccugu

SEQ ID NO: 3327533 - RNA, 13 nt, Human
agguucagcuugu

SEQ ID NO: 3327534 - RNA, 15 nt, Human
agguuaauaaaguaa

SEQ ID NO: 3327535 - RNA, 15 nt, Human
agguucaaagauauu

SEQ ID NO: 3327536 - RNA, 17 nt, Human
agguucaaagauauuuu

SEQ ID NO: 3327537 - RNA, 14 nt, Human
agguuaauguucau

SEQ ID NO: 3327538 - RNA, 14 nt, Human
aggucgaggcagga

SEQ ID NO: 3327539 - RNA, 16 nt, Human
aggugcugccauccag

SEQ ID NO: 3327540 - RNA, 17 nt, Human
aggugcugccauccagg

SEQ ID NO: 3327541 - RNA, 15 nt, Human
aggggcacagggucu

SEQ ID NO: 3327542 - RNA, 21 nt, Human
aggggauagagagagaccacu

SEQ ID NO: 3327543 - RNA, 16 nt, Human
aggggauagagagaga

SEQ ID NO: 3327544 - RNA, 19 nt, Human
agggcgggaggauguucug

SEQ ID NO: 3327545 - RNA, 14 nt, Human
agggccuggccuga

SEQ ID NO: 3327546 - RNA, 15 nt, Human
agggccuggccugag

SEQ ID NO: 3327547 - RNA, 16 nt, Human
agggccuggccugagc

SEQ ID NO: 3327548 - RNA, 17 nt, Human
agggccuggccugagcu

SEQ ID NO: 3327549 - RNA, 22 nt, Human
agggcacagaaaauggaagaca

SEQ ID NO: 3327550 - RNA, 21 nt, Human
agggcacaccgggcacucaga

SEQ ID NO: 3327551 - RNA, 20 nt, Human
agggcacaccgggcacucag

SEQ ID NO: 3327552 - RNA, 17 nt, Human
agggcacaccgggcacu

SEQ ID NO: 3327553 - RNA, 18 nt, Human
aggcugccucucccauca

SEQ ID NO: 3327554 - RNA, 12 nt, Human
agggacagaggg

SEQ ID NO: 3327555 - RNA, 13 nt, Human
agggacagagggg

SEQ ID NO: 3327556 - RNA, 21 nt, Human
agggacgcuacccgggaaggg

SEQ ID NO: 3327557 - RNA, 17 nt, Human
agggacgcuacccggga

SEQ ID NO: 3327558 - RNA, 23 nt, Human
aggcuagugugguguuuccuggc

SEQ ID NO: 3327559 - RNA, 19 nt, Human
agcuggucccacucagucc

SEQ ID NO: 3327560 - RNA, 21 nt, Human
agcuggucccacucaguccau

SEQ ID NO: 3327561 - RNA, 22 nt, Human
agcugggugucaagagggucug

SEQ ID NO: 3327562 - RNA, 17 nt, Human
agcugggugucaagagg

SEQ ID NO: 3327563 - RNA, 13 nt, Human
aggaaaaacugau

SEQ ID NO: 3327564 - RNA, 15 nt, Human
aggaaaaacugauuu

SEQ ID NO: 3327565 - RNA, 18 nt, Human
aggagaggggcacagggu

SEQ ID NO: 3327566 - RNA, 14 nt, Human
aggagaggggcaca

SEQ ID NO: 3327567 - RNA, 16 nt, Human
aggagaggggcacagg

SEQ ID NO: 3327568 - RNA, 15 nt, Human
aggagagcuagcagc

SEQ ID NO: 3327569 - RNA, 14 nt, Human
aggaccucagguga

SEQ ID NO: 3327570 - RNA, 20 nt, Human
aggaccucaggugagaagca

SEQ ID NO: 3327571 - RNA, 20 nt, Human
aggaccccuccaugugggcu

SEQ ID NO: 3327572 - RNA, 12 nt, Human
aggauucuuccu

SEQ ID NO: 3327573 - RNA, 17 nt, Human
aggaggggauagagaga

SEQ ID NO: 3327574 - RNA, 18 nt, Human
aggauguucugggacaca

SEQ ID NO: 3327575 - RNA, 20 nt, Human
aggauguucugggacacagu

SEQ ID NO: 3327576 - RNA, 15 nt, Human
agauagccaaggcca

SEQ ID NO: 3327577 - RNA, 16 nt, Human
agauagccaaggccaa

SEQ ID NO: 3327578 - RNA, 22 nt, Human
agaggggaacagacuggaagca

SEQ ID NO: 3327579 - RNA, 16 nt, Human
agaggggaagagacuu

SEQ ID NO: 3327580 - RNA, 13 nt, Human
agaggagaggggc

SEQ ID NO: 3327581 - RNA, 22 nt, Human
agauacuuggggggcugaggug

SEQ ID NO: 3327582 - RNA, 16 nt, Human
agauacuguaucauga

SEQ ID NO: 3327583 - RNA, 13 nt, Human
agauagccaaggc

SEQ ID NO: 3327584 - RNA, 23 nt, Human
agaggguggugaccucugccuga

SEQ ID NO: 3327585 - RNA, 23 nt, Human
agacugaguacguugugcauuug

SEQ ID NO: 3327586 - RNA, 23 nt, Human
agagaggguggugaccucugccu

SEQ ID NO: 3327587 - RNA, 10 nt, Human
agagaagaga

SEQ ID NO: 3327588 - RNA, 21 nt, Human
agagaagagauugugguuuca

SEQ ID NO: 3327589 - RNA, 14 nt, Human
agacaauuuauuau

SEQ ID NO: 3327590 - RNA, 15 nt, Human
agacaauuuauuaug

SEQ ID NO: 3327591 - RNA, 21 nt, Human
agacaauuuauuauggcacau

SEQ ID NO: 3327592 - RNA, 13 nt, Human
agacaaugacuua

SEQ ID NO: 3327593 - RNA, 17 nt, Human
agacaaugacuuacugu

SEQ ID NO: 3327594 - RNA, 13 nt, Human
agaccaucccuga

SEQ ID NO: 3327595 - RNA, 14 nt, Human
agaccaucccugaa

SEQ ID NO: 3327596 - RNA, 17 nt, Human
agaccaucccugaaggc

SEQ ID NO: 3327597 - RNA, 18 nt, Human
agaccaucccugaaggcc

SEQ ID NO: 3327598 - RNA, 18 nt, Human
agacagcccgggcucugc

SEQ ID NO: 3327599 - RNA, 20 nt, Human
agacagcccgggcucugccu

SEQ ID NO: 3327600 - RNA, 17 nt, Human
agacagcccgggcucug

SEQ ID NO: 3327601 - RNA, 16 nt, Human
agacagcccgggcucu

SEQ ID NO: 3327602 - RNA, 18 nt, Human
agacggagucccaccuug

SEQ ID NO: 3327603 - RNA, 19 nt, Human
agacggagucccaccuugg

SEQ ID NO: 3327604 - RNA, 12 nt, Human
agcaugccugga

SEQ ID NO: 3327605 - RNA, 20 nt, Human
agccaaagcuaggccuggcc

SEQ ID NO: 3327606 - RNA, 19 nt, Human
agccaaagcuaggccuggc

SEQ ID NO: 3327607 - RNA, 18 nt, Human
agccaaagcuaggccugg

SEQ ID NO: 3327608 - RNA, 23 nt, Human
agccaaggccaaaggaagcacau

SEQ ID NO: 3327609 - RNA, 22 nt, Human
agccaaggccaaaggaagcaca

SEQ ID NO: 3327610 - RNA, 20 nt, Human
agccaaggccaaaggaagca

SEQ ID NO: 3327611 - RNA, 18 nt, Human
agccagaggagagaggac

SEQ ID NO: 3327612 - RNA, 20 nt, Human
agccagaggagagaggaccc

SEQ ID NO: 3327613 - RNA, 22 nt, Human
agccagauuucacucuccuugg

SEQ ID NO: 3327614 - RNA, 19 nt, Human
agcacuaaggugugcucug

SEQ ID NO: 3327615 - RNA, 21 nt, Human
agcagccacauuccugaugcu

SEQ ID NO: 3327616 - RNA, 15 nt, Human
agcagccacauuccu

SEQ ID NO: 3327617 - RNA, 20 nt, Human
agccgagaucacgccacugc

SEQ ID NO: 3327618 - RNA, 19 nt, Human
agccgagaucacgccacug

SEQ ID NO: 3327619 - RNA, 15 nt, Human
agcccugagcuuucu

SEQ ID NO: 3327620 - RNA, 20 nt, Human
agccccaucccaaacccuuc

SEQ ID NO: 3327621 - RNA, 16 nt, Human
agccccagugcccaca

SEQ ID NO: 3327622 - RNA, 22 nt, Human
agccucccgaauagcugggacu

SEQ ID NO: 3327623 - RNA, 20 nt, Human
agccucccgaauagcuggga

SEQ ID NO: 3327624 - RNA, 19 nt, Human
agccucccgaauagcuggg

SEQ ID NO: 3327625 - RNA, 18 nt, Human
agccucccgaauagcugg

SEQ ID NO: 3327626 - RNA, 17 nt, Human
agccucccaaagugcug

SEQ ID NO: 3327627 - RNA, 22 nt, Human
agccucccgaguagcugggacu

SEQ ID NO: 3327628 - RNA, 14 nt, Human
agccgcuggggcca

SEQ ID NO: 3327629 - RNA, 22 nt, Human
agccgcuggggccaguuggucc

SEQ ID NO: 3327630 - RNA, 13 nt, Human
agccgcuggggcc

SEQ ID NO: 3327631 - RNA, 18 nt, Human
agccgagaucacgccacu

SEQ ID NO: 3327632 - RNA, 20 nt, Human
agccgagauugcaccacugc

SEQ ID NO: 3327633 - RNA, 19 nt, Human
agccgagauugcaccacug

SEQ ID NO: 3327634 - RNA, 21 nt, Human
agccgagaucacgccacugca

SEQ ID NO: 3327635 - RNA, 19 nt, Human
agccucccaaagugcuggg

SEQ ID NO: 3327636 - RNA, 18 nt, Human
agccucccaaagugcugg

SEQ ID NO: 3327637 - RNA, 14 nt, Human
accaucaugucugg

SEQ ID NO: 3327638 - RNA, 18 nt, Human
accaucccugaaggcccc

SEQ ID NO: 3327639 - RNA, 16 nt, Human
accaucccugaaggcc

SEQ ID NO: 3327640 - RNA, 17 nt, Human
accaucaugucuggcua

SEQ ID NO: 3327641 - RNA, 16 nt, Human
accaucaugucuggcu

SEQ ID NO: 3327642 - RNA, 21 nt, Human
accaucccugaaggccccgcc

SEQ ID NO: 3327643 - RNA, 22 nt, Human
accaucccugaaggccccgccc

SEQ ID NO: 3327644 - RNA, 17 nt, Human
acccaugcugcccugug

SEQ ID NO: 3327645 - RNA, 18 nt, Human
acccaugcugcccuguga

SEQ ID NO: 3327646 - RNA, 19 nt, Human
acccaugcugcccugugag

SEQ ID NO: 3327647 - RNA, 16 nt, Human
acccaugcugcccugu

SEQ ID NO: 3327648 - RNA, 13 nt, Human
acccaagggccug

SEQ ID NO: 3327649 - RNA, 16 nt, Human
acccaagggccuggcc

SEQ ID NO: 3327650 - RNA, 23 nt, Human
acccaagggccuggccugagcug

SEQ ID NO: 3327651 - RNA, 15 nt, Human
accccggccaccugc

SEQ ID NO: 3327652 - RNA, 15 nt, Human
accacguuucuaaag

SEQ ID NO: 3327653 - RNA, 19 nt, Human
accacguuucuaaaggcua

SEQ ID NO: 3327654 - RNA, 14 nt, Human
accacuacauucug

SEQ ID NO: 3327655 - RNA, 13 nt, Human
accagcagccugg

SEQ ID NO: 3327656 - RNA, 14 nt, Human
accagcagccugga

SEQ ID NO: 3327657 - RNA, 17 nt, Human
accagcagccuggaccc

SEQ ID NO: 3327658 - RNA, 21 nt, Human
accaacgucugugccauuuug

SEQ ID NO: 3327659 - RNA, 20 nt, Human
acaucagcacgauuucuguu

SEQ ID NO: 3327660 - RNA, 21 nt, Human
acaucagcacgauuucuguuu

SEQ ID NO: 3327661 - RNA, 22 nt, Human
acaucagcacgauuucuguuua

SEQ ID NO: 3327662 - RNA, 19 nt, Human
acaucagcacgauuucugu

SEQ ID NO: 3327663 - RNA, 23 nt, Human
acauaaacaagaccacguuucua

SEQ ID NO: 3327664 - RNA, 19 nt, Human
acauguuuuucuucucccu

SEQ ID NO: 3327665 - RNA, 19 nt, Human
acaugcaaggucauuuuuu

SEQ ID NO: 3327666 - RNA, 18 nt, Human
acaugcaaggucauuuuu

SEQ ID NO: 3327667 - RNA, 20 nt, Human
acaugcacagcuaacaugga

SEQ ID NO: 3327668 - RNA, 21 nt, Human
acauguuuuucuucucccuca

SEQ ID NO: 3327669 - RNA, 18 nt, Human
acacaaacgggcucagca

SEQ ID NO: 3327670 - RNA, 15 nt, Human
acaauuuauuauggc

SEQ ID NO: 3327671 - RNA, 16 nt, Human
acaauuuauuauggca

SEQ ID NO: 3327672 - RNA, 14 nt, Human
acaauuuauuaugg

SEQ ID NO: 3327673 - RNA, 21 nt, Human
acaccacuacauucuguuaau

SEQ ID NO: 3327674 - RNA, 12 nt, Human
acaccagagccc

SEQ ID NO: 3327675 - RNA, 12 nt, Human
acacagcucugu

SEQ ID NO: 3327676 - RNA, 11 nt, Human
acacagcucug

SEQ ID NO: 3327677 - RNA, 14 nt, Human
acacuaaccacgcu

SEQ ID NO: 3327678 - RNA, 15 nt, Human
acacggacacucaaa

SEQ ID NO: 3327679 - RNA, 15 nt, Human
acaaacgggcucagc

SEQ ID NO: 3327680 - RNA, 21 nt, Human
acaaaccuguuucugcagcca

SEQ ID NO: 3327681 - RNA, 13 nt, Human
acaaagacugagu

SEQ ID NO: 3327682 - RNA, 15 nt, Human
acagccaugauucuu

SEQ ID NO: 3327683 - RNA, 19 nt, Human
acagccacggccaggccag

SEQ ID NO: 3327684 - RNA, 19 nt, Human
acagagucucacuguugcc

SEQ ID NO: 3327685 - RNA, 17 nt, Human
acagagucucacuguug

SEQ ID NO: 3327686 - RNA, 14 nt, Human
acagagucucacug

SEQ ID NO: 3327687 - RNA, 12 nt, Human
acagagucucac

SEQ ID NO: 3327688 - RNA, 22 nt, Human
acagaggggguggccucccaac

SEQ ID NO: 3327689 - RNA, 21 nt, Human
acagaggggguggccucccaa

SEQ ID NO: 3327690 - RNA, 16 nt, Human
acaggcaagcaccucc

SEQ ID NO: 3327691 - RNA, 15 nt, Human
acaggcaagcaccuc

SEQ ID NO: 3327692 - RNA, 18 nt, Human
acaggcaagcaccuccug

SEQ ID NO: 3327693 - RNA, 23 nt, Human
acaggugugaaccaccacaccca

SEQ ID NO: 3327694 - RNA, 20 nt, Human
acaggugugaaccaccacac

SEQ ID NO: 3327695 - RNA, 19 nt, Human
acaggugugaaccaccaca

SEQ ID NO: 3327696 - RNA, 14 nt, Human
acagcuccuucugu

SEQ ID NO: 3327697 - RNA, 13 nt, Human
acagcuccuucug

SEQ ID NO: 3327698 - RNA, 12 nt, Human
acagcuccuucu

SEQ ID NO: 3327699 - RNA, 14 nt, Human
acagcugccuggga

SEQ ID NO: 3327700 - RNA, 13 nt, Human
acagcugccuggg

SEQ ID NO: 3327701 - RNA, 23 nt, Human
acagcugccugggaucccucauc

SEQ ID NO: 3327702 - RNA, 23 nt, Human
acagcuccuucuguccuacucug

SEQ ID NO: 3327703 - RNA, 12 nt, Human
accuuggcugca

SEQ ID NO: 3327704 - RNA, 14 nt, Human
accuuggcucaagu

SEQ ID NO: 3327705 - RNA, 12 nt, Human
accuuggcucaa

SEQ ID NO: 3327706 - RNA, 16 nt, Human
accuuucaauaggaaa

SEQ ID NO: 3327707 - RNA, 17 nt, Human
accuuucaauaggaaaa

SEQ ID NO: 3327708 - RNA, 21 nt, Human
accuuucaauaggaaaaacug

SEQ ID NO: 3327709 - RNA, 23 nt, Human
accuuucaauaggaaaaacugau

SEQ ID NO: 3327710 - RNA, 16 nt, Human
accucugcacaagcug

SEQ ID NO: 3327711 - RNA, 18 nt, Human
accucugcacaagcugca

SEQ ID NO: 3327712 - RNA, 21 nt, Human
accucugcacaagcugcaccc

SEQ ID NO: 3327713 - RNA, 12 nt, Human
accucugcacaa

SEQ ID NO: 3327714 - RNA, 23 nt, Human
accugccccucaacucuccucca

SEQ ID NO: 3327715 - RNA, 20 nt, Human
accugccccucaacucuccu

SEQ ID NO: 3327716 - RNA, 14 nt, Human
acgauuucuguuua

SEQ ID NO: 3327717 - RNA, 17 nt, Human
acgauuucuguuuagau

SEQ ID NO: 3327718 - RNA, 18 nt, Human
acgccacugcacuauagc

SEQ ID NO: 3327719 - RNA, 12 nt, Human
acgauuucuguu

SEQ ID NO: 3327720 - RNA, 13 nt, Human
acgauuucuguuu

SEQ ID NO: 3327721 - RNA, 15 nt, Human
acuaaguuuuuaugg

SEQ ID NO: 3327722 - RNA, 22 nt, Human
acuaaguuuuuauggcuuuugu

SEQ ID NO: 3327723 - RNA, 13 nt, Human
acguggcugcuuc

SEQ ID NO: 3327724 - RNA, 14 nt, Human
acguggcugcuuca

SEQ ID NO: 3327725 - RNA, 15 nt, Human
acguggcugcuucaa

SEQ ID NO: 3327726 - RNA, 11 nt, Human
acguggcugcu

SEQ ID NO: 3327727 - RNA, 18 nt, Human
acgcugugcugcccugcc

SEQ ID NO: 3327728 - RNA, 16 nt, Human
acgcugugcugcccug

SEQ ID NO: 3327729 - RNA, 17 nt, Human
acgcugugcugcccugc

SEQ ID NO: 3327730 - RNA, 15 nt, Human
acgcugugcugcccu

SEQ ID NO: 3327731 - RNA, 17 nt, Human
acucaaacucuuaaaac

SEQ ID NO: 3327732 - RNA, 16 nt, Human
acucaaacucuuaaaa

SEQ ID NO: 3327733 - RNA, 18 nt, Human
acucaaaagcugggcagg

SEQ ID NO: 3327734 - RNA, 13 nt, Human
acuccccugcugg

SEQ ID NO: 3327735 - RNA, 17 nt, Human
acuccccugcugggugu

SEQ ID NO: 3327736 - RNA, 14 nt, Human
acucccccaggugg

SEQ ID NO: 3327737 - RNA, 21 nt, Human
acucuacccucuuagaaaaac

SEQ ID NO: 3327738 - RNA, 13 nt, Human
acucuacccucuu

SEQ ID NO: 3327739 - RNA, 18 nt, Human
acucuacccucuuagaaa

SEQ ID NO: 3327740 - RNA, 16 nt, Human
acucugugucaggugg

SEQ ID NO: 3327741 - RNA, 11 nt, Human
acucuuaaaac

SEQ ID NO: 3327742 - RNA, 18 nt, Human
acucuuaaaacccaagug

SEQ ID NO: 3327743 - RNA, 16 nt, Human
acucuaucaaguauua

SEQ ID NO: 3327744 - RNA, 20 nt, Human
acucuggcagcucagagagg

SEQ ID NO: 3327745 - RNA, 14 nt, Human
acucuaucaaguau

SEQ ID NO: 3327746 - RNA, 18 nt, Human
agaaauaaaguuucuguu

SEQ ID NO: 3327747 - RNA, 15 nt, Human
agaaauaaaguuucu

SEQ ID NO: 3327748 - RNA, 23 nt, Human
agaaaggaggggauagagagaga

SEQ ID NO: 3327749 - RNA, 20 nt, Human
agaaaggaggggauagagag

SEQ ID NO: 3327750 - RNA, 23 nt, Human
acuuuccuucauucaacccaccu

SEQ ID NO: 3327751 - RNA, 21 nt, Human
acuuuccucuuuggucuacac

SEQ ID NO: 3327752 - RNA, 20 nt, Human
acuuuguucuggcucuucca

SEQ ID NO: 3327753 - RNA, 23 nt, Human
acuuuguucuggcucuuccaggc

SEQ ID NO: 3327754 - RNA, 15 nt, Human
acuuuuauaaacuuu

SEQ ID NO: 3327755 - RNA, 19 nt, Human
acuuuuauaaacuuuaccu

SEQ ID NO: 3327756 - RNA, 22 nt, Human
acuuuuauaaacuuuaccuuuu

SEQ ID NO: 3327757 - RNA, 23 nt, Human
agaaaauggaagacagcucuuau

SEQ ID NO: 3327758 - RNA, 15 nt, Human
agaaaauggacgugu

SEQ ID NO: 3327759 - RNA, 20 nt, Human
agaaaauggacguguuauga

SEQ ID NO: 3327760 - RNA, 22 nt, Human
agaaaauggacguguuaugacu

SEQ ID NO: 3327761 - RNA, 23 nt, Human
agaaaauggacguguuaugacuc

SEQ ID NO: 3327762 - RNA, 13 nt, Human
agaaacaaacuuu

SEQ ID NO: 3327763 - RNA, 12 nt, Human
agaaacaaacuu

SEQ ID NO: 3327764 - RNA, 22 nt, Human
agaaacaaacuuuucaaggcuu

SEQ ID NO: 3327765 - RNA, 19 nt, Human
acuucacauauugauuucc

SEQ ID NO: 3327766 - RNA, 18 nt, Human
acuucugccauauucugu

SEQ ID NO: 3327767 - RNA, 12 nt, Human
acugucuucagu

SEQ ID NO: 3327768 - RNA, 15 nt, Human
acuggaagcacagcu

SEQ ID NO: 3327769 - RNA, 14 nt, Human
acuggaagcacagc

SEQ ID NO: 3327770 - RNA, 23 nt, Human
acuggguacuuguggacacagcu

SEQ ID NO: 3327771 - RNA, 19 nt, Human
aaacacuguucucugcccu

SEQ ID NO: 3327772 - RNA, 22 nt, Human
aaacacuguucucugcccucca

SEQ ID NO: 3327773 - RNA, 16 nt, Human
aaacacuguucucugc

SEQ ID NO: 3327774 - RNA, 18 nt, Human
aaacacuguucucugccc

SEQ ID NO: 3327775 - RNA, 13 nt, Human
aaaauucagugga

SEQ ID NO: 3327776 - RNA, 13 nt, Human
aaaacacauuuuu

SEQ ID NO: 3327777 - RNA, 22 nt, Human
aaaacacacgcgcgcacacaca

SEQ ID NO: 3327778 - RNA, 11 nt, Human
aaagagguuuu

SEQ ID NO: 3327779 - RNA, 11 nt, Human
aaagugcuggg

SEQ ID NO: 3327780 - RNA, 21 nt, Human
aaauggacguguuaugacucc

SEQ ID NO: 3327781 - RNA, 22 nt, Human
aaauggacguguuaugacucca

SEQ ID NO: 3327782 - RNA, 20 nt, Human
aaauggacguguuaugacuc

SEQ ID NO: 3327783 - RNA, 16 nt, Human
aaauggaaaugggcag

SEQ ID NO: 3327784 - RNA, 18 nt, Human
aaauggaagacagcucuu

SEQ ID NO: 3327785 - RNA, 17 nt, Human
aacugauuuuuuuuucc

SEQ ID NO: 3327786 - RNA, 19 nt, Human
aacugauuuuuuuuuccuu

SEQ ID NO: 3327787 - RNA, 17 nt, Human
aacuuaaauaaugugaa

SEQ ID NO: 3327788 - RNA, 12 nt, Human
aacucaccccag

SEQ ID NO: 3327789 - RNA, 15 nt, Human
aacucaccugccccu

SEQ ID NO: 3327790 - RNA, 16 nt, Human
aacucaccugccccuc

SEQ ID NO: 3327791 - RNA, 16 nt, Human
aacuuuuauaaacuuu

SEQ ID NO: 3327792 - RNA, 19 nt, Human
aacuuuuauaaacuuuacc

SEQ ID NO: 3327793 - RNA, 20 nt, Human
aacuuuucaaggcuuauauu

SEQ ID NO: 3327794 - RNA, 14 nt, Human
aacuuugaccucug

SEQ ID NO: 3327795 - RNA, 17 nt, Human
aacuuugaccucugcag

SEQ ID NO: 3327796 - RNA, 13 nt, Human
aacuuugaccucu

SEQ ID NO: 3327797 - RNA, 12 nt, Human
aacuuuuauaaa

SEQ ID NO: 3327798 - RNA, 15 nt, Human
aacuuuuauaaacuu

SEQ ID NO: 3327799 - RNA, 19 nt, Human
aacuuugaccucugcagca

SEQ ID NO: 3327800 - RNA, 20 nt, Human
aacuuugaccucugcagcaa

SEQ ID NO: 3327801 - RNA, 14 nt, Human
aacaucaacaucuu

SEQ ID NO: 3327802 - RNA, 22 nt, Human
aaccacucuaucaaguauuaua

SEQ ID NO: 3327803 - RNA, 21 nt, Human
aacauguaauuaaguacuaug

SEQ ID NO: 3327804 - RNA, 14 nt, Human
aacauguaauuaag

SEQ ID NO: 3327805 - RNA, 14 nt, Human
aacccuggugacca

SEQ ID NO: 3327806 - RNA, 19 nt, Human
aacacauuuuucuuaggga

SEQ ID NO: 3327807 - RNA, 19 nt, Human
aacaccucugcacaagcug

SEQ ID NO: 3327808 - RNA, 22 nt, Human
aacaaacuuuucaaggcuuaua

SEQ ID NO: 3327809 - RNA, 20 nt, Human
aauauaggaacuuaaauaau

SEQ ID NO: 3327810 - RNA, 21 nt, Human
aauauaggaacuuaaauaaug

SEQ ID NO: 3327811 - RNA, 16 nt, Human
aauauaggaacuuaaa

SEQ ID NO: 3327812 - RNA, 18 nt, Human
aauauaggaacuuaaaua

SEQ ID NO: 3327813 - RNA, 23 nt, Human
aaugaaccacaucuugcucugcu

SEQ ID NO: 3327814 - RNA, 17 nt, Human
aaugaaccacaucuugc

SEQ ID NO: 3327815 - RNA, 16 nt, Human
aaugaaccacaucuug

SEQ ID NO: 3327816 - RNA, 22 nt, Human
aaucugcuuuuuaaagaaugcu

SEQ ID NO: 3327817 - RNA, 21 nt, Human
aaugaugauccuaggcauuug

SEQ ID NO: 3327818 - RNA, 14 nt, Human
aaucuccaaaauaa

SEQ ID NO: 3327819 - RNA, 13 nt, Human
aaucuccaaaaua

SEQ ID NO: 3327820 - RNA, 18 nt, Human
aauuaguggcacuugcuu

SEQ ID NO: 3327821 - RNA, 18 nt, Human
aauguuugccucugccuc

SEQ ID NO: 3327822 - RNA, 16 nt, Human
aauguuugccucugcc

SEQ ID NO: 3327823 - RNA, 19 nt, Human
aauguuugccucugccucu

SEQ ID NO: 3327824 - RNA, 18 nt, Human
aauuaaaacacaacaucu

SEQ ID NO: 3327825 - RNA, 15 nt, Human
aaugggcagagcaga

SEQ ID NO: 3327826 - RNA, 13 nt, Human
aaugggcagagca

SEQ ID NO: 3327827 - RNA, 20 nt, Human
aaugucucuuuaaugucaca

SEQ ID NO: 3327828 - RNA, 17 nt, Human
aaugucagugugacuga

SEQ ID NO: 3327829 - RNA, 21 nt, Human
aaugucagugugacugaucuc

SEQ ID NO: 3327830 - RNA, 22 nt, Human
aaugucuaguuguaacaccaug

SEQ ID NO: 3327831 - RNA, 15 nt, Human
aaugucagugugacu

SEQ ID NO: 3327832 - RNA, 16 nt, Human
aaugucagugugacug

SEQ ID NO: 3327833 - RNA, 13 nt, Human
aaugucaguguga

SEQ ID NO: 3327834 - RNA, 21 nt, Human
aagcgugagccacugcaccgg

SEQ ID NO: 3327835 - RNA, 12 nt, Human
aagcguggugga

SEQ ID NO: 3327836 - RNA, 22 nt, Human
aagcugcacccucaggcaggug

SEQ ID NO: 3327837 - RNA, 21 nt, Human
aagcugcacccucaggcaggu

SEQ ID NO: 3327838 - RNA, 20 nt, Human
aagcugcacccucaggcagg

SEQ ID NO: 3327839 - RNA, 18 nt, Human
aaggacauugcggacagc

SEQ ID NO: 3327840 - RNA, 13 nt, Human
aagcugggcaggu

SEQ ID NO: 3327841 - RNA, 11 nt, Human
aagcugggcag

SEQ ID NO: 3327842 - RNA, 17 nt, Human
aaggcaaggcugucaau

SEQ ID NO: 3327843 - RNA, 18 nt, Human
aaggcaaggcugucaauu

SEQ ID NO: 3327844 - RNA, 16 nt, Human
aaggcaaggcugucaa

SEQ ID NO: 3327845 - RNA, 18 nt, Human
aagccauaauuguucuua

SEQ ID NO: 3327846 - RNA, 14 nt, Human
aagcagaggaagga

SEQ ID NO: 3327847 - RNA, 16 nt, Human
aaguaucccuacugua

SEQ ID NO: 3327848 - RNA, 11 nt, Human
aaguacuucuu

SEQ ID NO: 3327849 - RNA, 23 nt, Human
aaguacuucuccacccugcucuc

SEQ ID NO: 3327850 - RNA, 11 nt, Human
aaggugggagg

SEQ ID NO: 3327851 - RNA, 16 nt, Human
aagguuaauaaaguaa

SEQ ID NO: 3327852 - RNA, 15 nt, Human
aagguuaauaaagua

SEQ ID NO: 3327853 - RNA, 16 nt, Human
aagucuuagauguaua

SEQ ID NO: 3327854 - RNA, 22 nt, Human
aagugcugggauuacaggugug

SEQ ID NO: 3327855 - RNA, 22 nt, Human
aaguuguaggcauaaagucagg

SEQ ID NO: 3327856 - RNA, 21 nt, Human
cugagaucaaaacgguuuuac

SEQ ID NO: 3327857 - RNA, 14 nt, Human
cugagcuuucugcu

SEQ ID NO: 3327858 - RNA, 15 nt, Human
cugagcuuucugcua

SEQ ID NO: 3327859 - RNA, 14 nt, Human
cugaggaauccaga

SEQ ID NO: 3327860 - RNA, 20 nt, Human
cugaggaauccagacccggc

SEQ ID NO: 3327861 - RNA, 17 nt, Human
cugaggaauccagaccc

SEQ ID NO: 3327862 - RNA, 20 nt, Human
cugaggacacuaaccacgcu

SEQ ID NO: 3327863 - RNA, 23 nt, Human
cugaggacacuaaccacgcugga

SEQ ID NO: 3327864 - RNA, 21 nt, Human
cugaguacguugugcauuugg

SEQ ID NO: 3327865 - RNA, 18 nt, Human
cugaguacguugugcauu

SEQ ID NO: 3327866 - RNA, 17 nt, Human
cugaguacguugugcau

SEQ ID NO: 3327867 - RNA, 19 nt, Human
cugaguacguugugcauuu

SEQ ID NO: 3327868 - RNA, 20 nt, Human
cugaguacguugugcauuug

SEQ ID NO: 3327869 - RNA, 23 nt, Human
cugagacagcccgggcucugccu

SEQ ID NO: 3327870 - RNA, 22 nt, Human
cugagacagcccgggcucugcc

SEQ ID NO: 3327871 - RNA, 21 nt, Human
cugagacucgcgacaaugcaa

SEQ ID NO: 3327872 - RNA, 20 nt, Human
cugagacucgcgacaaugca

SEQ ID NO: 3327873 - RNA, 21 nt, Human
cugacccaugcugcccuguga

SEQ ID NO: 3327874 - RNA, 22 nt, Human
cugacccaugcugcccugugag

SEQ ID NO: 3327875 - RNA, 20 nt, Human
cugacccaugcugcccugug

SEQ ID NO: 3327876 - RNA, 22 nt, Human
cugagacucgcgacaaugcaaa

SEQ ID NO: 3327877 - RNA, 17 nt, Human
cugagaguagagucacu

SEQ ID NO: 3327878 - RNA, 22 nt, Human
cugagaggacuuuucuuugugg

SEQ ID NO: 3327879 - RNA, 21 nt, Human
cugagaggacuuuucuuugug

SEQ ID NO: 3327880 - RNA, 16 nt, Human
cucuugagccuugaac

SEQ ID NO: 3327881 - RNA, 17 nt, Human
cucuugagccuugaacu

SEQ ID NO: 3327882 - RNA, 18 nt, Human
cucuugagccuugaacuu

SEQ ID NO: 3327883 - RNA, 16 nt, Human
cucuugagccugggag

SEQ ID NO: 3327884 - RNA, 21 nt, Human
cugaaggacauugcggacagc

SEQ ID NO: 3327885 - RNA, 23 nt, Human
cugaaggacauugcggacagcca

SEQ ID NO: 3327886 - RNA, 18 nt, Human
cugaaggccccgcccagg

SEQ ID NO: 3327887 - RNA, 19 nt, Human
cugaaggccccgcccaggc

SEQ ID NO: 3327888 - RNA, 21 nt, Human
cugaaggccccgcccaggcuu

SEQ ID NO: 3327889 - RNA, 22 nt, Human
cugacaacacucauugaccuga

SEQ ID NO: 3327890 - RNA, 23 nt, Human
cugacaacacucauugaccugag

SEQ ID NO: 3327891 - RNA, 18 nt, Human
cucugcuccucuccccag

SEQ ID NO: 3327892 - RNA, 13 nt, Human
cucugcuccucuc

SEQ ID NO: 3327893 - RNA, 21 nt, Human
cucugcacuccccugcugggu

SEQ ID NO: 3327894 - RNA, 20 nt, Human
cucugcacuccccugcuggg

SEQ ID NO: 3327895 - RNA, 18 nt, Human
cucugcacuccccugcug

SEQ ID NO: 3327896 - RNA, 14 nt, Human
cucugguccauaga

SEQ ID NO: 3327897 - RNA, 14 nt, Human
cucugcugacagac

SEQ ID NO: 3327898 - RNA, 13 nt, Human
cucugcugacaga

SEQ ID NO: 3327899 - RNA, 18 nt, Human
cucuucagaucucuaacu

SEQ ID NO: 3327900 - RNA, 19 nt, Human
cucuucagaucucuaacuu

SEQ ID NO: 3327901 - RNA, 14 nt, Human
cucuucaaucucuu

SEQ ID NO: 3327902 - RNA, 20 nt, Human
cucuuauugcccacgcugga

SEQ ID NO: 3327903 - RNA, 19 nt, Human
cucuuauugcccacgcugg

SEQ ID NO: 3327904 - RNA, 15 nt, Human
cucuuauugcccacg

SEQ ID NO: 3327905 - RNA, 14 nt, Human
cucuuauugcccac

SEQ ID NO: 3327906 - RNA, 13 nt, Human
cucuuauugccca

SEQ ID NO: 3327907 - RNA, 13 nt, Human
cuccaagcaggac

SEQ ID NO: 3327908 - RNA, 14 nt, Human
cuccaagcaggaca

SEQ ID NO: 3327909 - RNA, 22 nt, Human
cuccaagcaggacauggacaag

SEQ ID NO: 3327910 - RNA, 24 nt, Human
cuccaagcaggacauggacaagga

SEQ ID NO: 3327911 - RNA, 22 nt, Human
cuccaagaccuucuccuucacc

SEQ ID NO: 3327912 - RNA, 21 nt, Human
cuccaagaccuucuccuucac

SEQ ID NO: 3327913 - RNA, 13 nt, Human
cuccaagcuccca

SEQ ID NO: 3327914 - RNA, 14 nt, Human
cuccaagcucccag

SEQ ID NO: 3327915 - RNA, 15 nt, Human
cuccaagcucccagg

SEQ ID NO: 3327916 - RNA, 16 nt, Human
cuccaagcucccaggc

SEQ ID NO: 3327917 - RNA, 16 nt, Human
cuccacuuucuagcca

SEQ ID NO: 3327918 - RNA, 19 nt, Human
cuccacuuucuagccagag

SEQ ID NO: 3327919 - RNA, 17 nt, Human
cucccaccucagccucc

SEQ ID NO: 3327920 - RNA, 14 nt, Human
cucgaacuggcugc

SEQ ID NO: 3327921 - RNA, 13 nt, Human
cucgaacuggcug

SEQ ID NO: 3327922 - RNA, 15 nt, Human
cucgaacuggcugca

SEQ ID NO: 3327923 - RNA, 15 nt, Human
cucccccagccccau

SEQ ID NO: 3327924 - RNA, 20 nt, Human
cucccccagccccauccucu

SEQ ID NO: 3327925 - RNA, 22 nt, Human
cucccccagccccauccucugu

SEQ ID NO: 3327926 - RNA, 16 nt, Human
cuccuggcccacugca

SEQ ID NO: 3327927 - RNA, 18 nt, Human
cuccucugcugcuggcug

SEQ ID NO: 3327928 - RNA, 15 nt, Human
cuccucugcugcugg

SEQ ID NO: 3327929 - RNA, 16 nt, Human
cuccucugcugcuggc

SEQ ID NO: 3327930 - RNA, 16 nt, Human
cgguuuuacugcagcu

SEQ ID NO: 3327931 - RNA, 20 nt, Human
cguguaaccauggacccaau

SEQ ID NO: 3327932 - RNA, 17 nt, Human
cgugaggccagagacac

SEQ ID NO: 3327933 - RNA, 16 nt, Human
cgugaguccuggcaug

SEQ ID NO: 3327934 - RNA, 17 nt, Human
cgugaguccuggcaugg

SEQ ID NO: 3327935 - RNA, 16 nt, Human
cgugaggccagagaca

SEQ ID NO: 3327936 - RNA, 16 nt, Human
cggagucccaccuugg

SEQ ID NO: 3327937 - RNA, 11 nt, Human
cgggcucagca

SEQ ID NO: 3327938 - RNA, 14 nt, Human
cgggcucugccucc

SEQ ID NO: 3327939 - RNA, 16 nt, Human
cgggcucugccuccca

SEQ ID NO: 3327940 - RNA, 15 nt, Human
cgggcucagcaaaag

SEQ ID NO: 3327941 - RNA, 13 nt, Human
cgggcucugccuc

SEQ ID NO: 3327942 - RNA, 17 nt, Human
cgggcucugccucccau

SEQ ID NO: 3327943 - RNA, 14 nt, Human
cggggacagcuccu

SEQ ID NO: 3327944 - RNA, 18 nt, Human
cgguguggagaagcggcu

SEQ ID NO: 3327945 - RNA, 13 nt, Human
cgguguggagaag

SEQ ID NO: 3327946 - RNA, 15 nt, Human
cggggacagcuccuu

SEQ ID NO: 3327947 - RNA, 14 nt, Human
cggcucacugcagc

SEQ ID NO: 3327948 - RNA, 15 nt, Human
cggcucacugcagcc

SEQ ID NO: 3327949 - RNA, 20 nt, Human
cggagucccaccuuggcugc

SEQ ID NO: 3327950 - RNA, 18 nt, Human
cggagucccaccuuggcu

SEQ ID NO: 3327951 - RNA, 16 nt, Human
cggcucacugcagccu

SEQ ID NO: 3327952 - RNA, 14 nt, Human
cggagucccaccuu

SEQ ID NO: 3327953 - RNA, 12 nt, Human
cggcuccaggcu

SEQ ID NO: 3327954 - RNA, 16 nt, Human
cggcuccaggcuccuu

SEQ ID NO: 3327955 - RNA, 15 nt, Human
cggcuccaggcuccu

SEQ ID NO: 3327956 - RNA, 14 nt, Human
cggcuccaggcucc

SEQ ID NO: 3327957 - RNA, 13 nt, Human
cggcuccaggcuc

SEQ ID NO: 3327958 - RNA, 14 nt, Human
cgggccacagagaa

SEQ ID NO: 3327959 - RNA, 12 nt, Human
cgggccacagag

SEQ ID NO: 3327960 - RNA, 12 nt, Human
cgacaaugcaaa

SEQ ID NO: 3327961 - RNA, 13 nt, Human
cgacaaugcaaac

SEQ ID NO: 3327962 - RNA, 19 nt, Human
cgacccuugccgucuaccu

SEQ ID NO: 3327963 - RNA, 20 nt, Human
cgacccuugccgucuaccug

SEQ ID NO: 3327964 - RNA, 17 nt, Human
cgacugcccggcagggu

SEQ ID NO: 3327965 - RNA, 15 nt, Human
ccuuuugagugccuu

SEQ ID NO: 3327966 - RNA, 17 nt, Human
ccuuuugagugccuuac

SEQ ID NO: 3327967 - RNA, 21 nt, Human
ccuuucaauaggaaaaacuga

SEQ ID NO: 3327968 - RNA, 18 nt, Human
ccuuucaauaggaaaaac

SEQ ID NO: 3327969 - RNA, 14 nt, Human
ccuuuaagagaaau

SEQ ID NO: 3327970 - RNA, 16 nt, Human
ccuugccgucuaccug

SEQ ID NO: 3327971 - RNA, 14 nt, Human
cgauagugguggug

SEQ ID NO: 3327972 - RNA, 16 nt, Human
cgaguagcugggacua

SEQ ID NO: 3327973 - RNA, 22 nt, Human
cgcaggauucuuccucccuccc

SEQ ID NO: 3327974 - RNA, 14 nt, Human
cgccuacaggagug

SEQ ID NO: 3327975 - RNA, 14 nt, Human
cuaucuaaauguug

SEQ ID NO: 3327976 - RNA, 15 nt, Human
cuaucucccccagcc

SEQ ID NO: 3327977 - RNA, 14 nt, Human
cuaucucccccagc

SEQ ID NO: 3327978 - RNA, 21 nt, Human
cuaguuugauuaaauucuugc

SEQ ID NO: 3327979 - RNA, 22 nt, Human
cuaguuugauuaaauucuugca

SEQ ID NO: 3327980 - RNA, 12 nt, Human
cuagccagagga

SEQ ID NO: 3327981 - RNA, 13 nt, Human
cuagccagaggag

SEQ ID NO: 3327982 - RNA, 15 nt, Human
cuagccagaggagag

SEQ ID NO: 3327983 - RNA, 13 nt, Human
cuaguuugauuaa

SEQ ID NO: 3327984 - RNA, 22 nt, Human
cuaguuguuugauucagacagc

SEQ ID NO: 3327985 - RNA, 23 nt, Human
cuaguuguuugauucagacagcu

SEQ ID NO: 3327986 - RNA, 15 nt, Human
cucaaugcacugaca

SEQ ID NO: 3327987 - RNA, 13 nt, Human
cucaaugcacuga

SEQ ID NO: 3327988 - RNA, 20 nt, Human
cucaaacucuugaccucagg

SEQ ID NO: 3327989 - RNA, 16 nt, Human
cuaucucccccagccc

SEQ ID NO: 3327990 - RNA, 17 nt, Human
cuaucucccccagcccc

SEQ ID NO: 3327991 - RNA, 18 nt, Human
cucaaaagcugggcaggu

SEQ ID NO: 3327992 - RNA, 20 nt, Human
cuaaguuuuuauggcuuuug

SEQ ID NO: 3327993 - RNA, 21 nt, Human
cuaagugguacuaacuuuccu

SEQ ID NO: 3327994 - RNA, 23 nt, Human
cuaagugauccucccaccucagc

SEQ ID NO: 3327995 - RNA, 23 nt, Human
cuaaguuuuuauggcuuuugugc

SEQ ID NO: 3327996 - RNA, 19 nt, Human
cuacaguccucccaucuca

SEQ ID NO: 3327997 - RNA, 19 nt, Human
cuacaguugaaaaacagcu

SEQ ID NO: 3327998 - RNA, 21 nt, Human
cuacaguugaaaaacagcuga

SEQ ID NO: 3327999 - RNA, 20 nt, Human
cuacaguccucccaucucac

SEQ ID NO: 3328000 - RNA, 18 nt, Human
cuacaguccucccaucuc

SEQ ID NO: 3328001 - RNA, 22 nt, Human
cuacaguugaaaaacagcugag

SEQ ID NO: 3328002 - RNA, 18 nt, Human
cuacauacaauuccaaac

SEQ ID NO: 3328003 - RNA, 17 nt, Human
cuaccuuuguauucucu

SEQ ID NO: 3328004 - RNA, 21 nt, Human
cuagcauacguacacauuuua

SEQ ID NO: 3328005 - RNA, 23 nt, Human
cuagcauacguacacauuuuauu

SEQ ID NO: 3328006 - RNA, 20 nt, Human
cuagcauacguacacauuuu

SEQ ID NO: 3328007 - RNA, 22 nt, Human
cuagaagauuuugaaauuuuua

SEQ ID NO: 3328008 - RNA, 12 nt, Human
ccagucaccccg

SEQ ID NO: 3328009 - RNA, 20 nt, Human
ccagucaccccggccaccug

SEQ ID NO: 3328010 - RNA, 21 nt, Human
ccagucaccccggccaccugc

SEQ ID NO: 3328011 - RNA, 19 nt, Human
ccagucaccccggccaccu

SEQ ID NO: 3328012 - RNA, 19 nt, Human
ccaggcuggcgugcagugg

SEQ ID NO: 3328013 - RNA, 22 nt, Human
ccaggcugggagagccuuccag

SEQ ID NO: 3328014 - RNA, 15 nt, Human
ccaggcugggagagc

SEQ ID NO: 3328015 - RNA, 17 nt, Human
ccaggcugggagagccu

SEQ ID NO: 3328016 - RNA, 18 nt, Human
ccaggcugggagagccuu

SEQ ID NO: 3328017 - RNA, 21 nt, Human
ccaggcugggagagccuucca

SEQ ID NO: 3328018 - RNA, 13 nt, Human
ccaggcugggaga

SEQ ID NO: 3328019 - RNA, 14 nt, Human
ccaggcugggagag

SEQ ID NO: 3328020 - RNA, 21 nt, Human
ccagccccuggaugcagccuc

SEQ ID NO: 3328021 - RNA, 10 nt, Human
ccagccccuu

SEQ ID NO: 3328022 - RNA, 19 nt, Human
ccagcagccuggacccugu

SEQ ID NO: 3328023 - RNA, 18 nt, Human
ccagccccuggaugcagc

SEQ ID NO: 3328024 - RNA, 15 nt, Human
ccagcagccuggacc

SEQ ID NO: 3328025 - RNA, 14 nt, Human
ccagcagccuggac

SEQ ID NO: 3328026 - RNA, 22 nt, Human
ccaggaaaggcuccaggagcag

SEQ ID NO: 3328027 - RNA, 23 nt, Human
ccaggaaaggcuccaggagcagc

SEQ ID NO: 3328028 - RNA, 21 nt, Human
ccaggaaaggcuccaggagca

SEQ ID NO: 3328029 - RNA, 20 nt, Human
ccaggaaaggcuccaggagc

SEQ ID NO: 3328030 - RNA, 16 nt, Human
ccagcuuaucucaggg

SEQ ID NO: 3328031 - RNA, 23 nt, Human
ccagcagagcaccuuagacaguc

SEQ ID NO: 3328032 - RNA, 14 nt, Human
ccagcagagcaccu

SEQ ID NO: 3328033 - RNA, 19 nt, Human
ccagcagagcaccuuagac

SEQ ID NO: 3328034 - RNA, 13 nt, Human
ccaugagccucag

SEQ ID NO: 3328035 - RNA, 20 nt, Human
ccaucccugaaggccccgcc

SEQ ID NO: 3328036 - RNA, 16 nt, Human
ccauccccuguagagu

SEQ ID NO: 3328037 - RNA, 14 nt, Human
ccaugaguccccug

SEQ ID NO: 3328038 - RNA, 15 nt, Human
ccaugaguccccugu

SEQ ID NO: 3328039 - RNA, 16 nt, Human
ccaugaguccccuguu

SEQ ID NO: 3328040 - RNA, 13 nt, Human
ccaugggccuccu

SEQ ID NO: 3328041 - RNA, 13 nt, Human
ccaugaguccccu

SEQ ID NO: 3328042 - RNA, 19 nt, Human
ccaugagccucagcauccu

SEQ ID NO: 3328043 - RNA, 18 nt, Human
ccaugagccucagcaucc

SEQ ID NO: 3328044 - RNA, 14 nt, Human
ccaugagccucagc

SEQ ID NO: 3328045 - RNA, 12 nt, Human
ccaucccagccc

SEQ ID NO: 3328046 - RNA, 23 nt, Human
ccaucccaaacccuucagugcca

SEQ ID NO: 3328047 - RNA, 20 nt, Human
ccaucccaaacccuucagug

SEQ ID NO: 3328048 - RNA, 15 nt, Human
ccaugggccuccugu

SEQ ID NO: 3328049 - RNA, 14 nt, Human
ccaugggccuccug

SEQ ID NO: 3328050 - RNA, 22 nt, Human
cccauucugccugcccaggccc

SEQ ID NO: 3328051 - RNA, 21 nt, Human
cccauucugccugcccaggcc

SEQ ID NO: 3328052 - RNA, 20 nt, Human
cccauucugccugcccaggc

SEQ ID NO: 3328053 - RNA, 19 nt, Human
ccccauccucuguacagag

SEQ ID NO: 3328054 - RNA, 21 nt, Human
ccccauccucuguacagagcc

SEQ ID NO: 3328055 - RNA, 17 nt, Human
ccccauccucuguacag

SEQ ID NO: 3328056 - RNA, 20 nt, Human
ccccagcaagugagagcugg

SEQ ID NO: 3328057 - RNA, 19 nt, Human
ccccagcaagugagagcug

SEQ ID NO: 3328058 - RNA, 17 nt, Human
ccccagcaagugagagc

SEQ ID NO: 3328059 - RNA, 23 nt, Human
ccccagauugcaacaggcugggc

SEQ ID NO: 3328060 - RNA, 22 nt, Human
ccccagauugcaacaggcuggg

SEQ ID NO: 3328061 - RNA, 21 nt, Human
ccccagauugcaacaggcugg

SEQ ID NO: 3328062 - RNA, 15 nt, Human
cccaggcuuagucac

SEQ ID NO: 3328063 - RNA, 21 nt, Human
cccaggcuggcgugcaguggu

SEQ ID NO: 3328064 - RNA, 19 nt, Human
cccaggaaaggcuccagga

SEQ ID NO: 3328065 - RNA, 23 nt, Human
cccagcugugcucuggacaggca

SEQ ID NO: 3328066 - RNA, 21 nt, Human
cccagcugugcucuggacagg

SEQ ID NO: 3328067 - RNA, 21 nt, Human
cccaggaaaggcuccaggagc

SEQ ID NO: 3328068 - RNA, 22 nt, Human
cccaggaaaggcuccaggagca

SEQ ID NO: 3328069 - RNA, 23 nt, Human
cccaggaaaggcuccaggagcag

SEQ ID NO: 3328070 - RNA, 14 nt, Human
cccagcccacuucu

SEQ ID NO: 3328071 - RNA, 12 nt, Human
cccggcugcgga

SEQ ID NO: 3328072 - RNA, 16 nt, Human
ccccuucugacccaug

SEQ ID NO: 3328073 - RNA, 17 nt, Human
ccccuucugacccaugc

SEQ ID NO: 3328074 - RNA, 20 nt, Human
cccucaacucuccuccagag

SEQ ID NO: 3328075 - RNA, 14 nt, Human
ccccauucugccug

SEQ ID NO: 3328076 - RNA, 13 nt, Human
ccccauucugccu

SEQ ID NO: 3328077 - RNA, 15 nt, Human
ccccauucugccugc

SEQ ID NO: 3328078 - RNA, 17 nt, Human
ccccuucgcuccugugu

SEQ ID NO: 3328079 - RNA, 15 nt, Human
ccccuucgcuccugu

SEQ ID NO: 3328080 - RNA, 14 nt, Human
ccccuucgcuccug

SEQ ID NO: 3328081 - RNA, 19 nt, Human
ccccuucgcuccugugucu

SEQ ID NO: 3328082 - RNA, 17 nt, Human
cccugugauggggcccu

SEQ ID NO: 3328083 - RNA, 18 nt, Human
cccugugauggggcccug

SEQ ID NO: 3328084 - RNA, 19 nt, Human
cccugugauggggcccugc

SEQ ID NO: 3328085 - RNA, 13 nt, Human
cccuucgcuccug

SEQ ID NO: 3328086 - RNA, 20 nt, Human
cccugucucaaaaaaagaaa

SEQ ID NO: 3328087 - RNA, 23 nt, Human
cccugucucaaaaaaagaaaaag

SEQ ID NO: 3328088 - RNA, 16 nt, Human
cccugucuaaugaaac

SEQ ID NO: 3328089 - RNA, 13 nt, Human
cccugucuaauga

SEQ ID NO: 3328090 - RNA, 13 nt, Human
ccggccccugcug

SEQ ID NO: 3328091 - RNA, 22 nt, Human
cccuucucuccagccccuggau

SEQ ID NO: 3328092 - RNA, 23 nt, Human
ccgcagcccugcagagggcacag

SEQ ID NO: 3328093 - RNA, 21 nt, Human
cccuucucuccagccccugga

SEQ ID NO: 3328094 - RNA, 19 nt, Human
cccuucucuccagccccug

SEQ ID NO: 3328095 - RNA, 15 nt, Human
cccuucgcuccugug

SEQ ID NO: 3328096 - RNA, 14 nt, Human
cccuucgcuccugu

SEQ ID NO: 3328097 - RNA, 14 nt, Human
ccggccccugcugg

SEQ ID NO: 3328098 - RNA, 15 nt, Human
ccucccaccucagcc

SEQ ID NO: 3328099 - RNA, 13 nt, Human
ccucccaucucac

SEQ ID NO: 3328100 - RNA, 16 nt, Human
ccucccaucucacaca

SEQ ID NO: 3328101 - RNA, 19 nt, Human
ccugcccaccuggccucug

SEQ ID NO: 3328102 - RNA, 12 nt, Human
ccugcccaccug

SEQ ID NO: 3328103 - RNA, 14 nt, Human
ccugcccaccuggc

SEQ ID NO: 3328104 - RNA, 20 nt, Human
ccugcccaccuggccucugc

SEQ ID NO: 3328105 - RNA, 13 nt, Human
ccugcccaccugg

SEQ ID NO: 3328106 - RNA, 17 nt, Human
ccugcugcaguugccag

SEQ ID NO: 3328107 - RNA, 19 nt, Human
ccugcugcaguugccaguc

SEQ ID NO: 3328108 - RNA, 23 nt, Human
ccugccucgaacuggcugcaaag

SEQ ID NO: 3328109 - RNA, 21 nt, Human
ccugccucgaacuggcugcaa

SEQ ID NO: 3328110 - RNA, 19 nt, Human
ccugccucgaacuggcugc

SEQ ID NO: 3328111 - RNA, 16 nt, Human
ccugcugcaguugcca

SEQ ID NO: 3328112 - RNA, 20 nt, Human
ccugcugcaguugccaguca

SEQ ID NO: 3328113 - RNA, 13 nt, Human
ccucuuucccucc

SEQ ID NO: 3328114 - RNA, 17 nt, Human
ccugcacuugcagacuc

SEQ ID NO: 3328115 - RNA, 16 nt, Human
ccugcacuugcagacu

SEQ ID NO: 3328116 - RNA, 14 nt, Human
ccugcagagggcac

SEQ ID NO: 3328117 - RNA, 18 nt, Human
ccugcacuugcagacucu

SEQ ID NO: 3328118 - RNA, 11 nt, Human
ccucuuucccu

SEQ ID NO: 3328119 - RNA, 22 nt, Human
ccuggccuagcauacguacaca

SEQ ID NO: 3328120 - RNA, 16 nt, Human
ccuggccucugcacuc

SEQ ID NO: 3328121 - RNA, 20 nt, Human
ccuggccucugcacuccccu

SEQ ID NO: 3328122 - RNA, 21 nt, Human
ccuggccucugcacuccccug

SEQ ID NO: 3328123 - RNA, 22 nt, Human
ccuggccucugcacuccccugc

SEQ ID NO: 3328124 - RNA, 15 nt, Human
ccugucuaaugaaac

SEQ ID NO: 3328125 - RNA, 22 nt, Human
ccugucuaaugaaaccuguguc

SEQ ID NO: 3328126 - RNA, 21 nt, Human
ccugguggcagugggagcugc

SEQ ID NO: 3328127 - RNA, 20 nt, Human
ccugguggcagugggagcug

SEQ ID NO: 3328128 - RNA, 14 nt, Human
auuucuguuuagau

SEQ ID NO: 3328129 - RNA, 16 nt, Human
auuucuguuuagauaa

SEQ ID NO: 3328130 - RNA, 12 nt, Human
auuucuguuuag

SEQ ID NO: 3328131 - RNA, 14 nt, Human
auuuaaugaaagac

SEQ ID NO: 3328132 - RNA, 21 nt, Human
auuuaaugaaagacuguacaa

SEQ ID NO: 3328133 - RNA, 19 nt, Human
auuguucuuaguuugcagu

SEQ ID NO: 3328134 - RNA, 15 nt, Human
auuguaaggaaugau

SEQ ID NO: 3328135 - RNA, 16 nt, Human
auuguaaggaaugauu

SEQ ID NO: 3328136 - RNA, 17 nt, Human
auugauaugcuuauaca

SEQ ID NO: 3328137 - RNA, 19 nt, Human
auucucuccuguaccucuu

SEQ ID NO: 3328138 - RNA, 21 nt, Human
auucucuccuguaccucuuga

SEQ ID NO: 3328139 - RNA, 21 nt, Human
auuccugaugcuucuucagag

SEQ ID NO: 3328140 - RNA, 16 nt, Human
auucucuccuguaccu

SEQ ID NO: 3328141 - RNA, 17 nt, Human
auucuuuccugaggcug

SEQ ID NO: 3328142 - RNA, 22 nt, Human
auucuuuccugaggcugggcuc

SEQ ID NO: 3328143 - RNA, 13 nt, Human
auucuuuccugag

SEQ ID NO: 3328144 - RNA, 19 nt, Human
auucauauuuacuucuuau

SEQ ID NO: 3328145 - RNA, 18 nt, Human
auucauauuuacuucuua

SEQ ID NO: 3328146 - RNA, 20 nt, Human
auucauauuuacuucuuaua

SEQ ID NO: 3328147 - RNA, 14 nt, Human
auucauauuuacuu

SEQ ID NO: 3328148 - RNA, 14 nt, Human
auuaaauucuugca

SEQ ID NO: 3328149 - RNA, 18 nt, Human
auuaaauucuugcaaagu

SEQ ID NO: 3328150 - RNA, 20 nt, Human
auuaaauucuugcaaaguau

SEQ ID NO: 3328151 - RNA, 21 nt, Human
auucaaccauggacuuuauaa

SEQ ID NO: 3328152 - RNA, 20 nt, Human
auucaaccauggacuuuaua

SEQ ID NO: 3328153 - RNA, 19 nt, Human
auucaaccauggacuuuau

SEQ ID NO: 3328154 - RNA, 18 nt, Human
auucaaccauggacuuua

SEQ ID NO: 3328155 - RNA, 13 nt, Human
auuuguuugaacu

SEQ ID NO: 3328156 - RNA, 14 nt, Human
auuuguuugaacug

SEQ ID NO: 3328157 - RNA, 16 nt, Human
auuuguuugaacugau

SEQ ID NO: 3328158 - RNA, 15 nt, Human
caaaagcugggcagg

SEQ ID NO: 3328159 - RNA, 13 nt, Human
auuuuuuuuuccu

SEQ ID NO: 3328160 - RNA, 16 nt, Human
auuuuuuuuuccuuca

SEQ ID NO: 3328161 - RNA, 12 nt, Human
auuuuuuuuucc

SEQ ID NO: 3328162 - RNA, 23 nt, Human
caacaaaccuguuucugcagcca

SEQ ID NO: 3328163 - RNA, 16 nt, Human
caaaguacacuguuuc

SEQ ID NO: 3328164 - RNA, 20 nt, Human
caaaguacacuguuucaaac

SEQ ID NO: 3328165 - RNA, 21 nt, Human
caaaguacacuguuucaaacu

SEQ ID NO: 3328166 - RNA, 13 nt, Human
caaagaugcagcc

SEQ ID NO: 3328167 - RNA, 17 nt, Human
caaaucagcugcuacua

SEQ ID NO: 3328168 - RNA, 20 nt, Human
caacaccuuguuucccucuc

SEQ ID NO: 3328169 - RNA, 22 nt, Human
caacaccucugcacaagcugca

SEQ ID NO: 3328170 - RNA, 20 nt, Human
caacaccucugcacaagcug

SEQ ID NO: 3328171 - RNA, 18 nt, Human
caaccacugcgaccacaa

SEQ ID NO: 3328172 - RNA, 18 nt, Human
caagacccuugugguccc

SEQ ID NO: 3328173 - RNA, 19 nt, Human
caagacccuugugguccca

SEQ ID NO: 3328174 - RNA, 22 nt, Human
caagacccuuguggucccaccc

SEQ ID NO: 3328175 - RNA, 16 nt, Human
caacucaccccagccc

SEQ ID NO: 3328176 - RNA, 13 nt, Human
caacucaccccag

SEQ ID NO: 3328177 - RNA, 15 nt, Human
caacucaccccagcc

SEQ ID NO: 3328178 - RNA, 17 nt, Human
caacccccagccugcua

SEQ ID NO: 3328179 - RNA, 16 nt, Human
caacccccagccugcu

SEQ ID NO: 3328180 - RNA, 15 nt, Human
caacccccagccugc

SEQ ID NO: 3328181 - RNA, 14 nt, Human
caacccccagccug

SEQ ID NO: 3328182 - RNA, 17 nt, Human
caaccauggacuuuaua

SEQ ID NO: 3328183 - RNA, 18 nt, Human
caaccauggacuuuauaa

SEQ ID NO: 3328184 - RNA, 17 nt, Human
cagaaauguguuaucac

SEQ ID NO: 3328185 - RNA, 19 nt, Human
cagaaguuucugccgcagc

SEQ ID NO: 3328186 - RNA, 23 nt, Human
cagaaguuugagaucagccuggg

SEQ ID NO: 3328187 - RNA, 22 nt, Human
cagaaguuucugccgcagcccu

SEQ ID NO: 3328188 - RNA, 20 nt, Human
cagaaguuucugccgcagcc

SEQ ID NO: 3328189 - RNA, 21 nt, Human
cagaaguuucugccgcagccc

SEQ ID NO: 3328190 - RNA, 23 nt, Human
cacugggcuuggggaccagagcu

SEQ ID NO: 3328191 - RNA, 22 nt, Human
cacugggcuuggggaccagagc

SEQ ID NO: 3328192 - RNA, 20 nt, Human
cacugggcuuggggaccaga

SEQ ID NO: 3328193 - RNA, 16 nt, Human
cacuguugcccaggcu

SEQ ID NO: 3328194 - RNA, 15 nt, Human
cacuguugcccaggc

SEQ ID NO: 3328195 - RNA, 14 nt, Human
cacuguugcccagg

SEQ ID NO: 3328196 - RNA, 17 nt, Human
cacuggugacaugucuu

SEQ ID NO: 3328197 - RNA, 19 nt, Human
cacuguuucaaacuuuacu

SEQ ID NO: 3328198 - RNA, 17 nt, Human
cacucuuauugcccacg

SEQ ID NO: 3328199 - RNA, 18 nt, Human
cacucuuauugcccacgc

SEQ ID NO: 3328200 - RNA, 23 nt, Human
cacuacggaauaguuggcuagga

SEQ ID NO: 3328201 - RNA, 13 nt, Human
cacggccaggcca

SEQ ID NO: 3328202 - RNA, 16 nt, Human
cacggccaggccagag

SEQ ID NO: 3328203 - RNA, 15 nt, Human
cacggccaggccaga

SEQ ID NO: 3328204 - RNA, 14 nt, Human
cacggccaggccag

SEQ ID NO: 3328205 - RNA, 20 nt, Human
cacggagggugacgggggug

SEQ ID NO: 3328206 - RNA, 18 nt, Human
caccuugacagggcacac

SEQ ID NO: 3328207 - RNA, 17 nt, Human
caccugccagggacaga

SEQ ID NO: 3328208 - RNA, 19 nt, Human
caccuugacagggcacacc

SEQ ID NO: 3328209 - RNA, 13 nt, Human
caccuuggcucaa

SEQ ID NO: 3328210 - RNA, 14 nt, Human
caccuuugucccca

SEQ ID NO: 3328211 - RNA, 15 nt, Human
caccuuuguccccac

SEQ ID NO: 3328212 - RNA, 14 nt, Human
caccuuugaagaag

SEQ ID NO: 3328213 - RNA, 14 nt, Human
caccugccagggac

SEQ ID NO: 3328214 - RNA, 16 nt, Human
caccugccagggacag

SEQ ID NO: 3328215 - RNA, 13 nt, Human
caccugccaggga

SEQ ID NO: 3328216 - RNA, 17 nt, Human
cacccagcccacuucug

SEQ ID NO: 3328217 - RNA, 16 nt, Human
cacccagcccacuucu

SEQ ID NO: 3328218 - RNA, 23 nt, Human
caccaacauacucccaucuguga

SEQ ID NO: 3328219 - RNA, 14 nt, Human
caccagcagccugg

SEQ ID NO: 3328220 - RNA, 12 nt, Human
caccagcagccu

SEQ ID NO: 3328221 - RNA, 15 nt, Human
caccagcagccugga

SEQ ID NO: 3328222 - RNA, 21 nt, Human
caccagcccuuagcagggaaa

SEQ ID NO: 3328223 - RNA, 23 nt, Human
cacccaggagccccgaggccuuc

SEQ ID NO: 3328224 - RNA, 20 nt, Human
cacccaggagccccgaggcc

SEQ ID NO: 3328225 - RNA, 19 nt, Human
cacccagcccacuucugcc

SEQ ID NO: 3328226 - RNA, 24 nt, Human
cacccaggagccccgaggccuucu

SEQ ID NO: 3328227 - RNA, 16 nt, Human
cacccaggagccccga

SEQ ID NO: 3328228 - RNA, 13 nt, Human
cacauuuuucuua

SEQ ID NO: 3328229 - RNA, 14 nt, Human
cacauuuuucuuag

SEQ ID NO: 3328230 - RNA, 17 nt, Human
cacauuuuuuaaaugca

SEQ ID NO: 3328231 - RNA, 21 nt, Human
cacauuuuuuaaaugcaccug

SEQ ID NO: 3328232 - RNA, 20 nt, Human
caccaacauacucccaucug

SEQ ID NO: 3328233 - RNA, 21 nt, Human
caccaacauacucccaucugu

SEQ ID NO: 3328234 - RNA, 17 nt, Human
caccaacauacucccau

SEQ ID NO: 3328235 - RNA, 15 nt, Human
cacauuuuauuuuau

SEQ ID NO: 3328236 - RNA, 21 nt, Human
cacauuuuauuuuauuaugca

SEQ ID NO: 3328237 - RNA, 18 nt, Human
cacaucuugcucugcuga

SEQ ID NO: 3328238 - RNA, 19 nt, Human
cacaucagcacgauuucug

SEQ ID NO: 3328239 - RNA, 20 nt, Human
cacaucagcacgauuucugu

SEQ ID NO: 3328240 - RNA, 21 nt, Human
cacaucagcacgauuucuguu

SEQ ID NO: 3328241 - RNA, 22 nt, Human
cacaucagcacgauuucuguuu

SEQ ID NO: 3328242 - RNA, 17 nt, Human
cacaucuugcucugcug

SEQ ID NO: 3328243 - RNA, 16 nt, Human
cacaucuugcucugcu

SEQ ID NO: 3328244 - RNA, 18 nt, Human
cacaguauuacuucugcu

SEQ ID NO: 3328245 - RNA, 16 nt, Human
cacaguauuacuucug

SEQ ID NO: 3328246 - RNA, 20 nt, Human
cacagacccugcccuguggg

SEQ ID NO: 3328247 - RNA, 21 nt, Human
cacagacccugcccugugggc

SEQ ID NO: 3328248 - RNA, 19 nt, Human
cacagacccugcccugugg

SEQ ID NO: 3328249 - RNA, 15 nt, Human
cacagcuaacaugga

SEQ ID NO: 3328250 - RNA, 16 nt, Human
cacagcuaacauggaa

SEQ ID NO: 3328251 - RNA, 18 nt, Human
cacagacccugcccugug

SEQ ID NO: 3328252 - RNA, 19 nt, Human
cacagcucuguccugggag

SEQ ID NO: 3328253 - RNA, 23 nt, Human
cacagcucuguccugggagugag

SEQ ID NO: 3328254 - RNA, 20 nt, Human
cacagcucuguccugggagu

SEQ ID NO: 3328255 - RNA, 22 nt, Human
cacagcuaacauggaaguacua

SEQ ID NO: 3328256 - RNA, 22 nt, Human
caaugcugugcccuaaagugua

SEQ ID NO: 3328257 - RNA, 23 nt, Human
caaugcuggcuguuggcuggggg

SEQ ID NO: 3328258 - RNA, 22 nt, Human
caaugcuggcuguuggcugggg

SEQ ID NO: 3328259 - RNA, 21 nt, Human
caaugcuggcuguuggcuggg

SEQ ID NO: 3328260 - RNA, 14 nt, Human
cacaagccuucggc

SEQ ID NO: 3328261 - RNA, 14 nt, Human
cacaagacccuugu

SEQ ID NO: 3328262 - RNA, 16 nt, Human
cacaagacccuugugg

SEQ ID NO: 3328263 - RNA, 15 nt, Human
caggccagagggagu

SEQ ID NO: 3328264 - RNA, 13 nt, Human
caggccagaggga

SEQ ID NO: 3328265 - RNA, 18 nt, Human
caggcagauacaggaaaa

SEQ ID NO: 3328266 - RNA, 19 nt, Human
caggccaggcccucugccc

SEQ ID NO: 3328267 - RNA, 17 nt, Human
caggccaggcccucugc

SEQ ID NO: 3328268 - RNA, 18 nt, Human
caggccaggcccucugcc

SEQ ID NO: 3328269 - RNA, 17 nt, Human
caggccagcugcuuggg

SEQ ID NO: 3328270 - RNA, 19 nt, Human
caggccagcugcuugggcu

SEQ ID NO: 3328271 - RNA, 21 nt, Human
caggccagcugcuugggcuuc

SEQ ID NO: 3328272 - RNA, 16 nt, Human
caggccaggcccucug

SEQ ID NO: 3328273 - RNA, 12 nt, Human
caggcugggaga

SEQ ID NO: 3328274 - RNA, 14 nt, Human
caggcugggagagc

SEQ ID NO: 3328275 - RNA, 20 nt, Human
caggcugggcuucaguggca

SEQ ID NO: 3328276 - RNA, 19 nt, Human
caggcugggcuucaguggc

SEQ ID NO: 3328277 - RNA, 22 nt, Human
caggcugggcuucaguggcagc

SEQ ID NO: 3328278 - RNA, 21 nt, Human
caggcugggcuucaguggcag

SEQ ID NO: 3328279 - RNA, 20 nt, Human
cagggcucagcggggacagc

SEQ ID NO: 3328280 - RNA, 23 nt, Human
cagggcucagcggggacagcucc

SEQ ID NO: 3328281 - RNA, 21 nt, Human
cagggcucagcggggacagcu

SEQ ID NO: 3328282 - RNA, 19 nt, Human
caggggaaaaucagccugc

SEQ ID NO: 3328283 - RNA, 17 nt, Human
caggggaaaaucagccu

SEQ ID NO: 3328284 - RNA, 20 nt, Human
caggggaaaaucagccugcu

SEQ ID NO: 3328285 - RNA, 18 nt, Human
caguggugguuuucuguu

SEQ ID NO: 3328286 - RNA, 21 nt, Human
caguggugcgaucuggguuca

SEQ ID NO: 3328287 - RNA, 20 nt, Human
caguggugcgaucuggguuc

SEQ ID NO: 3328288 - RNA, 23 nt, Human
cagugggagcugccuguucagcu

SEQ ID NO: 3328289 - RNA, 12 nt, Human
cagugcccacag

SEQ ID NO: 3328290 - RNA, 18 nt, Human
cagugggagcugccuguu

SEQ ID NO: 3328291 - RNA, 20 nt, Human
cagugggagcugccuguuca

SEQ ID NO: 3328292 - RNA, 17 nt, Human
cagugcccacaggauca

SEQ ID NO: 3328293 - RNA, 16 nt, Human
cagugcaugcuguccc

SEQ ID NO: 3328294 - RNA, 17 nt, Human
cagugcaugcugucccu

SEQ ID NO: 3328295 - RNA, 15 nt, Human
cagugcccacaggau

SEQ ID NO: 3328296 - RNA, 13 nt, Human
cagugcccacagg

SEQ ID NO: 3328297 - RNA, 17 nt, Human
cagucuggaaugcagug

SEQ ID NO: 3328298 - RNA, 15 nt, Human
cagucuggaaugcag

SEQ ID NO: 3328299 - RNA, 13 nt, Human
cagugcaugcugu

SEQ ID NO: 3328300 - RNA, 14 nt, Human
cagugcaugcuguc

SEQ ID NO: 3328301 - RNA, 20 nt, Human
caggugauccacccaccuca

SEQ ID NO: 3328302 - RNA, 21 nt, Human
caggugauccacccaccucag

SEQ ID NO: 3328303 - RNA, 17 nt, Human
caggugcacaagcucca

SEQ ID NO: 3328304 - RNA, 18 nt, Human
caggugcacaagcuccaa

SEQ ID NO: 3328305 - RNA, 19 nt, Human
caggugcacaagcuccaag

SEQ ID NO: 3328306 - RNA, 20 nt, Human
caggugcacaagcuccaagc

SEQ ID NO: 3328307 - RNA, 23 nt, Human
caggugauccacccaccucagcc

SEQ ID NO: 3328308 - RNA, 22 nt, Human
caggugauccacccaccucagc

SEQ ID NO: 3328309 - RNA, 15 nt, Human
caggugcacaagcuc

SEQ ID NO: 3328310 - RNA, 16 nt, Human
cagguuuuccugaaga

SEQ ID NO: 3328311 - RNA, 12 nt, Human
cagguuuuccug

SEQ ID NO: 3328312 - RNA, 21 nt, Human
cagguuggugggggccucggu

SEQ ID NO: 3328313 - RNA, 21 nt, Human
caggugcacaagcuccaagcu

SEQ ID NO: 3328314 - RNA, 16 nt, Human
caggaaaagcugcuga

SEQ ID NO: 3328315 - RNA, 15 nt, Human
caggaaaagcugcug

SEQ ID NO: 3328316 - RNA, 19 nt, Human
cagcuguucagcugguuga

SEQ ID NO: 3328317 - RNA, 24 nt, Human
cagcugugcucuggacaggcaugu

SEQ ID NO: 3328318 - RNA, 20 nt, Human
cagcugugcucuggacaggc

SEQ ID NO: 3328319 - RNA, 19 nt, Human
cagcugugcucuggacagg

SEQ ID NO: 3328320 - RNA, 13 nt, Human
cagcugccuggga

SEQ ID NO: 3328321 - RNA, 14 nt, Human
cagcugccugggau

SEQ ID NO: 3328322 - RNA, 12 nt, Human
cagcugccuggg

SEQ ID NO: 3328323 - RNA, 19 nt, Human
cagcugagggugagugggu

SEQ ID NO: 3328324 - RNA, 12 nt, Human
cagccugcucca

SEQ ID NO: 3328325 - RNA, 19 nt, Human
cagccugcuaauuccccag

SEQ ID NO: 3328326 - RNA, 21 nt, Human
cagcggggacagcuccuucug

SEQ ID NO: 3328327 - RNA, 17 nt, Human
cagcggggacagcuccu

SEQ ID NO: 3328328 - RNA, 19 nt, Human
cagcggggacagcuccuuc

SEQ ID NO: 3328329 - RNA, 18 nt, Human
cagcggggacagcuccuu

SEQ ID NO: 3328330 - RNA, 19 nt, Human
cagccgagauagccaaggc

SEQ ID NO: 3328331 - RNA, 17 nt, Human
cagccucugaaaaccaa

SEQ ID NO: 3328332 - RNA, 20 nt, Human
cagcaucauggagguuugaa

SEQ ID NO: 3328333 - RNA, 16 nt, Human
cagcacgauuucuguu

SEQ ID NO: 3328334 - RNA, 18 nt, Human
cagcacgauuucuguuua

SEQ ID NO: 3328335 - RNA, 19 nt, Human
cagcacgauuucuguuuag

SEQ ID NO: 3328336 - RNA, 20 nt, Human
cagauucuuuccugaggcug

SEQ ID NO: 3328337 - RNA, 22 nt, Human
cagauucuuuccugaggcuggg

SEQ ID NO: 3328338 - RNA, 15 nt, Human
cagcacgauuucugu

SEQ ID NO: 3328339 - RNA, 15 nt, Human
cagauucuuuccuga

SEQ ID NO: 3328340 - RNA, 17 nt, Human
cagauucuuuccugagg

SEQ ID NO: 3328341 - RNA, 18 nt, Human
cagauucuuuccugaggc

SEQ ID NO: 3328342 - RNA, 19 nt, Human
cagauucuuuccugaggcu

SEQ ID NO: 3328343 - RNA, 22 nt, Human
cagaggggguggccucccaacu

SEQ ID NO: 3328344 - RNA, 23 nt, Human
cagaggggguggccucccaacuc

SEQ ID NO: 3328345 - RNA, 13 nt, Human
cauguuggccagg

SEQ ID NO: 3328346 - RNA, 15 nt, Human
cauguuggccaggcu

SEQ ID NO: 3328347 - RNA, 14 nt, Human
cauguuggccaggc

SEQ ID NO: 3328348 - RNA, 16 nt, Human
cauguuggccaggcug

SEQ ID NO: 3328349 - RNA, 19 nt, Human
cauguuggccaggcugguc

SEQ ID NO: 3328350 - RNA, 14 nt, Human
cauucuccaccugc

SEQ ID NO: 3328351 - RNA, 16 nt, Human
cauucuccaccugcca

SEQ ID NO: 3328352 - RNA, 13 nt, Human
cauucuccaccug

SEQ ID NO: 3328353 - RNA, 14 nt, Human
caugggaaugaaug

SEQ ID NO: 3328354 - RNA, 15 nt, Human
caugggaaugaaugu

SEQ ID NO: 3328355 - RNA, 16 nt, Human
caugggaaugaauguc

SEQ ID NO: 3328356 - RNA, 20 nt, Human
caugcuccuggcccacugca

SEQ ID NO: 3328357 - RNA, 14 nt, Human
caugcuacacacug

SEQ ID NO: 3328358 - RNA, 20 nt, Human
caugcuacacacugcauguu

SEQ ID NO: 3328359 - RNA, 23 nt, Human
caugcuacacacugcauguuugu

SEQ ID NO: 3328360 - RNA, 13 nt, Human
caugauguuuucc

SEQ ID NO: 3328361 - RNA, 15 nt, Human
cauccuggcacccgg

SEQ ID NO: 3328362 - RNA, 14 nt, Human
caucacuucccuac

SEQ ID NO: 3328363 - RNA, 12 nt, Human
caucacuucccu

SEQ ID NO: 3328364 - RNA, 21 nt, Human
cauccccuguagagugggagc

SEQ ID NO: 3328365 - RNA, 22 nt, Human
cauccuggcacccggccccugc

SEQ ID NO: 3328366 - RNA, 17 nt, Human
cauauucuguuggccag

SEQ ID NO: 3328367 - RNA, 22 nt, Human
cauauucaggaagcucagggcc

SEQ ID NO: 3328368 - RNA, 19 nt, Human
caguggugguuuucuguuc

SEQ ID NO: 3328369 - RNA, 20 nt, Human
caguggugguuuucuguucu

SEQ ID NO: 3328370 - RNA, 21 nt, Human
caguggugguuuucuguucuu

SEQ ID NO: 3328371 - RNA, 17 nt, Human
ccacucccugcaaccug

SEQ ID NO: 3328372 - RNA, 21 nt, Human
ccaccuuugaagaaguaagga

SEQ ID NO: 3328373 - RNA, 22 nt, Human
ccaccgcagacaggaccaggga

SEQ ID NO: 3328374 - RNA, 19 nt, Human
ccaccgcagacaggaccag

SEQ ID NO: 3328375 - RNA, 16 nt, Human
ccacgcccccacuggu

SEQ ID NO: 3328376 - RNA, 17 nt, Human
ccacgcccccacuggug

SEQ ID NO: 3328377 - RNA, 18 nt, Human
ccacgcccccacugguga

SEQ ID NO: 3328378 - RNA, 19 nt, Human
ccacgcccccacuggugac

SEQ ID NO: 3328379 - RNA, 13 nt, Human
ccacgcccccacu

SEQ ID NO: 3328380 - RNA, 17 nt, Human
ccaccacacccagccca

SEQ ID NO: 3328381 - RNA, 13 nt, Human
ccaccaucaagcc

SEQ ID NO: 3328382 - RNA, 14 nt, Human
ccaccaucaagcca

SEQ ID NO: 3328383 - RNA, 21 nt, Human
ccaaaacucuccucugcugcu

SEQ ID NO: 3328384 - RNA, 20 nt, Human
ccaaaacucuccucugcugc

SEQ ID NO: 3328385 - RNA, 17 nt, Human
ccaaugggagcucaugg

SEQ ID NO: 3328386 - RNA, 14 nt, Human
ccaaugggagcuca

SEQ ID NO: 3328387 - RNA, 17 nt, Human
ccaagcucugcuccucu

SEQ ID NO: 3328388 - RNA, 12 nt, Human
ccaagcucugcu

SEQ ID NO: 3328389 - RNA, 18 nt, Human
ccaagcucugcuccucuc

SEQ ID NO: 3328390 - RNA, 15 nt, Human
ccaaugauggucacc

SEQ ID NO: 3328391 - RNA, 17 nt, Human
ccaauauuuaccagacc

SEQ ID NO: 3328392 - RNA, 16 nt, Human
ccaacucaccccagcc

SEQ ID NO: 3328393 - RNA, 17 nt, Human
ccaacucaccccagccc

SEQ ID NO: 3328394 - RNA, 18 nt, Human
ccaacucaccccagcccc

SEQ ID NO: 3328395 - RNA, 22 nt, Human
ccaagcucccaggcauucccca

SEQ ID NO: 3328396 - RNA, 23 nt, Human
ccaaauggaaaugggcagagcag

SEQ ID NO: 3328397 - RNA, 14 nt, Human
ccaacucaccccag

SEQ ID NO: 3328398 - RNA, 20 nt, Human
cuggcagaguugaagacaga

SEQ ID NO: 3328399 - RNA, 21 nt, Human
cuggcagaguugaagacagag

SEQ ID NO: 3328400 - RNA, 19 nt, Human
cuggcagaguugaagacag

SEQ ID NO: 3328401 - RNA, 23 nt, Human
cuggcagccccuguucuggcaga

SEQ ID NO: 3328402 - RNA, 22 nt, Human
cuggcagaguugaagacagagc

SEQ ID NO: 3328403 - RNA, 13 nt, Human
cuggcagccccug

SEQ ID NO: 3328404 - RNA, 17 nt, Human
cuggcagcucagagagg

SEQ ID NO: 3328405 - RNA, 19 nt, Human
cuggcagcucagagagggu

SEQ ID NO: 3328406 - RNA, 16 nt, Human
cuggcagcucagagag

SEQ ID NO: 3328407 - RNA, 15 nt, Human
cuggcagcucagaga

SEQ ID NO: 3328408 - RNA, 17 nt, Human
cugggacuacaggugug

SEQ ID NO: 3328409 - RNA, 21 nt, Human
cugggacuacaggcacccacc

SEQ ID NO: 3328410 - RNA, 17 nt, Human
cugggacuacaggcacc

SEQ ID NO: 3328411 - RNA, 16 nt, Human
cugggacuacaggcac

SEQ ID NO: 3328412 - RNA, 14 nt, Human
cuggcucuuccagg

SEQ ID NO: 3328413 - RNA, 15 nt, Human
cuggcucuuccaggc

SEQ ID NO: 3328414 - RNA, 13 nt, Human
cuggcucuuccag

SEQ ID NO: 3328415 - RNA, 14 nt, Human
cuggagaaaaugga

SEQ ID NO: 3328416 - RNA, 21 nt, Human
cuggagaaaauggacguguua

SEQ ID NO: 3328417 - RNA, 14 nt, Human
cugcuuccagugag

SEQ ID NO: 3328418 - RNA, 23 nt, Human
cugcuucagccucccgaguagcu

SEQ ID NO: 3328419 - RNA, 14 nt, Human
cugcuucaaggauc

SEQ ID NO: 3328420 - RNA, 16 nt, Human
cugcuucaaggauccu

SEQ ID NO: 3328421 - RNA, 19 nt, Human
cugcuucaaggauccugag

SEQ ID NO: 3328422 - RNA, 13 nt, Human
cugcuucaaggau

SEQ ID NO: 3328423 - RNA, 16 nt, Human
cuggaugcagccucac

SEQ ID NO: 3328424 - RNA, 17 nt, Human
cuggaugcagccucaca

SEQ ID NO: 3328425 - RNA, 18 nt, Human
cuggaugcagccucacag

SEQ ID NO: 3328426 - RNA, 15 nt, Human
cuggaugcagccuca

SEQ ID NO: 3328427 - RNA, 23 nt, Human
cugccuguucagcuccagcucac

SEQ ID NO: 3328428 - RNA, 20 nt, Human
cugccuguucagcuccagcu

SEQ ID NO: 3328429 - RNA, 24 nt, Human
cugcugaaggcucgagcaugccug

SEQ ID NO: 3328430 - RNA, 23 nt, Human
cugcugaaggcucgagcaugccu

SEQ ID NO: 3328431 - RNA, 18 nt, Human
cugcugaaggcucgagca

SEQ ID NO: 3328432 - RNA, 17 nt, Human
cugcuaucaaagagguu

SEQ ID NO: 3328433 - RNA, 14 nt, Human
cugccuccuuugug

SEQ ID NO: 3328434 - RNA, 17 nt, Human
cugccuccuuugugagg

SEQ ID NO: 3328435 - RNA, 21 nt, Human
cugccuccuuugugaggaagc

SEQ ID NO: 3328436 - RNA, 23 nt, Human
cugccuccuuugugaggaagccg

SEQ ID NO: 3328437 - RNA, 14 nt, Human
cugccucgaacugg

SEQ ID NO: 3328438 - RNA, 20 nt, Human
cugccucgaacuggcugcaa

SEQ ID NO: 3328439 - RNA, 19 nt, Human
cugccucgaacuggcugca

SEQ ID NO: 3328440 - RNA, 24 nt, Human
cugcccugugaguacuacaguccu

SEQ ID NO: 3328441 - RNA, 13 nt, Human
cugcccugugagu

SEQ ID NO: 3328442 - RNA, 19 nt, Human
cugcccuuaccugccagga

SEQ ID NO: 3328443 - RNA, 17 nt, Human
cugcccuuaccugccag

SEQ ID NO: 3328444 - RNA, 12 nt, Human
cugcccuguggg

SEQ ID NO: 3328445 - RNA, 11 nt, Human
cugcccugugg

SEQ ID NO: 3328446 - RNA, 22 nt, Human
cugcccuuaccugccaggaagc

SEQ ID NO: 3328447 - RNA, 23 nt, Human
cugcccuuaccugccaggaagcc

SEQ ID NO: 3328448 - RNA, 13 nt, Human
cuuaaauaaugug

SEQ ID NO: 3328449 - RNA, 14 nt, Human
cuuaaauaauguga

SEQ ID NO: 3328450 - RNA, 16 nt, Human
cuuaaauaaugugaaa

SEQ ID NO: 3328451 - RNA, 19 nt, Human
cuuaaauaaugugaaacug

SEQ ID NO: 3328452 - RNA, 12 nt, Human
cuguuggccagu

SEQ ID NO: 3328453 - RNA, 18 nt, Human
cuguugcccaggcuggcg

SEQ ID NO: 3328454 - RNA, 22 nt, Human
cugugucagguggggcagcuug

SEQ ID NO: 3328455 - RNA, 18 nt, Human
cugugcucuggacaggca

SEQ ID NO: 3328456 - RNA, 17 nt, Human
cuguuacugucuucagu

SEQ ID NO: 3328457 - RNA, 13 nt, Human
cuguuacugucuu

SEQ ID NO: 3328458 - RNA, 15 nt, Human
cuguucagcuccagc

SEQ ID NO: 3328459 - RNA, 14 nt, Human
cuguucagcuccag

SEQ ID NO: 3328460 - RNA, 22 nt, Human
cuguucagcuccagcucaccag

SEQ ID NO: 3328461 - RNA, 19 nt, Human
cuguucagcuccagcucac

SEQ ID NO: 3328462 - RNA, 18 nt, Human
cuguucagcuccagcuca

SEQ ID NO: 3328463 - RNA, 16 nt, Human
cuguucagcuccagcu

SEQ ID NO: 3328464 - RNA, 12 nt, Human
cuguucagcugg

SEQ ID NO: 3328465 - RNA, 15 nt, Human
cugugcucuggacag

SEQ ID NO: 3328466 - RNA, 17 nt, Human
cugugcucuggacaggc

SEQ ID NO: 3328467 - RNA, 14 nt, Human
cugucauuugagca

SEQ ID NO: 3328468 - RNA, 14 nt, Human
cuguccugggagug

SEQ ID NO: 3328469 - RNA, 13 nt, Human
cuguccugggagu

SEQ ID NO: 3328470 - RNA, 20 nt, Human
cuguccugggagugagcugg

SEQ ID NO: 3328471 - RNA, 22 nt, Human
cugucuaaugaaaccugugucu

SEQ ID NO: 3328472 - RNA, 15 nt, Human
cuguagagugggagc

SEQ ID NO: 3328473 - RNA, 22 nt, Human
cuggugacaugucuuuucuugc

SEQ ID NO: 3328474 - RNA, 18 nt, Human
cuggucuuauuuguaaag

SEQ ID NO: 3328475 - RNA, 18 nt, Human
cuucugacccaugcugcc

SEQ ID NO: 3328476 - RNA, 16 nt, Human
cuucugacccaugcug

SEQ ID NO: 3328477 - RNA, 17 nt, Human
cuucugacccaugcugc

SEQ ID NO: 3328478 - RNA, 16 nt, Human
cuucuuauacauuuga

SEQ ID NO: 3328479 - RNA, 13 nt, Human
cuucuuauacauu

SEQ ID NO: 3328480 - RNA, 15 nt, Human
cuucugacccaugcu

SEQ ID NO: 3328481 - RNA, 22 nt, Human
cuucugaacuuggcgcugcccc

SEQ ID NO: 3328482 - RNA, 19 nt, Human
cuucugaacuuggcgcugc

SEQ ID NO: 3328483 - RNA, 13 nt, Human
cuuccucccuccc

SEQ ID NO: 3328484 - RNA, 12 nt, Human
cuuccucccucc

SEQ ID NO: 3328485 - RNA, 14 nt, Human
cuuccucccucccu

SEQ ID NO: 3328486 - RNA, 20 nt, Human
cuuggcgcugccccuggcag

SEQ ID NO: 3328487 - RNA, 23 nt, Human
cuuggcgcugccccuggcagccc

SEQ ID NO: 3328488 - RNA, 21 nt, Human
cuuggcgcugccccuggcagc

SEQ ID NO: 3328489 - RNA, 22 nt, Human
cuuggcgcugccccuggcagcc

SEQ ID NO: 3328490 - RNA, 14 nt, Human
cuuggauugucccc

SEQ ID NO: 3328491 - RNA, 18 nt, Human
cuuggauuguccccgacc

SEQ ID NO: 3328492 - RNA, 20 nt, Human
cuuggauuguccccgacccu

SEQ ID NO: 3328493 - RNA, 15 nt, Human
cuuggauuguccccg

SEQ ID NO: 3328494 - RNA, 18 nt, Human
cuugccgucuaccugagg

SEQ ID NO: 3328495 - RNA, 19 nt, Human
cuugauucauaaugacuua

SEQ ID NO: 3328496 - RNA, 12 nt, Human
cuugauucauaa

SEQ ID NO: 3328497 - RNA, 20 nt, Human
cuuuaaugucacaggcaggu

SEQ ID NO: 3328498 - RNA, 19 nt, Human
cuuuaaugucacaggcagg

SEQ ID NO: 3328499 - RNA, 18 nt, Human
cuuuaaugucacaggcag

SEQ ID NO: 3328500 - RNA, 17 nt, Human
cuuuaaugucacaggca

SEQ ID NO: 3328501 - RNA, 14 nt, Human
cuuucaauaggaaa

SEQ ID NO: 3328502 - RNA, 15 nt, Human
cuuucaauaggaaaa

SEQ ID NO: 3328503 - RNA, 22 nt, Human
cuuuaaugucacaggcaggucc

SEQ ID NO: 3328504 - RNA, 21 nt, Human
cuugucuuuggacccugaggc

SEQ ID NO: 3328505 - RNA, 22 nt, Human
cuugucuuuggacccugaggcc

SEQ ID NO: 3328506 - RNA, 17 nt, Human
cuuucaauaggaaaaac

SEQ ID NO: 3328507 - RNA, 16 nt, Human
cuugguccugcugcag

SEQ ID NO: 3328508 - RNA, 17 nt, Human
cuugguccugcugcagu

SEQ ID NO: 3328509 - RNA, 18 nt, Human
cuugguccugcugcaguu

SEQ ID NO: 3328510 - RNA, 20 nt, Human
cuugguccugcugcaguugc

SEQ ID NO: 3328511 - RNA, 15 nt, Human
cuugguccugcugca

SEQ ID NO: 3328512 - RNA, 19 nt, Human
cuugucuuuggacccugag

SEQ ID NO: 3328513 - RNA, 20 nt, Human
cuugucuuuggacccugagg

SEQ ID NO: 3328514 - RNA, 13 nt, Human
cuugucuguagau

SEQ ID NO: 3328515 - RNA, 20 nt, Human
cuugguucccauuugcuccu

SEQ ID NO: 3328516 - RNA, 16 nt, Human
cuugguucccauuugc

SEQ ID NO: 3328517 - RNA, 22 nt, Human
cuugguccugcugcaguugcca

SEQ ID NO: 3328518 - RNA, 20 nt, Human
cuuggugucgggcaugacac

SEQ ID NO: 3328519 - RNA, 14 nt, Human
gaacaaggcaaggc

SEQ ID NO: 3328520 - RNA, 15 nt, Human
gaacaaggcaaggcu

SEQ ID NO: 3328521 - RNA, 17 nt, Human
gaacaaggcaaggcugu

SEQ ID NO: 3328522 - RNA, 18 nt, Human
gaacaaggcaaggcuguc

SEQ ID NO: 3328523 - RNA, 21 nt, Human
gaacaaggcaaggcugucaau

SEQ ID NO: 3328524 - RNA, 17 nt, Human
gaaaggcuccaggagca

SEQ ID NO: 3328525 - RNA, 18 nt, Human
gaaaggcuccaggagcag

SEQ ID NO: 3328526 - RNA, 19 nt, Human
gaaaggcuccaggagcagc

SEQ ID NO: 3328527 - RNA, 16 nt, Human
gaaaggcuccaggagc

SEQ ID NO: 3328528 - RNA, 18 nt, Human
gaaagacuaucuaaaugu

SEQ ID NO: 3328529 - RNA, 21 nt, Human
gaaaguacuucuccacccugc

SEQ ID NO: 3328530 - RNA, 19 nt, Human
gaaauuuuuauuaaauuau

SEQ ID NO: 3328531 - RNA, 18 nt, Human
gaaauuuuuauuaaauua

SEQ ID NO: 3328532 - RNA, 17 nt, Human
gaaaucaccgaaaacgu

SEQ ID NO: 3328533 - RNA, 18 nt, Human
gaaaauuuugauguuuua

SEQ ID NO: 3328534 - RNA, 14 nt, Human
gaaaauuuuaaaaa

SEQ ID NO: 3328535 - RNA, 12 nt, Human
gaaacaaacuuu

SEQ ID NO: 3328536 - RNA, 19 nt, Human
gaaaaaauauuuuccugcc

SEQ ID NO: 3328537 - RNA, 21 nt, Human
cuuuuuuuuuuuuuuugacaa

SEQ ID NO: 3328538 - RNA, 14 nt, Human
cuuuugugcauuau

SEQ ID NO: 3328539 - RNA, 18 nt, Human
cuuuugugcauuaucuag

SEQ ID NO: 3328540 - RNA, 16 nt, Human
cuuuuggucuguguga

SEQ ID NO: 3328541 - RNA, 15 nt, Human
cuuuuggucugugug

SEQ ID NO: 3328542 - RNA, 16 nt, Human
cuuuugccguuauuaa

SEQ ID NO: 3328543 - RNA, 18 nt, Human
cuuuugccguuauuaaaa

SEQ ID NO: 3328544 - RNA, 17 nt, Human
gagggccugcaagggag

SEQ ID NO: 3328545 - RNA, 21 nt, Human
gagggccugcaagggagugag

SEQ ID NO: 3328546 - RNA, 14 nt, Human
gagggccugcaagg

SEQ ID NO: 3328547 - RNA, 19 nt, Human
gaggcauuuguuugaacug

SEQ ID NO: 3328548 - RNA, 22 nt, Human
gaggcaugugaugagaggaaau

SEQ ID NO: 3328549 - RNA, 20 nt, Human
gaggcaugugaugagaggaa

SEQ ID NO: 3328550 - RNA, 21 nt, Human
gaggcaugugaugagaggaaa

SEQ ID NO: 3328551 - RNA, 21 nt, Human
gaggcauuuguuugaacugau

SEQ ID NO: 3328552 - RNA, 20 nt, Human
gaggcagggucucacucugu

SEQ ID NO: 3328553 - RNA, 19 nt, Human
gaggcagggucucacucug

SEQ ID NO: 3328554 - RNA, 18 nt, Human
gaggcagggucucacucu

SEQ ID NO: 3328555 - RNA, 14 nt, Human
gaggagagaggacc

SEQ ID NO: 3328556 - RNA, 15 nt, Human
gaggagagaggaccc

SEQ ID NO: 3328557 - RNA, 12 nt, Human
gaggagagagga

SEQ ID NO: 3328558 - RNA, 16 nt, Human
gaggacuuuucuuugu

SEQ ID NO: 3328559 - RNA, 23 nt, Human
gaggacuuuucuuuguggcuucc

SEQ ID NO: 3328560 - RNA, 20 nt, Human
gaggacuuuucuuuguggcu

SEQ ID NO: 3328561 - RNA, 23 nt, Human
gaggacagggaggugaccccagg

SEQ ID NO: 3328562 - RNA, 13 nt, Human
gagcccugguggc

SEQ ID NO: 3328563 - RNA, 14 nt, Human
gagccccgaggccu

SEQ ID NO: 3328564 - RNA, 13 nt, Human
gagccccgaggcc

SEQ ID NO: 3328565 - RNA, 17 nt, Human
gagccccgaggccuucu

SEQ ID NO: 3328566 - RNA, 13 nt, Human
gagcaugccugga

SEQ ID NO: 3328567 - RNA, 15 nt, Human
gagcaucaggccagg

SEQ ID NO: 3328568 - RNA, 16 nt, Human
gagcaucaggccaggc

SEQ ID NO: 3328569 - RNA, 13 nt, Human
gagcaucaggcca

SEQ ID NO: 3328570 - RNA, 14 nt, Human
gagcaucaggccag

SEQ ID NO: 3328571 - RNA, 21 nt, Human
gagcagggcucagcggggaca

SEQ ID NO: 3328572 - RNA, 14 nt, Human
gacuuuuccaaccc

SEQ ID NO: 3328573 - RNA, 19 nt, Human
gacuuuuccaacccucauc

SEQ ID NO: 3328574 - RNA, 22 nt, Human
gacuuuguuaguuucuccaagc

SEQ ID NO: 3328575 - RNA, 14 nt, Human
gagacggaguccca

SEQ ID NO: 3328576 - RNA, 19 nt, Human
gagacggagucccaccuug

SEQ ID NO: 3328577 - RNA, 16 nt, Human
gagacggagucccacc

SEQ ID NO: 3328578 - RNA, 18 nt, Human
gagacgggggcagagagg

SEQ ID NO: 3328579 - RNA, 21 nt, Human
gagacccugucucaaaaaaag

SEQ ID NO: 3328580 - RNA, 23 nt, Human
gagaaugaaagggcccagagagg

SEQ ID NO: 3328581 - RNA, 15 nt, Human
gagaaugaaagggcc

SEQ ID NO: 3328582 - RNA, 15 nt, Human
gagaggacccccuga

SEQ ID NO: 3328583 - RNA, 20 nt, Human
gagagcugggugucaagagg

SEQ ID NO: 3328584 - RNA, 12 nt, Human
gagaggaaauca

SEQ ID NO: 3328585 - RNA, 22 nt, Human
gagaggcauccaguaucuugaa

SEQ ID NO: 3328586 - RNA, 18 nt, Human
gagagccuuccaggggug

SEQ ID NO: 3328587 - RNA, 20 nt, Human
gagagccuuccagggguggg

SEQ ID NO: 3328588 - RNA, 15 nt, Human
gagagcuagcagcag

SEQ ID NO: 3328589 - RNA, 21 nt, Human
gagagcuagcagcagggaggg

SEQ ID NO: 3328590 - RNA, 13 nt, Human
gagagcugggugu

SEQ ID NO: 3328591 - RNA, 13 nt, Human
gagacuccugcag

SEQ ID NO: 3328592 - RNA, 14 nt, Human
gagagccuuccagg

SEQ ID NO: 3328593 - RNA, 15 nt, Human
gagagccuuccaggg

SEQ ID NO: 3328594 - RNA, 16 nt, Human
gagagccuuccagggg

SEQ ID NO: 3328595 - RNA, 21 nt, Human
gagauugcaccacugcacucc

SEQ ID NO: 3328596 - RNA, 14 nt, Human
gagauuggaaggaa

SEQ ID NO: 3328597 - RNA, 23 nt, Human
gacauugcggacagccacggcca

SEQ ID NO: 3328598 - RNA, 17 nt, Human
gacauugcggacagcca

SEQ ID NO: 3328599 - RNA, 14 nt, Human
gacagucccugcca

SEQ ID NO: 3328600 - RNA, 15 nt, Human
gacagucccugccaa

SEQ ID NO: 3328601 - RNA, 16 nt, Human
gacagucccugccaau

SEQ ID NO: 3328602 - RNA, 20 nt, Human
gacagucccugccaauggac

SEQ ID NO: 3328603 - RNA, 11 nt, Human
gacagcucuua

SEQ ID NO: 3328604 - RNA, 12 nt, Human
gacagucccugc

SEQ ID NO: 3328605 - RNA, 10 nt, Human
gacagcucuu

SEQ ID NO: 3328606 - RNA, 19 nt, Human
gacagcuccuucuguccua

SEQ ID NO: 3328607 - RNA, 14 nt, Human
gacagcccgggcuc

SEQ ID NO: 3328608 - RNA, 18 nt, Human
gacagcuccuucuguccu

SEQ ID NO: 3328609 - RNA, 17 nt, Human
gacagcuccuucugucc

SEQ ID NO: 3328610 - RNA, 16 nt, Human
gacagcuccuucuguc

SEQ ID NO: 3328611 - RNA, 18 nt, Human
gaccucaggugagaagca

SEQ ID NO: 3328612 - RNA, 19 nt, Human
gaccucaggugagaagcag

SEQ ID NO: 3328613 - RNA, 19 nt, Human
gaccucaggccugggggcu

SEQ ID NO: 3328614 - RNA, 21 nt, Human
gaccucaggugauccacccac

SEQ ID NO: 3328615 - RNA, 20 nt, Human
gaccucaggugauccaccca

SEQ ID NO: 3328616 - RNA, 21 nt, Human
gaccucaggugagaagcagag

SEQ ID NO: 3328617 - RNA, 19 nt, Human
gaccucaggugauccaccc

SEQ ID NO: 3328618 - RNA, 14 nt, Human
gaccucaggccugg

SEQ ID NO: 3328619 - RNA, 13 nt, Human
gaccucaggccug

SEQ ID NO: 3328620 - RNA, 16 nt, Human
gaccucugcagcaaua

SEQ ID NO: 3328621 - RNA, 18 nt, Human
gaccucugcagcaauaaa

SEQ ID NO: 3328622 - RNA, 22 nt, Human
gaccucugcagcaauaaagcag

SEQ ID NO: 3328623 - RNA, 12 nt, Human
gacgccauccca

SEQ ID NO: 3328624 - RNA, 13 nt, Human
gacgccaucccag

SEQ ID NO: 3328625 - RNA, 14 nt, Human
gaccucugcagcaa

SEQ ID NO: 3328626 - RNA, 19 nt, Human
gacgccaucccagccccaa

SEQ ID NO: 3328627 - RNA, 21 nt, Human
gacgccaucccagccccaaug

SEQ ID NO: 3328628 - RNA, 16 nt, Human
gacgcugugcugcccu

SEQ ID NO: 3328629 - RNA, 17 nt, Human
gacgcugugcugcccug

SEQ ID NO: 3328630 - RNA, 18 nt, Human
gacgcugugcugcccugc

SEQ ID NO: 3328631 - RNA, 15 nt, Human
gacgcugugcugccc

SEQ ID NO: 3328632 - RNA, 22 nt, Human
gacgcuacccgggaagggggcu

SEQ ID NO: 3328633 - RNA, 19 nt, Human
gacgcuacccgggaagggg

SEQ ID NO: 3328634 - RNA, 23 nt, Human
gacgcuacccgggaagggggcug

SEQ ID NO: 3328635 - RNA, 12 nt, Human
gaauauugcuga

SEQ ID NO: 3328636 - RNA, 11 nt, Human
gaauauugcug

SEQ ID NO: 3328637 - RNA, 15 nt, Human
gaauauauaaccagu

SEQ ID NO: 3328638 - RNA, 20 nt, Human
gaauauugcugauggugcaa

SEQ ID NO: 3328639 - RNA, 24 nt, Human
gaauauugcugauggugcaaugac

SEQ ID NO: 3328640 - RNA, 22 nt, Human
gaauauugcugauggugcaaug

SEQ ID NO: 3328641 - RNA, 23 nt, Human
gaauauugcugauggugcaauga

SEQ ID NO: 3328642 - RNA, 20 nt, Human
gacacagcucuucuccaggc

SEQ ID NO: 3328643 - RNA, 19 nt, Human
gacacagcucuucuccagg

SEQ ID NO: 3328644 - RNA, 12 nt, Human
gacacagcucuu

SEQ ID NO: 3328645 - RNA, 17 nt, Human
gacacagcucuucucca

SEQ ID NO: 3328646 - RNA, 19 nt, Human
gaauguuugccucugccuc

SEQ ID NO: 3328647 - RNA, 18 nt, Human
gaauguuugccucugccu

SEQ ID NO: 3328648 - RNA, 17 nt, Human
gaauguuugccucugcc

SEQ ID NO: 3328649 - RNA, 16 nt, Human
gaauguuugccucugc

SEQ ID NO: 3328650 - RNA, 19 nt, Human
gaaugcacaaacagaggcc

SEQ ID NO: 3328651 - RNA, 15 nt, Human
gaauguuugccucug

SEQ ID NO: 3328652 - RNA, 18 nt, Human
gaaugcacaaacagaggc

SEQ ID NO: 3328653 - RNA, 20 nt, Human
gaaugaugauccuaggcauu

SEQ ID NO: 3328654 - RNA, 14 nt, Human
gaaugaugccauga

SEQ ID NO: 3328655 - RNA, 14 nt, Human
gaaugauuaauuaa

SEQ ID NO: 3328656 - RNA, 16 nt, Human
gcauacguacacauuu

SEQ ID NO: 3328657 - RNA, 17 nt, Human
gcauacguacacauuuu

SEQ ID NO: 3328658 - RNA, 15 nt, Human
gcauacguacacauu

SEQ ID NO: 3328659 - RNA, 14 nt, Human
gcauacguacacau

SEQ ID NO: 3328660 - RNA, 18 nt, Human
gcauccaguaucuugaag

SEQ ID NO: 3328661 - RNA, 14 nt, Human
gcauccaguaucuu

SEQ ID NO: 3328662 - RNA, 17 nt, Human
gcauccaguaucuugaa

SEQ ID NO: 3328663 - RNA, 16 nt, Human
gcauuuaaaagauaca

SEQ ID NO: 3328664 - RNA, 17 nt, Human
gcauuuaaaagauacag

SEQ ID NO: 3328665 - RNA, 16 nt, Human
gcauugugggaagggg

SEQ ID NO: 3328666 - RNA, 15 nt, Human
gcauuuaaaagauac

SEQ ID NO: 3328667 - RNA, 18 nt, Human
gcauuuaaaagauacagu

SEQ ID NO: 3328668 - RNA, 22 nt, Human
gcauuuaaaagauacaguuacu

SEQ ID NO: 3328669 - RNA, 15 nt, Human
gcauuuacuuugugu

SEQ ID NO: 3328670 - RNA, 13 nt, Human
gcauugugggaag

SEQ ID NO: 3328671 - RNA, 15 nt, Human
gcauugugggaaggg

SEQ ID NO: 3328672 - RNA, 21 nt, Human
gcaugugaugagaggaaauca

SEQ ID NO: 3328673 - RNA, 18 nt, Human
gcaugugaugagaggaaa

SEQ ID NO: 3328674 - RNA, 19 nt, Human
gcaugugaugagaggaaau

SEQ ID NO: 3328675 - RNA, 21 nt, Human
gcauggcugccaaugggagcu

SEQ ID NO: 3328676 - RNA, 13 nt, Human
gcauccuggcacc

SEQ ID NO: 3328677 - RNA, 16 nt, Human
gcagccaggccacaag

SEQ ID NO: 3328678 - RNA, 14 nt, Human
gcagagggcacaga

SEQ ID NO: 3328679 - RNA, 17 nt, Human
gcagcauauucaggaag

SEQ ID NO: 3328680 - RNA, 18 nt, Human
gcagcauauucaggaagc

SEQ ID NO: 3328681 - RNA, 19 nt, Human
gcagcauauucaggaagcu

SEQ ID NO: 3328682 - RNA, 23 nt, Human
gcagcauauucaggaagcucagg

SEQ ID NO: 3328683 - RNA, 13 nt, Human
gcagaggaaagca

SEQ ID NO: 3328684 - RNA, 14 nt, Human
gcagaggaaagcaa

SEQ ID NO: 3328685 - RNA, 18 nt, Human
gcagaggaaagcaaagga

SEQ ID NO: 3328686 - RNA, 20 nt, Human
gcagaggaaagcaaaggaga

SEQ ID NO: 3328687 - RNA, 21 nt, Human
gcagaggaaagcaaaggagau

SEQ ID NO: 3328688 - RNA, 16 nt, Human
gcacuuuguucuggcu

SEQ ID NO: 3328689 - RNA, 12 nt, Human
gcacuccccugc

SEQ ID NO: 3328690 - RNA, 15 nt, Human
gcacuccccugcugg

SEQ ID NO: 3328691 - RNA, 18 nt, Human
gcacuuuguucuggcucu

SEQ ID NO: 3328692 - RNA, 19 nt, Human
gcacuuuguucuggcucuu

SEQ ID NO: 3328693 - RNA, 13 nt, Human
gcacuccccugcu

SEQ ID NO: 3328694 - RNA, 14 nt, Human
gcacuccccugcug

SEQ ID NO: 3328695 - RNA, 14 nt, Human
gcacuccagccugg

SEQ ID NO: 3328696 - RNA, 22 nt, Human
gcacuuuguucuggcucuucca

SEQ ID NO: 3328697 - RNA, 18 nt, Human
gcaagugagagcugggug

SEQ ID NO: 3328698 - RNA, 20 nt, Human
gcacucagaagacacugaug

SEQ ID NO: 3328699 - RNA, 17 nt, Human
gcacucagaagacacug

SEQ ID NO: 3328700 - RNA, 21 nt, Human
gaugcuucuucagagacuccu

SEQ ID NO: 3328701 - RNA, 23 nt, Human
gaugcuucucacugccaugccag

SEQ ID NO: 3328702 - RNA, 17 nt, Human
gaugcuucuucagagac

SEQ ID NO: 3328703 - RNA, 20 nt, Human
gaugcuucuucagagacucc

SEQ ID NO: 3328704 - RNA, 22 nt, Human
gaugauuggaggggggaggugg

SEQ ID NO: 3328705 - RNA, 13 nt, Human
gaugauccuaggc

SEQ ID NO: 3328706 - RNA, 18 nt, Human
gaucucuugagccuggga

SEQ ID NO: 3328707 - RNA, 19 nt, Human
gaucucuugagccugggag

SEQ ID NO: 3328708 - RNA, 15 nt, Human
gaucucuaacuucac

SEQ ID NO: 3328709 - RNA, 17 nt, Human
gauauuuuuuucuuuuc

SEQ ID NO: 3328710 - RNA, 20 nt, Human
gaucaaaagguuaauaaagu

SEQ ID NO: 3328711 - RNA, 23 nt, Human
gaucaaaagguuaauaaaguaau

SEQ ID NO: 3328712 - RNA, 19 nt, Human
gauccacccaccucagccu

SEQ ID NO: 3328713 - RNA, 18 nt, Human
gauccacccaccucagcc

SEQ ID NO: 3328714 - RNA, 21 nt, Human
gauccaagcuggucccacuca

SEQ ID NO: 3328715 - RNA, 21 nt, Human
gauccacccaccucagccucc

SEQ ID NO: 3328716 - RNA, 20 nt, Human
gauccacccaccucagccuc

SEQ ID NO: 3328717 - RNA, 22 nt, Human
gauccacccaccucagccuccc

SEQ ID NO: 3328718 - RNA, 19 nt, Human
gauccaagcuggucccacu

SEQ ID NO: 3328719 - RNA, 17 nt, Human
gauccaagcugguccca

SEQ ID NO: 3328720 - RNA, 16 nt, Human
gauccaagcugguccc

SEQ ID NO: 3328721 - RNA, 12 nt, Human
gauccaagcugg

SEQ ID NO: 3328722 - RNA, 21 nt, Human
gauacuguaucaugacaaaga

SEQ ID NO: 3328723 - RNA, 17 nt, Human
gauacuguaucaugaca

SEQ ID NO: 3328724 - RNA, 23 nt, Human
gauacaggaaaagcugcugacag

SEQ ID NO: 3328725 - RNA, 19 nt, Human
gauacaguuacucagaauu

SEQ ID NO: 3328726 - RNA, 23 nt, Human
gauacaguuacucagaauucucu

SEQ ID NO: 3328727 - RNA, 16 nt, Human
gauacaguuacucaga

SEQ ID NO: 3328728 - RNA, 14 nt, Human
gcaaaaaggcagga

SEQ ID NO: 3328729 - RNA, 22 nt, Human
gcaaaagaugcuucucacugcc

SEQ ID NO: 3328730 - RNA, 17 nt, Human
gcaaaagaugcuucuca

SEQ ID NO: 3328731 - RNA, 16 nt, Human
gauuuuuuuuuccuuc

SEQ ID NO: 3328732 - RNA, 17 nt, Human
gauuuuuuuuuccuuca

SEQ ID NO: 3328733 - RNA, 18 nt, Human
gauuuuuuuuuccuucag

SEQ ID NO: 3328734 - RNA, 11 nt, Human
gauuucacucu

SEQ ID NO: 3328735 - RNA, 16 nt, Human
gauuuaacagaaaugu

SEQ ID NO: 3328736 - RNA, 17 nt, Human
gauuuaacagaaaugua

SEQ ID NO: 3328737 - RNA, 18 nt, Human
gauuuaacagaaauguac

SEQ ID NO: 3328738 - RNA, 15 nt, Human
gauucuucugcuuca

SEQ ID NO: 3328739 - RNA, 13 nt, Human
gauucuucugcuu

SEQ ID NO: 3328740 - RNA, 12 nt, Human
gauucuucugcu

SEQ ID NO: 3328741 - RNA, 13 nt, Human
gcaacaggcuggg

SEQ ID NO: 3328742 - RNA, 15 nt, Human
gcaacaggcugggcu

SEQ ID NO: 3328743 - RNA, 14 nt, Human
gcaacaggcugggc

SEQ ID NO: 3328744 - RNA, 19 nt, Human
gcaacaggcugggcuucag

SEQ ID NO: 3328745 - RNA, 16 nt, Human
gcaacaggcugggcuu

SEQ ID NO: 3328746 - RNA, 16 nt, Human
gcaaccaccaccaacc

SEQ ID NO: 3328747 - RNA, 18 nt, Human
gcaaccaccaccaaccac

SEQ ID NO: 3328748 - RNA, 13 nt, Human
gcaaccaccacca

SEQ ID NO: 3328749 - RNA, 19 nt, Human
gcaaccuccgccucuuggg

SEQ ID NO: 3328750 - RNA, 16 nt, Human
gcaacccccagccugc

SEQ ID NO: 3328751 - RNA, 15 nt, Human
gcaacccccagccug

SEQ ID NO: 3328752 - RNA, 14 nt, Human
gcaacccccagccu

SEQ ID NO: 3328753 - RNA, 20 nt, Human
gcaaccuccgccucuugggu

SEQ ID NO: 3328754 - RNA, 15 nt, Human
gcaagugagagcugg

SEQ ID NO: 3328755 - RNA, 16 nt, Human
gcaagugagagcuggg

SEQ ID NO: 3328756 - RNA, 14 nt, Human
ggcucacugcagcc

SEQ ID NO: 3328757 - RNA, 13 nt, Human
ggcucacugcagc

SEQ ID NO: 3328758 - RNA, 15 nt, Human
ggcucacugcagccu

SEQ ID NO: 3328759 - RNA, 14 nt, Human
ggcucuuccaggcu

SEQ ID NO: 3328760 - RNA, 15 nt, Human
ggcucuuccaggcug

SEQ ID NO: 3328761 - RNA, 17 nt, Human
ggcucuuccaggcuggg

SEQ ID NO: 3328762 - RNA, 18 nt, Human
ggcucuuccaggcuggga

SEQ ID NO: 3328763 - RNA, 14 nt, Human
ggcuggccuggccc

SEQ ID NO: 3328764 - RNA, 13 nt, Human
ggcuggccuggcc

SEQ ID NO: 3328765 - RNA, 14 nt, Human
aaaaaggaggaaga

SEQ ID NO: 3328766 - RNA, 21 nt, Human
aaaaaggaugcacagaguugu

SEQ ID NO: 3328767 - RNA, 12 nt, Human
aaaaaggcagga

SEQ ID NO: 3328768 - RNA, 22 nt, Human
ggcuggguucuacccaggugcu

SEQ ID NO: 3328769 - RNA, 14 nt, Human
ggcuggguuggagg

SEQ ID NO: 3328770 - RNA, 22 nt, Human
aaaaaacugcugacuguuuucu

SEQ ID NO: 3328771 - RNA, 13 nt, Human
aaaaaaacacaaa

SEQ ID NO: 3328772 - RNA, 16 nt, Human
ggccagaugcaccagc

SEQ ID NO: 3328773 - RNA, 15 nt, Human
ggccagaugcaccag

SEQ ID NO: 3328774 - RNA, 18 nt, Human
ggccucccaacucacccc

SEQ ID NO: 3328775 - RNA, 19 nt, Human
ggccucccaacucacccca

SEQ ID NO: 3328776 - RNA, 17 nt, Human
ggccucccaacucaccc

SEQ ID NO: 3328777 - RNA, 13 nt, Human
ggccucagugcca

SEQ ID NO: 3328778 - RNA, 20 nt, Human
ggccucccaacucaccccag

SEQ ID NO: 3328779 - RNA, 22 nt, Human
ggccucccaacucaccccagcc

SEQ ID NO: 3328780 - RNA, 23 nt, Human
ggccucccaacucaccccagccc

SEQ ID NO: 3328781 - RNA, 14 nt, Human
ggcuaccuuuguau

SEQ ID NO: 3328782 - RNA, 13 nt, Human
ggcuaccuuugua

SEQ ID NO: 3328783 - RNA, 16 nt, Human
ggcuaauguacugcau

SEQ ID NO: 3328784 - RNA, 20 nt, Human
ggcuaagugauccucccacc

SEQ ID NO: 3328785 - RNA, 15 nt, Human
ggccuggccagaugc

SEQ ID NO: 3328786 - RNA, 12 nt, Human
ggccuggccaga

SEQ ID NO: 3328787 - RNA, 16 nt, Human
ggccugcaagggagug

SEQ ID NO: 3328788 - RNA, 17 nt, Human
ggccagagacacaagcc

SEQ ID NO: 3328789 - RNA, 18 nt, Human
ggccagagacacaagccu

SEQ ID NO: 3328790 - RNA, 19 nt, Human
ggccagagggagugacaga

SEQ ID NO: 3328791 - RNA, 17 nt, Human
ggccagagggagugaca

SEQ ID NO: 3328792 - RNA, 17 nt, Human
ggcauuuguuugaacug

SEQ ID NO: 3328793 - RNA, 13 nt, Human
ggccaaaggaagc

SEQ ID NO: 3328794 - RNA, 14 nt, Human
ggccaaaggaagca

SEQ ID NO: 3328795 - RNA, 16 nt, Human
ggccaaaggaagcaca

SEQ ID NO: 3328796 - RNA, 19 nt, Human
ggccaaaggaagcacaugc

SEQ ID NO: 3328797 - RNA, 14 nt, Human
ggcauuugcugaau

SEQ ID NO: 3328798 - RNA, 20 nt, Human
ggcacugcuuccagugaggc

SEQ ID NO: 3328799 - RNA, 13 nt, Human
ggcagccaggcca

SEQ ID NO: 3328800 - RNA, 22 nt, Human
ggcagccccauucugccugccc

SEQ ID NO: 3328801 - RNA, 21 nt, Human
ggcagccccauucugccugcc

SEQ ID NO: 3328802 - RNA, 20 nt, Human
ggcagccccauucugccugc

SEQ ID NO: 3328803 - RNA, 16 nt, Human
ggcagccccauucugc

SEQ ID NO: 3328804 - RNA, 18 nt, Human
ggcaggaggaucacuuga

SEQ ID NO: 3328805 - RNA, 16 nt, Human
ggcacugcuuccagug

SEQ ID NO: 3328806 - RNA, 18 nt, Human
ggcacaucagcacgauuu

SEQ ID NO: 3328807 - RNA, 18 nt, Human
ggcacaccgggcacucag

SEQ ID NO: 3328808 - RNA, 15 nt, Human
ggcaaaaaggcagga

SEQ ID NO: 3328809 - RNA, 21 nt, Human
ggagggugacgggggugaacu

SEQ ID NO: 3328810 - RNA, 22 nt, Human
ggaggugggauccuccaggugc

SEQ ID NO: 3328811 - RNA, 23 nt, Human
ggaggugggauccuccaggugca

SEQ ID NO: 3328812 - RNA, 13 nt, Human
ggaggggggaggu

SEQ ID NO: 3328813 - RNA, 16 nt, Human
ggaguucaucuugaau

SEQ ID NO: 3328814 - RNA, 15 nt, Human
ggauccugagccaga

SEQ ID NO: 3328815 - RNA, 16 nt, Human
ggauccugagccagau

SEQ ID NO: 3328816 - RNA, 18 nt, Human
ggauccugagccagauuu

SEQ ID NO: 3328817 - RNA, 19 nt, Human
ggauccugagccagauuuc

SEQ ID NO: 3328818 - RNA, 20 nt, Human
ggauccugagccagauuuca

SEQ ID NO: 3328819 - RNA, 23 nt, Human
ggauccugagccagauuucacuc

SEQ ID NO: 3328820 - RNA, 13 nt, Human
ggauuguccccga

SEQ ID NO: 3328821 - RNA, 14 nt, Human
ggaugaaaaaauaa

SEQ ID NO: 3328822 - RNA, 22 nt, Human
ggauuuaacagaaauguacagc

SEQ ID NO: 3328823 - RNA, 16 nt, Human
ggauuuaacagaaaug

SEQ ID NO: 3328824 - RNA, 17 nt, Human
ggauuuaacagaaaugu

SEQ ID NO: 3328825 - RNA, 16 nt, Human
ggauuguccccgaccc

SEQ ID NO: 3328826 - RNA, 20 nt, Human
ggauuguccccgacccuugc

SEQ ID NO: 3328827 - RNA, 12 nt, Human
ggauuuaacaga

SEQ ID NO: 3328828 - RNA, 16 nt, Human
ggaguggccacagaaa

SEQ ID NO: 3328829 - RNA, 12 nt, Human
ggagugggccca

SEQ ID NO: 3328830 - RNA, 22 nt, Human
ggagugggcccaaugcacuuug

SEQ ID NO: 3328831 - RNA, 14 nt, Human
ggaguggccacaga

SEQ ID NO: 3328832 - RNA, 15 nt, Human
ggaguggccacagaa

SEQ ID NO: 3328833 - RNA, 15 nt, Human
aaauauaggaacuua

SEQ ID NO: 3328834 - RNA, 14 nt, Human
aaauauauauagaa

SEQ ID NO: 3328835 - RNA, 18 nt, Human
aaauauauacgaacaaaa

SEQ ID NO: 3328836 - RNA, 19 nt, Human
aaauaccagccaguaaaug

SEQ ID NO: 3328837 - RNA, 16 nt, Human
guacacacacauacac

SEQ ID NO: 3328838 - RNA, 20 nt, Human
aaauaccagccaguaaaugg

SEQ ID NO: 3328839 - RNA, 21 nt, Human
aaauaccagccaguaaauggg

SEQ ID NO: 3328840 - RNA, 18 nt, Human
aaauaccagccaguaaau

SEQ ID NO: 3328841 - RNA, 23 nt, Human
aaauaucugaaaauguaugugua

SEQ ID NO: 3328842 - RNA, 22 nt, Human
aaauaucugaaaauguaugugu

SEQ ID NO: 3328843 - RNA, 21 nt, Human
aaauaucugaaaauguaugug

SEQ ID NO: 3328844 - RNA, 19 nt, Human
aaauaucugaaaauguaug

SEQ ID NO: 3328845 - RNA, 18 nt, Human
aaauaucugaaaauguau

SEQ ID NO: 3328846 - RNA, 17 nt, Human
aaauaucugaaaaugua

SEQ ID NO: 3328847 - RNA, 14 nt, Human
aaauaucugaaaau

SEQ ID NO: 3328848 - RNA, 12 nt, Human
aaauaucugaaa

SEQ ID NO: 3328849 - RNA, 19 nt, Human
aaaucagccugcuccagcu

SEQ ID NO: 3328850 - RNA, 21 nt, Human
aaaucagccugcuccagcugu

SEQ ID NO: 3328851 - RNA, 23 nt, Human
aaaucagccugcuccagcuguuc

SEQ ID NO: 3328852 - RNA, 18 nt, Human
aaaucagccugcuccagc

SEQ ID NO: 3328853 - RNA, 22 nt, Human
aaaguguauuuuuuuacuaaua

SEQ ID NO: 3328854 - RNA, 14 nt, Human
aaauaaugugaaac

SEQ ID NO: 3328855 - RNA, 22 nt, Human
aaauaaugugaaacuggauuaa

SEQ ID NO: 3328856 - RNA, 16 nt, Human
guaacaagccacccca

SEQ ID NO: 3328857 - RNA, 19 nt, Human
guaacaggaaaauuuuaaa

SEQ ID NO: 3328858 - RNA, 21 nt, Human
guaauuuuuuuaucgucacug

SEQ ID NO: 3328859 - RNA, 15 nt, Human
guaauuugugauaca

SEQ ID NO: 3328860 - RNA, 17 nt, Human
guaauuugugauacaau

SEQ ID NO: 3328861 - RNA, 20 nt, Human
guaauuugugauacaaugcu

SEQ ID NO: 3328862 - RNA, 23 nt, Human
guaauccuagcacuuugggaggc

SEQ ID NO: 3328863 - RNA, 17 nt, Human
gguucccauuugcuccu

SEQ ID NO: 3328864 - RNA, 17 nt, Human
gguguuuccuggcacug

SEQ ID NO: 3328865 - RNA, 19 nt, Human
gguguuuccuggcacugcu

SEQ ID NO: 3328866 - RNA, 22 nt, Human
gguucccuuuuuuggcugcuga

SEQ ID NO: 3328867 - RNA, 23 nt, Human
gguucccuuugacgccaucccag

SEQ ID NO: 3328868 - RNA, 22 nt, Human
gguucccuuugacgccauccca

SEQ ID NO: 3328869 - RNA, 11 nt, Human
gguguggggga

SEQ ID NO: 3328870 - RNA, 13 nt, Human
ggugugggggaag

SEQ ID NO: 3328871 - RNA, 13 nt, Human
ggugggggccucg

SEQ ID NO: 3328872 - RNA, 14 nt, Human
gguguggagaagcg

SEQ ID NO: 3328873 - RNA, 23 nt, Human
gguguggagaagcggcuggcagc

SEQ ID NO: 3328874 - RNA, 12 nt, Human
gguguggagaag

SEQ ID NO: 3328875 - RNA, 19 nt, Human
aaaguacacuguuucaaac

SEQ ID NO: 3328876 - RNA, 23 nt, Human
aaaguacuucuccacccugcucu

SEQ ID NO: 3328877 - RNA, 18 nt, Human
aaaguacacuguuucaaa

SEQ ID NO: 3328878 - RNA, 22 nt, Human
aaaguagaagucuuagauguau

SEQ ID NO: 3328879 - RNA, 20 nt, Human
aaaguagaagucuuagaugu

SEQ ID NO: 3328880 - RNA, 21 nt, Human
aaaguaucccuacuguaauuu

SEQ ID NO: 3328881 - RNA, 14 nt, Human
aaaguguauuuuuu

SEQ ID NO: 3328882 - RNA, 21 nt, Human
aaaguguauuuuuuuacuaau

SEQ ID NO: 3328883 - RNA, 18 nt, Human
aaaguaucccuacuguaa

SEQ ID NO: 3328884 - RNA, 22 nt, Human
gguuucuaaagcugccagccga

SEQ ID NO: 3328885 - RNA, 16 nt, Human
gguuucuaaagcugcc

SEQ ID NO: 3328886 - RNA, 15 nt, Human
gguuucagaaaugug

SEQ ID NO: 3328887 - RNA, 20 nt, Human
gguuuguaaauuaacuuuua

SEQ ID NO: 3328888 - RNA, 12 nt, Human
gguggcuggguu

SEQ ID NO: 3328889 - RNA, 18 nt, Human
gguggcuggguuggaggg

SEQ ID NO: 3328890 - RNA, 17 nt, Human
ggugggacacccuguga

SEQ ID NO: 3328891 - RNA, 13 nt, Human
ggugggacacccu

SEQ ID NO: 3328892 - RNA, 16 nt, Human
ggugggacacccugug

SEQ ID NO: 3328893 - RNA, 19 nt, Human
gguggggaccucaggccug

SEQ ID NO: 3328894 - RNA, 20 nt, Human
aaagggcccagagagggugg

SEQ ID NO: 3328895 - RNA, 12 nt, Human
aaagcugccagc

SEQ ID NO: 3328896 - RNA, 13 nt, Human
aaagcugccagcc

SEQ ID NO: 3328897 - RNA, 13 nt, Human
aaagcagugcaug

SEQ ID NO: 3328898 - RNA, 16 nt, Human
aaagcuaggccuggcc

SEQ ID NO: 3328899 - RNA, 14 nt, Human
aaagcuaggccugg

SEQ ID NO: 3328900 - RNA, 14 nt, Human
gguggcaccagcag

SEQ ID NO: 3328901 - RNA, 20 nt, Human
gguggcaccagcagccugga

SEQ ID NO: 3328902 - RNA, 21 nt, Human
ggugcugccauccagguucag

SEQ ID NO: 3328903 - RNA, 19 nt, Human
aaacuuaaucuaaauggaa

SEQ ID NO: 3328904 - RNA, 15 nt, Human
gggugggacacccug

SEQ ID NO: 3328905 - RNA, 18 nt, Human
gggugggacacccuguga

SEQ ID NO: 3328906 - RNA, 14 nt, Human
ggguggccucccaa

SEQ ID NO: 3328907 - RNA, 19 nt, Human
aaacuguuaauaguucagg

SEQ ID NO: 3328908 - RNA, 20 nt, Human
aaacguggcugcuucaagga

SEQ ID NO: 3328909 - RNA, 21 nt, Human
aaacguggcugcuucaaggau

SEQ ID NO: 3328910 - RNA, 18 nt, Human
gguaacuagggaagauaa

SEQ ID NO: 3328911 - RNA, 23 nt, Human
ggguuuugccauguuggccaggc

SEQ ID NO: 3328912 - RNA, 20 nt, Human
ggguuuugccauguuggcca

SEQ ID NO: 3328913 - RNA, 12 nt, Human
ggguggugaccu

SEQ ID NO: 3328914 - RNA, 19 nt, Human
gguaucaggugcugccauc

SEQ ID NO: 3328915 - RNA, 18 nt, Human
aaacuuuacuauggcccu

SEQ ID NO: 3328916 - RNA, 14 nt, Human
gguaucaggugcug

SEQ ID NO: 3328917 - RNA, 20 nt, Human
gguaggguaagugagagagg

SEQ ID NO: 3328918 - RNA, 20 nt, Human
gguaaggaauaccugucccc

SEQ ID NO: 3328919 - RNA, 19 nt, Human
ggggccaguuggucccccu

SEQ ID NO: 3328920 - RNA, 14 nt, Human
ggggaccagagcug

SEQ ID NO: 3328921 - RNA, 18 nt, Human
aaaauguauguguaagua

SEQ ID NO: 3328922 - RNA, 12 nt, Human
ggggaccagagc

SEQ ID NO: 3328923 - RNA, 13 nt, Human
ggggaccagagcu

SEQ ID NO: 3328924 - RNA, 15 nt, Human
gggggcugggcagag

SEQ ID NO: 3328925 - RNA, 13 nt, Human
ggggguggccucc

SEQ ID NO: 3328926 - RNA, 21 nt, Human
ggggucacucuggcagcucag

SEQ ID NO: 3328927 - RNA, 17 nt, Human
gggggaucacagccucu

SEQ ID NO: 3328928 - RNA, 11 nt, Human
gggggcuggga

SEQ ID NO: 3328929 - RNA, 22 nt, Human
aaaccugugucucugagaguag

SEQ ID NO: 3328930 - RNA, 19 nt, Human
aaacauuuugucauauaag

SEQ ID NO: 3328931 - RNA, 14 nt, Human
gggucacucuggca

SEQ ID NO: 3328932 - RNA, 20 nt, Human
gggucacucuggcagcucag

SEQ ID NO: 3328933 - RNA, 16 nt, Human
aaaagguuaauaaagu

SEQ ID NO: 3328934 - RNA, 17 nt, Human
aaaagguuaauaaagua

SEQ ID NO: 3328935 - RNA, 11 nt, Human
aaaaggcagga

SEQ ID NO: 3328936 - RNA, 19 nt, Human
aaaagguaugcaaucaaau

SEQ ID NO: 3328937 - RNA, 14 nt, Human
aaaaggaugcacag

SEQ ID NO: 3328938 - RNA, 15 nt, Human
aaaaggaugcacaga

SEQ ID NO: 3328939 - RNA, 19 nt, Human
aaaaggaugcacagaguug

SEQ ID NO: 3328940 - RNA, 22 nt, Human
aaaaggaugcacagaguuguua

SEQ ID NO: 3328941 - RNA, 13 nt, Human
aaaaggaugcaca

SEQ ID NO: 3328942 - RNA, 22 nt, Human
aaaaggagccaauuuaaagaaa

SEQ ID NO: 3328943 - RNA, 13 nt, Human
aaaauaccaagga

SEQ ID NO: 3328944 - RNA, 16 nt, Human
aaaauauuuuccugcc

SEQ ID NO: 3328945 - RNA, 14 nt, Human
gggccucagugcca

SEQ ID NO: 3328946 - RNA, 13 nt, Human
gggccucagugcc

SEQ ID NO: 3328947 - RNA, 22 nt, Human
gggccucgguguggagaagcgg

SEQ ID NO: 3328948 - RNA, 18 nt, Human
gggccucuuaugggcugg

SEQ ID NO: 3328949 - RNA, 21 nt, Human
gggcggugagaggggaacaga

SEQ ID NO: 3328950 - RNA, 12 nt, Human
gggccaggagcc

SEQ ID NO: 3328951 - RNA, 13 nt, Human
gggccaggagccu

SEQ ID NO: 3328952 - RNA, 14 nt, Human
gggccaggagccuc

SEQ ID NO: 3328953 - RNA, 19 nt, Human
gggcucagcggggacagcu

SEQ ID NO: 3328954 - RNA, 17 nt, Human
gggcucagcggggacag

SEQ ID NO: 3328955 - RNA, 15 nt, Human
gggcuaguugggcuu

SEQ ID NO: 3328956 - RNA, 18 nt, Human
gggcucagcaaaagaugc

SEQ ID NO: 3328957 - RNA, 22 nt, Human
gggcucagcaaaagaugcuucu

SEQ ID NO: 3328958 - RNA, 21 nt, Human
gggcucagcggggacagcucc

SEQ ID NO: 3328959 - RNA, 10 nt, Human
gggcuccaga

SEQ ID NO: 3328960 - RNA, 13 nt, Human
gggcuccagacac

SEQ ID NO: 3328961 - RNA, 17 nt, Human
gggcugcaccggcuggc

SEQ ID NO: 3328962 - RNA, 19 nt, Human
gggcugcaccggcuggccu

SEQ ID NO: 3328963 - RNA, 12 nt, Human
gggcugggcaga

SEQ ID NO: 3328964 - RNA, 15 nt, Human
gggcugggcagagga

SEQ ID NO: 3328965 - RNA, 20 nt, Human
gggcugcaccggcuggccug

SEQ ID NO: 3328966 - RNA, 21 nt, Human
gggcugcaccggcuggccugg

SEQ ID NO: 3328967 - RNA, 20 nt, Human
gcuaggaccccuccaugugg

SEQ ID NO: 3328968 - RNA, 16 nt, Human
gcuaguugggcuuccu

SEQ ID NO: 3328969 - RNA, 14 nt, Human
gcuaguugggcuuc

SEQ ID NO: 3328970 - RNA, 22 nt, Human
gcuagugugguguuuccuggca

SEQ ID NO: 3328971 - RNA, 22 nt, Human
gcuaagugauccucccaccuca

SEQ ID NO: 3328972 - RNA, 18 nt, Human
gcuaagugauccucccac

SEQ ID NO: 3328973 - RNA, 22 nt, Human
gcucagagagggugggaguggg

SEQ ID NO: 3328974 - RNA, 18 nt, Human
gcucagggccuggcucag

SEQ ID NO: 3328975 - RNA, 19 nt, Human
gcucagggccuggcucagg

SEQ ID NO: 3328976 - RNA, 17 nt, Human
gcucagggccuggcuca

SEQ ID NO: 3328977 - RNA, 20 nt, Human
gcucagggccuggcucaggu

SEQ ID NO: 3328978 - RNA, 15 nt, Human
gcggcuggcagccca

SEQ ID NO: 3328979 - RNA, 16 nt, Human
gcggccuuuggcuuca

SEQ ID NO: 3328980 - RNA, 19 nt, Human
gccugugccucugggacug

SEQ ID NO: 3328981 - RNA, 23 nt, Human
gccugggaucccucauccucaua

SEQ ID NO: 3328982 - RNA, 21 nt, Human
gccugggaucccucauccuca

SEQ ID NO: 3328983 - RNA, 14 nt, Human
gccuugaacuuuga

SEQ ID NO: 3328984 - RNA, 16 nt, Human
gccuguucagcuccag

SEQ ID NO: 3328985 - RNA, 14 nt, Human
gccuguucagcucc

SEQ ID NO: 3328986 - RNA, 15 nt, Human
gccuguucagcucca

SEQ ID NO: 3328987 - RNA, 16 nt, Human
gccuucucugaaggac

SEQ ID NO: 3328988 - RNA, 15 nt, Human
gccuucucugaagga

SEQ ID NO: 3328989 - RNA, 23 nt, Human
gccuugaacuuugaccucugcag

SEQ ID NO: 3328990 - RNA, 21 nt, Human
gccuugaccauucuccaccug

SEQ ID NO: 3328991 - RNA, 22 nt, Human
gccuugaccauucuccaccugc

SEQ ID NO: 3328992 - RNA, 17 nt, Human
gcgauucuucugcuuca

SEQ ID NO: 3328993 - RNA, 22 nt, Human
gcgauucuucugcuucagccuc

SEQ ID NO: 3328994 - RNA, 23 nt, Human
gccuugaccauucuccaccugcc

SEQ ID NO: 3328995 - RNA, 23 nt, Human
gcgauucuucugcuucagccucc

SEQ ID NO: 3328996 - RNA, 20 nt, Human
gcgcagcauauucaggaagc

SEQ ID NO: 3328997 - RNA, 21 nt, Human
gcgcagcauauucaggaagcu

SEQ ID NO: 3328998 - RNA, 12 nt, Human
gccccuggcagc

SEQ ID NO: 3328999 - RNA, 15 nt, Human
gccccuggcagcccc

SEQ ID NO: 3329000 - RNA, 16 nt, Human
gccccugcugguucag

SEQ ID NO: 3329001 - RNA, 15 nt, Human
gccccugcugguuca

SEQ ID NO: 3329002 - RNA, 12 nt, Human
gccccugcuggu

SEQ ID NO: 3329003 - RNA, 12 nt, Human
gcccccacuggu

SEQ ID NO: 3329004 - RNA, 20 nt, Human
gccccaaaacucuccucugc

SEQ ID NO: 3329005 - RNA, 21 nt, Human
gccccaaaacucuccucugcu

SEQ ID NO: 3329006 - RNA, 19 nt, Human
gccccaaaacucuccucug

SEQ ID NO: 3329007 - RNA, 21 nt, Human
gcccacgcuggagugcaguga

SEQ ID NO: 3329008 - RNA, 19 nt, Human
gcccacgcuggagugcagu

SEQ ID NO: 3329009 - RNA, 23 nt, Human
gcccacgcuggagugcagugagc

SEQ ID NO: 3329010 - RNA, 24 nt, Human
gcccaggaaaggcuccaggagcag

SEQ ID NO: 3329011 - RNA, 21 nt, Human
gcccaggaaaggcuccaggag

SEQ ID NO: 3329012 - RNA, 22 nt, Human
gcccaggaaaggcuccaggagc

SEQ ID NO: 3329013 - RNA, 23 nt, Human
gcccaggaaaggcuccaggagca

SEQ ID NO: 3329014 - RNA, 13 nt, Human
gcccacuucugcc

SEQ ID NO: 3329015 - RNA, 15 nt, Human
gcccacgcccccacu

SEQ ID NO: 3329016 - RNA, 16 nt, Human
gcccacgcccccacug

SEQ ID NO: 3329017 - RNA, 17 nt, Human
gcccacgcccccacugg

SEQ ID NO: 3329018 - RNA, 21 nt, Human
gcccacgcccccacuggugac

SEQ ID NO: 3329019 - RNA, 18 nt, Human
gcauuuacuuuguguuca

SEQ ID NO: 3329020 - RNA, 11 nt, Human
gcccaggcagg

SEQ ID NO: 3329021 - RNA, 16 nt, Human
gcccaggcaggucuug

SEQ ID NO: 3329022 - RNA, 12 nt, Human
gcccaggccccu

SEQ ID NO: 3329023 - RNA, 11 nt, Human
gcccaggcccc

SEQ ID NO: 3329024 - RNA, 21 nt, Human
gcccaggccccugccacccug

SEQ ID NO: 3329025 - RNA, 20 nt, Human
gcccaggccccugccacccu

SEQ ID NO: 3329026 - RNA, 18 nt, Human
gcccaggccccugccacc

SEQ ID NO: 3329027 - RNA, 17 nt, Human
gccuacaggagugagca

SEQ ID NO: 3329028 - RNA, 12 nt, Human
gccuagcauacg

SEQ ID NO: 3329029 - RNA, 22 nt, Human
gccuccuuugugaggaagccgc

SEQ ID NO: 3329030 - RNA, 13 nt, Human
gccucgaacuggc

SEQ ID NO: 3329031 - RNA, 16 nt, Human
gccucgaacuggcugc

SEQ ID NO: 3329032 - RNA, 14 nt, Human
gccucugggacugg

SEQ ID NO: 3329033 - RNA, 21 nt, Human
gccuccuuugugaggaagccg

SEQ ID NO: 3329034 - RNA, 16 nt, Human
gccuacaggagugagc

SEQ ID NO: 3329035 - RNA, 16 nt, Human
gcccugugggccccca

SEQ ID NO: 3329036 - RNA, 17 nt, Human
gcccugugggcccccaa

SEQ ID NO: 3329037 - RNA, 21 nt, Human
gcccuuaccugccaggaagcc

SEQ ID NO: 3329038 - RNA, 22 nt, Human
gcccuuaccugccaggaagcca

SEQ ID NO: 3329039 - RNA, 23 nt, Human
gcccuuaccugccaggaagccag

SEQ ID NO: 3329040 - RNA, 14 nt, Human
gcccugcccaccug

SEQ ID NO: 3329041 - RNA, 16 nt, Human
gccccuggcagccccu

SEQ ID NO: 3329042 - RNA, 23 nt, Human
ggaaaucaccgaaaacguggcug

SEQ ID NO: 3329043 - RNA, 18 nt, Human
ggaagccgcuggggccag

SEQ ID NO: 3329044 - RNA, 15 nt, Human
ggaagccgcuggggc

SEQ ID NO: 3329045 - RNA, 22 nt, Human
ggaagccagcaggcucucaggc

SEQ ID NO: 3329046 - RNA, 23 nt, Human
ggaagccagcaggcucucaggcc

SEQ ID NO: 3329047 - RNA, 21 nt, Human
ggaagccagcaggcucucagg

SEQ ID NO: 3329048 - RNA, 16 nt, Human
ggaagcucagggccug

SEQ ID NO: 3329049 - RNA, 17 nt, Human
ggaagcucagggccugg

SEQ ID NO: 3329050 - RNA, 21 nt, Human
ggaagcucagggccuggcuca

SEQ ID NO: 3329051 - RNA, 15 nt, Human
ggaauaccugucccc

SEQ ID NO: 3329052 - RNA, 15 nt, Human
ggaagcucagggccu

SEQ ID NO: 3329053 - RNA, 16 nt, Human
ggaauaccuguccccc

SEQ ID NO: 3329054 - RNA, 19 nt, Human
ggaauaccugucccccuga

SEQ ID NO: 3329055 - RNA, 16 nt, Human
ggaauauauaaccagu

SEQ ID NO: 3329056 - RNA, 19 nt, Human
ggaaugaaugucaguguga

SEQ ID NO: 3329057 - RNA, 12 nt, Human
ggacacagcucu

SEQ ID NO: 3329058 - RNA, 21 nt, Human
ggacacagcucuucuccaggc

SEQ ID NO: 3329059 - RNA, 13 nt, Human
ggacacagcucuu

SEQ ID NO: 3329060 - RNA, 12 nt, Human
ggacacccugug

SEQ ID NO: 3329061 - RNA, 17 nt, Human
ggacagggaggugaccc

SEQ ID NO: 3329062 - RNA, 23 nt, Human
ggacaggcauguucucugaggac

SEQ ID NO: 3329063 - RNA, 13 nt, Human
ggacacccuguga

SEQ ID NO: 3329064 - RNA, 23 nt, Human
ggacacccugugauggggcccug

SEQ ID NO: 3329065 - RNA, 13 nt, Human
ggacauggacaag

SEQ ID NO: 3329066 - RNA, 19 nt, Human
ggaaagcaaaggagauugg

SEQ ID NO: 3329067 - RNA, 16 nt, Human
ggaaagaguaggaaga

SEQ ID NO: 3329068 - RNA, 17 nt, Human
ggaaagaguaggaagac

SEQ ID NO: 3329069 - RNA, 20 nt, Human
ggaaagacuuuuccaacccu

SEQ ID NO: 3329070 - RNA, 14 nt, Human
ggaaagaggcucug

SEQ ID NO: 3329071 - RNA, 13 nt, Human
gcuuuugugcauu

SEQ ID NO: 3329072 - RNA, 19 nt, Human
gcuuuugugcauuaucuag

SEQ ID NO: 3329073 - RNA, 12 nt, Human
gcuuuugugcau

SEQ ID NO: 3329074 - RNA, 20 nt, Human
ggaaacagcuaaugggacac

SEQ ID NO: 3329075 - RNA, 16 nt, Human
gcuuaacuucacauau

SEQ ID NO: 3329076 - RNA, 16 nt, Human
gcuucuucagagacuc

SEQ ID NO: 3329077 - RNA, 15 nt, Human
gcuucuucagagacu

SEQ ID NO: 3329078 - RNA, 17 nt, Human
gcuuaacuucacauauu

SEQ ID NO: 3329079 - RNA, 14 nt, Human
gcuuaacuucacau

SEQ ID NO: 3329080 - RNA, 19 nt, Human
gcuucuucagagacuccug

SEQ ID NO: 3329081 - RNA, 21 nt, Human
gcuucuucagagacuccugca

SEQ ID NO: 3329082 - RNA, 16 nt, Human
gcuugaccgugaggcc

SEQ ID NO: 3329083 - RNA, 17 nt, Human
gcuugaccgugaggcca

SEQ ID NO: 3329084 - RNA, 18 nt, Human
gcuugaccgugaggccag

SEQ ID NO: 3329085 - RNA, 19 nt, Human
gcuugaccgugaggccaga

SEQ ID NO: 3329086 - RNA, 23 nt, Human
gcuugggcuucauccuccucaga

SEQ ID NO: 3329087 - RNA, 16 nt, Human
gcuuggggaccagagc

SEQ ID NO: 3329088 - RNA, 22 nt, Human
gcuuucuacccagcgagcccug

SEQ ID NO: 3329089 - RNA, 19 nt, Human
gcuuucuacccagcgagcc

SEQ ID NO: 3329090 - RNA, 13 nt, Human
gcuuucuacccag

SEQ ID NO: 3329091 - RNA, 17 nt, Human
gcuuggggaccagagcu

SEQ ID NO: 3329092 - RNA, 18 nt, Human
gcuuggggaccagagcug

SEQ ID NO: 3329093 - RNA, 20 nt, Human
gcuuggggaccagagcugcc

SEQ ID NO: 3329094 - RNA, 21 nt, Human
gcuuggggaccagagcugcca

SEQ ID NO: 3329095 - RNA, 19 nt, Human
gcuugggcuucauccuccu

SEQ ID NO: 3329096 - RNA, 18 nt, Human
gcugagggugagugggug

SEQ ID NO: 3329097 - RNA, 23 nt, Human
gcugagggugagugggugaauaa

SEQ ID NO: 3329098 - RNA, 14 nt, Human
gcugaggugggagg

SEQ ID NO: 3329099 - RNA, 17 nt, Human
gcugccccuggcagccc

SEQ ID NO: 3329100 - RNA, 20 nt, Human
gcugccccuggcagccccug

SEQ ID NO: 3329101 - RNA, 18 nt, Human
gcugccccuggcagcccc

SEQ ID NO: 3329102 - RNA, 19 nt, Human
gcugccccuggcagccccu

SEQ ID NO: 3329103 - RNA, 17 nt, Human
gcugccuguucagcucc

SEQ ID NO: 3329104 - RNA, 13 nt, Human
gcugccuguucag

SEQ ID NO: 3329105 - RNA, 12 nt, Human
gcugccuguuca

SEQ ID NO: 3329106 - RNA, 21 nt, Human
gcugccugggaucccucaucc

SEQ ID NO: 3329107 - RNA, 16 nt, Human
gcugccucucccauca

SEQ ID NO: 3329108 - RNA, 20 nt, Human
gcugccugggaucccucauc

SEQ ID NO: 3329109 - RNA, 16 nt, Human
gcugcacccucaggca

SEQ ID NO: 3329110 - RNA, 18 nt, Human
gcugcacccucaggcagg

SEQ ID NO: 3329111 - RNA, 19 nt, Human
gcugcacccucaggcaggu

SEQ ID NO: 3329112 - RNA, 13 nt, Human
gcugcaccggcug

SEQ ID NO: 3329113 - RNA, 23 nt, Human
gcugcaaaggguaucaggugcug

SEQ ID NO: 3329114 - RNA, 15 nt, Human
gcugugcugcccugc

SEQ ID NO: 3329115 - RNA, 16 nt, Human
gcugugcugcccugcc

SEQ ID NO: 3329116 - RNA, 15 nt, Human
gcuguuggcuggggg

SEQ ID NO: 3329117 - RNA, 20 nt, Human
gcuguuggcugggggccuca

SEQ ID NO: 3329118 - RNA, 16 nt, Human
gcuguuggcugggggc

SEQ ID NO: 3329119 - RNA, 14 nt, Human
gcuguuggcugggg

SEQ ID NO: 3329120 - RNA, 16 nt, Human
gcugugcucuggacag

SEQ ID NO: 3329121 - RNA, 15 nt, Human
gcugugcucuggaca

SEQ ID NO: 3329122 - RNA, 14 nt, Human
gcugugcugcccug

SEQ ID NO: 3329123 - RNA, 13 nt, Human
gcugugcucugga

SEQ ID NO: 3329124 - RNA, 17 nt, Human
gcuguaucccaugagcc

SEQ ID NO: 3329125 - RNA, 19 nt, Human
gcuggcuguuggcuggggg

SEQ ID NO: 3329126 - RNA, 18 nt, Human
gcuggcuguuggcugggg

SEQ ID NO: 3329127 - RNA, 18 nt, Human
gcuggcgugcaguggugc

SEQ ID NO: 3329128 - RNA, 15 nt, Human
gcuggcgugcagugg

SEQ ID NO: 3329129 - RNA, 14 nt, Human
gcuggcgugcagug

SEQ ID NO: 3329130 - RNA, 17 nt, Human
gcugggguggggaccuc

SEQ ID NO: 3329131 - RNA, 19 nt, Human
gcugggguggggaccucag

SEQ ID NO: 3329132 - RNA, 23 nt, Human
gcuggcuguuggcugggggccuc

SEQ ID NO: 3329133 - RNA, 20 nt, Human
gcuggcuguuggcugggggc

SEQ ID NO: 3329134 - RNA, 17 nt, Human
gcuggcuguuggcuggg

SEQ ID NO: 3329135 - RNA, 14 nt, Human
gcugggcagguugg

SEQ ID NO: 3329136 - RNA, 22 nt, Human
gcugggguggggaccucaggcc

SEQ ID NO: 3329137 - RNA, 18 nt, Human
gcuggguucuacccaggu

SEQ ID NO: 3329138 - RNA, 17 nt, Human
gcuggguucuacccagg

SEQ ID NO: 3329139 - RNA, 20 nt, Human
gcuggguucuacccaggugc

SEQ ID NO: 3329140 - RNA, 22 nt, Human
agugagcacuaaggugugcucu

SEQ ID NO: 3329141 - RNA, 15 nt, Human
ugugauggggcccug

SEQ ID NO: 3329142 - RNA, 16 nt, Human
ugugauggggcccugc

SEQ ID NO: 3329143 - RNA, 17 nt, Human
ugugauggggcccugcc

SEQ ID NO: 3329144 - RNA, 17 nt, Human
agugagacucugucuca

SEQ ID NO: 3329145 - RNA, 16 nt, Human
agugagacucugucuc

SEQ ID NO: 3329146 - RNA, 22 nt, Human
agugagacucugucucaaaaaa

SEQ ID NO: 3329147 - RNA, 17 nt, Human
agugagacccugucuca

SEQ ID NO: 3329148 - RNA, 21 nt, Human
agugagacccugucucaaaaa

SEQ ID NO: 3329149 - RNA, 13 nt, Human
agugagacucugu

SEQ ID NO: 3329150 - RNA, 11 nt, Human
agugaaaaagg

SEQ ID NO: 3329151 - RNA, 17 nt, Human
agugaaaaaggaggaag

SEQ ID NO: 3329152 - RNA, 20 nt, Human
agugaaaaaggaggaagaga

SEQ ID NO: 3329153 - RNA, 23 nt, Human
agugaaaaaggaggaagagaaaa

SEQ ID NO: 3329154 - RNA, 14 nt, Human
ugugaagagaacca

SEQ ID NO: 3329155 - RNA, 19 nt, Human
ugugagcacaaagguagcu

SEQ ID NO: 3329156 - RNA, 15 nt, Human
ugugaaccaccacac

SEQ ID NO: 3329157 - RNA, 23 nt, Human
ugugaaccaccacacccagccca

SEQ ID NO: 3329158 - RNA, 22 nt, Human
ugugaaccaccacacccagccc

SEQ ID NO: 3329159 - RNA, 21 nt, Human
ugugaaccaccacacccagcc

SEQ ID NO: 3329160 - RNA, 16 nt, Human
ugugaaccaccacacc

SEQ ID NO: 3329161 - RNA, 21 nt, Human
ugucuugcaauggcagccuug

SEQ ID NO: 3329162 - RNA, 20 nt, Human
ugucuugcaauggcagccuu

SEQ ID NO: 3329163 - RNA, 18 nt, Human
ugucuugcaauggcagcc

SEQ ID NO: 3329164 - RNA, 17 nt, Human
ugucuugcaauggcagc

SEQ ID NO: 3329165 - RNA, 15 nt, Human
ugucuugcaauggca

SEQ ID NO: 3329166 - RNA, 18 nt, Human
ugucucuugguccugcug

SEQ ID NO: 3329167 - RNA, 19 nt, Human
ugucucuugguccugcugc

SEQ ID NO: 3329168 - RNA, 20 nt, Human
ugucucuugguccugcugca

SEQ ID NO: 3329169 - RNA, 21 nt, Human
ugucucuugguccugcugcag

SEQ ID NO: 3329170 - RNA, 22 nt, Human
ugucucuugguccugcugcagu

SEQ ID NO: 3329171 - RNA, 21 nt, Human
ugucucuuuaaugucacaggc

SEQ ID NO: 3329172 - RNA, 22 nt, Human
ugucucuuuaaugucacaggca

SEQ ID NO: 3329173 - RNA, 23 nt, Human
aguccccuguuuguuucugaaag

SEQ ID NO: 3329174 - RNA, 13 nt, Human
agucccugccaau

SEQ ID NO: 3329175 - RNA, 14 nt, Human
agucccugccaaug

SEQ ID NO: 3329176 - RNA, 16 nt, Human
agucccugccaaugga

SEQ ID NO: 3329177 - RNA, 12 nt, Human
agucccugccaa

SEQ ID NO: 3329178 - RNA, 13 nt, Human
ugucucugagagu

SEQ ID NO: 3329179 - RNA, 12 nt, Human
ugucccuuuucc

SEQ ID NO: 3329180 - RNA, 16 nt, Human
ugucagccauuccugu

SEQ ID NO: 3329181 - RNA, 19 nt, Human
agucagggguucccuuuuu

SEQ ID NO: 3329182 - RNA, 14 nt, Human
aguccccuguuugu

SEQ ID NO: 3329183 - RNA, 19 nt, Human
aguccccuguuuguuucug

SEQ ID NO: 3329184 - RNA, 23 nt, Human
agucccaccuuggcugcagggag

SEQ ID NO: 3329185 - RNA, 21 nt, Human
agucccaccuuggcugcaggg

SEQ ID NO: 3329186 - RNA, 20 nt, Human
agucccaccuuggcugcagg

SEQ ID NO: 3329187 - RNA, 14 nt, Human
aguagcugggacua

SEQ ID NO: 3329188 - RNA, 13 nt, Human
aguagcugggacu

SEQ ID NO: 3329189 - RNA, 16 nt, Human
ugucaaaguggugaga

SEQ ID NO: 3329190 - RNA, 19 nt, Human
ugucaaaguggugagaggc

SEQ ID NO: 3329191 - RNA, 14 nt, Human
ugucaaagugguga

SEQ ID NO: 3329192 - RNA, 15 nt, Human
ugucaaaguggugag

SEQ ID NO: 3329193 - RNA, 12 nt, Human
uguagagccagg

SEQ ID NO: 3329194 - RNA, 14 nt, Human
uguauguguaagua

SEQ ID NO: 3329195 - RNA, 15 nt, Human
uguaucccaugagcc

SEQ ID NO: 3329196 - RNA, 15 nt, Human
aguauuauaccuuuu

SEQ ID NO: 3329197 - RNA, 14 nt, Human
aguauuauaccuuu

SEQ ID NO: 3329198 - RNA, 21 nt, Human
aguagcugggacuacaggcac

SEQ ID NO: 3329199 - RNA, 19 nt, Human
aguagcugggacuacaggc

SEQ ID NO: 3329200 - RNA, 22 nt, Human
aguagcugggacuacaggcacc

SEQ ID NO: 3329201 - RNA, 15 nt, Human
ugucagcauagaagu

SEQ ID NO: 3329202 - RNA, 17 nt, Human
agucacugagacagccc

SEQ ID NO: 3329203 - RNA, 15 nt, Human
agucacugagacagc

SEQ ID NO: 3329204 - RNA, 16 nt, Human
agucacugagacagcc

SEQ ID NO: 3329205 - RNA, 16 nt, Human
aggguaucaggugcug

SEQ ID NO: 3329206 - RNA, 19 nt, Human
aggguacuaaggaaucuuu

SEQ ID NO: 3329207 - RNA, 13 nt, Human
agggggcugggac

SEQ ID NO: 3329208 - RNA, 15 nt, Human
ugguccauagagagc

SEQ ID NO: 3329209 - RNA, 16 nt, Human
ugguccauagagagca

SEQ ID NO: 3329210 - RNA, 21 nt, Human
uggucaccaaaucagcugcua

SEQ ID NO: 3329211 - RNA, 23 nt, Human
uggucaccaaaucagcugcuacu

SEQ ID NO: 3329212 - RNA, 20 nt, Human
uggucaccaaaucagcugcu

SEQ ID NO: 3329213 - RNA, 14 nt, Human
uggguggaugccug

SEQ ID NO: 3329214 - RNA, 22 nt, Human
ugggugcuuggaggaaggaaac

SEQ ID NO: 3329215 - RNA, 15 nt, Human
aggguugggcuggug

SEQ ID NO: 3329216 - RNA, 13 nt, Human
aggguugggcugg

SEQ ID NO: 3329217 - RNA, 14 nt, Human
aggguuggccccug

SEQ ID NO: 3329218 - RNA, 13 nt, Human
aggguuggccccu

SEQ ID NO: 3329219 - RNA, 19 nt, Human
uggugaacagaacaaaagg

SEQ ID NO: 3329220 - RNA, 18 nt, Human
aggguggugaccucugcc

SEQ ID NO: 3329221 - RNA, 17 nt, Human
aggguggugaccucugc

SEQ ID NO: 3329222 - RNA, 19 nt, Human
aggguggugaccucugccu

SEQ ID NO: 3329223 - RNA, 19 nt, Human
ugguccauagagagcaaga

SEQ ID NO: 3329224 - RNA, 18 nt, Human
uggucugacccacugcuu

SEQ ID NO: 3329225 - RNA, 16 nt, Human
uggucuuauuuguaaa

SEQ ID NO: 3329226 - RNA, 12 nt, Human
uggucuguguga

SEQ ID NO: 3329227 - RNA, 21 nt, Human
aggucuugaacuccuggccuc

SEQ ID NO: 3329228 - RNA, 20 nt, Human
aggucuugaacuccuggccu

SEQ ID NO: 3329229 - RNA, 20 nt, Human
aggucauuuuuuuuaagaaa

SEQ ID NO: 3329230 - RNA, 18 nt, Human
aggucuugaacuccuggc

SEQ ID NO: 3329231 - RNA, 22 nt, Human
aggucauuuuuuuuaagaaaaa

SEQ ID NO: 3329232 - RNA, 23 nt, Human
aggucauuuuuuuuaagaaaaag

SEQ ID NO: 3329233 - RNA, 21 nt, Human
aggucaaggcugcagugagcc

SEQ ID NO: 3329234 - RNA, 17 nt, Human
aggguugggcugguguc

SEQ ID NO: 3329235 - RNA, 14 nt, Human
aggugugagucacc

SEQ ID NO: 3329236 - RNA, 20 nt, Human
aggugugacugaauuucuuu

SEQ ID NO: 3329237 - RNA, 17 nt, Human
aggugugaaccaccaca

SEQ ID NO: 3329238 - RNA, 22 nt, Human
aggugugaaccaccacacccag

SEQ ID NO: 3329239 - RNA, 18 nt, Human
aggugugacugaauuucu

SEQ ID NO: 3329240 - RNA, 23 nt, Human
aggugugaaccaccacacccagc

SEQ ID NO: 3329241 - RNA, 13 nt, Human
agguggggcagcu

SEQ ID NO: 3329242 - RNA, 23 nt, Human
agguggggucacucuggcagcuc

SEQ ID NO: 3329243 - RNA, 14 nt, Human
agguggggcagcuu

SEQ ID NO: 3329244 - RNA, 14 nt, Human
uguaaggaaugauu

SEQ ID NO: 3329245 - RNA, 15 nt, Human
uguaaggaaugauua

SEQ ID NO: 3329246 - RNA, 13 nt, Human
uguaaggaaugau

SEQ ID NO: 3329247 - RNA, 22 nt, Human
uguaagcucuacugaggugcua

SEQ ID NO: 3329248 - RNA, 16 nt, Human
uguaauuugugauaca

SEQ ID NO: 3329249 - RNA, 18 nt, Human
uguaaggaaugauuaauu

SEQ ID NO: 3329250 - RNA, 17 nt, Human
uguaauuugugauacaa

SEQ ID NO: 3329251 - RNA, 21 nt, Human
uguaauuugugauacaaugcu

SEQ ID NO: 3329252 - RNA, 23 nt, Human
uguacaaaguagaagucuuagau

SEQ ID NO: 3329253 - RNA, 19 nt, Human
uguacaaaguagaagucuu

SEQ ID NO: 3329254 - RNA, 19 nt, Human
uguacaugaaaacacauuu

SEQ ID NO: 3329255 - RNA, 17 nt, Human
uguacaugaaaacacau

SEQ ID NO: 3329256 - RNA, 18 nt, Human
uguacaugaaaacacauu

SEQ ID NO: 3329257 - RNA, 16 nt, Human
uguacaugaaaacaca

SEQ ID NO: 3329258 - RNA, 12 nt, Human
ugguuuucuguu

SEQ ID NO: 3329259 - RNA, 21 nt, Human
ugguuuguaaauuaacuuuua

SEQ ID NO: 3329260 - RNA, 14 nt, Human
ugguuucagaaaug

SEQ ID NO: 3329261 - RNA, 15 nt, Human
ugguuucagaaaugu

SEQ ID NO: 3329262 - RNA, 23 nt, Human
aggugauccacccaccucagccu

SEQ ID NO: 3329263 - RNA, 21 nt, Human
aggugauccacccaccucagc

SEQ ID NO: 3329264 - RNA, 13 nt, Human
ugguuuucuguuc

SEQ ID NO: 3329265 - RNA, 14 nt, Human
ugguuauggagagg

SEQ ID NO: 3329266 - RNA, 15 nt, Human
ugguguuuccuggca

SEQ ID NO: 3329267 - RNA, 17 nt, Human
ugguguuuccuggcacu

SEQ ID NO: 3329268 - RNA, 22 nt, Human
ugguucaggguuggccccugcc

SEQ ID NO: 3329269 - RNA, 20 nt, Human
ugguucaggguuggccccug

SEQ ID NO: 3329270 - RNA, 15 nt, Human
ugguggcagagugga

SEQ ID NO: 3329271 - RNA, 12 nt, Human
ugguggcagcuc

SEQ ID NO: 3329272 - RNA, 16 nt, Human
ugguggcagcucaccu

SEQ ID NO: 3329273 - RNA, 19 nt, Human
ugguggcagcucaccucuc

SEQ ID NO: 3329274 - RNA, 20 nt, Human
ugguggcagcucaccucucc

SEQ ID NO: 3329275 - RNA, 23 nt, Human
ugguggcagcucaccucucccuu

SEQ ID NO: 3329276 - RNA, 12 nt, Human
ugguggcagcug

SEQ ID NO: 3329277 - RNA, 13 nt, Human
auaaacuuuaccu

SEQ ID NO: 3329278 - RNA, 15 nt, Human
auaaacuuuaccuuu

SEQ ID NO: 3329279 - RNA, 20 nt, Human
auaacauguaauuaaguacu

SEQ ID NO: 3329280 - RNA, 23 nt, Human
uuaccauuuugggguacccacug

SEQ ID NO: 3329281 - RNA, 18 nt, Human
uuacaggaaguacuggag

SEQ ID NO: 3329282 - RNA, 15 nt, Human
uuacaggaaguacug

SEQ ID NO: 3329283 - RNA, 16 nt, Human
uuacaggaaguacugg

SEQ ID NO: 3329284 - RNA, 22 nt, Human
auaagaaccuuuugagugccuu

SEQ ID NO: 3329285 - RNA, 17 nt, Human
auaaguuaacuuccaau

SEQ ID NO: 3329286 - RNA, 23 nt, Human
auaagaaccuuuugagugccuua

SEQ ID NO: 3329287 - RNA, 23 nt, Human
auaauacaccacuacauucuguu

SEQ ID NO: 3329288 - RNA, 21 nt, Human
auaauacaccacuacauucug

SEQ ID NO: 3329289 - RNA, 22 nt, Human
auaaguuaacuuccaauuuaca

SEQ ID NO: 3329290 - RNA, 19 nt, Human
auaauacaguaucucaggg

SEQ ID NO: 3329291 - RNA, 14 nt, Human
auaauucuacuuug

SEQ ID NO: 3329292 - RNA, 20 nt, Human
auacaggaaaagcugcugac

SEQ ID NO: 3329293 - RNA, 19 nt, Human
auacaggaaaagcugcuga

SEQ ID NO: 3329294 - RNA, 14 nt, Human
auacaggaaaagcu

SEQ ID NO: 3329295 - RNA, 16 nt, Human
auacauuugauaaagu

SEQ ID NO: 3329296 - RNA, 17 nt, Human
auaccagccaguaaaug

SEQ ID NO: 3329297 - RNA, 19 nt, Human
auaccagccaguaaauggg

SEQ ID NO: 3329298 - RNA, 21 nt, Human
auacuaaccagcagaaaugcc

SEQ ID NO: 3329299 - RNA, 13 nt, Human
auacuacaguuug

SEQ ID NO: 3329300 - RNA, 15 nt, Human
auacuacaguuuguu

SEQ ID NO: 3329301 - RNA, 16 nt, Human
auacuacaguuuguua

SEQ ID NO: 3329302 - RNA, 20 nt, Human
auacuacaguuuguuaguau

SEQ ID NO: 3329303 - RNA, 13 nt, Human
uuauacauaaaca

SEQ ID NO: 3329304 - RNA, 13 nt, Human
auacaaaagcaug

SEQ ID NO: 3329305 - RNA, 15 nt, Human
auacaaaagcaugug

SEQ ID NO: 3329306 - RNA, 12 nt, Human
auacaaaagcau

SEQ ID NO: 3329307 - RNA, 13 nt, Human
uguucugggacac

SEQ ID NO: 3329308 - RNA, 12 nt, Human
uguucugggaca

SEQ ID NO: 3329309 - RNA, 14 nt, Human
uguucuuaauucuu

SEQ ID NO: 3329310 - RNA, 16 nt, Human
uguucuuaauucuuag

SEQ ID NO: 3329311 - RNA, 14 nt, Human
uguucugggacaca

SEQ ID NO: 3329312 - RNA, 17 nt, Human
uguucuugguuuguaaa

SEQ ID NO: 3329313 - RNA, 18 nt, Human
uguucuugguuuguaaau

SEQ ID NO: 3329314 - RNA, 13 nt, Human
uguucuuuccaaa

SEQ ID NO: 3329315 - RNA, 14 nt, Human
uguucuuuccaaag

SEQ ID NO: 3329316 - RNA, 19 nt, Human
uguucuuucacccuuuucu

SEQ ID NO: 3329317 - RNA, 23 nt, Human
aguguacauggaauaacauguaa

SEQ ID NO: 3329318 - RNA, 22 nt, Human
aguguacauggaauaacaugua

SEQ ID NO: 3329319 - RNA, 21 nt, Human
aguguacauggaauaacaugu

SEQ ID NO: 3329320 - RNA, 21 nt, Human
agugguuccuaauccucuagg

SEQ ID NO: 3329321 - RNA, 19 nt, Human
agugggugaauaauacagu

SEQ ID NO: 3329322 - RNA, 20 nt, Human
aguggcagcugcuuuugucu

SEQ ID NO: 3329323 - RNA, 14 nt, Human
aguggcagcugcuu

SEQ ID NO: 3329324 - RNA, 13 nt, Human
aguggcagcugcu

SEQ ID NO: 3329325 - RNA, 12 nt, Human
aguggcagcugc

SEQ ID NO: 3329326 - RNA, 11 nt, Human
aguggcagcug

SEQ ID NO: 3329327 - RNA, 13 nt, Human
agugggugaauaa

SEQ ID NO: 3329328 - RNA, 18 nt, Human
agugggugaauaauacag

SEQ ID NO: 3329329 - RNA, 19 nt, Human
agugggggaguggccacag

SEQ ID NO: 3329330 - RNA, 20 nt, Human
agugggggaguggccacaga

SEQ ID NO: 3329331 - RNA, 18 nt, Human
uguucuuuccaaaguaca

SEQ ID NO: 3329332 - RNA, 21 nt, Human
aguuauuuuuauuuauuuaaa

SEQ ID NO: 3329333 - RNA, 13 nt, Human
uguugucagcuga

SEQ ID NO: 3329334 - RNA, 16 nt, Human
uguugggccaggagcc

SEQ ID NO: 3329335 - RNA, 13 nt, Human
uguugggccagga

SEQ ID NO: 3329336 - RNA, 15 nt, Human
aguugauagcacaga

SEQ ID NO: 3329337 - RNA, 19 nt, Human
aguugauagcacagacccu

SEQ ID NO: 3329338 - RNA, 20 nt, Human
aguugauagcacagacccug

SEQ ID NO: 3329339 - RNA, 21 nt, Human
aguugauagcacagacccugc

SEQ ID NO: 3329340 - RNA, 14 nt, Human
aguugauagcacag

SEQ ID NO: 3329341 - RNA, 23 nt, Human
aguugauucagcucugcaagaau

SEQ ID NO: 3329342 - RNA, 14 nt, Human
aguugauucagcuc

SEQ ID NO: 3329343 - RNA, 15 nt, Human
aguugauucagcucu

SEQ ID NO: 3329344 - RNA, 17 nt, Human
aguugauucagcucugc

SEQ ID NO: 3329345 - RNA, 18 nt, Human
aguugauucagcucugca

SEQ ID NO: 3329346 - RNA, 13 nt, Human
aguugauucagcu

SEQ ID NO: 3329347 - RNA, 22 nt, Human
aguugauagcacagacccugcc

SEQ ID NO: 3329348 - RNA, 23 nt, Human
aguugauagcacagacccugccc

SEQ ID NO: 3329349 - RNA, 15 nt, Human
uguuuggggaugaga

SEQ ID NO: 3329350 - RNA, 14 nt, Human
uguugucagcugaa

SEQ ID NO: 3329351 - RNA, 14 nt, Human
uguuugccucugcc

SEQ ID NO: 3329352 - RNA, 16 nt, Human
uguuugccucugccuc

SEQ ID NO: 3329353 - RNA, 16 nt, Human
aguucucuccuucuuc

SEQ ID NO: 3329354 - RNA, 13 nt, Human
aguucucuccuuc

SEQ ID NO: 3329355 - RNA, 12 nt, Human
aguucucuccuu

SEQ ID NO: 3329356 - RNA, 21 nt, Human
uguuuuauuuuaauucaguug

SEQ ID NO: 3329357 - RNA, 15 nt, Human
uguuuucaguguaca

SEQ ID NO: 3329358 - RNA, 13 nt, Human
aguuucuccaagc

SEQ ID NO: 3329359 - RNA, 15 nt, Human
aguuucuccaagcag

SEQ ID NO: 3329360 - RNA, 16 nt, Human
uuaaauucuugcaaag

SEQ ID NO: 3329361 - RNA, 13 nt, Human
uuaaauucuugca

SEQ ID NO: 3329362 - RNA, 22 nt, Human
aguuuucacucuuauugcccac

SEQ ID NO: 3329363 - RNA, 17 nt, Human
uuaaaccgccaaggcug

SEQ ID NO: 3329364 - RNA, 19 nt, Human
uuaaauaaugugaaacugg

SEQ ID NO: 3329365 - RNA, 22 nt, Human
uuaaauaaugugaaacuggauu

SEQ ID NO: 3329366 - RNA, 20 nt, Human
uuaaauaaugugaaacugga

SEQ ID NO: 3329367 - RNA, 21 nt, Human
uuaaauaaugugaaacuggau

SEQ ID NO: 3329368 - RNA, 15 nt, Human
uuaaauaaaucauaa

SEQ ID NO: 3329369 - RNA, 13 nt, Human
uuaaauaaaucau

SEQ ID NO: 3329370 - RNA, 18 nt, Human
uuaaaaaguggaaaaaua

SEQ ID NO: 3329371 - RNA, 23 nt, Human
agcggcuggcagcccaccccuca

SEQ ID NO: 3329372 - RNA, 20 nt, Human
agcggggacagcuccuucug

SEQ ID NO: 3329373 - RNA, 19 nt, Human
agcggggacagcuccuucu

SEQ ID NO: 3329374 - RNA, 22 nt, Human
agcggggacagcuccuucuguc

SEQ ID NO: 3329375 - RNA, 13 nt, Human
agcggcuggcagc

SEQ ID NO: 3329376 - RNA, 18 nt, Human
ugccagcuuaucucaggg

SEQ ID NO: 3329377 - RNA, 20 nt, Human
ugcauuugaggucuguucuu

SEQ ID NO: 3329378 - RNA, 21 nt, Human
ugcauuugaggucuguucuuu

SEQ ID NO: 3329379 - RNA, 15 nt, Human
agccuugaacuuuga

SEQ ID NO: 3329380 - RNA, 18 nt, Human
agccuuccagggguggga

SEQ ID NO: 3329381 - RNA, 16 nt, Human
agccuugaacuuugac

SEQ ID NO: 3329382 - RNA, 22 nt, Human
agccuugaacuuugaccucugc

SEQ ID NO: 3329383 - RNA, 13 nt, Human
agccuugaacuuu

SEQ ID NO: 3329384 - RNA, 22 nt, Human
agccuugaccauucuccaccug

SEQ ID NO: 3329385 - RNA, 23 nt, Human
agccuugaccauucuccaccugc

SEQ ID NO: 3329386 - RNA, 22 nt, Human
agcgauucuucugcuucagccu

SEQ ID NO: 3329387 - RNA, 19 nt, Human
agcgauucuucugcuucag

SEQ ID NO: 3329388 - RNA, 20 nt, Human
ugcauuuaaaagauacaguu

SEQ ID NO: 3329389 - RNA, 19 nt, Human
ugcauuugaggucuguucu

SEQ ID NO: 3329390 - RNA, 18 nt, Human
ugcauuugaggucuguuc

SEQ ID NO: 3329391 - RNA, 18 nt, Human
ugcccaggccccugccac

SEQ ID NO: 3329392 - RNA, 17 nt, Human
ugcccaggccccugcca

SEQ ID NO: 3329393 - RNA, 15 nt, Human
ugcccaggccccugc

SEQ ID NO: 3329394 - RNA, 14 nt, Human
ugcccaggccccug

SEQ ID NO: 3329395 - RNA, 13 nt, Human
ugcccagccccuu

SEQ ID NO: 3329396 - RNA, 12 nt, Human
ugcccagccccu

SEQ ID NO: 3329397 - RNA, 16 nt, Human
ugcccagccccuucug

SEQ ID NO: 3329398 - RNA, 17 nt, Human
ugcccagccccuucuga

SEQ ID NO: 3329399 - RNA, 17 nt, Human
ugcccaaagaugcagcc

SEQ ID NO: 3329400 - RNA, 20 nt, Human
ugcccaaagaugcagccggu

SEQ ID NO: 3329401 - RNA, 20 nt, Human
ugcccuaaaguguauuuuuu

SEQ ID NO: 3329402 - RNA, 23 nt, Human
ugccccgaacauguuuuucuucu

SEQ ID NO: 3329403 - RNA, 20 nt, Human
agcucagggccuggcucagg

SEQ ID NO: 3329404 - RNA, 18 nt, Human
agcucagggccuggcuca

SEQ ID NO: 3329405 - RNA, 19 nt, Human
agcucagggccuggcucag

SEQ ID NO: 3329406 - RNA, 12 nt, Human
agcucagggccu

SEQ ID NO: 3329407 - RNA, 13 nt, Human
agcucagggccug

SEQ ID NO: 3329408 - RNA, 19 nt, Human
agcuauucaguaauaacuc

SEQ ID NO: 3329409 - RNA, 15 nt, Human
agcuccaagcuccca

SEQ ID NO: 3329410 - RNA, 16 nt, Human
agcuaggccuggccag

SEQ ID NO: 3329411 - RNA, 21 nt, Human
agcuaggccuggccagaugca

SEQ ID NO: 3329412 - RNA, 11 nt, Human
ugccucugccu

SEQ ID NO: 3329413 - RNA, 16 nt, Human
ugccucugacacacag

SEQ ID NO: 3329414 - RNA, 14 nt, Human
ugccucugacacac

SEQ ID NO: 3329415 - RNA, 19 nt, Human
ugccugcccaggccccugc

SEQ ID NO: 3329416 - RNA, 18 nt, Human
ugccugcccaggccccug

SEQ ID NO: 3329417 - RNA, 16 nt, Human
ugccugcccaggcccc

SEQ ID NO: 3329418 - RNA, 17 nt, Human
ugccugcccaggccccu

SEQ ID NO: 3329419 - RNA, 22 nt, Human
agcugcuuuugucuaugggacu

SEQ ID NO: 3329420 - RNA, 13 nt, Human
agcugccuguuca

SEQ ID NO: 3329421 - RNA, 10 nt, Human
agcugccugu

SEQ ID NO: 3329422 - RNA, 15 nt, Human
agcugggacuacagg

SEQ ID NO: 3329423 - RNA, 24 nt, Human
agcugcuuuugucuaugggacuca

SEQ ID NO: 3329424 - RNA, 23 nt, Human
agcugcuuuugucuaugggacuc

SEQ ID NO: 3329425 - RNA, 17 nt, Human
ugccucucucaggccaa

SEQ ID NO: 3329426 - RNA, 16 nt, Human
ugccucucucaggcca

SEQ ID NO: 3329427 - RNA, 22 nt, Human
ugccucccaucacccgcuaaga

SEQ ID NO: 3329428 - RNA, 19 nt, Human
ugccucccaucacccgcua

SEQ ID NO: 3329429 - RNA, 23 nt, Human
ugcccugugaguacuacaguccu

SEQ ID NO: 3329430 - RNA, 16 nt, Human
agcucuucuccaggcu

SEQ ID NO: 3329431 - RNA, 15 nt, Human
agcucuucuccaggc

SEQ ID NO: 3329432 - RNA, 15 nt, Human
ugcccugugggcccc

SEQ ID NO: 3329433 - RNA, 18 nt, Human
ugcccugugggcccccaa

SEQ ID NO: 3329434 - RNA, 22 nt, Human
ugcccuuaccugccaggaagcc

SEQ ID NO: 3329435 - RNA, 14 nt, Human
ugccgcagcccugc

SEQ ID NO: 3329436 - RNA, 20 nt, Human
ugccgcagcccugcagaggg

SEQ ID NO: 3329437 - RNA, 19 nt, Human
ugcccuuaccugccaggaa

SEQ ID NO: 3329438 - RNA, 19 nt, Human
ugcccuaaaguguauuuuu

SEQ ID NO: 3329439 - RNA, 17 nt, Human
agcuccaagcucccagg

SEQ ID NO: 3329440 - RNA, 16 nt, Human
agcuccaagcucccag

SEQ ID NO: 3329441 - RNA, 18 nt, Human
agcuccaagcucccaggc

SEQ ID NO: 3329442 - RNA, 19 nt, Human
agcuccaagcucccaggca

SEQ ID NO: 3329443 - RNA, 17 nt, Human
agcuccagcucaccagc

SEQ ID NO: 3329444 - RNA, 13 nt, Human
agcuccagcucac

SEQ ID NO: 3329445 - RNA, 19 nt, Human
agcuccagcucaccagccc

SEQ ID NO: 3329446 - RNA, 18 nt, Human
agcuccagcucaccagcc

SEQ ID NO: 3329447 - RNA, 21 nt, Human
agcuccagcucaccagcccca

SEQ ID NO: 3329448 - RNA, 23 nt, Human
agcuccuucuguccuacucugug

SEQ ID NO: 3329449 - RNA, 22 nt, Human
agcuccuucuguccuacucugu

SEQ ID NO: 3329450 - RNA, 23 nt, Human
agcucuguccugggagugagcug

SEQ ID NO: 3329451 - RNA, 15 nt, Human
agcccacuucugcca

SEQ ID NO: 3329452 - RNA, 14 nt, Human
agcccacuucugcc

SEQ ID NO: 3329453 - RNA, 13 nt, Human
agcccacuucugc

SEQ ID NO: 3329454 - RNA, 21 nt, Human
agccaguaaaugggggugcau

SEQ ID NO: 3329455 - RNA, 13 nt, Human
agccaguaaaugg

SEQ ID NO: 3329456 - RNA, 18 nt, Human
ugauuuccguuaaaauac

SEQ ID NO: 3329457 - RNA, 22 nt, Human
ugauuuccguuaaaauaccagc

SEQ ID NO: 3329458 - RNA, 17 nt, Human
ugauuuggggauauuuu

SEQ ID NO: 3329459 - RNA, 14 nt, Human
agcccaggaaaggc

SEQ ID NO: 3329460 - RNA, 15 nt, Human
ugauucauaaugacu

SEQ ID NO: 3329461 - RNA, 16 nt, Human
ugauucauaaugacuu

SEQ ID NO: 3329462 - RNA, 21 nt, Human
ugauucauaaugacuuaagca

SEQ ID NO: 3329463 - RNA, 23 nt, Human
ugauucccaagcucugcuccucu

SEQ ID NO: 3329464 - RNA, 22 nt, Human
ugauucccaagcucugcuccuc

SEQ ID NO: 3329465 - RNA, 21 nt, Human
ugauucccaagcucugcuccu

SEQ ID NO: 3329466 - RNA, 10 nt, Human
agccagagga

SEQ ID NO: 3329467 - RNA, 19 nt, Human
agccacugcaccgggccac

SEQ ID NO: 3329468 - RNA, 18 nt, Human
agccacugcaccgggcca

SEQ ID NO: 3329469 - RNA, 19 nt, Human
ugauuaaauucuugcaaag

SEQ ID NO: 3329470 - RNA, 17 nt, Human
ugauuaaauucuugcaa

SEQ ID NO: 3329471 - RNA, 13 nt, Human
ugauggugcaaug

SEQ ID NO: 3329472 - RNA, 20 nt, Human
ugauuaaauucuugcaaagu

SEQ ID NO: 3329473 - RNA, 19 nt, Human
ugauuaaccacuucagcug

SEQ ID NO: 3329474 - RNA, 16 nt, Human
agccacugcaccgggc

SEQ ID NO: 3329475 - RNA, 16 nt, Human
ugauccuaguuccacc

SEQ ID NO: 3329476 - RNA, 15 nt, Human
ugauccucccaccuc

SEQ ID NO: 3329477 - RNA, 21 nt, Human
ugauccucccaccucagccuc

SEQ ID NO: 3329478 - RNA, 22 nt, Human
ugauccucccaccucagccucc

SEQ ID NO: 3329479 - RNA, 13 nt, Human
ugaugagaggaaa

SEQ ID NO: 3329480 - RNA, 14 nt, Human
ugaugagaggaaau

SEQ ID NO: 3329481 - RNA, 15 nt, Human
ugaugagaggaaauc

SEQ ID NO: 3329482 - RNA, 16 nt, Human
ugaugagaggaaauca

SEQ ID NO: 3329483 - RNA, 23 nt, Human
ugaugcuucuucagagacuccug

SEQ ID NO: 3329484 - RNA, 14 nt, Human
ugauggggcccugc

SEQ ID NO: 3329485 - RNA, 15 nt, Human
ugauggggcccugcc

SEQ ID NO: 3329486 - RNA, 16 nt, Human
ugauggggcccugccu

SEQ ID NO: 3329487 - RNA, 19 nt, Human
ugauggggcccugccuccu

SEQ ID NO: 3329488 - RNA, 16 nt, Human
agcccuuagcagggaa

SEQ ID NO: 3329489 - RNA, 17 nt, Human
ugcagacucuacagagg

SEQ ID NO: 3329490 - RNA, 16 nt, Human
ugcagacucuacagag

SEQ ID NO: 3329491 - RNA, 20 nt, Human
agccgagauagccaaggcca

SEQ ID NO: 3329492 - RNA, 21 nt, Human
agccgagauagccaaggccaa

SEQ ID NO: 3329493 - RNA, 17 nt, Human
agccgagaucacgccac

SEQ ID NO: 3329494 - RNA, 21 nt, Human
agcccuuagcagggaaacagc

SEQ ID NO: 3329495 - RNA, 11 nt, Human
ugcacacauuu

SEQ ID NO: 3329496 - RNA, 12 nt, Human
ugcacacauuuu

SEQ ID NO: 3329497 - RNA, 13 nt, Human
ugcacacauuuuu

SEQ ID NO: 3329498 - RNA, 15 nt, Human
ugcacacauuuuuua

SEQ ID NO: 3329499 - RNA, 16 nt, Human
ugcacuccccugcugg

SEQ ID NO: 3329500 - RNA, 17 nt, Human
ugcacuccccugcuggg

SEQ ID NO: 3329501 - RNA, 19 nt, Human
ugcacuccccugcugggug

SEQ ID NO: 3329502 - RNA, 15 nt, Human
ugcacuccccugcug

SEQ ID NO: 3329503 - RNA, 22 nt, Human
ugcagacaggcaagcaccuccu

SEQ ID NO: 3329504 - RNA, 19 nt, Human
agccucaaccuccugggcu

SEQ ID NO: 3329505 - RNA, 20 nt, Human
agccucaaccuccugggcua

SEQ ID NO: 3329506 - RNA, 17 nt, Human
agccucacaguccuuac

SEQ ID NO: 3329507 - RNA, 18 nt, Human
agccucacaguccuuacc

SEQ ID NO: 3329508 - RNA, 21 nt, Human
ugcagccucaaccuccugggc

SEQ ID NO: 3329509 - RNA, 20 nt, Human
ugcagccucaaccuccuggg

SEQ ID NO: 3329510 - RNA, 22 nt, Human
ugcagccucaaccuccugggcu

SEQ ID NO: 3329511 - RNA, 23 nt, Human
agccucugaaaaccaauguucuc

SEQ ID NO: 3329512 - RNA, 18 nt, Human
ugcacacaccagagccca

SEQ ID NO: 3329513 - RNA, 17 nt, Human
ugcacacaccagagccc

SEQ ID NO: 3329514 - RNA, 21 nt, Human
ugcacacaccagagcccaccu

SEQ ID NO: 3329515 - RNA, 16 nt, Human
agcccugguggcagug

SEQ ID NO: 3329516 - RNA, 15 nt, Human
agcccugguggcagu

SEQ ID NO: 3329517 - RNA, 14 nt, Human
agcccugguggcag

SEQ ID NO: 3329518 - RNA, 21 nt, Human
ugcaaaccaucauugaaaucu

SEQ ID NO: 3329519 - RNA, 20 nt, Human
ugcaaaccaucauugaaauc

SEQ ID NO: 3329520 - RNA, 22 nt, Human
agccccauucugccugcccagg

SEQ ID NO: 3329521 - RNA, 21 nt, Human
agccccauucugccugcccag

SEQ ID NO: 3329522 - RNA, 18 nt, Human
agccccaaaacucuccuc

SEQ ID NO: 3329523 - RNA, 20 nt, Human
agccccauucugccugccca

SEQ ID NO: 3329524 - RNA, 16 nt, Human
agccccaaaacucucc

SEQ ID NO: 3329525 - RNA, 17 nt, Human
agccccaaaacucuccu

SEQ ID NO: 3329526 - RNA, 21 nt, Human
agcccaggccuccuacagcuu

SEQ ID NO: 3329527 - RNA, 15 nt, Human
aggauccugagccag

SEQ ID NO: 3329528 - RNA, 16 nt, Human
aggauccugagccaga

SEQ ID NO: 3329529 - RNA, 21 nt, Human
aggaucucuugagccugggag

SEQ ID NO: 3329530 - RNA, 22 nt, Human
aggaucucuugagccugggagg

SEQ ID NO: 3329531 - RNA, 17 nt, Human
aggauccugagccagau

SEQ ID NO: 3329532 - RNA, 16 nt, Human
aggaugaucuaggaag

SEQ ID NO: 3329533 - RNA, 17 nt, Human
aggaugaucuaggaaga

SEQ ID NO: 3329534 - RNA, 23 nt, Human
uggaaaugggcagagcagagacc

SEQ ID NO: 3329535 - RNA, 18 nt, Human
uggaaaugggcagagcag

SEQ ID NO: 3329536 - RNA, 20 nt, Human
uggaaauauuaagaaagacu

SEQ ID NO: 3329537 - RNA, 14 nt, Human
aggaugcccaaaga

SEQ ID NO: 3329538 - RNA, 19 nt, Human
aggaugcccaaagaugcag

SEQ ID NO: 3329539 - RNA, 19 nt, Human
aggauuuugauccaagcug

SEQ ID NO: 3329540 - RNA, 17 nt, Human
aggcaacucaucuuagg

SEQ ID NO: 3329541 - RNA, 14 nt, Human
uggacccugaggcc

SEQ ID NO: 3329542 - RNA, 12 nt, Human
uggacccugagg

SEQ ID NO: 3329543 - RNA, 13 nt, Human
uggacccugaggc

SEQ ID NO: 3329544 - RNA, 16 nt, Human
uggacacagcucuucu

SEQ ID NO: 3329545 - RNA, 15 nt, Human
uggacacagcucuuc

SEQ ID NO: 3329546 - RNA, 18 nt, Human
uggacacagcucuucucc

SEQ ID NO: 3329547 - RNA, 17 nt, Human
aggagccuccugcccuu

SEQ ID NO: 3329548 - RNA, 16 nt, Human
ugcuuggaggaaggaa

SEQ ID NO: 3329549 - RNA, 12 nt, Human
ugcuugggcuuc

SEQ ID NO: 3329550 - RNA, 16 nt, Human
ugcuugggcuucaucc

SEQ ID NO: 3329551 - RNA, 21 nt, Human
ugcuuggaggaaggaaaccca

SEQ ID NO: 3329552 - RNA, 15 nt, Human
uggaaauauuaagaa

SEQ ID NO: 3329553 - RNA, 19 nt, Human
ugcuugggcuucauccucc

SEQ ID NO: 3329554 - RNA, 18 nt, Human
aggacauugcggacagcc

SEQ ID NO: 3329555 - RNA, 17 nt, Human
aggacauugcggacagc

SEQ ID NO: 3329556 - RNA, 15 nt, Human
aggacauugcggaca

SEQ ID NO: 3329557 - RNA, 23 nt, Human
aggacauugcggacagccacggc

SEQ ID NO: 3329558 - RNA, 19 nt, Human
aggacauugcggacagcca

SEQ ID NO: 3329559 - RNA, 17 nt, Human
aggagccccgaggccuu

SEQ ID NO: 3329560 - RNA, 22 nt, Human
aggagccccgaggccuucucug

SEQ ID NO: 3329561 - RNA, 14 nt, Human
aggagcagccacau

SEQ ID NO: 3329562 - RNA, 17 nt, Human
aggagauuggaaggaac

SEQ ID NO: 3329563 - RNA, 23 nt, Human
aggacuuuucuuuguggcuuccu

SEQ ID NO: 3329564 - RNA, 15 nt, Human
ugcugagucugaagg

SEQ ID NO: 3329565 - RNA, 14 nt, Human
ugcugagucugaag

SEQ ID NO: 3329566 - RNA, 16 nt, Human
ugcucugcugacagac

SEQ ID NO: 3329567 - RNA, 22 nt, Human
ugcucugcugacagacacaggc

SEQ ID NO: 3329568 - RNA, 21 nt, Human
ugcucugcugacagacacagg

SEQ ID NO: 3329569 - RNA, 16 nt, Human
ugcuccagcuguucag

SEQ ID NO: 3329570 - RNA, 19 nt, Human
ugcuccagcuguucagcug

SEQ ID NO: 3329571 - RNA, 18 nt, Human
agcugggacuacaggcac

SEQ ID NO: 3329572 - RNA, 16 nt, Human
agcugggacuacaggc

SEQ ID NO: 3329573 - RNA, 16 nt, Human
ugcugagucugaaggc

SEQ ID NO: 3329574 - RNA, 17 nt, Human
ugcugagucugaaggcu

SEQ ID NO: 3329575 - RNA, 18 nt, Human
ugcugagucugaaggcug

SEQ ID NO: 3329576 - RNA, 21 nt, Human
ugcugagucugaaggcugggu

SEQ ID NO: 3329577 - RNA, 22 nt, Human
ugcugagucugaaggcuggguu

SEQ ID NO: 3329578 - RNA, 13 nt, Human
aggaagacuucau

SEQ ID NO: 3329579 - RNA, 19 nt, Human
aggaagacuucaucccucu

SEQ ID NO: 3329580 - RNA, 13 nt, Human
aggaagacuuugg

SEQ ID NO: 3329581 - RNA, 23 nt, Human
aggaagcacaugccucucucagg

SEQ ID NO: 3329582 - RNA, 24 nt, Human
aggaagcacaugccucucucaggc

SEQ ID NO: 3329583 - RNA, 14 nt, Human
aggaagccagcagg

SEQ ID NO: 3329584 - RNA, 15 nt, Human
aggaagccagcaggc

SEQ ID NO: 3329585 - RNA, 22 nt, Human
aggaagcacaugccucucucag

SEQ ID NO: 3329586 - RNA, 18 nt, Human
aggaaggaaacccagcuc

SEQ ID NO: 3329587 - RNA, 17 nt, Human
aggaagccagcaggcuc

SEQ ID NO: 3329588 - RNA, 13 nt, Human
aggaagccagcag

SEQ ID NO: 3329589 - RNA, 19 nt, Human
aggaaggaaacccagcucu

SEQ ID NO: 3329590 - RNA, 15 nt, Human
aggaaggagaggaga

SEQ ID NO: 3329591 - RNA, 16 nt, Human
ugcuucaaggauccug

SEQ ID NO: 3329592 - RNA, 18 nt, Human
ugcuucaaggauccugag

SEQ ID NO: 3329593 - RNA, 19 nt, Human
ugcuucaaggauccugagc

SEQ ID NO: 3329594 - RNA, 14 nt, Human
ugcuucagccuccc

SEQ ID NO: 3329595 - RNA, 13 nt, Human
ugcuucagccucc

SEQ ID NO: 3329596 - RNA, 12 nt, Human
ugcuucaaggau

SEQ ID NO: 3329597 - RNA, 13 nt, Human
ugcuuauacacuu

SEQ ID NO: 3329598 - RNA, 19 nt, Human
aggacacuaaccacgcugg

SEQ ID NO: 3329599 - RNA, 23 nt, Human
aggacacuaaccacgcuggaccu

SEQ ID NO: 3329600 - RNA, 18 nt, Human
ugcuguaacuuucugaaa

SEQ ID NO: 3329601 - RNA, 17 nt, Human
ugcugucccuuuuccuu

SEQ ID NO: 3329602 - RNA, 16 nt, Human
ugcuggcugguuagag

SEQ ID NO: 3329603 - RNA, 12 nt, Human
ugcugcccugug

SEQ ID NO: 3329604 - RNA, 13 nt, Human
ugcugcccuguga

SEQ ID NO: 3329605 - RNA, 14 nt, Human
ugcugcccugugag

SEQ ID NO: 3329606 - RNA, 15 nt, Human
ugcugcccugugagu

SEQ ID NO: 3329607 - RNA, 21 nt, Human
uggcagaguugaagacagagc

SEQ ID NO: 3329608 - RNA, 19 nt, Human
uggcagaguugaagacaga

SEQ ID NO: 3329609 - RNA, 15 nt, Human
uggcacccggccccu

SEQ ID NO: 3329610 - RNA, 22 nt, Human
uggcagaguugaagacagagcu

SEQ ID NO: 3329611 - RNA, 20 nt, Human
uggcacaucagcacgauuuc

SEQ ID NO: 3329612 - RNA, 18 nt, Human
uggcaccagcagccugga

SEQ ID NO: 3329613 - RNA, 12 nt, Human
uggauguucuga

SEQ ID NO: 3329614 - RNA, 20 nt, Human
aggccacaagacccuugugg

SEQ ID NO: 3329615 - RNA, 12 nt, Human
uggcagccccug

SEQ ID NO: 3329616 - RNA, 19 nt, Human
uggaugccugguggcagcu

SEQ ID NO: 3329617 - RNA, 18 nt, Human
uggaugccugguggcagc

SEQ ID NO: 3329618 - RNA, 16 nt, Human
uggaguucaucuugaa

SEQ ID NO: 3329619 - RNA, 17 nt, Human
uggaguucaucuugaau

SEQ ID NO: 3329620 - RNA, 20 nt, Human
uggaguucaucuugaauugu

SEQ ID NO: 3329621 - RNA, 15 nt, Human
uggaugccugguggc

SEQ ID NO: 3329622 - RNA, 15 nt, Human
aggccacaagacccu

SEQ ID NO: 3329623 - RNA, 14 nt, Human
uggaguauauguca

SEQ ID NO: 3329624 - RNA, 14 nt, Human
aggccaaaggaagc

SEQ ID NO: 3329625 - RNA, 20 nt, Human
aggccaaacucaccugcccc

SEQ ID NO: 3329626 - RNA, 23 nt, Human
aggccaaaggaagcacaugccuc

SEQ ID NO: 3329627 - RNA, 20 nt, Human
aggccaaaggaagcacaugc

SEQ ID NO: 3329628 - RNA, 18 nt, Human
aggccaaggugggaggau

SEQ ID NO: 3329629 - RNA, 16 nt, Human
aggccaaacucaccug

SEQ ID NO: 3329630 - RNA, 18 nt, Human
aggcauuuguuugaacug

SEQ ID NO: 3329631 - RNA, 20 nt, Human
aggcauuugcugaauacaga

SEQ ID NO: 3329632 - RNA, 20 nt, Human
uggaccuugaacuggguacu

SEQ ID NO: 3329633 - RNA, 12 nt, Human
uggcaugggaau

SEQ ID NO: 3329634 - RNA, 15 nt, Human
uggcaugggaaugaa

SEQ ID NO: 3329635 - RNA, 17 nt, Human
uggccaggcuggucuca

SEQ ID NO: 3329636 - RNA, 15 nt, Human
uggccaggcuggucu

SEQ ID NO: 3329637 - RNA, 13 nt, Human
aggcccucugccc

SEQ ID NO: 3329638 - RNA, 14 nt, Human
aggcccucugccca

SEQ ID NO: 3329639 - RNA, 14 nt, Human
uggccucugcacuc

SEQ ID NO: 3329640 - RNA, 15 nt, Human
uggccucugcacucc

SEQ ID NO: 3329641 - RNA, 17 nt, Human
uggccucugcacucccc

SEQ ID NO: 3329642 - RNA, 13 nt, Human
uggccucugcacu

SEQ ID NO: 3329643 - RNA, 21 nt, Human
aggccuggccagaugcaccag

SEQ ID NO: 3329644 - RNA, 17 nt, Human
aggccuggccagaugca

SEQ ID NO: 3329645 - RNA, 16 nt, Human
aggccuggccagaugc

SEQ ID NO: 3329646 - RNA, 15 nt, Human
aggccuggccagaug

SEQ ID NO: 3329647 - RNA, 23 nt, Human
aggccugggggcugggcagagga

SEQ ID NO: 3329648 - RNA, 23 nt, Human
aggccuggccagaugcaccagcc

SEQ ID NO: 3329649 - RNA, 22 nt, Human
aggccuggccagaugcaccagc

SEQ ID NO: 3329650 - RNA, 21 nt, Human
uggccccugcccggcugcgga

SEQ ID NO: 3329651 - RNA, 20 nt, Human
uggccccugcccggcugcgg

SEQ ID NO: 3329652 - RNA, 16 nt, Human
aggcucugcccuuggu

SEQ ID NO: 3329653 - RNA, 17 nt, Human
aggcuggcgugcagugg

SEQ ID NO: 3329654 - RNA, 13 nt, Human
aggcuggcgugca

SEQ ID NO: 3329655 - RNA, 21 nt, Human
aggcucgagcaugccuggaug

SEQ ID NO: 3329656 - RNA, 15 nt, Human
aggcucgagcaugcc

SEQ ID NO: 3329657 - RNA, 17 nt, Human
aggcucgagcaugccug

SEQ ID NO: 3329658 - RNA, 18 nt, Human
aggcucgagcaugccugg

SEQ ID NO: 3329659 - RNA, 19 nt, Human
aggcucgagcaugccugga

SEQ ID NO: 3329660 - RNA, 12 nt, Human
aggcucgagcau

SEQ ID NO: 3329661 - RNA, 19 nt, Human
aggcuccuuuagcgcccag

SEQ ID NO: 3329662 - RNA, 20 nt, Human
aggccugggggcugggcaga

SEQ ID NO: 3329663 - RNA, 11 nt, Human
aggcucucagg

SEQ ID NO: 3329664 - RNA, 12 nt, Human
aggcucucaggc

SEQ ID NO: 3329665 - RNA, 14 nt, Human
aggcucucaggcca

SEQ ID NO: 3329666 - RNA, 15 nt, Human
aggcucucaggccag

SEQ ID NO: 3329667 - RNA, 16 nt, Human
aggcucucaggccagc

SEQ ID NO: 3329668 - RNA, 18 nt, Human
aggcucucaggccagcug

SEQ ID NO: 3329669 - RNA, 19 nt, Human
aggcucucaggccagcugc

SEQ ID NO: 3329670 - RNA, 20 nt, Human
aggcucucaggccagcugcu

SEQ ID NO: 3329671 - RNA, 14 nt, Human
aggcucugcccuug

SEQ ID NO: 3329672 - RNA, 15 nt, Human
aggcucugcccuugg

SEQ ID NO: 3329673 - RNA, 13 nt, Human
aggcucugcccuu

SEQ ID NO: 3329674 - RNA, 12 nt, Human
aggcucugcccu

SEQ ID NO: 3329675 - RNA, 11 nt, Human
aggcucugccc

SEQ ID NO: 3329676 - RNA, 21 nt, Human
aggcucucaggccagcugcuu

SEQ ID NO: 3329677 - RNA, 12 nt, Human
uggcugcaaagg

SEQ ID NO: 3329678 - RNA, 20 nt, Human
uggcucuuccaggcugggag

SEQ ID NO: 3329679 - RNA, 21 nt, Human
uggcucuuccaggcugggaga

SEQ ID NO: 3329680 - RNA, 19 nt, Human
uggcucuuccaggcuggga

SEQ ID NO: 3329681 - RNA, 18 nt, Human
uggcugccaaugggagcu

SEQ ID NO: 3329682 - RNA, 20 nt, Human
uggcugccaaugggagcuca

SEQ ID NO: 3329683 - RNA, 14 nt, Human
uggcugcagggagu

SEQ ID NO: 3329684 - RNA, 13 nt, Human
uggcugcagggag

SEQ ID NO: 3329685 - RNA, 15 nt, Human
uggcugcagggaguc

SEQ ID NO: 3329686 - RNA, 15 nt, Human
uggcuaugcauuuga

SEQ ID NO: 3329687 - RNA, 17 nt, Human
uggcuaugcauuugaaa

SEQ ID NO: 3329688 - RNA, 14 nt, Human
uggcuaugcauuug

SEQ ID NO: 3329689 - RNA, 19 nt, Human
uggcuaugcauuugaaaau

SEQ ID NO: 3329690 - RNA, 22 nt, Human
uggcuauuagagaucaaccccu

SEQ ID NO: 3329691 - RNA, 20 nt, Human
aggcuggcgugcaguggugc

SEQ ID NO: 3329692 - RNA, 18 nt, Human
aggcuggcgugcaguggu

SEQ ID NO: 3329693 - RNA, 22 nt, Human
uggcuagagguucaaagauauu

SEQ ID NO: 3329694 - RNA, 14 nt, Human
aggcugggagagcc

SEQ ID NO: 3329695 - RNA, 16 nt, Human
ugggaaaggggaaguu

SEQ ID NO: 3329696 - RNA, 22 nt, Human
uggcuucacggaagagccuugc

SEQ ID NO: 3329697 - RNA, 23 nt, Human
uggcuucacggaagagccuugcg

SEQ ID NO: 3329698 - RNA, 17 nt, Human
uggcuuaaaacaacacu

SEQ ID NO: 3329699 - RNA, 14 nt, Human
uggcugugucuccc

SEQ ID NO: 3329700 - RNA, 13 nt, Human
uggcuguuggcug

SEQ ID NO: 3329701 - RNA, 14 nt, Human
uuguaaggaaugau

SEQ ID NO: 3329702 - RNA, 19 nt, Human
uugguuaggcauuguggga

SEQ ID NO: 3329703 - RNA, 22 nt, Human
uugggguacccacugcucuggu

SEQ ID NO: 3329704 - RNA, 19 nt, Human
uuggggaagaacgaagcca

SEQ ID NO: 3329705 - RNA, 17 nt, Human
uugggguacccacugcu

SEQ ID NO: 3329706 - RNA, 13 nt, Human
augaaccacaucu

SEQ ID NO: 3329707 - RNA, 20 nt, Human
augaaccacaucuugcucug

SEQ ID NO: 3329708 - RNA, 19 nt, Human
augacacgaauauugcuga

SEQ ID NO: 3329709 - RNA, 20 nt, Human
augacacgaauauugcugau

SEQ ID NO: 3329710 - RNA, 20 nt, Human
uuguaaggaaugauuaauua

SEQ ID NO: 3329711 - RNA, 11 nt, Human
uuggcugcuga

SEQ ID NO: 3329712 - RNA, 15 nt, Human
uuggcugcugaaggc

SEQ ID NO: 3329713 - RNA, 14 nt, Human
uuggcugcagggag

SEQ ID NO: 3329714 - RNA, 13 nt, Human
uuggcugcaggga

SEQ ID NO: 3329715 - RNA, 22 nt, Human
uuggcuagagguucaaagauau

SEQ ID NO: 3329716 - RNA, 22 nt, Human
uuggcuaggaccccuccaugug

SEQ ID NO: 3329717 - RNA, 21 nt, Human
uuggcuagagguucaaagaua

SEQ ID NO: 3329718 - RNA, 18 nt, Human
uuggaaagaguaggaaga

SEQ ID NO: 3329719 - RNA, 21 nt, Human
uuggacccugaggcccagagg

SEQ ID NO: 3329720 - RNA, 19 nt, Human
augaaagacuguacaaagu

SEQ ID NO: 3329721 - RNA, 20 nt, Human
augaaagacuguacaaagua

SEQ ID NO: 3329722 - RNA, 17 nt, Human
uuggaaagaguaggaag

SEQ ID NO: 3329723 - RNA, 17 nt, Human
uugcugauggugcaaug

SEQ ID NO: 3329724 - RNA, 18 nt, Human
uugcugauggugcaauga

SEQ ID NO: 3329725 - RNA, 20 nt, Human
uugcuaagugaggaugaaaa

SEQ ID NO: 3329726 - RNA, 19 nt, Human
uugcugaauacagaggcaa

SEQ ID NO: 3329727 - RNA, 16 nt, Human
augagccucagcaucc

SEQ ID NO: 3329728 - RNA, 15 nt, Human
augagccucagcauc

SEQ ID NO: 3329729 - RNA, 12 nt, Human
augagccucagc

SEQ ID NO: 3329730 - RNA, 22 nt, Human
augagcaucaggccaggcccuc

SEQ ID NO: 3329731 - RNA, 18 nt, Human
augagcaucaggccaggc

SEQ ID NO: 3329732 - RNA, 19 nt, Human
augagcaucaggccaggcc

SEQ ID NO: 3329733 - RNA, 20 nt, Human
augagcaucaggccaggccc

SEQ ID NO: 3329734 - RNA, 21 nt, Human
augagcaucaggccaggcccu

SEQ ID NO: 3329735 - RNA, 16 nt, Human
augagcaucaggccag

SEQ ID NO: 3329736 - RNA, 17 nt, Human
augagcaucaggccagg

SEQ ID NO: 3329737 - RNA, 15 nt, Human
augagcaucaggcca

SEQ ID NO: 3329738 - RNA, 14 nt, Human
augagaggaaauca

SEQ ID NO: 3329739 - RNA, 15 nt, Human
augagaggaaaucac

SEQ ID NO: 3329740 - RNA, 16 nt, Human
augagaggaaaucacc

SEQ ID NO: 3329741 - RNA, 12 nt, Human
augagaggaaau

SEQ ID NO: 3329742 - RNA, 13 nt, Human
augagaggaaauc

SEQ ID NO: 3329743 - RNA, 18 nt, Human
augagccucagcauccug

SEQ ID NO: 3329744 - RNA, 17 nt, Human
augagccucagcauccu

SEQ ID NO: 3329745 - RNA, 22 nt, Human
augaggucagagccugcaguua

SEQ ID NO: 3329746 - RNA, 23 nt, Human
augaguccccuguuuguuucuga

SEQ ID NO: 3329747 - RNA, 15 nt, Human
augauaaaacacaaa

SEQ ID NO: 3329748 - RNA, 18 nt, Human
uugucacacacuuuggcu

SEQ ID NO: 3329749 - RNA, 16 nt, Human
uuguccccgacccuug

SEQ ID NO: 3329750 - RNA, 14 nt, Human
augcaaggucauuu

SEQ ID NO: 3329751 - RNA, 16 nt, Human
augcaaggucauuuuu

SEQ ID NO: 3329752 - RNA, 16 nt, Human
augcaccuggaauaua

SEQ ID NO: 3329753 - RNA, 14 nt, Human
augcaccuggaaua

SEQ ID NO: 3329754 - RNA, 22 nt, Human
augcaaggucauuuuuuuuaag

SEQ ID NO: 3329755 - RNA, 15 nt, Human
augaucuucuuuaua

SEQ ID NO: 3329756 - RNA, 16 nt, Human
augcaaaccaucauug

SEQ ID NO: 3329757 - RNA, 18 nt, Human
augcaaaccaucauugaa

SEQ ID NO: 3329758 - RNA, 19 nt, Human
augcaaaccaucauugaaa

SEQ ID NO: 3329759 - RNA, 20 nt, Human
augcaaaccaucauugaaau

SEQ ID NO: 3329760 - RNA, 21 nt, Human
augcaaaccaucauugaaauc

SEQ ID NO: 3329761 - RNA, 22 nt, Human
augcaaaccaucauugaaaucu

SEQ ID NO: 3329762 - RNA, 19 nt, Human
augcaccuggaauauauaa

SEQ ID NO: 3329763 - RNA, 14 nt, Human
augaucuucuuuau

SEQ ID NO: 3329764 - RNA, 16 nt, Human
augauccuaggcauuu

SEQ ID NO: 3329765 - RNA, 23 nt, Human
augaucacggcucacugcagccu

SEQ ID NO: 3329766 - RNA, 15 nt, Human
augaucacggcucac

SEQ ID NO: 3329767 - RNA, 19 nt, Human
augaucacggcucacugca

SEQ ID NO: 3329768 - RNA, 18 nt, Human
augaucacggcucacugc

SEQ ID NO: 3329769 - RNA, 18 nt, Human
uuucgcaggauucuuccu

SEQ ID NO: 3329770 - RNA, 22 nt, Human
uuucgcaggauucuuccucccu

SEQ ID NO: 3329771 - RNA, 21 nt, Human
uuuccuucauucaacccaccu

SEQ ID NO: 3329772 - RNA, 22 nt, Human
uuuccuucagugccuuauggaa

SEQ ID NO: 3329773 - RNA, 18 nt, Human
uuuccuucagugccuuau

SEQ ID NO: 3329774 - RNA, 21 nt, Human
uuuccuucagugccuuaugga

SEQ ID NO: 3329775 - RNA, 23 nt, Human
uuuccuucauucaacccaccugc

SEQ ID NO: 3329776 - RNA, 12 nt, Human
uuuccugugucu

SEQ ID NO: 3329777 - RNA, 12 nt, Human
uuuccuucagug

SEQ ID NO: 3329778 - RNA, 15 nt, Human
uuuccuucagugccu

SEQ ID NO: 3329779 - RNA, 11 nt, Human
uuuccuucagu

SEQ ID NO: 3329780 - RNA, 18 nt, Human
auggccucuucagaucuc

SEQ ID NO: 3329781 - RNA, 21 nt, Human
auggacccaauauuuaccaga

SEQ ID NO: 3329782 - RNA, 19 nt, Human
auggacaugaucuucuuua

SEQ ID NO: 3329783 - RNA, 13 nt, Human
augggcagagcag

SEQ ID NO: 3329784 - RNA, 14 nt, Human
augggcagagcaga

SEQ ID NO: 3329785 - RNA, 15 nt, Human
augggcagagcagag

SEQ ID NO: 3329786 - RNA, 15 nt, Human
augggccuccugugu

SEQ ID NO: 3329787 - RNA, 21 nt, Human
augggcaacccccagccugcu

SEQ ID NO: 3329788 - RNA, 19 nt, Human
augggcaacccccagccug

SEQ ID NO: 3329789 - RNA, 18 nt, Human
augggcaacccccagccu

SEQ ID NO: 3329790 - RNA, 13 nt, Human
augggagcucaug

SEQ ID NO: 3329791 - RNA, 15 nt, Human
uuucuaugacacaug

SEQ ID NO: 3329792 - RNA, 21 nt, Human
uuucuaugacacaugcaaggu

SEQ ID NO: 3329793 - RNA, 21 nt, Human
uuucugcagccacuauuguua

SEQ ID NO: 3329794 - RNA, 14 nt, Human
uuucugccgcagcc

SEQ ID NO: 3329795 - RNA, 16 nt, Human
uuucugccgcagcccu

SEQ ID NO: 3329796 - RNA, 13 nt, Human
uuucuuuguggcu

SEQ ID NO: 3329797 - RNA, 14 nt, Human
auggggcccugccu

SEQ ID NO: 3329798 - RNA, 13 nt, Human
auggggcccugcc

SEQ ID NO: 3329799 - RNA, 23 nt, Human
augggcuggguucuacccaggug

SEQ ID NO: 3329800 - RNA, 19 nt, Human
uuuccagguuuaagcuguu

SEQ ID NO: 3329801 - RNA, 14 nt, Human
uuucacucuccuug

SEQ ID NO: 3329802 - RNA, 15 nt, Human
uuucacucuccuugg

SEQ ID NO: 3329803 - RNA, 15 nt, Human
auggaauaacaugua

SEQ ID NO: 3329804 - RNA, 14 nt, Human
auggaauaacaugu

SEQ ID NO: 3329805 - RNA, 18 nt, Human
auggaacacucugagacu

SEQ ID NO: 3329806 - RNA, 17 nt, Human
auggaacacucugagac

SEQ ID NO: 3329807 - RNA, 21 nt, Human
auggaaguacuauaauuuacc

SEQ ID NO: 3329808 - RNA, 19 nt, Human
augcugugcccuaaagugu

SEQ ID NO: 3329809 - RNA, 22 nt, Human
augcuggcuguuggcugggggc

SEQ ID NO: 3329810 - RNA, 15 nt, Human
uuuagauaauacacc

SEQ ID NO: 3329811 - RNA, 18 nt, Human
uuuagaguugauacuaca

SEQ ID NO: 3329812 - RNA, 13 nt, Human
uuuagauaauaca

SEQ ID NO: 3329813 - RNA, 19 nt, Human
uuuauuaaaugcccagccc

SEQ ID NO: 3329814 - RNA, 18 nt, Human
uuuacuaauagacaauuu

SEQ ID NO: 3329815 - RNA, 14 nt, Human
uuuacuaauagaca

SEQ ID NO: 3329816 - RNA, 17 nt, Human
uuuacuaauagacaauu

SEQ ID NO: 3329817 - RNA, 21 nt, Human
uuuaccuuuuuuauacauaaa

SEQ ID NO: 3329818 - RNA, 18 nt, Human
augcuacacacugcaugu

SEQ ID NO: 3329819 - RNA, 22 nt, Human
uuuaccugaagucuuuguacag

SEQ ID NO: 3329820 - RNA, 17 nt, Human
augcuacacacugcaug

SEQ ID NO: 3329821 - RNA, 19 nt, Human
uuuaccuuuuuuauacaua

SEQ ID NO: 3329822 - RNA, 20 nt, Human
uuuaccuuuuuuauacauaa

SEQ ID NO: 3329823 - RNA, 14 nt, Human
uuuaccuuuuuuau

SEQ ID NO: 3329824 - RNA, 21 nt, Human
auccuggcacccggccccugc

SEQ ID NO: 3329825 - RNA, 20 nt, Human
auccuggcacccggccccug

SEQ ID NO: 3329826 - RNA, 19 nt, Human
auccuggcacccggccccu

SEQ ID NO: 3329827 - RNA, 17 nt, Human
auccuggcacccggccc

SEQ ID NO: 3329828 - RNA, 15 nt, Human
auccuggaguucugg

SEQ ID NO: 3329829 - RNA, 23 nt, Human
auccuggcacccggccccugcug

SEQ ID NO: 3329830 - RNA, 22 nt, Human
auccuggcacccggccccugcu

SEQ ID NO: 3329831 - RNA, 20 nt, Human
uucuuuugccguuauuaaaa

SEQ ID NO: 3329832 - RNA, 18 nt, Human
auccucuguacagagccc

SEQ ID NO: 3329833 - RNA, 20 nt, Human
auccucuguacagagcccac

SEQ ID NO: 3329834 - RNA, 17 nt, Human
auccucuuugagugaag

SEQ ID NO: 3329835 - RNA, 12 nt, Human
auccugagccag

SEQ ID NO: 3329836 - RNA, 13 nt, Human
auccugagccaga

SEQ ID NO: 3329837 - RNA, 11 nt, Human
auccugagcca

SEQ ID NO: 3329838 - RNA, 14 nt, Human
auccugagccagau

SEQ ID NO: 3329839 - RNA, 15 nt, Human
auccugagccagauu

SEQ ID NO: 3329840 - RNA, 17 nt, Human
auccugagccagauuuc

SEQ ID NO: 3329841 - RNA, 21 nt, Human
auccugagccagauuucacuc

SEQ ID NO: 3329842 - RNA, 19 nt, Human
auccugagguguaccagga

SEQ ID NO: 3329843 - RNA, 17 nt, Human
uugaccauucuccaccu

SEQ ID NO: 3329844 - RNA, 18 nt, Human
uugaccauucuccaccug

SEQ ID NO: 3329845 - RNA, 19 nt, Human
uugaccauucuccaccugc

SEQ ID NO: 3329846 - RNA, 19 nt, Human
uugacagggcacaccgggc

SEQ ID NO: 3329847 - RNA, 24 nt, Human
uugaccauucuccaccugccaggg

SEQ ID NO: 3329848 - RNA, 15 nt, Human
uugaggucuguucuu

SEQ ID NO: 3329849 - RNA, 16 nt, Human
uugaggucuguucuuu

SEQ ID NO: 3329850 - RNA, 12 nt, Human
uugauaaaguaa

SEQ ID NO: 3329851 - RNA, 14 nt, Human
aucgucacugcuua

SEQ ID NO: 3329852 - RNA, 18 nt, Human
aucgucacugcuuaacuu

SEQ ID NO: 3329853 - RNA, 15 nt, Human
aucgugacaacacuu

SEQ ID NO: 3329854 - RNA, 14 nt, Human
aucgugacaacacu

SEQ ID NO: 3329855 - RNA, 19 nt, Human
aucuaaauggaaccacucu

SEQ ID NO: 3329856 - RNA, 15 nt, Human
aucuaaauguugaaa

SEQ ID NO: 3329857 - RNA, 12 nt, Human
aucauugaaauc

SEQ ID NO: 3329858 - RNA, 19 nt, Human
uucugcagccacuauuguu

SEQ ID NO: 3329859 - RNA, 20 nt, Human
uucucuaguuugauuaaauu

SEQ ID NO: 3329860 - RNA, 21 nt, Human
uucucuaguuugauuaaauuc

SEQ ID NO: 3329861 - RNA, 23 nt, Human
aucauaguggcuuaaaacaacac

SEQ ID NO: 3329862 - RNA, 15 nt, Human
aucauaaaacuugau

SEQ ID NO: 3329863 - RNA, 22 nt, Human
aucauuaaagccugaguuugcu

SEQ ID NO: 3329864 - RNA, 21 nt, Human
aucauccacugugccaugugc

SEQ ID NO: 3329865 - RNA, 16 nt, Human
aucauuaggugugacu

SEQ ID NO: 3329866 - RNA, 19 nt, Human
aucagucugauucccaagc

SEQ ID NO: 3329867 - RNA, 14 nt, Human
aucaggugcugcca

SEQ ID NO: 3329868 - RNA, 17 nt, Human
aucaggugcugccaucc

SEQ ID NO: 3329869 - RNA, 15 nt, Human
aucaggugcugccau

SEQ ID NO: 3329870 - RNA, 13 nt, Human
uucuugcaaagua

SEQ ID NO: 3329871 - RNA, 22 nt, Human
uucuucuccacuuucuagccag

SEQ ID NO: 3329872 - RNA, 17 nt, Human
uucuuucuggcuaugca

SEQ ID NO: 3329873 - RNA, 20 nt, Human
uucuuucuggcuaugcauuu

SEQ ID NO: 3329874 - RNA, 12 nt, Human
uucuuucuggcu

SEQ ID NO: 3329875 - RNA, 13 nt, Human
uucuguuuagaua

SEQ ID NO: 3329876 - RNA, 18 nt, Human
uucuguuuagauaauaca

SEQ ID NO: 3329877 - RNA, 21 nt, Human
uucuguuggccagugugacaa

SEQ ID NO: 3329878 - RNA, 16 nt, Human
uucugccugcccaggc

SEQ ID NO: 3329879 - RNA, 15 nt, Human
uucugccugcccagg

SEQ ID NO: 3329880 - RNA, 14 nt, Human
auccaguaucuuga

SEQ ID NO: 3329881 - RNA, 17 nt, Human
auccagguucagcuugu

SEQ ID NO: 3329882 - RNA, 17 nt, Human
aucccugaaggccccgc

SEQ ID NO: 3329883 - RNA, 22 nt, Human
aucccugaaggccccgcccagg

SEQ ID NO: 3329884 - RNA, 17 nt, Human
aucccaugagccucagc

SEQ ID NO: 3329885 - RNA, 16 nt, Human
aucccaugagccucag

SEQ ID NO: 3329886 - RNA, 13 nt, Human
aucccaugagccu

SEQ ID NO: 3329887 - RNA, 11 nt, Human
aucccagcccc

SEQ ID NO: 3329888 - RNA, 16 nt, Human
uucagguaacaggcag

SEQ ID NO: 3329889 - RNA, 15 nt, Human
uucagguaacaggca

SEQ ID NO: 3329890 - RNA, 22 nt, Human
uucaggguuggccccugcccgg

SEQ ID NO: 3329891 - RNA, 19 nt, Human
uucaggguuggccccugcc

SEQ ID NO: 3329892 - RNA, 17 nt, Human
uucaggguuggccccug

SEQ ID NO: 3329893 - RNA, 16 nt, Human
uucaggguuggccccu

SEQ ID NO: 3329894 - RNA, 14 nt, Human
uucaggguuggccc

SEQ ID NO: 3329895 - RNA, 16 nt, Human
uucagaaauguguuau

SEQ ID NO: 3329896 - RNA, 13 nt, Human
uucagaaaugugu

SEQ ID NO: 3329897 - RNA, 14 nt, Human
uucaguaagccgug

SEQ ID NO: 3329898 - RNA, 17 nt, Human
uucagguaacaggcaga

SEQ ID NO: 3329899 - RNA, 22 nt, Human
auauauguuuuaagaggcaggg

SEQ ID NO: 3329900 - RNA, 21 nt, Human
auauauguuuuaagaggcagg

SEQ ID NO: 3329901 - RNA, 21 nt, Human
uuccacaagagcccaggccuc

SEQ ID NO: 3329902 - RNA, 13 nt, Human
uuccaggcuggga

SEQ ID NO: 3329903 - RNA, 15 nt, Human
uuccaggcugggaga

SEQ ID NO: 3329904 - RNA, 17 nt, Human
uuccaggcugggagagc

SEQ ID NO: 3329905 - RNA, 18 nt, Human
uuccagguuuaagcuguu

SEQ ID NO: 3329906 - RNA, 17 nt, Human
uuccagguuuaagcugu

SEQ ID NO: 3329907 - RNA, 22 nt, Human
uuccaauuuacauacucugcuu

SEQ ID NO: 3329908 - RNA, 20 nt, Human
auauguggaguucaucuuga

SEQ ID NO: 3329909 - RNA, 21 nt, Human
auauguggaguucaucuugaa

SEQ ID NO: 3329910 - RNA, 20 nt, Human
auaugauuuaaaucagccgu

SEQ ID NO: 3329911 - RNA, 15 nt, Human
auauugauaugcuua

SEQ ID NO: 3329912 - RNA, 22 nt, Human
auauugcugauggugcaaugac

SEQ ID NO: 3329913 - RNA, 21 nt, Human
auauugcugauggugcaauga

SEQ ID NO: 3329914 - RNA, 13 nt, Human
auauuguuuucag

SEQ ID NO: 3329915 - RNA, 17 nt, Human
auauuaccacagacaua

SEQ ID NO: 3329916 - RNA, 17 nt, Human
auauuaagaaagacuau

SEQ ID NO: 3329917 - RNA, 15 nt, Human
auauuaagaaagacu

SEQ ID NO: 3329918 - RNA, 16 nt, Human
auauuaagaaagacua

SEQ ID NO: 3329919 - RNA, 15 nt, Human
uuccagugaggcucu

SEQ ID NO: 3329920 - RNA, 16 nt, Human
uuccagugaggcucug

SEQ ID NO: 3329921 - RNA, 22 nt, Human
uuccucuuuuuauuuaguuccu

SEQ ID NO: 3329922 - RNA, 19 nt, Human
uuccuggcacugcuuccag

SEQ ID NO: 3329923 - RNA, 20 nt, Human
uuccuggcacugcuuccagu

SEQ ID NO: 3329924 - RNA, 22 nt, Human
uuccuggcacugcuuccaguga

SEQ ID NO: 3329925 - RNA, 20 nt, Human
uucccuuuuuuggcugcuga

SEQ ID NO: 3329926 - RNA, 21 nt, Human
aucaacugcaucaagauguga

SEQ ID NO: 3329927 - RNA, 22 nt, Human
aucaaccccuucgcuccugugu

SEQ ID NO: 3329928 - RNA, 14 nt, Human
aucacgccacugca

SEQ ID NO: 3329929 - RNA, 17 nt, Human
aucacgccacugcacua

SEQ ID NO: 3329930 - RNA, 15 nt, Human
aucacgccacugcac

SEQ ID NO: 3329931 - RNA, 15 nt, Human
auuuuaauucaguug

SEQ ID NO: 3329932 - RNA, 21 nt, Human
auuuuacuuuaaaaggagcca

SEQ ID NO: 3329933 - RNA, 14 nt, Human
auuugugauacaau

SEQ ID NO: 3329934 - RNA, 14 nt, Human
auuuauucugcuca

SEQ ID NO: 3329935 - RNA, 15 nt, Human
auuuagaaauauaau

SEQ ID NO: 3329936 - RNA, 16 nt, Human
auuuacuucuuauaca

SEQ ID NO: 3329937 - RNA, 14 nt, Human
auuuacuucuuaua

SEQ ID NO: 3329938 - RNA, 12 nt, Human
auuuaacagaaa

SEQ ID NO: 3329939 - RNA, 14 nt, Human
auuuaacagaaaug

SEQ ID NO: 3329940 - RNA, 22 nt, Human
auuuauuaaaugcccagccccu

SEQ ID NO: 3329941 - RNA, 13 nt, Human
auuuauucugcuc

SEQ ID NO: 3329942 - RNA, 17 nt, Human
auuuccagccaaagccu

SEQ ID NO: 3329943 - RNA, 14 nt, Human
auuugaaaauuuug

SEQ ID NO: 3329944 - RNA, 15 nt, Human
auuuccguuaaaaua

SEQ ID NO: 3329945 - RNA, 16 nt, Human
auuuccguuaaaauac

SEQ ID NO: 3329946 - RNA, 14 nt, Human
auuuaaaaaaaauc

SEQ ID NO: 3329947 - RNA, 14 nt, Human
auugugucucuugg

SEQ ID NO: 3329948 - RNA, 17 nt, Human
auuguccccgacccuug

SEQ ID NO: 3329949 - RNA, 19 nt, Human
auuguccccgacccuugcc

SEQ ID NO: 3329950 - RNA, 21 nt, Human
auucuguuggccagugugaca

SEQ ID NO: 3329951 - RNA, 18 nt, Human
auucuuauuuaaugaaag

SEQ ID NO: 3329952 - RNA, 14 nt, Human
auucuuauuuaaug

SEQ ID NO: 3329953 - RNA, 13 nt, Human
auucuuauuuaau

SEQ ID NO: 3329954 - RNA, 22 nt, Human
auucuuccucccucccucuuuc

SEQ ID NO: 3329955 - RNA, 13 nt, Human
auucuuccucccu

SEQ ID NO: 3329956 - RNA, 13 nt, Human
auucuucuccacu

SEQ ID NO: 3329957 - RNA, 15 nt, Human
auugaaaaaccauuu

SEQ ID NO: 3329958 - RNA, 18 nt, Human
auugacaggauuauugga

SEQ ID NO: 3329959 - RNA, 14 nt, Human
auucaggaagcuca

SEQ ID NO: 3329960 - RNA, 19 nt, Human
auucagacagcugccuggg

SEQ ID NO: 3329961 - RNA, 17 nt, Human
auucaggaagcucaggg

SEQ ID NO: 3329962 - RNA, 19 nt, Human
auucaggaagcucagggcc

SEQ ID NO: 3329963 - RNA, 13 nt, Human
auucaggaagcuc

SEQ ID NO: 3329964 - RNA, 19 nt, Human
auucaguaauaacucuacc

SEQ ID NO: 3329965 - RNA, 15 nt, Human
auucaguaauaacuc

SEQ ID NO: 3329966 - RNA, 15 nt, Human
auucccaagcucugc

SEQ ID NO: 3329967 - RNA, 14 nt, Human
auucccaagcucug

SEQ ID NO: 3329968 - RNA, 16 nt, Human
auucccaagcucugcu

SEQ ID NO: 3329969 - RNA, 18 nt, Human
auucuccaccugccaggg

SEQ ID NO: 3329970 - RNA, 21 nt, Human
auucuccaccugccagggaca

SEQ ID NO: 3329971 - RNA, 13 nt, Human
auucuccugccuc

SEQ ID NO: 3329972 - RNA, 14 nt, Human
auucuccugccuca

SEQ ID NO: 3329973 - RNA, 11 nt, Human
auucuccugcc

SEQ ID NO: 3329974 - RNA, 16 nt, Human
auucuccuuguguuac

SEQ ID NO: 3329975 - RNA, 17 nt, Human
auucuccugccucagcc

SEQ ID NO: 3329976 - RNA, 15 nt, Human
auucuccugccucag

SEQ ID NO: 3329977 - RNA, 19 nt, Human
auucuccugccucagccuc

SEQ ID NO: 3329978 - RNA, 20 nt, Human
auucuccugccucagccucc

SEQ ID NO: 3329979 - RNA, 19 nt, Human
auucuccaccugccaggga

SEQ ID NO: 3329980 - RNA, 20 nt, Human
auucuccaccugccagggac

SEQ ID NO: 3329981 - RNA, 23 nt, Human
uuuugccauguuggccaggcugg

SEQ ID NO: 3329982 - RNA, 17 nt, Human
uuuugagugccuuacac

SEQ ID NO: 3329983 - RNA, 17 nt, Human
uuuugauccaagcuggu

SEQ ID NO: 3329984 - RNA, 11 nt, Human
uuuuuacuaau

SEQ ID NO: 3329985 - RNA, 22 nt, Human
uuuuuagacagagucucacugu

SEQ ID NO: 3329986 - RNA, 20 nt, Human
uuuuuaucgucacugcuuaa

SEQ ID NO: 3329987 - RNA, 12 nt, Human
uuuuuauggcuu

SEQ ID NO: 3329988 - RNA, 17 nt, Human
uuuugugcauuaucuag

SEQ ID NO: 3329989 - RNA, 20 nt, Human
uuuugugcauuaucuagaua

SEQ ID NO: 3329990 - RNA, 15 nt, Human
uuuuguuccacaagu

SEQ ID NO: 3329991 - RNA, 20 nt, Human
uuuuuauggcuuuugugcau

SEQ ID NO: 3329992 - RNA, 21 nt, Human
uuuuuauggcuuuugugcauu

SEQ ID NO: 3329993 - RNA, 22 nt, Human
uuuuuauggcuuuugugcauua

SEQ ID NO: 3329994 - RNA, 20 nt, Human
uuuuuguagagccagggucu

SEQ ID NO: 3329995 - RNA, 19 nt, Human
uuuuuguagagccaggguc

SEQ ID NO: 3329996 - RNA, 14 nt, Human
auuaaguacuaugu

SEQ ID NO: 3329997 - RNA, 20 nt, Human
auuaaaaaucucaaauuucu

SEQ ID NO: 3329998 - RNA, 23 nt, Human
auuaaaacacaacaucuuuuucu

SEQ ID NO: 3329999 - RNA, 14 nt, Human
auuaaaacauugga

SEQ ID NO: 3330000 - RNA, 13 nt, Human
auuaaaacauugg

SEQ ID NO: 3330001 - RNA, 15 nt, Human
auuaaaaaucucaaa

SEQ ID NO: 3330002 - RNA, 19 nt, Human
auuaaaaaucucaaauuuc

SEQ ID NO: 3330003 - RNA, 21 nt, Human
auuaaacuuaaucuaaaugga

SEQ ID NO: 3330004 - RNA, 20 nt, Human
auuaaaacauuggauuaucc

SEQ ID NO: 3330005 - RNA, 13 nt, Human
uuuuauuaugcau

SEQ ID NO: 3330006 - RNA, 11 nt, Human
uuuuauuuuau

SEQ ID NO: 3330007 - RNA, 14 nt, Human
uuuucaguguacau

SEQ ID NO: 3330008 - RNA, 20 nt, Human
uuuucauuuaggugaggaag

SEQ ID NO: 3330009 - RNA, 20 nt, Human
auguugcccaggcaggucuu

SEQ ID NO: 3330010 - RNA, 12 nt, Human
auguugcccagg

SEQ ID NO: 3330011 - RNA, 17 nt, Human
auguugcccaggcaggu

SEQ ID NO: 3330012 - RNA, 16 nt, Human
auguugcccaggcagg

SEQ ID NO: 3330013 - RNA, 21 nt, Human
augugccagguuuuuggucug

SEQ ID NO: 3330014 - RNA, 22 nt, Human
augugccagguuuuuggucuga

SEQ ID NO: 3330015 - RNA, 20 nt, Human
auggggcccugccuccuuug

SEQ ID NO: 3330016 - RNA, 20 nt, Human
auguggaguucaucuugaau

SEQ ID NO: 3330017 - RNA, 24 nt, Human
auguggaguucaucuugaauugua

SEQ ID NO: 3330018 - RNA, 16 nt, Human
agcaccuccugccucg

SEQ ID NO: 3330019 - RNA, 14 nt, Human
agcaccuccugccu

SEQ ID NO: 3330020 - RNA, 13 nt, Human
agcaccuccugcc

SEQ ID NO: 3330021 - RNA, 16 nt, Human
agcaccaucucuccuc

SEQ ID NO: 3330022 - RNA, 23 nt, Human
agcacaugccucucucaggccaa

SEQ ID NO: 3330023 - RNA, 19 nt, Human
agcacaugccucucucagg

SEQ ID NO: 3330024 - RNA, 20 nt, Human
agcacaugccucucucaggc

SEQ ID NO: 3330025 - RNA, 21 nt, Human
agcacaugccucucucaggcc

SEQ ID NO: 3330026 - RNA, 22 nt, Human
agcacaugccucucucaggcca

SEQ ID NO: 3330027 - RNA, 18 nt, Human
agcacaugccucucucag

SEQ ID NO: 3330028 - RNA, 16 nt, Human
agcacaugccucucuc

SEQ ID NO: 3330029 - RNA, 21 nt, Human
agcacagcuucauuuccugug

SEQ ID NO: 3330030 - RNA, 16 nt, Human
agcacagcuucauuuc

SEQ ID NO: 3330031 - RNA, 17 nt, Human
agcaagugagagcuggg

SEQ ID NO: 3330032 - RNA, 13 nt, Human
ugagccacugcac

SEQ ID NO: 3330033 - RNA, 12 nt, Human
ugagccacugca

SEQ ID NO: 3330034 - RNA, 18 nt, Human
ugagccagauuucacucu

SEQ ID NO: 3330035 - RNA, 19 nt, Human
ugagccagauuucacucuc

SEQ ID NO: 3330036 - RNA, 14 nt, Human
ugagccacugcacc

SEQ ID NO: 3330037 - RNA, 20 nt, Human
ugagccagauuucacucucc

SEQ ID NO: 3330038 - RNA, 17 nt, Human
agcaaggagauuuacaa

SEQ ID NO: 3330039 - RNA, 19 nt, Human
agcaaggagauuuacaacu

SEQ ID NO: 3330040 - RNA, 14 nt, Human
agcaaggagauuua

SEQ ID NO: 3330041 - RNA, 14 nt, Human
agcaagugagagcu

SEQ ID NO: 3330042 - RNA, 16 nt, Human
agcaagugagagcugg

SEQ ID NO: 3330043 - RNA, 15 nt, Human
agcaagugagagcug

SEQ ID NO: 3330044 - RNA, 10 nt, Human
ugagaggaaa

SEQ ID NO: 3330045 - RNA, 14 nt, Human
ugagagcugggugu

SEQ ID NO: 3330046 - RNA, 11 nt, Human
ugagaggaaau

SEQ ID NO: 3330047 - RNA, 12 nt, Human
ugagaggaaauc

SEQ ID NO: 3330048 - RNA, 13 nt, Human
ugagaggaaauca

SEQ ID NO: 3330049 - RNA, 14 nt, Human
ugagaggaaaucac

SEQ ID NO: 3330050 - RNA, 17 nt, Human
ugagaggaaaucaccga

SEQ ID NO: 3330051 - RNA, 23 nt, Human
ugagaggacuuuucuuuguggcu

SEQ ID NO: 3330052 - RNA, 13 nt, Human
ugagacagcccgg

SEQ ID NO: 3330053 - RNA, 21 nt, Human
ugagacagaguuuucacucuu

SEQ ID NO: 3330054 - RNA, 11 nt, Human
ugagacagagu

SEQ ID NO: 3330055 - RNA, 20 nt, Human
ugagaagcagaggaaggaga

SEQ ID NO: 3330056 - RNA, 17 nt, Human
ugagacagcccgggcuc

SEQ ID NO: 3330057 - RNA, 18 nt, Human
ugagacagcccgggcucu

SEQ ID NO: 3330058 - RNA, 19 nt, Human
ugagacagcccgggcucug

SEQ ID NO: 3330059 - RNA, 20 nt, Human
ugagacagcccgggcucugc

SEQ ID NO: 3330060 - RNA, 22 nt, Human
ugagacagcccgggcucugccu

SEQ ID NO: 3330061 - RNA, 20 nt, Human
ugagacucugucucaaaaaa

SEQ ID NO: 3330062 - RNA, 22 nt, Human
ugacagggcacaccgggcacuc

SEQ ID NO: 3330063 - RNA, 21 nt, Human
ugacagggcacaccgggcacu

SEQ ID NO: 3330064 - RNA, 19 nt, Human
ugacaggcaaugcuggcug

SEQ ID NO: 3330065 - RNA, 17 nt, Human
ugacaggcaaugcuggc

SEQ ID NO: 3330066 - RNA, 13 nt, Human
ugacauguuuuau

SEQ ID NO: 3330067 - RNA, 16 nt, Human
ugacacgaauauugcu

SEQ ID NO: 3330068 - RNA, 19 nt, Human
ugacacgaauauugcugau

SEQ ID NO: 3330069 - RNA, 22 nt, Human
ugacagagugagacucugucuc

SEQ ID NO: 3330070 - RNA, 15 nt, Human
ugaccuuuaagagaa

SEQ ID NO: 3330071 - RNA, 21 nt, Human
ugacuguuuucucuugagagg

SEQ ID NO: 3330072 - RNA, 12 nt, Human
ugaccuuucaau

SEQ ID NO: 3330073 - RNA, 20 nt, Human
ugacuuacuguacaugaaaa

SEQ ID NO: 3330074 - RNA, 19 nt, Human
ugacuuacuguacaugaaa

SEQ ID NO: 3330075 - RNA, 16 nt, Human
agauucauauuuacuu

SEQ ID NO: 3330076 - RNA, 13 nt, Human
agauucauauuua

SEQ ID NO: 3330077 - RNA, 19 nt, Human
agauuucacucuccuuggu

SEQ ID NO: 3330078 - RNA, 17 nt, Human
agauuucacucuccuug

SEQ ID NO: 3330079 - RNA, 14 nt, Human
ugaaaacacauuuu

SEQ ID NO: 3330080 - RNA, 12 nt, Human
ugaaaacacauu

SEQ ID NO: 3330081 - RNA, 13 nt, Human
ugaaaacacauuu

SEQ ID NO: 3330082 - RNA, 15 nt, Human
ugaaaacacauuuuu

SEQ ID NO: 3330083 - RNA, 17 nt, Human
ugaaaacacauuuuucu

SEQ ID NO: 3330084 - RNA, 19 nt, Human
ugaaaacacauuuuucuua

SEQ ID NO: 3330085 - RNA, 17 nt, Human
ugaaacuggauuaaacu

SEQ ID NO: 3330086 - RNA, 18 nt, Human
ugaaacuggauuaaacuu

SEQ ID NO: 3330087 - RNA, 13 nt, Human
agagacuccugca

SEQ ID NO: 3330088 - RNA, 14 nt, Human
agagacuccugcag

SEQ ID NO: 3330089 - RNA, 12 nt, Human
agagacuccugc

SEQ ID NO: 3330090 - RNA, 23 nt, Human
agagacuccugcaggcagccagg

SEQ ID NO: 3330091 - RNA, 11 nt, Human
agagacuccug

SEQ ID NO: 3330092 - RNA, 18 nt, Human
agagaccaucccugaagg

SEQ ID NO: 3330093 - RNA, 19 nt, Human
agagaccaucccugaaggc

SEQ ID NO: 3330094 - RNA, 21 nt, Human
agagaccaucccugaaggccc

SEQ ID NO: 3330095 - RNA, 22 nt, Human
agagaccaucccugaaggcccc

SEQ ID NO: 3330096 - RNA, 23 nt, Human
agagaccaucccugaaggccccg

SEQ ID NO: 3330097 - RNA, 22 nt, Human
ugaaagaaaauaccaaggaaca

SEQ ID NO: 3330098 - RNA, 16 nt, Human
ugaaagacuguacaaa

SEQ ID NO: 3330099 - RNA, 19 nt, Human
ugaaagacuguacaaagua

SEQ ID NO: 3330100 - RNA, 18 nt, Human
ugaaagacuguacaaagu

SEQ ID NO: 3330101 - RNA, 22 nt, Human
ugaaagacuguacaaaguagaa

SEQ ID NO: 3330102 - RNA, 13 nt, Human
agacuccugcagg

SEQ ID NO: 3330103 - RNA, 19 nt, Human
agacucuacagaggccaug

SEQ ID NO: 3330104 - RNA, 20 nt, Human
agacaggcaagcaccuccug

SEQ ID NO: 3330105 - RNA, 15 nt, Human
ucuuuaaugucacag

SEQ ID NO: 3330106 - RNA, 18 nt, Human
ucuuuaaugucacaggca

SEQ ID NO: 3330107 - RNA, 23 nt, Human
ucuuucccucccuuccucuuucc

SEQ ID NO: 3330108 - RNA, 15 nt, Human
agacuuuuccaaccc

SEQ ID NO: 3330109 - RNA, 19 nt, Human
agacuuuggaaagaguagg

SEQ ID NO: 3330110 - RNA, 16 nt, Human
agagacacaagccuuc

SEQ ID NO: 3330111 - RNA, 19 nt, Human
agagacacaagccuucggc

SEQ ID NO: 3330112 - RNA, 15 nt, Human
agagacacaagccuu

SEQ ID NO: 3330113 - RNA, 20 nt, Human
agacugguuccauggccucu

SEQ ID NO: 3330114 - RNA, 17 nt, Human
agacuuuggaaagacuu

SEQ ID NO: 3330115 - RNA, 15 nt, Human
agacuuuggaaagag

SEQ ID NO: 3330116 - RNA, 15 nt, Human
agacuuuggaaagac

SEQ ID NO: 3330117 - RNA, 14 nt, Human
ucuuuguacagaca

SEQ ID NO: 3330118 - RNA, 15 nt, Human
ucuuuguacagacaa

SEQ ID NO: 3330119 - RNA, 20 nt, Human
ucuuuguacagacaacaaac

SEQ ID NO: 3330120 - RNA, 22 nt, Human
agaggcugccucucccaucacu

SEQ ID NO: 3330121 - RNA, 13 nt, Human
agagguucaaaga

SEQ ID NO: 3330122 - RNA, 20 nt, Human
agagggagugacagaggcag

SEQ ID NO: 3330123 - RNA, 15 nt, Human
agagggagugacaga

SEQ ID NO: 3330124 - RNA, 15 nt, Human
agagggagguaagga

SEQ ID NO: 3330125 - RNA, 16 nt, Human
agagguucaaagauau

SEQ ID NO: 3330126 - RNA, 19 nt, Human
agagguucaaagauauuuu

SEQ ID NO: 3330127 - RNA, 23 nt, Human
agaggcagccccauucugccugc

SEQ ID NO: 3330128 - RNA, 21 nt, Human
agaggcagggucucacucugu

SEQ ID NO: 3330129 - RNA, 22 nt, Human
agaggcagccccauucugccug

SEQ ID NO: 3330130 - RNA, 21 nt, Human
agaggcagccccauucugccu

SEQ ID NO: 3330131 - RNA, 16 nt, Human
ugaaguaauaugcaca

SEQ ID NO: 3330132 - RNA, 20 nt, Human
ugaaguaauaugcacacauu

SEQ ID NO: 3330133 - RNA, 21 nt, Human
ugaaguaauaugcacacauuu

SEQ ID NO: 3330134 - RNA, 22 nt, Human
ugaaguaauaugcacacauuuu

SEQ ID NO: 3330135 - RNA, 15 nt, Human
ugaaguaauaugcac

SEQ ID NO: 3330136 - RNA, 13 nt, Human
ugaauaauacagu

SEQ ID NO: 3330137 - RNA, 12 nt, Human
ugaauaauacag

SEQ ID NO: 3330138 - RNA, 13 nt, Human
ugaagucacacag

SEQ ID NO: 3330139 - RNA, 17 nt, Human
ugaaauaacauggccuu

SEQ ID NO: 3330140 - RNA, 16 nt, Human
ugaaauaacauggccu

SEQ ID NO: 3330141 - RNA, 20 nt, Human
ugaaauuuuuauuaaauuau

SEQ ID NO: 3330142 - RNA, 19 nt, Human
ugaaauuuuuauuaaauua

SEQ ID NO: 3330143 - RNA, 22 nt, Human
ugaagacaaugacuuacuguac

SEQ ID NO: 3330144 - RNA, 23 nt, Human
ugaagacaaugacuuacuguaca

SEQ ID NO: 3330145 - RNA, 21 nt, Human
ugaagacaaugacuuacugua

SEQ ID NO: 3330146 - RNA, 22 nt, Human
ugaaccaccacacccagcccac

SEQ ID NO: 3330147 - RNA, 21 nt, Human
ugaaccaccacacccagccca

SEQ ID NO: 3330148 - RNA, 17 nt, Human
ucuccgaccagacaccu

SEQ ID NO: 3330149 - RNA, 21 nt, Human
ucucccuuggauuguccccga

SEQ ID NO: 3330150 - RNA, 23 nt, Human
ucuccccagcaagugagagcugg

SEQ ID NO: 3330151 - RNA, 18 nt, Human
ucuccaagcaggacaugg

SEQ ID NO: 3330152 - RNA, 19 nt, Human
ucuccaagcaggacaugga

SEQ ID NO: 3330153 - RNA, 20 nt, Human
acuuucugaaauaacauggc

SEQ ID NO: 3330154 - RNA, 14 nt, Human
acuuucugaaauaa

SEQ ID NO: 3330155 - RNA, 17 nt, Human
ucuccucugcugcuggc

SEQ ID NO: 3330156 - RNA, 18 nt, Human
ucuccucugcugcuggcu

SEQ ID NO: 3330157 - RNA, 15 nt, Human
ucuccucugcugcug

SEQ ID NO: 3330158 - RNA, 16 nt, Human
ucuccucugcugcugg

SEQ ID NO: 3330159 - RNA, 15 nt, Human
ucuccuccagaguca

SEQ ID NO: 3330160 - RNA, 13 nt, Human
ucuccuuguguua

SEQ ID NO: 3330161 - RNA, 21 nt, Human
ucuccuuguguuacuaaguuu

SEQ ID NO: 3330162 - RNA, 16 nt, Human
ucuccuucaccuuugu

SEQ ID NO: 3330163 - RNA, 14 nt, Human
ucuccuucaccuuu

SEQ ID NO: 3330164 - RNA, 15 nt, Human
ucuccuucaccuuug

SEQ ID NO: 3330165 - RNA, 17 nt, Human
agaaaaaauauuuuccc

SEQ ID NO: 3330166 - RNA, 15 nt, Human
acuuuuguucuuggu

SEQ ID NO: 3330167 - RNA, 23 nt, Human
acuuuuguucuugguuuguaaau

SEQ ID NO: 3330168 - RNA, 12 nt, Human
acuuuuguucuu

SEQ ID NO: 3330169 - RNA, 13 nt, Human
acuuuuguucuug

SEQ ID NO: 3330170 - RNA, 21 nt, Human
acuuuguuaguuucuccaagc

SEQ ID NO: 3330171 - RNA, 20 nt, Human
acuuuguuaguuucuccaag

SEQ ID NO: 3330172 - RNA, 18 nt, Human
acuuuguguucaccuugu

SEQ ID NO: 3330173 - RNA, 12 nt, Human
acuuugaccucu

SEQ ID NO: 3330174 - RNA, 13 nt, Human
acuuugaccucug

SEQ ID NO: 3330175 - RNA, 12 nt, Human
ucucaggccagc

SEQ ID NO: 3330176 - RNA, 13 nt, Human
ucucaggccagcu

SEQ ID NO: 3330177 - RNA, 12 nt, Human
ucucaggccaaa

SEQ ID NO: 3330178 - RNA, 10 nt, Human
ucucaggcca

SEQ ID NO: 3330179 - RNA, 17 nt, Human
ucucaggccagcugcuu

SEQ ID NO: 3330180 - RNA, 18 nt, Human
ucucaggccagcugcuug

SEQ ID NO: 3330181 - RNA, 21 nt, Human
ucucaggccagcugcuugggc

SEQ ID NO: 3330182 - RNA, 15 nt, Human
ucuccaagcaggaca

SEQ ID NO: 3330183 - RNA, 16 nt, Human
ucuccaagcaggacau

SEQ ID NO: 3330184 - RNA, 16 nt, Human
ucucauuugucacaca

SEQ ID NO: 3330185 - RNA, 14 nt, Human
ucucauuugucaca

SEQ ID NO: 3330186 - RNA, 23 nt, Human
acuugcagacucuacagaggcca

SEQ ID NO: 3330187 - RNA, 22 nt, Human
acuugcagacucuacagaggcc

SEQ ID NO: 3330188 - RNA, 19 nt, Human
acuugcagacucuacagag

SEQ ID NO: 3330189 - RNA, 23 nt, Human
ucucacuauguugcccaggcagg

SEQ ID NO: 3330190 - RNA, 22 nt, Human
ucucacuauguugcccaggcag

SEQ ID NO: 3330191 - RNA, 21 nt, Human
ucucacuauguugcccaggca

SEQ ID NO: 3330192 - RNA, 20 nt, Human
ucucacuauguugcccaggc

SEQ ID NO: 3330193 - RNA, 18 nt, Human
acuuguggacacagcucu

SEQ ID NO: 3330194 - RNA, 22 nt, Human
acuuguggacacagcucuucuc

SEQ ID NO: 3330195 - RNA, 19 nt, Human
acuuguggacacagcucuu

SEQ ID NO: 3330196 - RNA, 20 nt, Human
acuugucuuuggacccugag

SEQ ID NO: 3330197 - RNA, 18 nt, Human
acuugucuuuggacccug

SEQ ID NO: 3330198 - RNA, 21 nt, Human
acuugucuuuggacccugagg

SEQ ID NO: 3330199 - RNA, 14 nt, Human
ucuacccuggcacu

SEQ ID NO: 3330200 - RNA, 19 nt, Human
ucuacccuggcacuauaau

SEQ ID NO: 3330201 - RNA, 20 nt, Human
ucuacccagcgagcccuggu

SEQ ID NO: 3330202 - RNA, 21 nt, Human
ucuacccuggcacuauaaugu

SEQ ID NO: 3330203 - RNA, 16 nt, Human
acuguucucugcccuc

SEQ ID NO: 3330204 - RNA, 17 nt, Human
acuguucucugcccucc

SEQ ID NO: 3330205 - RNA, 18 nt, Human
acuguucucugcccucca

SEQ ID NO: 3330206 - RNA, 15 nt, Human
acuguucucugcccu

SEQ ID NO: 3330207 - RNA, 16 nt, Human
ucuacagaggccaugg

SEQ ID NO: 3330208 - RNA, 19 nt, Human
ucuacccagcgagcccugg

SEQ ID NO: 3330209 - RNA, 21 nt, Human
ucuacagaggccaugggccuc

SEQ ID NO: 3330210 - RNA, 18 nt, Human
uccugggagugagcuggu

SEQ ID NO: 3330211 - RNA, 21 nt, Human
acuuacuguacaugaaaacac

SEQ ID NO: 3330212 - RNA, 16 nt, Human
acuuacuguacaugaa

SEQ ID NO: 3330213 - RNA, 17 nt, Human
acuuacacuuuaugcac

SEQ ID NO: 3330214 - RNA, 22 nt, Human
acuuacuguacaugaaaacaca

SEQ ID NO: 3330215 - RNA, 15 nt, Human
acuuagguguggggg

SEQ ID NO: 3330216 - RNA, 22 nt, Human
acuuaaucuaaauggaaccacu

SEQ ID NO: 3330217 - RNA, 16 nt, Human
acuuacacuuuaugca

SEQ ID NO: 3330218 - RNA, 17 nt, Human
acuuaaucuaaauggaa

SEQ ID NO: 3330219 - RNA, 19 nt, Human
acuuaaucuaaauggaacc

SEQ ID NO: 3330220 - RNA, 13 nt, Human
acuuaagcacacu

SEQ ID NO: 3330221 - RNA, 20 nt, Human
acuuaaauaaugugaaacug

SEQ ID NO: 3330222 - RNA, 16 nt, Human
ucucacuauguugccc

SEQ ID NO: 3330223 - RNA, 19 nt, Human
ucucacuauguugcccagg

SEQ ID NO: 3330224 - RNA, 17 nt, Human
ucucacuauguugccca

SEQ ID NO: 3330225 - RNA, 23 nt, Human
ucuaugggacucaaugcacugac

SEQ ID NO: 3330226 - RNA, 18 nt, Human
ucuagcauggcugccaau

SEQ ID NO: 3330227 - RNA, 21 nt, Human
ucuaguuugauuaaauucuug

SEQ ID NO: 3330228 - RNA, 23 nt, Human
ucuaguuguuugauucagacagc

SEQ ID NO: 3330229 - RNA, 22 nt, Human
ucuaguuguuugauucagacag

SEQ ID NO: 3330230 - RNA, 15 nt, Human
ucugcuucagccucc

SEQ ID NO: 3330231 - RNA, 14 nt, Human
ucugcuucagccuc

SEQ ID NO: 3330232 - RNA, 13 nt, Human
ucugcuucagccu

SEQ ID NO: 3330233 - RNA, 20 nt, Human
ucugcucacauaucugucau

SEQ ID NO: 3330234 - RNA, 19 nt, Human
ucugcucacauaucuguca

SEQ ID NO: 3330235 - RNA, 17 nt, Human
ucugcucacauaucugu

SEQ ID NO: 3330236 - RNA, 23 nt, Human
ucugcccuugguuaggcauugug

SEQ ID NO: 3330237 - RNA, 22 nt, Human
ucugccgcagcccugcagaggg

SEQ ID NO: 3330238 - RNA, 22 nt, Human
ucugccugcccaggccccugcc

SEQ ID NO: 3330239 - RNA, 21 nt, Human
ucugccugcccaggccccugc

SEQ ID NO: 3330240 - RNA, 18 nt, Human
ucugcccacucccugcaa

SEQ ID NO: 3330241 - RNA, 21 nt, Human
ucugcccacucccugcaaccu

SEQ ID NO: 3330242 - RNA, 18 nt, Human
ucugcccuccaagaccuu

SEQ ID NO: 3330243 - RNA, 19 nt, Human
ucugcccuccaagaccuuc

SEQ ID NO: 3330244 - RNA, 14 nt, Human
ucugccgcagcccu

SEQ ID NO: 3330245 - RNA, 15 nt, Human
ucugccgcagcccug

SEQ ID NO: 3330246 - RNA, 18 nt, Human
agaagauuuugaaauuuu

SEQ ID NO: 3330247 - RNA, 12 nt, Human
agaagcccagga

SEQ ID NO: 3330248 - RNA, 16 nt, Human
agaagcccaggaaagg

SEQ ID NO: 3330249 - RNA, 18 nt, Human
agaagcccaggaaaggcu

SEQ ID NO: 3330250 - RNA, 20 nt, Human
agaagcccaggaaaggcucc

SEQ ID NO: 3330251 - RNA, 21 nt, Human
agaagcccaggaaaggcucca

SEQ ID NO: 3330252 - RNA, 22 nt, Human
agaagcccaggaaaggcuccag

SEQ ID NO: 3330253 - RNA, 16 nt, Human
ucugcccacucccugc

SEQ ID NO: 3330254 - RNA, 17 nt, Human
ucugcccacucccugca

SEQ ID NO: 3330255 - RNA, 21 nt, Human
ucugaucauccacugugccau

SEQ ID NO: 3330256 - RNA, 17 nt, Human
ucugaucauccacugug

SEQ ID NO: 3330257 - RNA, 21 nt, Human
ucugagacucgcgacaaugca

SEQ ID NO: 3330258 - RNA, 14 nt, Human
agaaauguacagca

SEQ ID NO: 3330259 - RNA, 15 nt, Human
agaaauguacagcaa

SEQ ID NO: 3330260 - RNA, 14 nt, Human
ucugcacuccccug

SEQ ID NO: 3330261 - RNA, 15 nt, Human
ucugcacuccccugc

SEQ ID NO: 3330262 - RNA, 16 nt, Human
ucugcacuccccugcu

SEQ ID NO: 3330263 - RNA, 17 nt, Human
ucugcagcaauaaagca

SEQ ID NO: 3330264 - RNA, 13 nt, Human
ucugcacuccccu

SEQ ID NO: 3330265 - RNA, 21 nt, Human
ucugaaggacauugcggacag

SEQ ID NO: 3330266 - RNA, 12 nt, Human
ucugacacacag

SEQ ID NO: 3330267 - RNA, 14 nt, Human
ucugacacacagcu

SEQ ID NO: 3330268 - RNA, 13 nt, Human
ucugacacacagc

SEQ ID NO: 3330269 - RNA, 15 nt, Human
ucugacacacagcuc

SEQ ID NO: 3330270 - RNA, 16 nt, Human
agacaggaccagggau

SEQ ID NO: 3330271 - RNA, 16 nt, Human
agacacauguccaaga

SEQ ID NO: 3330272 - RNA, 18 nt, Human
agacaccuugacagggca

SEQ ID NO: 3330273 - RNA, 17 nt, Human
agacaccuugacagggc

SEQ ID NO: 3330274 - RNA, 13 nt, Human
agacacaggcccg

SEQ ID NO: 3330275 - RNA, 12 nt, Human
agacacaggccc

SEQ ID NO: 3330276 - RNA, 22 nt, Human
ucuguucuuuccaaaguacacu

SEQ ID NO: 3330277 - RNA, 13 nt, Human
ucuguucuuucca

SEQ ID NO: 3330278 - RNA, 17 nt, Human
ucuguuggccaguguga

SEQ ID NO: 3330279 - RNA, 12 nt, Human
ucuguuggccag

SEQ ID NO: 3330280 - RNA, 22 nt, Human
ucugugaaaggaaagagggagg

SEQ ID NO: 3330281 - RNA, 21 nt, Human
agaaguuucugccgcagcccu

SEQ ID NO: 3330282 - RNA, 22 nt, Human
agaaguuucugccgcagcccug

SEQ ID NO: 3330283 - RNA, 12 nt, Human
ucagcuccagcu

SEQ ID NO: 3330284 - RNA, 23 nt, Human
ucagcggggacagcuccuucugu

SEQ ID NO: 3330285 - RNA, 21 nt, Human
ucagcggggacagcuccuucu

SEQ ID NO: 3330286 - RNA, 20 nt, Human
ucagcggggacagcuccuuc

SEQ ID NO: 3330287 - RNA, 19 nt, Human
ucagcggggacagcuccuu

SEQ ID NO: 3330288 - RNA, 18 nt, Human
ucagcggggacagcuccu

SEQ ID NO: 3330289 - RNA, 18 nt, Human
accccaucucuacaaaaa

SEQ ID NO: 3330290 - RNA, 23 nt, Human
acccaggagccccgaggccuucu

SEQ ID NO: 3330291 - RNA, 19 nt, Human
acccaggagccccgaggcc

SEQ ID NO: 3330292 - RNA, 13 nt, Human
accccagccccaa

SEQ ID NO: 3330293 - RNA, 22 nt, Human
accccagccccaaaacucuccu

SEQ ID NO: 3330294 - RNA, 17 nt, Human
accccacacacgccaga

SEQ ID NO: 3330295 - RNA, 21 nt, Human
ucagauuugaacucuucaauc

SEQ ID NO: 3330296 - RNA, 12 nt, Human
ucagauuugaac

SEQ ID NO: 3330297 - RNA, 15 nt, Human
ucagcaaaagaugcu

SEQ ID NO: 3330298 - RNA, 13 nt, Human
acccugaggccca

SEQ ID NO: 3330299 - RNA, 14 nt, Human
acccugaggcccag

SEQ ID NO: 3330300 - RNA, 16 nt, Human
acccugaaagcccuga

SEQ ID NO: 3330301 - RNA, 18 nt, Human
acccugaaagcccugagc

SEQ ID NO: 3330302 - RNA, 20 nt, Human
acccuuguggucccacccca

SEQ ID NO: 3330303 - RNA, 23 nt, Human
acccuuguggucccaccccacac

SEQ ID NO: 3330304 - RNA, 17 nt, Human
acccuugccgucuaccu

SEQ ID NO: 3330305 - RNA, 15 nt, Human
accgaaaacguggcu

SEQ ID NO: 3330306 - RNA, 15 nt, Human
acccugaggcccaga

SEQ ID NO: 3330307 - RNA, 16 nt, Human
acccugaggcccagag

SEQ ID NO: 3330308 - RNA, 15 nt, Human
acccugcccuguggg

SEQ ID NO: 3330309 - RNA, 14 nt, Human
acccugcccugugg

SEQ ID NO: 3330310 - RNA, 17 nt, Human
acccugcccugugggcc

SEQ ID NO: 3330311 - RNA, 22 nt, Human
acccugcccugugggcccccaa

SEQ ID NO: 3330312 - RNA, 18 nt, Human
ucagggucccugguggca

SEQ ID NO: 3330313 - RNA, 19 nt, Human
ucagggucccugguggcag

SEQ ID NO: 3330314 - RNA, 16 nt, Human
ucaggguuggccccug

SEQ ID NO: 3330315 - RNA, 22 nt, Human
ucagcuuguaaauagcucaggu

SEQ ID NO: 3330316 - RNA, 21 nt, Human
ucagcuuguaaauagcucagg

SEQ ID NO: 3330317 - RNA, 14 nt, Human
ucagcuccagcuca

SEQ ID NO: 3330318 - RNA, 20 nt, Human
ucagcuuguaaauagcucag

SEQ ID NO: 3330319 - RNA, 21 nt, Human
ucaggccaggcccucugccca

SEQ ID NO: 3330320 - RNA, 22 nt, Human
ucaggccaggcccucugcccac

SEQ ID NO: 3330321 - RNA, 20 nt, Human
ucaggccaggcccucugccc

SEQ ID NO: 3330322 - RNA, 16 nt, Human
acccggccccugcugg

SEQ ID NO: 3330323 - RNA, 15 nt, Human
acccggccccugcug

SEQ ID NO: 3330324 - RNA, 14 nt, Human
acccggccccugcu

SEQ ID NO: 3330325 - RNA, 22 nt, Human
ucagguaacaggcagauacagg

SEQ ID NO: 3330326 - RNA, 21 nt, Human
ucagguaacaggcagauacag

SEQ ID NO: 3330327 - RNA, 23 nt, Human
ucagguaacaggcagauacagga

SEQ ID NO: 3330328 - RNA, 16 nt, Human
ucagguaacaggcaga

SEQ ID NO: 3330329 - RNA, 20 nt, Human
acccggccccugcugguuca

SEQ ID NO: 3330330 - RNA, 17 nt, Human
acccggccccugcuggu

SEQ ID NO: 3330331 - RNA, 22 nt, Human
acccggccccugcugguucagg

SEQ ID NO: 3330332 - RNA, 12 nt, Human
acccgggaaggg

SEQ ID NO: 3330333 - RNA, 16 nt, Human
ucagugccuuauggaa

SEQ ID NO: 3330334 - RNA, 11 nt, Human
ucaguggcagc

SEQ ID NO: 3330335 - RNA, 12 nt, Human
ucaguggcagcu

SEQ ID NO: 3330336 - RNA, 16 nt, Human
ucaguggcagcugcuu

SEQ ID NO: 3330337 - RNA, 11 nt, Human
ucagugccuua

SEQ ID NO: 3330338 - RNA, 12 nt, Human
ucagugccuuau

SEQ ID NO: 3330339 - RNA, 14 nt, Human
ucagugccuuaugg

SEQ ID NO: 3330340 - RNA, 15 nt, Human
ucagugccuuaugga

SEQ ID NO: 3330341 - RNA, 9 nt, Human
ucagugccu

SEQ ID NO: 3330342 - RNA, 10 nt, Human
ucagugccuu

SEQ ID NO: 3330343 - RNA, 17 nt, Human
accgaaaacguggcugc

SEQ ID NO: 3330344 - RNA, 19 nt, Human
accgaaaacguggcugcuu

SEQ ID NO: 3330345 - RNA, 16 nt, Human
ucagugccaaaaacaa

SEQ ID NO: 3330346 - RNA, 12 nt, Human
ucagugccacua

SEQ ID NO: 3330347 - RNA, 23 nt, Human
ucauauuuacuucuuauacauuu

SEQ ID NO: 3330348 - RNA, 15 nt, Human
ucauauuuacuucuu

SEQ ID NO: 3330349 - RNA, 22 nt, Human
ucauauuuacuucuuauacauu

SEQ ID NO: 3330350 - RNA, 21 nt, Human
ucauaguaugguggcuggguu

SEQ ID NO: 3330351 - RNA, 18 nt, Human
ucauauaagauucauauu

SEQ ID NO: 3330352 - RNA, 19 nt, Human
ucauaguaugguggcuggg

SEQ ID NO: 3330353 - RNA, 18 nt, Human
ucauaguaugguggcugg

SEQ ID NO: 3330354 - RNA, 15 nt, Human
ucauaguaugguggc

SEQ ID NO: 3330355 - RNA, 14 nt, Human
ucauaaccuagccu

SEQ ID NO: 3330356 - RNA, 20 nt, Human
accucccacaaaggagagcu

SEQ ID NO: 3330357 - RNA, 12 nt, Human
accgcagacagg

SEQ ID NO: 3330358 - RNA, 16 nt, Human
accgcagacaggacca

SEQ ID NO: 3330359 - RNA, 23 nt, Human
ucauccacugugccaugugccag

SEQ ID NO: 3330360 - RNA, 16 nt, Human
accacaucuugcucug

SEQ ID NO: 3330361 - RNA, 18 nt, Human
accacaugugcacaugca

SEQ ID NO: 3330362 - RNA, 20 nt, Human
accaccacacccagcccacu

SEQ ID NO: 3330363 - RNA, 15 nt, Human
accaccacacccagc

SEQ ID NO: 3330364 - RNA, 18 nt, Human
accacaucuugcucugcu

SEQ ID NO: 3330365 - RNA, 17 nt, Human
accacaucuugcucugc

SEQ ID NO: 3330366 - RNA, 17 nt, Human
ucacaaaggaugcccaa

SEQ ID NO: 3330367 - RNA, 20 nt, Human
ucacagaugggugcuuggag

SEQ ID NO: 3330368 - RNA, 16 nt, Human
ucacaguucucuccuu

SEQ ID NO: 3330369 - RNA, 20 nt, Human
ucacaguucucuccuucuuc

SEQ ID NO: 3330370 - RNA, 13 nt, Human
ucacagccucuga

SEQ ID NO: 3330371 - RNA, 17 nt, Human
accacuacauucuguua

SEQ ID NO: 3330372 - RNA, 16 nt, Human
accacuacauucuguu

SEQ ID NO: 3330373 - RNA, 15 nt, Human
accacuacauucugu

SEQ ID NO: 3330374 - RNA, 22 nt, Human
accagcgugugacuacuccccc

SEQ ID NO: 3330375 - RNA, 19 nt, Human
accaggaaaggauuuuaua

SEQ ID NO: 3330376 - RNA, 21 nt, Human
accaggaaaggauuuuauaau

SEQ ID NO: 3330377 - RNA, 17 nt, Human
ucacugagacagcccgg

SEQ ID NO: 3330378 - RNA, 21 nt, Human
ucacugagacagcccgggcuc

SEQ ID NO: 3330379 - RNA, 14 nt, Human
ucacugcagccuca

SEQ ID NO: 3330380 - RNA, 16 nt, Human
ucacugagacagcccg

SEQ ID NO: 3330381 - RNA, 13 nt, Human
ucacugcagccuc

SEQ ID NO: 3330382 - RNA, 15 nt, Human
ucacugcagccucaa

SEQ ID NO: 3330383 - RNA, 19 nt, Human
ucacuguugcccaggcugg

SEQ ID NO: 3330384 - RNA, 23 nt, Human
ucacuguugcccaggcuggcgug

SEQ ID NO: 3330385 - RNA, 15 nt, Human
accaguguuguggau

SEQ ID NO: 3330386 - RNA, 17 nt, Human
accaguguuguggauuu

SEQ ID NO: 3330387 - RNA, 10 nt, Human
ucacuugagu

SEQ ID NO: 3330388 - RNA, 21 nt, Human
acauuuuuaagugcugcauuu

SEQ ID NO: 3330389 - RNA, 22 nt, Human
acauuuuuaagugcugcauuua

SEQ ID NO: 3330390 - RNA, 23 nt, Human
acauuuuuaagugcugcauuuaa

SEQ ID NO: 3330391 - RNA, 19 nt, Human
acauuuuuaagugcugcau

SEQ ID NO: 3330392 - RNA, 23 nt, Human
acauuuuucuuagggaaggauac

SEQ ID NO: 3330393 - RNA, 14 nt, Human
acauuuuuuaaaug

SEQ ID NO: 3330394 - RNA, 16 nt, Human
acauuuuuuaaaugca

SEQ ID NO: 3330395 - RNA, 17 nt, Human
acauuuuuuaaaugcac

SEQ ID NO: 3330396 - RNA, 18 nt, Human
acauuuuauuuuauuaug

SEQ ID NO: 3330397 - RNA, 14 nt, Human
acauuuuauuuuau

SEQ ID NO: 3330398 - RNA, 19 nt, Human
acauuuuauuuuauuaugc

SEQ ID NO: 3330399 - RNA, 20 nt, Human
acauuuuauuuuauuaugca

SEQ ID NO: 3330400 - RNA, 22 nt, Human
ucaaguccucuuuucugagagg

SEQ ID NO: 3330401 - RNA, 14 nt, Human
ucaaccagcagaug

SEQ ID NO: 3330402 - RNA, 15 nt, Human
ucaaccauggacuuu

SEQ ID NO: 3330403 - RNA, 20 nt, Human
ucaacugcaucaagauguga

SEQ ID NO: 3330404 - RNA, 17 nt, Human
ucaaccauggacuuuau

SEQ ID NO: 3330405 - RNA, 13 nt, Human
ucaaauuucuaaa

SEQ ID NO: 3330406 - RNA, 23 nt, Human
acauguaauuaaguacuauguau

SEQ ID NO: 3330407 - RNA, 15 nt, Human
acauguccaagaagc

SEQ ID NO: 3330408 - RNA, 14 nt, Human
acauuccugaugcu

SEQ ID NO: 3330409 - RNA, 22 nt, Human
acauguaauuaaguacuaugua

SEQ ID NO: 3330410 - RNA, 21 nt, Human
acauguaauuaaguacuaugu

SEQ ID NO: 3330411 - RNA, 19 nt, Human
acauguaauuaaguacuau

SEQ ID NO: 3330412 - RNA, 17 nt, Human
acauguaauuaaguacu

SEQ ID NO: 3330413 - RNA, 15 nt, Human
acauguaauuaagua

SEQ ID NO: 3330414 - RNA, 15 nt, Human
acaugcuacacacug

SEQ ID NO: 3330415 - RNA, 21 nt, Human
acaugcuacacacugcauguu

SEQ ID NO: 3330416 - RNA, 21 nt, Human
uccugcugcaguugccaguca

SEQ ID NO: 3330417 - RNA, 12 nt, Human
uccugcaggcag

SEQ ID NO: 3330418 - RNA, 13 nt, Human
uccugcaggcagc

SEQ ID NO: 3330419 - RNA, 14 nt, Human
uccugcaggcagcc

SEQ ID NO: 3330420 - RNA, 21 nt, Human
uccugccucgaacuggcugca

SEQ ID NO: 3330421 - RNA, 17 nt, Human
uccugggagugagcugg

SEQ ID NO: 3330422 - RNA, 14 nt, Human
uccugggagugagc

SEQ ID NO: 3330423 - RNA, 12 nt, Human
uccugggaguga

SEQ ID NO: 3330424 - RNA, 15 nt, Human
uccuggaaauauuaa

SEQ ID NO: 3330425 - RNA, 20 nt, Human
acugcacuauagccuaggug

SEQ ID NO: 3330426 - RNA, 16 nt, Human
acugcaccgggccaca

SEQ ID NO: 3330427 - RNA, 14 nt, Human
acugcaccgggcca

SEQ ID NO: 3330428 - RNA, 13 nt, Human
acugauaaagaug

SEQ ID NO: 3330429 - RNA, 21 nt, Human
acugauaaagaugagugagca

SEQ ID NO: 3330430 - RNA, 19 nt, Human
acugcacuccagccugggu

SEQ ID NO: 3330431 - RNA, 20 nt, Human
acugcacuccagccugggug

SEQ ID NO: 3330432 - RNA, 18 nt, Human
acugcacuccagccuggg

SEQ ID NO: 3330433 - RNA, 17 nt, Human
acugcacuccagccugg

SEQ ID NO: 3330434 - RNA, 14 nt, Human
acugcacuccagcc

SEQ ID NO: 3330435 - RNA, 21 nt, Human
acugcacuauagccuagguga

SEQ ID NO: 3330436 - RNA, 20 nt, Human
uccugaugcuucuucagaga

SEQ ID NO: 3330437 - RNA, 19 nt, Human
uccugaugcuucuucagag

SEQ ID NO: 3330438 - RNA, 12 nt, Human
uccucuuuccau

SEQ ID NO: 3330439 - RNA, 11 nt, Human
uccucuuucca

SEQ ID NO: 3330440 - RNA, 14 nt, Human
uccucccucccucu

SEQ ID NO: 3330441 - RNA, 11 nt, Human
uccucccuccc

SEQ ID NO: 3330442 - RNA, 19 nt, Human
uccucuuuggucuacacug

SEQ ID NO: 3330443 - RNA, 21 nt, Human
uccucuuuggucuacacugug

SEQ ID NO: 3330444 - RNA, 19 nt, Human
uccucuuuccaucuacccu

SEQ ID NO: 3330445 - RNA, 22 nt, Human
uccucuuuggucuacacugugc

SEQ ID NO: 3330446 - RNA, 15 nt, Human
acugagacagcccgg

SEQ ID NO: 3330447 - RNA, 18 nt, Human
acugagacagcccgggcu

SEQ ID NO: 3330448 - RNA, 21 nt, Human
acugagacagcccgggcucug

SEQ ID NO: 3330449 - RNA, 22 nt, Human
acugagacagcccgggcucugc

SEQ ID NO: 3330450 - RNA, 23 nt, Human
acugagacagcccgggcucugcc

SEQ ID NO: 3330451 - RNA, 22 nt, Human
uccucauacccacccccaccca

SEQ ID NO: 3330452 - RNA, 22 nt, Human
uccucauaguaugguggcuggg

SEQ ID NO: 3330453 - RNA, 23 nt, Human
uccucauacccacccccacccaa

SEQ ID NO: 3330454 - RNA, 16 nt, Human
acucuugaccucaggu

SEQ ID NO: 3330455 - RNA, 15 nt, Human
acucuugaccucagg

SEQ ID NO: 3330456 - RNA, 14 nt, Human
acucuugaccucag

SEQ ID NO: 3330457 - RNA, 23 nt, Human
acuccuugaaaacacuguucucu

SEQ ID NO: 3330458 - RNA, 24 nt, Human
acuccuugaaaacacuguucucug

SEQ ID NO: 3330459 - RNA, 14 nt, Human
acucuccuccagag

SEQ ID NO: 3330460 - RNA, 17 nt, Human
acucuccuccagaguca

SEQ ID NO: 3330461 - RNA, 18 nt, Human
acucuccuggaaauauua

SEQ ID NO: 3330462 - RNA, 15 nt, Human
acucuccuugguguc

SEQ ID NO: 3330463 - RNA, 21 nt, Human
acucuccucugcugcuggcug

SEQ ID NO: 3330464 - RNA, 13 nt, Human
acucuccucugcu

SEQ ID NO: 3330465 - RNA, 14 nt, Human
acucuccucugcug

SEQ ID NO: 3330466 - RNA, 12 nt, Human
acucuccucugc

SEQ ID NO: 3330467 - RNA, 16 nt, Human
acucuccuuggugucg

SEQ ID NO: 3330468 - RNA, 23 nt, Human
acucuccuuggugucgggcauga

SEQ ID NO: 3330469 - RNA, 11 nt, Human
acucugagacu

SEQ ID NO: 3330470 - RNA, 22 nt, Human
acucugagacucgcgacaaugc

SEQ ID NO: 3330471 - RNA, 13 nt, Human
acucuggcagcuc

SEQ ID NO: 3330472 - RNA, 15 nt, Human
acucuggcagcucag

SEQ ID NO: 3330473 - RNA, 14 nt, Human
uccuacucuguguc

SEQ ID NO: 3330474 - RNA, 13 nt, Human
uccuacucugugu

SEQ ID NO: 3330475 - RNA, 12 nt, Human
uccuacucugug

SEQ ID NO: 3330476 - RNA, 15 nt, Human
uccuacucuguguca

SEQ ID NO: 3330477 - RNA, 14 nt, Human
acuccuggccucaa

SEQ ID NO: 3330478 - RNA, 13 nt, Human
acuccuggccuca

SEQ ID NO: 3330479 - RNA, 13 nt, Human
uccuaggcauuug

SEQ ID NO: 3330480 - RNA, 12 nt, Human
acuccuggccuc

SEQ ID NO: 3330481 - RNA, 23 nt, Human
ucccuuuuuuggcugcugaaggc

SEQ ID NO: 3330482 - RNA, 20 nt, Human
ucccuuuuuuggcugcugaa

SEQ ID NO: 3330483 - RNA, 22 nt, Human
ucccuuuuuuggcugcugaagg

SEQ ID NO: 3330484 - RNA, 19 nt, Human
ucccuuugacgccauccca

SEQ ID NO: 3330485 - RNA, 17 nt, Human
ucccuuuuuuggcugcu

SEQ ID NO: 3330486 - RNA, 19 nt, Human
ucccuuuuuuggcugcuga

SEQ ID NO: 3330487 - RNA, 22 nt, Human
ucccugguggcagcucaccucu

SEQ ID NO: 3330488 - RNA, 19 nt, Human
ucccuuggauuguccccga

SEQ ID NO: 3330489 - RNA, 20 nt, Human
ucccuuggauuguccccgac

SEQ ID NO: 3330490 - RNA, 16 nt, Human
ucccuuugacgccauc

SEQ ID NO: 3330491 - RNA, 18 nt, Human
ucccuuugacgccauccc

SEQ ID NO: 3330492 - RNA, 18 nt, Human
ucccugguggcagcucac

SEQ ID NO: 3330493 - RNA, 19 nt, Human
ucccugguggcagcucacc

SEQ ID NO: 3330494 - RNA, 20 nt, Human
ucccugguggcagcucaccu

SEQ ID NO: 3330495 - RNA, 21 nt, Human
ucccugguggcagcucaccuc

SEQ ID NO: 3330496 - RNA, 16 nt, Human
ucccugguggcagcuc

SEQ ID NO: 3330497 - RNA, 17 nt, Human
ucccugguggcagcuca

SEQ ID NO: 3330498 - RNA, 11 nt, Human
acuccuggccu

SEQ ID NO: 3330499 - RNA, 15 nt, Human
acuccugcaggcagc

SEQ ID NO: 3330500 - RNA, 16 nt, Human
acuccugcaggcagcc

SEQ ID NO: 3330501 - RNA, 22 nt, Human
acuccugcaggcagccaggcca

SEQ ID NO: 3330502 - RNA, 21 nt, Human
acuccugcaggcagccaggcc

SEQ ID NO: 3330503 - RNA, 12 nt, Human
acuccugcaggc

SEQ ID NO: 3330504 - RNA, 14 nt, Human
acuccugcaggcag

SEQ ID NO: 3330505 - RNA, 14 nt, Human
acucaccccagccc

SEQ ID NO: 3330506 - RNA, 15 nt, Human
acucaccccagcccc

SEQ ID NO: 3330507 - RNA, 13 nt, Human
acucaccccagcc

SEQ ID NO: 3330508 - RNA, 23 nt, Human
uccccacccugaaagcccugagc

SEQ ID NO: 3330509 - RNA, 15 nt, Human
uccccaccgcagaca

SEQ ID NO: 3330510 - RNA, 18 nt, Human
uccccaggaggccagccu

SEQ ID NO: 3330511 - RNA, 12 nt, Human
uccccacccuga

SEQ ID NO: 3330512 - RNA, 17 nt, Human
uccccaggaggccagcc

SEQ ID NO: 3330513 - RNA, 20 nt, Human
uccccaggaggccagccuug

SEQ ID NO: 3330514 - RNA, 21 nt, Human
uccccaggaggccagccuuga

SEQ ID NO: 3330515 - RNA, 11 nt, Human
ucccccagccc

SEQ ID NO: 3330516 - RNA, 13 nt, Human
ucccccagcccca

SEQ ID NO: 3330517 - RNA, 15 nt, Human
ucccccagccccauc

SEQ ID NO: 3330518 - RNA, 16 nt, Human
ucccccagccccaucc

SEQ ID NO: 3330519 - RNA, 16 nt, Human
acucaaugcacugaca

SEQ ID NO: 3330520 - RNA, 16 nt, Human
acuauguugcccaggc

SEQ ID NO: 3330521 - RNA, 15 nt, Human
acuauguugcccagg

SEQ ID NO: 3330522 - RNA, 22 nt, Human
acuauggcccuggccuagcaua

SEQ ID NO: 3330523 - RNA, 14 nt, Human
acuauguugcccag

SEQ ID NO: 3330524 - RNA, 21 nt, Human
acuaucuaaauguugaaagau

SEQ ID NO: 3330525 - RNA, 16 nt, Human
acuaucuaaauguuga

SEQ ID NO: 3330526 - RNA, 22 nt, Human
acuauagccuaggugacagagu

SEQ ID NO: 3330527 - RNA, 20 nt, Human
acuauagccuaggugacaga

SEQ ID NO: 3330528 - RNA, 18 nt, Human
acuauagccuaggugaca

SEQ ID NO: 3330529 - RNA, 16 nt, Human
ucccagauacuugggg

SEQ ID NO: 3330530 - RNA, 12 nt, Human
ucccagccccaa

SEQ ID NO: 3330531 - RNA, 18 nt, Human
ucccagauacuugggggg

SEQ ID NO: 3330532 - RNA, 22 nt, Human
acguuucuaaaggcuaccuuug

SEQ ID NO: 3330533 - RNA, 15 nt, Human
acguuucuaaaggcu

SEQ ID NO: 3330534 - RNA, 16 nt, Human
acguuucuaaaggcua

SEQ ID NO: 3330535 - RNA, 14 nt, Human
acguugugcauuug

SEQ ID NO: 3330536 - RNA, 15 nt, Human
acguugugcauuugg

SEQ ID NO: 3330537 - RNA, 13 nt, Human
acguugugcauuu

SEQ ID NO: 3330538 - RNA, 17 nt, Human
acguggcugcuucaagg

SEQ ID NO: 3330539 - RNA, 18 nt, Human
acguggcugcuucaagga

SEQ ID NO: 3330540 - RNA, 19 nt, Human
acguggcugcuucaaggau

SEQ ID NO: 3330541 - RNA, 21 nt, Human
acguggcugcuucaaggaucc

SEQ ID NO: 3330542 - RNA, 17 nt, Human
acgguuuuacugcagcu

SEQ ID NO: 3330543 - RNA, 14 nt, Human
uccagaauuuccca

SEQ ID NO: 3330544 - RNA, 15 nt, Human
uccagaauuucccaa

SEQ ID NO: 3330545 - RNA, 13 nt, Human
uccagacacaugu

SEQ ID NO: 3330546 - RNA, 22 nt, Human
uccaggagcagccacauuccug

SEQ ID NO: 3330547 - RNA, 20 nt, Human
uccaggcugggagagccuuc

SEQ ID NO: 3330548 - RNA, 21 nt, Human
uccaggcugggagagccuucc

SEQ ID NO: 3330549 - RNA, 12 nt, Human
uccaggcuccuu

SEQ ID NO: 3330550 - RNA, 10 nt, Human
uccaggcucc

SEQ ID NO: 3330551 - RNA, 22 nt, Human
accuuuuuuauacauaaacaag

SEQ ID NO: 3330552 - RNA, 14 nt, Human
acgaaagagagaga

SEQ ID NO: 3330553 - RNA, 12 nt, Human
acgaaagagaga

SEQ ID NO: 3330554 - RNA, 23 nt, Human
uccaggcugggagagccuuccag

SEQ ID NO: 3330555 - RNA, 15 nt, Human
acgaauauugcugau

SEQ ID NO: 3330556 - RNA, 18 nt, Human
acgaauauugcugauggu

SEQ ID NO: 3330557 - RNA, 12 nt, Human
acgaacaaaaca

SEQ ID NO: 3330558 - RNA, 13 nt, Human
acgaacaaaacac

SEQ ID NO: 3330559 - RNA, 23 nt, Human
acgaaagagagagaaacaaacuu

SEQ ID NO: 3330560 - RNA, 17 nt, Human
accuuuguccccaccgc

SEQ ID NO: 3330561 - RNA, 18 nt, Human
accuuuguccccaccgca

SEQ ID NO: 3330562 - RNA, 20 nt, Human
accuugaacuggguacuugu

SEQ ID NO: 3330563 - RNA, 13 nt, Human
accuuuuuuauac

SEQ ID NO: 3330564 - RNA, 21 nt, Human
acgaauauugcugauggugca

SEQ ID NO: 3330565 - RNA, 14 nt, Human
acgaauauugcuga

SEQ ID NO: 3330566 - RNA, 21 nt, Human
acgcuacccgggaagggggcu

SEQ ID NO: 3330567 - RNA, 18 nt, Human
acgcuacccgggaagggg

SEQ ID NO: 3330568 - RNA, 15 nt, Human
acgcgcgcacacaca

SEQ ID NO: 3330569 - RNA, 14 nt, Human
acgcgcgcacacac

SEQ ID NO: 3330570 - RNA, 16 nt, Human
acgcuggagugcagug

SEQ ID NO: 3330571 - RNA, 15 nt, Human
acgcuggagugcagu

SEQ ID NO: 3330572 - RNA, 23 nt, Human
acgcuggaccuugaacuggguac

SEQ ID NO: 3330573 - RNA, 20 nt, Human
acgcuggaccuugaacuggg

SEQ ID NO: 3330574 - RNA, 17 nt, Human
acgcuggagugcaguga

SEQ ID NO: 3330575 - RNA, 21 nt, Human
acggagucccaccuuggcugc

SEQ ID NO: 3330576 - RNA, 23 nt, Human
acggagucccaccuuggcugcag

SEQ ID NO: 3330577 - RNA, 13 nt, Human
acgcuggaccuug

SEQ ID NO: 3330578 - RNA, 12 nt, Human
acggccaggcca

SEQ ID NO: 3330579 - RNA, 18 nt, Human
acggcucacugcagccuc

SEQ ID NO: 3330580 - RNA, 17 nt, Human
acggcucacugcagccu

SEQ ID NO: 3330581 - RNA, 15 nt, Human
acggcucacugcagc

SEQ ID NO: 3330582 - RNA, 16 nt, Human
acggcucacugcagcc

SEQ ID NO: 3330583 - RNA, 18 nt, Human
acggcuuuuacuuaaacc

SEQ ID NO: 3330584 - RNA, 14 nt, Human
uccaguaucuugaa

SEQ ID NO: 3330585 - RNA, 15 nt, Human
uccaguaucuugaag

SEQ ID NO: 3330586 - RNA, 16 nt, Human
uccaguaucuugaaga

SEQ ID NO: 3330587 - RNA, 18 nt, Human
uccaguaucuugaagacu

SEQ ID NO: 3330588 - RNA, 22 nt, Human
uccagugaggcucugcccuugg

SEQ ID NO: 3330589 - RNA, 23 nt, Human
uccagugaggcucugcccuuggu

SEQ ID NO: 3330590 - RNA, 15 nt, Human
uccagugaggcucug

SEQ ID NO: 3330591 - RNA, 16 nt, Human
uccagugaggcucugc

SEQ ID NO: 3330592 - RNA, 23 nt, Human
uaacauggacaugaucuucuuua

SEQ ID NO: 3330593 - RNA, 18 nt, Human
uaacauggacaugaucuu

SEQ ID NO: 3330594 - RNA, 16 nt, Human
uaacauggaaguacua

SEQ ID NO: 3330595 - RNA, 13 nt, Human
aauaguuggcuag

SEQ ID NO: 3330596 - RNA, 21 nt, Human
aauaguucagguaacaggcag

SEQ ID NO: 3330597 - RNA, 22 nt, Human
aauaguggugugauuuggggau

SEQ ID NO: 3330598 - RNA, 16 nt, Human
aauaguggugugauuu

SEQ ID NO: 3330599 - RNA, 14 nt, Human
uaacuucaccauau

SEQ ID NO: 3330600 - RNA, 21 nt, Human
uaacuucacauauugauuucc

SEQ ID NO: 3330601 - RNA, 13 nt, Human
uaacuucacauau

SEQ ID NO: 3330602 - RNA, 16 nt, Human
uaacuuucugaaauaa

SEQ ID NO: 3330603 - RNA, 15 nt, Human
uaagagaaaugagcu

SEQ ID NO: 3330604 - RNA, 16 nt, Human
aauaugcacacauuuu

SEQ ID NO: 3330605 - RNA, 17 nt, Human
aauaugcacacauuuuu

SEQ ID NO: 3330606 - RNA, 22 nt, Human
aauaugcacacauuuuuuaaau

SEQ ID NO: 3330607 - RNA, 15 nt, Human
aauaugcacacauuu

SEQ ID NO: 3330608 - RNA, 22 nt, Human
uaagcuguuacugucuucagua

SEQ ID NO: 3330609 - RNA, 18 nt, Human
uaagcacacuugacauca

SEQ ID NO: 3330610 - RNA, 14 nt, Human
uaagauucauauuu

SEQ ID NO: 3330611 - RNA, 16 nt, Human
uaaguacuauguauca

SEQ ID NO: 3330612 - RNA, 13 nt, Human
uaaguacuaugua

SEQ ID NO: 3330613 - RNA, 17 nt, Human
uaaguacuauguaucaa

SEQ ID NO: 3330614 - RNA, 17 nt, Human
uaaguauuaaaacauug

SEQ ID NO: 3330615 - RNA, 20 nt, Human
uaaguauucuuauuuaauga

SEQ ID NO: 3330616 - RNA, 19 nt, Human
uaaguauucuuauuuaaug

SEQ ID NO: 3330617 - RNA, 19 nt, Human
uaaguauuaaaacauugga

SEQ ID NO: 3330618 - RNA, 18 nt, Human
uaaguauuaaaacauugg

SEQ ID NO: 3330619 - RNA, 17 nt, Human
aaucauuaggugugacu

SEQ ID NO: 3330620 - RNA, 23 nt, Human
aaucauuaggugugacugaauuu

SEQ ID NO: 3330621 - RNA, 15 nt, Human
aaucauuagguguga

SEQ ID NO: 3330622 - RNA, 17 nt, Human
uaaugaaugaaacauuu

SEQ ID NO: 3330623 - RNA, 18 nt, Human
uaauacaccacuacauuc

SEQ ID NO: 3330624 - RNA, 19 nt, Human
uaauacaccacuacauucu

SEQ ID NO: 3330625 - RNA, 14 nt, Human
uaauagacaauuua

SEQ ID NO: 3330626 - RNA, 16 nt, Human
uaauagacaauuuauu

SEQ ID NO: 3330627 - RNA, 16 nt, Human
uaauacaccacuacau

SEQ ID NO: 3330628 - RNA, 14 nt, Human
uaauacaccacuac

SEQ ID NO: 3330629 - RNA, 18 nt, Human
uaauagacaauuuauuau

SEQ ID NO: 3330630 - RNA, 22 nt, Human
uaauagacaauuuauuauggca

SEQ ID NO: 3330631 - RNA, 18 nt, Human
uaaugucacaggcagguc

SEQ ID NO: 3330632 - RNA, 17 nt, Human
uaaugucacaggcaggu

SEQ ID NO: 3330633 - RNA, 13 nt, Human
uaauguacugcau

SEQ ID NO: 3330634 - RNA, 17 nt, Human
aaugaaaccugugucuc

SEQ ID NO: 3330635 - RNA, 17 nt, Human
aaugaaagacuguacaa

SEQ ID NO: 3330636 - RNA, 16 nt, Human
aaugaaagacuguaca

SEQ ID NO: 3330637 - RNA, 17 nt, Human
aaugaaacauuuuguca

SEQ ID NO: 3330638 - RNA, 22 nt, Human
aaugaaugucagugugacugau

SEQ ID NO: 3330639 - RNA, 15 nt, Human
aaugaccuuucaaua

SEQ ID NO: 3330640 - RNA, 13 nt, Human
aaugaaugucagu

SEQ ID NO: 3330641 - RNA, 20 nt, Human
aauguauguguaaguauucu

SEQ ID NO: 3330642 - RNA, 17 nt, Human
aaugugaaaagaaaaau

SEQ ID NO: 3330643 - RNA, 19 nt, Human
aauguauguguaaguauuc

SEQ ID NO: 3330644 - RNA, 15 nt, Human
aaugugaaacuggau

SEQ ID NO: 3330645 - RNA, 14 nt, Human
aaugugaaacugga

SEQ ID NO: 3330646 - RNA, 19 nt, Human
aaugugaaaagaaaaauga

SEQ ID NO: 3330647 - RNA, 24 nt, Human
uacauaaugcgugcauaccacuuu

SEQ ID NO: 3330648 - RNA, 21 nt, Human
uacauaaugcgugcauaccac

SEQ ID NO: 3330649 - RNA, 23 nt, Human
uacauaaugcgugcauaccacuu

SEQ ID NO: 3330650 - RNA, 16 nt, Human
uacaggugugagucac

SEQ ID NO: 3330651 - RNA, 13 nt, Human
uacauucuguuaa

SEQ ID NO: 3330652 - RNA, 12 nt, Human
uacauucuguua

SEQ ID NO: 3330653 - RNA, 21 nt, Human
aauguucucucuucuccaccu

SEQ ID NO: 3330654 - RNA, 16 nt, Human
aauggcagccuuggca

SEQ ID NO: 3330655 - RNA, 12 nt, Human
aauggcagccuu

SEQ ID NO: 3330656 - RNA, 22 nt, Human
uacagacaacaaaccuguuucu

SEQ ID NO: 3330657 - RNA, 19 nt, Human
uacagacaaagcguggugg

SEQ ID NO: 3330658 - RNA, 18 nt, Human
uacagaggccaugggccu

SEQ ID NO: 3330659 - RNA, 21 nt, Human
uacacauuuuauuuuauuaug

SEQ ID NO: 3330660 - RNA, 22 nt, Human
uacacauuuuauuuuauuaugc

SEQ ID NO: 3330661 - RNA, 19 nt, Human
uacacauuuuauuuuauua

SEQ ID NO: 3330662 - RNA, 15 nt, Human
uacacuaaaagguga

SEQ ID NO: 3330663 - RNA, 22 nt, Human
aaugcacuuuguucuggcucuu

SEQ ID NO: 3330664 - RNA, 20 nt, Human
aaugcacuuuguucuggcuc

SEQ ID NO: 3330665 - RNA, 21 nt, Human
uacaaugcugugcccuaaagu

SEQ ID NO: 3330666 - RNA, 18 nt, Human
aaugaccuuucaauagga

SEQ ID NO: 3330667 - RNA, 16 nt, Human
aaugaccuuucaauag

SEQ ID NO: 3330668 - RNA, 17 nt, Human
aaugaccuuucaauagg

SEQ ID NO: 3330669 - RNA, 21 nt, Human
aaugcacuuuguucuggcucu

SEQ ID NO: 3330670 - RNA, 16 nt, Human
uacaaugcugugcccu

SEQ ID NO: 3330671 - RNA, 20 nt, Human
aauggaaaugggcagagcag

SEQ ID NO: 3330672 - RNA, 21 nt, Human
aauggaaaugggcagagcaga

SEQ ID NO: 3330673 - RNA, 23 nt, Human
aauggacguguuaugacuccaga

SEQ ID NO: 3330674 - RNA, 20 nt, Human
aauggacuaacuugucuuug

SEQ ID NO: 3330675 - RNA, 21 nt, Human
aauggacguguuaugacucca

SEQ ID NO: 3330676 - RNA, 11 nt, Human
aaugcccagcc

SEQ ID NO: 3330677 - RNA, 12 nt, Human
aaugcccagccc

SEQ ID NO: 3330678 - RNA, 22 nt, Human
uacgccaggggaaaaucagccu

SEQ ID NO: 3330679 - RNA, 14 nt, Human
uacguugugcauuu

SEQ ID NO: 3330680 - RNA, 13 nt, Human
uacguacacauuu

SEQ ID NO: 3330681 - RNA, 15 nt, Human
uacguugugcauuug

SEQ ID NO: 3330682 - RNA, 16 nt, Human
uacguugugcauuugg

SEQ ID NO: 3330683 - RNA, 12 nt, Human
uacguacacauu

SEQ ID NO: 3330684 - RNA, 18 nt, Human
uacgggaggguaaggcug

SEQ ID NO: 3330685 - RNA, 23 nt, Human
uacucuccuggaaauauuaagaa

SEQ ID NO: 3330686 - RNA, 22 nt, Human
uacucuccuggaaauauuaaga

SEQ ID NO: 3330687 - RNA, 13 nt, Human
uacuauguaucaa

SEQ ID NO: 3330688 - RNA, 12 nt, Human
uacuauguauca

SEQ ID NO: 3330689 - RNA, 23 nt, Human
uacuauggcccuggccuagcaua

SEQ ID NO: 3330690 - RNA, 17 nt, Human
uacuacuccuguaggaa

SEQ ID NO: 3330691 - RNA, 13 nt, Human
uacuacuccugua

SEQ ID NO: 3330692 - RNA, 16 nt, Human
uacuggagaaaaugga

SEQ ID NO: 3330693 - RNA, 12 nt, Human
uacucuguguca

SEQ ID NO: 3330694 - RNA, 19 nt, Human
uacuguaauuugugauaca

SEQ ID NO: 3330695 - RNA, 20 nt, Human
uacuguaauuugugauacaa

SEQ ID NO: 3330696 - RNA, 18 nt, Human
uacuguaauuugugauac

SEQ ID NO: 3330697 - RNA, 21 nt, Human
uacuguacaugaaaacacauu

SEQ ID NO: 3330698 - RNA, 22 nt, Human
uacuguacaugaaaacacauuu

SEQ ID NO: 3330699 - RNA, 18 nt, Human
uacuguacaugaaaacac

SEQ ID NO: 3330700 - RNA, 17 nt, Human
uacuguaauuugugaua

SEQ ID NO: 3330701 - RNA, 15 nt, Human
aauuagccaagugug

SEQ ID NO: 3330702 - RNA, 13 nt, Human
uaccugucccccu

SEQ ID NO: 3330703 - RNA, 14 nt, Human
uaccugucccccug

SEQ ID NO: 3330704 - RNA, 16 nt, Human
uaccugucccccugac

SEQ ID NO: 3330705 - RNA, 17 nt, Human
uaccugucccccugaca

SEQ ID NO: 3330706 - RNA, 10 nt, Human
uaccuguccc

SEQ ID NO: 3330707 - RNA, 18 nt, Human
uaccugccaggaagccag

SEQ ID NO: 3330708 - RNA, 20 nt, Human
uaccugccaggaagccagca

SEQ ID NO: 3330709 - RNA, 23 nt, Human
uaccugccaggaagccagcaggc

SEQ ID NO: 3330710 - RNA, 16 nt, Human
uaccugccaggaagcc

SEQ ID NO: 3330711 - RNA, 14 nt, Human
aauuccccacccug

SEQ ID NO: 3330712 - RNA, 12 nt, Human
aauuccccagau

SEQ ID NO: 3330713 - RNA, 16 nt, Human
acacaguauuacuucu

SEQ ID NO: 3330714 - RNA, 18 nt, Human
acacaguauuacuucugc

SEQ ID NO: 3330715 - RNA, 19 nt, Human
acacaguauuacuucugcu

SEQ ID NO: 3330716 - RNA, 13 nt, Human
acacagugagucg

SEQ ID NO: 3330717 - RNA, 14 nt, Human
acacacagcucugu

SEQ ID NO: 3330718 - RNA, 13 nt, Human
acacacagcucug

SEQ ID NO: 3330719 - RNA, 17 nt, Human
acacacagcucuguccu

SEQ ID NO: 3330720 - RNA, 17 nt, Human
acacacacauacacgaa

SEQ ID NO: 3330721 - RNA, 21 nt, Human
acacacgcgugcacacaccag

SEQ ID NO: 3330722 - RNA, 20 nt, Human
acacaccagagcccaccuug

SEQ ID NO: 3330723 - RNA, 15 nt, Human
acacaccagagccca

SEQ ID NO: 3330724 - RNA, 14 nt, Human
acacaccagagccc

SEQ ID NO: 3330725 - RNA, 21 nt, Human
acacacugcauguuugugauu

SEQ ID NO: 3330726 - RNA, 16 nt, Human
acacacgcgcgcacac

SEQ ID NO: 3330727 - RNA, 15 nt, Human
acacacgcgcgcaca

SEQ ID NO: 3330728 - RNA, 14 nt, Human
acacacacauacac

SEQ ID NO: 3330729 - RNA, 19 nt, Human
acaaugugaaaagaaaaau

SEQ ID NO: 3330730 - RNA, 17 nt, Human
acaaugugaaaagaaaa

SEQ ID NO: 3330731 - RNA, 22 nt, Human
acaaugcugugcccuaaagugu

SEQ ID NO: 3330732 - RNA, 23 nt, Human
acaaugcugugcccuaaagugua

SEQ ID NO: 3330733 - RNA, 24 nt, Human
acaaugcugugcccuaaaguguau

SEQ ID NO: 3330734 - RNA, 21 nt, Human
acaaugcugugcccuaaagug

SEQ ID NO: 3330735 - RNA, 20 nt, Human
acacucacauuuauucugcu

SEQ ID NO: 3330736 - RNA, 20 nt, Human
acacuaaccacgcuggaccu

SEQ ID NO: 3330737 - RNA, 13 nt, Human
acacgaaagagag

SEQ ID NO: 3330738 - RNA, 15 nt, Human
acacgaaagagagag

SEQ ID NO: 3330739 - RNA, 14 nt, Human
acacgaaagagaga

SEQ ID NO: 3330740 - RNA, 19 nt, Human
acacccugugauggggccc

SEQ ID NO: 3330741 - RNA, 16 nt, Human
acaccgggcacucaga

SEQ ID NO: 3330742 - RNA, 19 nt, Human
acaccucugcacaagcugc

SEQ ID NO: 3330743 - RNA, 21 nt, Human
acaccucugcacaagcugcac

SEQ ID NO: 3330744 - RNA, 18 nt, Human
uaguucagguaacaggca

SEQ ID NO: 3330745 - RNA, 20 nt, Human
uaguuccaccaucaagccac

SEQ ID NO: 3330746 - RNA, 13 nt, Human
acacauuuuauuu

SEQ ID NO: 3330747 - RNA, 14 nt, Human
acacauuuuauuuu

SEQ ID NO: 3330748 - RNA, 19 nt, Human
acacauuuuauuuuauuau

SEQ ID NO: 3330749 - RNA, 20 nt, Human
acacauuuuauuuuauuaug

SEQ ID NO: 3330750 - RNA, 21 nt, Human
acacaugagcaucaggccagg

SEQ ID NO: 3330751 - RNA, 18 nt, Human
acaagaccacguuucuaa

SEQ ID NO: 3330752 - RNA, 17 nt, Human
acaaugacuuacuguac

SEQ ID NO: 3330753 - RNA, 18 nt, Human
acaaugacuuacuguaca

SEQ ID NO: 3330754 - RNA, 12 nt, Human
acaaugacuuac

SEQ ID NO: 3330755 - RNA, 21 nt, Human
uagggaaggauacaaaagcau

SEQ ID NO: 3330756 - RNA, 16 nt, Human
uaggcauuugcugaau

SEQ ID NO: 3330757 - RNA, 20 nt, Human
uaggcauuugcugaauacag

SEQ ID NO: 3330758 - RNA, 14 nt, Human
uaggcauuguggga

SEQ ID NO: 3330759 - RNA, 11 nt, Human
acaaaagcaug

SEQ ID NO: 3330760 - RNA, 22 nt, Human
acaaaagcaugugagacugguu

SEQ ID NO: 3330761 - RNA, 22 nt, Human
acaaaggaugcccaaagaugca

SEQ ID NO: 3330762 - RNA, 19 nt, Human
uagauauaugcucugcaug

SEQ ID NO: 3330763 - RNA, 15 nt, Human
uagauauaugcucug

SEQ ID NO: 3330764 - RNA, 21 nt, Human
uagccaaggccaaaggaagca

SEQ ID NO: 3330765 - RNA, 22 nt, Human
uagcauuuugcuaaaugugaau

SEQ ID NO: 3330766 - RNA, 14 nt, Human
uagccaaggccaaa

SEQ ID NO: 3330767 - RNA, 16 nt, Human
uagcauuuugcuaaau

SEQ ID NO: 3330768 - RNA, 19 nt, Human
uagcauggcugccaauggg

SEQ ID NO: 3330769 - RNA, 23 nt, Human
acaacacucauugaccugaggcc

SEQ ID NO: 3330770 - RNA, 21 nt, Human
acaacacucauugaccugagg

SEQ ID NO: 3330771 - RNA, 19 nt, Human
acaagaccacguuucuaaa

SEQ ID NO: 3330772 - RNA, 19 nt, Human
acaagacccuugugguccc

SEQ ID NO: 3330773 - RNA, 11 nt, Human
uagccagagga

SEQ ID NO: 3330774 - RNA, 15 nt, Human
uagccagaggagaga

SEQ ID NO: 3330775 - RNA, 22 nt, Human
acaggcauguucucugaggaca

SEQ ID NO: 3330776 - RNA, 20 nt, Human
acaggcauguucucugagga

SEQ ID NO: 3330777 - RNA, 19 nt, Human
acaggcauguucucugagg

SEQ ID NO: 3330778 - RNA, 18 nt, Human
acaggcauguucucugag

SEQ ID NO: 3330779 - RNA, 15 nt, Human
acaggcauguucucu

SEQ ID NO: 3330780 - RNA, 20 nt, Human
uauguggaguucaucuugaa

SEQ ID NO: 3330781 - RNA, 23 nt, Human
acaggaccagggauuuccaugau

SEQ ID NO: 3330782 - RNA, 13 nt, Human
acaggcaggucca

SEQ ID NO: 3330783 - RNA, 14 nt, Human
acaggaucagucug

SEQ ID NO: 3330784 - RNA, 16 nt, Human
acaggagugagcacua

SEQ ID NO: 3330785 - RNA, 16 nt, Human
acaggcagguccaggg

SEQ ID NO: 3330786 - RNA, 14 nt, Human
acaggcagguccag

SEQ ID NO: 3330787 - RNA, 14 nt, Human
acaggcauguucuc

SEQ ID NO: 3330788 - RNA, 13 nt, Human
acagcuaacaugg

SEQ ID NO: 3330789 - RNA, 16 nt, Human
acaggaaaagcugcug

SEQ ID NO: 3330790 - RNA, 15 nt, Human
acaggaaaagcugcu

SEQ ID NO: 3330791 - RNA, 17 nt, Human
acaggaaaagcugcuga

SEQ ID NO: 3330792 - RNA, 13 nt, Human
acaggaaguacug

SEQ ID NO: 3330793 - RNA, 14 nt, Human
uauucaggaagcuc

SEQ ID NO: 3330794 - RNA, 20 nt, Human
uauucaguaauaacucuacc

SEQ ID NO: 3330795 - RNA, 14 nt, Human
uauuacuucugcua

SEQ ID NO: 3330796 - RNA, 13 nt, Human
uauuacuucugcu

SEQ ID NO: 3330797 - RNA, 12 nt, Human
acagggcacacc

SEQ ID NO: 3330798 - RNA, 22 nt, Human
acaggcugggcuucaguggcag

SEQ ID NO: 3330799 - RNA, 21 nt, Human
acaggcugggcuucaguggca

SEQ ID NO: 3330800 - RNA, 23 nt, Human
acaggcugggcuucaguggcagc

SEQ ID NO: 3330801 - RNA, 14 nt, Human
uaucucccccagcc

SEQ ID NO: 3330802 - RNA, 13 nt, Human
uaucucccccagc

SEQ ID NO: 3330803 - RNA, 15 nt, Human
uaucucagggccugg

SEQ ID NO: 3330804 - RNA, 18 nt, Human
acagagaaaguacuucuc

SEQ ID NO: 3330805 - RNA, 11 nt, Human
acagagaaagu

SEQ ID NO: 3330806 - RNA, 20 nt, Human
acagaaaauggaagacagcu

SEQ ID NO: 3330807 - RNA, 13 nt, Human
acagaaauguaca

SEQ ID NO: 3330808 - RNA, 17 nt, Human
acagaaaauucuucucc

SEQ ID NO: 3330809 - RNA, 14 nt, Human
acagaaauguacag

SEQ ID NO: 3330810 - RNA, 16 nt, Human
acagaaauguacagca

SEQ ID NO: 3330811 - RNA, 17 nt, Human
acagaaauguacagcaa

SEQ ID NO: 3330812 - RNA, 13 nt, Human
acagacccugccc

SEQ ID NO: 3330813 - RNA, 14 nt, Human
acagacccugcccu

SEQ ID NO: 3330814 - RNA, 15 nt, Human
acagacccugcccug

SEQ ID NO: 3330815 - RNA, 18 nt, Human
acagcccgggcucugccu

SEQ ID NO: 3330816 - RNA, 19 nt, Human
acagcccgggcucugccuc

SEQ ID NO: 3330817 - RNA, 16 nt, Human
acagcaaggagauuua

SEQ ID NO: 3330818 - RNA, 21 nt, Human
acagcaaggagauuuacaacu

SEQ ID NO: 3330819 - RNA, 17 nt, Human
acagcccgggcucugcc

SEQ ID NO: 3330820 - RNA, 16 nt, Human
acagcccgggcucugc

SEQ ID NO: 3330821 - RNA, 18 nt, Human
acagagcccacgccccca

SEQ ID NO: 3330822 - RNA, 19 nt, Human
acagagcccacgcccccac

SEQ ID NO: 3330823 - RNA, 15 nt, Human
acagagcccacgccc

SEQ ID NO: 3330824 - RNA, 14 nt, Human
acagagcccacgcc

SEQ ID NO: 3330825 - RNA, 17 nt, Human
acagcaaggagauuuac

SEQ ID NO: 3330826 - RNA, 17 nt, Human
uaugccugggcagaagg

SEQ ID NO: 3330827 - RNA, 23 nt, Human
uaugcauuugaaaauuuugaugu

SEQ ID NO: 3330828 - RNA, 24 nt, Human
uaugcauuugaaaauuuugauguu

SEQ ID NO: 3330829 - RNA, 11 nt, Human
uaugcauuuga

SEQ ID NO: 3330830 - RNA, 18 nt, Human
uauggcuuuugugcauua

SEQ ID NO: 3330831 - RNA, 21 nt, Human
uauggcuuuugugcauuaucu

SEQ ID NO: 3330832 - RNA, 16 nt, Human
uauggcuuuugugcau

SEQ ID NO: 3330833 - RNA, 17 nt, Human
uauggcuuuugugcauu

SEQ ID NO: 3330834 - RNA, 15 nt, Human
uaugcuuauacacuu

SEQ ID NO: 3330835 - RNA, 19 nt, Human
guucuagcauggcugccaa

SEQ ID NO: 3330836 - RNA, 13 nt, Human
guucucuccuucu

SEQ ID NO: 3330837 - RNA, 13 nt, Human
guucucugcccuc

SEQ ID NO: 3330838 - RNA, 15 nt, Human
guucucugcccucca

SEQ ID NO: 3330839 - RNA, 15 nt, Human
guucucucuucucca

SEQ ID NO: 3330840 - RNA, 12 nt, Human
guucucugagga

SEQ ID NO: 3330841 - RNA, 13 nt, Human
guucuuaauucuu

SEQ ID NO: 3330842 - RNA, 17 nt, Human
guucucugcccuccaag

SEQ ID NO: 3330843 - RNA, 18 nt, Human
guucucugcccuccaaga

SEQ ID NO: 3330844 - RNA, 14 nt, Human
guucuuaauucuua

SEQ ID NO: 3330845 - RNA, 17 nt, Human
guucuuaauucuuagcu

SEQ ID NO: 3330846 - RNA, 14 nt, Human
guucuugguuugua

SEQ ID NO: 3330847 - RNA, 15 nt, Human
guucuugguuuguaa

SEQ ID NO: 3330848 - RNA, 14 nt, Human
guugauagcacaga

SEQ ID NO: 3330849 - RNA, 19 nt, Human
guugauagcacagacccug

SEQ ID NO: 3330850 - RNA, 17 nt, Human
aagcucugcuccucucc

SEQ ID NO: 3330851 - RNA, 22 nt, Human
guucccuuugacgccaucccag

SEQ ID NO: 3330852 - RNA, 21 nt, Human
guucccuuuuuuggcugcuga

SEQ ID NO: 3330853 - RNA, 22 nt, Human
guucccuuuuuuggcugcugaa

SEQ ID NO: 3330854 - RNA, 15 nt, Human
aagccuccuccagcc

SEQ ID NO: 3330855 - RNA, 16 nt, Human
aagccucccacgacug

SEQ ID NO: 3330856 - RNA, 22 nt, Human
aagcuaggccuggccagaugca

SEQ ID NO: 3330857 - RNA, 23 nt, Human
guucagcuuguaaauagcucagg

SEQ ID NO: 3330858 - RNA, 18 nt, Human
guucagcuccagcucacc

SEQ ID NO: 3330859 - RNA, 22 nt, Human
guucaggguuggccccugcccg

SEQ ID NO: 3330860 - RNA, 21 nt, Human
guucaggguuggccccugccc

SEQ ID NO: 3330861 - RNA, 20 nt, Human
guucaggguuggccccugcc

SEQ ID NO: 3330862 - RNA, 18 nt, Human
guucagguaacaggcaga

SEQ ID NO: 3330863 - RNA, 17 nt, Human
guucagguaacaggcag

SEQ ID NO: 3330864 - RNA, 21 nt, Human
aagccgugauuuucauugcug

SEQ ID NO: 3330865 - RNA, 19 nt, Human
guuagagguucccuuugac

SEQ ID NO: 3330866 - RNA, 14 nt, Human
aagcacaugccucu

SEQ ID NO: 3330867 - RNA, 15 nt, Human
aagcacaugccucuc

SEQ ID NO: 3330868 - RNA, 16 nt, Human
aagcacaugccucucu

SEQ ID NO: 3330869 - RNA, 19 nt, Human
aagcacaugccucucucag

SEQ ID NO: 3330870 - RNA, 20 nt, Human
aagcacaugccucucucagg

SEQ ID NO: 3330871 - RNA, 16 nt, Human
aagcacacuugacauc

SEQ ID NO: 3330872 - RNA, 16 nt, Human
aagcaccuccugccuc

SEQ ID NO: 3330873 - RNA, 15 nt, Human
aagcaccuccugccu

SEQ ID NO: 3330874 - RNA, 14 nt, Human
aagcaccuccugcc

SEQ ID NO: 3330875 - RNA, 13 nt, Human
aagcaccuccugc

SEQ ID NO: 3330876 - RNA, 21 nt, Human
aagcacaugccucucucaggc

SEQ ID NO: 3330877 - RNA, 17 nt, Human
aagcaccuccugccucg

SEQ ID NO: 3330878 - RNA, 18 nt, Human
aagccaaagcuaggccug

SEQ ID NO: 3330879 - RNA, 17 nt, Human
aagccaaagcuaggccu

SEQ ID NO: 3330880 - RNA, 12 nt, Human
aagcaugugaga

SEQ ID NO: 3330881 - RNA, 11 nt, Human
aagaggcaggg

SEQ ID NO: 3330882 - RNA, 14 nt, Human
aagaggcagggucu

SEQ ID NO: 3330883 - RNA, 21 nt, Human
aagagggagggagggcuccag

SEQ ID NO: 3330884 - RNA, 22 nt, Human
aagagggucugaggaauccaga

SEQ ID NO: 3330885 - RNA, 22 nt, Human
aagauauuuugcuuugugauuu

SEQ ID NO: 3330886 - RNA, 15 nt, Human
gugguuucagaaaug

SEQ ID NO: 3330887 - RNA, 21 nt, Human
gugcugcccugcccaccuggc

SEQ ID NO: 3330888 - RNA, 23 nt, Human
gugcugcccugcccaccuggccu

SEQ ID NO: 3330889 - RNA, 14 nt, Human
gugucaccugaaga

SEQ ID NO: 3330890 - RNA, 18 nt, Human
gugucagguggggcagcu

SEQ ID NO: 3330891 - RNA, 14 nt, Human
gugucagguggggc

SEQ ID NO: 3330892 - RNA, 22 nt, Human
gugucaccugaagacucauucu

SEQ ID NO: 3330893 - RNA, 23 nt, Human
gugugaaccaccacacccagccc

SEQ ID NO: 3330894 - RNA, 19 nt, Human
gugucagguggggcagcuu

SEQ ID NO: 3330895 - RNA, 20 nt, Human
aagaucaaaagguuaauaaa

SEQ ID NO: 3330896 - RNA, 23 nt, Human
aagaucaaaagguuaauaaagua

SEQ ID NO: 3330897 - RNA, 19 nt, Human
aaguuucugccgcagcccu

SEQ ID NO: 3330898 - RNA, 21 nt, Human
aaguuucugccgcagcccugc

SEQ ID NO: 3330899 - RNA, 20 nt, Human
aaguuugagaucagccuggg

SEQ ID NO: 3330900 - RNA, 23 nt, Human
aaguguauuuuuuuacuaauaga

SEQ ID NO: 3330901 - RNA, 13 nt, Human
aagugugguagag

SEQ ID NO: 3330902 - RNA, 20 nt, Human
aagugauccucccaccucag

SEQ ID NO: 3330903 - RNA, 19 nt, Human
aagugauccucccaccuca

SEQ ID NO: 3330904 - RNA, 13 nt, Human
aagugauccuccc

SEQ ID NO: 3330905 - RNA, 20 nt, Human
aagugauucuccugccucag

SEQ ID NO: 3330906 - RNA, 23 nt, Human
aagugauccucccaccucagccu

SEQ ID NO: 3330907 - RNA, 13 nt, Human
uaaaagucuugug

SEQ ID NO: 3330908 - RNA, 19 nt, Human
uaaaaggugaccaaugaug

SEQ ID NO: 3330909 - RNA, 12 nt, Human
uaaaacuuuuua

SEQ ID NO: 3330910 - RNA, 15 nt, Human
uaaaacuuuuuaaaa

SEQ ID NO: 3330911 - RNA, 13 nt, Human
uaaaacccaagug

SEQ ID NO: 3330912 - RNA, 15 nt, Human
uaaaaaugagguacu

SEQ ID NO: 3330913 - RNA, 23 nt, Human
uaaaaaucucaaauuucuaaauc

SEQ ID NO: 3330914 - RNA, 18 nt, Human
aaguaauaugcacacauu

SEQ ID NO: 3330915 - RNA, 20 nt, Human
aaguaauaugcacacauuuu

SEQ ID NO: 3330916 - RNA, 17 nt, Human
aaguaauaugcacacau

SEQ ID NO: 3330917 - RNA, 18 nt, Human
guuuuaaggaugcuugua

SEQ ID NO: 3330918 - RNA, 22 nt, Human
guuuuaaggaugcuuguacaua

SEQ ID NO: 3330919 - RNA, 15 nt, Human
guuuucuguucuuuc

SEQ ID NO: 3330920 - RNA, 16 nt, Human
guuuucuguucuuucu

SEQ ID NO: 3330921 - RNA, 14 nt, Human
guuuucuguucuuu

SEQ ID NO: 3330922 - RNA, 12 nt, Human
guuuucuguucu

SEQ ID NO: 3330923 - RNA, 13 nt, Human
aaguacuauguau

SEQ ID NO: 3330924 - RNA, 17 nt, Human
aaguacuauaauuuacc

SEQ ID NO: 3330925 - RNA, 14 nt, Human
aaguacuauaauuu

SEQ ID NO: 3330926 - RNA, 15 nt, Human
aaguauuauaccuuu

SEQ ID NO: 3330927 - RNA, 18 nt, Human
aaguacuucuccacccug

SEQ ID NO: 3330928 - RNA, 19 nt, Human
aaguacuucuccacccugc

SEQ ID NO: 3330929 - RNA, 16 nt, Human
aaguauuauaccuuuu

SEQ ID NO: 3330930 - RNA, 19 nt, Human
aaguauuauaccuuuuuua

SEQ ID NO: 3330931 - RNA, 19 nt, Human
aaguauucuuauuuaauga

SEQ ID NO: 3330932 - RNA, 21 nt, Human
aaguauucuuauuuaaugaaa

SEQ ID NO: 3330933 - RNA, 23 nt, Human
aaguauucuuauuuaaugaaaga

SEQ ID NO: 3330934 - RNA, 11 nt, Human
guuucagaaau

SEQ ID NO: 3330935 - RNA, 13 nt, Human
guuucagaaaugu

SEQ ID NO: 3330936 - RNA, 16 nt, Human
aaggcugggggaagaa

SEQ ID NO: 3330937 - RNA, 14 nt, Human
aaggcugggggaag

SEQ ID NO: 3330938 - RNA, 19 nt, Human
aaggcugggggaagaagcu

SEQ ID NO: 3330939 - RNA, 22 nt, Human
aaggcugggggaagaagcucuc

SEQ ID NO: 3330940 - RNA, 20 nt, Human
aaggcugucaauuacaggaa

SEQ ID NO: 3330941 - RNA, 12 nt, Human
aagggggcuggg

SEQ ID NO: 3330942 - RNA, 23 nt, Human
aagggggcugggacaugggaaag

SEQ ID NO: 3330943 - RNA, 13 nt, Human
aaggggagaguaa

SEQ ID NO: 3330944 - RNA, 21 nt, Human
guuuaagugacugauggcuaa

SEQ ID NO: 3330945 - RNA, 17 nt, Human
aaggaaacccagcucug

SEQ ID NO: 3330946 - RNA, 22 nt, Human
aaggaaacccagcucuggucca

SEQ ID NO: 3330947 - RNA, 23 nt, Human
guuguuugauucagacagcugcc

SEQ ID NO: 3330948 - RNA, 20 nt, Human
guuguuugauucagacagcu

SEQ ID NO: 3330949 - RNA, 16 nt, Human
aaggaaacccagcucu

SEQ ID NO: 3330950 - RNA, 17 nt, Human
guuucaaacuuuacuau

SEQ ID NO: 3330951 - RNA, 16 nt, Human
gugcucugaucaucca

SEQ ID NO: 3330952 - RNA, 13 nt, Human
gugcucuggacag

SEQ ID NO: 3330953 - RNA, 12 nt, Human
gugcugcccugc

SEQ ID NO: 3330954 - RNA, 13 nt, Human
gugcugcccugcc

SEQ ID NO: 3330955 - RNA, 14 nt, Human
gugcugcccugccc

SEQ ID NO: 3330956 - RNA, 15 nt, Human
gugcugcccugccca

SEQ ID NO: 3330957 - RNA, 15 nt, Human
gugcuaucuccccca

SEQ ID NO: 3330958 - RNA, 18 nt, Human
gugcuaucucccccagcc

SEQ ID NO: 3330959 - RNA, 21 nt, Human
aacuuuaccuuuuuuauacau

SEQ ID NO: 3330960 - RNA, 22 nt, Human
aacuuuaccuuuuuuauacaua

SEQ ID NO: 3330961 - RNA, 23 nt, Human
aacuuuaccuuuuuuauacauaa

SEQ ID NO: 3330962 - RNA, 13 nt, Human
aagaaaaagaaaa

SEQ ID NO: 3330963 - RNA, 19 nt, Human
aagaaaaaauauuuucccu

SEQ ID NO: 3330964 - RNA, 17 nt, Human
aagaaaaaugagccugg

SEQ ID NO: 3330965 - RNA, 18 nt, Human
aagaaaaaugagccuggc

SEQ ID NO: 3330966 - RNA, 21 nt, Human
aagaaaauaguggugugauuu

SEQ ID NO: 3330967 - RNA, 15 nt, Human
aagaaaauaguggug

SEQ ID NO: 3330968 - RNA, 16 nt, Human
aagaaaauaccaagga

SEQ ID NO: 3330969 - RNA, 17 nt, Human
gugcauuugaggucugu

SEQ ID NO: 3330970 - RNA, 19 nt, Human
gugcauuugaggucuguuc

SEQ ID NO: 3330971 - RNA, 21 nt, Human
gugcauuuggugguuucagaa

SEQ ID NO: 3330972 - RNA, 15 nt, Human
gugcauuuggugguu

SEQ ID NO: 3330973 - RNA, 23 nt, Human
gugccaaaaacaacaacaaaaug

SEQ ID NO: 3330974 - RNA, 18 nt, Human
gugcaaugaccuuucaau

SEQ ID NO: 3330975 - RNA, 13 nt, Human
gugcacaagcucc

SEQ ID NO: 3330976 - RNA, 16 nt, Human
gugcacaagcuccaag

SEQ ID NO: 3330977 - RNA, 21 nt, Human
gugcacaagcuccaagcuccc

SEQ ID NO: 3330978 - RNA, 21 nt, Human
gugcacaugcacgugugugca

SEQ ID NO: 3330979 - RNA, 23 nt, Human
gugauccucccaccucagccucc

SEQ ID NO: 3330980 - RNA, 22 nt, Human
aacuucacauauugauuuccgu

SEQ ID NO: 3330981 - RNA, 22 nt, Human
aacuucaccauauuaccacaga

SEQ ID NO: 3330982 - RNA, 14 nt, Human
aacuucacauauug

SEQ ID NO: 3330983 - RNA, 13 nt, Human
aacuucacauauu

SEQ ID NO: 3330984 - RNA, 13 nt, Human
aacgucugugcca

SEQ ID NO: 3330985 - RNA, 17 nt, Human
aacuagggaagauaaua

SEQ ID NO: 3330986 - RNA, 12 nt, Human
aacguggcugcu

SEQ ID NO: 3330987 - RNA, 13 nt, Human
aacguggcugcuu

SEQ ID NO: 3330988 - RNA, 14 nt, Human
gucugacaggcaau

SEQ ID NO: 3330989 - RNA, 13 nt, Human
gucugacaggcaa

SEQ ID NO: 3330990 - RNA, 12 nt, Human
gucugacaggca

SEQ ID NO: 3330991 - RNA, 18 nt, Human
gucugacaggcaaugcug

SEQ ID NO: 3330992 - RNA, 15 nt, Human
gucugacaggcaaug

SEQ ID NO: 3330993 - RNA, 23 nt, Human
gucucuuuaaugucacaggcagg

SEQ ID NO: 3330994 - RNA, 17 nt, Human
gucucaaaaaaagaaaa

SEQ ID NO: 3330995 - RNA, 14 nt, Human
gucucaaaaaaaca

SEQ ID NO: 3330996 - RNA, 16 nt, Human
gucuggaaugcagugg

SEQ ID NO: 3330997 - RNA, 15 nt, Human
gucuggaaugcagug

SEQ ID NO: 3330998 - RNA, 21 nt, Human
gucuuaaaaaguggaaaaaua

SEQ ID NO: 3330999 - RNA, 14 nt, Human
gugaggcucugccc

SEQ ID NO: 3331000 - RNA, 15 nt, Human
gugaggcucugcccu

SEQ ID NO: 3331001 - RNA, 16 nt, Human
gugaggcucugcccuu

SEQ ID NO: 3331002 - RNA, 17 nt, Human
gugaggcucugcccuug

SEQ ID NO: 3331003 - RNA, 12 nt, Human
gugaggcucugc

SEQ ID NO: 3331004 - RNA, 13 nt, Human
gugaggcucugcc

SEQ ID NO: 3331005 - RNA, 18 nt, Human
gugagacucugucucaaa

SEQ ID NO: 3331006 - RNA, 19 nt, Human
aacucuccucugcugcugg

SEQ ID NO: 3331007 - RNA, 21 nt, Human
aacucuccucugcugcuggcu

SEQ ID NO: 3331008 - RNA, 21 nt, Human
gugaguacuacaguccuccca

SEQ ID NO: 3331009 - RNA, 17 nt, Human
aacucuccucugcugcu

SEQ ID NO: 3331010 - RNA, 23 nt, Human
gugaguacuacaguccucccauc

SEQ ID NO: 3331011 - RNA, 17 nt, Human
gugagucaccaagccca

SEQ ID NO: 3331012 - RNA, 18 nt, Human
gugaggcucugcccuugg

SEQ ID NO: 3331013 - RNA, 22 nt, Human
aacucuccucugcugcuggcug

SEQ ID NO: 3331014 - RNA, 23 nt, Human
aacucuccucugcugcuggcugg

SEQ ID NO: 3331015 - RNA, 20 nt, Human
aacugauuuuuuuuuccuuc

SEQ ID NO: 3331016 - RNA, 21 nt, Human
aacugauuuuuuuuuccuuca

SEQ ID NO: 3331017 - RNA, 22 nt, Human
aacugauuuuuuuuuccuucag

SEQ ID NO: 3331018 - RNA, 16 nt, Human
aacugcauuggcuuug

SEQ ID NO: 3331019 - RNA, 19 nt, Human
gugacaugucuuuucuugc

SEQ ID NO: 3331020 - RNA, 16 nt, Human
gugagacucugucuca

SEQ ID NO: 3331021 - RNA, 14 nt, Human
gugagacucugucu

SEQ ID NO: 3331022 - RNA, 22 nt, Human
gugagacccugucucaaaaaaa

SEQ ID NO: 3331023 - RNA, 22 nt, Human
gugacagagugagacucugucu

SEQ ID NO: 3331024 - RNA, 20 nt, Human
gugacagagugagacucugu

SEQ ID NO: 3331025 - RNA, 23 nt, Human
gugacagaggcagccccauucug

SEQ ID NO: 3331026 - RNA, 14 nt, Human
gugacaugucuuuu

SEQ ID NO: 3331027 - RNA, 23 nt, Human
gugaauaauacaguaucucaggg

SEQ ID NO: 3331028 - RNA, 14 nt, Human
gucuaccugagggg

SEQ ID NO: 3331029 - RNA, 13 nt, Human
gucuaccugaggg

SEQ ID NO: 3331030 - RNA, 15 nt, Human
gucuaccugaggggc

SEQ ID NO: 3331031 - RNA, 16 nt, Human
gucuaccugaggggcc

SEQ ID NO: 3331032 - RNA, 22 nt, Human
gucuaugggacucaaugcacug

SEQ ID NO: 3331033 - RNA, 15 nt, Human
gucuaugggacucaa

SEQ ID NO: 3331034 - RNA, 16 nt, Human
gucgaggacagggagg

SEQ ID NO: 3331035 - RNA, 12 nt, Human
gucgaggcagga

SEQ ID NO: 3331036 - RNA, 19 nt, Human
guccugcugcaguugccag

SEQ ID NO: 3331037 - RNA, 17 nt, Human
guccugcugcaguugcc

SEQ ID NO: 3331038 - RNA, 16 nt, Human
guccuggcaugggaau

SEQ ID NO: 3331039 - RNA, 14 nt, Human
guccucuuuucuga

SEQ ID NO: 3331040 - RNA, 23 nt, Human
aacauguaauuaaguacuaugua

SEQ ID NO: 3331041 - RNA, 12 nt, Human
aacauuggauua

SEQ ID NO: 3331042 - RNA, 16 nt, Human
aacauuggauuauccu

SEQ ID NO: 3331043 - RNA, 21 nt, Human
guccggucccugucccagugc

SEQ ID NO: 3331044 - RNA, 18 nt, Human
aacaguccauugaaaggg

SEQ ID NO: 3331045 - RNA, 21 nt, Human
aacacucacauuuauucugcu

SEQ ID NO: 3331046 - RNA, 17 nt, Human
gucauuugagcagggcu

SEQ ID NO: 3331047 - RNA, 17 nt, Human
aacacuguucucugccc

SEQ ID NO: 3331048 - RNA, 18 nt, Human
aacacuguucucugcccu

SEQ ID NO: 3331049 - RNA, 16 nt, Human
aacacuguucucugcc

SEQ ID NO: 3331050 - RNA, 19 nt, Human
aacacaaacgggcucagca

SEQ ID NO: 3331051 - RNA, 19 nt, Human
aaauuucuaaaucuccaaa

SEQ ID NO: 3331052 - RNA, 19 nt, Human
gucccugguggcagcucac

SEQ ID NO: 3331053 - RNA, 18 nt, Human
gucccugguggcagcuca

SEQ ID NO: 3331054 - RNA, 18 nt, Human
gucccuuacgugaguccu

SEQ ID NO: 3331055 - RNA, 19 nt, Human
gucccuuacgugaguccug

SEQ ID NO: 3331056 - RNA, 18 nt, Human
guccccuguuuguuucug

SEQ ID NO: 3331057 - RNA, 22 nt, Human
guccccaccgcagacaggacca

SEQ ID NO: 3331058 - RNA, 18 nt, Human
guccccaccgcagacagg

SEQ ID NO: 3331059 - RNA, 17 nt, Human
guccccaccgcagacag

SEQ ID NO: 3331060 - RNA, 15 nt, Human
gucccaccccacaca

SEQ ID NO: 3331061 - RNA, 21 nt, Human
aaaugucucuuuaaugucaca

SEQ ID NO: 3331062 - RNA, 24 nt, Human
aaaugucuaguuguaacaccauga

SEQ ID NO: 3331063 - RNA, 18 nt, Human
guauucucuccuguaccu

SEQ ID NO: 3331064 - RNA, 13 nt, Human
aaauuucuaaauc

SEQ ID NO: 3331065 - RNA, 15 nt, Human
aaauuucuaaaucuc

SEQ ID NO: 3331066 - RNA, 12 nt, Human
aaauuucuaaau

SEQ ID NO: 3331067 - RNA, 22 nt, Human
gucagguggggcagcuugaggg

SEQ ID NO: 3331068 - RNA, 18 nt, Human
gucagguggggcagcuug

SEQ ID NO: 3331069 - RNA, 17 nt, Human
gucagguggggcagcuu

SEQ ID NO: 3331070 - RNA, 16 nt, Human
gucagguggggcagcu

SEQ ID NO: 3331071 - RNA, 15 nt, Human
gucacugcuuaacuu

SEQ ID NO: 3331072 - RNA, 21 nt, Human
gucacugcuuaacuucacaua

SEQ ID NO: 3331073 - RNA, 21 nt, Human
gucagaaguuucugccgcagc

SEQ ID NO: 3331074 - RNA, 10 nt, Human
gucacugcuu

SEQ ID NO: 3331075 - RNA, 17 nt, Human
gucacugagacagcccg

SEQ ID NO: 3331076 - RNA, 18 nt, Human
gucacugagacagcccgg

SEQ ID NO: 3331077 - RNA, 21 nt, Human
gucacugagacagcccgggcu

SEQ ID NO: 3331078 - RNA, 23 nt, Human
gucacugagacagcccgggcucu

SEQ ID NO: 3331079 - RNA, 22 nt, Human
gucacucuggcagcucagagag

SEQ ID NO: 3331080 - RNA, 14 nt, Human
gucacugagacagc

SEQ ID NO: 3331081 - RNA, 15 nt, Human
gucacugagacagcc

SEQ ID NO: 3331082 - RNA, 16 nt, Human
gucacugagacagccc

SEQ ID NO: 3331083 - RNA, 23 nt, Human
gucacucuggcagcucagagagg

SEQ ID NO: 3331084 - RNA, 15 nt, Human
gucaccaagcccagu

SEQ ID NO: 3331085 - RNA, 12 nt, Human
gucaccaagccc

SEQ ID NO: 3331086 - RNA, 22 nt, Human
gucaccaaaucagcugcuacua

SEQ ID NO: 3331087 - RNA, 22 nt, Human
gucaauuacaggaaguacugga

SEQ ID NO: 3331088 - RNA, 16 nt, Human
gucaauuacaggaagu

SEQ ID NO: 3331089 - RNA, 22 nt, Human
cacagcuucauuuccugugucu

SEQ ID NO: 3331090 - RNA, 21 nt, Human
cacagcuucauuuccuguguc

SEQ ID NO: 3331091 - RNA, 22 nt, Human
cacagcugggguggggaccuca

SEQ ID NO: 3331092 - RNA, 23 nt, Human
cacagcugggguggggaccucag

SEQ ID NO: 3331093 - RNA, 15 nt, Human
cacaggcagguccag

SEQ ID NO: 3331094 - RNA, 14 nt, Human
cacaggcaggucca

SEQ ID NO: 3331095 - RNA, 11 nt, Human
cacaggcaggu

SEQ ID NO: 3331096 - RNA, 13 nt, Human
cacaguccuuacc

SEQ ID NO: 3331097 - RNA, 15 nt, Human
cacaguccuuaccag

SEQ ID NO: 3331098 - RNA, 21 nt, Human
cacaguccuuaccagcagagc

SEQ ID NO: 3331099 - RNA, 21 nt, Human
cacagugagucgaggacaggg

SEQ ID NO: 3331100 - RNA, 22 nt, Human
cacagugagucgaggacaggga

SEQ ID NO: 3331101 - RNA, 15 nt, Human
cacaguucucuccuu

SEQ ID NO: 3331102 - RNA, 14 nt, Human
cacaguucucuccu

SEQ ID NO: 3331103 - RNA, 14 nt, Human
cacauaucugucau

SEQ ID NO: 3331104 - RNA, 16 nt, Human
caagagcccaggccuc

SEQ ID NO: 3331105 - RNA, 17 nt, Human
caagcaccuccugccuc

SEQ ID NO: 3331106 - RNA, 16 nt, Human
caagcaccuccugccu

SEQ ID NO: 3331107 - RNA, 15 nt, Human
caagcaccuccugcc

SEQ ID NO: 3331108 - RNA, 18 nt, Human
caagacucuuuggacacu

SEQ ID NO: 3331109 - RNA, 13 nt, Human
caagagcccaggc

SEQ ID NO: 3331110 - RNA, 14 nt, Human
caagagcccaggcc

SEQ ID NO: 3331111 - RNA, 15 nt, Human
caagagcccaggccu

SEQ ID NO: 3331112 - RNA, 23 nt, Human
caagacgcugugcugcccugccc

SEQ ID NO: 3331113 - RNA, 15 nt, Human
caagacgcugugcug

SEQ ID NO: 3331114 - RNA, 18 nt, Human
caagacgcugugcugccc

SEQ ID NO: 3331115 - RNA, 17 nt, Human
caagaccuucuccuuca

SEQ ID NO: 3331116 - RNA, 18 nt, Human
caagaccuucuccuucac

SEQ ID NO: 3331117 - RNA, 16 nt, Human
caagacgcugugcugc

SEQ ID NO: 3331118 - RNA, 17 nt, Human
caagacgcugugcugcc

SEQ ID NO: 3331119 - RNA, 14 nt, Human
caagaccuucuccu

SEQ ID NO: 3331120 - RNA, 16 nt, Human
caagaccuucuccuuc

SEQ ID NO: 3331121 - RNA, 20 nt, Human
caagaacuuuccaggaaggc

SEQ ID NO: 3331122 - RNA, 13 nt, Human
caacgucugugcc

SEQ ID NO: 3331123 - RNA, 14 nt, Human
caacgucugugcca

SEQ ID NO: 3331124 - RNA, 15 nt, Human
caaccuccugggcua

SEQ ID NO: 3331125 - RNA, 14 nt, Human
caaccuccugggcu

SEQ ID NO: 3331126 - RNA, 20 nt, Human
caacacucauugaccugagg

SEQ ID NO: 3331127 - RNA, 22 nt, Human
caacacucauugaccugaggcc

SEQ ID NO: 3331128 - RNA, 18 nt, Human
caacacucauugaccuga

SEQ ID NO: 3331129 - RNA, 22 nt, Human
caacacucacauuuauucugcu

SEQ ID NO: 3331130 - RNA, 22 nt, Human
caaccccuucgcuccugugucu

SEQ ID NO: 3331131 - RNA, 18 nt, Human
caaggggcccaaauucuu

SEQ ID NO: 3331132 - RNA, 17 nt, Human
caaggggcccaaauucu

SEQ ID NO: 3331133 - RNA, 12 nt, Human
caaggcugcagu

SEQ ID NO: 3331134 - RNA, 23 nt, Human
caaggcugucaauuacaggaagu

SEQ ID NO: 3331135 - RNA, 21 nt, Human
caaggcugucaauuacaggaa

SEQ ID NO: 3331136 - RNA, 14 nt, Human
caaguccucuuuuc

SEQ ID NO: 3331137 - RNA, 14 nt, Human
caaggucauuuuuu

SEQ ID NO: 3331138 - RNA, 20 nt, Human
caaggucauuuuuuuuaaga

SEQ ID NO: 3331139 - RNA, 13 nt, Human
caaggucauuuuu

SEQ ID NO: 3331140 - RNA, 14 nt, Human
caaguuaaauaaau

SEQ ID NO: 3331141 - RNA, 17 nt, Human
caagugagagcugggug

SEQ ID NO: 3331142 - RNA, 15 nt, Human
caagugagagcuggg

SEQ ID NO: 3331143 - RNA, 14 nt, Human
caagugagagcugg

SEQ ID NO: 3331144 - RNA, 21 nt, Human
caaguccucuuuucugagagg

SEQ ID NO: 3331145 - RNA, 19 nt, Human
caagugagacccugucuca

SEQ ID NO: 3331146 - RNA, 18 nt, Human
caagugagagcugggugu

SEQ ID NO: 3331147 - RNA, 19 nt, Human
caagcgauucuucugcuuc

SEQ ID NO: 3331148 - RNA, 22 nt, Human
caagcgauucuucugcuucagc

SEQ ID NO: 3331149 - RNA, 20 nt, Human
caagcgauucuucugcuuca

SEQ ID NO: 3331150 - RNA, 14 nt, Human
caagcaccuccugc

SEQ ID NO: 3331151 - RNA, 14 nt, Human
caagcaggacaugg

SEQ ID NO: 3331152 - RNA, 18 nt, Human
caagcaggacauggacaa

SEQ ID NO: 3331153 - RNA, 22 nt, Human
caagccaccaacauacucccau

SEQ ID NO: 3331154 - RNA, 19 nt, Human
caagcuggucccacucagu

SEQ ID NO: 3331155 - RNA, 17 nt, Human
caagcuggucccacuca

SEQ ID NO: 3331156 - RNA, 17 nt, Human
caauauucgcuguguca

SEQ ID NO: 3331157 - RNA, 17 nt, Human
caaugacuuacuguaca

SEQ ID NO: 3331158 - RNA, 18 nt, Human
caaugacuuacuguacau

SEQ ID NO: 3331159 - RNA, 15 nt, Human
caaugacuuacugua

SEQ ID NO: 3331160 - RNA, 21 nt, Human
caaugaccuuucaauaggaaa

SEQ ID NO: 3331161 - RNA, 23 nt, Human
caaugaccuuucaauaggaaaaa

SEQ ID NO: 3331162 - RNA, 12 nt, Human
caauaggaaaaa

SEQ ID NO: 3331163 - RNA, 13 nt, Human
caauaggaaaaac

SEQ ID NO: 3331164 - RNA, 15 nt, Human
caaugugauaaaacc

SEQ ID NO: 3331165 - RNA, 17 nt, Human
caaugugauaaaacccc

SEQ ID NO: 3331166 - RNA, 16 nt, Human
caauuacaggaaguac

SEQ ID NO: 3331167 - RNA, 23 nt, Human
caauucucauuugucacacacuu

SEQ ID NO: 3331168 - RNA, 20 nt, Human
caaugcacuuuguucuggcu

SEQ ID NO: 3331169 - RNA, 21 nt, Human
caaugcacuuuguucuggcuc

SEQ ID NO: 3331170 - RNA, 15 nt, Human
caaugggagcucaug

SEQ ID NO: 3331171 - RNA, 14 nt, Human
caaugcacuuuguu

SEQ ID NO: 3331172 - RNA, 17 nt, Human
caaugcacuuuguucug

SEQ ID NO: 3331173 - RNA, 12 nt, Human
caaauuucuaaa

SEQ ID NO: 3331174 - RNA, 11 nt, Human
caaauuucuaa

SEQ ID NO: 3331175 - RNA, 19 nt, Human
caaagugcugggauuacag

SEQ ID NO: 3331176 - RNA, 23 nt, Human
caaagugcugggauuacaggugu

SEQ ID NO: 3331177 - RNA, 14 nt, Human
caaacccuucagug

SEQ ID NO: 3331178 - RNA, 20 nt, Human
caaacccuucagugccaaaa

SEQ ID NO: 3331179 - RNA, 15 nt, Human
caaacacauacagga

SEQ ID NO: 3331180 - RNA, 12 nt, Human
caaaauaaaacu

SEQ ID NO: 3331181 - RNA, 15 nt, Human
caaaauguaggguua

SEQ ID NO: 3331182 - RNA, 17 nt, Human
caaagccuccuccagcc

SEQ ID NO: 3331183 - RNA, 18 nt, Human
caaagccuccuccagccg

SEQ ID NO: 3331184 - RNA, 22 nt, Human
caaagccaaagcuaggccuggc

SEQ ID NO: 3331185 - RNA, 17 nt, Human
caaacucaccugccccu

SEQ ID NO: 3331186 - RNA, 18 nt, Human
caaaggguaucaggugcu

SEQ ID NO: 3331187 - RNA, 16 nt, Human
caaaggguaucaggug

SEQ ID NO: 3331188 - RNA, 14 nt, Human
caaaggaagcacau

SEQ ID NO: 3331189 - RNA, 18 nt, Human
caaagcuaggccuggcca

SEQ ID NO: 3331190 - RNA, 19 nt, Human
caaagcuaggccuggccag

SEQ ID NO: 3331191 - RNA, 14 nt, Human
caaagcuaggccug

SEQ ID NO: 3331192 - RNA, 13 nt, Human
caaagcuaggccu

SEQ ID NO: 3331193 - RNA, 12 nt, Human
caaaggaagcac

SEQ ID NO: 3331194 - RNA, 13 nt, Human
caaaggaagcaca

SEQ ID NO: 3331195 - RNA, 13 nt, Human
caaaaaggcagga

SEQ ID NO: 3331196 - RNA, 20 nt, Human
caaaaacauggccuuugcuu

SEQ ID NO: 3331197 - RNA, 16 nt, Human
caaaaaaugcuugcuu

SEQ ID NO: 3331198 - RNA, 23 nt, Human
auuuugggguacccacugcucug

SEQ ID NO: 3331199 - RNA, 22 nt, Human
auuuugggguacccacugcucu

SEQ ID NO: 3331200 - RNA, 21 nt, Human
auuuugggguacccacugcuc

SEQ ID NO: 3331201 - RNA, 19 nt, Human
caaaacucuccucugcugc

SEQ ID NO: 3331202 - RNA, 22 nt, Human
caaaacacacgcgcgcacacac

SEQ ID NO: 3331203 - RNA, 23 nt, Human
caaaacacacgcgcgcacacaca

SEQ ID NO: 3331204 - RNA, 20 nt, Human
caaaacucuccucugcugcu

SEQ ID NO: 3331205 - RNA, 21 nt, Human
caaaacucuccucugcugcug

SEQ ID NO: 3331206 - RNA, 22 nt, Human
caaaacucuccucugcugcugg

SEQ ID NO: 3331207 - RNA, 17 nt, Human
caaaauaaaaaugaggu

SEQ ID NO: 3331208 - RNA, 13 nt, Human
gggaguggccaca

SEQ ID NO: 3331209 - RNA, 15 nt, Human
gggaguggccacaga

SEQ ID NO: 3331210 - RNA, 12 nt, Human
uauuaaauuaug

SEQ ID NO: 3331211 - RNA, 24 nt, Human
uauuaagaaagacuaucuaaaugu

SEQ ID NO: 3331212 - RNA, 13 nt, Human
uauguugcccagg

SEQ ID NO: 3331213 - RNA, 19 nt, Human
uauguugcccaggcagguc

SEQ ID NO: 3331214 - RNA, 16 nt, Human
uauguugcccaggcag

SEQ ID NO: 3331215 - RNA, 22 nt, Human
uauuguuuucaguguacaugga

SEQ ID NO: 3331216 - RNA, 20 nt, Human
uauuguuuucaguguacaug

SEQ ID NO: 3331217 - RNA, 18 nt, Human
uauuguuuucaguguaca

SEQ ID NO: 3331218 - RNA, 12 nt, Human
uauuguuuucag

SEQ ID NO: 3331219 - RNA, 21 nt, Human
uauugauaugcuuauacacuu

SEQ ID NO: 3331220 - RNA, 17 nt, Human
uauucucuccuguaccu

SEQ ID NO: 3331221 - RNA, 17 nt, Human
uauugcugauggugcaa

SEQ ID NO: 3331222 - RNA, 22 nt, Human
uauuggaaauuuguuauaauga

SEQ ID NO: 3331223 - RNA, 14 nt, Human
uauuuuauuaugca

SEQ ID NO: 3331224 - RNA, 17 nt, Human
uauuuuauuaugcauga

SEQ ID NO: 3331225 - RNA, 14 nt, Human
uauuuuuuuacuaa

SEQ ID NO: 3331226 - RNA, 17 nt, Human
uauuuuuuucuuuucuu

SEQ ID NO: 3331227 - RNA, 14 nt, Human
ucaaaaaaagaaaa

SEQ ID NO: 3331228 - RNA, 15 nt, Human
ucaaaaaaagaaaaa

SEQ ID NO: 3331229 - RNA, 22 nt, Human
uauuuucccuauuagagaagag

SEQ ID NO: 3331230 - RNA, 23 nt, Human
ucaaccccuucgcuccugugucu

SEQ ID NO: 3331231 - RNA, 20 nt, Human
ucaaccccuucgcuccugug

SEQ ID NO: 3331232 - RNA, 20 nt, Human
ucaagugauucuccugccuc

SEQ ID NO: 3331233 - RNA, 18 nt, Human
ucaagugauucuccugcc

SEQ ID NO: 3331234 - RNA, 21 nt, Human
ucaauuacaggaaguacugga

SEQ ID NO: 3331235 - RNA, 23 nt, Human
ucaauuacaggaaguacuggaga

SEQ ID NO: 3331236 - RNA, 17 nt, Human
ucacauuuauucugcuc

SEQ ID NO: 3331237 - RNA, 19 nt, Human
ucacauuuauucugcucac

SEQ ID NO: 3331238 - RNA, 18 nt, Human
ucacauuuauucugcuca

SEQ ID NO: 3331239 - RNA, 20 nt, Human
ucaccaaaucagcugcuacu

SEQ ID NO: 3331240 - RNA, 19 nt, Human
ucaccaaaucagcugcuac

SEQ ID NO: 3331241 - RNA, 13 nt, Human
ucaccaagcccag

SEQ ID NO: 3331242 - RNA, 18 nt, Human
ucacaggcagguccaggg

SEQ ID NO: 3331243 - RNA, 17 nt, Human
ucacaggcagguccagg

SEQ ID NO: 3331244 - RNA, 16 nt, Human
ucacaggcagguccag

SEQ ID NO: 3331245 - RNA, 22 nt, Human
ucacaguccuuaccagcagagc

SEQ ID NO: 3331246 - RNA, 23 nt, Human
ucacaguccuuaccagcagagca

SEQ ID NO: 3331247 - RNA, 19 nt, Human
ucacaguccuuaccagcag

SEQ ID NO: 3331248 - RNA, 20 nt, Human
ucaauuacaggaaguacugg

SEQ ID NO: 3331249 - RNA, 19 nt, Human
ucagccucccaaagugcug

SEQ ID NO: 3331250 - RNA, 14 nt, Human
ucagccucccaaag

SEQ ID NO: 3331251 - RNA, 13 nt, Human
ucagccucccaaa

SEQ ID NO: 3331252 - RNA, 22 nt, Human
ucagccucccgaauagcuggga

SEQ ID NO: 3331253 - RNA, 21 nt, Human
ucagccucccgaauagcuggg

SEQ ID NO: 3331254 - RNA, 18 nt, Human
ucagccucccgaguagcu

SEQ ID NO: 3331255 - RNA, 20 nt, Human
ucagccucccgaguagcugg

SEQ ID NO: 3331256 - RNA, 22 nt, Human
ucagccucccgaguagcuggga

SEQ ID NO: 3331257 - RNA, 21 nt, Human
ucagccucccgaguagcuggg

SEQ ID NO: 3331258 - RNA, 20 nt, Human
ucagccucccgaauagcugg

SEQ ID NO: 3331259 - RNA, 18 nt, Human
ucagccugcuccagcugu

SEQ ID NO: 3331260 - RNA, 19 nt, Human
ucagccugcuccagcuguu

SEQ ID NO: 3331261 - RNA, 15 nt, Human
ucagcugaaccuggg

SEQ ID NO: 3331262 - RNA, 16 nt, Human
ucagcugaaccugggu

SEQ ID NO: 3331263 - RNA, 15 nt, Human
ucaggugagaagcag

SEQ ID NO: 3331264 - RNA, 16 nt, Human
ucaggugagaagcaga

SEQ ID NO: 3331265 - RNA, 14 nt, Human
ucagggccuggcuc

SEQ ID NO: 3331266 - RNA, 16 nt, Human
ucagggccuggcucag

SEQ ID NO: 3331267 - RNA, 18 nt, Human
ucacugccaugccagcuu

SEQ ID NO: 3331268 - RNA, 20 nt, Human
ucacucuuauugcccacgcu

SEQ ID NO: 3331269 - RNA, 22 nt, Human
ucaccccggccaccugcggugc

SEQ ID NO: 3331270 - RNA, 13 nt, Human
ucaccagccccag

SEQ ID NO: 3331271 - RNA, 22 nt, Human
ucacucugucgcccagucugga

SEQ ID NO: 3331272 - RNA, 17 nt, Human
ucacucuuauugcccac

SEQ ID NO: 3331273 - RNA, 20 nt, Human
ucacugcuuaacuucacaua

SEQ ID NO: 3331274 - RNA, 14 nt, Human
ucacugcuuaacuu

SEQ ID NO: 3331275 - RNA, 23 nt, Human
ucagaauucucuaguuugauuaa

SEQ ID NO: 3331276 - RNA, 15 nt, Human
ucagaaauguguuau

SEQ ID NO: 3331277 - RNA, 16 nt, Human
ucagaauucucuaguu

SEQ ID NO: 3331278 - RNA, 10 nt, Human
ucagaaaugu

SEQ ID NO: 3331279 - RNA, 13 nt, Human
ucagacagcugcc

SEQ ID NO: 3331280 - RNA, 16 nt, Human
ucauuuccugugucuu

SEQ ID NO: 3331281 - RNA, 13 nt, Human
ucauuuccugugu

SEQ ID NO: 3331282 - RNA, 22 nt, Human
ucauuaggugugacugaauuuc

SEQ ID NO: 3331283 - RNA, 21 nt, Human
ucauucaacccaccugcgucu

SEQ ID NO: 3331284 - RNA, 23 nt, Human
ucaucuuagguuggcaaaaaggc

SEQ ID NO: 3331285 - RNA, 21 nt, Human
ucaggugagaagcagaggaag

SEQ ID NO: 3331286 - RNA, 23 nt, Human
ucaggugccucaagagaaggcaa

SEQ ID NO: 3331287 - RNA, 14 nt, Human
ucaggugcugccau

SEQ ID NO: 3331288 - RNA, 13 nt, Human
ucaggugcugcca

SEQ ID NO: 3331289 - RNA, 21 nt, Human
ucauacccacccccacccaag

SEQ ID NO: 3331290 - RNA, 19 nt, Human
ucaucaccaacgucugugc

SEQ ID NO: 3331291 - RNA, 20 nt, Human
ucaucaccaacgucugugcc

SEQ ID NO: 3331292 - RNA, 21 nt, Human
ucaucaccaacgucugugcca

SEQ ID NO: 3331293 - RNA, 17 nt, Human
uccaccugccagggaca

SEQ ID NO: 3331294 - RNA, 15 nt, Human
uccaccugccaggga

SEQ ID NO: 3331295 - RNA, 18 nt, Human
uccaccugccagggacag

SEQ ID NO: 3331296 - RNA, 21 nt, Human
uccaccugccagggacagagg

SEQ ID NO: 3331297 - RNA, 12 nt, Human
uccacccugcuc

SEQ ID NO: 3331298 - RNA, 16 nt, Human
uccacaagagcccagg

SEQ ID NO: 3331299 - RNA, 17 nt, Human
uccacaagagcccaggc

SEQ ID NO: 3331300 - RNA, 18 nt, Human
uccacaagagcccaggcc

SEQ ID NO: 3331301 - RNA, 15 nt, Human
uccacaagagcccag

SEQ ID NO: 3331302 - RNA, 18 nt, Human
uccacaaguuaaauaaau

SEQ ID NO: 3331303 - RNA, 17 nt, Human
uccacaaguuaaauaaa

SEQ ID NO: 3331304 - RNA, 18 nt, Human
uccaauuuacauacucug

SEQ ID NO: 3331305 - RNA, 17 nt, Human
uccaauuuacauacucu

SEQ ID NO: 3331306 - RNA, 20 nt, Human
uccaaaauaaaacuuuuuaa

SEQ ID NO: 3331307 - RNA, 18 nt, Human
uccaaaauaaaacuuuuu

SEQ ID NO: 3331308 - RNA, 16 nt, Human
uccagguucagcuugu

SEQ ID NO: 3331309 - RNA, 15 nt, Human
uccagguucagcuug

SEQ ID NO: 3331310 - RNA, 18 nt, Human
uccaggugcacaagcucc

SEQ ID NO: 3331311 - RNA, 20 nt, Human
uccaggugcacaagcuccaa

SEQ ID NO: 3331312 - RNA, 21 nt, Human
uccaggugcacaagcuccaag

SEQ ID NO: 3331313 - RNA, 22 nt, Human
uccaggugcacaagcuccaagc

SEQ ID NO: 3331314 - RNA, 23 nt, Human
uccaggggugggacacccuguga

SEQ ID NO: 3331315 - RNA, 15 nt, Human
uccaggugcacaagc

SEQ ID NO: 3331316 - RNA, 17 nt, Human
uccaggagcagccacau

SEQ ID NO: 3331317 - RNA, 18 nt, Human
uccaggagcagccacauu

SEQ ID NO: 3331318 - RNA, 22 nt, Human
uccaggggugggacacccugug

SEQ ID NO: 3331319 - RNA, 17 nt, Human
uccagcucaccagcccc

SEQ ID NO: 3331320 - RNA, 16 nt, Human
uccagcucaccagccc

SEQ ID NO: 3331321 - RNA, 15 nt, Human
uccagcucaccagcc

SEQ ID NO: 3331322 - RNA, 17 nt, Human
uccagcuguucagcugg

SEQ ID NO: 3331323 - RNA, 16 nt, Human
uccaggagcagccaca

SEQ ID NO: 3331324 - RNA, 23 nt, Human
uccagccaaagccuccuccagcc

SEQ ID NO: 3331325 - RNA, 12 nt, Human
ucuugaacuccu

SEQ ID NO: 3331326 - RNA, 15 nt, Human
ucuucuccaggcugu

SEQ ID NO: 3331327 - RNA, 15 nt, Human
ucuucagaucucuaa

SEQ ID NO: 3331328 - RNA, 18 nt, Human
ucuucagaucucuaacuu

SEQ ID NO: 3331329 - RNA, 23 nt, Human
ucuucagaucucuaacuucacca

SEQ ID NO: 3331330 - RNA, 22 nt, Human
ucuuaaauauguggaguucauc

SEQ ID NO: 3331331 - RNA, 22 nt, Human
ucugcugacagacacaggcccg

SEQ ID NO: 3331332 - RNA, 21 nt, Human
ucugcugacagacacaggccc

SEQ ID NO: 3331333 - RNA, 20 nt, Human
ucugcugacagacacaggcc

SEQ ID NO: 3331334 - RNA, 19 nt, Human
ucugcugacagacacaggc

SEQ ID NO: 3331335 - RNA, 19 nt, Human
ucuggaauaaggagaauga

SEQ ID NO: 3331336 - RNA, 15 nt, Human
ucuggaaugcagugg

SEQ ID NO: 3331337 - RNA, 14 nt, Human
ucuggacaggcaug

SEQ ID NO: 3331338 - RNA, 21 nt, Human
ucuggacaggcauguucucug

SEQ ID NO: 3331339 - RNA, 17 nt, Human
ucugcugacagacacag

SEQ ID NO: 3331340 - RNA, 18 nt, Human
ucugcugacagacacagg

SEQ ID NO: 3331341 - RNA, 18 nt, Human
ucugcuccucuccccagc

SEQ ID NO: 3331342 - RNA, 15 nt, Human
ucugccugcccaggc

SEQ ID NO: 3331343 - RNA, 13 nt, Human
ucugccugcccag

SEQ ID NO: 3331344 - RNA, 14 nt, Human
ucugccugcccagg

SEQ ID NO: 3331345 - RNA, 14 nt, Human
ucugucgcccaguc

SEQ ID NO: 3331346 - RNA, 19 nt, Human
ucuguccuacucuguguca

SEQ ID NO: 3331347 - RNA, 15 nt, Human
ucuguccuacucugu

SEQ ID NO: 3331348 - RNA, 21 nt, Human
ucuguccugggagugagcugg

SEQ ID NO: 3331349 - RNA, 16 nt, Human
ucuggugacuuuccuc

SEQ ID NO: 3331350 - RNA, 14 nt, Human
ucuguccuacucug

SEQ ID NO: 3331351 - RNA, 18 nt, Human
ucuggcucuuccaggcug

SEQ ID NO: 3331352 - RNA, 23 nt, Human
ucuggcucuuccaggcugggaga

SEQ ID NO: 3331353 - RNA, 23 nt, Human
ucuggugacuuuccucuuugguc

SEQ ID NO: 3331354 - RNA, 13 nt, Human
ucugggacacagu

SEQ ID NO: 3331355 - RNA, 14 nt, Human
ucugggacacaguu

SEQ ID NO: 3331356 - RNA, 19 nt, Human
ucuggcuaugcauuugaaa

SEQ ID NO: 3331357 - RNA, 22 nt, Human
ucuggcuaugcauuugaaaauu

SEQ ID NO: 3331358 - RNA, 17 nt, Human
ucuggcuaugcauuuga

SEQ ID NO: 3331359 - RNA, 13 nt, Human
ucugacccacugc

SEQ ID NO: 3331360 - RNA, 22 nt, Human
ucugacaggcaaugcuggcugu

SEQ ID NO: 3331361 - RNA, 21 nt, Human
ucugacaggcaaugcuggcug

SEQ ID NO: 3331362 - RNA, 12 nt, Human
ucugacaggcaa

SEQ ID NO: 3331363 - RNA, 19 nt, Human
ucugacacacagcucuguc

SEQ ID NO: 3331364 - RNA, 18 nt, Human
ucugacacacagcucugu

SEQ ID NO: 3331365 - RNA, 17 nt, Human
ucugacacacagcucug

SEQ ID NO: 3331366 - RNA, 16 nt, Human
ucugacacacagcucu

SEQ ID NO: 3331367 - RNA, 13 nt, Human
ucugaaaauguau

SEQ ID NO: 3331368 - RNA, 23 nt, Human
ucugaggaauccagacccggcug

SEQ ID NO: 3331369 - RNA, 14 nt, Human
ucugacccacugcu

SEQ ID NO: 3331370 - RNA, 20 nt, Human
ucugcaagaauugaagcagg

SEQ ID NO: 3331371 - RNA, 15 nt, Human
ucuccuguaccucuu

SEQ ID NO: 3331372 - RNA, 21 nt, Human
ucuccuggaaauauuaagaaa

SEQ ID NO: 3331373 - RNA, 15 nt, Human
ucuccugccucagcc

SEQ ID NO: 3331374 - RNA, 17 nt, Human
ucuccugccucagccuc

SEQ ID NO: 3331375 - RNA, 14 nt, Human
ucucgugauugaua

SEQ ID NO: 3331376 - RNA, 22 nt, Human
ucucgugauugauaagaaccuu

SEQ ID NO: 3331377 - RNA, 16 nt, Human
ucuccuguaccucuug

SEQ ID NO: 3331378 - RNA, 17 nt, Human
ucuccuguaccucuuga

SEQ ID NO: 3331379 - RNA, 13 nt, Human
ucuccuguaccuc

SEQ ID NO: 3331380 - RNA, 12 nt, Human
ucucuaacuuca

SEQ ID NO: 3331381 - RNA, 19 nt, Human
ucucuaacuucaccauauu

SEQ ID NO: 3331382 - RNA, 17 nt, Human
ucucugaggacacuaac

SEQ ID NO: 3331383 - RNA, 14 nt, Human
ucucugaggacacu

SEQ ID NO: 3331384 - RNA, 15 nt, Human
ucucuaguuugauua

SEQ ID NO: 3331385 - RNA, 16 nt, Human
uccuaaucuucugaac

SEQ ID NO: 3331386 - RNA, 13 nt, Human
uccgaccagacac

SEQ ID NO: 3331387 - RNA, 18 nt, Human
uccuacccacccuccuuu

SEQ ID NO: 3331388 - RNA, 18 nt, Human
uccuauauuguuuucagu

SEQ ID NO: 3331389 - RNA, 22 nt, Human
uccuaguuccaccaucaagcca

SEQ ID NO: 3331390 - RNA, 12 nt, Human
uccucugcugcu

SEQ ID NO: 3331391 - RNA, 14 nt, Human
uccucugcugcugg

SEQ ID NO: 3331392 - RNA, 15 nt, Human
uccucugcugcuggc

SEQ ID NO: 3331393 - RNA, 16 nt, Human
uccucugcugcuggcu

SEQ ID NO: 3331394 - RNA, 16 nt, Human
uccucuguacagagcc

SEQ ID NO: 3331395 - RNA, 17 nt, Human
uccucuguacagagccc

SEQ ID NO: 3331396 - RNA, 18 nt, Human
uccucuguacagagccca

SEQ ID NO: 3331397 - RNA, 15 nt, Human
uccucuguacagagc

SEQ ID NO: 3331398 - RNA, 14 nt, Human
uccucuaggagguc

SEQ ID NO: 3331399 - RNA, 17 nt, Human
uccagguuuaagcuguu

SEQ ID NO: 3331400 - RNA, 18 nt, Human
uccccuguuuguuucuga

SEQ ID NO: 3331401 - RNA, 20 nt, Human
uccccuguuuguuucugaaa

SEQ ID NO: 3331402 - RNA, 21 nt, Human
uccccuguuuguuucugaaag

SEQ ID NO: 3331403 - RNA, 13 nt, Human
ucccugcacuugc

SEQ ID NO: 3331404 - RNA, 14 nt, Human
ucccugcacuugca

SEQ ID NO: 3331405 - RNA, 13 nt, Human
ucccuucccaccu

SEQ ID NO: 3331406 - RNA, 21 nt, Human
ucuaggaagacuuuggaaaga

SEQ ID NO: 3331407 - RNA, 21 nt, Human
ucuaucaaguauuauaccuuu

SEQ ID NO: 3331408 - RNA, 15 nt, Human
ucuaucaaguauuau

SEQ ID NO: 3331409 - RNA, 17 nt, Human
ucucaaauaacuaaaag

SEQ ID NO: 3331410 - RNA, 21 nt, Human
ucuaaaucuccaaaauaaaac

SEQ ID NO: 3331411 - RNA, 16 nt, Human
ucgugauugauaagaa

SEQ ID NO: 3331412 - RNA, 21 nt, Human
uccuucaccuuuguccccacc

SEQ ID NO: 3331413 - RNA, 22 nt, Human
uccuucaccuuuguccccaccg

SEQ ID NO: 3331414 - RNA, 16 nt, Human
uccuuaccagcagagc

SEQ ID NO: 3331415 - RNA, 17 nt, Human
uccuuaccagcagagca

SEQ ID NO: 3331416 - RNA, 18 nt, Human
uccuuaccagcagagcac

SEQ ID NO: 3331417 - RNA, 18 nt, Human
uccuucacagaugggugc

SEQ ID NO: 3331418 - RNA, 18 nt, Human
uccuucaccuuugucccc

SEQ ID NO: 3331419 - RNA, 20 nt, Human
uccuucaccuuuguccccac

SEQ ID NO: 3331420 - RNA, 19 nt, Human
uccuucacagaugggugcu

SEQ ID NO: 3331421 - RNA, 23 nt, Human
uccuuuucacaguucucuccuuc

SEQ ID NO: 3331422 - RNA, 18 nt, Human
uccuggcacugcuuccag

SEQ ID NO: 3331423 - RNA, 22 nt, Human
uccuggcacugcuuccagugag

SEQ ID NO: 3331424 - RNA, 17 nt, Human
uccuggcacugcuucca

SEQ ID NO: 3331425 - RNA, 21 nt, Human
uccuggcacccggccccugcu

SEQ ID NO: 3331426 - RNA, 20 nt, Human
uccuggcacccggccccugc

SEQ ID NO: 3331427 - RNA, 14 nt, Human
uccuuaccagcaga

SEQ ID NO: 3331428 - RNA, 20 nt, Human
uccuguaccucuugagccuu

SEQ ID NO: 3331429 - RNA, 15 nt, Human
uccugccucagccuc

SEQ ID NO: 3331430 - RNA, 13 nt, Human
uccugccucagcc

SEQ ID NO: 3331431 - RNA, 16 nt, Human
uccugccucagccucc

SEQ ID NO: 3331432 - RNA, 19 nt, Human
uccuggcacccggccccug

SEQ ID NO: 3331433 - RNA, 16 nt, Human
uccuggcacccggccc

SEQ ID NO: 3331434 - RNA, 14 nt, Human
uccuggcacccggc

SEQ ID NO: 3331435 - RNA, 13 nt, Human
uccugagccagau

SEQ ID NO: 3331436 - RNA, 14 nt, Human
uccugccucagccu

SEQ ID NO: 3331437 - RNA, 20 nt, Human
ugcaccuggaauauauaacc

SEQ ID NO: 3331438 - RNA, 22 nt, Human
ugcaccuggaauauauaaccag

SEQ ID NO: 3331439 - RNA, 17 nt, Human
ugcaccuggaauauaua

SEQ ID NO: 3331440 - RNA, 19 nt, Human
ugcaccggcuggccuggcc

SEQ ID NO: 3331441 - RNA, 20 nt, Human
ugcaccggcuggccuggccc

SEQ ID NO: 3331442 - RNA, 18 nt, Human
ugcaccggcuggccuggc

SEQ ID NO: 3331443 - RNA, 21 nt, Human
ugcacugacauuguuggccaa

SEQ ID NO: 3331444 - RNA, 18 nt, Human
ugcacugacauuguuggc

SEQ ID NO: 3331445 - RNA, 16 nt, Human
ugcaauggcagccuug

SEQ ID NO: 3331446 - RNA, 15 nt, Human
ugcaauggcagccuu

SEQ ID NO: 3331447 - RNA, 14 nt, Human
ugcaauggcagccu

SEQ ID NO: 3331448 - RNA, 13 nt, Human
ugcaauggcagcc

SEQ ID NO: 3331449 - RNA, 17 nt, Human
ugcaaugaccuuucaau

SEQ ID NO: 3331450 - RNA, 19 nt, Human
ugcaaugaccuuucaauag

SEQ ID NO: 3331451 - RNA, 22 nt, Human
ugcaaugaccuuucaauaggaa

SEQ ID NO: 3331452 - RNA, 23 nt, Human
ugcaaugaccuuucaauaggaaa

SEQ ID NO: 3331453 - RNA, 13 nt, Human
ugcaaugaccuuu

SEQ ID NO: 3331454 - RNA, 16 nt, Human
ugcaaugaccuuucaa

SEQ ID NO: 3331455 - RNA, 17 nt, Human
ugcacaaacagaggccg

SEQ ID NO: 3331456 - RNA, 19 nt, Human
ugcacaaacagaggccgcc

SEQ ID NO: 3331457 - RNA, 20 nt, Human
ugcacaaacagaggccgcca

SEQ ID NO: 3331458 - RNA, 18 nt, Human
ugcacagaguuguuacau

SEQ ID NO: 3331459 - RNA, 19 nt, Human
ugcacagaguuguuacauu

SEQ ID NO: 3331460 - RNA, 17 nt, Human
ugcacagaguuguuaca

SEQ ID NO: 3331461 - RNA, 15 nt, Human
ugcacaaacagaggc

SEQ ID NO: 3331462 - RNA, 16 nt, Human
ugcacaaacagaggcc

SEQ ID NO: 3331463 - RNA, 22 nt, Human
ugcaaccugauugugucucuug

SEQ ID NO: 3331464 - RNA, 21 nt, Human
ugcaaccuccgccucuugggu

SEQ ID NO: 3331465 - RNA, 20 nt, Human
ugcaaccuccgccucuuggg

SEQ ID NO: 3331466 - RNA, 18 nt, Human
ugcaaccuccgccucuug

SEQ ID NO: 3331467 - RNA, 19 nt, Human
ugcaaccugauugugucuc

SEQ ID NO: 3331468 - RNA, 20 nt, Human
ugcaaccugauugugucucu

SEQ ID NO: 3331469 - RNA, 14 nt, Human
ugcaaccuccgccu

SEQ ID NO: 3331470 - RNA, 13 nt, Human
ugcaaccuccgcc

SEQ ID NO: 3331471 - RNA, 20 nt, Human
ugcaacaggcugggcuucag

SEQ ID NO: 3331472 - RNA, 19 nt, Human
ugcaacaggcugggcuuca

SEQ ID NO: 3331473 - RNA, 17 nt, Human
ugcaacaggcugggcuu

SEQ ID NO: 3331474 - RNA, 16 nt, Human
ugcaacaggcugggcu

SEQ ID NO: 3331475 - RNA, 15 nt, Human
ugcaacaggcugggc

SEQ ID NO: 3331476 - RNA, 14 nt, Human
ugcaacaggcuggg

SEQ ID NO: 3331477 - RNA, 13 nt, Human
ugcaacaggcugg

SEQ ID NO: 3331478 - RNA, 13 nt, Human
ugauuuucauugc

SEQ ID NO: 3331479 - RNA, 15 nt, Human
ugauuuucauugcug

SEQ ID NO: 3331480 - RNA, 22 nt, Human
ugauuuuuuuuuccuucagugc

SEQ ID NO: 3331481 - RNA, 23 nt, Human
ugauuuuuuuuuccuucagugcc

SEQ ID NO: 3331482 - RNA, 16 nt, Human
ugauuuuuuuuuccuu

SEQ ID NO: 3331483 - RNA, 17 nt, Human
ugauuuuuuuuuccuuc

SEQ ID NO: 3331484 - RNA, 19 nt, Human
ugauuuuuuuuuccuucag

SEQ ID NO: 3331485 - RNA, 20 nt, Human
ugauuuuuuuuuccuucagu

SEQ ID NO: 3331486 - RNA, 16 nt, Human
ugccugguggcagcug

SEQ ID NO: 3331487 - RNA, 19 nt, Human
ugccugguggcagcugcgg

SEQ ID NO: 3331488 - RNA, 18 nt, Human
ugccugguggcagcugcg

SEQ ID NO: 3331489 - RNA, 17 nt, Human
ugccugguggcagcugc

SEQ ID NO: 3331490 - RNA, 21 nt, Human
ugccucuucucuacucuaggg

SEQ ID NO: 3331491 - RNA, 21 nt, Human
ugccuccuuugugaggaagcc

SEQ ID NO: 3331492 - RNA, 20 nt, Human
ugccuccuuugugaggaagc

SEQ ID NO: 3331493 - RNA, 22 nt, Human
ugccuccuuugugaggaagccg

SEQ ID NO: 3331494 - RNA, 13 nt, Human
ugccucugggacu

SEQ ID NO: 3331495 - RNA, 15 nt, Human
ugccgucuaccugag

SEQ ID NO: 3331496 - RNA, 16 nt, Human
ugccgucuaccugagg

SEQ ID NO: 3331497 - RNA, 17 nt, Human
ugccgucuaccugaggg

SEQ ID NO: 3331498 - RNA, 19 nt, Human
ugccgucuaccugaggggc

SEQ ID NO: 3331499 - RNA, 17 nt, Human
ugcccuaaaguguauuu

SEQ ID NO: 3331500 - RNA, 22 nt, Human
ugcccugcccaccuggccucug

SEQ ID NO: 3331501 - RNA, 23 nt, Human
ugcccugcccaccuggccucugc

SEQ ID NO: 3331502 - RNA, 21 nt, Human
ugcccugcccaccuggccucu

SEQ ID NO: 3331503 - RNA, 12 nt, Human
ugcauuaucuag

SEQ ID NO: 3331504 - RNA, 17 nt, Human
ugcauuaucuagauacu

SEQ ID NO: 3331505 - RNA, 15 nt, Human
ugcauguuugugauu

SEQ ID NO: 3331506 - RNA, 19 nt, Human
ugcauguuacauaagauaa

SEQ ID NO: 3331507 - RNA, 12 nt, Human
ugccaggaagcc

SEQ ID NO: 3331508 - RNA, 16 nt, Human
ugccaggaagccagca

SEQ ID NO: 3331509 - RNA, 18 nt, Human
ugccaggaagccagcagg

SEQ ID NO: 3331510 - RNA, 17 nt, Human
ugccagguuuuuggucu

SEQ ID NO: 3331511 - RNA, 15 nt, Human
ugccauccagguuca

SEQ ID NO: 3331512 - RNA, 12 nt, Human
ugccauccaggu

SEQ ID NO: 3331513 - RNA, 21 nt, Human
ugcccacucccugcaaccuga

SEQ ID NO: 3331514 - RNA, 19 nt, Human
ugcccaccuggccucugca

SEQ ID NO: 3331515 - RNA, 18 nt, Human
ugcccacgcuggagugca

SEQ ID NO: 3331516 - RNA, 20 nt, Human
ugcccaccuggccucugcac

SEQ ID NO: 3331517 - RNA, 12 nt, Human
ugccauguuggc

SEQ ID NO: 3331518 - RNA, 15 nt, Human
ugccauguuggccag

SEQ ID NO: 3331519 - RNA, 14 nt, Human
ugccaugugccagg

SEQ ID NO: 3331520 - RNA, 15 nt, Human
ugccaugugccaggu

SEQ ID NO: 3331521 - RNA, 23 nt, Human
ugccaugaggaacaaggcaaggc

SEQ ID NO: 3331522 - RNA, 20 nt, Human
ugccaugaggaacaaggcaa

SEQ ID NO: 3331523 - RNA, 20 nt, Human
ugaggucuguucuuuccaaa

SEQ ID NO: 3331524 - RNA, 14 nt, Human
ugaggucuguucuu

SEQ ID NO: 3331525 - RNA, 15 nt, Human
ugaggucuguucuuu

SEQ ID NO: 3331526 - RNA, 11 nt, Human
ugaggcugggc

SEQ ID NO: 3331527 - RNA, 15 nt, Human
ugaggugcuauguuc

SEQ ID NO: 3331528 - RNA, 16 nt, Human
ugaggugcuauguucu

SEQ ID NO: 3331529 - RNA, 19 nt, Human
ugagguuucaaaccucccu

SEQ ID NO: 3331530 - RNA, 21 nt, Human
ugaguccccuguuuguuucug

SEQ ID NO: 3331531 - RNA, 19 nt, Human
ugaguccuggcaugggaau

SEQ ID NO: 3331532 - RNA, 22 nt, Human
ugaguccuggcaugggaaugaa

SEQ ID NO: 3331533 - RNA, 14 nt, Human
ugagucgaggacag

SEQ ID NO: 3331534 - RNA, 11 nt, Human
ugaguccuggc

SEQ ID NO: 3331535 - RNA, 18 nt, Human
ugaguccuggcaugggaa

SEQ ID NO: 3331536 - RNA, 20 nt, Human
ugaguccccuguuuguuucu

SEQ ID NO: 3331537 - RNA, 17 nt, Human
ugauagcacagacccug

SEQ ID NO: 3331538 - RNA, 18 nt, Human
ugauagcacagacccugc

SEQ ID NO: 3331539 - RNA, 20 nt, Human
ugauagcacagacccugccc

SEQ ID NO: 3331540 - RNA, 21 nt, Human
ugauagcacagacccugcccu

SEQ ID NO: 3331541 - RNA, 14 nt, Human
ugauagcacagacc

SEQ ID NO: 3331542 - RNA, 15 nt, Human
ugauagcacagaccc

SEQ ID NO: 3331543 - RNA, 16 nt, Human
ugauagcacagacccu

SEQ ID NO: 3331544 - RNA, 22 nt, Human
ugauagcacagacccugcccug

SEQ ID NO: 3331545 - RNA, 23 nt, Human
ugauagcacagacccugcccugu

SEQ ID NO: 3331546 - RNA, 21 nt, Human
ugaguugauagcacagacccu

SEQ ID NO: 3331547 - RNA, 23 nt, Human
ugaguugauagcacagacccugc

SEQ ID NO: 3331548 - RNA, 16 nt, Human
ugagucgaggacaggg

SEQ ID NO: 3331549 - RNA, 15 nt, Human
ugagucgaggacagg

SEQ ID NO: 3331550 - RNA, 16 nt, Human
ugaguugauucagcuc

SEQ ID NO: 3331551 - RNA, 19 nt, Human
ugaguugauucagcucugc

SEQ ID NO: 3331552 - RNA, 22 nt, Human
ugaugaucuuugcagacaggca

SEQ ID NO: 3331553 - RNA, 20 nt, Human
ugaugaugaaaugaggucag

SEQ ID NO: 3331554 - RNA, 23 nt, Human
ugaugaucuuugcagacaggcaa

SEQ ID NO: 3331555 - RNA, 14 nt, Human
ugaugccaugagga

SEQ ID NO: 3331556 - RNA, 20 nt, Human
ugaucuuugcagacaggcaa

SEQ ID NO: 3331557 - RNA, 19 nt, Human
ugaucuuugcagacaggca

SEQ ID NO: 3331558 - RNA, 23 nt, Human
ugaucuuugcagacaggcaagca

SEQ ID NO: 3331559 - RNA, 21 nt, Human
ugaucuuugcagacaggcaag

SEQ ID NO: 3331560 - RNA, 18 nt, Human
ugaucuuugcagacaggc

SEQ ID NO: 3331561 - RNA, 18 nt, Human
ugaugcuucuucagagac

SEQ ID NO: 3331562 - RNA, 19 nt, Human
ugaugcuucuucagagacu

SEQ ID NO: 3331563 - RNA, 21 nt, Human
ugaugcuucuucagagacucc

SEQ ID NO: 3331564 - RNA, 22 nt, Human
ugaugcuucuucagagacuccu

SEQ ID NO: 3331565 - RNA, 19 nt, Human
ugauccacccaccucagcc

SEQ ID NO: 3331566 - RNA, 20 nt, Human
ugauccacccaccucagccu

SEQ ID NO: 3331567 - RNA, 15 nt, Human
ugauccacccaccuc

SEQ ID NO: 3331568 - RNA, 21 nt, Human
ugauccaagcuggucccacuc

SEQ ID NO: 3331569 - RNA, 17 nt, Human
ugauccaagcugguccc

SEQ ID NO: 3331570 - RNA, 24 nt, Human
ugaucauccacugugccaugugcc

SEQ ID NO: 3331571 - RNA, 13 nt, Human
ugaucauccacug

SEQ ID NO: 3331572 - RNA, 15 nt, Human
ugaucuaggaagacu

SEQ ID NO: 3331573 - RNA, 17 nt, Human
ugaucucucgugauuga

SEQ ID NO: 3331574 - RNA, 19 nt, Human
ugaucuaggaagacuuugg

SEQ ID NO: 3331575 - RNA, 21 nt, Human
ugaucuaggaagacuuuggaa

SEQ ID NO: 3331576 - RNA, 22 nt, Human
ugauccacccaccucagccucc

SEQ ID NO: 3331577 - RNA, 21 nt, Human
ugauccacccaccucagccuc

SEQ ID NO: 3331578 - RNA, 22 nt, Human
ugaucacggcucacugcagccu

SEQ ID NO: 3331579 - RNA, 21 nt, Human
ugaucacggcucacugcagcc

SEQ ID NO: 3331580 - RNA, 13 nt, Human
ugacgccauccca

SEQ ID NO: 3331581 - RNA, 14 nt, Human
ugacgccaucccag

SEQ ID NO: 3331582 - RNA, 15 nt, Human
ugacgccaucccagc

SEQ ID NO: 3331583 - RNA, 16 nt, Human
ugacgccaucccagcc

SEQ ID NO: 3331584 - RNA, 18 nt, Human
ugaccuuucaauaggaaa

SEQ ID NO: 3331585 - RNA, 22 nt, Human
ugaccuuucaauaggaaaaacu

SEQ ID NO: 3331586 - RNA, 17 nt, Human
ugacgccaucccagccc

SEQ ID NO: 3331587 - RNA, 18 nt, Human
ugacgccaucccagcccc

SEQ ID NO: 3331588 - RNA, 19 nt, Human
ugacgccaucccagcccca

SEQ ID NO: 3331589 - RNA, 20 nt, Human
ugacgccaucccagccccaa

SEQ ID NO: 3331590 - RNA, 14 nt, Human
ugacugaauuucuu

SEQ ID NO: 3331591 - RNA, 15 nt, Human
ugacugaauuucuuu

SEQ ID NO: 3331592 - RNA, 13 nt, Human
ugacugaauuucu

SEQ ID NO: 3331593 - RNA, 18 nt, Human
ugaccucugcagcaauaa

SEQ ID NO: 3331594 - RNA, 21 nt, Human
ugaccucugcagcaauaaagc

SEQ ID NO: 3331595 - RNA, 23 nt, Human
ugaccucugcagcaauaaagcag

SEQ ID NO: 3331596 - RNA, 12 nt, Human
ugaccucugccu

SEQ ID NO: 3331597 - RNA, 15 nt, Human
ugaccuuucaauagg

SEQ ID NO: 3331598 - RNA, 16 nt, Human
ugaccuuucaauagga

SEQ ID NO: 3331599 - RNA, 14 nt, Human
ugaccuuucaauag

SEQ ID NO: 3331600 - RNA, 13 nt, Human
ugaccuuucaaua

SEQ ID NO: 3331601 - RNA, 22 nt, Human
ugaccucaggugauccacccac

SEQ ID NO: 3331602 - RNA, 21 nt, Human
ugaccucaggugauccaccca

SEQ ID NO: 3331603 - RNA, 13 nt, Human
ugaccucugcagc

SEQ ID NO: 3331604 - RNA, 16 nt, Human
ugaccucugcagcaau

SEQ ID NO: 3331605 - RNA, 20 nt, Human
ugaccauucuccaccugcca

SEQ ID NO: 3331606 - RNA, 21 nt, Human
ugaccauucuccaccugccag

SEQ ID NO: 3331607 - RNA, 22 nt, Human
ugaccauucuccaccugccagg

SEQ ID NO: 3331608 - RNA, 19 nt, Human
ugaccauucuccaccugcc

SEQ ID NO: 3331609 - RNA, 12 nt, Human
ugagacucuguc

SEQ ID NO: 3331610 - RNA, 14 nt, Human
ugagacucugucuc

SEQ ID NO: 3331611 - RNA, 13 nt, Human
ugagacucugucu

SEQ ID NO: 3331612 - RNA, 23 nt, Human
ugagaggcauccaguaucuugaa

SEQ ID NO: 3331613 - RNA, 23 nt, Human
ugagacucgcgacaaugcaaacc

SEQ ID NO: 3331614 - RNA, 22 nt, Human
ugagaggcauccaguaucuuga

SEQ ID NO: 3331615 - RNA, 17 nt, Human
ugagaguagagucacug

SEQ ID NO: 3331616 - RNA, 19 nt, Human
ugagaggggaacagacugg

SEQ ID NO: 3331617 - RNA, 15 nt, Human
ugagaucagccuggg

SEQ ID NO: 3331618 - RNA, 12 nt, Human
ugagacccuguc

SEQ ID NO: 3331619 - RNA, 13 nt, Human
ugagccucagcau

SEQ ID NO: 3331620 - RNA, 14 nt, Human
ugagcaucaggcca

SEQ ID NO: 3331621 - RNA, 15 nt, Human
ugagcaucaggccag

SEQ ID NO: 3331622 - RNA, 13 nt, Human
ugagcaucaggcc

SEQ ID NO: 3331623 - RNA, 13 nt, Human
uguaucugagcag

SEQ ID NO: 3331624 - RNA, 21 nt, Human
uguacagagcccacgccccca

SEQ ID NO: 3331625 - RNA, 12 nt, Human
uguacagagccc

SEQ ID NO: 3331626 - RNA, 22 nt, Human
uguacagcaaggagauuuacaa

SEQ ID NO: 3331627 - RNA, 23 nt, Human
uguacagcaaggagauuuacaac

SEQ ID NO: 3331628 - RNA, 16 nt, Human
ugucagugugacugau

SEQ ID NO: 3331629 - RNA, 15 nt, Human
ugucagugugacuga

SEQ ID NO: 3331630 - RNA, 14 nt, Human
ugucagugugacug

SEQ ID NO: 3331631 - RNA, 21 nt, Human
ugucacaggcagguccagggu

SEQ ID NO: 3331632 - RNA, 17 nt, Human
ugucacaggcaggucca

SEQ ID NO: 3331633 - RNA, 16 nt, Human
ugucacaggcaggucc

SEQ ID NO: 3331634 - RNA, 15 nt, Human
ugucacaggcagguc

SEQ ID NO: 3331635 - RNA, 13 nt, Human
ugucacaggcagg

SEQ ID NO: 3331636 - RNA, 14 nt, Human
ugucacaggcaggu

SEQ ID NO: 3331637 - RNA, 21 nt, Human
ugucaauuacaggaaguacug

SEQ ID NO: 3331638 - RNA, 19 nt, Human
ugucaauuacaggaaguac

SEQ ID NO: 3331639 - RNA, 21 nt, Human
ugucucaaaaaaagaaaaaga

SEQ ID NO: 3331640 - RNA, 15 nt, Human
ugucuaguuguuuga

SEQ ID NO: 3331641 - RNA, 23 nt, Human
ugucuaguuguuugauucagaca

SEQ ID NO: 3331642 - RNA, 16 nt, Human
ugucuaugggacucaa

SEQ ID NO: 3331643 - RNA, 15 nt, Human
ugucuaugggacuca

SEQ ID NO: 3331644 - RNA, 14 nt, Human
ugucuaugggacuc

SEQ ID NO: 3331645 - RNA, 23 nt, Human
ugucuuuggacccugaggcccag

SEQ ID NO: 3331646 - RNA, 16 nt, Human
ugucuuuucuugcaug

SEQ ID NO: 3331647 - RNA, 17 nt, Human
uguccccgcacugggcu

SEQ ID NO: 3331648 - RNA, 19 nt, Human
uguccccgcacugggcuug

SEQ ID NO: 3331649 - RNA, 17 nt, Human
uguccccgacccuugcc

SEQ ID NO: 3331650 - RNA, 14 nt, Human
ugucuaaugaaacc

SEQ ID NO: 3331651 - RNA, 20 nt, Human
uguccugggagugagcuggu

SEQ ID NO: 3331652 - RNA, 19 nt, Human
uguccugggagugagcugg

SEQ ID NO: 3331653 - RNA, 12 nt, Human
uguccugggagu

SEQ ID NO: 3331654 - RNA, 17 nt, Human
uggugguuucagaaaug

SEQ ID NO: 3331655 - RNA, 18 nt, Human
uggugguuucagaaaugu

SEQ ID NO: 3331656 - RNA, 19 nt, Human
uggugguuuucuguucuuu

SEQ ID NO: 3331657 - RNA, 13 nt, Human
ugguggcuggguu

SEQ ID NO: 3331658 - RNA, 16 nt, Human
uggugggggccucggu

SEQ ID NO: 3331659 - RNA, 18 nt, Human
uggugggggccucggugu

SEQ ID NO: 3331660 - RNA, 18 nt, Human
ugguggcagugggagcug

SEQ ID NO: 3331661 - RNA, 13 nt, Human
ugguggcaguggg

SEQ ID NO: 3331662 - RNA, 20 nt, Human
ugguggcagugggagcugcc

SEQ ID NO: 3331663 - RNA, 14 nt, Human
uggugcaaugaccu

SEQ ID NO: 3331664 - RNA, 19 nt, Human
uggugcaaugaccuuucaa

SEQ ID NO: 3331665 - RNA, 12 nt, Human
ugguggcagugg

SEQ ID NO: 3331666 - RNA, 23 nt, Human
uggguacuuguggacacagcucu

SEQ ID NO: 3331667 - RNA, 20 nt, Human
uggguacuuguggacacagc

SEQ ID NO: 3331668 - RNA, 23 nt, Human
ugguucaggguuggccccugccc

SEQ ID NO: 3331669 - RNA, 18 nt, Human
uggugucgggcaugacac

SEQ ID NO: 3331670 - RNA, 15 nt, Human
uggugucgggcauga

SEQ ID NO: 3331671 - RNA, 16 nt, Human
uggugucaccugaaga

SEQ ID NO: 3331672 - RNA, 18 nt, Human
ugguugaugaucuuugca

SEQ ID NO: 3331673 - RNA, 14 nt, Human
uguacagacaacaa

SEQ ID NO: 3331674 - RNA, 11 nt, Human
uguacagagcc

SEQ ID NO: 3331675 - RNA, 17 nt, Human
uguaacaagccacccca

SEQ ID NO: 3331676 - RNA, 14 nt, Human
uguaacaagccacc

SEQ ID NO: 3331677 - RNA, 16 nt, Human
ugguuuucuguucuuu

SEQ ID NO: 3331678 - RNA, 23 nt, Human
ugguuuuuaaaaaacugcugacu

SEQ ID NO: 3331679 - RNA, 21 nt, Human
ugguuuuuaaaaaacugcuga

SEQ ID NO: 3331680 - RNA, 19 nt, Human
ugguuuucuuguguguuua

SEQ ID NO: 3331681 - RNA, 15 nt, Human
ugguuuucuguucuu

SEQ ID NO: 3331682 - RNA, 13 nt, Human
ugcuuaacuucac

SEQ ID NO: 3331683 - RNA, 14 nt, Human
ugcuuaacuucaca

SEQ ID NO: 3331684 - RNA, 17 nt, Human
ugcuuaacuucacauau

SEQ ID NO: 3331685 - RNA, 18 nt, Human
ugcuuaacuucacauauu

SEQ ID NO: 3331686 - RNA, 19 nt, Human
ugcuuaacuucacauauug

SEQ ID NO: 3331687 - RNA, 22 nt, Human
ugcuuccagugaggcucugccc

SEQ ID NO: 3331688 - RNA, 23 nt, Human
ugcuuccagugaggcucugcccu

SEQ ID NO: 3331689 - RNA, 21 nt, Human
ugcuuccagugaggcucugcc

SEQ ID NO: 3331690 - RNA, 12 nt, Human
ugcuucucacug

SEQ ID NO: 3331691 - RNA, 14 nt, Human
uggaacacucugag

SEQ ID NO: 3331692 - RNA, 15 nt, Human
uggaacacucugaga

SEQ ID NO: 3331693 - RNA, 17 nt, Human
uggaacacucugagacu

SEQ ID NO: 3331694 - RNA, 18 nt, Human
ugcuugugaaaggaaaga

SEQ ID NO: 3331695 - RNA, 13 nt, Human
uggaugcagccuc

SEQ ID NO: 3331696 - RNA, 21 nt, Human
uggaugcagccucacaguccu

SEQ ID NO: 3331697 - RNA, 22 nt, Human
uggaugcagccucacaguccuu

SEQ ID NO: 3331698 - RNA, 21 nt, Human
uggauuguccccgacccuugc

SEQ ID NO: 3331699 - RNA, 18 nt, Human
uggcagcucagagagggu

SEQ ID NO: 3331700 - RNA, 22 nt, Human
uggcacugcuuccagugaggcu

SEQ ID NO: 3331701 - RNA, 19 nt, Human
uggcacugcuuccagugag

SEQ ID NO: 3331702 - RNA, 22 nt, Human
uggcacuauaauguaagcucua

SEQ ID NO: 3331703 - RNA, 15 nt, Human
uggauuuaacagaaa

SEQ ID NO: 3331704 - RNA, 21 nt, Human
uggcacuauaauguaagcucu

SEQ ID NO: 3331705 - RNA, 17 nt, Human
uggacaggcauguucuc

SEQ ID NO: 3331706 - RNA, 22 nt, Human
uggacaggcauguucucugagg

SEQ ID NO: 3331707 - RNA, 18 nt, Human
uggacaggcauguucucu

SEQ ID NO: 3331708 - RNA, 19 nt, Human
uggacuaacuugucuuugg

SEQ ID NO: 3331709 - RNA, 19 nt, Human
uggacguguuaugacucca

SEQ ID NO: 3331710 - RNA, 23 nt, Human
uggacguguuaugacuccagaau

SEQ ID NO: 3331711 - RNA, 23 nt, Human
uggccuagcauacguacacauuu

SEQ ID NO: 3331712 - RNA, 23 nt, Human
uggccucaagugauucuccugcc

SEQ ID NO: 3331713 - RNA, 18 nt, Human
uggccucaagugauucuc

SEQ ID NO: 3331714 - RNA, 11 nt, Human
uggccucccaa

SEQ ID NO: 3331715 - RNA, 14 nt, Human
uggccucccaacuc

SEQ ID NO: 3331716 - RNA, 19 nt, Human
uggccucccaacucacccc

SEQ ID NO: 3331717 - RNA, 20 nt, Human
uggccucccaacucacccca

SEQ ID NO: 3331718 - RNA, 21 nt, Human
uggccucccaacucaccccag

SEQ ID NO: 3331719 - RNA, 22 nt, Human
uggccucccaacucaccccagc

SEQ ID NO: 3331720 - RNA, 13 nt, Human
uggccccucaggg

SEQ ID NO: 3331721 - RNA, 20 nt, Human
uggccccucagggucccugg

SEQ ID NO: 3331722 - RNA, 17 nt, Human
uggcagcugcgguccac

SEQ ID NO: 3331723 - RNA, 21 nt, Human
uggccccucagggucccuggu

SEQ ID NO: 3331724 - RNA, 22 nt, Human
uggccccucagggucccuggug

SEQ ID NO: 3331725 - RNA, 20 nt, Human
uggccuagcauacguacaca

SEQ ID NO: 3331726 - RNA, 11 nt, Human
uggcugcugaa

SEQ ID NO: 3331727 - RNA, 13 nt, Human
uggcugcugaagg

SEQ ID NO: 3331728 - RNA, 14 nt, Human
uggcugcugaaggc

SEQ ID NO: 3331729 - RNA, 16 nt, Human
ugggggccucagugcc

SEQ ID NO: 3331730 - RNA, 19 nt, Human
uggggggcugaggugggag

SEQ ID NO: 3331731 - RNA, 19 nt, Human
ugggggcugggcagaggaa

SEQ ID NO: 3331732 - RNA, 17 nt, Human
ugggcuugucuguagau

SEQ ID NO: 3331733 - RNA, 23 nt, Human
ugggcuuggggaccagagcugcc

SEQ ID NO: 3331734 - RNA, 22 nt, Human
ugggcuuggggaccagagcugc

SEQ ID NO: 3331735 - RNA, 15 nt, Human
ugggcuucauccucc

SEQ ID NO: 3331736 - RNA, 21 nt, Human
ugggcuucaguggcagcugcu

SEQ ID NO: 3331737 - RNA, 22 nt, Human
ugggcuucaguggcagcugcuu

SEQ ID NO: 3331738 - RNA, 22 nt, Human
ugggccuccugugugugcgccu

SEQ ID NO: 3331739 - RNA, 13 nt, Human
ugggcagagcaga

SEQ ID NO: 3331740 - RNA, 15 nt, Human
ugggcagagcagaga

SEQ ID NO: 3331741 - RNA, 17 nt, Human
ugggcagagcagagacc

SEQ ID NO: 3331742 - RNA, 14 nt, Human
ugggcagagcagag

SEQ ID NO: 3331743 - RNA, 16 nt, Human
ugggaaugaaugucag

SEQ ID NO: 3331744 - RNA, 13 nt, Human
ugggacacccugu

SEQ ID NO: 3331745 - RNA, 14 nt, Human
ugggacacccugug

SEQ ID NO: 3331746 - RNA, 15 nt, Human
ugggacacccuguga

SEQ ID NO: 3331747 - RNA, 16 nt, Human
ugggaggaucucuuga

SEQ ID NO: 3331748 - RNA, 18 nt, Human
ugggaugauuggaggggg

SEQ ID NO: 3331749 - RNA, 12 nt, Human
uuuagacagagu

SEQ ID NO: 3331750 - RNA, 14 nt, Human
uuuagaaauauaau

SEQ ID NO: 3331751 - RNA, 22 nt, Human
uuuacuucuuauacauuugaua

SEQ ID NO: 3331752 - RNA, 19 nt, Human
uuuacuucuuauacauuug

SEQ ID NO: 3331753 - RNA, 15 nt, Human
uuuacuucuuauaca

SEQ ID NO: 3331754 - RNA, 18 nt, Human
uuuaagaaaaaggaugca

SEQ ID NO: 3331755 - RNA, 22 nt, Human
uuuaagaaaaaggaugcacaga

SEQ ID NO: 3331756 - RNA, 19 nt, Human
uuuaagugcugcauuuaaa

SEQ ID NO: 3331757 - RNA, 18 nt, Human
uuuaacagaaauguacag

SEQ ID NO: 3331758 - RNA, 13 nt, Human
uuuauuaugcaug

SEQ ID NO: 3331759 - RNA, 13 nt, Human
uuuauuauggcac

SEQ ID NO: 3331760 - RNA, 14 nt, Human
uuuauggcuuuugu

SEQ ID NO: 3331761 - RNA, 16 nt, Human
uuuauggcuuuugugc

SEQ ID NO: 3331762 - RNA, 22 nt, Human
uuuauaagccaguguugccuaa

SEQ ID NO: 3331763 - RNA, 17 nt, Human
uuucaauaggaaaaacu

SEQ ID NO: 3331764 - RNA, 12 nt, Human
uuucaauaggaa

SEQ ID NO: 3331765 - RNA, 14 nt, Human
uuucaauaggaaaa

SEQ ID NO: 3331766 - RNA, 14 nt, Human
uuucaguguacaug

SEQ ID NO: 3331767 - RNA, 13 nt, Human
uuucaguguacau

SEQ ID NO: 3331768 - RNA, 18 nt, Human
uuucauuuaggugaggaa

SEQ ID NO: 3331769 - RNA, 14 nt, Human
uuucauuuagguga

SEQ ID NO: 3331770 - RNA, 15 nt, Human
uugucuuaaaaagug

SEQ ID NO: 3331771 - RNA, 16 nt, Human
uugugauuuuuguaau

SEQ ID NO: 3331772 - RNA, 17 nt, Human
uugugauuuuuguaauu

SEQ ID NO: 3331773 - RNA, 12 nt, Human
uugugauuuuug

SEQ ID NO: 3331774 - RNA, 20 nt, Human
uugugaaaggaaagaggcuc

SEQ ID NO: 3331775 - RNA, 15 nt, Human
uuguauucucuccug

SEQ ID NO: 3331776 - RNA, 16 nt, Human
uuguauucucuccugu

SEQ ID NO: 3331777 - RNA, 19 nt, Human
uuguauucucuccuguacc

SEQ ID NO: 3331778 - RNA, 15 nt, Human
uuguaaauuaacuuu

SEQ ID NO: 3331779 - RNA, 16 nt, Human
uuguaaauuaacuuuu

SEQ ID NO: 3331780 - RNA, 18 nt, Human
uuguaaauuaacuuuuau

SEQ ID NO: 3331781 - RNA, 23 nt, Human
uuguaaauuaacuuuuauaaacu

SEQ ID NO: 3331782 - RNA, 18 nt, Human
uuguacauaaugcgugca

SEQ ID NO: 3331783 - RNA, 14 nt, Human
uuguacauaaugcg

SEQ ID NO: 3331784 - RNA, 17 nt, Human
uuguaaauagcucaggu

SEQ ID NO: 3331785 - RNA, 22 nt, Human
uuggguucaagcgauucuucug

SEQ ID NO: 3331786 - RNA, 13 nt, Human
uuggucuguguga

SEQ ID NO: 3331787 - RNA, 22 nt, Human
uuguuaguaugaggcauuuguu

SEQ ID NO: 3331788 - RNA, 20 nt, Human
uuguuagugugucuuagugu

SEQ ID NO: 3331789 - RNA, 19 nt, Human
uuguuaguaugaggcauuu

SEQ ID NO: 3331790 - RNA, 21 nt, Human
uuguuaguaugaggcauuugu

SEQ ID NO: 3331791 - RNA, 14 nt, Human
uuguuacauuuuua

SEQ ID NO: 3331792 - RNA, 20 nt, Human
uuguggauuuaacagaaaug

SEQ ID NO: 3331793 - RNA, 21 nt, Human
uuguggauuuaacagaaaugu

SEQ ID NO: 3331794 - RNA, 16 nt, Human
uuguggacacagcucu

SEQ ID NO: 3331795 - RNA, 17 nt, Human
uuguggacacagcucuu

SEQ ID NO: 3331796 - RNA, 22 nt, Human
uuguggauuuaacagaaaugua

SEQ ID NO: 3331797 - RNA, 23 nt, Human
uuguggauuuaacagaaauguac

SEQ ID NO: 3331798 - RNA, 13 nt, Human
uuguguucaccuu

SEQ ID NO: 3331799 - RNA, 21 nt, Human
uuguguuuauauauaagccaa

SEQ ID NO: 3331800 - RNA, 22 nt, Human
uugugcauuaucuagauacugu

SEQ ID NO: 3331801 - RNA, 23 nt, Human
uugugcauuaucuagauacugua

SEQ ID NO: 3331802 - RNA, 12 nt, Human
uugugcauuugg

SEQ ID NO: 3331803 - RNA, 17 nt, Human
uugugcauuaucuagau

SEQ ID NO: 3331804 - RNA, 13 nt, Human
uucaguggcagcu

SEQ ID NO: 3331805 - RNA, 14 nt, Human
uucaguggcagcug

SEQ ID NO: 3331806 - RNA, 15 nt, Human
uucagcuccagcuca

SEQ ID NO: 3331807 - RNA, 12 nt, Human
uucagcuccagc

SEQ ID NO: 3331808 - RNA, 21 nt, Human
uucagcugguugagguuucaa

SEQ ID NO: 3331809 - RNA, 16 nt, Human
uucaguggcagcugcu

SEQ ID NO: 3331810 - RNA, 15 nt, Human
uucaguggcagcugc

SEQ ID NO: 3331811 - RNA, 17 nt, Human
uucaguggcagcugcuu

SEQ ID NO: 3331812 - RNA, 12 nt, Human
uucaguguacau

SEQ ID NO: 3331813 - RNA, 13 nt, Human
uucaguguacaug

SEQ ID NO: 3331814 - RNA, 15 nt, Human
uucauccuccucaga

SEQ ID NO: 3331815 - RNA, 19 nt, Human
uucauccuccucagaucuu

SEQ ID NO: 3331816 - RNA, 15 nt, Human
uucauaaccuagccu

SEQ ID NO: 3331817 - RNA, 14 nt, Human
uuccauggacuuug

SEQ ID NO: 3331818 - RNA, 15 nt, Human
uuccauggacuuugu

SEQ ID NO: 3331819 - RNA, 19 nt, Human
uuccaacccucaucaccaa

SEQ ID NO: 3331820 - RNA, 16 nt, Human
uuccaaaguacacugu

SEQ ID NO: 3331821 - RNA, 13 nt, Human
uuccaaaguacac

SEQ ID NO: 3331822 - RNA, 20 nt, Human
uucaauaggaaaaacugauu

SEQ ID NO: 3331823 - RNA, 22 nt, Human
uucaauaggaaaaacugauuuu

SEQ ID NO: 3331824 - RNA, 21 nt, Human
uucaauaggaaaaacugauuu

SEQ ID NO: 3331825 - RNA, 19 nt, Human
uucaccuuuguccccaccg

SEQ ID NO: 3331826 - RNA, 20 nt, Human
uucaccuuuguccccaccgc

SEQ ID NO: 3331827 - RNA, 14 nt, Human
uucaccuuuguccc

SEQ ID NO: 3331828 - RNA, 13 nt, Human
uucacccuuuucu

SEQ ID NO: 3331829 - RNA, 13 nt, Human
uucacggaagagc

SEQ ID NO: 3331830 - RNA, 22 nt, Human
uucaccuuuguccccaccgcag

SEQ ID NO: 3331831 - RNA, 17 nt, Human
uucacggaagagccuug

SEQ ID NO: 3331832 - RNA, 14 nt, Human
uucagacagcugcc

SEQ ID NO: 3331833 - RNA, 15 nt, Human
uucagacagcugccu

SEQ ID NO: 3331834 - RNA, 16 nt, Human
uucagacagcugccug

SEQ ID NO: 3331835 - RNA, 17 nt, Human
uucagacagcugccugg

SEQ ID NO: 3331836 - RNA, 22 nt, Human
uuauuuuggaaaauaaauuauu

SEQ ID NO: 3331837 - RNA, 18 nt, Human
uucaaaugcuguaacuuu

SEQ ID NO: 3331838 - RNA, 21 nt, Human
uucaacagguuuuccugaaga

SEQ ID NO: 3331839 - RNA, 21 nt, Human
uucaaccauggacuuuauaag

SEQ ID NO: 3331840 - RNA, 15 nt, Human
uucaaccauggacuu

SEQ ID NO: 3331841 - RNA, 14 nt, Human
uucaaccauggacu

SEQ ID NO: 3331842 - RNA, 18 nt, Human
uuauuuuauuaugcauga

SEQ ID NO: 3331843 - RNA, 13 nt, Human
ugugaaaagaaaa

SEQ ID NO: 3331844 - RNA, 15 nt, Human
ugugaaaagaaaaau

SEQ ID NO: 3331845 - RNA, 17 nt, Human
ugugaaaagaaaaauga

SEQ ID NO: 3331846 - RNA, 15 nt, Human
uuauaauaauguuaa

SEQ ID NO: 3331847 - RNA, 18 nt, Human
uuauaauaauguuaacau

SEQ ID NO: 3331848 - RNA, 15 nt, Human
uuauaaugaaugaaa

SEQ ID NO: 3331849 - RNA, 11 nt, Human
uuauacauaaa

SEQ ID NO: 3331850 - RNA, 16 nt, Human
uuauauucaaccaugg

SEQ ID NO: 3331851 - RNA, 15 nt, Human
uuauauucaaccaug

SEQ ID NO: 3331852 - RNA, 14 nt, Human
uuauauucaaccau

SEQ ID NO: 3331853 - RNA, 11 nt, Human
uuauauucaac

SEQ ID NO: 3331854 - RNA, 23 nt, Human
uuauauucaaccauggacuuuau

SEQ ID NO: 3331855 - RNA, 17 nt, Human
uuauauucaaccaugga

SEQ ID NO: 3331856 - RNA, 19 nt, Human
uuauuaaaugcccagcccc

SEQ ID NO: 3331857 - RNA, 21 nt, Human
uuauuaaaugcccagccccuu

SEQ ID NO: 3331858 - RNA, 18 nt, Human
uuauggaacacucugaga

SEQ ID NO: 3331859 - RNA, 20 nt, Human
uuauggaacacucugagacu

SEQ ID NO: 3331860 - RNA, 21 nt, Human
uuauggacaaugacccagugg

SEQ ID NO: 3331861 - RNA, 16 nt, Human
uuauggaacacucuga

SEQ ID NO: 3331862 - RNA, 17 nt, Human
uuauggaacacucugag

SEQ ID NO: 3331863 - RNA, 17 nt, Human
uuauggcuuuugugcau

SEQ ID NO: 3331864 - RNA, 16 nt, Human
uuauggcuuuugugca

SEQ ID NO: 3331865 - RNA, 21 nt, Human
uucuccaccucccacaaagga

SEQ ID NO: 3331866 - RNA, 12 nt, Human
uucuccaccugc

SEQ ID NO: 3331867 - RNA, 14 nt, Human
uucuccaccugcca

SEQ ID NO: 3331868 - RNA, 15 nt, Human
uucuccaccugccag

SEQ ID NO: 3331869 - RNA, 16 nt, Human
uucuccaccugccagg

SEQ ID NO: 3331870 - RNA, 18 nt, Human
uucuccaccugccaggga

SEQ ID NO: 3331871 - RNA, 20 nt, Human
uucuccaccugccagggaca

SEQ ID NO: 3331872 - RNA, 16 nt, Human
uucuccacccugcucu

SEQ ID NO: 3331873 - RNA, 14 nt, Human
uucucuccuguacc

SEQ ID NO: 3331874 - RNA, 18 nt, Human
uucucuccuguaccucuu

SEQ ID NO: 3331875 - RNA, 15 nt, Human
uucucuccagccccu

SEQ ID NO: 3331876 - RNA, 13 nt, Human
uucucuccagccc

SEQ ID NO: 3331877 - RNA, 14 nt, Human
uucucuccagcccc

SEQ ID NO: 3331878 - RNA, 11 nt, Human
uucucugcccu

SEQ ID NO: 3331879 - RNA, 12 nt, Human
uucucugcccuc

SEQ ID NO: 3331880 - RNA, 14 nt, Human
uucucugaggacac

SEQ ID NO: 3331881 - RNA, 19 nt, Human
uucucuccuguaccucuug

SEQ ID NO: 3331882 - RNA, 19 nt, Human
uucugcucacauaucuguc

SEQ ID NO: 3331883 - RNA, 19 nt, Human
uucugauccuaguuccacc

SEQ ID NO: 3331884 - RNA, 16 nt, Human
uucucugcccuccaag

SEQ ID NO: 3331885 - RNA, 23 nt, Human
uucugacccaugcugcccuguga

SEQ ID NO: 3331886 - RNA, 22 nt, Human
uucugacccaugcugcccugug

SEQ ID NO: 3331887 - RNA, 18 nt, Human
uucugacccugcuucaaa

SEQ ID NO: 3331888 - RNA, 22 nt, Human
uucuacucgaguuacagacaaa

SEQ ID NO: 3331889 - RNA, 14 nt, Human
uucuacccaggugc

SEQ ID NO: 3331890 - RNA, 21 nt, Human
uucuacccagcgagcccuggu

SEQ ID NO: 3331891 - RNA, 20 nt, Human
uucuacccagcgagcccugg

SEQ ID NO: 3331892 - RNA, 13 nt, Human
uucuacgccaggg

SEQ ID NO: 3331893 - RNA, 19 nt, Human
uucuacccagcgagcccug

SEQ ID NO: 3331894 - RNA, 12 nt, Human
uucuacccagcg

SEQ ID NO: 3331895 - RNA, 20 nt, Human
uuccuugaguugauucagcu

SEQ ID NO: 3331896 - RNA, 21 nt, Human
uuccuugaguugauucagcuc

SEQ ID NO: 3331897 - RNA, 16 nt, Human
uuccauggccucuuca

SEQ ID NO: 3331898 - RNA, 12 nt, Human
uuccauggccuc

SEQ ID NO: 3331899 - RNA, 18 nt, Human
uuccugaagaauugaaaa

SEQ ID NO: 3331900 - RNA, 23 nt, Human
uuccugaugcuucuucagagacu

SEQ ID NO: 3331901 - RNA, 15 nt, Human
uuccugaggcugggc

SEQ ID NO: 3331902 - RNA, 20 nt, Human
uuccugaggcugggcucccu

SEQ ID NO: 3331903 - RNA, 18 nt, Human
uucuguauuuuguuuuug

SEQ ID NO: 3331904 - RNA, 19 nt, Human
uucuguccuacucuguguc

SEQ ID NO: 3331905 - RNA, 14 nt, Human
uucugcuucagccu

SEQ ID NO: 3331906 - RNA, 16 nt, Human
uucugcuucagccucc

SEQ ID NO: 3331907 - RNA, 15 nt, Human
uucugcuucagccuc

SEQ ID NO: 3331908 - RNA, 19 nt, Human
uucugcuucagccucccga

SEQ ID NO: 3331909 - RNA, 14 nt, Human
uucuuguguguuua

SEQ ID NO: 3331910 - RNA, 13 nt, Human
uucuuccucccuc

SEQ ID NO: 3331911 - RNA, 21 nt, Human
uucuuguguguuuauugucaa

SEQ ID NO: 3331912 - RNA, 14 nt, Human
uucuuuccaaagua

SEQ ID NO: 3331913 - RNA, 12 nt, Human
uucuuucagcca

SEQ ID NO: 3331914 - RNA, 21 nt, Human
uucuuccacaagagcccaggc

SEQ ID NO: 3331915 - RNA, 21 nt, Human
uucuuauacauuugauaaagu

SEQ ID NO: 3331916 - RNA, 22 nt, Human
uugaaaacacuguucucugccc

SEQ ID NO: 3331917 - RNA, 23 nt, Human
uugaaaacacuguucucugcccu

SEQ ID NO: 3331918 - RNA, 21 nt, Human
uucuuuccaaaguacacuguu

SEQ ID NO: 3331919 - RNA, 20 nt, Human
uugaaaaaccauuuugcugu

SEQ ID NO: 3331920 - RNA, 16 nt, Human
uugaacuccuggccuc

SEQ ID NO: 3331921 - RNA, 15 nt, Human
uugaacuccuggccu

SEQ ID NO: 3331922 - RNA, 21 nt, Human
uugcaaaguaucccuacugua

SEQ ID NO: 3331923 - RNA, 16 nt, Human
uugaugaucuuugcag

SEQ ID NO: 3331924 - RNA, 11 nt, Human
uugagccuggg

SEQ ID NO: 3331925 - RNA, 16 nt, Human
uugaggguugggcugg

SEQ ID NO: 3331926 - RNA, 13 nt, Human
uugaggguugggc

SEQ ID NO: 3331927 - RNA, 23 nt, Human
uugauagcacagacccugcccug

SEQ ID NO: 3331928 - RNA, 14 nt, Human
uugaauuguaagga

SEQ ID NO: 3331929 - RNA, 18 nt, Human
uugaacuggguacuugug

SEQ ID NO: 3331930 - RNA, 17 nt, Human
uugacgccaucccagcc

SEQ ID NO: 3331931 - RNA, 18 nt, Human
uugacgccaucccagccc

SEQ ID NO: 3331932 - RNA, 19 nt, Human
uugacgccaucccagcccc

SEQ ID NO: 3331933 - RNA, 15 nt, Human
uugacgccaucccag

SEQ ID NO: 3331934 - RNA, 14 nt, Human
uugaccucugcagc

SEQ ID NO: 3331935 - RNA, 15 nt, Human
uugaccucugcagca

SEQ ID NO: 3331936 - RNA, 21 nt, Human
uugaccucaggugauccaccc

SEQ ID NO: 3331937 - RNA, 13 nt, Human
uuuuuuuugacaa

SEQ ID NO: 3331938 - RNA, 12 nt, Human
uuuuuuuuaaga

SEQ ID NO: 3331939 - RNA, 11 nt, Human
uuuuuuuacua

SEQ ID NO: 3331940 - RNA, 18 nt, Human
uuuuuaagugcugcauuu

SEQ ID NO: 3331941 - RNA, 19 nt, Human
uuuuuaagugcugcauuua

SEQ ID NO: 3331942 - RNA, 22 nt, Human
uuuuuaagugcugcauuuaaaa

SEQ ID NO: 3331943 - RNA, 23 nt, Human
uuuuuaagugcugcauuuaaaag

SEQ ID NO: 3331944 - RNA, 16 nt, Human
uuuuuaagugcugcau

SEQ ID NO: 3331945 - RNA, 17 nt, Human
uuuuuaagugcugcauu

SEQ ID NO: 3331946 - RNA, 12 nt, Human
uuuuuaagaaaa

SEQ ID NO: 3331947 - RNA, 11 nt, Human
uuuuuaaaugc

SEQ ID NO: 3331948 - RNA, 12 nt, Human
uuuggaaaauaa

SEQ ID NO: 3331949 - RNA, 21 nt, Human
uuugagugccuuacacaaugg

SEQ ID NO: 3331950 - RNA, 15 nt, Human
uuuccguuaaaauac

SEQ ID NO: 3331951 - RNA, 17 nt, Human
uuuccguuaaaauacca

SEQ ID NO: 3331952 - RNA, 13 nt, Human
uuugagugccuua

SEQ ID NO: 3331953 - RNA, 22 nt, Human
uuuguuaguaugaggcauuugu

SEQ ID NO: 3331954 - RNA, 15 nt, Human
uuuguugucagcuga

SEQ ID NO: 3331955 - RNA, 15 nt, Human
uuuguauucucuccu

SEQ ID NO: 3331956 - RNA, 22 nt, Human
uuuucuuguguguuuauuguca

SEQ ID NO: 3331957 - RNA, 13 nt, Human
uuuucuucucccu

SEQ ID NO: 3331958 - RNA, 13 nt, Human
uuuucuacucgag

SEQ ID NO: 3331959 - RNA, 20 nt, Human
uuuucuacucgaguuacaga

SEQ ID NO: 3331960 - RNA, 22 nt, Human
uuuucuacucgaguuacagaca

SEQ ID NO: 3331961 - RNA, 18 nt, Human
uuuucccuauuagagaag

SEQ ID NO: 3331962 - RNA, 22 nt, Human
uuuucccuauuagagaagagau

SEQ ID NO: 3331963 - RNA, 15 nt, Human
uuuuacuaauagaca

SEQ ID NO: 3331964 - RNA, 13 nt, Human
uuuuauacauaaa

SEQ ID NO: 3331965 - RNA, 21 nt, Human
uuuuauacauaaacaagacca

SEQ ID NO: 3331966 - RNA, 19 nt, Human
uuuuaucgucacugcuuaa

SEQ ID NO: 3331967 - RNA, 17 nt, Human
uuuucaaaauaaaaaug

SEQ ID NO: 3331968 - RNA, 18 nt, Human
uuuuauuuuuagacagag

SEQ ID NO: 3331969 - RNA, 17 nt, Human
cauuuuuaguagagaca

SEQ ID NO: 3331970 - RNA, 21 nt, Human
cauuuuuaagugcugcauuua

SEQ ID NO: 3331971 - RNA, 23 nt, Human
cauuuuauuuuauuaugcaugaa

SEQ ID NO: 3331972 - RNA, 22 nt, Human
cauuuuauuuuauuaugcauga

SEQ ID NO: 3331973 - RNA, 13 nt, Human
cauuugcugaaua

SEQ ID NO: 3331974 - RNA, 22 nt, Human
cauuugaggucuguucuuucca

SEQ ID NO: 3331975 - RNA, 17 nt, Human
cauuugaaaauuuugau

SEQ ID NO: 3331976 - RNA, 19 nt, Human
cauuugaaaauuuugaugu

SEQ ID NO: 3331977 - RNA, 15 nt, Human
cauugaccugaggcc

SEQ ID NO: 3331978 - RNA, 17 nt, Human
cauugaccugaggcccu

SEQ ID NO: 3331979 - RNA, 14 nt, Human
cauugaccugaggc

SEQ ID NO: 3331980 - RNA, 18 nt, Human
cauugaccugaggcccuu

SEQ ID NO: 3331981 - RNA, 15 nt, Human
cauuuaaaaaaaauc

SEQ ID NO: 3331982 - RNA, 15 nt, Human
cauugugggaagggg

SEQ ID NO: 3331983 - RNA, 13 nt, Human
cauugugggaagg

SEQ ID NO: 3331984 - RNA, 14 nt, Human
cauuccugaugcuu

SEQ ID NO: 3331985 - RNA, 16 nt, Human
cauuccugaugcuucu

SEQ ID NO: 3331986 - RNA, 19 nt, Human
cauuccugaugcuucuuca

SEQ ID NO: 3331987 - RNA, 22 nt, Human
cauuccugaugcuucuucagag

SEQ ID NO: 3331988 - RNA, 23 nt, Human
cauuccugaugcuucuucagaga

SEQ ID NO: 3331989 - RNA, 20 nt, Human
cauucugccugcccaggccc

SEQ ID NO: 3331990 - RNA, 19 nt, Human
cauucugccugcccaggcc

SEQ ID NO: 3331991 - RNA, 18 nt, Human
cauucugccugcccaggc

SEQ ID NO: 3331992 - RNA, 17 nt, Human
cauucugccugcccagg

SEQ ID NO: 3331993 - RNA, 16 nt, Human
cauucugccugcccag

SEQ ID NO: 3331994 - RNA, 15 nt, Human
cauucugccugccca

SEQ ID NO: 3331995 - RNA, 13 nt, Human
cauucugccugcc

SEQ ID NO: 3331996 - RNA, 12 nt, Human
cauucugccugc

SEQ ID NO: 3331997 - RNA, 17 nt, Human
cauucuguuaaucauua

SEQ ID NO: 3331998 - RNA, 21 nt, Human
cauucuuacuuacuaaaauau

SEQ ID NO: 3331999 - RNA, 12 nt, Human
cauucuuacuua

SEQ ID NO: 3332000 - RNA, 23 nt, Human
cauucuuacuuacuaaaauauau

SEQ ID NO: 3332001 - RNA, 22 nt, Human
cauucuuacuuacuaaaauaua

SEQ ID NO: 3332002 - RNA, 23 nt, Human
cauucuucuguacgucugacagg

SEQ ID NO: 3332003 - RNA, 18 nt, Human
cauuccccaggaggccag

SEQ ID NO: 3332004 - RNA, 19 nt, Human
cauuccccaggaggccagc

SEQ ID NO: 3332005 - RNA, 20 nt, Human
cauuccccaggaggccagcc

SEQ ID NO: 3332006 - RNA, 15 nt, Human
cauuccccaggaggc

SEQ ID NO: 3332007 - RNA, 17 nt, Human
cauuccccaggaggcca

SEQ ID NO: 3332008 - RNA, 13 nt, Human
cauuccccaggag

SEQ ID NO: 3332009 - RNA, 12 nt, Human
cauguuugugau

SEQ ID NO: 3332010 - RNA, 14 nt, Human
cauguuugugauug

SEQ ID NO: 3332011 - RNA, 23 nt, Human
cauguuugauguaucugagcagg

SEQ ID NO: 3332012 - RNA, 20 nt, Human
cauguuuuucuucucccuca

SEQ ID NO: 3332013 - RNA, 19 nt, Human
cauguuuuucuucucccuc

SEQ ID NO: 3332014 - RNA, 18 nt, Human
cauguuuuucuucucccu

SEQ ID NO: 3332015 - RNA, 17 nt, Human
cauggucggaaaacaug

SEQ ID NO: 3332016 - RNA, 19 nt, Human
cauggucggaaaacaugcu

SEQ ID NO: 3332017 - RNA, 23 nt, Human
cauggucggaaaacaugcuacac

SEQ ID NO: 3332018 - RNA, 14 nt, Human
caugugcacaugca

SEQ ID NO: 3332019 - RNA, 22 nt, Human
caugugccagguuuuuggucug

SEQ ID NO: 3332020 - RNA, 21 nt, Human
caugugaugagaggaaaucac

SEQ ID NO: 3332021 - RNA, 18 nt, Human
caugugaugagaggaaau

SEQ ID NO: 3332022 - RNA, 20 nt, Human
caugugaugagaggaaauca

SEQ ID NO: 3332023 - RNA, 16 nt, Human
caugugaugagaggaa

SEQ ID NO: 3332024 - RNA, 17 nt, Human
caugugaugagaggaaa

SEQ ID NO: 3332025 - RNA, 15 nt, Human
caugugaugagagga

SEQ ID NO: 3332026 - RNA, 12 nt, Human
caugucuggcua

SEQ ID NO: 3332027 - RNA, 13 nt, Human
caugcugucccuu

SEQ ID NO: 3332028 - RNA, 15 nt, Human
caugcugucccuuac

SEQ ID NO: 3332029 - RNA, 15 nt, Human
cauggacuuccacug

SEQ ID NO: 3332030 - RNA, 18 nt, Human
cauggacaugaucuucuu

SEQ ID NO: 3332031 - RNA, 18 nt, Human
caugggccuccugugugu

SEQ ID NO: 3332032 - RNA, 14 nt, Human
caucaacaucuugg

SEQ ID NO: 3332033 - RNA, 23 nt, Human
cauauauauguuuuaagaggcag

SEQ ID NO: 3332034 - RNA, 23 nt, Human
cauauaagauucauauuuacuuc

SEQ ID NO: 3332035 - RNA, 15 nt, Human
cauaguaugguggcu

SEQ ID NO: 3332036 - RNA, 16 nt, Human
cauaguaugguggcug

SEQ ID NO: 3332037 - RNA, 20 nt, Human
cauaguaugguggcuggguu

SEQ ID NO: 3332038 - RNA, 21 nt, Human
cauauugauuuccguuaaaau

SEQ ID NO: 3332039 - RNA, 17 nt, Human
cauauugauuuccguua

SEQ ID NO: 3332040 - RNA, 18 nt, Human
cauauucuguuggccagu

SEQ ID NO: 3332041 - RNA, 22 nt, Human
cauauucuguuggccaguguga

SEQ ID NO: 3332042 - RNA, 22 nt, Human
caucccugaaggccccgcccag

SEQ ID NO: 3332043 - RNA, 23 nt, Human
cauccacugugccaugugccagg

SEQ ID NO: 3332044 - RNA, 17 nt, Human
cauccacugugccaugu

SEQ ID NO: 3332045 - RNA, 14 nt, Human
cauccacugugcca

SEQ ID NO: 3332046 - RNA, 17 nt, Human
cauccagguucagcuug

SEQ ID NO: 3332047 - RNA, 20 nt, Human
caucaccaacgucugugcca

SEQ ID NO: 3332048 - RNA, 12 nt, Human
caucacccgcua

SEQ ID NO: 3332049 - RNA, 16 nt, Human
caucauccuaagcuau

SEQ ID NO: 3332050 - RNA, 13 nt, Human
caucaugucuggc

SEQ ID NO: 3332051 - RNA, 15 nt, Human
caucaugucuggcua

SEQ ID NO: 3332052 - RNA, 14 nt, Human
caucaugucuggcu

SEQ ID NO: 3332053 - RNA, 17 nt, Human
caucuugcucugcugac

SEQ ID NO: 3332054 - RNA, 16 nt, Human
caucuugcucugcuga

SEQ ID NO: 3332055 - RNA, 15 nt, Human
caucuugcucugcug

SEQ ID NO: 3332056 - RNA, 16 nt, Human
caucuugaauuguaag

SEQ ID NO: 3332057 - RNA, 21 nt, Human
caucuugaauuguaaggaaug

SEQ ID NO: 3332058 - RNA, 15 nt, Human
caucucuccuccuuu

SEQ ID NO: 3332059 - RNA, 16 nt, Human
caucucuacaaaaagc

SEQ ID NO: 3332060 - RNA, 12 nt, Human
caugaagacaga

SEQ ID NO: 3332061 - RNA, 19 nt, Human
caugaaaacacauuuuucu

SEQ ID NO: 3332062 - RNA, 21 nt, Human
caugaaaacacauuuuucuua

SEQ ID NO: 3332063 - RNA, 14 nt, Human
caugaaaacacauu

SEQ ID NO: 3332064 - RNA, 15 nt, Human
caugaaaacacauuu

SEQ ID NO: 3332065 - RNA, 16 nt, Human
caugaaaacacauuuu

SEQ ID NO: 3332066 - RNA, 17 nt, Human
caugaaaacacauuuuu

SEQ ID NO: 3332067 - RNA, 13 nt, Human
caugaaaacacau

SEQ ID NO: 3332068 - RNA, 16 nt, Human
caugaggaacaaggca

SEQ ID NO: 3332069 - RNA, 17 nt, Human
caugaggaacaaggcaa

SEQ ID NO: 3332070 - RNA, 20 nt, Human
caugaggaacaaggcaaggc

SEQ ID NO: 3332071 - RNA, 21 nt, Human
caugaggaacaaggcaaggcu

SEQ ID NO: 3332072 - RNA, 23 nt, Human
caugagccucagcauccuggcac

SEQ ID NO: 3332073 - RNA, 22 nt, Human
caugagccucagcauccuggca

SEQ ID NO: 3332074 - RNA, 23 nt, Human
caugaggaacaaggcaaggcugu

SEQ ID NO: 3332075 - RNA, 14 nt, Human
caugaguccccugu

SEQ ID NO: 3332076 - RNA, 15 nt, Human
caugaguccccuguu

SEQ ID NO: 3332077 - RNA, 23 nt, Human
caugaguccccuguuuguuucug

SEQ ID NO: 3332078 - RNA, 13 nt, Human
caugaguccccug

SEQ ID NO: 3332079 - RNA, 15 nt, Human
caugagcaucaggcc

SEQ ID NO: 3332080 - RNA, 16 nt, Human
caugagcaucaggcca

SEQ ID NO: 3332081 - RNA, 17 nt, Human
caugagcaucaggccag

SEQ ID NO: 3332082 - RNA, 18 nt, Human
caugagcaucaggccagg

SEQ ID NO: 3332083 - RNA, 20 nt, Human
caugagcaucaggccaggcc

SEQ ID NO: 3332084 - RNA, 21 nt, Human
caugagcaucaggccaggccc

SEQ ID NO: 3332085 - RNA, 22 nt, Human
caugagcaucaggccaggcccu

SEQ ID NO: 3332086 - RNA, 23 nt, Human
caugagcaucaggccaggcccuc

SEQ ID NO: 3332087 - RNA, 21 nt, Human
caugagccucagcauccuggc

SEQ ID NO: 3332088 - RNA, 20 nt, Human
caugagccucagcauccugg

SEQ ID NO: 3332089 - RNA, 19 nt, Human
caugagccucagcauccug

SEQ ID NO: 3332090 - RNA, 18 nt, Human
caugagccucagcauccu

SEQ ID NO: 3332091 - RNA, 17 nt, Human
caugagccucagcaucc

SEQ ID NO: 3332092 - RNA, 15 nt, Human
caugagccucagcau

SEQ ID NO: 3332093 - RNA, 12 nt, Human
caugagccucag

SEQ ID NO: 3332094 - RNA, 13 nt, Human
caugagcaucagg

SEQ ID NO: 3332095 - RNA, 20 nt, Human
ccaccaacauacucccaucu

SEQ ID NO: 3332096 - RNA, 16 nt, Human
ccaccacacccagccc

SEQ ID NO: 3332097 - RNA, 14 nt, Human
ccaccacacccagc

SEQ ID NO: 3332098 - RNA, 17 nt, Human
ccacccaagggccuggc

SEQ ID NO: 3332099 - RNA, 19 nt, Human
ccacccaagggccuggccu

SEQ ID NO: 3332100 - RNA, 16 nt, Human
ccacccaagggccugg

SEQ ID NO: 3332101 - RNA, 20 nt, Human
ccacccaagggccuggccug

SEQ ID NO: 3332102 - RNA, 21 nt, Human
ccacccaagggccuggccuga

SEQ ID NO: 3332103 - RNA, 22 nt, Human
ccacccaagggccuggccugag

SEQ ID NO: 3332104 - RNA, 13 nt, Human
ccacccaccucag

SEQ ID NO: 3332105 - RNA, 15 nt, Human
ccacccaccucagcc

SEQ ID NO: 3332106 - RNA, 14 nt, Human
ccacccaccucagc

SEQ ID NO: 3332107 - RNA, 16 nt, Human
ccacccaccucagccu

SEQ ID NO: 3332108 - RNA, 14 nt, Human
ccacaucuugcucu

SEQ ID NO: 3332109 - RNA, 23 nt, Human
ccacaucuugcucugcugacaga

SEQ ID NO: 3332110 - RNA, 22 nt, Human
ccacaucuugcucugcugacag

SEQ ID NO: 3332111 - RNA, 20 nt, Human
ccacaucuugcucugcugac

SEQ ID NO: 3332112 - RNA, 16 nt, Human
ccacaucuugcucugc

SEQ ID NO: 3332113 - RNA, 14 nt, Human
ccaccaacauacuc

SEQ ID NO: 3332114 - RNA, 18 nt, Human
ccaccaacauacucccau

SEQ ID NO: 3332115 - RNA, 12 nt, Human
ccacacccagcc

SEQ ID NO: 3332116 - RNA, 14 nt, Human
ccacacccagccca

SEQ ID NO: 3332117 - RNA, 13 nt, Human
ccacacccagccc

SEQ ID NO: 3332118 - RNA, 13 nt, Human
ccacguuucuaaa

SEQ ID NO: 3332119 - RNA, 16 nt, Human
ccacugcgaccacaag

SEQ ID NO: 3332120 - RNA, 20 nt, Human
ccacugcacuccagccuggg

SEQ ID NO: 3332121 - RNA, 19 nt, Human
ccacugcacuccagccugg

SEQ ID NO: 3332122 - RNA, 15 nt, Human
ccacucccugcaacc

SEQ ID NO: 3332123 - RNA, 18 nt, Human
ccacugcacuccagccug

SEQ ID NO: 3332124 - RNA, 18 nt, Human
ccacuacauucuguuaau

SEQ ID NO: 3332125 - RNA, 22 nt, Human
ccacuacggaauaguuggcuag

SEQ ID NO: 3332126 - RNA, 23 nt, Human
ccacuacggaauaguuggcuagg

SEQ ID NO: 3332127 - RNA, 12 nt, Human
ccacucccugca

SEQ ID NO: 3332128 - RNA, 13 nt, Human
ccacucccugcaa

SEQ ID NO: 3332129 - RNA, 18 nt, Human
ccacucaguccauagcag

SEQ ID NO: 3332130 - RNA, 15 nt, Human
ccaccucagccuccc

SEQ ID NO: 3332131 - RNA, 14 nt, Human
ccaccucagccucc

SEQ ID NO: 3332132 - RNA, 13 nt, Human
ccaccucagccuc

SEQ ID NO: 3332133 - RNA, 16 nt, Human
ccacccugaaagcccu

SEQ ID NO: 3332134 - RNA, 17 nt, Human
ccacccugaaagcccug

SEQ ID NO: 3332135 - RNA, 12 nt, Human
ccaccucagccu

SEQ ID NO: 3332136 - RNA, 14 nt, Human
ccacccaggagccc

SEQ ID NO: 3332137 - RNA, 12 nt, Human
ccacccaggagc

SEQ ID NO: 3332138 - RNA, 15 nt, Human
ccacggccaggccag

SEQ ID NO: 3332139 - RNA, 14 nt, Human
ccacggccaggcca

SEQ ID NO: 3332140 - RNA, 13 nt, Human
ccacggccaggcc

SEQ ID NO: 3332141 - RNA, 12 nt, Human
ccacggccaggc

SEQ ID NO: 3332142 - RNA, 17 nt, Human
ccaccuggccucugcac

SEQ ID NO: 3332143 - RNA, 14 nt, Human
ccaccuggccucug

SEQ ID NO: 3332144 - RNA, 19 nt, Human
ccacgcuggagugcaguga

SEQ ID NO: 3332145 - RNA, 22 nt, Human
ccaccugcggugcuaucucccc

SEQ ID NO: 3332146 - RNA, 15 nt, Human
ccaccuggccucugc

SEQ ID NO: 3332147 - RNA, 16 nt, Human
ccaccuggccucugca

SEQ ID NO: 3332148 - RNA, 17 nt, Human
ccaccugccuguugggc

SEQ ID NO: 3332149 - RNA, 20 nt, Human
ccaccugccuguugggccag

SEQ ID NO: 3332150 - RNA, 16 nt, Human
ccaccugccagggaca

SEQ ID NO: 3332151 - RNA, 17 nt, Human
ccaccucccacaaagga

SEQ ID NO: 3332152 - RNA, 12 nt, Human
ccagauuucacu

SEQ ID NO: 3332153 - RNA, 18 nt, Human
ccagauugcaacaggcug

SEQ ID NO: 3332154 - RNA, 20 nt, Human
ccagauugcaacaggcuggg

SEQ ID NO: 3332155 - RNA, 19 nt, Human
ccagauugcaacaggcugg

SEQ ID NO: 3332156 - RNA, 15 nt, Human
ccagagggccugcaa

SEQ ID NO: 3332157 - RNA, 16 nt, Human
ccagagggccugcaag

SEQ ID NO: 3332158 - RNA, 23 nt, Human
ccagaugcaccagcccuuagcag

SEQ ID NO: 3332159 - RNA, 23 nt, Human
ccagagggagugacagaggcagc

SEQ ID NO: 3332160 - RNA, 22 nt, Human
ccagagggagugacagaggcag

SEQ ID NO: 3332161 - RNA, 13 nt, Human
ccagagggccugc

SEQ ID NO: 3332162 - RNA, 19 nt, Human
ccagauucuuuccugaggc

SEQ ID NO: 3332163 - RNA, 20 nt, Human
ccagauucuuuccugaggcu

SEQ ID NO: 3332164 - RNA, 21 nt, Human
ccagauucuuuccugaggcug

SEQ ID NO: 3332165 - RNA, 22 nt, Human
ccagauucuuuccugaggcugg

SEQ ID NO: 3332166 - RNA, 18 nt, Human
ccagauucuuuccugagg

SEQ ID NO: 3332167 - RNA, 13 nt, Human
ccagagagggugg

SEQ ID NO: 3332168 - RNA, 14 nt, Human
ccagagaggguggu

SEQ ID NO: 3332169 - RNA, 23 nt, Human
ccagagaggguggugaccucugc

SEQ ID NO: 3332170 - RNA, 21 nt, Human
ccagagaggguggugaccucu

SEQ ID NO: 3332171 - RNA, 19 nt, Human
ccagacaccuugacagggc

SEQ ID NO: 3332172 - RNA, 17 nt, Human
ccagacaccuugacagg

SEQ ID NO: 3332173 - RNA, 22 nt, Human
ccagaggagagaggacccccug

SEQ ID NO: 3332174 - RNA, 21 nt, Human
ccagaggagagaggacccccu

SEQ ID NO: 3332175 - RNA, 21 nt, Human
ccagagggagugacagaggca

SEQ ID NO: 3332176 - RNA, 20 nt, Human
ccagagggagugacagaggc

SEQ ID NO: 3332177 - RNA, 19 nt, Human
ccagagggagugacagagg

SEQ ID NO: 3332178 - RNA, 18 nt, Human
ccagagggagugacagag

SEQ ID NO: 3332179 - RNA, 17 nt, Human
ccagagggagugacaga

SEQ ID NO: 3332180 - RNA, 16 nt, Human
ccagagggagugacag

SEQ ID NO: 3332181 - RNA, 14 nt, Human
ccagagcugccacc

SEQ ID NO: 3332182 - RNA, 15 nt, Human
ccagagcugccaccu

SEQ ID NO: 3332183 - RNA, 16 nt, Human
ccagagcugccaccug

SEQ ID NO: 3332184 - RNA, 19 nt, Human
ccagagcugccaccugccu

SEQ ID NO: 3332185 - RNA, 12 nt, Human
ccagagcugcca

SEQ ID NO: 3332186 - RNA, 13 nt, Human
ccagagcugccac

SEQ ID NO: 3332187 - RNA, 11 nt, Human
ccagagcugcc

SEQ ID NO: 3332188 - RNA, 22 nt, Human
ccagcaagugagagcugggugu

SEQ ID NO: 3332189 - RNA, 21 nt, Human
ccagcaagugagagcugggug

SEQ ID NO: 3332190 - RNA, 20 nt, Human
ccagcaagugagagcugggu

SEQ ID NO: 3332191 - RNA, 14 nt, Human
ccagauuucacucu

SEQ ID NO: 3332192 - RNA, 15 nt, Human
ccagcaagugagagc

SEQ ID NO: 3332193 - RNA, 18 nt, Human
ccagccgccaugcuccug

SEQ ID NO: 3332194 - RNA, 14 nt, Human
ccagccgccaugcu

SEQ ID NO: 3332195 - RNA, 23 nt, Human
ccagccgagauagccaaggccaa

SEQ ID NO: 3332196 - RNA, 17 nt, Human
ccagcccuuagcaggga

SEQ ID NO: 3332197 - RNA, 16 nt, Human
ccagcccuuagcaggg

SEQ ID NO: 3332198 - RNA, 16 nt, Human
ccagccccagugccca

SEQ ID NO: 3332199 - RNA, 23 nt, Human
ccagccccaaaacucuccucugc

SEQ ID NO: 3332200 - RNA, 19 nt, Human
ccagccccaaaacucuccu

SEQ ID NO: 3332201 - RNA, 15 nt, Human
ccagccccagugccc

SEQ ID NO: 3332202 - RNA, 13 nt, Human
ccagccccagugc

SEQ ID NO: 3332203 - RNA, 18 nt, Human
ccagccaaagccuccucc

SEQ ID NO: 3332204 - RNA, 19 nt, Human
ccagccaaagccuccucca

SEQ ID NO: 3332205 - RNA, 15 nt, Human
ccagccaaagccucc

SEQ ID NO: 3332206 - RNA, 20 nt, Human
ccagugccgagaaggaagcc

SEQ ID NO: 3332207 - RNA, 22 nt, Human
ccagugguuccuaauccucuag

SEQ ID NO: 3332208 - RNA, 14 nt, Human
ccagugaggcucug

SEQ ID NO: 3332209 - RNA, 15 nt, Human
ccagugaggcucugc

SEQ ID NO: 3332210 - RNA, 16 nt, Human
ccagugaggcucugcc

SEQ ID NO: 3332211 - RNA, 23 nt, Human
ccagugcccacaggaucagucug

SEQ ID NO: 3332212 - RNA, 22 nt, Human
ccaguguuguggauuuaacaga

SEQ ID NO: 3332213 - RNA, 17 nt, Human
ccaguguugccuaagua

SEQ ID NO: 3332214 - RNA, 19 nt, Human
ccaguguugccuaaguauu

SEQ ID NO: 3332215 - RNA, 23 nt, Human
ccauauucuguuggccaguguga

SEQ ID NO: 3332216 - RNA, 20 nt, Human
ccaggcuuagucacugagac

SEQ ID NO: 3332217 - RNA, 14 nt, Human
ccagggacagaggg

SEQ ID NO: 3332218 - RNA, 15 nt, Human
ccagggacagagggg

SEQ ID NO: 3332219 - RNA, 21 nt, Human
ccagggacagaggggguggcc

SEQ ID NO: 3332220 - RNA, 19 nt, Human
ccaggugcacaagcuccaa

SEQ ID NO: 3332221 - RNA, 20 nt, Human
ccaggugcacaagcuccaag

SEQ ID NO: 3332222 - RNA, 18 nt, Human
ccaggugcacaagcucca

SEQ ID NO: 3332223 - RNA, 18 nt, Human
ccagucuggaaugcagug

SEQ ID NO: 3332224 - RNA, 13 nt, Human
ccagugaggcucu

SEQ ID NO: 3332225 - RNA, 20 nt, Human
ccagucuggaaugcaguggu

SEQ ID NO: 3332226 - RNA, 19 nt, Human
ccagucuggaaugcagugg

SEQ ID NO: 3332227 - RNA, 17 nt, Human
ccagguuuuuggucuga

SEQ ID NO: 3332228 - RNA, 15 nt, Human
ccagguucagcuugu

SEQ ID NO: 3332229 - RNA, 20 nt, Human
ccaggcccucugcccacucc

SEQ ID NO: 3332230 - RNA, 21 nt, Human
ccaggcccucugcccacuccc

SEQ ID NO: 3332231 - RNA, 22 nt, Human
ccaggcccucugcccacucccu

SEQ ID NO: 3332232 - RNA, 23 nt, Human
ccaggcccucugcccacucccug

SEQ ID NO: 3332233 - RNA, 17 nt, Human
ccaggcuuagucacuga

SEQ ID NO: 3332234 - RNA, 24 nt, Human
ccaggcuguaucccaugagccuca

SEQ ID NO: 3332235 - RNA, 17 nt, Human
ccaggcauuccccagga

SEQ ID NO: 3332236 - RNA, 18 nt, Human
ccaggcauuccccaggag

SEQ ID NO: 3332237 - RNA, 19 nt, Human
ccaggcauuccccaggagg

SEQ ID NO: 3332238 - RNA, 21 nt, Human
ccaggcauuccccaggaggcc

SEQ ID NO: 3332239 - RNA, 20 nt, Human
ccaggagccccgaggccuuc

SEQ ID NO: 3332240 - RNA, 19 nt, Human
ccaggagccuccugcccuu

SEQ ID NO: 3332241 - RNA, 19 nt, Human
ccaggagccccgaggccuu

SEQ ID NO: 3332242 - RNA, 16 nt, Human
ccaggagccccgaggc

SEQ ID NO: 3332243 - RNA, 14 nt, Human
ccauuuguguuuau

SEQ ID NO: 3332244 - RNA, 19 nt, Human
ccauucuccaccugccagg

SEQ ID NO: 3332245 - RNA, 20 nt, Human
ccauucuccaccugccaggg

SEQ ID NO: 3332246 - RNA, 16 nt, Human
cccaaagcagugcaug

SEQ ID NO: 3332247 - RNA, 16 nt, Human
cccaaaacucuccucu

SEQ ID NO: 3332248 - RNA, 18 nt, Human
cccaaaacucuccucugc

SEQ ID NO: 3332249 - RNA, 15 nt, Human
cccaaagugcuggga

SEQ ID NO: 3332250 - RNA, 13 nt, Human
cccaaagugcugg

SEQ ID NO: 3332251 - RNA, 16 nt, Human
cccaaagugcugggau

SEQ ID NO: 3332252 - RNA, 18 nt, Human
cccaaauggaaaugggca

SEQ ID NO: 3332253 - RNA, 22 nt, Human
cccaaauggaaaugggcagagc

SEQ ID NO: 3332254 - RNA, 19 nt, Human
ccauauucuguuggccagu

SEQ ID NO: 3332255 - RNA, 18 nt, Human
ccauucuccaccugccag

SEQ ID NO: 3332256 - RNA, 16 nt, Human
ccauguuggccaggcu

SEQ ID NO: 3332257 - RNA, 17 nt, Human
ccauguuggccaggcug

SEQ ID NO: 3332258 - RNA, 23 nt, Human
ccugccuguugggccaggagccu

SEQ ID NO: 3332259 - RNA, 22 nt, Human
ccugccccucaacucuccucca

SEQ ID NO: 3332260 - RNA, 16 nt, Human
ccugcggugcuaucuc

SEQ ID NO: 3332261 - RNA, 17 nt, Human
ccugcggugcuaucucc

SEQ ID NO: 3332262 - RNA, 22 nt, Human
ccugcucuccgaccagacaccu

SEQ ID NO: 3332263 - RNA, 22 nt, Human
ccugcggugcuaucucccccag

SEQ ID NO: 3332264 - RNA, 21 nt, Human
ccugcucuccgaccagacacc

SEQ ID NO: 3332265 - RNA, 14 nt, Human
ccugcuucaaauau

SEQ ID NO: 3332266 - RNA, 15 nt, Human
ccuggccagaugcac

SEQ ID NO: 3332267 - RNA, 18 nt, Human
ccuggaauauauaaccag

SEQ ID NO: 3332268 - RNA, 12 nt, Human
ccuggcagcccc

SEQ ID NO: 3332269 - RNA, 13 nt, Human
ccuggcagccccu

SEQ ID NO: 3332270 - RNA, 23 nt, Human
ccuggcacccggccccugcuggu

SEQ ID NO: 3332271 - RNA, 21 nt, Human
ccuggcacccggccccugcug

SEQ ID NO: 3332272 - RNA, 22 nt, Human
ccuggcacccggccccugcugg

SEQ ID NO: 3332273 - RNA, 13 nt, Human
ccugccaggaagc

SEQ ID NO: 3332274 - RNA, 14 nt, Human
ccugccaggaagcc

SEQ ID NO: 3332275 - RNA, 15 nt, Human
ccugccaggaagcca

SEQ ID NO: 3332276 - RNA, 17 nt, Human
ccugccaggaagccagc

SEQ ID NO: 3332277 - RNA, 15 nt, Human
ccugccaggcauggu

SEQ ID NO: 3332278 - RNA, 23 nt, Human
ccugccaggaagccagcaggcuc

SEQ ID NO: 3332279 - RNA, 16 nt, Human
ccugccaggcauggug

SEQ ID NO: 3332280 - RNA, 11 nt, Human
ccugccaggga

SEQ ID NO: 3332281 - RNA, 18 nt, Human
ccugccaggaagccagca

SEQ ID NO: 3332282 - RNA, 19 nt, Human
ccugccaggaagccagcag

SEQ ID NO: 3332283 - RNA, 21 nt, Human
ccugccaggaagccagcaggc

SEQ ID NO: 3332284 - RNA, 22 nt, Human
ccugccaggaagccagcaggcu

SEQ ID NO: 3332285 - RNA, 12 nt, Human
ccugccagggac

SEQ ID NO: 3332286 - RNA, 13 nt, Human
ccugccagggaca

SEQ ID NO: 3332287 - RNA, 14 nt, Human
ccugccagggacag

SEQ ID NO: 3332288 - RNA, 15 nt, Human
ccugccagggacaga

SEQ ID NO: 3332289 - RNA, 16 nt, Human
ccugccagggacagag

SEQ ID NO: 3332290 - RNA, 22 nt, Human
ccugcaaccugauugugucucu

SEQ ID NO: 3332291 - RNA, 21 nt, Human
ccugcaaccugauugugucuc

SEQ ID NO: 3332292 - RNA, 17 nt, Human
ccugauugugucucuug

SEQ ID NO: 3332293 - RNA, 11 nt, Human
ccugaggcccu

SEQ ID NO: 3332294 - RNA, 12 nt, Human
ccugaggcccuu

SEQ ID NO: 3332295 - RNA, 19 nt, Human
ccugaugcuucuucagaga

SEQ ID NO: 3332296 - RNA, 20 nt, Human
ccugaugcuucuucagagac

SEQ ID NO: 3332297 - RNA, 21 nt, Human
ccugaugcuucuucagagacu

SEQ ID NO: 3332298 - RNA, 15 nt, Human
ccugauugugucucu

SEQ ID NO: 3332299 - RNA, 23 nt, Human
ccugcaggcagccaggccacaag

SEQ ID NO: 3332300 - RNA, 14 nt, Human
ccugcaagaacaag

SEQ ID NO: 3332301 - RNA, 23 nt, Human
ccugacaacacucauugaccuga

SEQ ID NO: 3332302 - RNA, 21 nt, Human
ccugaggcccagagggccugc

SEQ ID NO: 3332303 - RNA, 18 nt, Human
ccugaggcccagagggcc

SEQ ID NO: 3332304 - RNA, 16 nt, Human
ccugagcuuucugcua

SEQ ID NO: 3332305 - RNA, 20 nt, Human
ccugagccagauuucacucu

SEQ ID NO: 3332306 - RNA, 14 nt, Human
ccugagcuuucugc

SEQ ID NO: 3332307 - RNA, 17 nt, Human
cgccaugcuccuggccc

SEQ ID NO: 3332308 - RNA, 17 nt, Human
cgccagauucuuuccug

SEQ ID NO: 3332309 - RNA, 19 nt, Human
cgccagauucuuuccugag

SEQ ID NO: 3332310 - RNA, 20 nt, Human
cgccagauucuuuccugagg

SEQ ID NO: 3332311 - RNA, 21 nt, Human
cgccagauucuuuccugaggc

SEQ ID NO: 3332312 - RNA, 15 nt, Human
cgcagacaggaccag

SEQ ID NO: 3332313 - RNA, 16 nt, Human
cgcagacaggaccagg

SEQ ID NO: 3332314 - RNA, 14 nt, Human
cgcagcccugcaga

SEQ ID NO: 3332315 - RNA, 20 nt, Human
cgauuucuguuuagauaaua

SEQ ID NO: 3332316 - RNA, 18 nt, Human
cgcacacacacacauaca

SEQ ID NO: 3332317 - RNA, 16 nt, Human
cgcacacacacacaua

SEQ ID NO: 3332318 - RNA, 18 nt, Human
cgagcaugccuggauggg

SEQ ID NO: 3332319 - RNA, 16 nt, Human
cgagcccugguggcag

SEQ ID NO: 3332320 - RNA, 15 nt, Human
cgagcccugguggca

SEQ ID NO: 3332321 - RNA, 20 nt, Human
ccuuugacgccaucccagcc

SEQ ID NO: 3332322 - RNA, 21 nt, Human
ccuuugacgccaucccagccc

SEQ ID NO: 3332323 - RNA, 22 nt, Human
ccuuugacgccaucccagcccc

SEQ ID NO: 3332324 - RNA, 18 nt, Human
cgaaaacguggcugcuuc

SEQ ID NO: 3332325 - RNA, 19 nt, Human
cgaaaacguggcugcuuca

SEQ ID NO: 3332326 - RNA, 15 nt, Human
cgaaaacguggcugc

SEQ ID NO: 3332327 - RNA, 20 nt, Human
cgaaaacguggcugcuucaa

SEQ ID NO: 3332328 - RNA, 21 nt, Human
cgaaagaacaguccauugaaa

SEQ ID NO: 3332329 - RNA, 12 nt, Human
cgaaagaacagu

SEQ ID NO: 3332330 - RNA, 23 nt, Human
cgaaagagagagaaacaaacuuu

SEQ ID NO: 3332331 - RNA, 22 nt, Human
cgaaagagagagaaacaaacuu

SEQ ID NO: 3332332 - RNA, 13 nt, Human
cgaaagagagaga

SEQ ID NO: 3332333 - RNA, 12 nt, Human
cgaaagagagag

SEQ ID NO: 3332334 - RNA, 11 nt, Human
cgaaagagaga

SEQ ID NO: 3332335 - RNA, 23 nt, Human
cgaacauguuuuucuucucccuc

SEQ ID NO: 3332336 - RNA, 22 nt, Human
cgaaagggacuuggaagcuccg

SEQ ID NO: 3332337 - RNA, 20 nt, Human
cgaaaggaugaaagugacca

SEQ ID NO: 3332338 - RNA, 19 nt, Human
cgaaagggacuuggaagcu

SEQ ID NO: 3332339 - RNA, 14 nt, Human
cgaacuggcugcaa

SEQ ID NO: 3332340 - RNA, 12 nt, Human
cgaacuggcugc

SEQ ID NO: 3332341 - RNA, 18 nt, Human
cgagauagccaaggccaa

SEQ ID NO: 3332342 - RNA, 17 nt, Human
cgagaucacgccacugc

SEQ ID NO: 3332343 - RNA, 14 nt, Human
cgaauagcugggac

SEQ ID NO: 3332344 - RNA, 13 nt, Human
cgaauagcuggga

SEQ ID NO: 3332345 - RNA, 14 nt, Human
cgagcaugccugga

SEQ ID NO: 3332346 - RNA, 13 nt, Human
cgagcaugccugg

SEQ ID NO: 3332347 - RNA, 16 nt, Human
cgagcaugccuggaug

SEQ ID NO: 3332348 - RNA, 17 nt, Human
cgagcaugccuggaugg

SEQ ID NO: 3332349 - RNA, 20 nt, Human
cgagcaggcuucuucccccc

SEQ ID NO: 3332350 - RNA, 20 nt, Human
cgagaucacgccacugcacu

SEQ ID NO: 3332351 - RNA, 18 nt, Human
cgagaucacgccacugca

SEQ ID NO: 3332352 - RNA, 20 nt, Human
cgagauugcaccacugcacu

SEQ ID NO: 3332353 - RNA, 21 nt, Human
ccugugugugcgccuacagga

SEQ ID NO: 3332354 - RNA, 20 nt, Human
ccugugugugcgccuacagg

SEQ ID NO: 3332355 - RNA, 22 nt, Human
ccugugucuugcaauggcagcc

SEQ ID NO: 3332356 - RNA, 21 nt, Human
ccugugucuugcaauggcagc

SEQ ID NO: 3332357 - RNA, 19 nt, Human
ccugugucuugcaauggca

SEQ ID NO: 3332358 - RNA, 17 nt, Human
ccugugucuugcaaugg

SEQ ID NO: 3332359 - RNA, 14 nt, Human
ccuguuuguuucug

SEQ ID NO: 3332360 - RNA, 18 nt, Human
ccuguuuguuucugaaag

SEQ ID NO: 3332361 - RNA, 16 nt, Human
ccuguuucugcagcca

SEQ ID NO: 3332362 - RNA, 23 nt, Human
ccuguugggccaggagccuccug

SEQ ID NO: 3332363 - RNA, 15 nt, Human
ccuuacccucauguu

SEQ ID NO: 3332364 - RNA, 17 nt, Human
ccuuaccagcagagcac

SEQ ID NO: 3332365 - RNA, 20 nt, Human
ccuuaccagcagagcaccuu

SEQ ID NO: 3332366 - RNA, 14 nt, Human
ccuuaccugccagg

SEQ ID NO: 3332367 - RNA, 19 nt, Human
ccuuaccugccaggaagcc

SEQ ID NO: 3332368 - RNA, 18 nt, Human
ccuuagaagucacacagu

SEQ ID NO: 3332369 - RNA, 17 nt, Human
ccuuagaagucacacag

SEQ ID NO: 3332370 - RNA, 14 nt, Human
ccuuacacaauggu

SEQ ID NO: 3332371 - RNA, 20 nt, Human
ccuuacacaaugguuuucuu

SEQ ID NO: 3332372 - RNA, 21 nt, Human
ccuugguuaggcauuguggga

SEQ ID NO: 3332373 - RNA, 22 nt, Human
ccuugguuaggcauugugggaa

SEQ ID NO: 3332374 - RNA, 22 nt, Human
ccuuggugucgggcaugacacg

SEQ ID NO: 3332375 - RNA, 21 nt, Human
ccuuggugucgggcaugacac

SEQ ID NO: 3332376 - RNA, 16 nt, Human
ccuuugacgccauccc

SEQ ID NO: 3332377 - RNA, 17 nt, Human
ccuuugacgccauccca

SEQ ID NO: 3332378 - RNA, 18 nt, Human
ccuuugacgccaucccag

SEQ ID NO: 3332379 - RNA, 15 nt, Human
ccuucuccuucaccu

SEQ ID NO: 3332380 - RNA, 19 nt, Human
ccuucuccuucaccuuugu

SEQ ID NO: 3332381 - RNA, 15 nt, Human
ccuucggcgccuuaa

SEQ ID NO: 3332382 - RNA, 13 nt, Human
ccuugacucuuuc

SEQ ID NO: 3332383 - RNA, 22 nt, Human
ccuugaccauucuccaccugcc

SEQ ID NO: 3332384 - RNA, 23 nt, Human
ccuugaccauucuccaccugcca

SEQ ID NO: 3332385 - RNA, 19 nt, Human
ccuugaacuuugaccucug

SEQ ID NO: 3332386 - RNA, 19 nt, Human
ccuucauuuggcauucccc

SEQ ID NO: 3332387 - RNA, 14 nt, Human
ccuucagugccaaa

SEQ ID NO: 3332388 - RNA, 11 nt, Human
ccuucagugcc

SEQ ID NO: 3332389 - RNA, 10 nt, Human
ccuucagugc

SEQ ID NO: 3332390 - RNA, 21 nt, Human
ccuucaccuuuguccccaccg

SEQ ID NO: 3332391 - RNA, 19 nt, Human
ccuucaccuuuguccccac

SEQ ID NO: 3332392 - RNA, 20 nt, Human
ccuucaccuuuguccccacc

SEQ ID NO: 3332393 - RNA, 17 nt, Human
ccuucacagaugggugc

SEQ ID NO: 3332394 - RNA, 22 nt, Human
ccuucauuuggcauuccccacu

SEQ ID NO: 3332395 - RNA, 18 nt, Human
ccuucgcuccugugucuu

SEQ ID NO: 3332396 - RNA, 17 nt, Human
ccucccgaauagcuggg

SEQ ID NO: 3332397 - RNA, 10 nt, Human
ccucccuccc

SEQ ID NO: 3332398 - RNA, 14 nt, Human
ccuccucagaucuu

SEQ ID NO: 3332399 - RNA, 21 nt, Human
ccucccgaguagcugggacua

SEQ ID NO: 3332400 - RNA, 20 nt, Human
ccucccgaguagcugggacu

SEQ ID NO: 3332401 - RNA, 19 nt, Human
ccucccgaguagcugggac

SEQ ID NO: 3332402 - RNA, 14 nt, Human
ccuccugggcuaag

SEQ ID NO: 3332403 - RNA, 23 nt, Human
ccuccugccucgaacuggcugca

SEQ ID NO: 3332404 - RNA, 13 nt, Human
ccuccugccucga

SEQ ID NO: 3332405 - RNA, 16 nt, Human
ccucggugccuuccuc

SEQ ID NO: 3332406 - RNA, 14 nt, Human
ccucgguguggaga

SEQ ID NO: 3332407 - RNA, 16 nt, Human
ccucuaggaggucucu

SEQ ID NO: 3332408 - RNA, 13 nt, Human
ccucauccucaua

SEQ ID NO: 3332409 - RNA, 20 nt, Human
ccucauccucauacccaccc

SEQ ID NO: 3332410 - RNA, 13 nt, Human
ccucaucaccaac

SEQ ID NO: 3332411 - RNA, 14 nt, Human
ccucaucaccaacg

SEQ ID NO: 3332412 - RNA, 22 nt, Human
ccucauaguaugguggcugggu

SEQ ID NO: 3332413 - RNA, 21 nt, Human
ccucauaguaugguggcuggg

SEQ ID NO: 3332414 - RNA, 13 nt, Human
ccucauacccacc

SEQ ID NO: 3332415 - RNA, 20 nt, Human
ccucauaguaugguggcugg

SEQ ID NO: 3332416 - RNA, 20 nt, Human
ccucagucuggcccuuccuu

SEQ ID NO: 3332417 - RNA, 12 nt, Human
ccucauacccac

SEQ ID NO: 3332418 - RNA, 11 nt, Human
ccucagugcca

SEQ ID NO: 3332419 - RNA, 19 nt, Human
ccucagucuggcccuuccu

SEQ ID NO: 3332420 - RNA, 15 nt, Human
ccucccaaagugcug

SEQ ID NO: 3332421 - RNA, 23 nt, Human
ccuccaugugggcuaguugggcu

SEQ ID NO: 3332422 - RNA, 19 nt, Human
ccuccaggugcacaagcuc

SEQ ID NO: 3332423 - RNA, 21 nt, Human
ccuccaggugcacaagcucca

SEQ ID NO: 3332424 - RNA, 22 nt, Human
ccuccaggugcacaagcuccaa

SEQ ID NO: 3332425 - RNA, 17 nt, Human
ccuccaggugcacaagc

SEQ ID NO: 3332426 - RNA, 14 nt, Human
ccuaaaguguauuu

SEQ ID NO: 3332427 - RNA, 13 nt, Human
ccuaguuccacca

SEQ ID NO: 3332428 - RNA, 21 nt, Human
ccuaguuccaccaucaagcca

SEQ ID NO: 3332429 - RNA, 23 nt, Human
ccuaguuccaccaucaagccacc

SEQ ID NO: 3332430 - RNA, 18 nt, Human
ccuauauuguuuucagug

SEQ ID NO: 3332431 - RNA, 22 nt, Human
ccuauauuguuuucaguguaca

SEQ ID NO: 3332432 - RNA, 23 nt, Human
ccgcuaagagggagggagggcuc

SEQ ID NO: 3332433 - RNA, 21 nt, Human
ccgcuaagagggagggagggc

SEQ ID NO: 3332434 - RNA, 14 nt, Human
ccgcacugggcuug

SEQ ID NO: 3332435 - RNA, 17 nt, Human
ccgaguagcugggacua

SEQ ID NO: 3332436 - RNA, 16 nt, Human
ccgaguagcugggacu

SEQ ID NO: 3332437 - RNA, 20 nt, Human
ccgaguagcugggacuacag

SEQ ID NO: 3332438 - RNA, 14 nt, Human
ccgaggccuucucu

SEQ ID NO: 3332439 - RNA, 12 nt, Human
ccgcuuucuacc

SEQ ID NO: 3332440 - RNA, 17 nt, Human
ccggcuggccuggcccc

SEQ ID NO: 3332441 - RNA, 18 nt, Human
ccggcuggccuggccccu

SEQ ID NO: 3332442 - RNA, 15 nt, Human
ccggcuggccuggcc

SEQ ID NO: 3332443 - RNA, 19 nt, Human
ccgcuuucuacccagcgag

SEQ ID NO: 3332444 - RNA, 20 nt, Human
ccgggaagggggcugggaca

SEQ ID NO: 3332445 - RNA, 22 nt, Human
ccgggcucugccucccaucacc

SEQ ID NO: 3332446 - RNA, 20 nt, Human
ccgggcgcgguggcucacgc

SEQ ID NO: 3332447 - RNA, 12 nt, Human
cccucuggggcu

SEQ ID NO: 3332448 - RNA, 16 nt, Human
cccucuggggcuguuc

SEQ ID NO: 3332449 - RNA, 13 nt, Human
cccugaggcccag

SEQ ID NO: 3332450 - RNA, 15 nt, Human
cccugaaagcccuga

SEQ ID NO: 3332451 - RNA, 14 nt, Human
cccugaggcccaga

SEQ ID NO: 3332452 - RNA, 15 nt, Human
cccugaggcccagag

SEQ ID NO: 3332453 - RNA, 16 nt, Human
cccugaggcccagagg

SEQ ID NO: 3332454 - RNA, 17 nt, Human
cccugaggcccagaggg

SEQ ID NO: 3332455 - RNA, 18 nt, Human
cccugaggcccagagggc

SEQ ID NO: 3332456 - RNA, 19 nt, Human
cccugaggcccagagggcc

SEQ ID NO: 3332457 - RNA, 20 nt, Human
cccugaggcccagagggccu

SEQ ID NO: 3332458 - RNA, 23 nt, Human
cccugaggcccagagggccugca

SEQ ID NO: 3332459 - RNA, 19 nt, Human
cccugcacuugcagacucu

SEQ ID NO: 3332460 - RNA, 12 nt, Human
cccugcacuugc

SEQ ID NO: 3332461 - RNA, 13 nt, Human
cccugcccaccug

SEQ ID NO: 3332462 - RNA, 14 nt, Human
cccugcccaccugg

SEQ ID NO: 3332463 - RNA, 17 nt, Human
cccugcccaccuggccu

SEQ ID NO: 3332464 - RNA, 18 nt, Human
cccugcccaccuggccuc

SEQ ID NO: 3332465 - RNA, 16 nt, Human
cccugcuggguguggc

SEQ ID NO: 3332466 - RNA, 21 nt, Human
cccugcuggguguggcgcagc

SEQ ID NO: 3332467 - RNA, 16 nt, Human
cccugguggcagcuca

SEQ ID NO: 3332468 - RNA, 17 nt, Human
cccugguggcagcucac

SEQ ID NO: 3332469 - RNA, 15 nt, Human
cccugguggcagcuc

SEQ ID NO: 3332470 - RNA, 14 nt, Human
cccgggcucugccu

SEQ ID NO: 3332471 - RNA, 15 nt, Human
cccgggcucugccuc

SEQ ID NO: 3332472 - RNA, 12 nt, Human
cccgggcucugc

SEQ ID NO: 3332473 - RNA, 22 nt, Human
cccgaguagcugggacuacagg

SEQ ID NO: 3332474 - RNA, 22 nt, Human
cccgcccaggcuuagucacuga

SEQ ID NO: 3332475 - RNA, 19 nt, Human
cccgcugucagccauuccu

SEQ ID NO: 3332476 - RNA, 20 nt, Human
cccgcugucagccauuccug

SEQ ID NO: 3332477 - RNA, 21 nt, Human
cccgaguagcugggacuacag

SEQ ID NO: 3332478 - RNA, 18 nt, Human
cccgaguagcugggacua

SEQ ID NO: 3332479 - RNA, 17 nt, Human
cccgaguagcugggacu

SEQ ID NO: 3332480 - RNA, 16 nt, Human
cccgaguagcugggac

SEQ ID NO: 3332481 - RNA, 15 nt, Human
cccgaguagcuggga

SEQ ID NO: 3332482 - RNA, 14 nt, Human
cccgaguagcuggg

SEQ ID NO: 3332483 - RNA, 13 nt, Human
cccgaguagcugg

SEQ ID NO: 3332484 - RNA, 15 nt, Human
cccagagggccugca

SEQ ID NO: 3332485 - RNA, 21 nt, Human
cccgaggccuucucugaagga

SEQ ID NO: 3332486 - RNA, 14 nt, Human
cccagagggccugc

SEQ ID NO: 3332487 - RNA, 20 nt, Human
cccuacaguugaaaaacagc

SEQ ID NO: 3332488 - RNA, 16 nt, Human
cccgggcucugccucc

SEQ ID NO: 3332489 - RNA, 19 nt, Human
cccaccgcagacaggacca

SEQ ID NO: 3332490 - RNA, 20 nt, Human
cccaccgcagacaggaccag

SEQ ID NO: 3332491 - RNA, 19 nt, Human
cccaccucucucacuccuu

SEQ ID NO: 3332492 - RNA, 22 nt, Human
cccaccucucucacuccuugaa

SEQ ID NO: 3332493 - RNA, 17 nt, Human
cccaccucagccucccg

SEQ ID NO: 3332494 - RNA, 20 nt, Human
cccacgcuggagugcaguga

SEQ ID NO: 3332495 - RNA, 19 nt, Human
cccacgcuggagugcagug

SEQ ID NO: 3332496 - RNA, 14 nt, Human
cccacgcuggagug

SEQ ID NO: 3332497 - RNA, 23 nt, Human
cccacuugagaauuacccuuuug

SEQ ID NO: 3332498 - RNA, 12 nt, Human
cccacuucugcc

SEQ ID NO: 3332499 - RNA, 20 nt, Human
cccacgacugcccggcaggg

SEQ ID NO: 3332500 - RNA, 21 nt, Human
cccacgacugcccggcagggu

SEQ ID NO: 3332501 - RNA, 20 nt, Human
cccaccuuggcugcagggag

SEQ ID NO: 3332502 - RNA, 16 nt, Human
cccaccuggccucugc

SEQ ID NO: 3332503 - RNA, 19 nt, Human
cccaccuggccucugcacu

SEQ ID NO: 3332504 - RNA, 21 nt, Human
cccaccuggccucugcacucc

SEQ ID NO: 3332505 - RNA, 17 nt, Human
cccaccuggccucugca

SEQ ID NO: 3332506 - RNA, 16 nt, Human
cccaaugcacuuuguu

SEQ ID NO: 3332507 - RNA, 20 nt, Human
cccaaugcacuuuguucugg

SEQ ID NO: 3332508 - RNA, 21 nt, Human
cccacaaaggagagcuagcag

SEQ ID NO: 3332509 - RNA, 21 nt, Human
cugggauuacaagcgugagcc

SEQ ID NO: 3332510 - RNA, 18 nt, Human
cugggggccucagugcca

SEQ ID NO: 3332511 - RNA, 14 nt, Human
cugggggcugggca

SEQ ID NO: 3332512 - RNA, 18 nt, Human
cugggcuugucuguagau

SEQ ID NO: 3332513 - RNA, 22 nt, Human
cugggcuuggggaccagagcug

SEQ ID NO: 3332514 - RNA, 21 nt, Human
cugggcuuggggaccagagcu

SEQ ID NO: 3332515 - RNA, 15 nt, Human
cugggcuucaguggc

SEQ ID NO: 3332516 - RNA, 17 nt, Human
cuguacaugaaaacaca

SEQ ID NO: 3332517 - RNA, 20 nt, Human
cuguacaugaaaacacauuu

SEQ ID NO: 3332518 - RNA, 21 nt, Human
cuguacaugaaaacacauuuu

SEQ ID NO: 3332519 - RNA, 18 nt, Human
cuguacgucugacaggca

SEQ ID NO: 3332520 - RNA, 16 nt, Human
cuguacgucugacagg

SEQ ID NO: 3332521 - RNA, 15 nt, Human
cuguacgucugacag

SEQ ID NO: 3332522 - RNA, 14 nt, Human
cuguacgucugaca

SEQ ID NO: 3332523 - RNA, 20 nt, Human
cuguacgucugacaggcaau

SEQ ID NO: 3332524 - RNA, 19 nt, Human
cuguacgucugacaggcaa

SEQ ID NO: 3332525 - RNA, 19 nt, Human
cuguaucccaugagccuca

SEQ ID NO: 3332526 - RNA, 20 nt, Human
cuguaucccaugagccucag

SEQ ID NO: 3332527 - RNA, 21 nt, Human
cuguaucccaugagccucagc

SEQ ID NO: 3332528 - RNA, 15 nt, Human
cugucaauuacagga

SEQ ID NO: 3332529 - RNA, 16 nt, Human
cugucaauuacaggaa

SEQ ID NO: 3332530 - RNA, 13 nt, Human
cugucaauuacag

SEQ ID NO: 3332531 - RNA, 20 nt, Human
cuguauuuuguuuuugucuu

SEQ ID NO: 3332532 - RNA, 21 nt, Human
cugguuagagguucccuuuga

SEQ ID NO: 3332533 - RNA, 22 nt, Human
cugguuagagguucccuuugac

SEQ ID NO: 3332534 - RNA, 14 nt, Human
cuguacagagccca

SEQ ID NO: 3332535 - RNA, 15 nt, Human
cuguacagagcccac

SEQ ID NO: 3332536 - RNA, 18 nt, Human
cuguacagagcccacgcc

SEQ ID NO: 3332537 - RNA, 14 nt, Human
cuguaauuugugau

SEQ ID NO: 3332538 - RNA, 15 nt, Human
cuguaauuugugaua

SEQ ID NO: 3332539 - RNA, 18 nt, Human
cugguggcagugggagcu

SEQ ID NO: 3332540 - RNA, 14 nt, Human
cugguggcaguggg

SEQ ID NO: 3332541 - RNA, 20 nt, Human
cugguggcagcucaccucuc

SEQ ID NO: 3332542 - RNA, 15 nt, Human
cugguggcagcugcg

SEQ ID NO: 3332543 - RNA, 17 nt, Human
cugguggcagcucaccu

SEQ ID NO: 3332544 - RNA, 18 nt, Human
cugguggcagcucaccuc

SEQ ID NO: 3332545 - RNA, 16 nt, Human
cugguggcagcucacc

SEQ ID NO: 3332546 - RNA, 14 nt, Human
cugguggcagcugc

SEQ ID NO: 3332547 - RNA, 18 nt, Human
cugucaauuacaggaagu

SEQ ID NO: 3332548 - RNA, 20 nt, Human
cugucauuugagcagggcuc

SEQ ID NO: 3332549 - RNA, 22 nt, Human
cugucauuugagcagggcucag

SEQ ID NO: 3332550 - RNA, 21 nt, Human
cugucauuugagcagggcuca

SEQ ID NO: 3332551 - RNA, 15 nt, Human
cugugaaaggaaaga

SEQ ID NO: 3332552 - RNA, 18 nt, Human
cugucuucaguaagccgu

SEQ ID NO: 3332553 - RNA, 22 nt, Human
cugugccauuuuguauuuuacu

SEQ ID NO: 3332554 - RNA, 19 nt, Human
cugugcccuaaaguguauu

SEQ ID NO: 3332555 - RNA, 14 nt, Human
cugugccaugugcc

SEQ ID NO: 3332556 - RNA, 15 nt, Human
cugugauggggcccu

SEQ ID NO: 3332557 - RNA, 16 nt, Human
cugugauggggcccug

SEQ ID NO: 3332558 - RNA, 21 nt, Human
cugugauggggcccugccucc

SEQ ID NO: 3332559 - RNA, 23 nt, Human
cugugauggggcccugccuccuu

SEQ ID NO: 3332560 - RNA, 20 nt, Human
cugugauggggcccugccuc

SEQ ID NO: 3332561 - RNA, 16 nt, Human
cugugaaaggaaagag

SEQ ID NO: 3332562 - RNA, 22 nt, Human
cugugaaaggaaagagggaggu

SEQ ID NO: 3332563 - RNA, 21 nt, Human
cuguggguuucuaaagcugcc

SEQ ID NO: 3332564 - RNA, 22 nt, Human
cuguggguuucuaaagcugcca

SEQ ID NO: 3332565 - RNA, 20 nt, Human
cugugucuuuuuucacuaca

SEQ ID NO: 3332566 - RNA, 23 nt, Human
cugugucuugcaauggcagccuu

SEQ ID NO: 3332567 - RNA, 23 nt, Human
cuguucuuucuggcuaugcauuu

SEQ ID NO: 3332568 - RNA, 16 nt, Human
cuguugcccaggcugg

SEQ ID NO: 3332569 - RNA, 15 nt, Human
cuguugcccaggcug

SEQ ID NO: 3332570 - RNA, 14 nt, Human
cuguugcccaggcu

SEQ ID NO: 3332571 - RNA, 13 nt, Human
cuguugcccaggc

SEQ ID NO: 3332572 - RNA, 12 nt, Human
cuguugcccagg

SEQ ID NO: 3332573 - RNA, 15 nt, Human
cuguucuuuccaaag

SEQ ID NO: 3332574 - RNA, 16 nt, Human
cuguucuuuccaaagu

SEQ ID NO: 3332575 - RNA, 19 nt, Human
cuguucuuuccaaaguaca

SEQ ID NO: 3332576 - RNA, 21 nt, Human
cuguucuuuccaaaguacacu

SEQ ID NO: 3332577 - RNA, 13 nt, Human
cuguucuuucugg

SEQ ID NO: 3332578 - RNA, 14 nt, Human
cuguucuuucuggc

SEQ ID NO: 3332579 - RNA, 21 nt, Human
cuguucuuucuggcuaugcau

SEQ ID NO: 3332580 - RNA, 16 nt, Human
cuguuaauaguucagg

SEQ ID NO: 3332581 - RNA, 17 nt, Human
cuguuugcuaagugagg

SEQ ID NO: 3332582 - RNA, 19 nt, Human
cuguuugcuaagugaggau

SEQ ID NO: 3332583 - RNA, 15 nt, Human
cuguuucaaacuuua

SEQ ID NO: 3332584 - RNA, 17 nt, Human
cuguuucaaacuuuacu

SEQ ID NO: 3332585 - RNA, 18 nt, Human
cuguuuagauaauacacc

SEQ ID NO: 3332586 - RNA, 14 nt, Human
cuguuuagauaaua

SEQ ID NO: 3332587 - RNA, 17 nt, Human
cuguuuagauaauacac

SEQ ID NO: 3332588 - RNA, 17 nt, Human
cuguugcccaggcuggc

SEQ ID NO: 3332589 - RNA, 16 nt, Human
cuuaaaaaguggaaaa

SEQ ID NO: 3332590 - RNA, 17 nt, Human
cuuaaaaaguggaaaaa

SEQ ID NO: 3332591 - RNA, 21 nt, Human
cuguuuuauuuuaauucaguu

SEQ ID NO: 3332592 - RNA, 23 nt, Human
cuuagguuggcaaaaaggcagga

SEQ ID NO: 3332593 - RNA, 21 nt, Human
cuuagguuggcaaaaaggcag

SEQ ID NO: 3332594 - RNA, 19 nt, Human
cuuagaauuaguggcacuu

SEQ ID NO: 3332595 - RNA, 20 nt, Human
cuuagaagucacacaguauu

SEQ ID NO: 3332596 - RNA, 17 nt, Human
cuuagaagucacacagu

SEQ ID NO: 3332597 - RNA, 20 nt, Human
cuuagaaaaaccaccaccau

SEQ ID NO: 3332598 - RNA, 13 nt, Human
cuuaccugccagg

SEQ ID NO: 3332599 - RNA, 20 nt, Human
cuuaccugccaggaagccag

SEQ ID NO: 3332600 - RNA, 16 nt, Human
cuuaaucuaaauggaa

SEQ ID NO: 3332601 - RNA, 20 nt, Human
cuuaauucuuagcucauucu

SEQ ID NO: 3332602 - RNA, 14 nt, Human
cuucacauauugau

SEQ ID NO: 3332603 - RNA, 23 nt, Human
cuucacauauugauuuccguuaa

SEQ ID NO: 3332604 - RNA, 24 nt, Human
cuucagagacuccugcaggcagcc

SEQ ID NO: 3332605 - RNA, 21 nt, Human
cuucaaggauccugagccaga

SEQ ID NO: 3332606 - RNA, 22 nt, Human
cuucaaggauccugagccagau

SEQ ID NO: 3332607 - RNA, 23 nt, Human
cuucaaggauccugagccagauu

SEQ ID NO: 3332608 - RNA, 17 nt, Human
cuucaaggauccugagc

SEQ ID NO: 3332609 - RNA, 18 nt, Human
cuucaaggauccugagcc

SEQ ID NO: 3332610 - RNA, 19 nt, Human
cuucaaggauccugagcca

SEQ ID NO: 3332611 - RNA, 20 nt, Human
cuucaaggauccugagccag

SEQ ID NO: 3332612 - RNA, 16 nt, Human
cuucaaggauccugag

SEQ ID NO: 3332613 - RNA, 21 nt, Human
cuuagucacugagacagcccg

SEQ ID NO: 3332614 - RNA, 20 nt, Human
cuuagucacugagacagccc

SEQ ID NO: 3332615 - RNA, 22 nt, Human
cuuagucacugagacagcccgg

SEQ ID NO: 3332616 - RNA, 15 nt, Human
cuucaaauauuuccc

SEQ ID NO: 3332617 - RNA, 14 nt, Human
cuucagugccaaaa

SEQ ID NO: 3332618 - RNA, 14 nt, Human
cuuccacaagagcc

SEQ ID NO: 3332619 - RNA, 15 nt, Human
cuuccacaagagccc

SEQ ID NO: 3332620 - RNA, 13 nt, Human
cuuccacaagagc

SEQ ID NO: 3332621 - RNA, 14 nt, Human
cuucaguaagccgu

SEQ ID NO: 3332622 - RNA, 15 nt, Human
cuucagcugacuuuu

SEQ ID NO: 3332623 - RNA, 19 nt, Human
cuucagcugacuuuucugu

SEQ ID NO: 3332624 - RNA, 14 nt, Human
cuucagccucccga

SEQ ID NO: 3332625 - RNA, 20 nt, Human
cuucagccucccgaguagcu

SEQ ID NO: 3332626 - RNA, 16 nt, Human
cuucagccucccgagu

SEQ ID NO: 3332627 - RNA, 17 nt, Human
cuucccuacaguugaaa

SEQ ID NO: 3332628 - RNA, 17 nt, Human
cuucgcuccugugucuu

SEQ ID NO: 3332629 - RNA, 16 nt, Human
cuucgcuccugugucu

SEQ ID NO: 3332630 - RNA, 21 nt, Human
cuucucacugccaugccagcu

SEQ ID NO: 3332631 - RNA, 16 nt, Human
cuucucacugccaugc

SEQ ID NO: 3332632 - RNA, 18 nt, Human
cuuuguuuguugucagcu

SEQ ID NO: 3332633 - RNA, 20 nt, Human
cuuuucauaaccuagccuua

SEQ ID NO: 3332634 - RNA, 22 nt, Human
cuuuucauaaccuagccuuaga

SEQ ID NO: 3332635 - RNA, 18 nt, Human
cuuuucuguccgagcuuu

SEQ ID NO: 3332636 - RNA, 18 nt, Human
cuuuucuugcaugaggcu

SEQ ID NO: 3332637 - RNA, 23 nt, Human
cuuuucuugcaugaggcuagugu

SEQ ID NO: 3332638 - RNA, 19 nt, Human
cuuuggacccugaggccca

SEQ ID NO: 3332639 - RNA, 17 nt, Human
cuuuggacccugaggcc

SEQ ID NO: 3332640 - RNA, 18 nt, Human
cuuuggacccugaggccc

SEQ ID NO: 3332641 - RNA, 15 nt, Human
cuuuggacccugagg

SEQ ID NO: 3332642 - RNA, 16 nt, Human
cuuuggacccugaggc

SEQ ID NO: 3332643 - RNA, 16 nt, Human
cuuucccaucuuccaa

SEQ ID NO: 3332644 - RNA, 17 nt, Human
cuuugugauuuuuguaa

SEQ ID NO: 3332645 - RNA, 18 nt, Human
cuuugugauuuuuguaau

SEQ ID NO: 3332646 - RNA, 12 nt, Human
cuuugugauuuu

SEQ ID NO: 3332647 - RNA, 14 nt, Human
cuuuguucuggcuc

SEQ ID NO: 3332648 - RNA, 13 nt, Human
cuuugggaggcca

SEQ ID NO: 3332649 - RNA, 18 nt, Human
cuuuguccccaccgcaga

SEQ ID NO: 3332650 - RNA, 15 nt, Human
cuuuguccccaccgc

SEQ ID NO: 3332651 - RNA, 22 nt, Human
cuuuguccccaccgcagacagg

SEQ ID NO: 3332652 - RNA, 14 nt, Human
cuuugugauuuuug

SEQ ID NO: 3332653 - RNA, 15 nt, Human
cuuuuuucacuacau

SEQ ID NO: 3332654 - RNA, 16 nt, Human
cuuuugagcauuuaga

SEQ ID NO: 3332655 - RNA, 21 nt, Human
cuuuugagugccuuacacaau

SEQ ID NO: 3332656 - RNA, 23 nt, Human
gaaaaaggaugcacagaguuguu

SEQ ID NO: 3332657 - RNA, 17 nt, Human
gaaaaaggaugcacaga

SEQ ID NO: 3332658 - RNA, 14 nt, Human
cuuuuuuggcugcu

SEQ ID NO: 3332659 - RNA, 15 nt, Human
cuuuuuuggcugcug

SEQ ID NO: 3332660 - RNA, 15 nt, Human
gaaaacguggcugcu

SEQ ID NO: 3332661 - RNA, 16 nt, Human
gaaaacguggcugcuu

SEQ ID NO: 3332662 - RNA, 18 nt, Human
gaaaacguggcugcuuca

SEQ ID NO: 3332663 - RNA, 14 nt, Human
gaaaacguggcugc

SEQ ID NO: 3332664 - RNA, 14 nt, Human
gaaaacaugcuaca

SEQ ID NO: 3332665 - RNA, 15 nt, Human
gaaaacaugcuacac

SEQ ID NO: 3332666 - RNA, 12 nt, Human
gaaaacaugcua

SEQ ID NO: 3332667 - RNA, 13 nt, Human
gaaaacacauuuu

SEQ ID NO: 3332668 - RNA, 18 nt, Human
gaaacagcuaaugggaca

SEQ ID NO: 3332669 - RNA, 17 nt, Human
gaaaagcugcugacagu

SEQ ID NO: 3332670 - RNA, 13 nt, Human
gaaaagcugcuga

SEQ ID NO: 3332671 - RNA, 16 nt, Human
gaaaaucagccugcuc

SEQ ID NO: 3332672 - RNA, 14 nt, Human
gaaaaucagccugc

SEQ ID NO: 3332673 - RNA, 16 nt, Human
cuucuccacccugcuc

SEQ ID NO: 3332674 - RNA, 18 nt, Human
cuucuccacccugcucuc

SEQ ID NO: 3332675 - RNA, 17 nt, Human
cuucuccacccugcucu

SEQ ID NO: 3332676 - RNA, 14 nt, Human
cuugcucugcugac

SEQ ID NO: 3332677 - RNA, 13 nt, Human
cuugcucugcuga

SEQ ID NO: 3332678 - RNA, 16 nt, Human
cuuggaaaugggagac

SEQ ID NO: 3332679 - RNA, 13 nt, Human
cuuggaggaagga

SEQ ID NO: 3332680 - RNA, 13 nt, Human
cuuggaagcuccg

SEQ ID NO: 3332681 - RNA, 16 nt, Human
cuugcucugcugacag

SEQ ID NO: 3332682 - RNA, 16 nt, Human
cuuggcugcagggagu

SEQ ID NO: 3332683 - RNA, 23 nt, Human
cuuggagggcaugaagacagaua

SEQ ID NO: 3332684 - RNA, 12 nt, Human
cuuggagggcau

SEQ ID NO: 3332685 - RNA, 22 nt, Human
cuuggaggaaggaaacccagcu

SEQ ID NO: 3332686 - RNA, 17 nt, Human
cuuggcugcagggaguc

SEQ ID NO: 3332687 - RNA, 14 nt, Human
cuuggcugcaggga

SEQ ID NO: 3332688 - RNA, 22 nt, Human
cuugggcuucauccuccucaga

SEQ ID NO: 3332689 - RNA, 20 nt, Human
cuuggggaccagagcugcca

SEQ ID NO: 3332690 - RNA, 21 nt, Human
cuuggggaccagagcugccac

SEQ ID NO: 3332691 - RNA, 14 nt, Human
cuugggccacugug

SEQ ID NO: 3332692 - RNA, 13 nt, Human
cuugggcuucauc

SEQ ID NO: 3332693 - RNA, 15 nt, Human
cuuggggggcugagg

SEQ ID NO: 3332694 - RNA, 22 nt, Human
cuuggggaccagagcugccacc

SEQ ID NO: 3332695 - RNA, 16 nt, Human
cuuggggggcugaggu

SEQ ID NO: 3332696 - RNA, 20 nt, Human
cuuguguguuuauugucaaa

SEQ ID NO: 3332697 - RNA, 21 nt, Human
cuuguggacacagcucuucuc

SEQ ID NO: 3332698 - RNA, 21 nt, Human
cuuguguguuuauugucaaag

SEQ ID NO: 3332699 - RNA, 16 nt, Human
cuuuccaaaugcccag

SEQ ID NO: 3332700 - RNA, 18 nt, Human
cuuuccaaaugcccagcu

SEQ ID NO: 3332701 - RNA, 19 nt, Human
cuuuccaaaugcccagcuu

SEQ ID NO: 3332702 - RNA, 22 nt, Human
cuuuccaaaugcccagcuuaaa

SEQ ID NO: 3332703 - RNA, 15 nt, Human
gaagccagcaggcuc

SEQ ID NO: 3332704 - RNA, 16 nt, Human
gaagccagcaggcucu

SEQ ID NO: 3332705 - RNA, 21 nt, Human
gaagacucauucuucuguacg

SEQ ID NO: 3332706 - RNA, 19 nt, Human
gaagacucauucuucugua

SEQ ID NO: 3332707 - RNA, 18 nt, Human
gaagacucauucuucugu

SEQ ID NO: 3332708 - RNA, 23 nt, Human
gaagccagcaggcucucaggcca

SEQ ID NO: 3332709 - RNA, 20 nt, Human
gaagcccaggaaaggcucca

SEQ ID NO: 3332710 - RNA, 19 nt, Human
gaagcccaggaaaggcucc

SEQ ID NO: 3332711 - RNA, 21 nt, Human
gaagcccaggaaaggcuccag

SEQ ID NO: 3332712 - RNA, 22 nt, Human
gaagcccaggaaaggcuccagg

SEQ ID NO: 3332713 - RNA, 21 nt, Human
gaagccgcuggggccaguugg

SEQ ID NO: 3332714 - RNA, 14 nt, Human
gaaggccccgccca

SEQ ID NO: 3332715 - RNA, 15 nt, Human
gaaggccccgcccag

SEQ ID NO: 3332716 - RNA, 16 nt, Human
gaaggccccgcccagg

SEQ ID NO: 3332717 - RNA, 14 nt, Human
gaaggaaacccagc

SEQ ID NO: 3332718 - RNA, 17 nt, Human
gaaggaaacccagcucu

SEQ ID NO: 3332719 - RNA, 18 nt, Human
gaaggaaacccagcucug

SEQ ID NO: 3332720 - RNA, 12 nt, Human
gaaggauacaaa

SEQ ID NO: 3332721 - RNA, 19 nt, Human
gaaggauacaaaagcaugu

SEQ ID NO: 3332722 - RNA, 21 nt, Human
gaaggauacaaaagcauguga

SEQ ID NO: 3332723 - RNA, 12 nt, Human
gaaguuucugcc

SEQ ID NO: 3332724 - RNA, 14 nt, Human
gaauagcugggacu

SEQ ID NO: 3332725 - RNA, 16 nt, Human
gaaucucaaauaacua

SEQ ID NO: 3332726 - RNA, 14 nt, Human
gaaugaaagggccc

SEQ ID NO: 3332727 - RNA, 19 nt, Human
gaaugaaagggcccagaga

SEQ ID NO: 3332728 - RNA, 21 nt, Human
gaaauaucugaaaauguaugu

SEQ ID NO: 3332729 - RNA, 13 nt, Human
gaaauauaauuga

SEQ ID NO: 3332730 - RNA, 20 nt, Human
gaaauaucugaaaauguaug

SEQ ID NO: 3332731 - RNA, 20 nt, Human
gaaaugggcagagcagagac

SEQ ID NO: 3332732 - RNA, 19 nt, Human
gaaaugggcagagcagaga

SEQ ID NO: 3332733 - RNA, 14 nt, Human
gaaaugggcagagc

SEQ ID NO: 3332734 - RNA, 17 nt, Human
gaaauuuguuauaauga

SEQ ID NO: 3332735 - RNA, 21 nt, Human
gaaccacaucuugcucugcug

SEQ ID NO: 3332736 - RNA, 20 nt, Human
gaaccacaucuugcucugcu

SEQ ID NO: 3332737 - RNA, 16 nt, Human
gaacagacuggaagca

SEQ ID NO: 3332738 - RNA, 15 nt, Human
gaacagacuggaagc

SEQ ID NO: 3332739 - RNA, 16 nt, Human
gaaccaccacacccag

SEQ ID NO: 3332740 - RNA, 15 nt, Human
gaacuuggcgcugcc

SEQ ID NO: 3332741 - RNA, 16 nt, Human
gaacuuggcgcugccc

SEQ ID NO: 3332742 - RNA, 13 nt, Human
gaacuuggcgcug

SEQ ID NO: 3332743 - RNA, 23 nt, Human
gaacuugguucccauuugcuccu

SEQ ID NO: 3332744 - RNA, 12 nt, Human
gaacuugguucc

SEQ ID NO: 3332745 - RNA, 22 nt, Human
gaacuggguacuuguggacaca

SEQ ID NO: 3332746 - RNA, 17 nt, Human
gaacuuaaauaauguga

SEQ ID NO: 3332747 - RNA, 23 nt, Human
cgcccaguuggguggaugccugg

SEQ ID NO: 3332748 - RNA, 15 nt, Human
cgccaugcuccuggc

SEQ ID NO: 3332749 - RNA, 20 nt, Human
cgccaucccagccccaauga

SEQ ID NO: 3332750 - RNA, 17 nt, Human
cgccaucccagccccaa

SEQ ID NO: 3332751 - RNA, 21 nt, Human
cgcccagucuggaaugcagug

SEQ ID NO: 3332752 - RNA, 22 nt, Human
cgcccaguuggguggaugccug

SEQ ID NO: 3332753 - RNA, 18 nt, Human
cuaggugacagagugaga

SEQ ID NO: 3332754 - RNA, 14 nt, Human
cuaggugacagagu

SEQ ID NO: 3332755 - RNA, 24 nt, Human
cuaggugacagagugagacucugu

SEQ ID NO: 3332756 - RNA, 23 nt, Human
cuaugggacucaaugcacugaca

SEQ ID NO: 3332757 - RNA, 22 nt, Human
cuaugggacucaaugcacugac

SEQ ID NO: 3332758 - RNA, 18 nt, Human
cuaugggacucaaugcac

SEQ ID NO: 3332759 - RNA, 15 nt, Human
cuauuagagaagaga

SEQ ID NO: 3332760 - RNA, 17 nt, Human
cuauagccuaggugaca

SEQ ID NO: 3332761 - RNA, 16 nt, Human
cuauaauguaagcucu

SEQ ID NO: 3332762 - RNA, 22 nt, Human
cuauaauuuaccugaagucuuu

SEQ ID NO: 3332763 - RNA, 21 nt, Human
cuauaauguaagcucuacuga

SEQ ID NO: 3332764 - RNA, 15 nt, Human
cucagaucuucugug

SEQ ID NO: 3332765 - RNA, 21 nt, Human
cucagcaaaagaugcuucuca

SEQ ID NO: 3332766 - RNA, 17 nt, Human
cucagcauccuggcacc

SEQ ID NO: 3332767 - RNA, 16 nt, Human
cucagcauccuggcac

SEQ ID NO: 3332768 - RNA, 14 nt, Human
cucagagagggugg

SEQ ID NO: 3332769 - RNA, 22 nt, Human
cucacuguugcccaggcuggcg

SEQ ID NO: 3332770 - RNA, 21 nt, Human
cucacuguugcccaggcuggc

SEQ ID NO: 3332771 - RNA, 19 nt, Human
cucacuguugcccaggcug

SEQ ID NO: 3332772 - RNA, 19 nt, Human
cucacugccaugccagcuu

SEQ ID NO: 3332773 - RNA, 22 nt, Human
cucacugccaugccagcuuauc

SEQ ID NO: 3332774 - RNA, 20 nt, Human
cucacuguugcccaggcugg

SEQ ID NO: 3332775 - RNA, 22 nt, Human
cucacuauguugcccaggcagg

SEQ ID NO: 3332776 - RNA, 21 nt, Human
cucacuauguugcccaggcag

SEQ ID NO: 3332777 - RNA, 23 nt, Human
cucacuauguugcccaggcaggu

SEQ ID NO: 3332778 - RNA, 20 nt, Human
cucacuauguugcccaggca

SEQ ID NO: 3332779 - RNA, 19 nt, Human
cucacuauguugcccaggc

SEQ ID NO: 3332780 - RNA, 15 nt, Human
cucaccccagcccca

SEQ ID NO: 3332781 - RNA, 14 nt, Human
cucaccccagcccc

SEQ ID NO: 3332782 - RNA, 21 nt, Human
cucacucugucgcccagucug

SEQ ID NO: 3332783 - RNA, 13 nt, Human
cucacucugucgc

SEQ ID NO: 3332784 - RNA, 22 nt, Human
cucacucugucgcccagucugg

SEQ ID NO: 3332785 - RNA, 12 nt, Human
cucacugcagcc

SEQ ID NO: 3332786 - RNA, 13 nt, Human
cucacugcagccu

SEQ ID NO: 3332787 - RNA, 13 nt, Human
cucacuccuugaa

SEQ ID NO: 3332788 - RNA, 12 nt, Human
cucacucugucg

SEQ ID NO: 3332789 - RNA, 11 nt, Human
cucacucuguc

SEQ ID NO: 3332790 - RNA, 22 nt, Human
cucacacaugagcaucaggcca

SEQ ID NO: 3332791 - RNA, 24 nt, Human
cucacacaugagcaucaggccagg

SEQ ID NO: 3332792 - RNA, 21 nt, Human
cucacacaugagcaucaggcc

SEQ ID NO: 3332793 - RNA, 15 nt, Human
cucacaguccuuacc

SEQ ID NO: 3332794 - RNA, 14 nt, Human
cucaaguccucuuu

SEQ ID NO: 3332795 - RNA, 21 nt, Human
cucaaguccucuuuucugaga

SEQ ID NO: 3332796 - RNA, 18 nt, Human
cucaccagccccagugcc

SEQ ID NO: 3332797 - RNA, 17 nt, Human
cucaccagccccagugc

SEQ ID NO: 3332798 - RNA, 15 nt, Human
cucaccagccccagu

SEQ ID NO: 3332799 - RNA, 14 nt, Human
cucaccagccccag

SEQ ID NO: 3332800 - RNA, 13 nt, Human
cucaccagcccca

SEQ ID NO: 3332801 - RNA, 22 nt, Human
cucacauuuauucugcucacau

SEQ ID NO: 3332802 - RNA, 19 nt, Human
cucacauuuauucugcuca

SEQ ID NO: 3332803 - RNA, 15 nt, Human
cucacauuuauucug

SEQ ID NO: 3332804 - RNA, 17 nt, Human
cucacaguccuuaccag

SEQ ID NO: 3332805 - RNA, 19 nt, Human
cucacaguccuuaccagca

SEQ ID NO: 3332806 - RNA, 22 nt, Human
cucacaguccuuaccagcagag

SEQ ID NO: 3332807 - RNA, 15 nt, Human
cucaaccuccugggc

SEQ ID NO: 3332808 - RNA, 13 nt, Human
cucaaccuccugg

SEQ ID NO: 3332809 - RNA, 21 nt, Human
cucaacaccucugcacaagcu

SEQ ID NO: 3332810 - RNA, 20 nt, Human
cuccugugugugcgccuaca

SEQ ID NO: 3332811 - RNA, 24 nt, Human
cuccugugugugcgccuacaggag

SEQ ID NO: 3332812 - RNA, 23 nt, Human
cuccugugugugcgccuacagga

SEQ ID NO: 3332813 - RNA, 21 nt, Human
cuccugugugugcgccuacag

SEQ ID NO: 3332814 - RNA, 14 nt, Human
cuccuggaaauauu

SEQ ID NO: 3332815 - RNA, 15 nt, Human
cuccucuccccagca

SEQ ID NO: 3332816 - RNA, 13 nt, Human
cuccucuccccag

SEQ ID NO: 3332817 - RNA, 11 nt, Human
cuccugccuca

SEQ ID NO: 3332818 - RNA, 12 nt, Human
cuccugccucag

SEQ ID NO: 3332819 - RNA, 16 nt, Human
cuccugccucagccuc

SEQ ID NO: 3332820 - RNA, 17 nt, Human
cuccugccucagccucc

SEQ ID NO: 3332821 - RNA, 21 nt, Human
cuccugccucgaacuggcugc

SEQ ID NO: 3332822 - RNA, 20 nt, Human
cuccugccucgaacuggcug

SEQ ID NO: 3332823 - RNA, 18 nt, Human
cuccugccucgaacuggc

SEQ ID NO: 3332824 - RNA, 22 nt, Human
cucgagcaugccuggauggggc

SEQ ID NO: 3332825 - RNA, 23 nt, Human
cuccuuggugucgggcaugacac

SEQ ID NO: 3332826 - RNA, 13 nt, Human
cucgagcaugccu

SEQ ID NO: 3332827 - RNA, 15 nt, Human
cucgagcaugccugg

SEQ ID NO: 3332828 - RNA, 16 nt, Human
cucgagcaugccugga

SEQ ID NO: 3332829 - RNA, 19 nt, Human
cucgagcaugccuggaugg

SEQ ID NO: 3332830 - RNA, 15 nt, Human
cuccuccagccgcca

SEQ ID NO: 3332831 - RNA, 13 nt, Human
cuccuccagaguc

SEQ ID NO: 3332832 - RNA, 15 nt, Human
cuccuccagagucag

SEQ ID NO: 3332833 - RNA, 15 nt, Human
cuccgaccagacacc

SEQ ID NO: 3332834 - RNA, 20 nt, Human
cucccuuggauuguccccga

SEQ ID NO: 3332835 - RNA, 18 nt, Human
cuccucagaucuucugug

SEQ ID NO: 3332836 - RNA, 20 nt, Human
cucccgaguagcugggacua

SEQ ID NO: 3332837 - RNA, 19 nt, Human
cucccgaguagcugggacu

SEQ ID NO: 3332838 - RNA, 18 nt, Human
cucccgaguagcugggac

SEQ ID NO: 3332839 - RNA, 21 nt, Human
cuccccagcaagugagagcug

SEQ ID NO: 3332840 - RNA, 23 nt, Human
cuccccagcaagugagagcuggg

SEQ ID NO: 3332841 - RNA, 22 nt, Human
cuccccagcaagugagagcugg

SEQ ID NO: 3332842 - RNA, 20 nt, Human
cucauaguaugguggcuggg

SEQ ID NO: 3332843 - RNA, 23 nt, Human
cucauaguaugguggcuggguug

SEQ ID NO: 3332844 - RNA, 21 nt, Human
cucaucaccaacgucugugcc

SEQ ID NO: 3332845 - RNA, 22 nt, Human
cucaucaccaacgucugugcca

SEQ ID NO: 3332846 - RNA, 15 nt, Human
cucauccucauaccc

SEQ ID NO: 3332847 - RNA, 16 nt, Human
cucauacccaccccca

SEQ ID NO: 3332848 - RNA, 18 nt, Human
cucauacccacccccacc

SEQ ID NO: 3332849 - RNA, 19 nt, Human
cucauacccacccccaccc

SEQ ID NO: 3332850 - RNA, 21 nt, Human
cucauacccacccccacccaa

SEQ ID NO: 3332851 - RNA, 19 nt, Human
cucaggugauccacccacc

SEQ ID NO: 3332852 - RNA, 18 nt, Human
cucaggugauccacccac

SEQ ID NO: 3332853 - RNA, 14 nt, Human
cucagggucccugg

SEQ ID NO: 3332854 - RNA, 20 nt, Human
cucaggugauccacccaccu

SEQ ID NO: 3332855 - RNA, 22 nt, Human
cucauacucaccucaccccacu

SEQ ID NO: 3332856 - RNA, 14 nt, Human
cucauacucaccuc

SEQ ID NO: 3332857 - RNA, 15 nt, Human
cucauacccaccccc

SEQ ID NO: 3332858 - RNA, 21 nt, Human
cucauaguaugguggcugggu

SEQ ID NO: 3332859 - RNA, 16 nt, Human
cucaggugagaagcag

SEQ ID NO: 3332860 - RNA, 14 nt, Human
cucaggugagaagc

SEQ ID NO: 3332861 - RNA, 19 nt, Human
cucaggugagaagcagagg

SEQ ID NO: 3332862 - RNA, 20 nt, Human
cucaggugagaagcagagga

SEQ ID NO: 3332863 - RNA, 15 nt, Human
cucagggucccuggu

SEQ ID NO: 3332864 - RNA, 16 nt, Human
cucagggucccuggug

SEQ ID NO: 3332865 - RNA, 17 nt, Human
cucagggucccuggugg

SEQ ID NO: 3332866 - RNA, 14 nt, Human
cucagggccugguc

SEQ ID NO: 3332867 - RNA, 15 nt, Human
cucagggccuggucg

SEQ ID NO: 3332868 - RNA, 16 nt, Human
cucagggccuggcuca

SEQ ID NO: 3332869 - RNA, 14 nt, Human
cucagggccuggcu

SEQ ID NO: 3332870 - RNA, 15 nt, Human
cucagggccuggcuc

SEQ ID NO: 3332871 - RNA, 13 nt, Human
cucagggccuggc

SEQ ID NO: 3332872 - RNA, 18 nt, Human
cucaggaguuugagacca

SEQ ID NO: 3332873 - RNA, 23 nt, Human
cucaggaguuugagaccaaccug

SEQ ID NO: 3332874 - RNA, 18 nt, Human
cucagcauccuggcaccc

SEQ ID NO: 3332875 - RNA, 15 nt, Human
cucagcauccuggca

SEQ ID NO: 3332876 - RNA, 13 nt, Human
cuccacccugcuc

SEQ ID NO: 3332877 - RNA, 15 nt, Human
cuccacccugcucuc

SEQ ID NO: 3332878 - RNA, 15 nt, Human
cuccaaaauaaaacu

SEQ ID NO: 3332879 - RNA, 16 nt, Human
cuccaaaauaaaacuu

SEQ ID NO: 3332880 - RNA, 17 nt, Human
cucauuugucacacacu

SEQ ID NO: 3332881 - RNA, 15 nt, Human
cuccagccccuggau

SEQ ID NO: 3332882 - RNA, 12 nt, Human
cuccaccugcca

SEQ ID NO: 3332883 - RNA, 13 nt, Human
cuccaccugccag

SEQ ID NO: 3332884 - RNA, 14 nt, Human
cuccaccugccagg

SEQ ID NO: 3332885 - RNA, 20 nt, Human
cuccagccccuggaugcagc

SEQ ID NO: 3332886 - RNA, 16 nt, Human
cuccagccccuggaug

SEQ ID NO: 3332887 - RNA, 17 nt, Human
cuccagccccuggaugc

SEQ ID NO: 3332888 - RNA, 12 nt, Human
cuccagccuggg

SEQ ID NO: 3332889 - RNA, 14 nt, Human
cuccaggagcagcc

SEQ ID NO: 3332890 - RNA, 15 nt, Human
cuccaggagcagcca

SEQ ID NO: 3332891 - RNA, 16 nt, Human
cuccaggagcagccac

SEQ ID NO: 3332892 - RNA, 17 nt, Human
cuccaggagcagccaca

SEQ ID NO: 3332893 - RNA, 11 nt, Human
cuccaggagca

SEQ ID NO: 3332894 - RNA, 13 nt, Human
cuccaggagcagc

SEQ ID NO: 3332895 - RNA, 18 nt, Human
cuccaggagcagccacau

SEQ ID NO: 3332896 - RNA, 23 nt, Human
cuccaggagcagccacauuccug

SEQ ID NO: 3332897 - RNA, 11 nt, Human
cugccaggcau

SEQ ID NO: 3332898 - RNA, 13 nt, Human
cugccaggcaugg

SEQ ID NO: 3332899 - RNA, 14 nt, Human
cugcccaccuggcc

SEQ ID NO: 3332900 - RNA, 15 nt, Human
cugcccaccuggccu

SEQ ID NO: 3332901 - RNA, 13 nt, Human
cugcccaccuggc

SEQ ID NO: 3332902 - RNA, 14 nt, Human
cugccaugccagcu

SEQ ID NO: 3332903 - RNA, 17 nt, Human
cugcccaccuggccucu

SEQ ID NO: 3332904 - RNA, 18 nt, Human
cugcccaccuggccucug

SEQ ID NO: 3332905 - RNA, 19 nt, Human
cugcccaccuggccucugc

SEQ ID NO: 3332906 - RNA, 20 nt, Human
cugcccaccuggccucugca

SEQ ID NO: 3332907 - RNA, 22 nt, Human
cugcccaccuggccucugcacu

SEQ ID NO: 3332908 - RNA, 14 nt, Human
cugcccacucccug

SEQ ID NO: 3332909 - RNA, 15 nt, Human
cugcccacucccugc

SEQ ID NO: 3332910 - RNA, 16 nt, Human
cugcccacucccugca

SEQ ID NO: 3332911 - RNA, 18 nt, Human
cugcccacucccugcaac

SEQ ID NO: 3332912 - RNA, 17 nt, Human
cugccaaugggagcuca

SEQ ID NO: 3332913 - RNA, 18 nt, Human
cugccaaugggagcucau

SEQ ID NO: 3332914 - RNA, 19 nt, Human
cugccaaugggagcucaug

SEQ ID NO: 3332915 - RNA, 18 nt, Human
cugcaugcgggcuuccuc

SEQ ID NO: 3332916 - RNA, 22 nt, Human
cugcaugcgggcuuccuccugg

SEQ ID NO: 3332917 - RNA, 16 nt, Human
cugcaucguuucaucu

SEQ ID NO: 3332918 - RNA, 22 nt, Human
cugcaucguuucaucuuccaac

SEQ ID NO: 3332919 - RNA, 19 nt, Human
cugcaguugccagucaccc

SEQ ID NO: 3332920 - RNA, 23 nt, Human
cugcacuugcagacucuacagag

SEQ ID NO: 3332921 - RNA, 17 nt, Human
cugcacuugcagacucu

SEQ ID NO: 3332922 - RNA, 21 nt, Human
cugcaguugccagucaccccg

SEQ ID NO: 3332923 - RNA, 22 nt, Human
cugcaguugccagucaccccgg

SEQ ID NO: 3332924 - RNA, 17 nt, Human
cugcaguugccagucac

SEQ ID NO: 3332925 - RNA, 14 nt, Human
cugccucagccucc

SEQ ID NO: 3332926 - RNA, 15 nt, Human
cugccucagccuccc

SEQ ID NO: 3332927 - RNA, 19 nt, Human
cugccucagccucccaaag

SEQ ID NO: 3332928 - RNA, 19 nt, Human
cugccgcagcccugcagag

SEQ ID NO: 3332929 - RNA, 20 nt, Human
cugccgcagcccugcagagg

SEQ ID NO: 3332930 - RNA, 21 nt, Human
cugccgcagcccugcagaggg

SEQ ID NO: 3332931 - RNA, 22 nt, Human
cugccgcagcccugcagagggc

SEQ ID NO: 3332932 - RNA, 23 nt, Human
cugccgcagcccugcagagggca

SEQ ID NO: 3332933 - RNA, 12 nt, Human
cugccgcagccc

SEQ ID NO: 3332934 - RNA, 13 nt, Human
cugccgcagcccu

SEQ ID NO: 3332935 - RNA, 18 nt, Human
cugcgguccacccaggag

SEQ ID NO: 3332936 - RNA, 17 nt, Human
cugcgguccacccagga

SEQ ID NO: 3332937 - RNA, 19 nt, Human
cugcgguccacccaggagc

SEQ ID NO: 3332938 - RNA, 21 nt, Human
cugccucugacacacagcucu

SEQ ID NO: 3332939 - RNA, 18 nt, Human
cugccucugacacacagc

SEQ ID NO: 3332940 - RNA, 15 nt, Human
cugccucugacacac

SEQ ID NO: 3332941 - RNA, 17 nt, Human
cugccucugacacacag

SEQ ID NO: 3332942 - RNA, 22 nt, Human
cugccugcccaggccccugcca

SEQ ID NO: 3332943 - RNA, 21 nt, Human
cugccugcccaggccccugcc

SEQ ID NO: 3332944 - RNA, 18 nt, Human
cugcaauaaggggagagu

SEQ ID NO: 3332945 - RNA, 22 nt, Human
cugcacaagcugcacccucagg

SEQ ID NO: 3332946 - RNA, 18 nt, Human
cugcacaagcugcacccu

SEQ ID NO: 3332947 - RNA, 16 nt, Human
cugcacuccccugcug

SEQ ID NO: 3332948 - RNA, 17 nt, Human
cugcacuccccugcugg

SEQ ID NO: 3332949 - RNA, 18 nt, Human
cugcacuugcagacucua

SEQ ID NO: 3332950 - RNA, 13 nt, Human
cugcacccucagg

SEQ ID NO: 3332951 - RNA, 14 nt, Human
cugcacccucaggc

SEQ ID NO: 3332952 - RNA, 20 nt, Human
cugcaccggcuggccuggcc

SEQ ID NO: 3332953 - RNA, 22 nt, Human
cugcaccggcuggccuggcccc

SEQ ID NO: 3332954 - RNA, 14 nt, Human
cugcacuccccugc

SEQ ID NO: 3332955 - RNA, 15 nt, Human
cugcacuccccugcu

SEQ ID NO: 3332956 - RNA, 23 nt, Human
cugcaccggcuggccuggccccu

SEQ ID NO: 3332957 - RNA, 12 nt, Human
cugcaccgggcc

SEQ ID NO: 3332958 - RNA, 16 nt, Human
cugauuuuuuuuuccu

SEQ ID NO: 3332959 - RNA, 18 nt, Human
cugauuuuuuuuuccuuc

SEQ ID NO: 3332960 - RNA, 19 nt, Human
cugauuuuuuuuuccuuca

SEQ ID NO: 3332961 - RNA, 20 nt, Human
cugauuuuuuuuuccuucag

SEQ ID NO: 3332962 - RNA, 21 nt, Human
cugauuuuuuuuuccuucagu

SEQ ID NO: 3332963 - RNA, 22 nt, Human
cugauuuuuuuuuccuucagug

SEQ ID NO: 3332964 - RNA, 23 nt, Human
cugauuuuuuuuuccuucagugc

SEQ ID NO: 3332965 - RNA, 21 nt, Human
cugauugugucucuugguccu

SEQ ID NO: 3332966 - RNA, 17 nt, Human
cugauggugcaaugacc

SEQ ID NO: 3332967 - RNA, 19 nt, Human
cugauggugcaaugaccuu

SEQ ID NO: 3332968 - RNA, 20 nt, Human
cugauggugcaaugaccuuu

SEQ ID NO: 3332969 - RNA, 21 nt, Human
cugauggugcaaugaccuuuc

SEQ ID NO: 3332970 - RNA, 17 nt, Human
cugauugugucucuugg

SEQ ID NO: 3332971 - RNA, 22 nt, Human
cugagugggggaucacagccuc

SEQ ID NO: 3332972 - RNA, 18 nt, Human
cugagucugaaggcuggg

SEQ ID NO: 3332973 - RNA, 19 nt, Human
cugagucugaaggcugggu

SEQ ID NO: 3332974 - RNA, 17 nt, Human
cugagucugaaggcugg

SEQ ID NO: 3332975 - RNA, 21 nt, Human
cugauaaagaugagugagcau

SEQ ID NO: 3332976 - RNA, 20 nt, Human
cugauccuaguuccaccauc

SEQ ID NO: 3332977 - RNA, 21 nt, Human
cugauccuaguuccaccauca

SEQ ID NO: 3332978 - RNA, 15 nt, Human
cugauggugcaauga

SEQ ID NO: 3332979 - RNA, 16 nt, Human
cugauggugcaaugac

SEQ ID NO: 3332980 - RNA, 14 nt, Human
cugauggugcaaug

SEQ ID NO: 3332981 - RNA, 15 nt, Human
cugaggcugggcucc

SEQ ID NO: 3332982 - RNA, 16 nt, Human
cugaggcugggcuccc

SEQ ID NO: 3332983 - RNA, 17 nt, Human
cugaggcugggcucccu

SEQ ID NO: 3332984 - RNA, 22 nt, Human
cugaggcugggcucccuuccca

SEQ ID NO: 3332985 - RNA, 13 nt, Human
cugaggcugggcu

SEQ ID NO: 3332986 - RNA, 24 nt, Human
cugaggcccuucucuccagccccu

SEQ ID NO: 3332987 - RNA, 14 nt, Human
cucugaggacacua

SEQ ID NO: 3332988 - RNA, 12 nt, Human
cucugaggacac

SEQ ID NO: 3332989 - RNA, 20 nt, Human
cucugagacucgcgacaaug

SEQ ID NO: 3332990 - RNA, 23 nt, Human
cucugagacucgcgacaaugcaa

SEQ ID NO: 3332991 - RNA, 21 nt, Human
cucugagacucgcgacaaugc

SEQ ID NO: 3332992 - RNA, 23 nt, Human
cucugacagaagaaccccagggu

SEQ ID NO: 3332993 - RNA, 19 nt, Human
cucugacacacagcucugu

SEQ ID NO: 3332994 - RNA, 18 nt, Human
cucugacacacagcucug

SEQ ID NO: 3332995 - RNA, 17 nt, Human
cucugacacacagcucu

SEQ ID NO: 3332996 - RNA, 16 nt, Human
cucugacacacagcuc

SEQ ID NO: 3332997 - RNA, 15 nt, Human
cucugacacacagcu

SEQ ID NO: 3332998 - RNA, 14 nt, Human
cucugacacacagc

SEQ ID NO: 3332999 - RNA, 22 nt, Human
cucugaaggacauugcggacag

SEQ ID NO: 3333000 - RNA, 14 nt, Human
cucugcacaagcug

SEQ ID NO: 3333001 - RNA, 15 nt, Human
cucugcacaagcugc

SEQ ID NO: 3333002 - RNA, 10 nt, Human
cucugcacaa

SEQ ID NO: 3333003 - RNA, 13 nt, Human
cucugcacaagcu

SEQ ID NO: 3333004 - RNA, 13 nt, Human
cucugcccacucc

SEQ ID NO: 3333005 - RNA, 15 nt, Human
cucugcccacucccu

SEQ ID NO: 3333006 - RNA, 16 nt, Human
cucugcccacucccug

SEQ ID NO: 3333007 - RNA, 17 nt, Human
cucugcccacucccugc

SEQ ID NO: 3333008 - RNA, 18 nt, Human
cucugcccacucccugca

SEQ ID NO: 3333009 - RNA, 13 nt, Human
cucugccucccau

SEQ ID NO: 3333010 - RNA, 14 nt, Human
cucugccucccauc

SEQ ID NO: 3333011 - RNA, 16 nt, Human
cucugccucccaucac

SEQ ID NO: 3333012 - RNA, 17 nt, Human
cucugccucccaucacc

SEQ ID NO: 3333013 - RNA, 12 nt, Human
cucugcccuugg

SEQ ID NO: 3333014 - RNA, 13 nt, Human
cucuucuccaggc

SEQ ID NO: 3333015 - RNA, 15 nt, Human
cucuucuccaggcug

SEQ ID NO: 3333016 - RNA, 23 nt, Human
cucugugucagguggggcagcuu

SEQ ID NO: 3333017 - RNA, 22 nt, Human
cucugugucagguggggcagcu

SEQ ID NO: 3333018 - RNA, 21 nt, Human
cucugugucagguggggcagc

SEQ ID NO: 3333019 - RNA, 20 nt, Human
cucugugucagguggggcag

SEQ ID NO: 3333020 - RNA, 19 nt, Human
cucugugucagguggggca

SEQ ID NO: 3333021 - RNA, 13 nt, Human
cucugucgcccag

SEQ ID NO: 3333022 - RNA, 17 nt, Human
cucugucgcccagucug

SEQ ID NO: 3333023 - RNA, 19 nt, Human
cucugucgcccagucugga

SEQ ID NO: 3333024 - RNA, 18 nt, Human
cucugucgcccagucugg

SEQ ID NO: 3333025 - RNA, 22 nt, Human
cucuguccugggagugagcugg

SEQ ID NO: 3333026 - RNA, 15 nt, Human
cucuguccugggagu

SEQ ID NO: 3333027 - RNA, 13 nt, Human
cucuguccuggga

SEQ ID NO: 3333028 - RNA, 14 nt, Human
cucuguccugggag

SEQ ID NO: 3333029 - RNA, 20 nt, Human
cucugccucugacacacagc

SEQ ID NO: 3333030 - RNA, 19 nt, Human
cucugccucugacacacag

SEQ ID NO: 3333031 - RNA, 21 nt, Human
cucugccucccaucacccgcu

SEQ ID NO: 3333032 - RNA, 16 nt, Human
cucugccucugacaca

SEQ ID NO: 3333033 - RNA, 23 nt, Human
cucuggcagcucagagagggugg

SEQ ID NO: 3333034 - RNA, 20 nt, Human
cucuggcagcucagagaggg

SEQ ID NO: 3333035 - RNA, 12 nt, Human
cugaauuucuuu

SEQ ID NO: 3333036 - RNA, 20 nt, Human
cugaaugguuuucaaaauaa

SEQ ID NO: 3333037 - RNA, 19 nt, Human
cugaaugguuuucaaaaua

SEQ ID NO: 3333038 - RNA, 17 nt, Human
cugaaguucagcugcau

SEQ ID NO: 3333039 - RNA, 22 nt, Human
cugaagucccagauacuugggg

SEQ ID NO: 3333040 - RNA, 17 nt, Human
cugaagucuuuguacag

SEQ ID NO: 3333041 - RNA, 20 nt, Human
cugaagucuuuguacagaca

SEQ ID NO: 3333042 - RNA, 17 nt, Human
cugaagucacacaguga

SEQ ID NO: 3333043 - RNA, 19 nt, Human
cugaagucacacagugagu

SEQ ID NO: 3333044 - RNA, 18 nt, Human
cugaagucacacagugag

SEQ ID NO: 3333045 - RNA, 21 nt, Human
cugaagucacacagugagucg

SEQ ID NO: 3333046 - RNA, 16 nt, Human
cugaagucacacagug

SEQ ID NO: 3333047 - RNA, 23 nt, Human
cugaaagggacgcuacccgggaa

SEQ ID NO: 3333048 - RNA, 14 nt, Human
cucuuuucaaaaca

SEQ ID NO: 3333049 - RNA, 22 nt, Human
cucuuuggucuacacugugcug

SEQ ID NO: 3333050 - RNA, 23 nt, Human
cucuuuggucuacacugugcuga

SEQ ID NO: 3333051 - RNA, 21 nt, Human
cucuuuggucuacacugugcu

SEQ ID NO: 3333052 - RNA, 16 nt, Human
cucuucuccaggcugu

SEQ ID NO: 3333053 - RNA, 18 nt, Human
cugacagacacaggcccg

SEQ ID NO: 3333054 - RNA, 17 nt, Human
cugacagacacaggccc

SEQ ID NO: 3333055 - RNA, 15 nt, Human
cugacagacacaggc

SEQ ID NO: 3333056 - RNA, 14 nt, Human
cugaauuucuuuug

SEQ ID NO: 3333057 - RNA, 16 nt, Human
cugacagacacaggcc

SEQ ID NO: 3333058 - RNA, 21 nt, Human
cugagacagcccgggcucugc

SEQ ID NO: 3333059 - RNA, 20 nt, Human
cugagacagcccgggcucug

SEQ ID NO: 3333060 - RNA, 19 nt, Human
cugagacagcccgggcucu

SEQ ID NO: 3333061 - RNA, 13 nt, Human
cugagccagauuu

SEQ ID NO: 3333062 - RNA, 14 nt, Human
cugagccagauuuc

SEQ ID NO: 3333063 - RNA, 19 nt, Human
gauucaacagguuuuccug

SEQ ID NO: 3333064 - RNA, 19 nt, Human
gauuaaccacuucagcuga

SEQ ID NO: 3333065 - RNA, 21 nt, Human
gauuaaccacuucagcugacu

SEQ ID NO: 3333066 - RNA, 18 nt, Human
gauuaaccacuucagcug

SEQ ID NO: 3333067 - RNA, 12 nt, Human
gauuaaauucuu

SEQ ID NO: 3333068 - RNA, 19 nt, Human
gauuaaauucuugcaaagu

SEQ ID NO: 3333069 - RNA, 15 nt, Human
gauguuuuccaugag

SEQ ID NO: 3333070 - RNA, 14 nt, Human
gauguuuuccauga

SEQ ID NO: 3333071 - RNA, 21 nt, Human
gauguuuuaaggaugcuugua

SEQ ID NO: 3333072 - RNA, 21 nt, Human
gauguucuuucacccuuuucu

SEQ ID NO: 3333073 - RNA, 17 nt, Human
gauggugcaaugaccuu

SEQ ID NO: 3333074 - RNA, 23 nt, Human
gauggugcaaugaccuuucaaua

SEQ ID NO: 3333075 - RNA, 20 nt, Human
gauggugcaaugaccuuuca

SEQ ID NO: 3333076 - RNA, 16 nt, Human
gauguucugggacaca

SEQ ID NO: 3333077 - RNA, 14 nt, Human
gauguucugggaca

SEQ ID NO: 3333078 - RNA, 22 nt, Human
gauucccaagcucugcuccucu

SEQ ID NO: 3333079 - RNA, 21 nt, Human
gauucccaagcucugcuccuc

SEQ ID NO: 3333080 - RNA, 23 nt, Human
gauugacgggacuguugguauug

SEQ ID NO: 3333081 - RNA, 18 nt, Human
gauugcuugagcucagga

SEQ ID NO: 3333082 - RNA, 15 nt, Human
gauuguccccgaccc

SEQ ID NO: 3333083 - RNA, 20 nt, Human
gauuguccccgacccuugcc

SEQ ID NO: 3333084 - RNA, 13 nt, Human
gauccugagccag

SEQ ID NO: 3333085 - RNA, 14 nt, Human
gauccugagccaga

SEQ ID NO: 3333086 - RNA, 15 nt, Human
gauccugagccagau

SEQ ID NO: 3333087 - RNA, 19 nt, Human
gauccugagccagauuuca

SEQ ID NO: 3333088 - RNA, 20 nt, Human
gauccucccaccucagccuc

SEQ ID NO: 3333089 - RNA, 19 nt, Human
gauccucccaccucagccu

SEQ ID NO: 3333090 - RNA, 11 nt, Human
gauccuccagg

SEQ ID NO: 3333091 - RNA, 18 nt, Human
gauccuaggcauuugcug

SEQ ID NO: 3333092 - RNA, 18 nt, Human
gauccuaguuccaccauc

SEQ ID NO: 3333093 - RNA, 15 nt, Human
gaucacgccacugca

SEQ ID NO: 3333094 - RNA, 14 nt, Human
gaucacgccacugc

SEQ ID NO: 3333095 - RNA, 13 nt, Human
gaucacgccacug

SEQ ID NO: 3333096 - RNA, 23 nt, Human
gaucaaccccuucgcuccugugu

SEQ ID NO: 3333097 - RNA, 15 nt, Human
gaugaaaaaauaaca

SEQ ID NO: 3333098 - RNA, 16 nt, Human
gaucuuugcagacagg

SEQ ID NO: 3333099 - RNA, 18 nt, Human
gauccucccaccucagcc

SEQ ID NO: 3333100 - RNA, 20 nt, Human
gaugaccuugaaugaugcca

SEQ ID NO: 3333101 - RNA, 11 nt, Human
gaugagaaagg

SEQ ID NO: 3333102 - RNA, 22 nt, Human
gaugagaaagguugaagcacca

SEQ ID NO: 3333103 - RNA, 22 nt, Human
gaugggcaacccccagccugcu

SEQ ID NO: 3333104 - RNA, 23 nt, Human
gagucucacuguugcccaggcug

SEQ ID NO: 3333105 - RNA, 22 nt, Human
gagucucacuguugcccaggcu

SEQ ID NO: 3333106 - RNA, 21 nt, Human
gagucugaaggcuggguucug

SEQ ID NO: 3333107 - RNA, 21 nt, Human
gagucucacuguugcccaggc

SEQ ID NO: 3333108 - RNA, 20 nt, Human
gagucucacuguugcccagg

SEQ ID NO: 3333109 - RNA, 19 nt, Human
gagucucacuguugcccag

SEQ ID NO: 3333110 - RNA, 16 nt, Human
gagucgaggacaggga

SEQ ID NO: 3333111 - RNA, 17 nt, Human
gagucgaggacagggag

SEQ ID NO: 3333112 - RNA, 14 nt, Human
gaguagcugggacu

SEQ ID NO: 3333113 - RNA, 12 nt, Human
gaguagcuggga

SEQ ID NO: 3333114 - RNA, 21 nt, Human
gagucccaccuuggcugcagg

SEQ ID NO: 3333115 - RNA, 12 nt, Human
gaguccccuguu

SEQ ID NO: 3333116 - RNA, 14 nt, Human
gaguccccuguuug

SEQ ID NO: 3333117 - RNA, 23 nt, Human
gaguccccuguuuguuucugaaa

SEQ ID NO: 3333118 - RNA, 21 nt, Human
gaggugggauccuccaggugc

SEQ ID NO: 3333119 - RNA, 22 nt, Human
gaggugggauccuccaggugca

SEQ ID NO: 3333120 - RNA, 18 nt, Human
gaggugggauccuccagg

SEQ ID NO: 3333121 - RNA, 15 nt, Human
gaggggggagguggg

SEQ ID NO: 3333122 - RNA, 22 nt, Human
gaggggggaggugggauccucc

SEQ ID NO: 3333123 - RNA, 17 nt, Human
gaguacguugugcauuu

SEQ ID NO: 3333124 - RNA, 18 nt, Human
gaguacguugugcauuug

SEQ ID NO: 3333125 - RNA, 20 nt, Human
gaguacguugugcauuuggu

SEQ ID NO: 3333126 - RNA, 15 nt, Human
gaguacuacaguccu

SEQ ID NO: 3333127 - RNA, 18 nt, Human
gaguacuacaguccuccc

SEQ ID NO: 3333128 - RNA, 19 nt, Human
gaguacuacaguccuccca

SEQ ID NO: 3333129 - RNA, 16 nt, Human
gaguacguugugcauu

SEQ ID NO: 3333130 - RNA, 19 nt, Human
gagguuuuaaaaaaauccc

SEQ ID NO: 3333131 - RNA, 19 nt, Human
gagguucaaagauauuuug

SEQ ID NO: 3333132 - RNA, 14 nt, Human
gagguucccuuuga

SEQ ID NO: 3333133 - RNA, 22 nt, Human
gaucaaccccuucgcuccugug

SEQ ID NO: 3333134 - RNA, 21 nt, Human
gaucaaccccuucgcuccugu

SEQ ID NO: 3333135 - RNA, 23 nt, Human
gauauaugcucugcauguuacau

SEQ ID NO: 3333136 - RNA, 13 nt, Human
gauagccaaggcc

SEQ ID NO: 3333137 - RNA, 16 nt, Human
gauagcacagacccug

SEQ ID NO: 3333138 - RNA, 12 nt, Human
gauagccaaggc

SEQ ID NO: 3333139 - RNA, 19 nt, Human
gauagcacagacccugccc

SEQ ID NO: 3333140 - RNA, 13 nt, Human
gauacaaugcugu

SEQ ID NO: 3333141 - RNA, 18 nt, Human
gauacaaugcugugcccu

SEQ ID NO: 3333142 - RNA, 17 nt, Human
gauagcacagacccugc

SEQ ID NO: 3333143 - RNA, 18 nt, Human
gauagcacagacccugcc

SEQ ID NO: 3333144 - RNA, 17 nt, Human
gauacaaaagcauguga

SEQ ID NO: 3333145 - RNA, 23 nt, Human
gaguucaucuugaauuguaagga

SEQ ID NO: 3333146 - RNA, 20 nt, Human
gaguucaucuugaauuguaa

SEQ ID NO: 3333147 - RNA, 13 nt, Human
gaguucugguucc

SEQ ID NO: 3333148 - RNA, 12 nt, Human
gagugggcccaa

SEQ ID NO: 3333149 - RNA, 15 nt, Human
gagucugaaggcugg

SEQ ID NO: 3333150 - RNA, 20 nt, Human
gagccacugcaccgggccac

SEQ ID NO: 3333151 - RNA, 18 nt, Human
gagcagccacauuccuga

SEQ ID NO: 3333152 - RNA, 12 nt, Human
gagcccacgccc

SEQ ID NO: 3333153 - RNA, 15 nt, Human
gagcccacgccccca

SEQ ID NO: 3333154 - RNA, 16 nt, Human
gagcccacgcccccac

SEQ ID NO: 3333155 - RNA, 12 nt, Human
gagcccaggccu

SEQ ID NO: 3333156 - RNA, 14 nt, Human
gagcccugguggca

SEQ ID NO: 3333157 - RNA, 13 nt, Human
gagcccaggccuc

SEQ ID NO: 3333158 - RNA, 14 nt, Human
gagcccaggccucc

SEQ ID NO: 3333159 - RNA, 11 nt, Human
gagcccacgcc

SEQ ID NO: 3333160 - RNA, 22 nt, Human
gagccacugcaccgggccacag

SEQ ID NO: 3333161 - RNA, 17 nt, Human
gagcaccuuagacaguc

SEQ ID NO: 3333162 - RNA, 19 nt, Human
gagcaaaaucgaugcagug

SEQ ID NO: 3333163 - RNA, 21 nt, Human
gagcaagacgcugugcugccc

SEQ ID NO: 3333164 - RNA, 18 nt, Human
gagcaagacgcugugcug

SEQ ID NO: 3333165 - RNA, 22 nt, Human
gagcaagacgcugugcugcccu

SEQ ID NO: 3333166 - RNA, 20 nt, Human
gagaucaaccccuucgcucc

SEQ ID NO: 3333167 - RNA, 14 nt, Human
gagaucagccuggg

SEQ ID NO: 3333168 - RNA, 16 nt, Human
gagaucagccugggca

SEQ ID NO: 3333169 - RNA, 13 nt, Human
gagaucagccugg

SEQ ID NO: 3333170 - RNA, 20 nt, Human
gagccuccugcccuuaccug

SEQ ID NO: 3333171 - RNA, 22 nt, Human
gagccuccugcccuuaccugcc

SEQ ID NO: 3333172 - RNA, 17 nt, Human
gagcccugguggcagug

SEQ ID NO: 3333173 - RNA, 19 nt, Human
gagccucagcauccuggca

SEQ ID NO: 3333174 - RNA, 16 nt, Human
gagcccugguggcagu

SEQ ID NO: 3333175 - RNA, 15 nt, Human
gagcccugguggcag

SEQ ID NO: 3333176 - RNA, 13 nt, Human
gagccuccugccc

SEQ ID NO: 3333177 - RNA, 14 nt, Human
gagccuccugcccu

SEQ ID NO: 3333178 - RNA, 21 nt, Human
gagccucagcauccuggcacc

SEQ ID NO: 3333179 - RNA, 20 nt, Human
gagccucagcauccuggcac

SEQ ID NO: 3333180 - RNA, 13 nt, Human
gagccugggaggu

SEQ ID NO: 3333181 - RNA, 21 nt, Human
gagccugggaggucaaggcug

SEQ ID NO: 3333182 - RNA, 10 nt, Human
gagccuggca

SEQ ID NO: 3333183 - RNA, 15 nt, Human
gagccuggcaagaau

SEQ ID NO: 3333184 - RNA, 15 nt, Human
gagcugccaccugcc

SEQ ID NO: 3333185 - RNA, 16 nt, Human
gagcugccaccugccu

SEQ ID NO: 3333186 - RNA, 13 nt, Human
gagcugccaccug

SEQ ID NO: 3333187 - RNA, 23 nt, Human
gagcuacacaggggaaaagagga

SEQ ID NO: 3333188 - RNA, 15 nt, Human
gagggagggagggcu

SEQ ID NO: 3333189 - RNA, 15 nt, Human
gagggagggcuccag

SEQ ID NO: 3333190 - RNA, 14 nt, Human
gagggagggagggc

SEQ ID NO: 3333191 - RNA, 14 nt, Human
gagggagugacaga

SEQ ID NO: 3333192 - RNA, 14 nt, Human
gagggagguaagga

SEQ ID NO: 3333193 - RNA, 13 nt, Human
gagggagugacag

SEQ ID NO: 3333194 - RNA, 14 nt, Human
gagggcacagaaaa

SEQ ID NO: 3333195 - RNA, 22 nt, Human
gagggcacagaaaauggaagac

SEQ ID NO: 3333196 - RNA, 23 nt, Human
gagggcacagaaaauggaagaca

SEQ ID NO: 3333197 - RNA, 22 nt, Human
gaggggccucuuaugggcuggg

SEQ ID NO: 3333198 - RNA, 12 nt, Human
gaggggccucuu

SEQ ID NO: 3333199 - RNA, 13 nt, Human
gaggcugggcucc

SEQ ID NO: 3333200 - RNA, 14 nt, Human
gaggcugggcuccc

SEQ ID NO: 3333201 - RNA, 15 nt, Human
gaggcugggcucccu

SEQ ID NO: 3333202 - RNA, 23 nt, Human
gaggcccuucucuccagccccug

SEQ ID NO: 3333203 - RNA, 24 nt, Human
gaggcccuucucuccagccccugg

SEQ ID NO: 3333204 - RNA, 22 nt, Human
gaggcccuucucuccagccccu

SEQ ID NO: 3333205 - RNA, 15 nt, Human
gaggaauccagaccc

SEQ ID NO: 3333206 - RNA, 22 nt, Human
gaggaaggaaacccagcucugg

SEQ ID NO: 3333207 - RNA, 21 nt, Human
gaggaaggaaacccagcucug

SEQ ID NO: 3333208 - RNA, 14 nt, Human
gaggaauccagacc

SEQ ID NO: 3333209 - RNA, 22 nt, Human
gaggacagggaggugaccccag

SEQ ID NO: 3333210 - RNA, 13 nt, Human
gaggacagggagg

SEQ ID NO: 3333211 - RNA, 23 nt, Human
gaggaguuugggguaugggagag

SEQ ID NO: 3333212 - RNA, 20 nt, Human
gaggauguucugggacacag

SEQ ID NO: 3333213 - RNA, 17 nt, Human
gaggauguucugggaca

SEQ ID NO: 3333214 - RNA, 12 nt, Human
gaggauguucug

SEQ ID NO: 3333215 - RNA, 22 nt, Human
gaggcagccccauucugccugc

SEQ ID NO: 3333216 - RNA, 21 nt, Human
gaggcagccccauucugccug

SEQ ID NO: 3333217 - RNA, 23 nt, Human
gaggcagccccauucugccugcc

SEQ ID NO: 3333218 - RNA, 13 nt, Human
gaggccagccuug

SEQ ID NO: 3333219 - RNA, 12 nt, Human
gaggccagccuu

SEQ ID NO: 3333220 - RNA, 13 nt, Human
gaggcagccccau

SEQ ID NO: 3333221 - RNA, 16 nt, Human
gccacaagacccuugu

SEQ ID NO: 3333222 - RNA, 22 nt, Human
gccacaagacccuugugguccc

SEQ ID NO: 3333223 - RNA, 20 nt, Human
gccacagagaaaguacuucu

SEQ ID NO: 3333224 - RNA, 14 nt, Human
gccacagagaaagu

SEQ ID NO: 3333225 - RNA, 13 nt, Human
gccacagagaaag

SEQ ID NO: 3333226 - RNA, 23 nt, Human
gccacagagaaaguacuucucca

SEQ ID NO: 3333227 - RNA, 19 nt, Human
gcauuugaggucuguucuu

SEQ ID NO: 3333228 - RNA, 20 nt, Human
gcauuugaggucuguucuuu

SEQ ID NO: 3333229 - RNA, 22 nt, Human
gcauuuggugguuucagaaaug

SEQ ID NO: 3333230 - RNA, 23 nt, Human
gcauuuggugguuucagaaaugu

SEQ ID NO: 3333231 - RNA, 21 nt, Human
gccaaggcugggggaagaagc

SEQ ID NO: 3333232 - RNA, 21 nt, Human
gcauuuggugguuucagaaau

SEQ ID NO: 3333233 - RNA, 23 nt, Human
gccaaggugggaggauugcuuga

SEQ ID NO: 3333234 - RNA, 14 nt, Human
gccaaggugggagg

SEQ ID NO: 3333235 - RNA, 15 nt, Human
gccaaggugggagga

SEQ ID NO: 3333236 - RNA, 18 nt, Human
gccagaugcaccagcccu

SEQ ID NO: 3333237 - RNA, 17 nt, Human
gccagaugcaccagccc

SEQ ID NO: 3333238 - RNA, 16 nt, Human
gccagaugcaccagcc

SEQ ID NO: 3333239 - RNA, 23 nt, Human
gccagagggagugacagaggcag

SEQ ID NO: 3333240 - RNA, 12 nt, Human
gccagaggagag

SEQ ID NO: 3333241 - RNA, 13 nt, Human
gccagaggagaga

SEQ ID NO: 3333242 - RNA, 15 nt, Human
gccagaggagagagg

SEQ ID NO: 3333243 - RNA, 17 nt, Human
gccagaggagagaggac

SEQ ID NO: 3333244 - RNA, 19 nt, Human
gccagaggagagaggaccc

SEQ ID NO: 3333245 - RNA, 20 nt, Human
gccagagggagugacagagg

SEQ ID NO: 3333246 - RNA, 22 nt, Human
gccagagggagugacagaggca

SEQ ID NO: 3333247 - RNA, 21 nt, Human
gccagagggagugacagaggc

SEQ ID NO: 3333248 - RNA, 17 nt, Human
gccagagacacaagccu

SEQ ID NO: 3333249 - RNA, 19 nt, Human
gccagagacacaagccuuc

SEQ ID NO: 3333250 - RNA, 16 nt, Human
gccagagacacaagcc

SEQ ID NO: 3333251 - RNA, 10 nt, Human
gccagaggag

SEQ ID NO: 3333252 - RNA, 17 nt, Human
gccaccugccuguuggg

SEQ ID NO: 3333253 - RNA, 19 nt, Human
gccacggccaggccagagg

SEQ ID NO: 3333254 - RNA, 17 nt, Human
gccacggccaggccaga

SEQ ID NO: 3333255 - RNA, 18 nt, Human
gccacggccaggccagag

SEQ ID NO: 3333256 - RNA, 14 nt, Human
gccaccugcggugc

SEQ ID NO: 3333257 - RNA, 20 nt, Human
gccaccugcggugcuaucuc

SEQ ID NO: 3333258 - RNA, 22 nt, Human
gccaccugcggugcuaucuccc

SEQ ID NO: 3333259 - RNA, 20 nt, Human
gcccagagggccugcaaggg

SEQ ID NO: 3333260 - RNA, 21 nt, Human
gcccagagggccugcaaggga

SEQ ID NO: 3333261 - RNA, 22 nt, Human
gcccagagggccugcaagggag

SEQ ID NO: 3333262 - RNA, 11 nt, Human
gcccagccccu

SEQ ID NO: 3333263 - RNA, 12 nt, Human
gcccagccccuu

SEQ ID NO: 3333264 - RNA, 9 nt, Human
gcccagccc

SEQ ID NO: 3333265 - RNA, 14 nt, Human
gcccagagggccug

SEQ ID NO: 3333266 - RNA, 15 nt, Human
gcccagagggccugc

SEQ ID NO: 3333267 - RNA, 18 nt, Human
gcccagagggccugcaag

SEQ ID NO: 3333268 - RNA, 19 nt, Human
gcccagagggccugcaagg

SEQ ID NO: 3333269 - RNA, 12 nt, Human
gcccagagggcc

SEQ ID NO: 3333270 - RNA, 21 nt, Human
gcccaaugcacuuuguucugg

SEQ ID NO: 3333271 - RNA, 18 nt, Human
gcccaggaaaggcuccag

SEQ ID NO: 3333272 - RNA, 19 nt, Human
gcccaggaaaggcuccagg

SEQ ID NO: 3333273 - RNA, 20 nt, Human
gcccaggaaaggcuccagga

SEQ ID NO: 3333274 - RNA, 20 nt, Human
gcccaggcuggcgugcagug

SEQ ID NO: 3333275 - RNA, 19 nt, Human
gcccaggcuggcgugcagu

SEQ ID NO: 3333276 - RNA, 22 nt, Human
gcccaggcuggcgugcaguggu

SEQ ID NO: 3333277 - RNA, 19 nt, Human
gcccaggcuuagucacuga

SEQ ID NO: 3333278 - RNA, 21 nt, Human
gcccaggcuuagucacugaga

SEQ ID NO: 3333279 - RNA, 23 nt, Human
gcccaggcuuagucacugagaca

SEQ ID NO: 3333280 - RNA, 19 nt, Human
gcccagucuggaaugcagu

SEQ ID NO: 3333281 - RNA, 15 nt, Human
gcccaguugggugga

SEQ ID NO: 3333282 - RNA, 13 nt, Human
gcccagccccuuc

SEQ ID NO: 3333283 - RNA, 14 nt, Human
gcccagccccuucu

SEQ ID NO: 3333284 - RNA, 16 nt, Human
gcccagccccuucuga

SEQ ID NO: 3333285 - RNA, 17 nt, Human
gcccagccccuucugac

SEQ ID NO: 3333286 - RNA, 20 nt, Human
gcccagccccuucugaccca

SEQ ID NO: 3333287 - RNA, 24 nt, Human
gcccagccccuucugacccaugcu

SEQ ID NO: 3333288 - RNA, 15 nt, Human
gccagaugcaccagc

SEQ ID NO: 3333289 - RNA, 16 nt, Human
gccagauuucacucuc

SEQ ID NO: 3333290 - RNA, 18 nt, Human
gccagauuucacucuccu

SEQ ID NO: 3333291 - RNA, 21 nt, Human
gccagauuucacucuccuugg

SEQ ID NO: 3333292 - RNA, 23 nt, Human
gccagggacagaggggguggccu

SEQ ID NO: 3333293 - RNA, 15 nt, Human
gccaggcuggucuca

SEQ ID NO: 3333294 - RNA, 16 nt, Human
gccagggacagagggg

SEQ ID NO: 3333295 - RNA, 18 nt, Human
gccagggacagagggggu

SEQ ID NO: 3333296 - RNA, 13 nt, Human
gccagggacagag

SEQ ID NO: 3333297 - RNA, 17 nt, Human
gccagucaccccggcca

SEQ ID NO: 3333298 - RNA, 18 nt, Human
gccagucaccccggccac

SEQ ID NO: 3333299 - RNA, 20 nt, Human
gccagucaccccggccaccu

SEQ ID NO: 3333300 - RNA, 17 nt, Human
gccagguuuuuggucug

SEQ ID NO: 3333301 - RNA, 23 nt, Human
gccaggggaaaaucagccugcuc

SEQ ID NO: 3333302 - RNA, 18 nt, Human
gccaugaggaacaaggca

SEQ ID NO: 3333303 - RNA, 13 nt, Human
gccaugccagcuu

SEQ ID NO: 3333304 - RNA, 18 nt, Human
gccaugccagcuuaucuc

SEQ ID NO: 3333305 - RNA, 19 nt, Human
gccaugccagcuuaucuca

SEQ ID NO: 3333306 - RNA, 24 nt, Human
gccaugcuccuggcccacugcauc

SEQ ID NO: 3333307 - RNA, 16 nt, Human
gccauuuguguuuaua

SEQ ID NO: 3333308 - RNA, 13 nt, Human
gcauguuacauaa

SEQ ID NO: 3333309 - RNA, 14 nt, Human
gcaugccuggaugg

SEQ ID NO: 3333310 - RNA, 22 nt, Human
gcauuaucuagauacuguauca

SEQ ID NO: 3333311 - RNA, 24 nt, Human
gcauuaucuagauacuguaucaug

SEQ ID NO: 3333312 - RNA, 19 nt, Human
gcauuaucuagauacugua

SEQ ID NO: 3333313 - RNA, 12 nt, Human
gcauuccccagg

SEQ ID NO: 3333314 - RNA, 14 nt, Human
gcauuccccaggag

SEQ ID NO: 3333315 - RNA, 15 nt, Human
gcauuccccaggagg

SEQ ID NO: 3333316 - RNA, 16 nt, Human
gcauuccccaggaggc

SEQ ID NO: 3333317 - RNA, 17 nt, Human
gcauuccccaggaggcc

SEQ ID NO: 3333318 - RNA, 18 nt, Human
gcauuccccaggaggcca

SEQ ID NO: 3333319 - RNA, 19 nt, Human
gcauuccccaggaggccag

SEQ ID NO: 3333320 - RNA, 20 nt, Human
gcauuccccaggaggccagc

SEQ ID NO: 3333321 - RNA, 21 nt, Human
gcauuccccaggaggccagcc

SEQ ID NO: 3333322 - RNA, 18 nt, Human
gcauuugaggucuguucu

SEQ ID NO: 3333323 - RNA, 22 nt, Human
gcauuccccaggaggccagccu

SEQ ID NO: 3333324 - RNA, 20 nt, Human
gcaugacacgaauauugcug

SEQ ID NO: 3333325 - RNA, 21 nt, Human
gcaugacacgaauauugcuga

SEQ ID NO: 3333326 - RNA, 18 nt, Human
gcaugaaguaauaugcac

SEQ ID NO: 3333327 - RNA, 22 nt, Human
gcaugacacgaauauugcugau

SEQ ID NO: 3333328 - RNA, 21 nt, Human
gcaugaaguaauaugcacaca

SEQ ID NO: 3333329 - RNA, 22 nt, Human
gcaugaaguaauaugcacacau

SEQ ID NO: 3333330 - RNA, 20 nt, Human
gcaugaaguaauaugcacac

SEQ ID NO: 3333331 - RNA, 23 nt, Human
gcaucaggccaggcccucugccc

SEQ ID NO: 3333332 - RNA, 18 nt, Human
gcaucaggccaggcccuc

SEQ ID NO: 3333333 - RNA, 12 nt, Human
gcaucaggccag

SEQ ID NO: 3333334 - RNA, 19 nt, Human
gcaguggugcgaucugggu

SEQ ID NO: 3333335 - RNA, 18 nt, Human
gcaguggugcgaucuggg

SEQ ID NO: 3333336 - RNA, 11 nt, Human
gcagugggagc

SEQ ID NO: 3333337 - RNA, 20 nt, Human
gcaguggugguuuucuguuc

SEQ ID NO: 3333338 - RNA, 21 nt, Human
gcaguggugguuuucuguucu

SEQ ID NO: 3333339 - RNA, 21 nt, Human
gcaguggugcgaucuggguuc

SEQ ID NO: 3333340 - RNA, 20 nt, Human
gcaguggugcgaucuggguu

SEQ ID NO: 3333341 - RNA, 19 nt, Human
gcaguggugguuuucuguu

SEQ ID NO: 3333342 - RNA, 22 nt, Human
gcaguggugcgaucuggguuca

SEQ ID NO: 3333343 - RNA, 18 nt, Human
gcauacguacacauuuua

SEQ ID NO: 3333344 - RNA, 19 nt, Human
gcauacguacacauuuuau

SEQ ID NO: 3333345 - RNA, 19 nt, Human
gcaggguccuagaaauucc

SEQ ID NO: 3333346 - RNA, 16 nt, Human
gcagggucucacucug

SEQ ID NO: 3333347 - RNA, 22 nt, Human
gcagggcucagcggggacagcu

SEQ ID NO: 3333348 - RNA, 18 nt, Human
gcaggcagccaggccaca

SEQ ID NO: 3333349 - RNA, 17 nt, Human
gcaggcagccaggccac

SEQ ID NO: 3333350 - RNA, 16 nt, Human
gcacccucaggcaggu

SEQ ID NO: 3333351 - RNA, 19 nt, Human
gcacccucaggcagguggg

SEQ ID NO: 3333352 - RNA, 14 nt, Human
gcacgugugugcac

SEQ ID NO: 3333353 - RNA, 20 nt, Human
gcacuaaggugugcucugau

SEQ ID NO: 3333354 - RNA, 19 nt, Human
gcacuaaggugugcucuga

SEQ ID NO: 3333355 - RNA, 12 nt, Human
gcacugcuucca

SEQ ID NO: 3333356 - RNA, 13 nt, Human
gcacugcuuccag

SEQ ID NO: 3333357 - RNA, 14 nt, Human
gcacugcuuccagu

SEQ ID NO: 3333358 - RNA, 15 nt, Human
gcacuauaauguaag

SEQ ID NO: 3333359 - RNA, 14 nt, Human
gcacuauaauguaa

SEQ ID NO: 3333360 - RNA, 20 nt, Human
gcacuauaauguaagcucua

SEQ ID NO: 3333361 - RNA, 12 nt, Human
gcacugggcuug

SEQ ID NO: 3333362 - RNA, 19 nt, Human
gcacuguuuuauuuuaauu

SEQ ID NO: 3333363 - RNA, 17 nt, Human
gcaccaucucuccuccu

SEQ ID NO: 3333364 - RNA, 14 nt, Human
gcaccaucucuccu

SEQ ID NO: 3333365 - RNA, 15 nt, Human
gcaccaucucuccuc

SEQ ID NO: 3333366 - RNA, 13 nt, Human
gcaccagcagccu

SEQ ID NO: 3333367 - RNA, 23 nt, Human
gcacagcuucauuuccugugucu

SEQ ID NO: 3333368 - RNA, 21 nt, Human
gcacagcuucauuuccugugu

SEQ ID NO: 3333369 - RNA, 20 nt, Human
gauugugucucuugguccug

SEQ ID NO: 3333370 - RNA, 18 nt, Human
gcagcucagagagggugg

SEQ ID NO: 3333371 - RNA, 19 nt, Human
gcagcucagagaggguggg

SEQ ID NO: 3333372 - RNA, 17 nt, Human
gcagcucaccucucccu

SEQ ID NO: 3333373 - RNA, 20 nt, Human
gcagcucaccucucccuugg

SEQ ID NO: 3333374 - RNA, 21 nt, Human
gcagcucaccucucccuugga

SEQ ID NO: 3333375 - RNA, 14 nt, Human
gcagcucagagagg

SEQ ID NO: 3333376 - RNA, 16 nt, Human
gcagcucaccucuccc

SEQ ID NO: 3333377 - RNA, 18 nt, Human
gcagcagggagggcuucu

SEQ ID NO: 3333378 - RNA, 19 nt, Human
gcagcagggagggcuucug

SEQ ID NO: 3333379 - RNA, 19 nt, Human
gcagccucacaguccuuac

SEQ ID NO: 3333380 - RNA, 15 nt, Human
gcagccucacagucc

SEQ ID NO: 3333381 - RNA, 17 nt, Human
gcagccucacaguccuu

SEQ ID NO: 3333382 - RNA, 22 nt, Human
gcagagaccaucccugaaggcc

SEQ ID NO: 3333383 - RNA, 20 nt, Human
gcagagaccaucccugaagg

SEQ ID NO: 3333384 - RNA, 21 nt, Human
gcagagaccaucccugaaggc

SEQ ID NO: 3333385 - RNA, 19 nt, Human
gcagagaccaucccugaag

SEQ ID NO: 3333386 - RNA, 22 nt, Human
gcagacucuacagaggccaugg

SEQ ID NO: 3333387 - RNA, 19 nt, Human
gcagacucuacagaggcca

SEQ ID NO: 3333388 - RNA, 18 nt, Human
gcagacucuacagaggcc

SEQ ID NO: 3333389 - RNA, 17 nt, Human
gcagacucuacagaggc

SEQ ID NO: 3333390 - RNA, 14 nt, Human
gcacuugcagacuc

SEQ ID NO: 3333391 - RNA, 22 nt, Human
gcacuucgggaggucgaggcag

SEQ ID NO: 3333392 - RNA, 18 nt, Human
gcagauggagaccccuug

SEQ ID NO: 3333393 - RNA, 21 nt, Human
gcuucauccuccucagaucuu

SEQ ID NO: 3333394 - RNA, 20 nt, Human
gcuucaguggcagcugcuuu

SEQ ID NO: 3333395 - RNA, 19 nt, Human
gcuucaguggcagcugcuu

SEQ ID NO: 3333396 - RNA, 23 nt, Human
gcuuauauucaaccauggacuuu

SEQ ID NO: 3333397 - RNA, 20 nt, Human
gcuuauacacuuacacuuua

SEQ ID NO: 3333398 - RNA, 22 nt, Human
gcuuauauucaaccauggacuu

SEQ ID NO: 3333399 - RNA, 20 nt, Human
gcuuauauucaaccauggac

SEQ ID NO: 3333400 - RNA, 13 nt, Human
gcuuauauucaac

SEQ ID NO: 3333401 - RNA, 18 nt, Human
gcuucauuuccugugucu

SEQ ID NO: 3333402 - RNA, 22 nt, Human
gcuucucacugccaugccagcu

SEQ ID NO: 3333403 - RNA, 17 nt, Human
gcuucucacugccaugc

SEQ ID NO: 3333404 - RNA, 23 nt, Human
gcugucccuuacgugaguccugg

SEQ ID NO: 3333405 - RNA, 22 nt, Human
gcugucccuuacgugaguccug

SEQ ID NO: 3333406 - RNA, 16 nt, Human
gcugucccuuuuccuu

SEQ ID NO: 3333407 - RNA, 15 nt, Human
gcuggugucaccuga

SEQ ID NO: 3333408 - RNA, 14 nt, Human
gcuggugucaccug

SEQ ID NO: 3333409 - RNA, 17 nt, Human
gcugucagccauuccug

SEQ ID NO: 3333410 - RNA, 15 nt, Human
gcugugucucccuuc

SEQ ID NO: 3333411 - RNA, 20 nt, Human
gcuggucccacucaguccau

SEQ ID NO: 3333412 - RNA, 13 nt, Human
gcugggggccuca

SEQ ID NO: 3333413 - RNA, 15 nt, Human
gcugggggccucagu

SEQ ID NO: 3333414 - RNA, 14 nt, Human
gcugggggccucag

SEQ ID NO: 3333415 - RNA, 13 nt, Human
gcuggccuggccc

SEQ ID NO: 3333416 - RNA, 12 nt, Human
gcuggccuggcc

SEQ ID NO: 3333417 - RNA, 14 nt, Human
gcuggccuggcccc

SEQ ID NO: 3333418 - RNA, 15 nt, Human
gcuggccuggccccu

SEQ ID NO: 3333419 - RNA, 19 nt, Human
gcugggaugauuggagggg

SEQ ID NO: 3333420 - RNA, 21 nt, Human
gcugggcucccuucccaccuc

SEQ ID NO: 3333421 - RNA, 20 nt, Human
gcugggcuucaguggcagcu

SEQ ID NO: 3333422 - RNA, 22 nt, Human
gcugggcuucaguggcagcugc

SEQ ID NO: 3333423 - RNA, 21 nt, Human
gcugggcuucaguggcagcug

SEQ ID NO: 3333424 - RNA, 19 nt, Human
gcugggcuucaguggcagc

SEQ ID NO: 3333425 - RNA, 12 nt, Human
gcugcccugccc

SEQ ID NO: 3333426 - RNA, 13 nt, Human
gcugcccugccca

SEQ ID NO: 3333427 - RNA, 14 nt, Human
gcugcccugcccac

SEQ ID NO: 3333428 - RNA, 16 nt, Human
gcugcccugcccaccu

SEQ ID NO: 3333429 - RNA, 18 nt, Human
gcugcccugcccaccugg

SEQ ID NO: 3333430 - RNA, 20 nt, Human
gcugcccugcccaccuggcc

SEQ ID NO: 3333431 - RNA, 21 nt, Human
gcugcccugcccaccuggccu

SEQ ID NO: 3333432 - RNA, 22 nt, Human
gcugcccugcccaccuggccuc

SEQ ID NO: 3333433 - RNA, 23 nt, Human
gcugcccugcccaccuggccucu

SEQ ID NO: 3333434 - RNA, 24 nt, Human
gcugcccugcccaccuggccucug

SEQ ID NO: 3333435 - RNA, 22 nt, Human
gcugcgguccacccaggagccc

SEQ ID NO: 3333436 - RNA, 21 nt, Human
gcugcgguccacccaggagcc

SEQ ID NO: 3333437 - RNA, 19 nt, Human
gcugcgguccacccaggag

SEQ ID NO: 3333438 - RNA, 15 nt, Human
gcugcgguccaccca

SEQ ID NO: 3333439 - RNA, 14 nt, Human
gcugcgguccaccc

SEQ ID NO: 3333440 - RNA, 19 nt, Human
gcugccuguucagcuccag

SEQ ID NO: 3333441 - RNA, 18 nt, Human
gcugccuguucagcucca

SEQ ID NO: 3333442 - RNA, 22 nt, Human
gcugccuguucagcuccagcuc

SEQ ID NO: 3333443 - RNA, 20 nt, Human
gcugccuguucagcuccagc

SEQ ID NO: 3333444 - RNA, 15 nt, Human
gcuggaccuugaacu

SEQ ID NO: 3333445 - RNA, 22 nt, Human
gcugcuugggcuucauccuccu

SEQ ID NO: 3333446 - RNA, 22 nt, Human
gcugcuuuugucuaugggacuc

SEQ ID NO: 3333447 - RNA, 20 nt, Human
gcucucaggccagcugcuug

SEQ ID NO: 3333448 - RNA, 21 nt, Human
gcucucaggccagcugcuugg

SEQ ID NO: 3333449 - RNA, 22 nt, Human
gcugacuguuuucucuugagag

SEQ ID NO: 3333450 - RNA, 19 nt, Human
gcugacagacacaggcccg

SEQ ID NO: 3333451 - RNA, 18 nt, Human
gcugacagacacaggccc

SEQ ID NO: 3333452 - RNA, 17 nt, Human
gcugacagacacaggcc

SEQ ID NO: 3333453 - RNA, 12 nt, Human
gcugccaccugc

SEQ ID NO: 3333454 - RNA, 20 nt, Human
gcugccaaugggagcucaug

SEQ ID NO: 3333455 - RNA, 19 nt, Human
gcugcauuuaaaagauaca

SEQ ID NO: 3333456 - RNA, 17 nt, Human
gcugcauuuaaaagaua

SEQ ID NO: 3333457 - RNA, 18 nt, Human
gcugcauuuaaaagauac

SEQ ID NO: 3333458 - RNA, 13 nt, Human
gcugcaguugcca

SEQ ID NO: 3333459 - RNA, 14 nt, Human
gcugcaguugccag

SEQ ID NO: 3333460 - RNA, 22 nt, Human
gcugcaaaggguaucaggugcu

SEQ ID NO: 3333461 - RNA, 22 nt, Human
gcucagcggggacagcuccuuc

SEQ ID NO: 3333462 - RNA, 23 nt, Human
gcucagcggggacagcuccuucu

SEQ ID NO: 3333463 - RNA, 18 nt, Human
gcucagcggggacagcuc

SEQ ID NO: 3333464 - RNA, 17 nt, Human
gcucagcggggacagcu

SEQ ID NO: 3333465 - RNA, 16 nt, Human
gcucagcggggacagc

SEQ ID NO: 3333466 - RNA, 15 nt, Human
gcucaccagccccag

SEQ ID NO: 3333467 - RNA, 14 nt, Human
gcucaccagcccca

SEQ ID NO: 3333468 - RNA, 13 nt, Human
gcucaccagcccc

SEQ ID NO: 3333469 - RNA, 12 nt, Human
gcucaccagccc

SEQ ID NO: 3333470 - RNA, 16 nt, Human
gcucacauaucuguca

SEQ ID NO: 3333471 - RNA, 14 nt, Human
gcucaccucucccu

SEQ ID NO: 3333472 - RNA, 16 nt, Human
gcucaccucucccuug

SEQ ID NO: 3333473 - RNA, 17 nt, Human
gcucaccucucccuugg

SEQ ID NO: 3333474 - RNA, 18 nt, Human
gcucaccucucccuugga

SEQ ID NO: 3333475 - RNA, 13 nt, Human
gcuaucuccccca

SEQ ID NO: 3333476 - RNA, 18 nt, Human
gcucaaguccucuuuucu

SEQ ID NO: 3333477 - RNA, 14 nt, Human
gcuaucucccccag

SEQ ID NO: 3333478 - RNA, 22 nt, Human
gcucaaguccucuuuucugaga

SEQ ID NO: 3333479 - RNA, 19 nt, Human
gcucaaguccucuuuucug

SEQ ID NO: 3333480 - RNA, 19 nt, Human
gcggugcuaucucccccag

SEQ ID NO: 3333481 - RNA, 22 nt, Human
gcggugcuaucucccccagccc

SEQ ID NO: 3333482 - RNA, 21 nt, Human
gcuaguugggcuuccucauag

SEQ ID NO: 3333483 - RNA, 24 nt, Human
gcuccaggcuccuuuagcgcccag

SEQ ID NO: 3333484 - RNA, 12 nt, Human
gcuccaggcucc

SEQ ID NO: 3333485 - RNA, 15 nt, Human
gcuccaggagcagcc

SEQ ID NO: 3333486 - RNA, 16 nt, Human
gcuccaggagcagcca

SEQ ID NO: 3333487 - RNA, 17 nt, Human
gcuccaggagcagccac

SEQ ID NO: 3333488 - RNA, 18 nt, Human
gcuccaggagcagccaca

SEQ ID NO: 3333489 - RNA, 12 nt, Human
gcuccaggagca

SEQ ID NO: 3333490 - RNA, 14 nt, Human
gcuccaggagcagc

SEQ ID NO: 3333491 - RNA, 11 nt, Human
gcuccaggagc

SEQ ID NO: 3333492 - RNA, 21 nt, Human
gcuccagcuguucagcugguu

SEQ ID NO: 3333493 - RNA, 20 nt, Human
gcuccagcuguucagcuggu

SEQ ID NO: 3333494 - RNA, 23 nt, Human
gcuccgcuuucuacccagcgagc

SEQ ID NO: 3333495 - RNA, 22 nt, Human
gcuccgcuuucuacccagcgag

SEQ ID NO: 3333496 - RNA, 21 nt, Human
gcuccgcuuucuacccagcga

SEQ ID NO: 3333497 - RNA, 18 nt, Human
gcuccgcuuucuacccag

SEQ ID NO: 3333498 - RNA, 20 nt, Human
gcucccuucccaccucucuc

SEQ ID NO: 3333499 - RNA, 19 nt, Human
gcucccuucccaccucucu

SEQ ID NO: 3333500 - RNA, 24 nt, Human
gcuccgcuuucuacccagcgagcc

SEQ ID NO: 3333501 - RNA, 19 nt, Human
gcucgagcaugccuggaug

SEQ ID NO: 3333502 - RNA, 21 nt, Human
gcucgagcaugccuggauggg

SEQ ID NO: 3333503 - RNA, 17 nt, Human
gcucgagcaugccugga

SEQ ID NO: 3333504 - RNA, 17 nt, Human
gcuccuuuagcgcccag

SEQ ID NO: 3333505 - RNA, 13 nt, Human
gcuccuucugucc

SEQ ID NO: 3333506 - RNA, 13 nt, Human
gcuccugugucuu

SEQ ID NO: 3333507 - RNA, 12 nt, Human
gcuccugugucu

SEQ ID NO: 3333508 - RNA, 23 nt, Human
gcgcccaguuggguggaugccug

SEQ ID NO: 3333509 - RNA, 21 nt, Human
gcgccuuaaggauguucuagc

SEQ ID NO: 3333510 - RNA, 14 nt, Human
gcggggacagcucc

SEQ ID NO: 3333511 - RNA, 13 nt, Human
gcggggacagcuc

SEQ ID NO: 3333512 - RNA, 16 nt, Human
gcggagaaaggaaggg

SEQ ID NO: 3333513 - RNA, 17 nt, Human
gcgcugccccuggcagc

SEQ ID NO: 3333514 - RNA, 18 nt, Human
gcgcugccccuggcagcc

SEQ ID NO: 3333515 - RNA, 21 nt, Human
gcgcugccccuggcagccccu

SEQ ID NO: 3333516 - RNA, 14 nt, Human
gcgguccacccagg

SEQ ID NO: 3333517 - RNA, 13 nt, Human
gcgguccacccag

SEQ ID NO: 3333518 - RNA, 19 nt, Human
gcggugagaggggaacaga

SEQ ID NO: 3333519 - RNA, 17 nt, Human
gcggggacagcuccuuc

SEQ ID NO: 3333520 - RNA, 15 nt, Human
gcggggacagcuccu

SEQ ID NO: 3333521 - RNA, 12 nt, Human
gcgacaaugcaa

SEQ ID NO: 3333522 - RNA, 13 nt, Human
gcgacaaugcaaa

SEQ ID NO: 3333523 - RNA, 20 nt, Human
gcgacaaugcaaaccaucau

SEQ ID NO: 3333524 - RNA, 21 nt, Human
gcgacaaugcaaaccaucauu

SEQ ID NO: 3333525 - RNA, 15 nt, Human
gccuuacacaauggu

SEQ ID NO: 3333526 - RNA, 15 nt, Human
gccuguaauccuagc

SEQ ID NO: 3333527 - RNA, 20 nt, Human
gccuguaauccuagcacuuu

SEQ ID NO: 3333528 - RNA, 21 nt, Human
gccuggccagaugcaccagcc

SEQ ID NO: 3333529 - RNA, 16 nt, Human
gccuggccagaugcac

SEQ ID NO: 3333530 - RNA, 20 nt, Human
gccuggccagaugcaccagc

SEQ ID NO: 3333531 - RNA, 13 nt, Human
gccuggccccuca

SEQ ID NO: 3333532 - RNA, 18 nt, Human
gccugggcagaaggaaga

SEQ ID NO: 3333533 - RNA, 20 nt, Human
gccuggauggggcugcaccg

SEQ ID NO: 3333534 - RNA, 16 nt, Human
gccuggauggggcugc

SEQ ID NO: 3333535 - RNA, 18 nt, Human
gccuggauggggcugcac

SEQ ID NO: 3333536 - RNA, 12 nt, Human
gccugagcuggg

SEQ ID NO: 3333537 - RNA, 16 nt, Human
gccugaagucacacag

SEQ ID NO: 3333538 - RNA, 15 nt, Human
gccugaagucacaca

SEQ ID NO: 3333539 - RNA, 21 nt, Human
gcccaguuggguggaugccug

SEQ ID NO: 3333540 - RNA, 19 nt, Human
gcccaguuggguggaugcc

SEQ ID NO: 3333541 - RNA, 17 nt, Human
gccugaagucacacagu

SEQ ID NO: 3333542 - RNA, 14 nt, Human
ggcccagagggccu

SEQ ID NO: 3333543 - RNA, 17 nt, Human
ggcccagagggccugca

SEQ ID NO: 3333544 - RNA, 19 nt, Human
ggcccagagggccugcaag

SEQ ID NO: 3333545 - RNA, 20 nt, Human
ggcccagagggccugcaagg

SEQ ID NO: 3333546 - RNA, 22 nt, Human
ggccucaagugauucuccugcc

SEQ ID NO: 3333547 - RNA, 14 nt, Human
ggccucaagugauu

SEQ ID NO: 3333548 - RNA, 22 nt, Human
ggccuagcauacguacacauuu

SEQ ID NO: 3333549 - RNA, 20 nt, Human
ggccuagcauacguacacau

SEQ ID NO: 3333550 - RNA, 14 nt, Human
ggccuccugugugu

SEQ ID NO: 3333551 - RNA, 20 nt, Human
ggccucgguguggagaagcg

SEQ ID NO: 3333552 - RNA, 16 nt, Human
ggccucugcacucccc

SEQ ID NO: 3333553 - RNA, 23 nt, Human
ggcgcagcauauucaggaagcuc

SEQ ID NO: 3333554 - RNA, 24 nt, Human
ggcgcagcauauucaggaagcuca

SEQ ID NO: 3333555 - RNA, 15 nt, Human
ggccuggccugagcu

SEQ ID NO: 3333556 - RNA, 16 nt, Human
ggccuggccugagcug

SEQ ID NO: 3333557 - RNA, 23 nt, Human
ggccugggggcugggcagaggaa

SEQ ID NO: 3333558 - RNA, 22 nt, Human
ggccugggggcugggcagagga

SEQ ID NO: 3333559 - RNA, 14 nt, Human
ggccuggccccuca

SEQ ID NO: 3333560 - RNA, 15 nt, Human
ggccuggccccucag

SEQ ID NO: 3333561 - RNA, 17 nt, Human
ggccuggccccucaggg

SEQ ID NO: 3333562 - RNA, 18 nt, Human
ggccuggccccucagggu

SEQ ID NO: 3333563 - RNA, 23 nt, Human
ggccuggccccucagggucccug

SEQ ID NO: 3333564 - RNA, 10 nt, Human
ggccuggccu

SEQ ID NO: 3333565 - RNA, 13 nt, Human
ggccuggccugag

SEQ ID NO: 3333566 - RNA, 14 nt, Human
ggccuggccugagc

SEQ ID NO: 3333567 - RNA, 13 nt, Human
ggccuggccccuc

SEQ ID NO: 3333568 - RNA, 18 nt, Human
ggccucugcacuccccug

SEQ ID NO: 3333569 - RNA, 19 nt, Human
ggccucugcacuccccugc

SEQ ID NO: 3333570 - RNA, 22 nt, Human
ggccucugcacuccccugcugg

SEQ ID NO: 3333571 - RNA, 16 nt, Human
ggcucugccucccauc

SEQ ID NO: 3333572 - RNA, 14 nt, Human
ggcucugcccuugg

SEQ ID NO: 3333573 - RNA, 15 nt, Human
ggcucugcccuuggu

SEQ ID NO: 3333574 - RNA, 13 nt, Human
ggcucugccuccc

SEQ ID NO: 3333575 - RNA, 15 nt, Human
ggcucugccucccau

SEQ ID NO: 3333576 - RNA, 12 nt, Human
ggcucugcccuu

SEQ ID NO: 3333577 - RNA, 14 nt, Human
ggcucucaggccag

SEQ ID NO: 3333578 - RNA, 17 nt, Human
ggcucucaggccagcug

SEQ ID NO: 3333579 - RNA, 18 nt, Human
ggcucucaggccagcugc

SEQ ID NO: 3333580 - RNA, 19 nt, Human
ggcucucaggccagcugcu

SEQ ID NO: 3333581 - RNA, 20 nt, Human
ggcucucaggccagcugcuu

SEQ ID NO: 3333582 - RNA, 15 nt, Human
ggcucucaggccagc

SEQ ID NO: 3333583 - RNA, 16 nt, Human
ggcucucaggccagcu

SEQ ID NO: 3333584 - RNA, 14 nt, Human
ggcuccaggcuccu

SEQ ID NO: 3333585 - RNA, 10 nt, Human
ggcuccagac

SEQ ID NO: 3333586 - RNA, 14 nt, Human
ggcuccaggagcag

SEQ ID NO: 3333587 - RNA, 16 nt, Human
ggcuccaggagcagcc

SEQ ID NO: 3333588 - RNA, 17 nt, Human
ggcuccaggagcagcca

SEQ ID NO: 3333589 - RNA, 13 nt, Human
ggcuccaggagca

SEQ ID NO: 3333590 - RNA, 11 nt, Human
ggcuccaggcu

SEQ ID NO: 3333591 - RNA, 13 nt, Human
ggcuccaggcucc

SEQ ID NO: 3333592 - RNA, 12 nt, Human
ggcuccaggcuc

SEQ ID NO: 3333593 - RNA, 12 nt, Human
ggcuaugcauuu

SEQ ID NO: 3333594 - RNA, 13 nt, Human
ggcuaugcauuug

SEQ ID NO: 3333595 - RNA, 9 nt, Human
ggcuccaga

SEQ ID NO: 3333596 - RNA, 15 nt, Human
ggcgcgguggcucac

SEQ ID NO: 3333597 - RNA, 11 nt, Human
ggcgcugcccc

SEQ ID NO: 3333598 - RNA, 17 nt, Human
ggcgcugccccuggcag

SEQ ID NO: 3333599 - RNA, 14 nt, Human
ggcugcuucaagga

SEQ ID NO: 3333600 - RNA, 20 nt, Human
ggcugcuucaaggauccuga

SEQ ID NO: 3333601 - RNA, 15 nt, Human
ggcugcuucaaggau

SEQ ID NO: 3333602 - RNA, 19 nt, Human
ggcugcuucaaggauccug

SEQ ID NO: 3333603 - RNA, 18 nt, Human
ggcugggcuucaguggca

SEQ ID NO: 3333604 - RNA, 22 nt, Human
ggcugggcuucaguggcagcug

SEQ ID NO: 3333605 - RNA, 21 nt, Human
ggcugggcuucaguggcagcu

SEQ ID NO: 3333606 - RNA, 11 nt, Human
ggcugggcuuc

SEQ ID NO: 3333607 - RNA, 16 nt, Human
ggcugggggaagaagc

SEQ ID NO: 3333608 - RNA, 20 nt, Human
ggcugggcucccuucccacc

SEQ ID NO: 3333609 - RNA, 21 nt, Human
ggcugggcucccuucccaccu

SEQ ID NO: 3333610 - RNA, 18 nt, Human
ggcugggcucccuuccca

SEQ ID NO: 3333611 - RNA, 14 nt, Human
ggcuuagucacuga

SEQ ID NO: 3333612 - RNA, 20 nt, Human
ggcuucacggaagagccuug

SEQ ID NO: 3333613 - RNA, 21 nt, Human
ggcuucacggaagagccuugc

SEQ ID NO: 3333614 - RNA, 17 nt, Human
ggcuuggggaccagagc

SEQ ID NO: 3333615 - RNA, 18 nt, Human
ggcuuggggaccagagcu

SEQ ID NO: 3333616 - RNA, 20 nt, Human
ggcuguuggcugggggccuc

SEQ ID NO: 3333617 - RNA, 16 nt, Human
ggcuguuggcuggggg

SEQ ID NO: 3333618 - RNA, 15 nt, Human
ggcuguuggcugggg

SEQ ID NO: 3333619 - RNA, 14 nt, Human
ggcuguuggcuggg

SEQ ID NO: 3333620 - RNA, 22 nt, Human
gggagcugccuguucagcucca

SEQ ID NO: 3333621 - RNA, 21 nt, Human
gggagcugccuguucagcucc

SEQ ID NO: 3333622 - RNA, 13 nt, Human
gggagcugccugu

SEQ ID NO: 3333623 - RNA, 21 nt, Human
gggagugaguugauagcacag

SEQ ID NO: 3333624 - RNA, 23 nt, Human
gggaggauugcuugagcucagga

SEQ ID NO: 3333625 - RNA, 20 nt, Human
gggaggugggauccuccagg

SEQ ID NO: 3333626 - RNA, 21 nt, Human
gggaggauugcuugagcucag

SEQ ID NO: 3333627 - RNA, 22 nt, Human
gggaggauguucugggacacag

SEQ ID NO: 3333628 - RNA, 23 nt, Human
gggaggaucucuugagccuggga

SEQ ID NO: 3333629 - RNA, 21 nt, Human
gggaauguuugccucugccuc

SEQ ID NO: 3333630 - RNA, 19 nt, Human
gggaauguuugccucugcc

SEQ ID NO: 3333631 - RNA, 14 nt, Human
gggacacccuguga

SEQ ID NO: 3333632 - RNA, 19 nt, Human
gggacucaaugcacugaca

SEQ ID NO: 3333633 - RNA, 17 nt, Human
gggacucaaugcacuga

SEQ ID NO: 3333634 - RNA, 23 nt, Human
gggacucaaugcacugacauugu

SEQ ID NO: 3333635 - RNA, 16 nt, Human
gggacucaaugcacug

SEQ ID NO: 3333636 - RNA, 14 nt, Human
ggagccuccugccc

SEQ ID NO: 3333637 - RNA, 15 nt, Human
ggagccuccugcccu

SEQ ID NO: 3333638 - RNA, 12 nt, Human
ggagggagggcu

SEQ ID NO: 3333639 - RNA, 13 nt, Human
ggagggagggcuc

SEQ ID NO: 3333640 - RNA, 16 nt, Human
ggagggagggcuccag

SEQ ID NO: 3333641 - RNA, 17 nt, Human
ggagggagggcuccaga

SEQ ID NO: 3333642 - RNA, 21 nt, Human
ggaggauguucugggacacag

SEQ ID NO: 3333643 - RNA, 18 nt, Human
ggaggauguucugggaca

SEQ ID NO: 3333644 - RNA, 15 nt, Human
ggaggauguucuggg

SEQ ID NO: 3333645 - RNA, 22 nt, Human
ggagucccaccuuggcugcagg

SEQ ID NO: 3333646 - RNA, 21 nt, Human
ggagucccaccuuggcugcag

SEQ ID NO: 3333647 - RNA, 22 nt, Human
ggacacucaaaagcugggcagg

SEQ ID NO: 3333648 - RNA, 16 nt, Human
ggacagaggggguggc

SEQ ID NO: 3333649 - RNA, 16 nt, Human
ggacagcuccuucugu

SEQ ID NO: 3333650 - RNA, 15 nt, Human
ggacagcuccuucug

SEQ ID NO: 3333651 - RNA, 11 nt, Human
ggacagcuccu

SEQ ID NO: 3333652 - RNA, 22 nt, Human
ggacagccacggccaggccaga

SEQ ID NO: 3333653 - RNA, 14 nt, Human
ggaccagagcugcc

SEQ ID NO: 3333654 - RNA, 19 nt, Human
ggaccagagcugccaccug

SEQ ID NO: 3333655 - RNA, 18 nt, Human
ggaccuugaacuggguac

SEQ ID NO: 3333656 - RNA, 18 nt, Human
ggagaagcggcuggcagc

SEQ ID NO: 3333657 - RNA, 22 nt, Human
ggcaugacacgaauauugcuga

SEQ ID NO: 3333658 - RNA, 18 nt, Human
ggcaugugaugagaggaa

SEQ ID NO: 3333659 - RNA, 23 nt, Human
ggcaugugaugagaggaaaucac

SEQ ID NO: 3333660 - RNA, 17 nt, Human
ggcagguuggugggggc

SEQ ID NO: 3333661 - RNA, 17 nt, Human
ggcagggucucacucug

SEQ ID NO: 3333662 - RNA, 12 nt, Human
ggcaggguccua

SEQ ID NO: 3333663 - RNA, 24 nt, Human
ggcagcugcgguccacccaggagc

SEQ ID NO: 3333664 - RNA, 23 nt, Human
ggcagcugcgguccacccaggag

SEQ ID NO: 3333665 - RNA, 21 nt, Human
ggcagcugcgguccacccagg

SEQ ID NO: 3333666 - RNA, 17 nt, Human
ggcagaguugaagacag

SEQ ID NO: 3333667 - RNA, 19 nt, Human
ggcagaguugaagacagag

SEQ ID NO: 3333668 - RNA, 12 nt, Human
ggcccagagagg

SEQ ID NO: 3333669 - RNA, 11 nt, Human
ggccaggagcc

SEQ ID NO: 3333670 - RNA, 13 nt, Human
ggccaggagccuc

SEQ ID NO: 3333671 - RNA, 14 nt, Human
ggccaggcccucug

SEQ ID NO: 3333672 - RNA, 15 nt, Human
ggccaggcccucugc

SEQ ID NO: 3333673 - RNA, 16 nt, Human
ggccaggcccucugcc

SEQ ID NO: 3333674 - RNA, 17 nt, Human
ggccaggcccucugccc

SEQ ID NO: 3333675 - RNA, 20 nt, Human
ggccacugugaagagaacca

SEQ ID NO: 3333676 - RNA, 22 nt, Human
ggccacagaaaauucuucucca

SEQ ID NO: 3333677 - RNA, 20 nt, Human
ggcauguucucugaggacac

SEQ ID NO: 3333678 - RNA, 18 nt, Human
ggaugcccaaagaugcag

SEQ ID NO: 3333679 - RNA, 17 nt, Human
ggaugccugguggcagc

SEQ ID NO: 3333680 - RNA, 13 nt, Human
ggaugccuggugg

SEQ ID NO: 3333681 - RNA, 19 nt, Human
ggaugcccaaagaugcagc

SEQ ID NO: 3333682 - RNA, 23 nt, Human
ggagucccaccuuggcugcaggg

SEQ ID NO: 3333683 - RNA, 18 nt, Human
ggaugaucuaggaagacu

SEQ ID NO: 3333684 - RNA, 22 nt, Human
ggaugaucuaggaagacuuugg

SEQ ID NO: 3333685 - RNA, 16 nt, Human
ggaugaucuaggaaga

SEQ ID NO: 3333686 - RNA, 20 nt, Human
ggaugccugguggcagcugc

SEQ ID NO: 3333687 - RNA, 19 nt, Human
ggaugccugguggcagcug

SEQ ID NO: 3333688 - RNA, 18 nt, Human
ggaugccugguggcagcu

SEQ ID NO: 3333689 - RNA, 13 nt, Human
ggauuauccugag

SEQ ID NO: 3333690 - RNA, 17 nt, Human
ggcaagcaccuccugcc

SEQ ID NO: 3333691 - RNA, 16 nt, Human
ggauucuuccucccuc

SEQ ID NO: 3333692 - RNA, 21 nt, Human
ggauucuuccucccucccucu

SEQ ID NO: 3333693 - RNA, 17 nt, Human
ggcaccagcagccugga

SEQ ID NO: 3333694 - RNA, 16 nt, Human
ggcaccagcagccugg

SEQ ID NO: 3333695 - RNA, 19 nt, Human
ggcaagcaccuccugccuc

SEQ ID NO: 3333696 - RNA, 18 nt, Human
ggcaagcaccuccugccu

SEQ ID NO: 3333697 - RNA, 19 nt, Human
ggcacucagaagacacuga

SEQ ID NO: 3333698 - RNA, 18 nt, Human
ggcacucagaagacacug

SEQ ID NO: 3333699 - RNA, 17 nt, Human
ggcacccggccccugcu

SEQ ID NO: 3333700 - RNA, 19 nt, Human
ggcacccggccccugcugg

SEQ ID NO: 3333701 - RNA, 18 nt, Human
ggcacccggccccugcug

SEQ ID NO: 3333702 - RNA, 22 nt, Human
ggcagagcagagaccaucccug

SEQ ID NO: 3333703 - RNA, 21 nt, Human
cacccggccccugcugguuca

SEQ ID NO: 3333704 - RNA, 18 nt, Human
cacccggccccugcuggu

SEQ ID NO: 3333705 - RNA, 17 nt, Human
cacccggccccugcugg

SEQ ID NO: 3333706 - RNA, 16 nt, Human
cacccggccccugcug

SEQ ID NO: 3333707 - RNA, 14 nt, Human
cacccggccccugc

SEQ ID NO: 3333708 - RNA, 13 nt, Human
cacccggccccug

SEQ ID NO: 3333709 - RNA, 19 nt, Human
cacccgcuaagagggaggg

SEQ ID NO: 3333710 - RNA, 12 nt, Human
cacccggccccu

SEQ ID NO: 3333711 - RNA, 13 nt, Human
cacauauugauuu

SEQ ID NO: 3333712 - RNA, 20 nt, Human
caccccucaacaccucugca

SEQ ID NO: 3333713 - RNA, 11 nt, Human
cacccugugau

SEQ ID NO: 3333714 - RNA, 12 nt, Human
cacccugugaug

SEQ ID NO: 3333715 - RNA, 15 nt, Human
cacccugugaugggg

SEQ ID NO: 3333716 - RNA, 18 nt, Human
cacccugugauggggccc

SEQ ID NO: 3333717 - RNA, 20 nt, Human
cacccugugauggggcccug

SEQ ID NO: 3333718 - RNA, 21 nt, Human
cacccugugauggggcccugc

SEQ ID NO: 3333719 - RNA, 22 nt, Human
cacccugugauggggcccugcc

SEQ ID NO: 3333720 - RNA, 23 nt, Human
cacccugugauggggcccugccu

SEQ ID NO: 3333721 - RNA, 15 nt, Human
caccgaaaacguggc

SEQ ID NO: 3333722 - RNA, 18 nt, Human
caccgaaaacguggcugc

SEQ ID NO: 3333723 - RNA, 19 nt, Human
caccgaaaacguggcugcu

SEQ ID NO: 3333724 - RNA, 21 nt, Human
caccgaaaacguggcugcuuc

SEQ ID NO: 3333725 - RNA, 22 nt, Human
caccgaaaacguggcugcuuca

SEQ ID NO: 3333726 - RNA, 14 nt, Human
caccgcagacagga

SEQ ID NO: 3333727 - RNA, 15 nt, Human
caccgcagacaggac

SEQ ID NO: 3333728 - RNA, 17 nt, Human
caccgcagacaggacca

SEQ ID NO: 3333729 - RNA, 18 nt, Human
caccgcagacaggaccag

SEQ ID NO: 3333730 - RNA, 12 nt, Human
caccgcagacag

SEQ ID NO: 3333731 - RNA, 13 nt, Human
caccgcagacagg

SEQ ID NO: 3333732 - RNA, 20 nt, Human
caccuggaauauauaaccag

SEQ ID NO: 3333733 - RNA, 23 nt, Human
caccugcggugcuaucuccccca

SEQ ID NO: 3333734 - RNA, 20 nt, Human
caccugcggugcuaucuccc

SEQ ID NO: 3333735 - RNA, 23 nt, Human
caccugaagacucauucuucugu

SEQ ID NO: 3333736 - RNA, 15 nt, Human
caccugaagacucau

SEQ ID NO: 3333737 - RNA, 14 nt, Human
caccugaagacuca

SEQ ID NO: 3333738 - RNA, 15 nt, Human
caccucucucacucc

SEQ ID NO: 3333739 - RNA, 17 nt, Human
caccucucucacuccuu

SEQ ID NO: 3333740 - RNA, 18 nt, Human
caccucucucacuccuug

SEQ ID NO: 3333741 - RNA, 19 nt, Human
caccucucucacuccuuga

SEQ ID NO: 3333742 - RNA, 18 nt, Human
caccucugcacaagcugc

SEQ ID NO: 3333743 - RNA, 19 nt, Human
caccucugcacaagcugca

SEQ ID NO: 3333744 - RNA, 12 nt, Human
caccuggccucu

SEQ ID NO: 3333745 - RNA, 13 nt, Human
caccuggccucug

SEQ ID NO: 3333746 - RNA, 14 nt, Human
caccuggccucugc

SEQ ID NO: 3333747 - RNA, 15 nt, Human
caccuggccucugca

SEQ ID NO: 3333748 - RNA, 17 nt, Human
caccuggccucugcacu

SEQ ID NO: 3333749 - RNA, 18 nt, Human
caccuggccucugcacuc

SEQ ID NO: 3333750 - RNA, 19 nt, Human
caccuggccucugcacucc

SEQ ID NO: 3333751 - RNA, 20 nt, Human
caccuggccucugcacuccc

SEQ ID NO: 3333752 - RNA, 23 nt, Human
caccuggccucugcacuccccug

SEQ ID NO: 3333753 - RNA, 14 nt, Human
caccuccugccucg

SEQ ID NO: 3333754 - RNA, 11 nt, Human
caccuccugcc

SEQ ID NO: 3333755 - RNA, 13 nt, Human
caccuccugccuc

SEQ ID NO: 3333756 - RNA, 13 nt, Human
caccucucccuug

SEQ ID NO: 3333757 - RNA, 14 nt, Human
caccucucccuugg

SEQ ID NO: 3333758 - RNA, 17 nt, Human
caccucucccuuggauu

SEQ ID NO: 3333759 - RNA, 21 nt, Human
caccgcagacaggaccaggga

SEQ ID NO: 3333760 - RNA, 15 nt, Human
caccggcuggccugg

SEQ ID NO: 3333761 - RNA, 16 nt, Human
caccggcuggccuggc

SEQ ID NO: 3333762 - RNA, 14 nt, Human
caccggcuggccug

SEQ ID NO: 3333763 - RNA, 17 nt, Human
caccggcuggccuggcc

SEQ ID NO: 3333764 - RNA, 18 nt, Human
caccggcuggccuggccc

SEQ ID NO: 3333765 - RNA, 20 nt, Human
caccggcuggccuggccccu

SEQ ID NO: 3333766 - RNA, 14 nt, Human
caccgggcacucag

SEQ ID NO: 3333767 - RNA, 18 nt, Human
caccgggccacagagaaa

SEQ ID NO: 3333768 - RNA, 15 nt, Human
caccgggccacagag

SEQ ID NO: 3333769 - RNA, 22 nt, Human
caccgggcacucagaagacacu

SEQ ID NO: 3333770 - RNA, 15 nt, Human
caccgggcacucaga

SEQ ID NO: 3333771 - RNA, 14 nt, Human
caccuuagacaguc

SEQ ID NO: 3333772 - RNA, 16 nt, Human
caccuuagacaguccc

SEQ ID NO: 3333773 - RNA, 18 nt, Human
caccuuagacagucccug

SEQ ID NO: 3333774 - RNA, 19 nt, Human
caccuuagacagucccugc

SEQ ID NO: 3333775 - RNA, 21 nt, Human
caccuuagacagucccugcca

SEQ ID NO: 3333776 - RNA, 23 nt, Human
caccuuagacagucccugccaau

SEQ ID NO: 3333777 - RNA, 16 nt, Human
cacgaauauugcugau

SEQ ID NO: 3333778 - RNA, 19 nt, Human
cacgaauauugcugauggu

SEQ ID NO: 3333779 - RNA, 22 nt, Human
cacgaauauugcugauggugca

SEQ ID NO: 3333780 - RNA, 16 nt, Human
cacgacugcccggcag

SEQ ID NO: 3333781 - RNA, 17 nt, Human
cacgacugcccggcagg

SEQ ID NO: 3333782 - RNA, 13 nt, Human
caccuugacaggg

SEQ ID NO: 3333783 - RNA, 16 nt, Human
caccuugacagggcac

SEQ ID NO: 3333784 - RNA, 15 nt, Human
caccuugacagggca

SEQ ID NO: 3333785 - RNA, 20 nt, Human
cacgccagauucuuuccuga

SEQ ID NO: 3333786 - RNA, 22 nt, Human
cacgccagauucuuuccugagg

SEQ ID NO: 3333787 - RNA, 19 nt, Human
cacgccagauucuuuccug

SEQ ID NO: 3333788 - RNA, 15 nt, Human
cacgccacugcacua

SEQ ID NO: 3333789 - RNA, 13 nt, Human
cacgccacugcac

SEQ ID NO: 3333790 - RNA, 13 nt, Human
cacgcccccacug

SEQ ID NO: 3333791 - RNA, 15 nt, Human
cacgcccccacuggu

SEQ ID NO: 3333792 - RNA, 23 nt, Human
cacgccagauucuuuccugaggc

SEQ ID NO: 3333793 - RNA, 17 nt, Human
cacgcccccacugguga

SEQ ID NO: 3333794 - RNA, 18 nt, Human
cacgcccccacuggugac

SEQ ID NO: 3333795 - RNA, 16 nt, Human
cacgccagauucuuuc

SEQ ID NO: 3333796 - RNA, 16 nt, Human
cacgauuucuguuuag

SEQ ID NO: 3333797 - RNA, 12 nt, Human
cacgauuucugu

SEQ ID NO: 3333798 - RNA, 14 nt, Human
cacgauuucuguuu

SEQ ID NO: 3333799 - RNA, 17 nt, Human
cacgcacuucgggaggu

SEQ ID NO: 3333800 - RNA, 23 nt, Human
cacgcgugcacacaccagagccc

SEQ ID NO: 3333801 - RNA, 22 nt, Human
cacgcgcgcacacacacacaua

SEQ ID NO: 3333802 - RNA, 15 nt, Human
cacgcgcgcacacac

SEQ ID NO: 3333803 - RNA, 23 nt, Human
cacgcgcgcacacacacacauac

SEQ ID NO: 3333804 - RNA, 21 nt, Human
cacgcgugcacacaccagagc

SEQ ID NO: 3333805 - RNA, 16 nt, Human
cacgcgugcacacacc

SEQ ID NO: 3333806 - RNA, 15 nt, Human
cacgcgugcacacac

SEQ ID NO: 3333807 - RNA, 13 nt, Human
cacgcgcgcacac

SEQ ID NO: 3333808 - RNA, 19 nt, Human
cacgccuguaauccuagca

SEQ ID NO: 3333809 - RNA, 20 nt, Human
cacgccuguaauccuagcac

SEQ ID NO: 3333810 - RNA, 20 nt, Human
cacggcucacugcagccuca

SEQ ID NO: 3333811 - RNA, 19 nt, Human
cacggcucacugcagccuc

SEQ ID NO: 3333812 - RNA, 17 nt, Human
cacggcucacugcagcc

SEQ ID NO: 3333813 - RNA, 16 nt, Human
cacggcucacugcagc

SEQ ID NO: 3333814 - RNA, 17 nt, Human
cacgcuggaccuugaac

SEQ ID NO: 3333815 - RNA, 20 nt, Human
cacgcuggaccuugaacugg

SEQ ID NO: 3333816 - RNA, 15 nt, Human
cacggcucacugcag

SEQ ID NO: 3333817 - RNA, 14 nt, Human
cacguacacacaca

SEQ ID NO: 3333818 - RNA, 19 nt, Human
cacguacacacacauacac

SEQ ID NO: 3333819 - RNA, 18 nt, Human
cacguacacacacauaca

SEQ ID NO: 3333820 - RNA, 12 nt, Human
cacguuucuaaa

SEQ ID NO: 3333821 - RNA, 14 nt, Human
cacguuucuaaagg

SEQ ID NO: 3333822 - RNA, 23 nt, Human
cacguuucuaaaggcuaccuuug

SEQ ID NO: 3333823 - RNA, 16 nt, Human
cacgugguccuaaucu

SEQ ID NO: 3333824 - RNA, 19 nt, Human
cacgugguccuaaucuucu

SEQ ID NO: 3333825 - RNA, 12 nt, Human
cacucugagacu

SEQ ID NO: 3333826 - RNA, 23 nt, Human
cacucugagacucgcgacaaugc

SEQ ID NO: 3333827 - RNA, 12 nt, Human
cacucuccuugg

SEQ ID NO: 3333828 - RNA, 12 nt, Human
cacucuggcagc

SEQ ID NO: 3333829 - RNA, 13 nt, Human
cacucuggcagcu

SEQ ID NO: 3333830 - RNA, 14 nt, Human
cacucuggcagcuc

SEQ ID NO: 3333831 - RNA, 14 nt, Human
cacuccuucacaga

SEQ ID NO: 3333832 - RNA, 21 nt, Human
cacuccuucacagaugggugc

SEQ ID NO: 3333833 - RNA, 17 nt, Human
cacucccugcaaccuga

SEQ ID NO: 3333834 - RNA, 18 nt, Human
cacucauugaccugaggc

SEQ ID NO: 3333835 - RNA, 19 nt, Human
cacucauugaccugaggcc

SEQ ID NO: 3333836 - RNA, 20 nt, Human
cacucauugaccugaggccc

SEQ ID NO: 3333837 - RNA, 13 nt, Human
cacucccugcaac

SEQ ID NO: 3333838 - RNA, 16 nt, Human
cacucccugcaaccug

SEQ ID NO: 3333839 - RNA, 12 nt, Human
cacucccugcaa

SEQ ID NO: 3333840 - RNA, 15 nt, Human
cacuccccugcuggg

SEQ ID NO: 3333841 - RNA, 16 nt, Human
cacucaguccauagca

SEQ ID NO: 3333842 - RNA, 15 nt, Human
cacucauugaccuga

SEQ ID NO: 3333843 - RNA, 19 nt, Human
cacucagaagacacugaug

SEQ ID NO: 3333844 - RNA, 18 nt, Human
cacucagaagacacugau

SEQ ID NO: 3333845 - RNA, 22 nt, Human
cacucagaagacacugaugggc

SEQ ID NO: 3333846 - RNA, 20 nt, Human
cacucacauuuauucugcuc

SEQ ID NO: 3333847 - RNA, 19 nt, Human
cacucacauuuauucugcu

SEQ ID NO: 3333848 - RNA, 17 nt, Human
cacucagaagacacuga

SEQ ID NO: 3333849 - RNA, 16 nt, Human
cacucagaagacacug

SEQ ID NO: 3333850 - RNA, 12 nt, Human
cacucagaagac

SEQ ID NO: 3333851 - RNA, 15 nt, Human
cacucaaaagcuggg

SEQ ID NO: 3333852 - RNA, 17 nt, Human
cacucaaaagcugggca

SEQ ID NO: 3333853 - RNA, 18 nt, Human
cacucaaaagcugggcag

SEQ ID NO: 3333854 - RNA, 19 nt, Human
cacucaaaagcugggcagg

SEQ ID NO: 3333855 - RNA, 21 nt, Human
cacuauguugcccaggcaggu

SEQ ID NO: 3333856 - RNA, 20 nt, Human
cacuauguugcccaggcagg

SEQ ID NO: 3333857 - RNA, 20 nt, Human
cacucaaaagcugggcaggu

SEQ ID NO: 3333858 - RNA, 15 nt, Human
cacuauguugcccag

SEQ ID NO: 3333859 - RNA, 19 nt, Human
cacuauguugcccaggcag

SEQ ID NO: 3333860 - RNA, 18 nt, Human
cacuauguugcccaggca

SEQ ID NO: 3333861 - RNA, 17 nt, Human
cacuauguugcccaggc

SEQ ID NO: 3333862 - RNA, 16 nt, Human
cacuauguugcccagg

SEQ ID NO: 3333863 - RNA, 21 nt, Human
cacuauagccuaggugacaga

SEQ ID NO: 3333864 - RNA, 18 nt, Human
cacuauaauguaagcucu

SEQ ID NO: 3333865 - RNA, 14 nt, Human
cacuauagccuagg

SEQ ID NO: 3333866 - RNA, 14 nt, Human
cacuauaauguaag

SEQ ID NO: 3333867 - RNA, 18 nt, Human
cacuaaggugugcucuga

SEQ ID NO: 3333868 - RNA, 17 nt, Human
cacuaaggugugcucug

SEQ ID NO: 3333869 - RNA, 18 nt, Human
cacuaaccacgcuggacc

SEQ ID NO: 3333870 - RNA, 16 nt, Human
cacuaaccacgcugga

SEQ ID NO: 3333871 - RNA, 15 nt, Human
cacuaaccacgcugg

SEQ ID NO: 3333872 - RNA, 14 nt, Human
cacuaaccacgcug

SEQ ID NO: 3333873 - RNA, 24 nt, Human
cacugaugggcaacccccagccug

SEQ ID NO: 3333874 - RNA, 18 nt, Human
cacugaugggcaaccccc

SEQ ID NO: 3333875 - RNA, 14 nt, Human
cacugaugggcaac

SEQ ID NO: 3333876 - RNA, 23 nt, Human
cacugagacagcccgggcucugc

SEQ ID NO: 3333877 - RNA, 13 nt, Human
cacugcaaccucc

SEQ ID NO: 3333878 - RNA, 23 nt, Human
cacugcaaccuccgccucuuggg

SEQ ID NO: 3333879 - RNA, 16 nt, Human
cacugcaaccuccgcc

SEQ ID NO: 3333880 - RNA, 14 nt, Human
cacugcaaccuccg

SEQ ID NO: 3333881 - RNA, 14 nt, Human
cacugagacagccc

SEQ ID NO: 3333882 - RNA, 17 nt, Human
cacugagacagcccggg

SEQ ID NO: 3333883 - RNA, 19 nt, Human
cacugagacagcccgggcu

SEQ ID NO: 3333884 - RNA, 22 nt, Human
cacugagacagcccgggcucug

SEQ ID NO: 3333885 - RNA, 12 nt, Human
cacugagacagc

SEQ ID NO: 3333886 - RNA, 13 nt, Human
cacugagacagcc

SEQ ID NO: 3333887 - RNA, 15 nt, Human
cacucuggcagcuca

SEQ ID NO: 3333888 - RNA, 16 nt, Human
cacucuggcagcucag

SEQ ID NO: 3333889 - RNA, 17 nt, Human
cacucuggcagcucaga

SEQ ID NO: 3333890 - RNA, 19 nt, Human
cacucuggcagcucagaga

SEQ ID NO: 3333891 - RNA, 20 nt, Human
cacucuggcagcucagagag

SEQ ID NO: 3333892 - RNA, 21 nt, Human
cacucuggcagcucagagagg

SEQ ID NO: 3333893 - RNA, 23 nt, Human
cacucuggcagcucagagagggu

SEQ ID NO: 3333894 - RNA, 19 nt, Human
cacucugucgcccagucug

SEQ ID NO: 3333895 - RNA, 16 nt, Human
cacucugucgcccagu

SEQ ID NO: 3333896 - RNA, 15 nt, Human
cacucugucgcccag

SEQ ID NO: 3333897 - RNA, 23 nt, Human
cacugacauuguuggccaaagcc

SEQ ID NO: 3333898 - RNA, 18 nt, Human
cacugcuuccagugaggc

SEQ ID NO: 3333899 - RNA, 19 nt, Human
cacugcuuccagugaggcu

SEQ ID NO: 3333900 - RNA, 20 nt, Human
cacugcuuccagugaggcuc

SEQ ID NO: 3333901 - RNA, 21 nt, Human
cacugcuuccagugaggcucu

SEQ ID NO: 3333902 - RNA, 22 nt, Human
cacugcuuccagugaggcucug

SEQ ID NO: 3333903 - RNA, 20 nt, Human
cacugcuuuuggucugugug

SEQ ID NO: 3333904 - RNA, 13 nt, Human
cacugcuuaacuu

SEQ ID NO: 3333905 - RNA, 14 nt, Human
cacugcuuccagug

SEQ ID NO: 3333906 - RNA, 15 nt, Human
cacugcuuccaguga

SEQ ID NO: 3333907 - RNA, 16 nt, Human
cacugcuuccagugag

SEQ ID NO: 3333908 - RNA, 17 nt, Human
cacuggaacacuaauga

SEQ ID NO: 3333909 - RNA, 21 nt, Human
cacugcuuuuggucuguguga

SEQ ID NO: 3333910 - RNA, 18 nt, Human
cacugcacuauagccuag

SEQ ID NO: 3333911 - RNA, 19 nt, Human
cacugcaccgggccacaga

SEQ ID NO: 3333912 - RNA, 18 nt, Human
cacugcaccgggccacag

SEQ ID NO: 3333913 - RNA, 16 nt, Human
cacugcaccgggccac

SEQ ID NO: 3333914 - RNA, 15 nt, Human
cacugcaccgggcca

SEQ ID NO: 3333915 - RNA, 14 nt, Human
cacugcaccgggcc

SEQ ID NO: 3333916 - RNA, 17 nt, Human
cacugccaugccagcuu

SEQ ID NO: 3333917 - RNA, 12 nt, Human
cacugcucuggu

SEQ ID NO: 3333918 - RNA, 16 nt, Human
cacugugccaugugcc

SEQ ID NO: 3333919 - RNA, 15 nt, Human
cacugugccaugugc

SEQ ID NO: 3333920 - RNA, 18 nt, Human
cacugugccaugugccag

SEQ ID NO: 3333921 - RNA, 13 nt, Human
cacugugcugagu

SEQ ID NO: 3333922 - RNA, 15 nt, Human
cacugugcugagucu

SEQ ID NO: 3333923 - RNA, 17 nt, Human
cacugugcugagucuga

SEQ ID NO: 3333924 - RNA, 20 nt, Human
cacugugcugagucugaagg

SEQ ID NO: 3333925 - RNA, 21 nt, Human
cacugugcugagucugaaggc

SEQ ID NO: 3333926 - RNA, 22 nt, Human
cacugugcugagucugaaggcu

SEQ ID NO: 3333927 - RNA, 13 nt, Human
cacuguucucugc

SEQ ID NO: 3333928 - RNA, 14 nt, Human
cacuguucucugcc

SEQ ID NO: 3333929 - RNA, 15 nt, Human
cacuguucucugccc

SEQ ID NO: 3333930 - RNA, 16 nt, Human
cacuguucucugcccu

SEQ ID NO: 3333931 - RNA, 17 nt, Human
cacuguucucugcccuc

SEQ ID NO: 3333932 - RNA, 19 nt, Human
cacuguucucugcccucca

SEQ ID NO: 3333933 - RNA, 21 nt, Human
cacuguucucugcccuccaag

SEQ ID NO: 3333934 - RNA, 22 nt, Human
cacuguucucugcccuccaaga

SEQ ID NO: 3333935 - RNA, 14 nt, Human
cacugugccaugug

SEQ ID NO: 3333936 - RNA, 13 nt, Human
cacugugaagaga

SEQ ID NO: 3333937 - RNA, 12 nt, Human
cacuucagcuga

SEQ ID NO: 3333938 - RNA, 21 nt, Human
cacuucagcugacuuuucugu

SEQ ID NO: 3333939 - RNA, 16 nt, Human
cacuucccuacaugga

SEQ ID NO: 3333940 - RNA, 22 nt, Human
cacuucugccauauucuguugg

SEQ ID NO: 3333941 - RNA, 21 nt, Human
cacuucgggaggucgaggcag

SEQ ID NO: 3333942 - RNA, 23 nt, Human
cacuucgggaggucgaggcagga

SEQ ID NO: 3333943 - RNA, 13 nt, Human
cacuugcagacuc

SEQ ID NO: 3333944 - RNA, 13 nt, Human
cacuugaguccag

SEQ ID NO: 3333945 - RNA, 17 nt, Human
cacuugagaauuacccu

SEQ ID NO: 3333946 - RNA, 19 nt, Human
cacuugacaucaacugcau

SEQ ID NO: 3333947 - RNA, 20 nt, Human
cacuugagaauuacccuuuu

SEQ ID NO: 3333948 - RNA, 16 nt, Human
cacuugacaucaacug

SEQ ID NO: 3333949 - RNA, 24 nt, Human
cacuugcagacucuacagaggcca

SEQ ID NO: 3333950 - RNA, 22 nt, Human
cacuugcagacucuacagaggc

SEQ ID NO: 3333951 - RNA, 19 nt, Human
cacuugcagacucuacaga

SEQ ID NO: 3333952 - RNA, 18 nt, Human
cacuugcagacucuacag

SEQ ID NO: 3333953 - RNA, 14 nt, Human
cacuugcagacucu

SEQ ID NO: 3333954 - RNA, 19 nt, Human
cacuuucuagccagaggag

SEQ ID NO: 3333955 - RNA, 20 nt, Human
cacuuucuagccagaggaga

SEQ ID NO: 3333956 - RNA, 18 nt, Human
cacuuucuagccagagga

SEQ ID NO: 3333957 - RNA, 14 nt, Human
cagaccacaaaacu

SEQ ID NO: 3333958 - RNA, 20 nt, Human
cagaccacaaaacuuuucua

SEQ ID NO: 3333959 - RNA, 22 nt, Human
cagacccugcccugugggcccc

SEQ ID NO: 3333960 - RNA, 15 nt, Human
cagacccugcccugu

SEQ ID NO: 3333961 - RNA, 16 nt, Human
cagacccugcccugug

SEQ ID NO: 3333962 - RNA, 17 nt, Human
cagacccugcccugugg

SEQ ID NO: 3333963 - RNA, 21 nt, Human
cagacccugcccugugggccc

SEQ ID NO: 3333964 - RNA, 14 nt, Human
cagacccggcugcg

SEQ ID NO: 3333965 - RNA, 12 nt, Human
cagacccggcug

SEQ ID NO: 3333966 - RNA, 13 nt, Human
cagacccugcccu

SEQ ID NO: 3333967 - RNA, 14 nt, Human
cagacccugcccug

SEQ ID NO: 3333968 - RNA, 12 nt, Human
cagacccugccc

SEQ ID NO: 3333969 - RNA, 16 nt, Human
cagacccggcugcgug

SEQ ID NO: 3333970 - RNA, 23 nt, Human
cagagaaaguacuucuccacccu

SEQ ID NO: 3333971 - RNA, 19 nt, Human
cagagaaaguacuucucca

SEQ ID NO: 3333972 - RNA, 14 nt, Human
cagaauuucccaaa

SEQ ID NO: 3333973 - RNA, 15 nt, Human
cagaauucucuaguu

SEQ ID NO: 3333974 - RNA, 18 nt, Human
cagaauucucuaguuuga

SEQ ID NO: 3333975 - RNA, 11 nt, Human
cagaauucuca

SEQ ID NO: 3333976 - RNA, 17 nt, Human
cagaauuucccaaagca

SEQ ID NO: 3333977 - RNA, 18 nt, Human
cagaauuucccaaagcag

SEQ ID NO: 3333978 - RNA, 19 nt, Human
cagaauuucccaaagcagu

SEQ ID NO: 3333979 - RNA, 20 nt, Human
cagaauuucccaaagcagug

SEQ ID NO: 3333980 - RNA, 24 nt, Human
cagaauuucccaaagcagugcaug

SEQ ID NO: 3333981 - RNA, 12 nt, Human
cagacaaagcgu

SEQ ID NO: 3333982 - RNA, 20 nt, Human
cagacaacaaaccuguuucu

SEQ ID NO: 3333983 - RNA, 16 nt, Human
cagacaacaaaccugu

SEQ ID NO: 3333984 - RNA, 22 nt, Human
cagacaaagcgugguggacaug

SEQ ID NO: 3333985 - RNA, 14 nt, Human
cagacacaugucca

SEQ ID NO: 3333986 - RNA, 17 nt, Human
cagacacauguccaaga

SEQ ID NO: 3333987 - RNA, 21 nt, Human
cagacacauguccaagaagcc

SEQ ID NO: 3333988 - RNA, 22 nt, Human
cagacacauguccaagaagccc

SEQ ID NO: 3333989 - RNA, 23 nt, Human
cagacacauguccaagaagccca

SEQ ID NO: 3333990 - RNA, 23 nt, Human
cagacacaggcccggcuccaggc

SEQ ID NO: 3333991 - RNA, 22 nt, Human
cagacacaggcccggcuccagg

SEQ ID NO: 3333992 - RNA, 21 nt, Human
cagacacaggcccggcuccag

SEQ ID NO: 3333993 - RNA, 18 nt, Human
cagacacaggcccggcuc

SEQ ID NO: 3333994 - RNA, 17 nt, Human
cagacacaggcccggcu

SEQ ID NO: 3333995 - RNA, 15 nt, Human
cagacacaggcccgg

SEQ ID NO: 3333996 - RNA, 14 nt, Human
cagacacaggcccg

SEQ ID NO: 3333997 - RNA, 13 nt, Human
cagacacaggccc

SEQ ID NO: 3333998 - RNA, 22 nt, Human
cagacaccuugacagggcacac

SEQ ID NO: 3333999 - RNA, 20 nt, Human
cagacaccuugacagggcac

SEQ ID NO: 3334000 - RNA, 19 nt, Human
cagacaccuugacagggca

SEQ ID NO: 3334001 - RNA, 20 nt, Human
cagacaguuaagagaaauga

SEQ ID NO: 3334002 - RNA, 19 nt, Human
cagacauacuaaccagcag

SEQ ID NO: 3334003 - RNA, 18 nt, Human
cagaaucucaaauaacua

SEQ ID NO: 3334004 - RNA, 17 nt, Human
cagaaucucaaauaacu

SEQ ID NO: 3334005 - RNA, 16 nt, Human
cagaaggaagacuuca

SEQ ID NO: 3334006 - RNA, 17 nt, Human
cagaaggaagacuucau

SEQ ID NO: 3334007 - RNA, 18 nt, Human
cagaaggaagacuucauc

SEQ ID NO: 3334008 - RNA, 19 nt, Human
cagaaggaagacuucaucc

SEQ ID NO: 3334009 - RNA, 21 nt, Human
cagaagacacugaugggcaac

SEQ ID NO: 3334010 - RNA, 22 nt, Human
cacuuucuagccagaggagaga

SEQ ID NO: 3334011 - RNA, 13 nt, Human
cacuuuguucugg

SEQ ID NO: 3334012 - RNA, 14 nt, Human
cacuuuguucuggc

SEQ ID NO: 3334013 - RNA, 16 nt, Human
cacuuuguucuggcuc

SEQ ID NO: 3334014 - RNA, 23 nt, Human
cacuuuguucuggcucuuccagg

SEQ ID NO: 3334015 - RNA, 12 nt, Human
cacuuugggagg

SEQ ID NO: 3334016 - RNA, 13 nt, Human
cacuuugggaggc

SEQ ID NO: 3334017 - RNA, 16 nt, Human
cacuuugggaggccaa

SEQ ID NO: 3334018 - RNA, 14 nt, Human
cacuuuuguucuug

SEQ ID NO: 3334019 - RNA, 22 nt, Human
cacuuuuguucuugguuuguaa

SEQ ID NO: 3334020 - RNA, 16 nt, Human
cagaaaauggaagaca

SEQ ID NO: 3334021 - RNA, 20 nt, Human
cagaaaauggaagacagcuc

SEQ ID NO: 3334022 - RNA, 21 nt, Human
cagaaaauggaagacagcucu

SEQ ID NO: 3334023 - RNA, 22 nt, Human
cagaaaauggaagacagcucuu

SEQ ID NO: 3334024 - RNA, 23 nt, Human
cagaaaauggaagacagcucuua

SEQ ID NO: 3334025 - RNA, 13 nt, Human
cagaggcugccuc

SEQ ID NO: 3334026 - RNA, 23 nt, Human
cagaggcugccucucccaucacu

SEQ ID NO: 3334027 - RNA, 19 nt, Human
cagagggagugacagaggc

SEQ ID NO: 3334028 - RNA, 18 nt, Human
cagagggagugacagagg

SEQ ID NO: 3334029 - RNA, 16 nt, Human
cagagggagugacaga

SEQ ID NO: 3334030 - RNA, 14 nt, Human
cagagggagugaca

SEQ ID NO: 3334031 - RNA, 22 nt, Human
cagaggcagccccauucugccu

SEQ ID NO: 3334032 - RNA, 20 nt, Human
cagaggcagccccauucugc

SEQ ID NO: 3334033 - RNA, 19 nt, Human
cagaggcagccccauucug

SEQ ID NO: 3334034 - RNA, 18 nt, Human
cagaggcagccccauucu

SEQ ID NO: 3334035 - RNA, 15 nt, Human
cagaggcagccccau

SEQ ID NO: 3334036 - RNA, 14 nt, Human
cagaggcagcccca

SEQ ID NO: 3334037 - RNA, 13 nt, Human
cagaggcagcccc

SEQ ID NO: 3334038 - RNA, 12 nt, Human
cagaggcagccc

SEQ ID NO: 3334039 - RNA, 16 nt, Human
cagaggccaugggccu

SEQ ID NO: 3334040 - RNA, 19 nt, Human
cagaggccaugggccuccu

SEQ ID NO: 3334041 - RNA, 23 nt, Human
cagaggcagccccauucugccug

SEQ ID NO: 3334042 - RNA, 21 nt, Human
cagaggccaugggccuccugu

SEQ ID NO: 3334043 - RNA, 20 nt, Human
cagaggccaugggccuccug

SEQ ID NO: 3334044 - RNA, 18 nt, Human
cagagugagacucugucu

SEQ ID NO: 3334045 - RNA, 17 nt, Human
cagagugagacucuguc

SEQ ID NO: 3334046 - RNA, 16 nt, Human
cagagugagacucugu

SEQ ID NO: 3334047 - RNA, 23 nt, Human
cagagucucacuguugcccaggc

SEQ ID NO: 3334048 - RNA, 22 nt, Human
cagagucucacuguugcccagg

SEQ ID NO: 3334049 - RNA, 20 nt, Human
cagagugagacucugucuca

SEQ ID NO: 3334050 - RNA, 19 nt, Human
cagagugagacucugucuc

SEQ ID NO: 3334051 - RNA, 23 nt, Human
cagagggagugacagaggcagcc

SEQ ID NO: 3334052 - RNA, 22 nt, Human
cagagggagugacagaggcagc

SEQ ID NO: 3334053 - RNA, 21 nt, Human
cagagggagugacagaggcag

SEQ ID NO: 3334054 - RNA, 20 nt, Human
cagagggagugacagaggca

SEQ ID NO: 3334055 - RNA, 15 nt, Human
cagagggccugcaag

SEQ ID NO: 3334056 - RNA, 21 nt, Human
cagagucucacuguugcccag

SEQ ID NO: 3334057 - RNA, 20 nt, Human
cagagucucacuguugccca

SEQ ID NO: 3334058 - RNA, 19 nt, Human
cagagucucacuguugccc

SEQ ID NO: 3334059 - RNA, 17 nt, Human
cagagucucacuguugc

SEQ ID NO: 3334060 - RNA, 13 nt, Human
cagagucucacug

SEQ ID NO: 3334061 - RNA, 13 nt, Human
cagaugcaccagc

SEQ ID NO: 3334062 - RNA, 16 nt, Human
cagaugcaccagcccu

SEQ ID NO: 3334063 - RNA, 14 nt, Human
cagaugcaccagcc

SEQ ID NO: 3334064 - RNA, 22 nt, Human
cagaugcaccagcccuuagcag

SEQ ID NO: 3334065 - RNA, 17 nt, Human
cagaugcaccagcccuu

SEQ ID NO: 3334066 - RNA, 20 nt, Human
cagaucucuaacuucaccau

SEQ ID NO: 3334067 - RNA, 21 nt, Human
cagauacaggaaaagcugcug

SEQ ID NO: 3334068 - RNA, 20 nt, Human
cagauacaggaaaagcugcu

SEQ ID NO: 3334069 - RNA, 22 nt, Human
cagauacaggaaaagcugcuga

SEQ ID NO: 3334070 - RNA, 15 nt, Human
cagaguugaagacag

SEQ ID NO: 3334071 - RNA, 16 nt, Human
cagaguugaagacaga

SEQ ID NO: 3334072 - RNA, 14 nt, Human
cagaguugaagaca

SEQ ID NO: 3334073 - RNA, 17 nt, Human
cagaguugaagacagag

SEQ ID NO: 3334074 - RNA, 18 nt, Human
cagaguugaagacagagc

SEQ ID NO: 3334075 - RNA, 19 nt, Human
cagaguugaagacagagcu

SEQ ID NO: 3334076 - RNA, 20 nt, Human
cagaguugaagacagagcua

SEQ ID NO: 3334077 - RNA, 14 nt, Human
cagaguuguuacau

SEQ ID NO: 3334078 - RNA, 22 nt, Human
cagaguugaagacagagcuaca

SEQ ID NO: 3334079 - RNA, 19 nt, Human
cagaguuguuacauuuuua

SEQ ID NO: 3334080 - RNA, 15 nt, Human
cagaguuguuacauu

SEQ ID NO: 3334081 - RNA, 18 nt, Human
cagaguuguuacauuuuu

SEQ ID NO: 3334082 - RNA, 21 nt, Human
cagagaccaucccugaaggcc

SEQ ID NO: 3334083 - RNA, 17 nt, Human
cagagaccaucccugaa

SEQ ID NO: 3334084 - RNA, 18 nt, Human
cagagaccaucccugaag

SEQ ID NO: 3334085 - RNA, 19 nt, Human
cagagaccaucccugaagg

SEQ ID NO: 3334086 - RNA, 20 nt, Human
cagagaccaucccugaaggc

SEQ ID NO: 3334087 - RNA, 13 nt, Human
cagagacuccugc

SEQ ID NO: 3334088 - RNA, 14 nt, Human
cagagacuccugca

SEQ ID NO: 3334089 - RNA, 15 nt, Human
cagagacuccugcag

SEQ ID NO: 3334090 - RNA, 16 nt, Human
cagagacuccugcagg

SEQ ID NO: 3334091 - RNA, 17 nt, Human
cagagacuccugcaggc

SEQ ID NO: 3334092 - RNA, 18 nt, Human
cagagacuccugcaggca

SEQ ID NO: 3334093 - RNA, 14 nt, Human
cagagcaagugaga

SEQ ID NO: 3334094 - RNA, 20 nt, Human
cagagcaagugagacccugu

SEQ ID NO: 3334095 - RNA, 16 nt, Human
cagagcaccuuagaca

SEQ ID NO: 3334096 - RNA, 16 nt, Human
cagagacacaagccuu

SEQ ID NO: 3334097 - RNA, 17 nt, Human
cagagacacaagccuuc

SEQ ID NO: 3334098 - RNA, 14 nt, Human
cagagacacaagcc

SEQ ID NO: 3334099 - RNA, 15 nt, Human
cagagacacaagccu

SEQ ID NO: 3334100 - RNA, 14 nt, Human
cagagaccaucccu

SEQ ID NO: 3334101 - RNA, 16 nt, Human
cagagaccaucccuga

SEQ ID NO: 3334102 - RNA, 13 nt, Human
cagagaccauccc

SEQ ID NO: 3334103 - RNA, 21 nt, Human
cagagaaugaaagggcccaga

SEQ ID NO: 3334104 - RNA, 20 nt, Human
cagagaaugaaagggcccag

SEQ ID NO: 3334105 - RNA, 15 nt, Human
cagagaauucucuua

SEQ ID NO: 3334106 - RNA, 19 nt, Human
cagagaaugaaagggccca

SEQ ID NO: 3334107 - RNA, 16 nt, Human
cagagcccacgccccc

SEQ ID NO: 3334108 - RNA, 20 nt, Human
cagagcccaccuuggcucaa

SEQ ID NO: 3334109 - RNA, 19 nt, Human
cagagcccaccuuggcuca

SEQ ID NO: 3334110 - RNA, 17 nt, Human
cagagcccaccuuggcu

SEQ ID NO: 3334111 - RNA, 15 nt, Human
cagagcccaccuugg

SEQ ID NO: 3334112 - RNA, 13 nt, Human
cagagcagagacc

SEQ ID NO: 3334113 - RNA, 14 nt, Human
cagagcagagacca

SEQ ID NO: 3334114 - RNA, 15 nt, Human
cagagcagagaccau

SEQ ID NO: 3334115 - RNA, 17 nt, Human
cagagcagagaccaucc

SEQ ID NO: 3334116 - RNA, 18 nt, Human
cagagcagagaccauccc

SEQ ID NO: 3334117 - RNA, 19 nt, Human
cagagcagagaccaucccu

SEQ ID NO: 3334118 - RNA, 21 nt, Human
cagagcagagaccaucccuga

SEQ ID NO: 3334119 - RNA, 18 nt, Human
cagagcaccuuagacagu

SEQ ID NO: 3334120 - RNA, 19 nt, Human
cagagcaccuuagacaguc

SEQ ID NO: 3334121 - RNA, 21 nt, Human
cagagcaccuuagacaguccc

SEQ ID NO: 3334122 - RNA, 22 nt, Human
cagagcaccuuagacagucccu

SEQ ID NO: 3334123 - RNA, 11 nt, Human
cagagcagaga

SEQ ID NO: 3334124 - RNA, 12 nt, Human
cagagcagagac

SEQ ID NO: 3334125 - RNA, 23 nt, Human
cagagcaccuuagacagucccug

SEQ ID NO: 3334126 - RNA, 12 nt, Human
cagagccugcag

SEQ ID NO: 3334127 - RNA, 20 nt, Human
cagaggaaagcaaaggagau

SEQ ID NO: 3334128 - RNA, 13 nt, Human
cagaggaaggaga

SEQ ID NO: 3334129 - RNA, 23 nt, Human
cagagcccacgcccccacuggug

SEQ ID NO: 3334130 - RNA, 17 nt, Human
cagagcccacgccccca

SEQ ID NO: 3334131 - RNA, 19 nt, Human
cagagcccacgcccccacu

SEQ ID NO: 3334132 - RNA, 20 nt, Human
cagagcccacgcccccacug

SEQ ID NO: 3334133 - RNA, 21 nt, Human
cagagcccacgcccccacugg

SEQ ID NO: 3334134 - RNA, 20 nt, Human
cagaggagagaggacccccu

SEQ ID NO: 3334135 - RNA, 11 nt, Human
cagaggcagcc

SEQ ID NO: 3334136 - RNA, 15 nt, Human
cagaggagagaggac

SEQ ID NO: 3334137 - RNA, 19 nt, Human
cagaggagagaggaccccc

SEQ ID NO: 3334138 - RNA, 13 nt, Human
cagaggagagagg

SEQ ID NO: 3334139 - RNA, 11 nt, Human
cagcagagcac

SEQ ID NO: 3334140 - RNA, 13 nt, Human
cagcagagcaccu

SEQ ID NO: 3334141 - RNA, 19 nt, Human
cagcagaaaugccuuaccc

SEQ ID NO: 3334142 - RNA, 22 nt, Human
cagcagaaaugccuuacccuca

SEQ ID NO: 3334143 - RNA, 15 nt, Human
cagcagaaaugccuu

SEQ ID NO: 3334144 - RNA, 17 nt, Human
cagcagaaaugccuuac

SEQ ID NO: 3334145 - RNA, 13 nt, Human
cagcaauaaagca

SEQ ID NO: 3334146 - RNA, 21 nt, Human
cagcaauaaagcagcguuucu

SEQ ID NO: 3334147 - RNA, 21 nt, Human
cagcaagugagagcugggugu

SEQ ID NO: 3334148 - RNA, 19 nt, Human
cagcaagugagagcugggu

SEQ ID NO: 3334149 - RNA, 22 nt, Human
cagcaauaaagcagcguuucua

SEQ ID NO: 3334150 - RNA, 17 nt, Human
cagcaagugagagcugg

SEQ ID NO: 3334151 - RNA, 16 nt, Human
cagcaagugagagcug

SEQ ID NO: 3334152 - RNA, 15 nt, Human
cagcaagugagagcu

SEQ ID NO: 3334153 - RNA, 14 nt, Human
cagcaagugagagc

SEQ ID NO: 3334154 - RNA, 12 nt, Human
cagcaagugaga

SEQ ID NO: 3334155 - RNA, 18 nt, Human
cagcaaggagauuuacaa

SEQ ID NO: 3334156 - RNA, 17 nt, Human
cagcaaggagauuuaca

SEQ ID NO: 3334157 - RNA, 14 nt, Human
cagauucuuuccug

SEQ ID NO: 3334158 - RNA, 18 nt, Human
cagcaaaagaugcuucuc

SEQ ID NO: 3334159 - RNA, 23 nt, Human
cagaugggugcuuggaggaagga

SEQ ID NO: 3334160 - RNA, 18 nt, Human
cagaugggugcuuggagg

SEQ ID NO: 3334161 - RNA, 15 nt, Human
cagcccacuucugcc

SEQ ID NO: 3334162 - RNA, 15 nt, Human
cagcccaccccucaa

SEQ ID NO: 3334163 - RNA, 20 nt, Human
cagccccaaaacucuccucu

SEQ ID NO: 3334164 - RNA, 21 nt, Human
cagccccaaaacucuccucug

SEQ ID NO: 3334165 - RNA, 22 nt, Human
cagccccaaaacucuccucugc

SEQ ID NO: 3334166 - RNA, 18 nt, Human
cagcccacuucugccaua

SEQ ID NO: 3334167 - RNA, 14 nt, Human
cagccacauuccug

SEQ ID NO: 3334168 - RNA, 15 nt, Human
cagccacauuccuga

SEQ ID NO: 3334169 - RNA, 17 nt, Human
cagccacauuccugaug

SEQ ID NO: 3334170 - RNA, 19 nt, Human
cagccacauuccugaugcu

SEQ ID NO: 3334171 - RNA, 22 nt, Human
cagccacggccaggccagaggg

SEQ ID NO: 3334172 - RNA, 21 nt, Human
cagccacggccaggccagagg

SEQ ID NO: 3334173 - RNA, 19 nt, Human
cagccacggccaggccaga

SEQ ID NO: 3334174 - RNA, 18 nt, Human
cagccacggccaggccag

SEQ ID NO: 3334175 - RNA, 17 nt, Human
cagccacggccaggcca

SEQ ID NO: 3334176 - RNA, 16 nt, Human
cagccacggccaggcc

SEQ ID NO: 3334177 - RNA, 15 nt, Human
cagccacggccaggc

SEQ ID NO: 3334178 - RNA, 14 nt, Human
cagccacggccagg

SEQ ID NO: 3334179 - RNA, 22 nt, Human
cagccaguaaaugggggugcau

SEQ ID NO: 3334180 - RNA, 13 nt, Human
cagccaguaaaug

SEQ ID NO: 3334181 - RNA, 23 nt, Human
cagccacggccaggccagaggga

SEQ ID NO: 3334182 - RNA, 14 nt, Human
cagcaggcucucag

SEQ ID NO: 3334183 - RNA, 15 nt, Human
cagcaggcucucagg

SEQ ID NO: 3334184 - RNA, 12 nt, Human
cagcaggcucuc

SEQ ID NO: 3334185 - RNA, 19 nt, Human
cagcagccuggacccugug

SEQ ID NO: 3334186 - RNA, 22 nt, Human
cagcagccuggacccuguggau

SEQ ID NO: 3334187 - RNA, 12 nt, Human
cagcagccugga

SEQ ID NO: 3334188 - RNA, 14 nt, Human
cagcagccuggacc

SEQ ID NO: 3334189 - RNA, 15 nt, Human
cagcagccuggaccc

SEQ ID NO: 3334190 - RNA, 18 nt, Human
cagcagccuggacccugu

SEQ ID NO: 3334191 - RNA, 18 nt, Human
cagcagggagggcuucug

SEQ ID NO: 3334192 - RNA, 20 nt, Human
cagcaggcucucaggccagc

SEQ ID NO: 3334193 - RNA, 22 nt, Human
cagcaggcucucaggccagcug

SEQ ID NO: 3334194 - RNA, 16 nt, Human
cagcaggcucucaggc

SEQ ID NO: 3334195 - RNA, 17 nt, Human
cagcaggcucucaggcc

SEQ ID NO: 3334196 - RNA, 18 nt, Human
cagcaggcucucaggcca

SEQ ID NO: 3334197 - RNA, 19 nt, Human
cagcaggcucucaggccag

SEQ ID NO: 3334198 - RNA, 20 nt, Human
cagcagggagggcuucugcc

SEQ ID NO: 3334199 - RNA, 17 nt, Human
cagcauccuggcacccg

SEQ ID NO: 3334200 - RNA, 16 nt, Human
cagcauccuggcaccc

SEQ ID NO: 3334201 - RNA, 15 nt, Human
cagcauccuggcacc

SEQ ID NO: 3334202 - RNA, 14 nt, Human
cagcauccuggcac

SEQ ID NO: 3334203 - RNA, 20 nt, Human
cagcauccuggcacccggcc

SEQ ID NO: 3334204 - RNA, 19 nt, Human
cagcauccuggcacccggc

SEQ ID NO: 3334205 - RNA, 21 nt, Human
cagcauccuggcacccggccc

SEQ ID NO: 3334206 - RNA, 18 nt, Human
cagccaaagccuccucca

SEQ ID NO: 3334207 - RNA, 21 nt, Human
cagccaaagccuccuccagcc

SEQ ID NO: 3334208 - RNA, 15 nt, Human
cagccaaagccuccu

SEQ ID NO: 3334209 - RNA, 16 nt, Human
cagccaaagccuccuc

SEQ ID NO: 3334210 - RNA, 20 nt, Human
caggaagcucagggccuggc

SEQ ID NO: 3334211 - RNA, 21 nt, Human
caggaagcucagggccuggcu

SEQ ID NO: 3334212 - RNA, 22 nt, Human
caggaagcucagggccuggcuc

SEQ ID NO: 3334213 - RNA, 23 nt, Human
caggaagcucagggccuggcuca

SEQ ID NO: 3334214 - RNA, 16 nt, Human
caggaagcucagggcc

SEQ ID NO: 3334215 - RNA, 17 nt, Human
caggaagcucagggccu

SEQ ID NO: 3334216 - RNA, 18 nt, Human
caggaagcucagggccug

SEQ ID NO: 3334217 - RNA, 19 nt, Human
caggaagcucagggccugg

SEQ ID NO: 3334218 - RNA, 14 nt, Human
caggaagcucaggg

SEQ ID NO: 3334219 - RNA, 15 nt, Human
caggaagcucagggc

SEQ ID NO: 3334220 - RNA, 13 nt, Human
caggaagcucagg

SEQ ID NO: 3334221 - RNA, 14 nt, Human
caggaagccagcag

SEQ ID NO: 3334222 - RNA, 16 nt, Human
caggaagccagcaggc

SEQ ID NO: 3334223 - RNA, 17 nt, Human
caggaagccagcaggcu

SEQ ID NO: 3334224 - RNA, 18 nt, Human
caggaagccagcaggcuc

SEQ ID NO: 3334225 - RNA, 19 nt, Human
caggaagccagcaggcucu

SEQ ID NO: 3334226 - RNA, 21 nt, Human
caggaagccagcaggcucuca

SEQ ID NO: 3334227 - RNA, 22 nt, Human
caggaagccagcaggcucucag

SEQ ID NO: 3334228 - RNA, 15 nt, Human
caggaaggcuaaagg

SEQ ID NO: 3334229 - RNA, 14 nt, Human
caggaaguacugga

SEQ ID NO: 3334230 - RNA, 16 nt, Human
caggaaguacuggaga

SEQ ID NO: 3334231 - RNA, 12 nt, Human
caggaaguacug

SEQ ID NO: 3334232 - RNA, 17 nt, Human
caggaaguacuggagaa

SEQ ID NO: 3334233 - RNA, 18 nt, Human
caggaaguacuggagaaa

SEQ ID NO: 3334234 - RNA, 20 nt, Human
caggaaguacuggagaaaau

SEQ ID NO: 3334235 - RNA, 21 nt, Human
cagcuugaggguugggcuggu

SEQ ID NO: 3334236 - RNA, 20 nt, Human
cagcuugaggguugggcugg

SEQ ID NO: 3334237 - RNA, 19 nt, Human
cagcuugaggguugggcug

SEQ ID NO: 3334238 - RNA, 18 nt, Human
cagcuugaggguugggcu

SEQ ID NO: 3334239 - RNA, 18 nt, Human
cagcuugaccgugaggcc

SEQ ID NO: 3334240 - RNA, 19 nt, Human
cagcuugaccgugaggcca

SEQ ID NO: 3334241 - RNA, 20 nt, Human
cagcuugaccgugaggccag

SEQ ID NO: 3334242 - RNA, 21 nt, Human
cagcuugaccgugaggccaga

SEQ ID NO: 3334243 - RNA, 15 nt, Human
cagcuugaggguugg

SEQ ID NO: 3334244 - RNA, 14 nt, Human
cagcuugaggguug

SEQ ID NO: 3334245 - RNA, 21 nt, Human
cagcuucauuuccugugucuu

SEQ ID NO: 3334246 - RNA, 20 nt, Human
cagcuucauuuccugugucu

SEQ ID NO: 3334247 - RNA, 19 nt, Human
cagcuucauuuccuguguc

SEQ ID NO: 3334248 - RNA, 12 nt, Human
cagcuuuguuug

SEQ ID NO: 3334249 - RNA, 21 nt, Human
cagcuuuguuuguugucagcu

SEQ ID NO: 3334250 - RNA, 22 nt, Human
cagcuuuguuuguugucagcug

SEQ ID NO: 3334251 - RNA, 23 nt, Human
cagcuuuguuuguugucagcuga

SEQ ID NO: 3334252 - RNA, 22 nt, Human
cagcuuguaaauagcucaggug

SEQ ID NO: 3334253 - RNA, 21 nt, Human
cagcuuguaaauagcucaggu

SEQ ID NO: 3334254 - RNA, 20 nt, Human
cagcuuguaaauagcucagg

SEQ ID NO: 3334255 - RNA, 19 nt, Human
cagcuuguaaauagcucag

SEQ ID NO: 3334256 - RNA, 18 nt, Human
cagcuuguaaauagcuca

SEQ ID NO: 3334257 - RNA, 18 nt, Human
cagcugccugggaucccu

SEQ ID NO: 3334258 - RNA, 23 nt, Human
cagcugccugggaucccucaucc

SEQ ID NO: 3334259 - RNA, 24 nt, Human
cagcugcgguccacccaggagccc

SEQ ID NO: 3334260 - RNA, 23 nt, Human
cagcugcgguccacccaggagcc

SEQ ID NO: 3334261 - RNA, 22 nt, Human
cagcugcgguccacccaggagc

SEQ ID NO: 3334262 - RNA, 21 nt, Human
cagcugcgguccacccaggag

SEQ ID NO: 3334263 - RNA, 20 nt, Human
cagcugcgguccacccagga

SEQ ID NO: 3334264 - RNA, 19 nt, Human
cagcugcgguccacccagg

SEQ ID NO: 3334265 - RNA, 15 nt, Human
cagcugccugggauc

SEQ ID NO: 3334266 - RNA, 18 nt, Human
cagcugcgguccacccag

SEQ ID NO: 3334267 - RNA, 13 nt, Human
cagcugcuugggc

SEQ ID NO: 3334268 - RNA, 14 nt, Human
cagcugcuugggcu

SEQ ID NO: 3334269 - RNA, 15 nt, Human
cagcugcuugggcuu

SEQ ID NO: 3334270 - RNA, 16 nt, Human
cagcugcuugggcuuc

SEQ ID NO: 3334271 - RNA, 18 nt, Human
cagcugcuugggcuucau

SEQ ID NO: 3334272 - RNA, 19 nt, Human
cagcugcuugggcuucauc

SEQ ID NO: 3334273 - RNA, 21 nt, Human
cagcugcuugggcuucauccu

SEQ ID NO: 3334274 - RNA, 22 nt, Human
cagcugcuugggcuucauccuc

SEQ ID NO: 3334275 - RNA, 17 nt, Human
cagcugcuacuacuccu

SEQ ID NO: 3334276 - RNA, 22 nt, Human
cagcugcuuuugucuaugggac

SEQ ID NO: 3334277 - RNA, 23 nt, Human
cagcugcuuuugucuaugggacu

SEQ ID NO: 3334278 - RNA, 21 nt, Human
cagcugggguggggaccucag

SEQ ID NO: 3334279 - RNA, 22 nt, Human
cagcugggguggggaccucagg

SEQ ID NO: 3334280 - RNA, 23 nt, Human
cagcugggguggggaccucaggc

SEQ ID NO: 3334281 - RNA, 18 nt, Human
cagcugguugagguuuca

SEQ ID NO: 3334282 - RNA, 23 nt, Human
cagcucuucuccaggcuguaucc

SEQ ID NO: 3334283 - RNA, 19 nt, Human
cagcucuucuccaggcugu

SEQ ID NO: 3334284 - RNA, 18 nt, Human
cagcucuucuccaggcug

SEQ ID NO: 3334285 - RNA, 17 nt, Human
cagcucuucuccaggcu

SEQ ID NO: 3334286 - RNA, 16 nt, Human
cagcucuucuccaggc

SEQ ID NO: 3334287 - RNA, 15 nt, Human
cagcucuucuccagg

SEQ ID NO: 3334288 - RNA, 14 nt, Human
cagcucuucuccag

SEQ ID NO: 3334289 - RNA, 13 nt, Human
cagcucuucucca

SEQ ID NO: 3334290 - RNA, 10 nt, Human
cagcucuuau

SEQ ID NO: 3334291 - RNA, 21 nt, Human
cagcucuuauauugccauuuc

SEQ ID NO: 3334292 - RNA, 23 nt, Human
cagcucuguccugggagugagcu

SEQ ID NO: 3334293 - RNA, 18 nt, Human
cagcucuguccugggagu

SEQ ID NO: 3334294 - RNA, 17 nt, Human
cagcucuguccugggag

SEQ ID NO: 3334295 - RNA, 16 nt, Human
cagcucuguccuggga

SEQ ID NO: 3334296 - RNA, 14 nt, Human
cagcucuguccugg

SEQ ID NO: 3334297 - RNA, 22 nt, Human
cagcucugguccauagagagca

SEQ ID NO: 3334298 - RNA, 23 nt, Human
cagcucugguccauagagagcaa

SEQ ID NO: 3334299 - RNA, 13 nt, Human
cagcucuguccug

SEQ ID NO: 3334300 - RNA, 12 nt, Human
cagcucuguccu

SEQ ID NO: 3334301 - RNA, 16 nt, Human
cagcucugguccauag

SEQ ID NO: 3334302 - RNA, 17 nt, Human
cagcucugguccauaga

SEQ ID NO: 3334303 - RNA, 18 nt, Human
cagcucugguccauagag

SEQ ID NO: 3334304 - RNA, 21 nt, Human
cagcucugguccauagagagc

SEQ ID NO: 3334305 - RNA, 10 nt, Human
cagcucuggu

SEQ ID NO: 3334306 - RNA, 13 nt, Human
cagcucuggucca

SEQ ID NO: 3334307 - RNA, 13 nt, Human
cagcucagagagg

SEQ ID NO: 3334308 - RNA, 17 nt, Human
cagcucagagagggugg

SEQ ID NO: 3334309 - RNA, 19 nt, Human
cagcucagagaggguggga

SEQ ID NO: 3334310 - RNA, 20 nt, Human
cagcucagagagggugggag

SEQ ID NO: 3334311 - RNA, 23 nt, Human
cagcuccuucuguccuacucugu

SEQ ID NO: 3334312 - RNA, 21 nt, Human
cagcuccuucuguccuacucu

SEQ ID NO: 3334313 - RNA, 17 nt, Human
cagcuccuucuguccua

SEQ ID NO: 3334314 - RNA, 16 nt, Human
cagcuccuucuguccu

SEQ ID NO: 3334315 - RNA, 15 nt, Human
cagcucugcaagaau

SEQ ID NO: 3334316 - RNA, 16 nt, Human
cagcucugcaagaauu

SEQ ID NO: 3334317 - RNA, 21 nt, Human
cagcucugcaagaauugaagc

SEQ ID NO: 3334318 - RNA, 17 nt, Human
cagcccgggcucugccu

SEQ ID NO: 3334319 - RNA, 18 nt, Human
cagcccgggcucugccuc

SEQ ID NO: 3334320 - RNA, 19 nt, Human
cagcccgggcucugccucc

SEQ ID NO: 3334321 - RNA, 20 nt, Human
cagcccgggcucugccuccc

SEQ ID NO: 3334322 - RNA, 21 nt, Human
cagcccgggcucugccuccca

SEQ ID NO: 3334323 - RNA, 22 nt, Human
cagcccgggcucugccucccau

SEQ ID NO: 3334324 - RNA, 13 nt, Human
cagcccgggcucu

SEQ ID NO: 3334325 - RNA, 14 nt, Human
cagcccgggcucug

SEQ ID NO: 3334326 - RNA, 15 nt, Human
cagcccgggcucugc

SEQ ID NO: 3334327 - RNA, 16 nt, Human
cagcccgggcucugcc

SEQ ID NO: 3334328 - RNA, 16 nt, Human
cagccccuucugaccc

SEQ ID NO: 3334329 - RNA, 17 nt, Human
cagccccuucugaccca

SEQ ID NO: 3334330 - RNA, 19 nt, Human
cagccccuucugacccaug

SEQ ID NO: 3334331 - RNA, 21 nt, Human
cagccccuucugacccaugcu

SEQ ID NO: 3334332 - RNA, 22 nt, Human
cagccccuucugacccaugcug

SEQ ID NO: 3334333 - RNA, 23 nt, Human
cagccccuucugacccaugcugc

SEQ ID NO: 3334334 - RNA, 24 nt, Human
cagccccuucugacccaugcugcc

SEQ ID NO: 3334335 - RNA, 22 nt, Human
cagccccaucccaaacccuuca

SEQ ID NO: 3334336 - RNA, 12 nt, Human
cagccccauccu

SEQ ID NO: 3334337 - RNA, 13 nt, Human
cagccccauccuc

SEQ ID NO: 3334338 - RNA, 14 nt, Human
cagccccauccucu

SEQ ID NO: 3334339 - RNA, 16 nt, Human
cagccccauccucugu

SEQ ID NO: 3334340 - RNA, 22 nt, Human
cagccccauccucuguacagag

SEQ ID NO: 3334341 - RNA, 14 nt, Human
cagccccauucugc

SEQ ID NO: 3334342 - RNA, 13 nt, Human
cagccccauucug

SEQ ID NO: 3334343 - RNA, 23 nt, Human
cagccccuggaugcagccucaca

SEQ ID NO: 3334344 - RNA, 17 nt, Human
cagccccauucugccug

SEQ ID NO: 3334345 - RNA, 16 nt, Human
cagccccauucugccu

SEQ ID NO: 3334346 - RNA, 20 nt, Human
cagccccuguucuggcagag

SEQ ID NO: 3334347 - RNA, 22 nt, Human
cagccccuggaugcagccucac

SEQ ID NO: 3334348 - RNA, 21 nt, Human
cagccccuguucuggcagagu

SEQ ID NO: 3334349 - RNA, 11 nt, Human
cagccccaucc

SEQ ID NO: 3334350 - RNA, 21 nt, Human
cagccccaucccaaacccuuc

SEQ ID NO: 3334351 - RNA, 18 nt, Human
cagccccagugcccacag

SEQ ID NO: 3334352 - RNA, 17 nt, Human
cagccccagugcccaca

SEQ ID NO: 3334353 - RNA, 16 nt, Human
cagccccagugcccac

SEQ ID NO: 3334354 - RNA, 15 nt, Human
cagccccagugccca

SEQ ID NO: 3334355 - RNA, 14 nt, Human
cagccccagugccc

SEQ ID NO: 3334356 - RNA, 13 nt, Human
cagccccagugcc

SEQ ID NO: 3334357 - RNA, 18 nt, Human
cagcccugcagagggcac

SEQ ID NO: 3334358 - RNA, 20 nt, Human
cagcccugcagagggcacag

SEQ ID NO: 3334359 - RNA, 13 nt, Human
cagcccugcagag

SEQ ID NO: 3334360 - RNA, 14 nt, Human
cagcccugcagagg

SEQ ID NO: 3334361 - RNA, 15 nt, Human
cagcccugcagaggg

SEQ ID NO: 3334362 - RNA, 16 nt, Human
cagcccugcagagggc

SEQ ID NO: 3334363 - RNA, 21 nt, Human
cagccguguaaccauggaccc

SEQ ID NO: 3334364 - RNA, 14 nt, Human
cagccucacagucc

SEQ ID NO: 3334365 - RNA, 15 nt, Human
cagccucacaguccu

SEQ ID NO: 3334366 - RNA, 20 nt, Human
cagccucacaguccuuacca

SEQ ID NO: 3334367 - RNA, 21 nt, Human
cagccucaaccuccugggcua

SEQ ID NO: 3334368 - RNA, 20 nt, Human
cagccucaaccuccugggcu

SEQ ID NO: 3334369 - RNA, 19 nt, Human
cagccucaaccuccugggc

SEQ ID NO: 3334370 - RNA, 18 nt, Human
cagccucaaccuccuggg

SEQ ID NO: 3334371 - RNA, 17 nt, Human
cagccucaaccuccugg

SEQ ID NO: 3334372 - RNA, 22 nt, Human
cagccucccgaauagcugggac

SEQ ID NO: 3334373 - RNA, 21 nt, Human
cagccucccgaauagcuggga

SEQ ID NO: 3334374 - RNA, 20 nt, Human
cagccucccgaauagcuggg

SEQ ID NO: 3334375 - RNA, 23 nt, Human
cagccucccaaagugcugggauu

SEQ ID NO: 3334376 - RNA, 21 nt, Human
cagccucccaaagugcuggga

SEQ ID NO: 3334377 - RNA, 20 nt, Human
cagccucccaaagugcuggg

SEQ ID NO: 3334378 - RNA, 19 nt, Human
cagccucccaaagugcugg

SEQ ID NO: 3334379 - RNA, 20 nt, Human
cagccuugaccauucuccac

SEQ ID NO: 3334380 - RNA, 21 nt, Human
cagccuugaccauucuccacc

SEQ ID NO: 3334381 - RNA, 17 nt, Human
cagccuugaccauucuc

SEQ ID NO: 3334382 - RNA, 22 nt, Human
cagccuugaccauucuccaccu

SEQ ID NO: 3334383 - RNA, 23 nt, Human
cagccuugaccauucuccaccug

SEQ ID NO: 3334384 - RNA, 24 nt, Human
cagccuugaccauucuccaccugc

SEQ ID NO: 3334385 - RNA, 16 nt, Human
cagccugggcaaugug

SEQ ID NO: 3334386 - RNA, 19 nt, Human
cagccugggcaaugugaua

SEQ ID NO: 3334387 - RNA, 23 nt, Human
cagccucccgaguagcugggacu

SEQ ID NO: 3334388 - RNA, 22 nt, Human
cagccucccgaguagcugggac

SEQ ID NO: 3334389 - RNA, 21 nt, Human
cagccucccgaguagcuggga

SEQ ID NO: 3334390 - RNA, 20 nt, Human
cagccucccgaguagcuggg

SEQ ID NO: 3334391 - RNA, 19 nt, Human
cagccucccgaguagcugg

SEQ ID NO: 3334392 - RNA, 23 nt, Human
cagccucccgaauagcugggacu

SEQ ID NO: 3334393 - RNA, 20 nt, Human
cagccugcuccagcuguuca

SEQ ID NO: 3334394 - RNA, 15 nt, Human
cagccuggacccugu

SEQ ID NO: 3334395 - RNA, 19 nt, Human
cagccuggacccuguggau

SEQ ID NO: 3334396 - RNA, 19 nt, Human
cagccugcuccagcuguuc

SEQ ID NO: 3334397 - RNA, 19 nt, Human
cagcucaccagccccagug

SEQ ID NO: 3334398 - RNA, 17 nt, Human
cagcucaccagccccag

SEQ ID NO: 3334399 - RNA, 16 nt, Human
cagcucaccagcccca

SEQ ID NO: 3334400 - RNA, 15 nt, Human
cagcucaccagcccc

SEQ ID NO: 3334401 - RNA, 13 nt, Human
cagcucaccagcc

SEQ ID NO: 3334402 - RNA, 13 nt, Human
cagcucaccucuc

SEQ ID NO: 3334403 - RNA, 15 nt, Human
cagcucaccucuccc

SEQ ID NO: 3334404 - RNA, 16 nt, Human
cagcucaccucucccu

SEQ ID NO: 3334405 - RNA, 17 nt, Human
cagcucaccucucccuu

SEQ ID NO: 3334406 - RNA, 21 nt, Human
cagcucaccagccccagugcc

SEQ ID NO: 3334407 - RNA, 20 nt, Human
cagcucaccagccccagugc

SEQ ID NO: 3334408 - RNA, 14 nt, Human
cagcucaccagccc

SEQ ID NO: 3334409 - RNA, 22 nt, Human
cagcucaccagccccagugccc

SEQ ID NO: 3334410 - RNA, 19 nt, Human
cagcucaccucucccuugg

SEQ ID NO: 3334411 - RNA, 20 nt, Human
cagcucaccucucccuugga

SEQ ID NO: 3334412 - RNA, 12 nt, Human
cagcucagagag

SEQ ID NO: 3334413 - RNA, 20 nt, Human
cagcgagcccugguggcagu

SEQ ID NO: 3334414 - RNA, 19 nt, Human
cagcgagcccugguggcag

SEQ ID NO: 3334415 - RNA, 17 nt, Human
cagcgagcccugguggc

SEQ ID NO: 3334416 - RNA, 16 nt, Human
cagcgagcccuggugg

SEQ ID NO: 3334417 - RNA, 13 nt, Human
cagcgagcccugg

SEQ ID NO: 3334418 - RNA, 19 nt, Human
cagcuaacauggaaguacu

SEQ ID NO: 3334419 - RNA, 18 nt, Human
cagcuaacauggaaguac

SEQ ID NO: 3334420 - RNA, 21 nt, Human
cagcgagcccugguggcagug

SEQ ID NO: 3334421 - RNA, 16 nt, Human
cagcuaaugggacacu

SEQ ID NO: 3334422 - RNA, 15 nt, Human
cagcuaaugggacac

SEQ ID NO: 3334423 - RNA, 20 nt, Human
cagcuaacauggaaguacua

SEQ ID NO: 3334424 - RNA, 22 nt, Human
caggcuuagucacugagacagc

SEQ ID NO: 3334425 - RNA, 23 nt, Human
caggcuuagucacugagacagcc

SEQ ID NO: 3334426 - RNA, 16 nt, Human
caggcuuagucacuga

SEQ ID NO: 3334427 - RNA, 17 nt, Human
caggcuuagucacugag

SEQ ID NO: 3334428 - RNA, 20 nt, Human
caggcuuagucacugagaca

SEQ ID NO: 3334429 - RNA, 21 nt, Human
caggcuuagucacugagacag

SEQ ID NO: 3334430 - RNA, 23 nt, Human
caggcuguaucccaugagccuca

SEQ ID NO: 3334431 - RNA, 22 nt, Human
caggcuguaucccaugagccuc

SEQ ID NO: 3334432 - RNA, 21 nt, Human
caggcuguaucccaugagccu

SEQ ID NO: 3334433 - RNA, 20 nt, Human
caggcuguaucccaugagcc

SEQ ID NO: 3334434 - RNA, 14 nt, Human
caggcuguauccca

SEQ ID NO: 3334435 - RNA, 19 nt, Human
caggcuggucucaaacucu

SEQ ID NO: 3334436 - RNA, 12 nt, Human
caggcuggucuc

SEQ ID NO: 3334437 - RNA, 23 nt, Human
caggcugggcuucaguggcagcu

SEQ ID NO: 3334438 - RNA, 19 nt, Human
caggcccggcuccaggcuc

SEQ ID NO: 3334439 - RNA, 18 nt, Human
caggcccggcuccaggcu

SEQ ID NO: 3334440 - RNA, 16 nt, Human
caggcccggcuccagg

SEQ ID NO: 3334441 - RNA, 17 nt, Human
caggcccggcuccaggc

SEQ ID NO: 3334442 - RNA, 13 nt, Human
caggcccucugcc

SEQ ID NO: 3334443 - RNA, 14 nt, Human
caggcccucugccc

SEQ ID NO: 3334444 - RNA, 15 nt, Human
caggcccucugccca

SEQ ID NO: 3334445 - RNA, 21 nt, Human
caggcccggcuccaggcuccu

SEQ ID NO: 3334446 - RNA, 20 nt, Human
caggcccggcuccaggcucc

SEQ ID NO: 3334447 - RNA, 22 nt, Human
caggcccggcuccaggcuccuu

SEQ ID NO: 3334448 - RNA, 16 nt, Human
caggcccucugcccac

SEQ ID NO: 3334449 - RNA, 17 nt, Human
caggcccucugcccacu

SEQ ID NO: 3334450 - RNA, 19 nt, Human
caggcccucugcccacucc

SEQ ID NO: 3334451 - RNA, 20 nt, Human
caggcccucugcccacuccc

SEQ ID NO: 3334452 - RNA, 21 nt, Human
caggcccucugcccacucccu

SEQ ID NO: 3334453 - RNA, 22 nt, Human
caggcccucugcccacucccug

SEQ ID NO: 3334454 - RNA, 13 nt, Human
caggcucucaggc

SEQ ID NO: 3334455 - RNA, 14 nt, Human
caggcucucaggcc

SEQ ID NO: 3334456 - RNA, 15 nt, Human
caggcucucaggcca

SEQ ID NO: 3334457 - RNA, 16 nt, Human
caggcucucaggccag

SEQ ID NO: 3334458 - RNA, 20 nt, Human
caggcucgggcuccccagcc

SEQ ID NO: 3334459 - RNA, 12 nt, Human
caggcucucagg

SEQ ID NO: 3334460 - RNA, 21 nt, Human
caggcuccuuuagcgcccagu

SEQ ID NO: 3334461 - RNA, 17 nt, Human
caggcucucaggccagc

SEQ ID NO: 3334462 - RNA, 18 nt, Human
caggcucucaggccagcu

SEQ ID NO: 3334463 - RNA, 19 nt, Human
caggcucucaggccagcug

SEQ ID NO: 3334464 - RNA, 20 nt, Human
caggcucucaggccagcugc

SEQ ID NO: 3334465 - RNA, 21 nt, Human
caggcucucaggccagcugcu

SEQ ID NO: 3334466 - RNA, 23 nt, Human
caggcucucaggccagcugcuug

SEQ ID NO: 3334467 - RNA, 20 nt, Human
caggcuccuuuagcgcccag

SEQ ID NO: 3334468 - RNA, 19 nt, Human
caggcuccuuuagcgccca

SEQ ID NO: 3334469 - RNA, 14 nt, Human
caggcuccuuuagc

SEQ ID NO: 3334470 - RNA, 21 nt, Human
cagggcacaccgggcacucag

SEQ ID NO: 3334471 - RNA, 19 nt, Human
cagggcacaccgggcacuc

SEQ ID NO: 3334472 - RNA, 17 nt, Human
cagggcacaccgggcac

SEQ ID NO: 3334473 - RNA, 15 nt, Human
cagggcacaccgggc

SEQ ID NO: 3334474 - RNA, 23 nt, Human
cagggcacaccgggcacucagaa

SEQ ID NO: 3334475 - RNA, 22 nt, Human
cagggcacaccgggcacucaga

SEQ ID NO: 3334476 - RNA, 14 nt, Human
cagggcacaccggg

SEQ ID NO: 3334477 - RNA, 23 nt, Human
cagggacagaggggguggccucc

SEQ ID NO: 3334478 - RNA, 19 nt, Human
caggggaggguagagcgga

SEQ ID NO: 3334479 - RNA, 14 nt, Human
cagggccuggcuca

SEQ ID NO: 3334480 - RNA, 15 nt, Human
cagggccuggcucag

SEQ ID NO: 3334481 - RNA, 13 nt, Human
cagggccuggcuc

SEQ ID NO: 3334482 - RNA, 16 nt, Human
cagggccuggcucagg

SEQ ID NO: 3334483 - RNA, 19 nt, Human
cagggccuggcucaggugg

SEQ ID NO: 3334484 - RNA, 22 nt, Human
cagggaaacagcuaaugggaca

SEQ ID NO: 3334485 - RNA, 16 nt, Human
cagggaaacagcuaau

SEQ ID NO: 3334486 - RNA, 14 nt, Human
cagggacagagggg

SEQ ID NO: 3334487 - RNA, 20 nt, Human
cagggacagaggggguggcc

SEQ ID NO: 3334488 - RNA, 13 nt, Human
cagggacagaggg

SEQ ID NO: 3334489 - RNA, 20 nt, Human
caggccccugccacccuggg

SEQ ID NO: 3334490 - RNA, 19 nt, Human
caggccccugccacccugg

SEQ ID NO: 3334491 - RNA, 17 nt, Human
caggccccugccacccu

SEQ ID NO: 3334492 - RNA, 15 nt, Human
caggccccugccacc

SEQ ID NO: 3334493 - RNA, 15 nt, Human
caggcccggcuccag

SEQ ID NO: 3334494 - RNA, 14 nt, Human
caggcccggcucca

SEQ ID NO: 3334495 - RNA, 13 nt, Human
caggcccggcucc

SEQ ID NO: 3334496 - RNA, 20 nt, Human
caggccaggcccucugccca

SEQ ID NO: 3334497 - RNA, 21 nt, Human
caggccaggcccucugcccac

SEQ ID NO: 3334498 - RNA, 22 nt, Human
caggccaggcccucugcccacu

SEQ ID NO: 3334499 - RNA, 20 nt, Human
caggccacaagacccuugug

SEQ ID NO: 3334500 - RNA, 17 nt, Human
caggccacaagacccuu

SEQ ID NO: 3334501 - RNA, 18 nt, Human
caggccacaagacccuug

SEQ ID NO: 3334502 - RNA, 13 nt, Human
caggccacaagac

SEQ ID NO: 3334503 - RNA, 18 nt, Human
caggccaaacucaccugc

SEQ ID NO: 3334504 - RNA, 23 nt, Human
caggccaaacucaccugccccuc

SEQ ID NO: 3334505 - RNA, 13 nt, Human
caggccccugcca

SEQ ID NO: 3334506 - RNA, 13 nt, Human
caggaucagucug

SEQ ID NO: 3334507 - RNA, 14 nt, Human
caggaucagucuga

SEQ ID NO: 3334508 - RNA, 23 nt, Human
caggauggccgggcgcgguggcu

SEQ ID NO: 3334509 - RNA, 18 nt, Human
caggauucuuccucccuc

SEQ ID NO: 3334510 - RNA, 17 nt, Human
caggauucuuccucccu

SEQ ID NO: 3334511 - RNA, 13 nt, Human
caggcagguccag

SEQ ID NO: 3334512 - RNA, 16 nt, Human
caggcagccaggccac

SEQ ID NO: 3334513 - RNA, 17 nt, Human
caggcagccaggccaca

SEQ ID NO: 3334514 - RNA, 14 nt, Human
caggcagccaggcc

SEQ ID NO: 3334515 - RNA, 15 nt, Human
caggcagccaggcca

SEQ ID NO: 3334516 - RNA, 21 nt, Human
caggcaagcaccuccugccuc

SEQ ID NO: 3334517 - RNA, 16 nt, Human
caggcaagcaccuccu

SEQ ID NO: 3334518 - RNA, 15 nt, Human
caggcaagcaccucc

SEQ ID NO: 3334519 - RNA, 14 nt, Human
caggcaagcaccuc

SEQ ID NO: 3334520 - RNA, 20 nt, Human
caggauucuuccucccuccc

SEQ ID NO: 3334521 - RNA, 13 nt, Human
caggcauucccca

SEQ ID NO: 3334522 - RNA, 15 nt, Human
caggcauuccccagg

SEQ ID NO: 3334523 - RNA, 16 nt, Human
caggcauuccccagga

SEQ ID NO: 3334524 - RNA, 17 nt, Human
caggcauuccccaggag

SEQ ID NO: 3334525 - RNA, 20 nt, Human
caggcauguucucugaggac

SEQ ID NO: 3334526 - RNA, 19 nt, Human
caggcauguucucugagga

SEQ ID NO: 3334527 - RNA, 18 nt, Human
caggcauguucucugagg

SEQ ID NO: 3334528 - RNA, 15 nt, Human
caggcauguucucug

SEQ ID NO: 3334529 - RNA, 18 nt, Human
caggcauuccccaggagg

SEQ ID NO: 3334530 - RNA, 19 nt, Human
caggcauuccccaggaggc

SEQ ID NO: 3334531 - RNA, 20 nt, Human
caggcauuccccaggaggcc

SEQ ID NO: 3334532 - RNA, 21 nt, Human
caggcauuccccaggaggcca

SEQ ID NO: 3334533 - RNA, 22 nt, Human
caggcauuccccaggaggccag

SEQ ID NO: 3334534 - RNA, 23 nt, Human
caggcauuccccaggaggccagc

SEQ ID NO: 3334535 - RNA, 24 nt, Human
caggcauuccccaggaggccagcc

SEQ ID NO: 3334536 - RNA, 12 nt, Human
caggcaggucuu

SEQ ID NO: 3334537 - RNA, 19 nt, Human
caggcagguccaggguuug

SEQ ID NO: 3334538 - RNA, 15 nt, Human
caggcagguccaggg

SEQ ID NO: 3334539 - RNA, 14 nt, Human
caggcagguccagg

SEQ ID NO: 3334540 - RNA, 22 nt, Human
caggcaggucuugaacuccugg

SEQ ID NO: 3334541 - RNA, 13 nt, Human
caggcaggucuug

SEQ ID NO: 3334542 - RNA, 15 nt, Human
caggcaggugggaug

SEQ ID NO: 3334543 - RNA, 23 nt, Human
caggcaggucuugaacuccuggc

SEQ ID NO: 3334544 - RNA, 17 nt, Human
caggcaugguggcccac

SEQ ID NO: 3334545 - RNA, 21 nt, Human
caggaguuugagaccaaccug

SEQ ID NO: 3334546 - RNA, 22 nt, Human
caggaguuugagaccaaccugg

SEQ ID NO: 3334547 - RNA, 23 nt, Human
caggaguuugagaccaaccuggg

SEQ ID NO: 3334548 - RNA, 23 nt, Human
caggagccccgaggccuucucug

SEQ ID NO: 3334549 - RNA, 22 nt, Human
caggagccccgaggccuucucu

SEQ ID NO: 3334550 - RNA, 20 nt, Human
caggagccccgaggccuucu

SEQ ID NO: 3334551 - RNA, 12 nt, Human
caggagcagcca

SEQ ID NO: 3334552 - RNA, 13 nt, Human
caggagcagccac

SEQ ID NO: 3334553 - RNA, 14 nt, Human
caggagcagccaca

SEQ ID NO: 3334554 - RNA, 19 nt, Human
caggagcagccacauuccu

SEQ ID NO: 3334555 - RNA, 18 nt, Human
caggagccccgaggccuu

SEQ ID NO: 3334556 - RNA, 16 nt, Human
caggagccccgaggcc

SEQ ID NO: 3334557 - RNA, 15 nt, Human
caggagccccgaggc

SEQ ID NO: 3334558 - RNA, 14 nt, Human
caggagccuccugc

SEQ ID NO: 3334559 - RNA, 17 nt, Human
caggagccuccugcccu

SEQ ID NO: 3334560 - RNA, 20 nt, Human
caggagccuccugcccuuac

SEQ ID NO: 3334561 - RNA, 12 nt, Human
caggagugagca

SEQ ID NO: 3334562 - RNA, 23 nt, Human
cagugccuuauggaacacucuga

SEQ ID NO: 3334563 - RNA, 15 nt, Human
caguccuuaccagca

SEQ ID NO: 3334564 - RNA, 18 nt, Human
caguccuuaccagcagag

SEQ ID NO: 3334565 - RNA, 19 nt, Human
caguccuuaccagcagagc

SEQ ID NO: 3334566 - RNA, 20 nt, Human
caguccuuaccagcagagca

SEQ ID NO: 3334567 - RNA, 21 nt, Human
caguccuuaccagcagagcac

SEQ ID NO: 3334568 - RNA, 18 nt, Human
cagucuggaaugcagugg

SEQ ID NO: 3334569 - RNA, 16 nt, Human
caguccucccaucuca

SEQ ID NO: 3334570 - RNA, 17 nt, Human
caguccucccaucucac

SEQ ID NO: 3334571 - RNA, 19 nt, Human
cagucuggaaugcaguggu

SEQ ID NO: 3334572 - RNA, 24 nt, Human
cagugagccgagauugcaccacug

SEQ ID NO: 3334573 - RNA, 12 nt, Human
cagugaggcucu

SEQ ID NO: 3334574 - RNA, 13 nt, Human
cagugaggcucug

SEQ ID NO: 3334575 - RNA, 14 nt, Human
cagugaggcucugc

SEQ ID NO: 3334576 - RNA, 15 nt, Human
cagugaggcucugcc

SEQ ID NO: 3334577 - RNA, 16 nt, Human
cagugaggcucugccc

SEQ ID NO: 3334578 - RNA, 17 nt, Human
cagugaggcucugcccu

SEQ ID NO: 3334579 - RNA, 18 nt, Human
cagugaggcucugcccuu

SEQ ID NO: 3334580 - RNA, 19 nt, Human
cagugaggcucugcccuug

SEQ ID NO: 3334581 - RNA, 20 nt, Human
cagugaggcucugcccuugg

SEQ ID NO: 3334582 - RNA, 18 nt, Human
cagugagucgaggacagg

SEQ ID NO: 3334583 - RNA, 17 nt, Human
cagugagucgaggacag

SEQ ID NO: 3334584 - RNA, 21 nt, Human
cagugaggcucugcccuuggu

SEQ ID NO: 3334585 - RNA, 15 nt, Human
cagugccuuauggaa

SEQ ID NO: 3334586 - RNA, 16 nt, Human
cagugccuuauggaac

SEQ ID NO: 3334587 - RNA, 17 nt, Human
cagugccuuauggaaca

SEQ ID NO: 3334588 - RNA, 18 nt, Human
cagugccuuauggaacac

SEQ ID NO: 3334589 - RNA, 19 nt, Human
cagugccuuauggaacacu

SEQ ID NO: 3334590 - RNA, 20 nt, Human
cagugccuuauggaacacuc

SEQ ID NO: 3334591 - RNA, 21 nt, Human
cagugccuuauggaacacucu

SEQ ID NO: 3334592 - RNA, 22 nt, Human
cagugccuuauggaacacucug

SEQ ID NO: 3334593 - RNA, 15 nt, Human
cagugccgagaagga

SEQ ID NO: 3334594 - RNA, 18 nt, Human
cagugccgagaaggaagc

SEQ ID NO: 3334595 - RNA, 11 nt, Human
cagugccuuau

SEQ ID NO: 3334596 - RNA, 13 nt, Human
cagugccuuaugg

SEQ ID NO: 3334597 - RNA, 23 nt, Human
cagugagucgaggacagggaggu

SEQ ID NO: 3334598 - RNA, 22 nt, Human
cagugagucgaggacagggagg

SEQ ID NO: 3334599 - RNA, 20 nt, Human
cagugagucgaggacaggga

SEQ ID NO: 3334600 - RNA, 19 nt, Human
cagugagucgaggacaggg

SEQ ID NO: 3334601 - RNA, 12 nt, Human
cagucccugcca

SEQ ID NO: 3334602 - RNA, 13 nt, Human
cagucccugccaa

SEQ ID NO: 3334603 - RNA, 14 nt, Human
cagucccugccaau

SEQ ID NO: 3334604 - RNA, 15 nt, Human
cagucccugccaaug

SEQ ID NO: 3334605 - RNA, 16 nt, Human
cagucccugccaaugg

SEQ ID NO: 3334606 - RNA, 12 nt, Human
caguccucccau

SEQ ID NO: 3334607 - RNA, 13 nt, Human
caguccucccauc

SEQ ID NO: 3334608 - RNA, 14 nt, Human
caguccucccaucu

SEQ ID NO: 3334609 - RNA, 15 nt, Human
caguccucccaucuc

SEQ ID NO: 3334610 - RNA, 17 nt, Human
cagucccugccaaugga

SEQ ID NO: 3334611 - RNA, 18 nt, Human
caguauuacuucugcuac

SEQ ID NO: 3334612 - RNA, 16 nt, Human
caguauuacuucugcu

SEQ ID NO: 3334613 - RNA, 16 nt, Human
caguccauagcagaga

SEQ ID NO: 3334614 - RNA, 14 nt, Human
caguccauugaaag

SEQ ID NO: 3334615 - RNA, 13 nt, Human
caguaucucaggg

SEQ ID NO: 3334616 - RNA, 15 nt, Human
caguaucucagggcc

SEQ ID NO: 3334617 - RNA, 12 nt, Human
caguaucuugaa

SEQ ID NO: 3334618 - RNA, 18 nt, Human
caguaucuugaagacuuu

SEQ ID NO: 3334619 - RNA, 21 nt, Human
caguaucuugaagacuuuucu

SEQ ID NO: 3334620 - RNA, 14 nt, Human
cagggucccuggug

SEQ ID NO: 3334621 - RNA, 12 nt, Human
cagggucccugg

SEQ ID NO: 3334622 - RNA, 15 nt, Human
cagggucccuggugg

SEQ ID NO: 3334623 - RNA, 18 nt, Human
cagggucccugguggcag

SEQ ID NO: 3334624 - RNA, 19 nt, Human
cagggucccugguggcagc

SEQ ID NO: 3334625 - RNA, 22 nt, Human
cagggucccugguggcagcuca

SEQ ID NO: 3334626 - RNA, 20 nt, Human
caggguauuccagagugggg

SEQ ID NO: 3334627 - RNA, 21 nt, Human
caggguauuccagagugggga

SEQ ID NO: 3334628 - RNA, 16 nt, Human
cagggucucacucugu

SEQ ID NO: 3334629 - RNA, 16 nt, Human
caggguuuugccaugu

SEQ ID NO: 3334630 - RNA, 17 nt, Human
cagguaacaggcagaua

SEQ ID NO: 3334631 - RNA, 16 nt, Human
cagguaacaggcagau

SEQ ID NO: 3334632 - RNA, 15 nt, Human
cagguaacaggcaga

SEQ ID NO: 3334633 - RNA, 14 nt, Human
cagguaacaggcag

SEQ ID NO: 3334634 - RNA, 18 nt, Human
caggguccuguagcccua

SEQ ID NO: 3334635 - RNA, 23 nt, Human
cagggucccugguggcagcucac

SEQ ID NO: 3334636 - RNA, 15 nt, Human
cagggucucacucug

SEQ ID NO: 3334637 - RNA, 23 nt, Human
cagggucucacuauguugcccag

SEQ ID NO: 3334638 - RNA, 22 nt, Human
cagggucucacuauguugccca

SEQ ID NO: 3334639 - RNA, 21 nt, Human
cagggucucacuauguugccc

SEQ ID NO: 3334640 - RNA, 14 nt, Human
caggggugggacac

SEQ ID NO: 3334641 - RNA, 15 nt, Human
caggggugggacacc

SEQ ID NO: 3334642 - RNA, 20 nt, Human
caggggugggacacccugug

SEQ ID NO: 3334643 - RNA, 21 nt, Human
caggggugggacacccuguga

SEQ ID NO: 3334644 - RNA, 23 nt, Human
caggucuugaacuccuggccuca

SEQ ID NO: 3334645 - RNA, 22 nt, Human
caggucuugaacuccuggccuc

SEQ ID NO: 3334646 - RNA, 21 nt, Human
caggucuugaacuccuggccu

SEQ ID NO: 3334647 - RNA, 20 nt, Human
caggucuugaacuccuggcc

SEQ ID NO: 3334648 - RNA, 19 nt, Human
caggucuugaacuccuggc

SEQ ID NO: 3334649 - RNA, 18 nt, Human
caggucuugaacuccugg

SEQ ID NO: 3334650 - RNA, 13 nt, Human
caggugagaagca

SEQ ID NO: 3334651 - RNA, 20 nt, Human
caggugagaagcagaggaag

SEQ ID NO: 3334652 - RNA, 21 nt, Human
caggugagaagcagaggaagg

SEQ ID NO: 3334653 - RNA, 21 nt, Human
cagguaacaggcagauacagg

SEQ ID NO: 3334654 - RNA, 20 nt, Human
cagguaacaggcagauacag

SEQ ID NO: 3334655 - RNA, 20 nt, Human
caggugguuauggagagggu

SEQ ID NO: 3334656 - RNA, 14 nt, Human
caggugucccugca

SEQ ID NO: 3334657 - RNA, 11 nt, Human
caggugucccu

SEQ ID NO: 3334658 - RNA, 18 nt, Human
cagguggggucacucugg

SEQ ID NO: 3334659 - RNA, 17 nt, Human
cagguggggcagcuuga

SEQ ID NO: 3334660 - RNA, 16 nt, Human
cagguggggcagcuug

SEQ ID NO: 3334661 - RNA, 15 nt, Human
cagguggggcagcuu

SEQ ID NO: 3334662 - RNA, 14 nt, Human
cagguggggcagcu

SEQ ID NO: 3334663 - RNA, 13 nt, Human
cagguggggcagc

SEQ ID NO: 3334664 - RNA, 19 nt, Human
cagguggggucacucuggc

SEQ ID NO: 3334665 - RNA, 20 nt, Human
cagguggggucacucuggca

SEQ ID NO: 3334666 - RNA, 21 nt, Human
cagguggggucacucuggcag

SEQ ID NO: 3334667 - RNA, 22 nt, Human
cagguggggucacucuggcagc

SEQ ID NO: 3334668 - RNA, 23 nt, Human
cagguggggucacucuggcagcu

SEQ ID NO: 3334669 - RNA, 18 nt, Human
caggugguuauggagagg

SEQ ID NO: 3334670 - RNA, 13 nt, Human
cagguucagcuug

SEQ ID NO: 3334671 - RNA, 12 nt, Human
cagguucagcuu

SEQ ID NO: 3334672 - RNA, 20 nt, Human
caguaaaugggggugcauuu

SEQ ID NO: 3334673 - RNA, 21 nt, Human
caguaaaugggggugcauuug

SEQ ID NO: 3334674 - RNA, 22 nt, Human
caguaaaugggggugcauuuga

SEQ ID NO: 3334675 - RNA, 13 nt, Human
caguaauaacucu

SEQ ID NO: 3334676 - RNA, 12 nt, Human
caguaauaacuc

SEQ ID NO: 3334677 - RNA, 12 nt, Human
caggugugaacc

SEQ ID NO: 3334678 - RNA, 19 nt, Human
caggugucccugcacuugc

SEQ ID NO: 3334679 - RNA, 18 nt, Human
caggugucccugcacuug

SEQ ID NO: 3334680 - RNA, 16 nt, Human
caggugucccugcacu

SEQ ID NO: 3334681 - RNA, 15 nt, Human
caggugucccugcac

SEQ ID NO: 3334682 - RNA, 16 nt, Human
caggugugagucacca

SEQ ID NO: 3334683 - RNA, 21 nt, Human
caggugugagucaccaagccc

SEQ ID NO: 3334684 - RNA, 20 nt, Human
caggugugagucaccaagcc

SEQ ID NO: 3334685 - RNA, 23 nt, Human
caggugugaaccaccacacccag

SEQ ID NO: 3334686 - RNA, 22 nt, Human
caggugugaaccaccacaccca

SEQ ID NO: 3334687 - RNA, 19 nt, Human
caggugugaaccaccacac

SEQ ID NO: 3334688 - RNA, 16 nt, Human
caggugugaaccacca

SEQ ID NO: 3334689 - RNA, 23 nt, Human
caggugugagucaccaagcccag

SEQ ID NO: 3334690 - RNA, 22 nt, Human
caggugugagucaccaagccca

SEQ ID NO: 3334691 - RNA, 22 nt, Human
gaaccaccacacccagcccacu

SEQ ID NO: 3334692 - RNA, 21 nt, Human
gaaccaccacacccagcccac

SEQ ID NO: 3334693 - RNA, 20 nt, Human
gaaccaccacacccagccca

SEQ ID NO: 3334694 - RNA, 18 nt, Human
gaaccaccacacccagcc

SEQ ID NO: 3334695 - RNA, 16 nt, Human
gaagacucauucuucu

SEQ ID NO: 3334696 - RNA, 17 nt, Human
gaagacucauucuucug

SEQ ID NO: 3334697 - RNA, 22 nt, Human
gaagcacaugccucucucaggc

SEQ ID NO: 3334698 - RNA, 14 nt, Human
gaagcacagcuuca

SEQ ID NO: 3334699 - RNA, 13 nt, Human
gaagcacagcuuc

SEQ ID NO: 3334700 - RNA, 16 nt, Human
gaagcaccauaacuuu

SEQ ID NO: 3334701 - RNA, 21 nt, Human
gaagcacaugccucucucagg

SEQ ID NO: 3334702 - RNA, 14 nt, Human
gaagacagcucuua

SEQ ID NO: 3334703 - RNA, 15 nt, Human
gaagacagcucuuau

SEQ ID NO: 3334704 - RNA, 13 nt, Human
gaagacagagcua

SEQ ID NO: 3334705 - RNA, 15 nt, Human
gaagacagagcuaca

SEQ ID NO: 3334706 - RNA, 12 nt, Human
gaagacagcucu

SEQ ID NO: 3334707 - RNA, 13 nt, Human
gaagacagcucuu

SEQ ID NO: 3334708 - RNA, 21 nt, Human
gaagacacugaugggcaaccc

SEQ ID NO: 3334709 - RNA, 16 nt, Human
gaagacacugaugggc

SEQ ID NO: 3334710 - RNA, 14 nt, Human
gaacuccuggccuc

SEQ ID NO: 3334711 - RNA, 13 nt, Human
gaacuccuggccu

SEQ ID NO: 3334712 - RNA, 22 nt, Human
gaaccauggucggaaaacaugc

SEQ ID NO: 3334713 - RNA, 23 nt, Human
gaaccaccacacccagcccacuu

SEQ ID NO: 3334714 - RNA, 17 nt, Human
gaaccaccacacccagc

SEQ ID NO: 3334715 - RNA, 16 nt, Human
gaaagggcccagagag

SEQ ID NO: 3334716 - RNA, 15 nt, Human
gaaagggcccagaga

SEQ ID NO: 3334717 - RNA, 23 nt, Human
gaacaaaacacacgcgcgcacac

SEQ ID NO: 3334718 - RNA, 13 nt, Human
gaaagggcccaga

SEQ ID NO: 3334719 - RNA, 12 nt, Human
gaaaggcuccag

SEQ ID NO: 3334720 - RNA, 14 nt, Human
gaaaggcuccagga

SEQ ID NO: 3334721 - RNA, 15 nt, Human
gaaaggcuccaggag

SEQ ID NO: 3334722 - RNA, 13 nt, Human
gaaaggcuccagg

SEQ ID NO: 3334723 - RNA, 21 nt, Human
gaaagaaaauaccaaggaaca

SEQ ID NO: 3334724 - RNA, 13 nt, Human
gaaacuggauuaa

SEQ ID NO: 3334725 - RNA, 17 nt, Human
gaaacuggauuaaacuu

SEQ ID NO: 3334726 - RNA, 23 nt, Human
gaaaagaaaaaugagccuggcaa

SEQ ID NO: 3334727 - RNA, 19 nt, Human
cuuuuauaaacuuuaccuu

SEQ ID NO: 3334728 - RNA, 22 nt, Human
cuuuguauucucuccuguaccu

SEQ ID NO: 3334729 - RNA, 20 nt, Human
cuuuuauaaacuuuaccuuu

SEQ ID NO: 3334730 - RNA, 21 nt, Human
cuuuuauaaacuuuaccuuuu

SEQ ID NO: 3334731 - RNA, 17 nt, Human
cuuuguauucucuccug

SEQ ID NO: 3334732 - RNA, 16 nt, Human
cuuugacgccauccca

SEQ ID NO: 3334733 - RNA, 17 nt, Human
cuuugacgccaucccag

SEQ ID NO: 3334734 - RNA, 16 nt, Human
cuuucuacccagcgag

SEQ ID NO: 3334735 - RNA, 15 nt, Human
cuuucuacccagcga

SEQ ID NO: 3334736 - RNA, 20 nt, Human
cuuucacccuuuucuguuug

SEQ ID NO: 3334737 - RNA, 14 nt, Human
cuuucacccuuuuc

SEQ ID NO: 3334738 - RNA, 15 nt, Human
cuuucacccuuuucu

SEQ ID NO: 3334739 - RNA, 23 nt, Human
cuuuaaugucacaggcaggucca

SEQ ID NO: 3334740 - RNA, 18 nt, Human
cuugucuuuggacccuga

SEQ ID NO: 3334741 - RNA, 13 nt, Human
cuugucuuuggac

SEQ ID NO: 3334742 - RNA, 15 nt, Human
cuugucuuuggaccc

SEQ ID NO: 3334743 - RNA, 19 nt, Human
cuuggugucgggcaugaca

SEQ ID NO: 3334744 - RNA, 22 nt, Human
cuugguagaagcccuucuaccu

SEQ ID NO: 3334745 - RNA, 14 nt, Human
cuugguccugcugc

SEQ ID NO: 3334746 - RNA, 13 nt, Human
cuuccuccuggug

SEQ ID NO: 3334747 - RNA, 21 nt, Human
cuuccucuuuccaucuacccu

SEQ ID NO: 3334748 - RNA, 22 nt, Human
cuuccucuuuccaucuacccuc

SEQ ID NO: 3334749 - RNA, 23 nt, Human
cuucugaacuuggcgcugccccu

SEQ ID NO: 3334750 - RNA, 13 nt, Human
cuucuucagagac

SEQ ID NO: 3334751 - RNA, 14 nt, Human
cuucuucagagacu

SEQ ID NO: 3334752 - RNA, 23 nt, Human
cuuggauuguccccgacccuugc

SEQ ID NO: 3334753 - RNA, 24 nt, Human
cuuggauuguccccgacccuugcc

SEQ ID NO: 3334754 - RNA, 22 nt, Human
cuuggauuguccccgacccuug

SEQ ID NO: 3334755 - RNA, 15 nt, Human
cuugauguguuaucu

SEQ ID NO: 3334756 - RNA, 18 nt, Human
cuugauguguuaucucuu

SEQ ID NO: 3334757 - RNA, 22 nt, Human
cuugauauccucuuugagugaa

SEQ ID NO: 3334758 - RNA, 17 nt, Human
cuugauauccucuuuga

SEQ ID NO: 3334759 - RNA, 16 nt, Human
cuugacaucaacugca

SEQ ID NO: 3334760 - RNA, 20 nt, Human
cuugacagggcacaccgggc

SEQ ID NO: 3334761 - RNA, 23 nt, Human
cuugaaugaugccaugaggaaca

SEQ ID NO: 3334762 - RNA, 11 nt, Human
cuggcagccca

SEQ ID NO: 3334763 - RNA, 12 nt, Human
cuggcagccccu

SEQ ID NO: 3334764 - RNA, 17 nt, Human
cuggcagaguugaagac

SEQ ID NO: 3334765 - RNA, 18 nt, Human
cuggcagaguugaagaca

SEQ ID NO: 3334766 - RNA, 22 nt, Human
cuggccccucagggucccuggu

SEQ ID NO: 3334767 - RNA, 15 nt, Human
cuggguucacugcaa

SEQ ID NO: 3334768 - RNA, 20 nt, Human
cuggguucacugcaaccucc

SEQ ID NO: 3334769 - RNA, 18 nt, Human
cuggguucacugcaaccu

SEQ ID NO: 3334770 - RNA, 14 nt, Human
cuggggagaaagua

SEQ ID NO: 3334771 - RNA, 15 nt, Human
cugggcagaaggaag

SEQ ID NO: 3334772 - RNA, 12 nt, Human
cugggcagaagg

SEQ ID NO: 3334773 - RNA, 15 nt, Human
cugccuguucagcuc

SEQ ID NO: 3334774 - RNA, 21 nt, Human
cugccuguugggccaggagcc

SEQ ID NO: 3334775 - RNA, 22 nt, Human
cugccuguugggccaggagccu

SEQ ID NO: 3334776 - RNA, 18 nt, Human
cugcugacuguuuucucu

SEQ ID NO: 3334777 - RNA, 21 nt, Human
cugcugacuguuuucucuuga

SEQ ID NO: 3334778 - RNA, 20 nt, Human
cugccuguugggccaggagc

SEQ ID NO: 3334779 - RNA, 19 nt, Human
cugccuguucagcuccagc

SEQ ID NO: 3334780 - RNA, 18 nt, Human
cugccuguucagcuccag

SEQ ID NO: 3334781 - RNA, 17 nt, Human
cugccuguucagcucca

SEQ ID NO: 3334782 - RNA, 23 nt, Human
cugccucucccaucacuucccua

SEQ ID NO: 3334783 - RNA, 22 nt, Human
cugccucucccaucacuucccu

SEQ ID NO: 3334784 - RNA, 15 nt, Human
cugccucucccauca

SEQ ID NO: 3334785 - RNA, 21 nt, Human
cugcuuuugucuaugggacuc

SEQ ID NO: 3334786 - RNA, 19 nt, Human
cugcuuuugucuaugggac

SEQ ID NO: 3334787 - RNA, 20 nt, Human
cugcuucaaggauccugagc

SEQ ID NO: 3334788 - RNA, 20 nt, Human
cugcuuuugucuaugggacu

SEQ ID NO: 3334789 - RNA, 22 nt, Human
cugcuucaaggauccugagcca

SEQ ID NO: 3334790 - RNA, 23 nt, Human
cugcuucaaggauccugagccag

SEQ ID NO: 3334791 - RNA, 19 nt, Human
cugcuucaaauauuucccu

SEQ ID NO: 3334792 - RNA, 12 nt, Human
cugcuucaagga

SEQ ID NO: 3334793 - RNA, 21 nt, Human
cugcuucaaggauccugagcc

SEQ ID NO: 3334794 - RNA, 14 nt, Human
cugcuucaaauauu

SEQ ID NO: 3334795 - RNA, 23 nt, Human
cuuagcucauucuccuuguguua

SEQ ID NO: 3334796 - RNA, 22 nt, Human
cuuagcucauucuccuuguguu

SEQ ID NO: 3334797 - RNA, 16 nt, Human
cuuaccagcagagcac

SEQ ID NO: 3334798 - RNA, 21 nt, Human
cuuagcagggaaacagcuaau

SEQ ID NO: 3334799 - RNA, 21 nt, Human
cuuagggaaggauacaaaagc

SEQ ID NO: 3334800 - RNA, 19 nt, Human
cuuagggaaggauacaaaa

SEQ ID NO: 3334801 - RNA, 14 nt, Human
cuguuggcuggggg

SEQ ID NO: 3334802 - RNA, 22 nt, Human
cuguuggcugggggccucagug

SEQ ID NO: 3334803 - RNA, 19 nt, Human
cuguuggcugggggccuca

SEQ ID NO: 3334804 - RNA, 15 nt, Human
cuguuggccagugug

SEQ ID NO: 3334805 - RNA, 14 nt, Human
cuuaaaacaacacu

SEQ ID NO: 3334806 - RNA, 15 nt, Human
cuuaccagcagagca

SEQ ID NO: 3334807 - RNA, 13 nt, Human
cuguagaguggga

SEQ ID NO: 3334808 - RNA, 21 nt, Human
cuguccugggagugagcuggu

SEQ ID NO: 3334809 - RNA, 23 nt, Human
cugucaauuacaggaaguacugg

SEQ ID NO: 3334810 - RNA, 19 nt, Human
cugucaauuacaggaagua

SEQ ID NO: 3334811 - RNA, 20 nt, Human
cugucaauuacaggaaguac

SEQ ID NO: 3334812 - RNA, 16 nt, Human
cugucgcccagucugg

SEQ ID NO: 3334813 - RNA, 15 nt, Human
cugucgcccagucug

SEQ ID NO: 3334814 - RNA, 15 nt, Human
cugugcugcccugcc

SEQ ID NO: 3334815 - RNA, 17 nt, Human
cugugcugcccugccca

SEQ ID NO: 3334816 - RNA, 18 nt, Human
cugugcugcccugcccac

SEQ ID NO: 3334817 - RNA, 19 nt, Human
cugugcugcccugcccacc

SEQ ID NO: 3334818 - RNA, 17 nt, Human
cugugucagcauagaag

SEQ ID NO: 3334819 - RNA, 12 nt, Human
cugugcugcccu

SEQ ID NO: 3334820 - RNA, 13 nt, Human
cugugcugcccug

SEQ ID NO: 3334821 - RNA, 14 nt, Human
cugugcugcccugc

SEQ ID NO: 3334822 - RNA, 18 nt, Human
cugugccucugggacugg

SEQ ID NO: 3334823 - RNA, 23 nt, Human
gauuuuuuuuuccuucagugccu

SEQ ID NO: 3334824 - RNA, 21 nt, Human
gauuuuuuuuuccuucagugc

SEQ ID NO: 3334825 - RNA, 22 nt, Human
gauuuuuuuuuccuucagugcc

SEQ ID NO: 3334826 - RNA, 17 nt, Human
gauuucacucuccuugg

SEQ ID NO: 3334827 - RNA, 18 nt, Human
gauuucacucuccuuggu

SEQ ID NO: 3334828 - RNA, 12 nt, Human
gauuucacucuc

SEQ ID NO: 3334829 - RNA, 19 nt, Human
gauuuaacagaaauguaca

SEQ ID NO: 3334830 - RNA, 13 nt, Human
gauuucacucucc

SEQ ID NO: 3334831 - RNA, 16 nt, Human
gauuucacucuccuug

SEQ ID NO: 3334832 - RNA, 20 nt, Human
gauucuucugcuucagccuc

SEQ ID NO: 3334833 - RNA, 21 nt, Human
gauucuucugcuucagccucc

SEQ ID NO: 3334834 - RNA, 23 nt, Human
gauucuuauggacaaugacccag

SEQ ID NO: 3334835 - RNA, 20 nt, Human
gauuuaacagaaauguacag

SEQ ID NO: 3334836 - RNA, 23 nt, Human
gauuuaacagaaauguacagcaa

SEQ ID NO: 3334837 - RNA, 21 nt, Human
gauucuccugccucagccucc

SEQ ID NO: 3334838 - RNA, 20 nt, Human
gauucuccugccucagccuc

SEQ ID NO: 3334839 - RNA, 19 nt, Human
gauucuccugccucagccu

SEQ ID NO: 3334840 - RNA, 18 nt, Human
gaucuggguucacugcaa

SEQ ID NO: 3334841 - RNA, 14 nt, Human
gaugcuuguacaua

SEQ ID NO: 3334842 - RNA, 16 nt, Human
gaugcuuguacauaau

SEQ ID NO: 3334843 - RNA, 21 nt, Human
gaugaugaaaugaggucagag

SEQ ID NO: 3334844 - RNA, 17 nt, Human
gcacuccagccugggug

SEQ ID NO: 3334845 - RNA, 15 nt, Human
gcacuccagccuggg

SEQ ID NO: 3334846 - RNA, 22 nt, Human
gcacuauagccuaggugacaga

SEQ ID NO: 3334847 - RNA, 22 nt, Human
gcacuauaauguaagcucuacu

SEQ ID NO: 3334848 - RNA, 20 nt, Human
gcacacaccagagcccaccu

SEQ ID NO: 3334849 - RNA, 12 nt, Human
gcacacauuuuu

SEQ ID NO: 3334850 - RNA, 11 nt, Human
gcacacauuuu

SEQ ID NO: 3334851 - RNA, 17 nt, Human
gcaccggcuggccuggc

SEQ ID NO: 3334852 - RNA, 15 nt, Human
gcaccggcuggccug

SEQ ID NO: 3334853 - RNA, 16 nt, Human
gcaccggcuggccugg

SEQ ID NO: 3334854 - RNA, 12 nt, Human
gcaccuccugcc

SEQ ID NO: 3334855 - RNA, 15 nt, Human
gcaaaagaugcuucu

SEQ ID NO: 3334856 - RNA, 18 nt, Human
gcaacccccagccugcua

SEQ ID NO: 3334857 - RNA, 16 nt, Human
gcaaaagaugcuucuc

SEQ ID NO: 3334858 - RNA, 17 nt, Human
gcaacccccagccugcu

SEQ ID NO: 3334859 - RNA, 22 nt, Human
gcaacccuggugaccagcacca

SEQ ID NO: 3334860 - RNA, 18 nt, Human
gcaaccuccgccucuugg

SEQ ID NO: 3334861 - RNA, 19 nt, Human
gcacacaccagagcccacc

SEQ ID NO: 3334862 - RNA, 18 nt, Human
gcacacaccagagcccac

SEQ ID NO: 3334863 - RNA, 17 nt, Human
gcacacaccagagccca

SEQ ID NO: 3334864 - RNA, 16 nt, Human
gcacacaccagagccc

SEQ ID NO: 3334865 - RNA, 15 nt, Human
gcacacaccagagcc

SEQ ID NO: 3334866 - RNA, 14 nt, Human
gcacacaccagagc

SEQ ID NO: 3334867 - RNA, 12 nt, Human
gcacacaccaga

SEQ ID NO: 3334868 - RNA, 23 nt, Human
gcaauaaggggagaguaacccug

SEQ ID NO: 3334869 - RNA, 11 nt, Human
gcaauaaagca

SEQ ID NO: 3334870 - RNA, 22 nt, Human
gcagggaaacagcuaaugggac

SEQ ID NO: 3334871 - RNA, 13 nt, Human
gcagggaaacagc

SEQ ID NO: 3334872 - RNA, 17 nt, Human
gcaggcucucaggccag

SEQ ID NO: 3334873 - RNA, 13 nt, Human
gcaggcucucagg

SEQ ID NO: 3334874 - RNA, 14 nt, Human
gcaggcucucaggc

SEQ ID NO: 3334875 - RNA, 15 nt, Human
gcaggcucucaggcc

SEQ ID NO: 3334876 - RNA, 16 nt, Human
gcaggcucucaggcca

SEQ ID NO: 3334877 - RNA, 22 nt, Human
gcaggcucgggcuccccagccc

SEQ ID NO: 3334878 - RNA, 12 nt, Human
gcaggcucucag

SEQ ID NO: 3334879 - RNA, 21 nt, Human
gcagcuugaggguugggcugg

SEQ ID NO: 3334880 - RNA, 19 nt, Human
gcagcuugaggguugggcu

SEQ ID NO: 3334881 - RNA, 16 nt, Human
gcagcuugaggguugg

SEQ ID NO: 3334882 - RNA, 20 nt, Human
gcagcugcuuuugucuaugg

SEQ ID NO: 3334883 - RNA, 13 nt, Human
gcagcugcuuuug

SEQ ID NO: 3334884 - RNA, 23 nt, Human
gcagcugcgguccacccaggagc

SEQ ID NO: 3334885 - RNA, 22 nt, Human
gcagcugcgguccacccaggag

SEQ ID NO: 3334886 - RNA, 19 nt, Human
gcagcugcgguccacccag

SEQ ID NO: 3334887 - RNA, 14 nt, Human
gcaguugccaguca

SEQ ID NO: 3334888 - RNA, 23 nt, Human
gcaguugccagucaccccggcca

SEQ ID NO: 3334889 - RNA, 15 nt, Human
gcauaaaaauuagcc

SEQ ID NO: 3334890 - RNA, 15 nt, Human
gcauaccacuuuugu

SEQ ID NO: 3334891 - RNA, 17 nt, Human
gccaaggccaaaggaag

SEQ ID NO: 3334892 - RNA, 11 nt, Human
gccaaggccaa

SEQ ID NO: 3334893 - RNA, 14 nt, Human
gccaagaauucuua

SEQ ID NO: 3334894 - RNA, 18 nt, Human
gccaagaauucuuaaaua

SEQ ID NO: 3334895 - RNA, 14 nt, Human
gcauuugaaaauuu

SEQ ID NO: 3334896 - RNA, 16 nt, Human
gcauuugaaaauuuug

SEQ ID NO: 3334897 - RNA, 18 nt, Human
gcauugugggaaggggag

SEQ ID NO: 3334898 - RNA, 12 nt, Human
gcauuuaaaaga

SEQ ID NO: 3334899 - RNA, 13 nt, Human
gcaugggaaugaa

SEQ ID NO: 3334900 - RNA, 16 nt, Human
gcaugggaaugaaugu

SEQ ID NO: 3334901 - RNA, 19 nt, Human
gcaugggaaugaaugucag

SEQ ID NO: 3334902 - RNA, 17 nt, Human
gcaugugaugagaggaa

SEQ ID NO: 3334903 - RNA, 23 nt, Human
gcauccuggcacccggccccugc

SEQ ID NO: 3334904 - RNA, 22 nt, Human
gcauccuggcacccggccccug

SEQ ID NO: 3334905 - RNA, 14 nt, Human
gcauccuggcaccc

SEQ ID NO: 3334906 - RNA, 21 nt, Human
gcauccuggcacccggccccu

SEQ ID NO: 3334907 - RNA, 17 nt, Human
gcauccuggcacccggc

SEQ ID NO: 3334908 - RNA, 11 nt, Human
gacagcuccuu

SEQ ID NO: 3334909 - RNA, 15 nt, Human
gacagcuccuucugu

SEQ ID NO: 3334910 - RNA, 14 nt, Human
gacagcuccuucug

SEQ ID NO: 3334911 - RNA, 13 nt, Human
gacagcuccuucu

SEQ ID NO: 3334912 - RNA, 16 nt, Human
gacccuauugcugcuu

SEQ ID NO: 3334913 - RNA, 13 nt, Human
gacccggcugcgu

SEQ ID NO: 3334914 - RNA, 12 nt, Human
gacccggcugcg

SEQ ID NO: 3334915 - RNA, 16 nt, Human
gaccaucccugaaggc

SEQ ID NO: 3334916 - RNA, 17 nt, Human
gaccaucccugaaggcc

SEQ ID NO: 3334917 - RNA, 16 nt, Human
gaccauucuccaccug

SEQ ID NO: 3334918 - RNA, 14 nt, Human
gaccaucccugaag

SEQ ID NO: 3334919 - RNA, 15 nt, Human
gaccaucccugaagg

SEQ ID NO: 3334920 - RNA, 13 nt, Human
gacgcugugcugc

SEQ ID NO: 3334921 - RNA, 12 nt, Human
gacgcugugcug

SEQ ID NO: 3334922 - RNA, 17 nt, Human
gagaagcggcuggcagc

SEQ ID NO: 3334923 - RNA, 16 nt, Human
gagaagcggcuggcag

SEQ ID NO: 3334924 - RNA, 14 nt, Human
gacucaaugcacug

SEQ ID NO: 3334925 - RNA, 17 nt, Human
gacucaaugcacugaca

SEQ ID NO: 3334926 - RNA, 22 nt, Human
gacuguacaaaguagaagucuu

SEQ ID NO: 3334927 - RNA, 16 nt, Human
gacuguuuucucuuga

SEQ ID NO: 3334928 - RNA, 18 nt, Human
gacuguuuucucuugaga

SEQ ID NO: 3334929 - RNA, 14 nt, Human
gacuuuggaaagac

SEQ ID NO: 3334930 - RNA, 14 nt, Human
gacuuuggaaagag

SEQ ID NO: 3334931 - RNA, 20 nt, Human
gacuuuuccaacccucauca

SEQ ID NO: 3334932 - RNA, 21 nt, Human
gacuuuucuguccgagcuuug

SEQ ID NO: 3334933 - RNA, 18 nt, Human
gagugagacucugucuca

SEQ ID NO: 3334934 - RNA, 14 nt, Human
gagugagacucugu

SEQ ID NO: 3334935 - RNA, 18 nt, Human
gagugcagugagccgaga

SEQ ID NO: 3334936 - RNA, 13 nt, Human
gagugcagugagc

SEQ ID NO: 3334937 - RNA, 22 nt, Human
gaguugauacuacaguuuguua

SEQ ID NO: 3334938 - RNA, 21 nt, Human
gaguugauagcacagacccug

SEQ ID NO: 3334939 - RNA, 19 nt, Human
gaguugauacuacaguuug

SEQ ID NO: 3334940 - RNA, 14 nt, Human
gagucacuggaaca

SEQ ID NO: 3334941 - RNA, 21 nt, Human
gagucacuggaacacuaauga

SEQ ID NO: 3334942 - RNA, 17 nt, Human
gaggugggauccuccag

SEQ ID NO: 3334943 - RNA, 15 nt, Human
gaggugggauccucc

SEQ ID NO: 3334944 - RNA, 16 nt, Human
gaggugggauccucca

SEQ ID NO: 3334945 - RNA, 13 nt, Human
gaggugggauccu

SEQ ID NO: 3334946 - RNA, 12 nt, Human
gagggcuccaga

SEQ ID NO: 3334947 - RNA, 13 nt, Human
gagggcuccagac

SEQ ID NO: 3334948 - RNA, 14 nt, Human
gagggcuccagaca

SEQ ID NO: 3334949 - RNA, 15 nt, Human
gagggcuccagacac

SEQ ID NO: 3334950 - RNA, 12 nt, Human
gaggggaacaga

SEQ ID NO: 3334951 - RNA, 15 nt, Human
gaggcucugcccuug

SEQ ID NO: 3334952 - RNA, 17 nt, Human
gaggcucugcccuuggu

SEQ ID NO: 3334953 - RNA, 12 nt, Human
gaggcucugccc

SEQ ID NO: 3334954 - RNA, 13 nt, Human
gaggcucugcccu

SEQ ID NO: 3334955 - RNA, 14 nt, Human
gaggcucugcccuu

SEQ ID NO: 3334956 - RNA, 20 nt, Human
gaggccagagacacaagccu

SEQ ID NO: 3334957 - RNA, 19 nt, Human
gaggccagagacacaagcc

SEQ ID NO: 3334958 - RNA, 19 nt, Human
gagcugccuguucagcucc

SEQ ID NO: 3334959 - RNA, 16 nt, Human
gagcugccuguucagc

SEQ ID NO: 3334960 - RNA, 15 nt, Human
gagcugccuguucag

SEQ ID NO: 3334961 - RNA, 17 nt, Human
gagcaucaggccaggcc

SEQ ID NO: 3334962 - RNA, 12 nt, Human
gagccuuccagg

SEQ ID NO: 3334963 - RNA, 13 nt, Human
gagccuuccaggg

SEQ ID NO: 3334964 - RNA, 20 nt, Human
gagcaucaggccaggcccuc

SEQ ID NO: 3334965 - RNA, 22 nt, Human
gagcaucaggccaggcccucug

SEQ ID NO: 3334966 - RNA, 16 nt, Human
ggccagugugacaagg

SEQ ID NO: 3334967 - RNA, 20 nt, Human
ggccagugugacaaggauug

SEQ ID NO: 3334968 - RNA, 14 nt, Human
ggccaguugguccc

SEQ ID NO: 3334969 - RNA, 17 nt, Human
ggccaguuggucccccu

SEQ ID NO: 3334970 - RNA, 19 nt, Human
ggcccuucucuccagcccc

SEQ ID NO: 3334971 - RNA, 20 nt, Human
ggcccuucucuccagccccu

SEQ ID NO: 3334972 - RNA, 21 nt, Human
ggcccuucucuccagccccug

SEQ ID NO: 3334973 - RNA, 15 nt, Human
ggcccggcuccaggc

SEQ ID NO: 3334974 - RNA, 13 nt, Human
ggcccggcuccag

SEQ ID NO: 3334975 - RNA, 23 nt, Human
ggccccugcugguucaggguugg

SEQ ID NO: 3334976 - RNA, 14 nt, Human
ggccccugcugguu

SEQ ID NO: 3334977 - RNA, 13 nt, Human
ggccccugcuggu

SEQ ID NO: 3334978 - RNA, 22 nt, Human
ggcccuucucuccagccccugg

SEQ ID NO: 3334979 - RNA, 23 nt, Human
ggcccuucucuccagccccugga

SEQ ID NO: 3334980 - RNA, 23 nt, Human
ggccucaagugauucuccugccu

SEQ ID NO: 3334981 - RNA, 22 nt, Human
ggcagccccuguucuggcagag

SEQ ID NO: 3334982 - RNA, 20 nt, Human
ggcaguggugguuuucuguu

SEQ ID NO: 3334983 - RNA, 21 nt, Human
ggcaguggugguuuucuguuc

SEQ ID NO: 3334984 - RNA, 16 nt, Human
ggagagaagagaaugc

SEQ ID NO: 3334985 - RNA, 20 nt, Human
ggcacagaaaauggaagaca

SEQ ID NO: 3334986 - RNA, 21 nt, Human
ggcacagaaaauggaagacag

SEQ ID NO: 3334987 - RNA, 19 nt, Human
ggcacagaaaauggaagac

SEQ ID NO: 3334988 - RNA, 13 nt, Human
ggcacaucagcac

SEQ ID NO: 3334989 - RNA, 20 nt, Human
ggcacucagaagacacugau

SEQ ID NO: 3334990 - RNA, 23 nt, Human
ggcacucagaagacacugauggg

SEQ ID NO: 3334991 - RNA, 11 nt, Human
ggcagccccug

SEQ ID NO: 3334992 - RNA, 23 nt, Human
ggcagccccauucugccugccca

SEQ ID NO: 3334993 - RNA, 18 nt, Human
ggcucagcggggacagcu

SEQ ID NO: 3334994 - RNA, 19 nt, Human
ggcucagcggggacagcuc

SEQ ID NO: 3334995 - RNA, 19 nt, Human
ggcucagguggggucacuc

SEQ ID NO: 3334996 - RNA, 20 nt, Human
ggcucagguggggucacucu

SEQ ID NO: 3334997 - RNA, 13 nt, Human
ggcugggagagcc

SEQ ID NO: 3334998 - RNA, 14 nt, Human
ggcugggagagccu

SEQ ID NO: 3334999 - RNA, 15 nt, Human
ggcugggagagccuu

SEQ ID NO: 3335000 - RNA, 16 nt, Human
ggcugggagagccuuc

SEQ ID NO: 3335001 - RNA, 22 nt, Human
ggcugcggaaugaaccacaucu

SEQ ID NO: 3335002 - RNA, 19 nt, Human
ggcugccaaugggagcuca

SEQ ID NO: 3335003 - RNA, 20 nt, Human
ggcugccaaugggagcucau

SEQ ID NO: 3335004 - RNA, 22 nt, Human
ggcugcaugcgggcuuccuccu

SEQ ID NO: 3335005 - RNA, 12 nt, Human
ggcucuuccagg

SEQ ID NO: 3335006 - RNA, 13 nt, Human
ggcucucaggcca

SEQ ID NO: 3335007 - RNA, 11 nt, Human
ggcucucaggc

SEQ ID NO: 3335008 - RNA, 23 nt, Human
gggacuuggaagcuccgcuuucu

SEQ ID NO: 3335009 - RNA, 18 nt, Human
gggacuuggaagcuccgc

SEQ ID NO: 3335010 - RNA, 17 nt, Human
gggacuuggaagcuccg

SEQ ID NO: 3335011 - RNA, 15 nt, Human
gggacuuggaagcuc

SEQ ID NO: 3335012 - RNA, 21 nt, Human
gggagaaccaaaaagaggcua

SEQ ID NO: 3335013 - RNA, 18 nt, Human
gggaggucaaggcugcag

SEQ ID NO: 3335014 - RNA, 15 nt, Human
gggagggagggcucc

SEQ ID NO: 3335015 - RNA, 16 nt, Human
gggagggagggcucca

SEQ ID NO: 3335016 - RNA, 15 nt, Human
gggagagccuuccag

SEQ ID NO: 3335017 - RNA, 19 nt, Human
gggagagccuuccaggggu

SEQ ID NO: 3335018 - RNA, 23 nt, Human
gggagcaggcucgggcuccccag

SEQ ID NO: 3335019 - RNA, 18 nt, Human
aaaacucuccucugcugc

SEQ ID NO: 3335020 - RNA, 13 nt, Human
aaaacaugcuaca

SEQ ID NO: 3335021 - RNA, 14 nt, Human
aaaacaugcuacac

SEQ ID NO: 3335022 - RNA, 12 nt, Human
aaaacccaagug

SEQ ID NO: 3335023 - RNA, 14 nt, Human
gggaccagagcugc

SEQ ID NO: 3335024 - RNA, 20 nt, Human
gggaccagagcugccaccug

SEQ ID NO: 3335025 - RNA, 21 nt, Human
ggcuuccuccugguguggaag

SEQ ID NO: 3335026 - RNA, 18 nt, Human
gggaagaagcucucuccu

SEQ ID NO: 3335027 - RNA, 15 nt, Human
gggacagcuccuucu

SEQ ID NO: 3335028 - RNA, 13 nt, Human
gggacagcuccuu

SEQ ID NO: 3335029 - RNA, 12 nt, Human
gggacagcuccu

SEQ ID NO: 3335030 - RNA, 18 nt, Human
ggcuucauccuccucaga

SEQ ID NO: 3335031 - RNA, 22 nt, Human
ggcuucauccuccucagaucuu

SEQ ID NO: 3335032 - RNA, 16 nt, Human
ggcuuccucauaguau

SEQ ID NO: 3335033 - RNA, 18 nt, Human
ggcuguaucccaugagcc

SEQ ID NO: 3335034 - RNA, 20 nt, Human
ggcuucaguggcagcugcuu

SEQ ID NO: 3335035 - RNA, 19 nt, Human
ggcuucaguggcagcugcu

SEQ ID NO: 3335036 - RNA, 17 nt, Human
ggcuucaguggcagcug

SEQ ID NO: 3335037 - RNA, 18 nt, Human
ggcuucaguggcagcugc

SEQ ID NO: 3335038 - RNA, 14 nt, Human
ggcugggggccuca

SEQ ID NO: 3335039 - RNA, 19 nt, Human
ggcuggguucuacccaggu

SEQ ID NO: 3335040 - RNA, 21 nt, Human
ggcuggguucuacccaggugc

SEQ ID NO: 3335041 - RNA, 19 nt, Human
ggcuggguggcaccagcag

SEQ ID NO: 3335042 - RNA, 19 nt, Human
ggcugggggccucagugcc

SEQ ID NO: 3335043 - RNA, 17 nt, Human
ggcugggggccucagug

SEQ ID NO: 3335044 - RNA, 16 nt, Human
ggcugggggccucagu

SEQ ID NO: 3335045 - RNA, 15 nt, Human
ggcugggggccucag

SEQ ID NO: 3335046 - RNA, 13 nt, Human
aaagcugcugaca

SEQ ID NO: 3335047 - RNA, 15 nt, Human
aaagcuuguuaagau

SEQ ID NO: 3335048 - RNA, 15 nt, Human
aaagcucacuuuacu

SEQ ID NO: 3335049 - RNA, 22 nt, Human
aaagcugccagccgagauagcc

SEQ ID NO: 3335050 - RNA, 21 nt, Human
aaaggagagcuagcagcaggg

SEQ ID NO: 3335051 - RNA, 17 nt, Human
aaaggagagcuagcagc

SEQ ID NO: 3335052 - RNA, 17 nt, Human
aaaggagauuggaagga

SEQ ID NO: 3335053 - RNA, 22 nt, Human
aaaggaaagagggagguaagga

SEQ ID NO: 3335054 - RNA, 22 nt, Human
aaagggacuuggaagcuccgcu

SEQ ID NO: 3335055 - RNA, 13 nt, Human
ggugcaaugaccu

SEQ ID NO: 3335056 - RNA, 12 nt, Human
ggugcaaugacc

SEQ ID NO: 3335057 - RNA, 24 nt, Human
ggugauccacccaccucagccucc

SEQ ID NO: 3335058 - RNA, 23 nt, Human
ggugauccacccaccucagccuc

SEQ ID NO: 3335059 - RNA, 18 nt, Human
ggugauccacccaccuca

SEQ ID NO: 3335060 - RNA, 13 nt, Human
ggucgaggcagga

SEQ ID NO: 3335061 - RNA, 13 nt, Human
ggugaacagaaca

SEQ ID NO: 3335062 - RNA, 13 nt, Human
gguggaugccugg

SEQ ID NO: 3335063 - RNA, 12 nt, Human
gguccugcugca

SEQ ID NO: 3335064 - RNA, 11 nt, Human
gguccugcugc

SEQ ID NO: 3335065 - RNA, 13 nt, Human
aaagacuguacaa

SEQ ID NO: 3335066 - RNA, 23 nt, Human
aaagacugaguacguugugcauu

SEQ ID NO: 3335067 - RNA, 17 nt, Human
aaagaugcuucucacug

SEQ ID NO: 3335068 - RNA, 14 nt, Human
aaagaugcuucuca

SEQ ID NO: 3335069 - RNA, 19 nt, Human
aaagaugcuucucacugcc

SEQ ID NO: 3335070 - RNA, 18 nt, Human
aaacuuuucaaggcuuau

SEQ ID NO: 3335071 - RNA, 22 nt, Human
aaacuugauguguuaucucuua

SEQ ID NO: 3335072 - RNA, 22 nt, Human
aaacuuuucaaggcuuauauuc

SEQ ID NO: 3335073 - RNA, 17 nt, Human
aaacuuaaucuaaaugg

SEQ ID NO: 3335074 - RNA, 18 nt, Human
aaacuuaaucuaaaugga

SEQ ID NO: 3335075 - RNA, 16 nt, Human
aaacuuaaucuaaaug

SEQ ID NO: 3335076 - RNA, 14 nt, Human
aaacuuaaucuaaa

SEQ ID NO: 3335077 - RNA, 19 nt, Human
ggguggcaccagcagccug

SEQ ID NO: 3335078 - RNA, 15 nt, Human
aaacgggcucagcaa

SEQ ID NO: 3335079 - RNA, 23 nt, Human
aaaccaagucaagugaaaaagga

SEQ ID NO: 3335080 - RNA, 13 nt, Human
gggaugagaaagg

SEQ ID NO: 3335081 - RNA, 19 nt, Human
aaaauuuagaaauauaauu

SEQ ID NO: 3335082 - RNA, 20 nt, Human
aaaauuuugauguuuuaagg

SEQ ID NO: 3335083 - RNA, 11 nt, Human
aaacacauuuu

SEQ ID NO: 3335084 - RNA, 18 nt, Human
gggggccucagugccacu

SEQ ID NO: 3335085 - RNA, 17 nt, Human
gggggccucagugccac

SEQ ID NO: 3335086 - RNA, 15 nt, Human
gggggccucagugcc

SEQ ID NO: 3335087 - RNA, 12 nt, Human
gggggccucagu

SEQ ID NO: 3335088 - RNA, 22 nt, Human
ggggaauguuugccucugccuc

SEQ ID NO: 3335089 - RNA, 18 nt, Human
ggggaauguuugccucug

SEQ ID NO: 3335090 - RNA, 16 nt, Human
ggggaccagagcugcc

SEQ ID NO: 3335091 - RNA, 15 nt, Human
ggggaccagagcugc

SEQ ID NO: 3335092 - RNA, 17 nt, Human
aaacauggccuuugcuu

SEQ ID NO: 3335093 - RNA, 16 nt, Human
aaacauggccuuugcu

SEQ ID NO: 3335094 - RNA, 17 nt, Human
guacaugaaaacacauu

SEQ ID NO: 3335095 - RNA, 18 nt, Human
guacaugaaaacacauuu

SEQ ID NO: 3335096 - RNA, 19 nt, Human
guacaugaaaacacauuuu

SEQ ID NO: 3335097 - RNA, 20 nt, Human
guacaugaaaacacauuuuu

SEQ ID NO: 3335098 - RNA, 19 nt, Human
guacauggaauaacaugua

SEQ ID NO: 3335099 - RNA, 14 nt, Human
guacaugaaaacac

SEQ ID NO: 3335100 - RNA, 15 nt, Human
guacaugaaaacaca

SEQ ID NO: 3335101 - RNA, 16 nt, Human
guacaugaaaacacau

SEQ ID NO: 3335102 - RNA, 12 nt, Human
guacccacugcu

SEQ ID NO: 3335103 - RNA, 23 nt, Human
guaccaggaaaggauuuuauaau

SEQ ID NO: 3335104 - RNA, 19 nt, Human
aaaucagccguguaaccau

SEQ ID NO: 3335105 - RNA, 12 nt, Human
aaaucagccugc

SEQ ID NO: 3335106 - RNA, 16 nt, Human
aaaucagcugcuacua

SEQ ID NO: 3335107 - RNA, 19 nt, Human
aaauauuaagaaagacuau

SEQ ID NO: 3335108 - RNA, 18 nt, Human
guacuacaguccucccau

SEQ ID NO: 3335109 - RNA, 19 nt, Human
guacuacaguccucccauc

SEQ ID NO: 3335110 - RNA, 14 nt, Human
guacccacugcucu

SEQ ID NO: 3335111 - RNA, 13 nt, Human
guacccacugcuc

SEQ ID NO: 3335112 - RNA, 13 nt, Human
guacuauguauca

SEQ ID NO: 3335113 - RNA, 17 nt, Human
guacuacaguccuccca

SEQ ID NO: 3335114 - RNA, 17 nt, Human
guacuauguaucaauga

SEQ ID NO: 3335115 - RNA, 15 nt, Human
guacuauguaucaau

SEQ ID NO: 3335116 - RNA, 16 nt, Human
guacuggagaaaaugg

SEQ ID NO: 3335117 - RNA, 23 nt, Human
guagaaauaucugaaaauguaug

SEQ ID NO: 3335118 - RNA, 21 nt, Human
guagaaauaucugaaaaugua

SEQ ID NO: 3335119 - RNA, 20 nt, Human
guagaaauaucugaaaaugu

SEQ ID NO: 3335120 - RNA, 21 nt, Human
guagaagucuuagauguauau

SEQ ID NO: 3335121 - RNA, 18 nt, Human
guagaagcccuucuaccu

SEQ ID NO: 3335122 - RNA, 12 nt, Human
guagagacaggg

SEQ ID NO: 3335123 - RNA, 11 nt, Human
guagagacagg

SEQ ID NO: 3335124 - RNA, 15 nt, Human
guagagccagggucu

SEQ ID NO: 3335125 - RNA, 10 nt, Human
guagagccag

SEQ ID NO: 3335126 - RNA, 13 nt, Human
guagagacagggu

SEQ ID NO: 3335127 - RNA, 11 nt, Human
guagagccagg

SEQ ID NO: 3335128 - RNA, 14 nt, Human
aaauauaauugaca

SEQ ID NO: 3335129 - RNA, 17 nt, Human
aaauacagauagauaua

SEQ ID NO: 3335130 - RNA, 14 nt, Human
guaauaugcacaca

SEQ ID NO: 3335131 - RNA, 16 nt, Human
guaauaugcacacauu

SEQ ID NO: 3335132 - RNA, 17 nt, Human
guaauaugcacacauuu

SEQ ID NO: 3335133 - RNA, 18 nt, Human
guaauaugcacacauuuu

SEQ ID NO: 3335134 - RNA, 22 nt, Human
guaauuugugauacaaugcugu

SEQ ID NO: 3335135 - RNA, 21 nt, Human
aaaguacuucuccacccugcu

SEQ ID NO: 3335136 - RNA, 20 nt, Human
aaaguacuucuccacccugc

SEQ ID NO: 3335137 - RNA, 19 nt, Human
aaaguacuucuccacccug

SEQ ID NO: 3335138 - RNA, 20 nt, Human
aaaguacacuguuucaaacu

SEQ ID NO: 3335139 - RNA, 23 nt, Human
gcucugcaagaauugaagcagga

SEQ ID NO: 3335140 - RNA, 17 nt, Human
gcucugaucauccacug

SEQ ID NO: 3335141 - RNA, 23 nt, Human
gcucugaucauccacugugccau

SEQ ID NO: 3335142 - RNA, 11 nt, Human
gcucugcccuu

SEQ ID NO: 3335143 - RNA, 18 nt, Human
gcuccuggcccacugcau

SEQ ID NO: 3335144 - RNA, 19 nt, Human
gcuccuggcccacugcauc

SEQ ID NO: 3335145 - RNA, 20 nt, Human
gcuccuggcccacugcaucg

SEQ ID NO: 3335146 - RNA, 14 nt, Human
gcuccuggcccacu

SEQ ID NO: 3335147 - RNA, 15 nt, Human
gcuccuggcccacug

SEQ ID NO: 3335148 - RNA, 20 nt, Human
gcuccagcucaccagcccca

SEQ ID NO: 3335149 - RNA, 18 nt, Human
gcuccagcucaccagccc

SEQ ID NO: 3335150 - RNA, 17 nt, Human
gcuccagcucaccagcc

SEQ ID NO: 3335151 - RNA, 12 nt, Human
gcuaugcauuug

SEQ ID NO: 3335152 - RNA, 21 nt, Human
gcuagugugguguuuccuggc

SEQ ID NO: 3335153 - RNA, 13 nt, Human
gcuaugcauuuga

SEQ ID NO: 3335154 - RNA, 19 nt, Human
gcuauucaguaauaacucu

SEQ ID NO: 3335155 - RNA, 16 nt, Human
gcuaggccuggccaga

SEQ ID NO: 3335156 - RNA, 23 nt, Human
gcuaggccuggccagaugcacca

SEQ ID NO: 3335157 - RNA, 17 nt, Human
gcuaggccuggccagau

SEQ ID NO: 3335158 - RNA, 20 nt, Human
gcuauucaguaauaacucua

SEQ ID NO: 3335159 - RNA, 18 nt, Human
gcuauucaguaauaacuc

SEQ ID NO: 3335160 - RNA, 14 nt, Human
gcucacugcagccu

SEQ ID NO: 3335161 - RNA, 13 nt, Human
gcucacugcagcc

SEQ ID NO: 3335162 - RNA, 12 nt, Human
gcucacugcagc

SEQ ID NO: 3335163 - RNA, 11 nt, Human
gcucacugcag

SEQ ID NO: 3335164 - RNA, 16 nt, Human
gcucacugcagccuca

SEQ ID NO: 3335165 - RNA, 15 nt, Human
gcucacugcagccuc

SEQ ID NO: 3335166 - RNA, 17 nt, Human
gcucacugcagccucaa

SEQ ID NO: 3335167 - RNA, 13 nt, Human
gcucagagagggu

SEQ ID NO: 3335168 - RNA, 14 nt, Human
gcucagagagggug

SEQ ID NO: 3335169 - RNA, 23 nt, Human
gcucagguggggucacucuggca

SEQ ID NO: 3335170 - RNA, 14 nt, Human
gcucaggugucccu

SEQ ID NO: 3335171 - RNA, 16 nt, Human
gcucaggugucccugc

SEQ ID NO: 3335172 - RNA, 13 nt, Human
gcucaggaguuug

SEQ ID NO: 3335173 - RNA, 23 nt, Human
gcuaagugauccucccaccucag

SEQ ID NO: 3335174 - RNA, 15 nt, Human
gcuaaugggacacua

SEQ ID NO: 3335175 - RNA, 13 nt, Human
gcuaaugggacac

SEQ ID NO: 3335176 - RNA, 23 nt, Human
gcgugcacacaccagagcccacc

SEQ ID NO: 3335177 - RNA, 19 nt, Human
gcgugcacacaccagagcc

SEQ ID NO: 3335178 - RNA, 18 nt, Human
gcguuucuaugacacaug

SEQ ID NO: 3335179 - RNA, 20 nt, Human
gcgggaggauguucugggac

SEQ ID NO: 3335180 - RNA, 22 nt, Human
gcgggaggauguucugggacac

SEQ ID NO: 3335181 - RNA, 21 nt, Human
gcgggaggauguucugggaca

SEQ ID NO: 3335182 - RNA, 20 nt, Human
gcgugcacacaccagagccc

SEQ ID NO: 3335183 - RNA, 20 nt, Human
gccuggccugagcugggaug

SEQ ID NO: 3335184 - RNA, 14 nt, Human
gccuggccugagcu

SEQ ID NO: 3335185 - RNA, 18 nt, Human
gccuggccugagcuggga

SEQ ID NO: 3335186 - RNA, 13 nt, Human
gccuggccugagc

SEQ ID NO: 3335187 - RNA, 15 nt, Human
gccuguugggccagg

SEQ ID NO: 3335188 - RNA, 16 nt, Human
gccuguugggccagga

SEQ ID NO: 3335189 - RNA, 18 nt, Human
gccuguugggccaggagc

SEQ ID NO: 3335190 - RNA, 20 nt, Human
gccuguugggccaggagccu

SEQ ID NO: 3335191 - RNA, 14 nt, Human
gccuguugggccag

SEQ ID NO: 3335192 - RNA, 17 nt, Human
gccugugccucugggac

SEQ ID NO: 3335193 - RNA, 16 nt, Human
gccugugccucuggga

SEQ ID NO: 3335194 - RNA, 13 nt, Human
gccuggcucaggu

SEQ ID NO: 3335195 - RNA, 18 nt, Human
gccugugccucugggacu

SEQ ID NO: 3335196 - RNA, 15 nt, Human
gcgagcccugguggc

SEQ ID NO: 3335197 - RNA, 17 nt, Human
gcgagcccugguggcag

SEQ ID NO: 3335198 - RNA, 17 nt, Human
gccuugaccauucucca

SEQ ID NO: 3335199 - RNA, 19 nt, Human
gccuugaccauucuccacc

SEQ ID NO: 3335200 - RNA, 20 nt, Human
gccuugaccauucuccaccu

SEQ ID NO: 3335201 - RNA, 16 nt, Human
gccuugaccauucucc

SEQ ID NO: 3335202 - RNA, 22 nt, Human
gcgaucuggguucacugcaacc

SEQ ID NO: 3335203 - RNA, 11 nt, Human
gcgcacacaca

SEQ ID NO: 3335204 - RNA, 16 nt, Human
gcgcacacacacacau

SEQ ID NO: 3335205 - RNA, 18 nt, Human
gcgcacacacacacauac

SEQ ID NO: 3335206 - RNA, 19 nt, Human
gcgcacacacacacauaca

SEQ ID NO: 3335207 - RNA, 20 nt, Human
gccugcccaggccccugcca

SEQ ID NO: 3335208 - RNA, 15 nt, Human
gccugcccaggcccc

SEQ ID NO: 3335209 - RNA, 12 nt, Human
gccugcccaggc

SEQ ID NO: 3335210 - RNA, 22 nt, Human
gccugcccaggccccugccacc

SEQ ID NO: 3335211 - RNA, 21 nt, Human
gccucuuaugggcuggguucu

SEQ ID NO: 3335212 - RNA, 14 nt, Human
gccucuuggguuca

SEQ ID NO: 3335213 - RNA, 14 nt, Human
gccugcccaggccc

SEQ ID NO: 3335214 - RNA, 13 nt, Human
gccugcccaggcc

SEQ ID NO: 3335215 - RNA, 22 nt, Human
gccucgaacuggcugcaaaggg

SEQ ID NO: 3335216 - RNA, 20 nt, Human
gccucgaacuggcugcaaag

SEQ ID NO: 3335217 - RNA, 17 nt, Human
gccucuuaugggcuggg

SEQ ID NO: 3335218 - RNA, 18 nt, Human
gccucuuaugggcugggu

SEQ ID NO: 3335219 - RNA, 16 nt, Human
gccucuuaugggcugg

SEQ ID NO: 3335220 - RNA, 17 nt, Human
gccucccaaagugcugg

SEQ ID NO: 3335221 - RNA, 13 nt, Human
gccuccugugugu

SEQ ID NO: 3335222 - RNA, 16 nt, Human
gccucccaaagugcug

SEQ ID NO: 3335223 - RNA, 23 nt, Human
gccuccugugugugcgccuacag

SEQ ID NO: 3335224 - RNA, 19 nt, Human
gccuccugugugugcgccu

SEQ ID NO: 3335225 - RNA, 17 nt, Human
gccucgaacuggcugca

SEQ ID NO: 3335226 - RNA, 16 nt, Human
gccccugccacccugg

SEQ ID NO: 3335227 - RNA, 17 nt, Human
gccccugccacccuggg

SEQ ID NO: 3335228 - RNA, 23 nt, Human
gcccgggcucugccucccaucac

SEQ ID NO: 3335229 - RNA, 21 nt, Human
gcccgggcucugccucccauc

SEQ ID NO: 3335230 - RNA, 20 nt, Human
gcccuuagcagggaaacagc

SEQ ID NO: 3335231 - RNA, 19 nt, Human
gcccuuagcagggaaacag

SEQ ID NO: 3335232 - RNA, 12 nt, Human
gcccugccuccu

SEQ ID NO: 3335233 - RNA, 13 nt, Human
gcccugccuccuu

SEQ ID NO: 3335234 - RNA, 22 nt, Human
gcccuuagcagggaaacagcua

SEQ ID NO: 3335235 - RNA, 20 nt, Human
gccgcagcccugcagagggc

SEQ ID NO: 3335236 - RNA, 19 nt, Human
gccgcagcccugcagaggg

SEQ ID NO: 3335237 - RNA, 15 nt, Human
gcccugcccaccugg

SEQ ID NO: 3335238 - RNA, 11 nt, Human
gcccugccucc

SEQ ID NO: 3335239 - RNA, 17 nt, Human
gcccugcccaccuggcc

SEQ ID NO: 3335240 - RNA, 20 nt, Human
gcccugcccaccuggccucu

SEQ ID NO: 3335241 - RNA, 21 nt, Human
gcccugcccaccuggccucug

SEQ ID NO: 3335242 - RNA, 22 nt, Human
gcccugcccaccuggccucugc

SEQ ID NO: 3335243 - RNA, 18 nt, Human
gcccugcagagggcacag

SEQ ID NO: 3335244 - RNA, 16 nt, Human
gcccugcagagggcac

SEQ ID NO: 3335245 - RNA, 23 nt, Human
gccuagcauacguacacauuuua

SEQ ID NO: 3335246 - RNA, 19 nt, Human
gccuagcauacguacacau

SEQ ID NO: 3335247 - RNA, 21 nt, Human
gccuagcauacguacacauuu

SEQ ID NO: 3335248 - RNA, 22 nt, Human
gccuagcauacguacacauuuu

SEQ ID NO: 3335249 - RNA, 20 nt, Human
gccuagcauacguacacauu

SEQ ID NO: 3335250 - RNA, 15 nt, Human
gccuaggugacagag

SEQ ID NO: 3335251 - RNA, 14 nt, Human
gccuaggugacaga

SEQ ID NO: 3335252 - RNA, 13 nt, Human
gccuaggugacag

SEQ ID NO: 3335253 - RNA, 20 nt, Human
gccuaggugacagagugaga

SEQ ID NO: 3335254 - RNA, 20 nt, Human
gcuggccuggccccucaggg

SEQ ID NO: 3335255 - RNA, 22 nt, Human
gcuggagugcagugagccgaga

SEQ ID NO: 3335256 - RNA, 17 nt, Human
gcuggagugcagugagc

SEQ ID NO: 3335257 - RNA, 18 nt, Human
gcuggagugcagugagcc

SEQ ID NO: 3335258 - RNA, 20 nt, Human
gcuggcgugcaguggugcga

SEQ ID NO: 3335259 - RNA, 19 nt, Human
gcuggccuggccccucagg

SEQ ID NO: 3335260 - RNA, 15 nt, Human
gcucugguccauaga

SEQ ID NO: 3335261 - RNA, 16 nt, Human
gcucugguccauagag

SEQ ID NO: 3335262 - RNA, 12 nt, Human
gcugcugaaggc

SEQ ID NO: 3335263 - RNA, 13 nt, Human
gcugcugaaggcu

SEQ ID NO: 3335264 - RNA, 14 nt, Human
gcugcugaaggcuc

SEQ ID NO: 3335265 - RNA, 15 nt, Human
gcugcugaaggcucg

SEQ ID NO: 3335266 - RNA, 13 nt, Human
gcugcuggcuggu

SEQ ID NO: 3335267 - RNA, 16 nt, Human
gcuggcuguuggcugg

SEQ ID NO: 3335268 - RNA, 15 nt, Human
gcuggcuguuggcug

SEQ ID NO: 3335269 - RNA, 23 nt, Human
gcugggguggggaccucaggccu

SEQ ID NO: 3335270 - RNA, 21 nt, Human
gcuggguggcaccagcagccu

SEQ ID NO: 3335271 - RNA, 22 nt, Human
gcuggguggcaccagcagccug

SEQ ID NO: 3335272 - RNA, 23 nt, Human
gcuggguggcaccagcagccugg

SEQ ID NO: 3335273 - RNA, 18 nt, Human
gcuucacggaagagccuu

SEQ ID NO: 3335274 - RNA, 12 nt, Human
gcuucagccucc

SEQ ID NO: 3335275 - RNA, 17 nt, Human
gcuucacggaagagccu

SEQ ID NO: 3335276 - RNA, 15 nt, Human
gcuucacggaagagc

SEQ ID NO: 3335277 - RNA, 20 nt, Human
gcuucaaggauccugagcca

SEQ ID NO: 3335278 - RNA, 21 nt, Human
gcuucaaggauccugagccag

SEQ ID NO: 3335279 - RNA, 19 nt, Human
gcuucaaggauccugagcc

SEQ ID NO: 3335280 - RNA, 18 nt, Human
gcuucaaggauccugagc

SEQ ID NO: 3335281 - RNA, 22 nt, Human
gcuugaccuuuaagagaaauga

SEQ ID NO: 3335282 - RNA, 14 nt, Human
gcuugagcucagga

SEQ ID NO: 3335283 - RNA, 20 nt, Human
gcuuguaaauagcucaggug

SEQ ID NO: 3335284 - RNA, 23 nt, Human
gcuucuucagagacuccugcagg

SEQ ID NO: 3335285 - RNA, 22 nt, Human
gcuuccucauaguaugguggcu

SEQ ID NO: 3335286 - RNA, 13 nt, Human
ggaagacuuugga

SEQ ID NO: 3335287 - RNA, 17 nt, Human
ggaagacuuuggaaaga

SEQ ID NO: 3335288 - RNA, 12 nt, Human
ggaagacuuugg

SEQ ID NO: 3335289 - RNA, 13 nt, Human
ggaagacagcucu

SEQ ID NO: 3335290 - RNA, 14 nt, Human
ggaagacagcucuu

SEQ ID NO: 3335291 - RNA, 22 nt, Human
ggaagacaaugugaaaagaaaa

SEQ ID NO: 3335292 - RNA, 13 nt, Human
ggaagagaaaaaa

SEQ ID NO: 3335293 - RNA, 18 nt, Human
ggaagacuuuggaaagag

SEQ ID NO: 3335294 - RNA, 15 nt, Human
ggaagagaaaaaaua

SEQ ID NO: 3335295 - RNA, 15 nt, Human
ggaacacucugagac

SEQ ID NO: 3335296 - RNA, 16 nt, Human
ggaacacucugagacu

SEQ ID NO: 3335297 - RNA, 12 nt, Human
ggaacacucuga

SEQ ID NO: 3335298 - RNA, 14 nt, Human
ggaacacucugaga

SEQ ID NO: 3335299 - RNA, 19 nt, Human
ggaacacuccuucacagau

SEQ ID NO: 3335300 - RNA, 22 nt, Human
ggacaaggaugaucuaggaaga

SEQ ID NO: 3335301 - RNA, 23 nt, Human
ggacaaggaugaucuaggaagac

SEQ ID NO: 3335302 - RNA, 13 nt, Human
ggacaagagcagg

SEQ ID NO: 3335303 - RNA, 18 nt, Human
ggaauaacauguaauuaa

SEQ ID NO: 3335304 - RNA, 16 nt, Human
ggaauccagacccggc

SEQ ID NO: 3335305 - RNA, 18 nt, Human
ggacacagcucuucucca

SEQ ID NO: 3335306 - RNA, 15 nt, Human
ggacacagcucuucu

SEQ ID NO: 3335307 - RNA, 14 nt, Human
ggacacagcucuuc

SEQ ID NO: 3335308 - RNA, 17 nt, Human
ggacagcuccuucuguc

SEQ ID NO: 3335309 - RNA, 20 nt, Human
ggacagcuccuucuguccua

SEQ ID NO: 3335310 - RNA, 19 nt, Human
ggacagcuccuucuguccu

SEQ ID NO: 3335311 - RNA, 17 nt, Human
ggacacuaaccacgcug

SEQ ID NO: 3335312 - RNA, 16 nt, Human
ggaaggaaacccagcu

SEQ ID NO: 3335313 - RNA, 23 nt, Human
ggaagcucagggccuggcucagg

SEQ ID NO: 3335314 - RNA, 11 nt, Human
ggaagcuccgc

SEQ ID NO: 3335315 - RNA, 22 nt, Human
ggaagcucagggccuggcucag

SEQ ID NO: 3335316 - RNA, 19 nt, Human
ggaaggaaacccagcucug

SEQ ID NO: 3335317 - RNA, 20 nt, Human
ggaaggaaacccagcucugg

SEQ ID NO: 3335318 - RNA, 24 nt, Human
ggacuaacuugucuuuggacccug

SEQ ID NO: 3335319 - RNA, 14 nt, Human
ggacuacaggugug

SEQ ID NO: 3335320 - RNA, 15 nt, Human
ggacucaaugcacug

SEQ ID NO: 3335321 - RNA, 20 nt, Human
ggacuaacuugucuuuggac

SEQ ID NO: 3335322 - RNA, 16 nt, Human
ggacucaaugcacuga

SEQ ID NO: 3335323 - RNA, 14 nt, Human
ggacuuggaagcuc

SEQ ID NO: 3335324 - RNA, 16 nt, Human
ggagaaaggaagggcu

SEQ ID NO: 3335325 - RNA, 14 nt, Human
ggaccucaggccug

SEQ ID NO: 3335326 - RNA, 15 nt, Human
ggaccucaggccugg

SEQ ID NO: 3335327 - RNA, 20 nt, Human
ggacguguuaugacuccaga

SEQ ID NO: 3335328 - RNA, 13 nt, Human
ggaccucaggccu

SEQ ID NO: 3335329 - RNA, 12 nt, Human
ggaccucaggcc

SEQ ID NO: 3335330 - RNA, 12 nt, Human
ggacccugaggc

SEQ ID NO: 3335331 - RNA, 19 nt, Human
ggacccugaggcccagagg

SEQ ID NO: 3335332 - RNA, 11 nt, Human
ggacccugagg

SEQ ID NO: 3335333 - RNA, 12 nt, Human
ggacccccugaa

SEQ ID NO: 3335334 - RNA, 18 nt, Human
ccaccaucaugucuggcu

SEQ ID NO: 3335335 - RNA, 18 nt, Human
ccaccaucaccagacagg

SEQ ID NO: 3335336 - RNA, 19 nt, Human
ccaccaucaugucuggcua

SEQ ID NO: 3335337 - RNA, 16 nt, Human
ccaccuuggcugcagg

SEQ ID NO: 3335338 - RNA, 15 nt, Human
ccaccuuggcugcag

SEQ ID NO: 3335339 - RNA, 14 nt, Human
ccaccuuggcugca

SEQ ID NO: 3335340 - RNA, 12 nt, Human
ccaccuuggcug

SEQ ID NO: 3335341 - RNA, 19 nt, Human
ccaccuuggcugcagggag

SEQ ID NO: 3335342 - RNA, 18 nt, Human
ccaccuuggcugcaggga

SEQ ID NO: 3335343 - RNA, 16 nt, Human
ccaccuuggcucaagu

SEQ ID NO: 3335344 - RNA, 18 nt, Human
ccacgcuggaccuugaac

SEQ ID NO: 3335345 - RNA, 22 nt, Human
ccacagagaaaguacuucucca

SEQ ID NO: 3335346 - RNA, 13 nt, Human
ccaagaagcccag

SEQ ID NO: 3335347 - RNA, 13 nt, Human
ccaacgucugugc

SEQ ID NO: 3335348 - RNA, 15 nt, Human
ccaacgucugugcca

SEQ ID NO: 3335349 - RNA, 22 nt, Human
ccaaauggaaaugggcagagca

SEQ ID NO: 3335350 - RNA, 15 nt, Human
ccaaggccaaaggaa

SEQ ID NO: 3335351 - RNA, 14 nt, Human
ccaagaagcccagg

SEQ ID NO: 3335352 - RNA, 19 nt, Human
ccaagcuggucccacucag

SEQ ID NO: 3335353 - RNA, 12 nt, Human
ccaagcuggucc

SEQ ID NO: 3335354 - RNA, 19 nt, Human
cauuuuuuaaaugcaccug

SEQ ID NO: 3335355 - RNA, 15 nt, Human
cauuuuuuaaaugca

SEQ ID NO: 3335356 - RNA, 16 nt, Human
cauuuuuuaaaugcac

SEQ ID NO: 3335357 - RNA, 14 nt, Human
cauuuauucugcuc

SEQ ID NO: 3335358 - RNA, 17 nt, Human
cauuugucacacacuuu

SEQ ID NO: 3335359 - RNA, 15 nt, Human
cauuuggauuggaug

SEQ ID NO: 3335360 - RNA, 22 nt, Human
caugauuaaccacuucagcuga

SEQ ID NO: 3335361 - RNA, 23 nt, Human
caugauuaaccacuucagcugac

SEQ ID NO: 3335362 - RNA, 12 nt, Human
caugcugcccug

SEQ ID NO: 3335363 - RNA, 13 nt, Human
caugcugcccugu

SEQ ID NO: 3335364 - RNA, 13 nt, Human
caugcuccuggcc

SEQ ID NO: 3335365 - RNA, 16 nt, Human
caugcacgugugugca

SEQ ID NO: 3335366 - RNA, 15 nt, Human
caugaaguaauaugc

SEQ ID NO: 3335367 - RNA, 19 nt, Human
caugaaguaauaugcacac

SEQ ID NO: 3335368 - RNA, 22 nt, Human
caugaaguaauaugcacacauu

SEQ ID NO: 3335369 - RNA, 23 nt, Human
caugaaguaauaugcacacauuu

SEQ ID NO: 3335370 - RNA, 21 nt, Human
caugacacgaauauugcugau

SEQ ID NO: 3335371 - RNA, 23 nt, Human
caugacacgaauauugcugaugg

SEQ ID NO: 3335372 - RNA, 14 nt, Human
caugcugcccugug

SEQ ID NO: 3335373 - RNA, 12 nt, Human
cauuccuguucc

SEQ ID NO: 3335374 - RNA, 19 nt, Human
cauguccaagaagcccagg

SEQ ID NO: 3335375 - RNA, 20 nt, Human
cauguccaagaagcccagga

SEQ ID NO: 3335376 - RNA, 18 nt, Human
cauguccaagaagcccag

SEQ ID NO: 3335377 - RNA, 16 nt, Human
cauguccaagaagccc

SEQ ID NO: 3335378 - RNA, 12 nt, Human
cauguuggccag

SEQ ID NO: 3335379 - RNA, 22 nt, Human
cauuaggugugacugaauuucu

SEQ ID NO: 3335380 - RNA, 23 nt, Human
cauuaucuagauacuguaucaug

SEQ ID NO: 3335381 - RNA, 18 nt, Human
cauuaucuagauacugua

SEQ ID NO: 3335382 - RNA, 20 nt, Human
cauauucaggaagcucaggg

SEQ ID NO: 3335383 - RNA, 14 nt, Human
cauauucaggaagc

SEQ ID NO: 3335384 - RNA, 15 nt, Human
cauauucaggaagcu

SEQ ID NO: 3335385 - RNA, 22 nt, Human
cauaugccugggcagaaggaag

SEQ ID NO: 3335386 - RNA, 13 nt, Human
cauaugccugggc

SEQ ID NO: 3335387 - RNA, 15 nt, Human
cauaugccugggcag

SEQ ID NO: 3335388 - RNA, 20 nt, Human
cauaugccugggcagaagga

SEQ ID NO: 3335389 - RNA, 22 nt, Human
cauagcagagaaugaaagggcc

SEQ ID NO: 3335390 - RNA, 19 nt, Human
cauagcagagaaugaaagg

SEQ ID NO: 3335391 - RNA, 13 nt, Human
cauacacgaaaga

SEQ ID NO: 3335392 - RNA, 17 nt, Human
cauacacgaaagagaga

SEQ ID NO: 3335393 - RNA, 19 nt, Human
caucccauaugccugggca

SEQ ID NO: 3335394 - RNA, 14 nt, Human
cauccccuguagag

SEQ ID NO: 3335395 - RNA, 15 nt, Human
caucaggccaggccc

SEQ ID NO: 3335396 - RNA, 14 nt, Human
caucaggccaggcc

SEQ ID NO: 3335397 - RNA, 16 nt, Human
caucaggccaggcccu

SEQ ID NO: 3335398 - RNA, 19 nt, Human
caucaggccaggcccucug

SEQ ID NO: 3335399 - RNA, 17 nt, Human
caucccagccccaauga

SEQ ID NO: 3335400 - RNA, 18 nt, Human
cagguuuaagcuguuacu

SEQ ID NO: 3335401 - RNA, 14 nt, Human
cagguuuaagcugu

SEQ ID NO: 3335402 - RNA, 16 nt, Human
cagguuuaagcuguua

SEQ ID NO: 3335403 - RNA, 22 nt, Human
cagucaccccggccaccugcgg

SEQ ID NO: 3335404 - RNA, 20 nt, Human
cagucaccccggccaccugc

SEQ ID NO: 3335405 - RNA, 19 nt, Human
cagucaccccggccaccug

SEQ ID NO: 3335406 - RNA, 22 nt, Human
caggugcacaagcuccaagcuc

SEQ ID NO: 3335407 - RNA, 17 nt, Human
caggugauccacccacc

SEQ ID NO: 3335408 - RNA, 16 nt, Human
caggugauccacccac

SEQ ID NO: 3335409 - RNA, 12 nt, Human
caggguuggccc

SEQ ID NO: 3335410 - RNA, 14 nt, Human
cagguugguggggg

SEQ ID NO: 3335411 - RNA, 18 nt, Human
caggugcuaggaacacuc

SEQ ID NO: 3335412 - RNA, 20 nt, Human
caggugcuaggaacacuccu

SEQ ID NO: 3335413 - RNA, 14 nt, Human
caggugcgaaagga

SEQ ID NO: 3335414 - RNA, 18 nt, Human
cagggucucacucugucg

SEQ ID NO: 3335415 - RNA, 17 nt, Human
cagggucucacucuguc

SEQ ID NO: 3335416 - RNA, 21 nt, Human
cagggucucacucugucgccc

SEQ ID NO: 3335417 - RNA, 22 nt, Human
cagugcaugcugucccuuacgu

SEQ ID NO: 3335418 - RNA, 23 nt, Human
cagugcaugcugucccuuacgug

SEQ ID NO: 3335419 - RNA, 19 nt, Human
cagugcaugcugucccuua

SEQ ID NO: 3335420 - RNA, 19 nt, Human
cagucugauucccaagcuc

SEQ ID NO: 3335421 - RNA, 11 nt, Human
cagugggagcu

SEQ ID NO: 3335422 - RNA, 15 nt, Human
cagugccaaaaacaa

SEQ ID NO: 3335423 - RNA, 14 nt, Human
caggaggccagccu

SEQ ID NO: 3335424 - RNA, 15 nt, Human
caggaggccagccuu

SEQ ID NO: 3335425 - RNA, 16 nt, Human
caggaggccagccuug

SEQ ID NO: 3335426 - RNA, 18 nt, Human
caggcacccaccaucaug

SEQ ID NO: 3335427 - RNA, 23 nt, Human
caggcacccaccaucaugucugg

SEQ ID NO: 3335428 - RNA, 22 nt, Human
caggcacccaccaucaugucug

SEQ ID NO: 3335429 - RNA, 17 nt, Human
caggaggccagccuuga

SEQ ID NO: 3335430 - RNA, 21 nt, Human
caggccagagggagugacaga

SEQ ID NO: 3335431 - RNA, 19 nt, Human
caggccagagggagugaca

SEQ ID NO: 3335432 - RNA, 16 nt, Human
caggccagagggagug

SEQ ID NO: 3335433 - RNA, 18 nt, Human
cagggaggugaccccagg

SEQ ID NO: 3335434 - RNA, 22 nt, Human
cagggaguccgaaagggacuug

SEQ ID NO: 3335435 - RNA, 15 nt, Human
caggcugggcuucag

SEQ ID NO: 3335436 - RNA, 16 nt, Human
caggcugggcuucagu

SEQ ID NO: 3335437 - RNA, 17 nt, Human
caggcugggcuucagug

SEQ ID NO: 3335438 - RNA, 16 nt, Human
cagagcugccaccugc

SEQ ID NO: 3335439 - RNA, 18 nt, Human
cagagcugccaccugccu

SEQ ID NO: 3335440 - RNA, 20 nt, Human
cagaaguuugagaucagccu

SEQ ID NO: 3335441 - RNA, 23 nt, Human
cagaaguuucugccgcagcccug

SEQ ID NO: 3335442 - RNA, 22 nt, Human
cagaaguuugagaucagccugg

SEQ ID NO: 3335443 - RNA, 19 nt, Human
cagagggccugcaagggag

SEQ ID NO: 3335444 - RNA, 22 nt, Human
cagagggccugcaagggaguga

SEQ ID NO: 3335445 - RNA, 18 nt, Human
cagaggggguggccuccc

SEQ ID NO: 3335446 - RNA, 17 nt, Human
cagaggggguggccucc

SEQ ID NO: 3335447 - RNA, 19 nt, Human
cagaggggguggccuccca

SEQ ID NO: 3335448 - RNA, 20 nt, Human
cagaggggguggccucccaa

SEQ ID NO: 3335449 - RNA, 20 nt, Human
cagagucagaaguuucugcc

SEQ ID NO: 3335450 - RNA, 12 nt, Human
cagccaggccac

SEQ ID NO: 3335451 - RNA, 13 nt, Human
cagccaggccaca

SEQ ID NO: 3335452 - RNA, 19 nt, Human
cagcauauucaggaagcuc

SEQ ID NO: 3335453 - RNA, 22 nt, Human
cagcauauucaggaagcucagg

SEQ ID NO: 3335454 - RNA, 23 nt, Human
cagcauauucaggaagcucaggg

SEQ ID NO: 3335455 - RNA, 15 nt, Human
cagcuccagcucacc

SEQ ID NO: 3335456 - RNA, 14 nt, Human
cagcuccagcucac

SEQ ID NO: 3335457 - RNA, 13 nt, Human
cagcuccagcuca

SEQ ID NO: 3335458 - RNA, 20 nt, Human
cagcuccagcucaccagccc

SEQ ID NO: 3335459 - RNA, 18 nt, Human
cagcuccagcucaccagc

SEQ ID NO: 3335460 - RNA, 17 nt, Human
cagcuccagcucaccag

SEQ ID NO: 3335461 - RNA, 16 nt, Human
cagcuccagcucacca

SEQ ID NO: 3335462 - RNA, 22 nt, Human
cagcuccagcucaccagcccca

SEQ ID NO: 3335463 - RNA, 14 nt, Human
caggaaaggcucca

SEQ ID NO: 3335464 - RNA, 15 nt, Human
caggaaaggcuccag

SEQ ID NO: 3335465 - RNA, 18 nt, Human
cagcugugcucuggacag

SEQ ID NO: 3335466 - RNA, 15 nt, Human
cagcuucauuuccug

SEQ ID NO: 3335467 - RNA, 18 nt, Human
cagcuucauuuccugugu

SEQ ID NO: 3335468 - RNA, 12 nt, Human
cagccccuggau

SEQ ID NO: 3335469 - RNA, 13 nt, Human
cagccccuggaug

SEQ ID NO: 3335470 - RNA, 14 nt, Human
cagccccuggaugc

SEQ ID NO: 3335471 - RNA, 17 nt, Human
cagccccuggaugcagc

SEQ ID NO: 3335472 - RNA, 18 nt, Human
cagccccuggaugcagcc

SEQ ID NO: 3335473 - RNA, 19 nt, Human
cagccccuggaugcagccu

SEQ ID NO: 3335474 - RNA, 21 nt, Human
cagccccuggaugcagccuca

SEQ ID NO: 3335475 - RNA, 21 nt, Human
cagcccuuagcagggaaacag

SEQ ID NO: 3335476 - RNA, 16 nt, Human
cagcccuuagcaggga

SEQ ID NO: 3335477 - RNA, 15 nt, Human
cagcccuuagcaggg

SEQ ID NO: 3335478 - RNA, 20 nt, Human
cagccgagauagccaaggcc

SEQ ID NO: 3335479 - RNA, 21 nt, Human
cagccgagauagccaaggcca

SEQ ID NO: 3335480 - RNA, 16 nt, Human
cagcggggacagcucc

SEQ ID NO: 3335481 - RNA, 14 nt, Human
cagcggggacagcu

SEQ ID NO: 3335482 - RNA, 15 nt, Human
cagcggggacagcuc

SEQ ID NO: 3335483 - RNA, 17 nt, Human
auucuccuuguguuacu

SEQ ID NO: 3335484 - RNA, 18 nt, Human
auucuccuuguguuacua

SEQ ID NO: 3335485 - RNA, 19 nt, Human
auucuccuuguguuacuaa

SEQ ID NO: 3335486 - RNA, 21 nt, Human
auucuccuuguguuacuaagu

SEQ ID NO: 3335487 - RNA, 22 nt, Human
auucuccuuguguuacuaaguu

SEQ ID NO: 3335488 - RNA, 17 nt, Human
auucucuaguuugauua

SEQ ID NO: 3335489 - RNA, 18 nt, Human
auucucuaguuugauuaa

SEQ ID NO: 3335490 - RNA, 22 nt, Human
auucuucuguacgucugacagg

SEQ ID NO: 3335491 - RNA, 20 nt, Human
auucuucugcuucagccucc

SEQ ID NO: 3335492 - RNA, 19 nt, Human
auucuucugcuucagccuc

SEQ ID NO: 3335493 - RNA, 15 nt, Human
auucuugcaaaguau

SEQ ID NO: 3335494 - RNA, 16 nt, Human
auucuugcaaaguauc

SEQ ID NO: 3335495 - RNA, 14 nt, Human
auucuugcaaagua

SEQ ID NO: 3335496 - RNA, 14 nt, Human
auucuucugcuuca

SEQ ID NO: 3335497 - RNA, 18 nt, Human
auucaacagguuuuccug

SEQ ID NO: 3335498 - RNA, 14 nt, Human
auucaaccauggac

SEQ ID NO: 3335499 - RNA, 17 nt, Human
auucaaccauggacuuu

SEQ ID NO: 3335500 - RNA, 17 nt, Human
auuaaaugcccagcccc

SEQ ID NO: 3335501 - RNA, 19 nt, Human
auuaaaugcccagccccuu

SEQ ID NO: 3335502 - RNA, 23 nt, Human
auuaugcaugaaguaauaugcac

SEQ ID NO: 3335503 - RNA, 18 nt, Human
auugcuugagcucaggag

SEQ ID NO: 3335504 - RNA, 14 nt, Human
auuucacucuccuu

SEQ ID NO: 3335505 - RNA, 20 nt, Human
auuuaaugaaagacuguaca

SEQ ID NO: 3335506 - RNA, 15 nt, Human
auuuaaugaaagacu

SEQ ID NO: 3335507 - RNA, 16 nt, Human
auuuaaugaaagacug

SEQ ID NO: 3335508 - RNA, 20 nt, Human
auuuuuuuuuccuucagugc

SEQ ID NO: 3335509 - RNA, 22 nt, Human
auuuuuuuuuccuucagugccu

SEQ ID NO: 3335510 - RNA, 17 nt, Human
auuuuuuuuuccuucag

SEQ ID NO: 3335511 - RNA, 19 nt, Human
caaaagcugggcagguugg

SEQ ID NO: 3335512 - RNA, 18 nt, Human
auuuuuuuuuccuucagu

SEQ ID NO: 3335513 - RNA, 16 nt, Human
auuuuuuugagacaga

SEQ ID NO: 3335514 - RNA, 16 nt, Human
auuuuuaagugcugca

SEQ ID NO: 3335515 - RNA, 18 nt, Human
auuuuuaagugcugcauu

SEQ ID NO: 3335516 - RNA, 19 nt, Human
auuuuuaagugcugcauuu

SEQ ID NO: 3335517 - RNA, 13 nt, Human
auuuuuaagugcu

SEQ ID NO: 3335518 - RNA, 14 nt, Human
auuuuuagacagag

SEQ ID NO: 3335519 - RNA, 23 nt, Human
caaaugcuguaacuuucugaaau

SEQ ID NO: 3335520 - RNA, 21 nt, Human
caaaucugcuuuuuaaagaau

SEQ ID NO: 3335521 - RNA, 19 nt, Human
caaaguaucccuacuguaa

SEQ ID NO: 3335522 - RNA, 21 nt, Human
caaaguaucccuacuguaauu

SEQ ID NO: 3335523 - RNA, 22 nt, Human
caaaguagaagucuuagaugua

SEQ ID NO: 3335524 - RNA, 14 nt, Human
caaagauauuuugc

SEQ ID NO: 3335525 - RNA, 16 nt, Human
caaagauauuuugcuu

SEQ ID NO: 3335526 - RNA, 18 nt, Human
caaagcagugcaugcugu

SEQ ID NO: 3335527 - RNA, 21 nt, Human
caaagcagugcaugcuguccc

SEQ ID NO: 3335528 - RNA, 22 nt, Human
caaagcagugcaugcugucccu

SEQ ID NO: 3335529 - RNA, 17 nt, Human
caacucaccccagcccc

SEQ ID NO: 3335530 - RNA, 18 nt, Human
caacucaccccagcccca

SEQ ID NO: 3335531 - RNA, 15 nt, Human
caaccauggacuuua

SEQ ID NO: 3335532 - RNA, 14 nt, Human
caaccauggacuuu

SEQ ID NO: 3335533 - RNA, 13 nt, Human
caaccauggacuu

SEQ ID NO: 3335534 - RNA, 14 nt, Human
caacucuccuccag

SEQ ID NO: 3335535 - RNA, 22 nt, Human
caagaauugaagcaggacuaaa

SEQ ID NO: 3335536 - RNA, 17 nt, Human
caagaccacguuucuaa

SEQ ID NO: 3335537 - RNA, 18 nt, Human
caagaccacguuucuaaa

SEQ ID NO: 3335538 - RNA, 16 nt, Human
caagaccacguuucua

SEQ ID NO: 3335539 - RNA, 12 nt, Human
cacacauuuuuu

SEQ ID NO: 3335540 - RNA, 16 nt, Human
cacacauuuuuuaaau

SEQ ID NO: 3335541 - RNA, 19 nt, Human
cacacauuuuuuaaaugca

SEQ ID NO: 3335542 - RNA, 20 nt, Human
cacacauuuuuuaaaugcac

SEQ ID NO: 3335543 - RNA, 10 nt, Human
cacacauuuu

SEQ ID NO: 3335544 - RNA, 11 nt, Human
cacacauuuuu

SEQ ID NO: 3335545 - RNA, 10 nt, Human
cacagcucuu

SEQ ID NO: 3335546 - RNA, 18 nt, Human
cacagcucuguccuggga

SEQ ID NO: 3335547 - RNA, 16 nt, Human
cacagcucuguccugg

SEQ ID NO: 3335548 - RNA, 15 nt, Human
cacagcucuguccug

SEQ ID NO: 3335549 - RNA, 15 nt, Human
cacagcucuucucca

SEQ ID NO: 3335550 - RNA, 14 nt, Human
cacagcucuucucc

SEQ ID NO: 3335551 - RNA, 17 nt, Human
cacagcucuucuccagg

SEQ ID NO: 3335552 - RNA, 14 nt, Human
cacagcucuguccu

SEQ ID NO: 3335553 - RNA, 11 nt, Human
cacagcucugu

SEQ ID NO: 3335554 - RNA, 16 nt, Human
cacagacccugcccug

SEQ ID NO: 3335555 - RNA, 17 nt, Human
cacagacccugcccugu

SEQ ID NO: 3335556 - RNA, 13 nt, Human
cacagacccugcc

SEQ ID NO: 3335557 - RNA, 14 nt, Human
cacagacccugccc

SEQ ID NO: 3335558 - RNA, 14 nt, Human
caccaacgucugug

SEQ ID NO: 3335559 - RNA, 17 nt, Human
cacauuuuauuuuauua

SEQ ID NO: 3335560 - RNA, 19 nt, Human
cacauuuuauuuuauuaug

SEQ ID NO: 3335561 - RNA, 20 nt, Human
cacauuuuauuuuauuaugc

SEQ ID NO: 3335562 - RNA, 17 nt, Human
cacccaccucagccucc

SEQ ID NO: 3335563 - RNA, 13 nt, Human
caccagccccagu

SEQ ID NO: 3335564 - RNA, 18 nt, Human
cacccaccucagccuccc

SEQ ID NO: 3335565 - RNA, 20 nt, Human
cacaagcuccaagcucccag

SEQ ID NO: 3335566 - RNA, 13 nt, Human
caaugcuggcugu

SEQ ID NO: 3335567 - RNA, 20 nt, Human
caaugcuggcuguuggcugg

SEQ ID NO: 3335568 - RNA, 12 nt, Human
caaugcuggcug

SEQ ID NO: 3335569 - RNA, 16 nt, Human
caauggcagccuuggc

SEQ ID NO: 3335570 - RNA, 17 nt, Human
cacaagagcccaggccu

SEQ ID NO: 3335571 - RNA, 20 nt, Human
cacaagagcccaggccuccu

SEQ ID NO: 3335572 - RNA, 18 nt, Human
cacaagcuccaagcuccc

SEQ ID NO: 3335573 - RNA, 19 nt, Human
cacaagcuccaagcuccca

SEQ ID NO: 3335574 - RNA, 18 nt, Human
cacaagagcccaggccuc

SEQ ID NO: 3335575 - RNA, 19 nt, Human
cacaagagcccaggccucc

SEQ ID NO: 3335576 - RNA, 19 nt, Human
caaggccaaaggaagcaca

SEQ ID NO: 3335577 - RNA, 20 nt, Human
caaggccaaaggaagcacau

SEQ ID NO: 3335578 - RNA, 21 nt, Human
caaggccaaaggaagcacaug

SEQ ID NO: 3335579 - RNA, 18 nt, Human
caaggcaaggcugucaau

SEQ ID NO: 3335580 - RNA, 17 nt, Human
caaggcaaggcugucaa

SEQ ID NO: 3335581 - RNA, 16 nt, Human
caaggcaaggcuguca

SEQ ID NO: 3335582 - RNA, 18 nt, Human
cacuuguguuaugaagca

SEQ ID NO: 3335583 - RNA, 16 nt, Human
cacuuucuagccagag

SEQ ID NO: 3335584 - RNA, 17 nt, Human
cacuuucuagccagagg

SEQ ID NO: 3335585 - RNA, 13 nt, Human
cacuuucuagcca

SEQ ID NO: 3335586 - RNA, 14 nt, Human
cacugcagccucaa

SEQ ID NO: 3335587 - RNA, 19 nt, Human
cacugcagccucaaccucc

SEQ ID NO: 3335588 - RNA, 23 nt, Human
cacugcagccucaaccuccuggg

SEQ ID NO: 3335589 - RNA, 22 nt, Human
cacugcagccucaaccuccugg

SEQ ID NO: 3335590 - RNA, 21 nt, Human
cacugcagccucaaccuccug

SEQ ID NO: 3335591 - RNA, 20 nt, Human
cacugcagccucaaccuccu

SEQ ID NO: 3335592 - RNA, 19 nt, Human
cacuguugcccaggcuggc

SEQ ID NO: 3335593 - RNA, 18 nt, Human
cacuguugcccaggcugg

SEQ ID NO: 3335594 - RNA, 23 nt, Human
cacuguugcccaggcuggcgugc

SEQ ID NO: 3335595 - RNA, 17 nt, Human
cacuguugcccaggcug

SEQ ID NO: 3335596 - RNA, 16 nt, Human
cagaaauguacagcaa

SEQ ID NO: 3335597 - RNA, 14 nt, Human
cagaaguuucugcc

SEQ ID NO: 3335598 - RNA, 16 nt, Human
cagaaguuucugccgc

SEQ ID NO: 3335599 - RNA, 16 nt, Human
caccuuggcugcaggg

SEQ ID NO: 3335600 - RNA, 15 nt, Human
caccuuggcugcagg

SEQ ID NO: 3335601 - RNA, 18 nt, Human
caccuuggcugcagggag

SEQ ID NO: 3335602 - RNA, 14 nt, Human
caccuuggcugcag

SEQ ID NO: 3335603 - RNA, 17 nt, Human
caccuuuguccccaccg

SEQ ID NO: 3335604 - RNA, 14 nt, Human
caccuuucccaucu

SEQ ID NO: 3335605 - RNA, 13 nt, Human
cacgaaagagaga

SEQ ID NO: 3335606 - RNA, 22 nt, Human
cacgaaagagagagaaacaaac

SEQ ID NO: 3335607 - RNA, 22 nt, Human
cacucuuauugcccacgcugga

SEQ ID NO: 3335608 - RNA, 21 nt, Human
cacucuuauugcccacgcugg

SEQ ID NO: 3335609 - RNA, 20 nt, Human
cacucuuauugcccacgcug

SEQ ID NO: 3335610 - RNA, 19 nt, Human
cacucuuauugcccacgcu

SEQ ID NO: 3335611 - RNA, 12 nt, Human
cacggccaggcc

SEQ ID NO: 3335612 - RNA, 17 nt, Human
cacggccaggccagagg

SEQ ID NO: 3335613 - RNA, 14 nt, Human
cacggcucacugca

SEQ ID NO: 3335614 - RNA, 20 nt, Human
cacucugucgcccagucugg

SEQ ID NO: 3335615 - RNA, 14 nt, Human
cacuccagccuggg

SEQ ID NO: 3335616 - RNA, 13 nt, Human
cacuccagccugg

SEQ ID NO: 3335617 - RNA, 16 nt, Human
cacuacauucuguuaa

SEQ ID NO: 3335618 - RNA, 17 nt, Human
cacuacauucuguuaau

SEQ ID NO: 3335619 - RNA, 21 nt, Human
cacuacauucuguuaaucauu

SEQ ID NO: 3335620 - RNA, 15 nt, Human
ccuggauggggcugc

SEQ ID NO: 3335621 - RNA, 17 nt, Human
ccuggauggggcugcac

SEQ ID NO: 3335622 - RNA, 18 nt, Human
ccuggauggggcugcacc

SEQ ID NO: 3335623 - RNA, 16 nt, Human
ccuggccccucagggu

SEQ ID NO: 3335624 - RNA, 18 nt, Human
ccuggccccucagggucc

SEQ ID NO: 3335625 - RNA, 20 nt, Human
ccuggccccucagggucccu

SEQ ID NO: 3335626 - RNA, 21 nt, Human
ccuggccccucagggucccug

SEQ ID NO: 3335627 - RNA, 22 nt, Human
ccuggccucaagugauucuccu

SEQ ID NO: 3335628 - RNA, 20 nt, Human
ccuggccugagcugggauga

SEQ ID NO: 3335629 - RNA, 15 nt, Human
ccuggggagaaagua

SEQ ID NO: 3335630 - RNA, 13 nt, Human
ccugguguggaag

SEQ ID NO: 3335631 - RNA, 19 nt, Human
ccugguggcagugggagcu

SEQ ID NO: 3335632 - RNA, 18 nt, Human
ccugguggcagugggagc

SEQ ID NO: 3335633 - RNA, 15 nt, Human
ccugguggcaguggg

SEQ ID NO: 3335634 - RNA, 15 nt, Human
ccucuuugagugaag

SEQ ID NO: 3335635 - RNA, 19 nt, Human
ccucuuucccucccuuccu

SEQ ID NO: 3335636 - RNA, 16 nt, Human
ccucuuucccucccuu

SEQ ID NO: 3335637 - RNA, 12 nt, Human
ccugcaggcagc

SEQ ID NO: 3335638 - RNA, 13 nt, Human
ccugcaggcagcc

SEQ ID NO: 3335639 - RNA, 14 nt, Human
ccugcaggcagcca

SEQ ID NO: 3335640 - RNA, 16 nt, Human
ccugaggggccucuua

SEQ ID NO: 3335641 - RNA, 14 nt, Human
ccugagguguacca

SEQ ID NO: 3335642 - RNA, 18 nt, Human
ccugcccaccuggccucu

SEQ ID NO: 3335643 - RNA, 19 nt, Human
ccugcccaggccccugcca

SEQ ID NO: 3335644 - RNA, 18 nt, Human
ccugcccaggccccugcc

SEQ ID NO: 3335645 - RNA, 14 nt, Human
ccugccucagccuc

SEQ ID NO: 3335646 - RNA, 21 nt, Human
ccugcccaggccccugccacc

SEQ ID NO: 3335647 - RNA, 15 nt, Human
ccugccucagccucc

SEQ ID NO: 3335648 - RNA, 16 nt, Human
ccugccucagccuccc

SEQ ID NO: 3335649 - RNA, 15 nt, Human
ccugcccaccuggcc

SEQ ID NO: 3335650 - RNA, 17 nt, Human
ccugcccaccuggccuc

SEQ ID NO: 3335651 - RNA, 20 nt, Human
ccuagccugugccucuggga

SEQ ID NO: 3335652 - RNA, 21 nt, Human
ccuagcauacguacacauuuu

SEQ ID NO: 3335653 - RNA, 23 nt, Human
ccuagccugugccucugggacug

SEQ ID NO: 3335654 - RNA, 19 nt, Human
ccuagccuuagaagucaca

SEQ ID NO: 3335655 - RNA, 22 nt, Human
ccuagccuuagaagucacacag

SEQ ID NO: 3335656 - RNA, 18 nt, Human
ccggccaccugcggugcu

SEQ ID NO: 3335657 - RNA, 17 nt, Human
ccggccaccugcggugc

SEQ ID NO: 3335658 - RNA, 14 nt, Human
cccuucucuccagc

SEQ ID NO: 3335659 - RNA, 19 nt, Human
cccuuuuuuggcugcugaa

SEQ ID NO: 3335660 - RNA, 21 nt, Human
cccuuuuuuggcugcugaagg

SEQ ID NO: 3335661 - RNA, 22 nt, Human
cccuuuuuuggcugcugaaggc

SEQ ID NO: 3335662 - RNA, 23 nt, Human
cccuuuuuuggcugcugaaggcu

SEQ ID NO: 3335663 - RNA, 23 nt, Human
cccugugaguacuacaguccucc

SEQ ID NO: 3335664 - RNA, 15 nt, Human
cccugugauggggcc

SEQ ID NO: 3335665 - RNA, 21 nt, Human
cccugugaguacuacaguccu

SEQ ID NO: 3335666 - RNA, 14 nt, Human
cccuccuuucacca

SEQ ID NO: 3335667 - RNA, 14 nt, Human
ccgcagcccugcag

SEQ ID NO: 3335668 - RNA, 18 nt, Human
ccgcagcccugcagaggg

SEQ ID NO: 3335669 - RNA, 16 nt, Human
ccucaacaccucugca

SEQ ID NO: 3335670 - RNA, 21 nt, Human
ccucaacucuccuccagaguc

SEQ ID NO: 3335671 - RNA, 23 nt, Human
ccucaacucuccuccagagucag

SEQ ID NO: 3335672 - RNA, 19 nt, Human
ccucaacucuccuccagag

SEQ ID NO: 3335673 - RNA, 15 nt, Human
ccucaaccuccuggg

SEQ ID NO: 3335674 - RNA, 18 nt, Human
ccucauuagcauuuugcu

SEQ ID NO: 3335675 - RNA, 12 nt, Human
ccucaggcaggu

SEQ ID NO: 3335676 - RNA, 18 nt, Human
ccucaggcaggugggaug

SEQ ID NO: 3335677 - RNA, 20 nt, Human
ccucaagugauucuccugcc

SEQ ID NO: 3335678 - RNA, 17 nt, Human
ccucccaucacccgcua

SEQ ID NO: 3335679 - RNA, 17 nt, Human
ccuccaagaccuucucc

SEQ ID NO: 3335680 - RNA, 19 nt, Human
ccuccaagaccuucuccuu

SEQ ID NO: 3335681 - RNA, 16 nt, Human
ccuccaagaccuucuc

SEQ ID NO: 3335682 - RNA, 12 nt, Human
ccucccaucacc

SEQ ID NO: 3335683 - RNA, 18 nt, Human
ccuccuuuucacaguucu

SEQ ID NO: 3335684 - RNA, 23 nt, Human
ccuccuuugugaggaagccgcug

SEQ ID NO: 3335685 - RNA, 20 nt, Human
ccuccuuugugaggaagccg

SEQ ID NO: 3335686 - RNA, 14 nt, Human
ccuccgccucuugg

SEQ ID NO: 3335687 - RNA, 13 nt, Human
ccuccgccucuug

SEQ ID NO: 3335688 - RNA, 14 nt, Human
ccaggcaggucuug

SEQ ID NO: 3335689 - RNA, 12 nt, Human
ccaggcaggucu

SEQ ID NO: 3335690 - RNA, 23 nt, Human
ccaggcaggucuugaacuccugg

SEQ ID NO: 3335691 - RNA, 12 nt, Human
ccaggcuggcgu

SEQ ID NO: 3335692 - RNA, 21 nt, Human
ccaggggaaaaucagccugcu

SEQ ID NO: 3335693 - RNA, 23 nt, Human
ccagccccuucugacccaugcug

SEQ ID NO: 3335694 - RNA, 24 nt, Human
ccagccccuucugacccaugcugc

SEQ ID NO: 3335695 - RNA, 18 nt, Human
ccagccccuucugaccca

SEQ ID NO: 3335696 - RNA, 12 nt, Human
ccagcagagcac

SEQ ID NO: 3335697 - RNA, 13 nt, Human
ccagcagagcacc

SEQ ID NO: 3335698 - RNA, 17 nt, Human
ccagccccagugcccac

SEQ ID NO: 3335699 - RNA, 15 nt, Human
ccagccccauccucu

SEQ ID NO: 3335700 - RNA, 17 nt, Human
ccagccccauccucugu

SEQ ID NO: 3335701 - RNA, 20 nt, Human
ccaugaggaacaaggcaagg

SEQ ID NO: 3335702 - RNA, 18 nt, Human
ccaugaggaacaaggcaa

SEQ ID NO: 3335703 - RNA, 23 nt, Human
ccaugaggaacaaggcaaggcug

SEQ ID NO: 3335704 - RNA, 18 nt, Human
ccaugaguccccuguuug

SEQ ID NO: 3335705 - RNA, 22 nt, Human
ccauccccuguagagugggagc

SEQ ID NO: 3335706 - RNA, 21 nt, Human
ccaucccauaugccugggcag

SEQ ID NO: 3335707 - RNA, 19 nt, Human
ccaucccauaugccugggc

SEQ ID NO: 3335708 - RNA, 20 nt, Human
ccaucccauaugccugggca

SEQ ID NO: 3335709 - RNA, 19 nt, Human
ccauccagguucagcuugu

SEQ ID NO: 3335710 - RNA, 18 nt, Human
ccauccagguucagcuug

SEQ ID NO: 3335711 - RNA, 18 nt, Human
ccaguuggucccccuucc

SEQ ID NO: 3335712 - RNA, 13 nt, Human
ccaguuggucccc

SEQ ID NO: 3335713 - RNA, 23 nt, Human
ccaguuggguggaugccuggugg

SEQ ID NO: 3335714 - RNA, 22 nt, Human
cccacugcuuuuggucugugug

SEQ ID NO: 3335715 - RNA, 23 nt, Human
cccacugcuuuuggucuguguga

SEQ ID NO: 3335716 - RNA, 13 nt, Human
cccacucccugca

SEQ ID NO: 3335717 - RNA, 12 nt, Human
cccacucccugc

SEQ ID NO: 3335718 - RNA, 12 nt, Human
cccaagcucugc

SEQ ID NO: 3335719 - RNA, 14 nt, Human
cccaagcucugcuc

SEQ ID NO: 3335720 - RNA, 13 nt, Human
cccaagcucugcu

SEQ ID NO: 3335721 - RNA, 17 nt, Human
cccaacucaccccagcc

SEQ ID NO: 3335722 - RNA, 20 nt, Human
cccaacucaccccagcccca

SEQ ID NO: 3335723 - RNA, 15 nt, Human
cccaacucaccccag

SEQ ID NO: 3335724 - RNA, 16 nt, Human
cccaacucaccccagc

SEQ ID NO: 3335725 - RNA, 23 nt, Human
ccauucuuacuuacuaaaauaua

SEQ ID NO: 3335726 - RNA, 22 nt, Human
ccauucuuacuuacuaaaauau

SEQ ID NO: 3335727 - RNA, 16 nt, Human
ccccugccacccuggg

SEQ ID NO: 3335728 - RNA, 14 nt, Human
ccccugccacccug

SEQ ID NO: 3335729 - RNA, 15 nt, Human
ccccugacaacacuc

SEQ ID NO: 3335730 - RNA, 18 nt, Human
cccgggaagggggcuggg

SEQ ID NO: 3335731 - RNA, 21 nt, Human
cccgggaagggggcugggaca

SEQ ID NO: 3335732 - RNA, 16 nt, Human
cccucaacaccucugc

SEQ ID NO: 3335733 - RNA, 16 nt, Human
cccucaacucuccucc

SEQ ID NO: 3335734 - RNA, 17 nt, Human
cccggccaccugcggug

SEQ ID NO: 3335735 - RNA, 18 nt, Human
cccgaauagcugggacua

SEQ ID NO: 3335736 - RNA, 17 nt, Human
cccgaauagcugggacu

SEQ ID NO: 3335737 - RNA, 16 nt, Human
cccgaauagcugggac

SEQ ID NO: 3335738 - RNA, 14 nt, Human
ccccuucugaccca

SEQ ID NO: 3335739 - RNA, 13 nt, Human
ccccuucugaccc

SEQ ID NO: 3335740 - RNA, 15 nt, Human
cccgggaagggggcu

SEQ ID NO: 3335741 - RNA, 12 nt, Human
cccgggaagggg

SEQ ID NO: 3335742 - RNA, 15 nt, Human
cccggccccugcugg

SEQ ID NO: 3335743 - RNA, 16 nt, Human
cccggccccugcuggu

SEQ ID NO: 3335744 - RNA, 23 nt, Human
ccccgaggccuucucugaaggac

SEQ ID NO: 3335745 - RNA, 14 nt, Human
ccccgcacugggcu

SEQ ID NO: 3335746 - RNA, 20 nt, Human
ccccagauugcaacaggcug

SEQ ID NO: 3335747 - RNA, 15 nt, Human
ccccagauugcaaca

SEQ ID NO: 3335748 - RNA, 15 nt, Human
cccauucugccugcc

SEQ ID NO: 3335749 - RNA, 14 nt, Human
cccauucugccugc

SEQ ID NO: 3335750 - RNA, 19 nt, Human
cccauucugccugcccagg

SEQ ID NO: 3335751 - RNA, 13 nt, Human
cccauucugccug

SEQ ID NO: 3335752 - RNA, 15 nt, Human
cccauuugcuccuuu

SEQ ID NO: 3335753 - RNA, 21 nt, Human
cccauccucuguacagagccc

SEQ ID NO: 3335754 - RNA, 22 nt, Human
cccauccucuguacagagccca

SEQ ID NO: 3335755 - RNA, 20 nt, Human
cccauccucuguacagagcc

SEQ ID NO: 3335756 - RNA, 23 nt, Human
cccagcaagugagagcugggugu

SEQ ID NO: 3335757 - RNA, 15 nt, Human
cccaggaaaggcucc

SEQ ID NO: 3335758 - RNA, 16 nt, Human
cccaggaaaggcucca

SEQ ID NO: 3335759 - RNA, 17 nt, Human
cccaggaaaggcuccag

SEQ ID NO: 3335760 - RNA, 18 nt, Human
cccaggaaaggcuccagg

SEQ ID NO: 3335761 - RNA, 20 nt, Human
cccaggcuuagucacugaga

SEQ ID NO: 3335762 - RNA, 22 nt, Human
cccaggcuuagucacugagaca

SEQ ID NO: 3335763 - RNA, 18 nt, Human
cgcugccccuggcagccc

SEQ ID NO: 3335764 - RNA, 23 nt, Human
cgcuggaccuugaacuggguacu

SEQ ID NO: 3335765 - RNA, 19 nt, Human
cgcuggaccuugaacuggg

SEQ ID NO: 3335766 - RNA, 16 nt, Human
cgcugccccuggcagc

SEQ ID NO: 3335767 - RNA, 17 nt, Human
cgcugccccuggcagcc

SEQ ID NO: 3335768 - RNA, 13 nt, Human
cgcugccccuggc

SEQ ID NO: 3335769 - RNA, 16 nt, Human
cgccuuaaggauguuc

SEQ ID NO: 3335770 - RNA, 17 nt, Human
cgcuggggccaguuggu

SEQ ID NO: 3335771 - RNA, 17 nt, Human
cggagaaaggaagggcu

SEQ ID NO: 3335772 - RNA, 14 nt, Human
cuaaagcugccagc

SEQ ID NO: 3335773 - RNA, 15 nt, Human
cuaaaggcuaccuuu

SEQ ID NO: 3335774 - RNA, 16 nt, Human
cuaaaggcuaccuuug

SEQ ID NO: 3335775 - RNA, 11 nt, Human
cuaaagcugcc

SEQ ID NO: 3335776 - RNA, 15 nt, Human
cuaaagcugccagcc

SEQ ID NO: 3335777 - RNA, 22 nt, Human
cuaaaguguauuuuuuuacuaa

SEQ ID NO: 3335778 - RNA, 17 nt, Human
cuaaaggcuaccuuugu

SEQ ID NO: 3335779 - RNA, 19 nt, Human
cuaaaggcuaccuuuguau

SEQ ID NO: 3335780 - RNA, 19 nt, Human
cuaaaguguauuuuuuuac

SEQ ID NO: 3335781 - RNA, 13 nt, Human
cguuaaaauacca

SEQ ID NO: 3335782 - RNA, 13 nt, Human
cguacacauuuua

SEQ ID NO: 3335783 - RNA, 15 nt, Human
cuaccugaggggccu

SEQ ID NO: 3335784 - RNA, 16 nt, Human
cuaccugaggggccuc

SEQ ID NO: 3335785 - RNA, 19 nt, Human
cuaccugaggggccucuua

SEQ ID NO: 3335786 - RNA, 23 nt, Human
cuaccugaggggccucuuauggg

SEQ ID NO: 3335787 - RNA, 19 nt, Human
cuagccagaggagagagga

SEQ ID NO: 3335788 - RNA, 17 nt, Human
cuagccagaggagagag

SEQ ID NO: 3335789 - RNA, 13 nt, Human
cuaggccuggcca

SEQ ID NO: 3335790 - RNA, 19 nt, Human
cuaggccuggccagaugca

SEQ ID NO: 3335791 - RNA, 18 nt, Human
cuaggccuggccagaugc

SEQ ID NO: 3335792 - RNA, 15 nt, Human
cuaggccuggccaga

SEQ ID NO: 3335793 - RNA, 14 nt, Human
cuaggccuggccag

SEQ ID NO: 3335794 - RNA, 12 nt, Human
cuaggccugggg

SEQ ID NO: 3335795 - RNA, 13 nt, Human
cuaggccugggga

SEQ ID NO: 3335796 - RNA, 16 nt, Human
cuagcauacguacaca

SEQ ID NO: 3335797 - RNA, 18 nt, Human
cuagcauacguacacauu

SEQ ID NO: 3335798 - RNA, 19 nt, Human
cuagcauacguacacauuu

SEQ ID NO: 3335799 - RNA, 15 nt, Human
cuaguuugauuaaau

SEQ ID NO: 3335800 - RNA, 20 nt, Human
cuaguuugauuaaauucuug

SEQ ID NO: 3335801 - RNA, 14 nt, Human
cuagggaagauaau

SEQ ID NO: 3335802 - RNA, 21 nt, Human
cuagggaaaaaccagcgugug

SEQ ID NO: 3335803 - RNA, 17 nt, Human
cuaguuugauuaaauuc

SEQ ID NO: 3335804 - RNA, 19 nt, Human
cuaguuugauuaaauucuu

SEQ ID NO: 3335805 - RNA, 14 nt, Human
cucacacaugagca

SEQ ID NO: 3335806 - RNA, 14 nt, Human
cucacaaaggaugc

SEQ ID NO: 3335807 - RNA, 12 nt, Human
cucaaauaacua

SEQ ID NO: 3335808 - RNA, 20 nt, Human
cuaucucccccagccccauc

SEQ ID NO: 3335809 - RNA, 19 nt, Human
cuauguaucaaugaguaac

SEQ ID NO: 3335810 - RNA, 18 nt, Human
cuaucucccccagcccca

SEQ ID NO: 3335811 - RNA, 17 nt, Human
cuaugugagcacaaagg

SEQ ID NO: 3335812 - RNA, 16 nt, Human
cuauguaucaaugagu

SEQ ID NO: 3335813 - RNA, 22 nt, Human
cuauguguagggcgggaggaug

SEQ ID NO: 3335814 - RNA, 15 nt, Human
cuauguugcccaggc

SEQ ID NO: 3335815 - RNA, 14 nt, Human
cuauguugcccagg

SEQ ID NO: 3335816 - RNA, 18 nt, Human
cucaaaaaaagaaaaaga

SEQ ID NO: 3335817 - RNA, 17 nt, Human
cucaaaaaaagaaaaag

SEQ ID NO: 3335818 - RNA, 16 nt, Human
cuauguugcccaggca

SEQ ID NO: 3335819 - RNA, 18 nt, Human
cucaccugccccucaacu

SEQ ID NO: 3335820 - RNA, 14 nt, Human
cucaccugccccuc

SEQ ID NO: 3335821 - RNA, 16 nt, Human
cucaccugccccucaa

SEQ ID NO: 3335822 - RNA, 13 nt, Human
cucaccugccccu

SEQ ID NO: 3335823 - RNA, 14 nt, Human
cucaccucucccuu

SEQ ID NO: 3335824 - RNA, 15 nt, Human
cucaccucucccuug

SEQ ID NO: 3335825 - RNA, 16 nt, Human
cucaccucucccuugg

SEQ ID NO: 3335826 - RNA, 17 nt, Human
cucaccucucccuugga

SEQ ID NO: 3335827 - RNA, 13 nt, Human
cucaccucucccu

SEQ ID NO: 3335828 - RNA, 15 nt, Human
cucccucuuucccuc

SEQ ID NO: 3335829 - RNA, 16 nt, Human
cucccucccucuuucc

SEQ ID NO: 3335830 - RNA, 19 nt, Human
cucccucuuucccucccuu

SEQ ID NO: 3335831 - RNA, 20 nt, Human
cuccgcuuucuacccagcga

SEQ ID NO: 3335832 - RNA, 21 nt, Human
cuccgcuuucuacccagcgag

SEQ ID NO: 3335833 - RNA, 22 nt, Human
cuccgcuuucuacccagcgagc

SEQ ID NO: 3335834 - RNA, 22 nt, Human
cuccagaauuucccaaagcagu

SEQ ID NO: 3335835 - RNA, 11 nt, Human
cuccagacaca

SEQ ID NO: 3335836 - RNA, 17 nt, Human
cucagaaucucaaauaa

SEQ ID NO: 3335837 - RNA, 16 nt, Human
cucagaaucucaaaua

SEQ ID NO: 3335838 - RNA, 21 nt, Human
cuccagaauuucccaaagcag

SEQ ID NO: 3335839 - RNA, 22 nt, Human
cuccaggcuguaucccaugagc

SEQ ID NO: 3335840 - RNA, 23 nt, Human
cuccaggcuguaucccaugagcc

SEQ ID NO: 3335841 - RNA, 13 nt, Human
cucccaccucagc

SEQ ID NO: 3335842 - RNA, 16 nt, Human
cucccaccucagccuc

SEQ ID NO: 3335843 - RNA, 14 nt, Human
cucccaccucagcc

SEQ ID NO: 3335844 - RNA, 19 nt, Human
cuccaggugcacaagcucc

SEQ ID NO: 3335845 - RNA, 20 nt, Human
cuccaggugcacaagcucca

SEQ ID NO: 3335846 - RNA, 18 nt, Human
cuccaggugcacaagcuc

SEQ ID NO: 3335847 - RNA, 16 nt, Human
cucugcacaagcugca

SEQ ID NO: 3335848 - RNA, 13 nt, Human
cucucccuuggau

SEQ ID NO: 3335849 - RNA, 13 nt, Human
cucuccuccuuuu

SEQ ID NO: 3335850 - RNA, 20 nt, Human
cucuccuccuuuucacaguu

SEQ ID NO: 3335851 - RNA, 16 nt, Human
cucuccgaccagacac

SEQ ID NO: 3335852 - RNA, 10 nt, Human
cucuccucug

SEQ ID NO: 3335853 - RNA, 11 nt, Human
cucggugccuu

SEQ ID NO: 3335854 - RNA, 23 nt, Human
cucgguguggagaagcggcuggc

SEQ ID NO: 3335855 - RNA, 22 nt, Human
cuccuagccugugccucuggga

SEQ ID NO: 3335856 - RNA, 17 nt, Human
cuccuuuagcgcccagu

SEQ ID NO: 3335857 - RNA, 16 nt, Human
cuccuuuagcgcccag

SEQ ID NO: 3335858 - RNA, 22 nt, Human
cuccuuuagcgcccaguugggu

SEQ ID NO: 3335859 - RNA, 23 nt, Human
cuccuuugugaggaagccgcugg

SEQ ID NO: 3335860 - RNA, 24 nt, Human
cuccuuuucacaguucucuccuuc

SEQ ID NO: 3335861 - RNA, 23 nt, Human
cugacacacagcucuguccuggg

SEQ ID NO: 3335862 - RNA, 22 nt, Human
cugacacacagcucuguccugg

SEQ ID NO: 3335863 - RNA, 21 nt, Human
cugacacacagcucuguccug

SEQ ID NO: 3335864 - RNA, 20 nt, Human
cugacacacagcucuguccu

SEQ ID NO: 3335865 - RNA, 19 nt, Human
cugacacacagcucugucc

SEQ ID NO: 3335866 - RNA, 18 nt, Human
cugacacacagcucuguc

SEQ ID NO: 3335867 - RNA, 17 nt, Human
cugacacacagcucugu

SEQ ID NO: 3335868 - RNA, 16 nt, Human
cugacacacagcucug

SEQ ID NO: 3335869 - RNA, 15 nt, Human
cugacacacagcucu

SEQ ID NO: 3335870 - RNA, 13 nt, Human
cugacacacagcu

SEQ ID NO: 3335871 - RNA, 22 nt, Human
cucuugauucauaaugacuuaa

SEQ ID NO: 3335872 - RNA, 23 nt, Human
cucuugagccuugaacuuugacc

SEQ ID NO: 3335873 - RNA, 15 nt, Human
cucuugagccuggga

SEQ ID NO: 3335874 - RNA, 13 nt, Human
cucuugagccugg

SEQ ID NO: 3335875 - RNA, 14 nt, Human
cucuugagccuggg

SEQ ID NO: 3335876 - RNA, 24 nt, Human
cucuugauucauaaugacuuaagc

SEQ ID NO: 3335877 - RNA, 17 nt, Human
cucugcacaagcugcac

SEQ ID NO: 3335878 - RNA, 18 nt, Human
cucugcacaagcugcacc

SEQ ID NO: 3335879 - RNA, 22 nt, Human
cugaggugggaggaucucuuga

SEQ ID NO: 3335880 - RNA, 13 nt, Human
cugaggugggagg

SEQ ID NO: 3335881 - RNA, 12 nt, Human
cugaggugggag

SEQ ID NO: 3335882 - RNA, 23 nt, Human
cugaggaauccagacccggcugc

SEQ ID NO: 3335883 - RNA, 14 nt, Human
cugaggggccucuu

SEQ ID NO: 3335884 - RNA, 12 nt, Human
cugagcugggau

SEQ ID NO: 3335885 - RNA, 22 nt, Human
cugagcugggaugauuggaggg

SEQ ID NO: 3335886 - RNA, 19 nt, Human
cugacccugcuucaaauau

SEQ ID NO: 3335887 - RNA, 21 nt, Human
cugaggaauccagacccggcu

SEQ ID NO: 3335888 - RNA, 17 nt, Human
cugaucucucgugauug

SEQ ID NO: 3335889 - RNA, 18 nt, Human
cugaucucucgugauuga

SEQ ID NO: 3335890 - RNA, 14 nt, Human
cugaucucucguga

SEQ ID NO: 3335891 - RNA, 23 nt, Human
augugcacaugcacgugugugca

SEQ ID NO: 3335892 - RNA, 17 nt, Human
augugaugagaggaaau

SEQ ID NO: 3335893 - RNA, 19 nt, Human
augugaugagaggaaauca

SEQ ID NO: 3335894 - RNA, 16 nt, Human
augugaugagaggaaa

SEQ ID NO: 3335895 - RNA, 15 nt, Human
augugaugagaggaa

SEQ ID NO: 3335896 - RNA, 15 nt, Human
auguauguguaagua

SEQ ID NO: 3335897 - RNA, 16 nt, Human
auguauguguaaguau

SEQ ID NO: 3335898 - RNA, 12 nt, Human
augucaguguga

SEQ ID NO: 3335899 - RNA, 13 nt, Human
augucagugugac

SEQ ID NO: 3335900 - RNA, 13 nt, Human
uuugacgccaucc

SEQ ID NO: 3335901 - RNA, 14 nt, Human
uuugacgccauccc

SEQ ID NO: 3335902 - RNA, 16 nt, Human
uuugacgccaucccag

SEQ ID NO: 3335903 - RNA, 19 nt, Human
uuugacgccaucccagccc

SEQ ID NO: 3335904 - RNA, 20 nt, Human
uuugacgccaucccagcccc

SEQ ID NO: 3335905 - RNA, 18 nt, Human
uuugauuaaauucuugca

SEQ ID NO: 3335906 - RNA, 21 nt, Human
uuugauuaaauucuugcaaag

SEQ ID NO: 3335907 - RNA, 18 nt, Human
uuugauucagacagcugc

SEQ ID NO: 3335908 - RNA, 21 nt, Human
uuugauucagacagcugccug

SEQ ID NO: 3335909 - RNA, 13 nt, Human
uuugauuaaauuc

SEQ ID NO: 3335910 - RNA, 22 nt, Human
uuugauguucuuucacccuuuu

SEQ ID NO: 3335911 - RNA, 22 nt, Human
uuugauucagacagcugccugg

SEQ ID NO: 3335912 - RNA, 15 nt, Human
uuugccguuauuaaa

SEQ ID NO: 3335913 - RNA, 13 nt, Human
uuugccucugccu

SEQ ID NO: 3335914 - RNA, 12 nt, Human
uuugaccucugc

SEQ ID NO: 3335915 - RNA, 17 nt, Human
augguggcuggguugga

SEQ ID NO: 3335916 - RNA, 15 nt, Human
augguggcuggguug

SEQ ID NO: 3335917 - RNA, 13 nt, Human
augguggcugggu

SEQ ID NO: 3335918 - RNA, 12 nt, Human
augguggcuggg

SEQ ID NO: 3335919 - RNA, 19 nt, Human
auggugcaaugaccuuuca

SEQ ID NO: 3335920 - RNA, 16 nt, Human
auggugcaaugaccuu

SEQ ID NO: 3335921 - RNA, 17 nt, Human
auggugcaaugaccuuu

SEQ ID NO: 3335922 - RNA, 12 nt, Human
auggugcaauga

SEQ ID NO: 3335923 - RNA, 13 nt, Human
auggugcaaugac

SEQ ID NO: 3335924 - RNA, 15 nt, Human
auggugcaaugaccu

SEQ ID NO: 3335925 - RNA, 15 nt, Human
augggugcuuggagg

SEQ ID NO: 3335926 - RNA, 20 nt, Human
auggugagggauacccaucc

SEQ ID NO: 3335927 - RNA, 15 nt, Human
augguuuucaaaaua

SEQ ID NO: 3335928 - RNA, 14 nt, Human
augguuuucaaaau

SEQ ID NO: 3335929 - RNA, 16 nt, Human
augguuuucaaaauaa

SEQ ID NO: 3335930 - RNA, 14 nt, Human
augguuuucuugug

SEQ ID NO: 3335931 - RNA, 15 nt, Human
uuucuggcuaugcau

SEQ ID NO: 3335932 - RNA, 16 nt, Human
uuucuggcuaugcauu

SEQ ID NO: 3335933 - RNA, 18 nt, Human
uuucuggcuaugcauuug

SEQ ID NO: 3335934 - RNA, 19 nt, Human
uuucuggcuaugcauuuga

SEQ ID NO: 3335935 - RNA, 19 nt, Human
uuucugcagccacuauugu

SEQ ID NO: 3335936 - RNA, 15 nt, Human
augggauccuggagu

SEQ ID NO: 3335937 - RNA, 12 nt, Human
auggggcugcac

SEQ ID NO: 3335938 - RNA, 24 nt, Human
auggggcugcaccggcuggccugg

SEQ ID NO: 3335939 - RNA, 14 nt, Human
augggggugcauuu

SEQ ID NO: 3335940 - RNA, 15 nt, Human
augggggugcauuug

SEQ ID NO: 3335941 - RNA, 18 nt, Human
augggccuccugugugug

SEQ ID NO: 3335942 - RNA, 17 nt, Human
augggccuccugugugu

SEQ ID NO: 3335943 - RNA, 20 nt, Human
augggcuggguucuacccag

SEQ ID NO: 3335944 - RNA, 19 nt, Human
augcacuuuguucuggcuc

SEQ ID NO: 3335945 - RNA, 20 nt, Human
augcacuuuguucuggcucu

SEQ ID NO: 3335946 - RNA, 17 nt, Human
augcacuuuguucuggc

SEQ ID NO: 3335947 - RNA, 16 nt, Human
augcacuuuguucugg

SEQ ID NO: 3335948 - RNA, 13 nt, Human
augcaccuggaau

SEQ ID NO: 3335949 - RNA, 14 nt, Human
augcaccagcccuu

SEQ ID NO: 3335950 - RNA, 22 nt, Human
augcaccagcccuuagcaggga

SEQ ID NO: 3335951 - RNA, 13 nt, Human
uuuaaagaaugcu

SEQ ID NO: 3335952 - RNA, 23 nt, Human
uuuaaaaauacagauagauauau

SEQ ID NO: 3335953 - RNA, 20 nt, Human
uuguucuugguuuguaaauu

SEQ ID NO: 3335954 - RNA, 13 nt, Human
uuguguuacuaag

SEQ ID NO: 3335955 - RNA, 15 nt, Human
uuguguuacuaaguu

SEQ ID NO: 3335956 - RNA, 20 nt, Human
uuguguuacuaaguuuuuau

SEQ ID NO: 3335957 - RNA, 21 nt, Human
uuguuccacaaguuaaauaaa

SEQ ID NO: 3335958 - RNA, 15 nt, Human
augaucuaggaagac

SEQ ID NO: 3335959 - RNA, 17 nt, Human
augaucuaggaagacuu

SEQ ID NO: 3335960 - RNA, 20 nt, Human
augaucuaggaagacuuugg

SEQ ID NO: 3335961 - RNA, 17 nt, Human
augcagccucacagucc

SEQ ID NO: 3335962 - RNA, 18 nt, Human
augcagccucacaguccu

SEQ ID NO: 3335963 - RNA, 19 nt, Human
uuuaauuuuuuugagacag

SEQ ID NO: 3335964 - RNA, 12 nt, Human
augcccagcccc

SEQ ID NO: 3335965 - RNA, 13 nt, Human
augcccagccccu

SEQ ID NO: 3335966 - RNA, 14 nt, Human
augcccagccccuu

SEQ ID NO: 3335967 - RNA, 11 nt, Human
augcccagccc

SEQ ID NO: 3335968 - RNA, 13 nt, Human
augcagugcuucc

SEQ ID NO: 3335969 - RNA, 23 nt, Human
augcagugguaugaucacggcuc

SEQ ID NO: 3335970 - RNA, 19 nt, Human
auggacuaacuugucuuug

SEQ ID NO: 3335971 - RNA, 11 nt, Human
auggacuuugu

SEQ ID NO: 3335972 - RNA, 12 nt, Human
auggacuuuguu

SEQ ID NO: 3335973 - RNA, 17 nt, Human
auggacuuuauaagcca

SEQ ID NO: 3335974 - RNA, 17 nt, Human
uuuccaugaguccccug

SEQ ID NO: 3335975 - RNA, 18 nt, Human
uuuccaugaguccccugu

SEQ ID NO: 3335976 - RNA, 19 nt, Human
augggagagaagagaaugc

SEQ ID NO: 3335977 - RNA, 15 nt, Human
augggagagaagaga

SEQ ID NO: 3335978 - RNA, 22 nt, Human
augcugugcccuaaaguguauu

SEQ ID NO: 3335979 - RNA, 13 nt, Human
augcuucucacug

SEQ ID NO: 3335980 - RNA, 15 nt, Human
uuucaaacuuuacua

SEQ ID NO: 3335981 - RNA, 22 nt, Human
uuucaaacuuuacuauggcccu

SEQ ID NO: 3335982 - RNA, 16 nt, Human
uuucaaacuuuacuau

SEQ ID NO: 3335983 - RNA, 11 nt, Human
aucagaauucu

SEQ ID NO: 3335984 - RNA, 13 nt, Human
aucagcacgauuu

SEQ ID NO: 3335985 - RNA, 15 nt, Human
aucaggccaggcccu

SEQ ID NO: 3335986 - RNA, 16 nt, Human
aucaggccaggcccuc

SEQ ID NO: 3335987 - RNA, 18 nt, Human
aucaggccaggcccucug

SEQ ID NO: 3335988 - RNA, 12 nt, Human
aucagaauucuc

SEQ ID NO: 3335989 - RNA, 14 nt, Human
aucaggccaggccc

SEQ ID NO: 3335990 - RNA, 16 nt, Human
uucuagcauggcugcc

SEQ ID NO: 3335991 - RNA, 21 nt, Human
uucuaaaucuccaaaauaaaa

SEQ ID NO: 3335992 - RNA, 19 nt, Human
uucuaaaucuccaaaauaa

SEQ ID NO: 3335993 - RNA, 20 nt, Human
uucuaaaggcuaccuuugua

SEQ ID NO: 3335994 - RNA, 21 nt, Human
uucuaaaggcuaccuuuguau

SEQ ID NO: 3335995 - RNA, 19 nt, Human
uucuaaaggcuaccuuugu

SEQ ID NO: 3335996 - RNA, 19 nt, Human
uucgcuccugugucuugca

SEQ ID NO: 3335997 - RNA, 15 nt, Human
uucgcuccugugucu

SEQ ID NO: 3335998 - RNA, 13 nt, Human
uucgcuccugugu

SEQ ID NO: 3335999 - RNA, 13 nt, Human
uuccucuuuccau

SEQ ID NO: 3336000 - RNA, 11 nt, Human
uuccucuuucc

SEQ ID NO: 3336001 - RNA, 22 nt, Human
uuccucuuuccaucuacccucc

SEQ ID NO: 3336002 - RNA, 17 nt, Human
uuccucuuuccaucuac

SEQ ID NO: 3336003 - RNA, 14 nt, Human
uuccugaaccgaug

SEQ ID NO: 3336004 - RNA, 17 nt, Human
uuccuaauccucuagga

SEQ ID NO: 3336005 - RNA, 15 nt, Human
uucccuauuagagaa

SEQ ID NO: 3336006 - RNA, 20 nt, Human
uucccucaccuuucccaucu

SEQ ID NO: 3336007 - RNA, 14 nt, Human
uuccguuaaaauac

SEQ ID NO: 3336008 - RNA, 16 nt, Human
uuccguuaaaauacca

SEQ ID NO: 3336009 - RNA, 14 nt, Human
aucaaugaguaaca

SEQ ID NO: 3336010 - RNA, 15 nt, Human
aucacggcucacugc

SEQ ID NO: 3336011 - RNA, 13 nt, Human
aucacgccacugc

SEQ ID NO: 3336012 - RNA, 18 nt, Human
aucacggcucacugcagc

SEQ ID NO: 3336013 - RNA, 21 nt, Human
aucaagaugugacauguuuua

SEQ ID NO: 3336014 - RNA, 20 nt, Human
uucuucugcuucagccuccc

SEQ ID NO: 3336015 - RNA, 13 nt, Human
aucccucauccuc

SEQ ID NO: 3336016 - RNA, 21 nt, Human
aucccucauccucauacccac

SEQ ID NO: 3336017 - RNA, 23 nt, Human
aucccucauccucauacccaccc

SEQ ID NO: 3336018 - RNA, 14 nt, Human
aucccucauccuca

SEQ ID NO: 3336019 - RNA, 24 nt, Human
aucccauaugccugggcagaagga

SEQ ID NO: 3336020 - RNA, 17 nt, Human
aucccauaugccugggc

SEQ ID NO: 3336021 - RNA, 13 nt, Human
uucuucucccuca

SEQ ID NO: 3336022 - RNA, 11 nt, Human
uucuucucccu

SEQ ID NO: 3336023 - RNA, 14 nt, Human
uucuucucccucag

SEQ ID NO: 3336024 - RNA, 15 nt, Human
uucuucugcuucagc

SEQ ID NO: 3336025 - RNA, 13 nt, Human
uucuucugcuuca

SEQ ID NO: 3336026 - RNA, 12 nt, Human
auccuaagcuau

SEQ ID NO: 3336027 - RNA, 16 nt, Human
auccuaggcauuugcu

SEQ ID NO: 3336028 - RNA, 16 nt, Human
auccuccucagaucuu

SEQ ID NO: 3336029 - RNA, 14 nt, Human
auccuccucagauc

SEQ ID NO: 3336030 - RNA, 21 nt, Human
uucuccuuguguuacuaaguu

SEQ ID NO: 3336031 - RNA, 19 nt, Human
aucaggugcugccauccag

SEQ ID NO: 3336032 - RNA, 15 nt, Human
uucucuaguuugauu

SEQ ID NO: 3336033 - RNA, 17 nt, Human
uucucuaguuugauuaa

SEQ ID NO: 3336034 - RNA, 18 nt, Human
uucugccugcccaggccc

SEQ ID NO: 3336035 - RNA, 17 nt, Human
uucugccugcccaggcc

SEQ ID NO: 3336036 - RNA, 15 nt, Human
uucuggcucuuccag

SEQ ID NO: 3336037 - RNA, 21 nt, Human
uucugccugcccaggccccug

SEQ ID NO: 3336038 - RNA, 16 nt, Human
uucuggcucuuccagg

SEQ ID NO: 3336039 - RNA, 17 nt, Human
uucuggcucuuccaggc

SEQ ID NO: 3336040 - RNA, 19 nt, Human
uucugaacuuggcgcugcc

SEQ ID NO: 3336041 - RNA, 22 nt, Human
uucugaacuuggcgcugccccu

SEQ ID NO: 3336042 - RNA, 15 nt, Human
uucugccauauucug

SEQ ID NO: 3336043 - RNA, 15 nt, Human
auccaguaucuugaa

SEQ ID NO: 3336044 - RNA, 16 nt, Human
auccaguaucuugaag

SEQ ID NO: 3336045 - RNA, 15 nt, Human
auccacccaccucag

SEQ ID NO: 3336046 - RNA, 13 nt, Human
auccacccaccuc

SEQ ID NO: 3336047 - RNA, 18 nt, Human
auccaagcuggucccacu

SEQ ID NO: 3336048 - RNA, 19 nt, Human
aucccaaacccuucagugc

SEQ ID NO: 3336049 - RNA, 20 nt, Human
aucccaaacccuucagugcc

SEQ ID NO: 3336050 - RNA, 12 nt, Human
aucccagcccca

SEQ ID NO: 3336051 - RNA, 18 nt, Human
aucccauaugccugggca

SEQ ID NO: 3336052 - RNA, 21 nt, Human
auccaguaucuugaagacuuu

SEQ ID NO: 3336053 - RNA, 16 nt, Human
aucuggugacuuuccu

SEQ ID NO: 3336054 - RNA, 17 nt, Human
aucuggugacuuuccuc

SEQ ID NO: 3336055 - RNA, 10 nt, Human
aucuggugac

SEQ ID NO: 3336056 - RNA, 17 nt, Human
aucugugaaaggaaaga

SEQ ID NO: 3336057 - RNA, 22 nt, Human
aucugucauuugagcagggcuc

SEQ ID NO: 3336058 - RNA, 18 nt, Human
aucugugaaaggaaagag

SEQ ID NO: 3336059 - RNA, 20 nt, Human
aucuuggucagauuugaacu

SEQ ID NO: 3336060 - RNA, 22 nt, Human
aucuuuucauuuaggugaggaa

SEQ ID NO: 3336061 - RNA, 17 nt, Human
aucuuugcagacaggca

SEQ ID NO: 3336062 - RNA, 18 nt, Human
augaaagggcccagagag

SEQ ID NO: 3336063 - RNA, 15 nt, Human
augaaagggcccaga

SEQ ID NO: 3336064 - RNA, 23 nt, Human
uuggcuauuagagaucaaccccu

SEQ ID NO: 3336065 - RNA, 16 nt, Human
uuggagggugucccaa

SEQ ID NO: 3336066 - RNA, 18 nt, Human
uuggccccugcccggcug

SEQ ID NO: 3336067 - RNA, 14 nt, Human
uugcuugaaagaaa

SEQ ID NO: 3336068 - RNA, 19 nt, Human
augaaagggcccagagagg

SEQ ID NO: 3336069 - RNA, 14 nt, Human
augaaaugagguca

SEQ ID NO: 3336070 - RNA, 18 nt, Human
uuggggaccagagcugcc

SEQ ID NO: 3336071 - RNA, 14 nt, Human
aucucagggccugg

SEQ ID NO: 3336072 - RNA, 16 nt, Human
aucucagggccugguc

SEQ ID NO: 3336073 - RNA, 14 nt, Human
aucuccaaaauaaa

SEQ ID NO: 3336074 - RNA, 17 nt, Human
aucuccaaaauaaaacu

SEQ ID NO: 3336075 - RNA, 20 nt, Human
aucuccaaaauaaaacuuuu

SEQ ID NO: 3336076 - RNA, 21 nt, Human
aucuccaaaauaaaacuuuuu

SEQ ID NO: 3336077 - RNA, 13 nt, Human
aucuccaaaauaa

SEQ ID NO: 3336078 - RNA, 16 nt, Human
aucucccccagcccca

SEQ ID NO: 3336079 - RNA, 17 nt, Human
aucucccccagccccau

SEQ ID NO: 3336080 - RNA, 14 nt, Human
aucucccccagccc

SEQ ID NO: 3336081 - RNA, 15 nt, Human
aucucccccagcccc

SEQ ID NO: 3336082 - RNA, 22 nt, Human
aucugaaaauguauguguaagu

SEQ ID NO: 3336083 - RNA, 20 nt, Human
aucugaaaauguauguguaa

SEQ ID NO: 3336084 - RNA, 19 nt, Human
aucugaaaauguaugugua

SEQ ID NO: 3336085 - RNA, 16 nt, Human
aucugaaaauguaugu

SEQ ID NO: 3336086 - RNA, 14 nt, Human
aucugaaaauguau

SEQ ID NO: 3336087 - RNA, 15 nt, Human
aucucuugagccugg

SEQ ID NO: 3336088 - RNA, 14 nt, Human
uugcaccacugcac

SEQ ID NO: 3336089 - RNA, 15 nt, Human
uugcaccacugcacu

SEQ ID NO: 3336090 - RNA, 16 nt, Human
uugcaccacugcacuc

SEQ ID NO: 3336091 - RNA, 19 nt, Human
uugcaauggcagccuuggc

SEQ ID NO: 3336092 - RNA, 17 nt, Human
uugcaauggcagccuug

SEQ ID NO: 3336093 - RNA, 16 nt, Human
uugcaauggcagccuu

SEQ ID NO: 3336094 - RNA, 14 nt, Human
uugcaauggcagcc

SEQ ID NO: 3336095 - RNA, 23 nt, Human
uugauguuuuaaggaugcuugua

SEQ ID NO: 3336096 - RNA, 13 nt, Human
uugauuaaauucu

SEQ ID NO: 3336097 - RNA, 23 nt, Human
aucugaaaauguauguguaagua

SEQ ID NO: 3336098 - RNA, 12 nt, Human
aucugaaaaugu

SEQ ID NO: 3336099 - RNA, 14 nt, Human
uugauuaaauucuu

SEQ ID NO: 3336100 - RNA, 21 nt, Human
uugauuaaauucuugcaaagu

SEQ ID NO: 3336101 - RNA, 17 nt, Human
aucuaaauggaaccacu

SEQ ID NO: 3336102 - RNA, 18 nt, Human
aucuaaauggaaccacuc

SEQ ID NO: 3336103 - RNA, 13 nt, Human
aucuaaauggaac

SEQ ID NO: 3336104 - RNA, 16 nt, Human
auccucuguacagagc

SEQ ID NO: 3336105 - RNA, 17 nt, Human
auccucuguacagagcc

SEQ ID NO: 3336106 - RNA, 16 nt, Human
uugagaucagccuggg

SEQ ID NO: 3336107 - RNA, 15 nt, Human
uugagaucagccugg

SEQ ID NO: 3336108 - RNA, 12 nt, Human
uugagacagagu

SEQ ID NO: 3336109 - RNA, 20 nt, Human
uugagugaagcugggagaac

SEQ ID NO: 3336110 - RNA, 20 nt, Human
uugaguugauucagcucugc

SEQ ID NO: 3336111 - RNA, 18 nt, Human
aucuaauauguaacaagc

SEQ ID NO: 3336112 - RNA, 17 nt, Human
auuuaaaagauacaguu

SEQ ID NO: 3336113 - RNA, 14 nt, Human
auuuaaaagauaca

SEQ ID NO: 3336114 - RNA, 16 nt, Human
auuuaaaagauacagu

SEQ ID NO: 3336115 - RNA, 13 nt, Human
auuuaaaagauac

SEQ ID NO: 3336116 - RNA, 21 nt, Human
auuguuuggggaugagaaagg

SEQ ID NO: 3336117 - RNA, 13 nt, Human
auugugggaaggg

SEQ ID NO: 3336118 - RNA, 14 nt, Human
auugugggaagggg

SEQ ID NO: 3336119 - RNA, 20 nt, Human
auuguccccgacccuugccg

SEQ ID NO: 3336120 - RNA, 23 nt, Human
auugucaaaguggugagaggcau

SEQ ID NO: 3336121 - RNA, 16 nt, Human
auugucaaagugguga

SEQ ID NO: 3336122 - RNA, 21 nt, Human
auugauuuccguuaaaauacc

SEQ ID NO: 3336123 - RNA, 16 nt, Human
auuggauuauccugag

SEQ ID NO: 3336124 - RNA, 19 nt, Human
auuucccaaagcagugcau

SEQ ID NO: 3336125 - RNA, 16 nt, Human
auuucccaaagcagug

SEQ ID NO: 3336126 - RNA, 14 nt, Human
auuuauuuaaauuu

SEQ ID NO: 3336127 - RNA, 12 nt, Human
auuuauuuaaau

SEQ ID NO: 3336128 - RNA, 16 nt, Human
auuugaaaauuuugau

SEQ ID NO: 3336129 - RNA, 15 nt, Human
auuugaaaauuuuga

SEQ ID NO: 3336130 - RNA, 16 nt, Human
auuucuuccacaagag

SEQ ID NO: 3336131 - RNA, 20 nt, Human
auuucuuccacaagagccca

SEQ ID NO: 3336132 - RNA, 23 nt, Human
auuucuuccacaagagcccaggc

SEQ ID NO: 3336133 - RNA, 22 nt, Human
auuuuaaaaauacagauagaua

SEQ ID NO: 3336134 - RNA, 21 nt, Human
auuuugcugucccuuuuccuu

SEQ ID NO: 3336135 - RNA, 20 nt, Human
auuuugcuaaaugugaauga

SEQ ID NO: 3336136 - RNA, 17 nt, Human
auuuugauguuuuaagg

SEQ ID NO: 3336137 - RNA, 15 nt, Human
auuuugauguuuuaa

SEQ ID NO: 3336138 - RNA, 19 nt, Human
auuuugauccaagcugguc

SEQ ID NO: 3336139 - RNA, 18 nt, Human
auuuugauccaagcuggu

SEQ ID NO: 3336140 - RNA, 16 nt, Human
auuuuccugccaggca

SEQ ID NO: 3336141 - RNA, 19 nt, Human
auuuucccuauuagagaag

SEQ ID NO: 3336142 - RNA, 20 nt, Human
auuuuggaaaauaaauuauu

SEQ ID NO: 3336143 - RNA, 19 nt, Human
auuuuggaaaauaaauuau

SEQ ID NO: 3336144 - RNA, 14 nt, Human
auuuuggaaaauaa

SEQ ID NO: 3336145 - RNA, 18 nt, Human
auuuugcuuugugauuuu

SEQ ID NO: 3336146 - RNA, 20 nt, Human
auuuugcuuugugauuuuug

SEQ ID NO: 3336147 - RNA, 12 nt, Human
auuuugcuuugu

SEQ ID NO: 3336148 - RNA, 23 nt, Human
auuuugucauauaagauucauau

SEQ ID NO: 3336149 - RNA, 19 nt, Human
auuuugugcccccauguaa

SEQ ID NO: 3336150 - RNA, 22 nt, Human
auuuuucuuagggaaggauaca

SEQ ID NO: 3336151 - RNA, 21 nt, Human
auuuuucuuagggaaggauac

SEQ ID NO: 3336152 - RNA, 13 nt, Human
auuuuuuaaaugc

SEQ ID NO: 3336153 - RNA, 14 nt, Human
auuuuuuaaaugca

SEQ ID NO: 3336154 - RNA, 12 nt, Human
auuuuuguaauu

SEQ ID NO: 3336155 - RNA, 19 nt, Human
auuuuuguagagccagggu

SEQ ID NO: 3336156 - RNA, 14 nt, Human
auuaucuagauacu

SEQ ID NO: 3336157 - RNA, 18 nt, Human
auuaucuagauacuguau

SEQ ID NO: 3336158 - RNA, 14 nt, Human
auucagacagcugc

SEQ ID NO: 3336159 - RNA, 15 nt, Human
auucagacagcugcc

SEQ ID NO: 3336160 - RNA, 16 nt, Human
auucagacagcugccu

SEQ ID NO: 3336161 - RNA, 17 nt, Human
auucagacagcugccug

SEQ ID NO: 3336162 - RNA, 18 nt, Human
auucagacagcugccugg

SEQ ID NO: 3336163 - RNA, 12 nt, Human
auucaggaagcu

SEQ ID NO: 3336164 - RNA, 12 nt, Human
auucagacagcu

SEQ ID NO: 3336165 - RNA, 13 nt, Human
auucagacagcug

SEQ ID NO: 3336166 - RNA, 11 nt, Human
auucagacagc

SEQ ID NO: 3336167 - RNA, 19 nt, Human
auucuguuggccaguguga

SEQ ID NO: 3336168 - RNA, 14 nt, Human
auucuguuggccag

SEQ ID NO: 3336169 - RNA, 22 nt, Human
auucugcucacauaucugucau

SEQ ID NO: 3336170 - RNA, 21 nt, Human
auucugcucacauaucuguca

SEQ ID NO: 3336171 - RNA, 20 nt, Human
auucugcucacauaucuguc

SEQ ID NO: 3336172 - RNA, 19 nt, Human
auucugcucacauaucugu

SEQ ID NO: 3336173 - RNA, 21 nt, Human
auucugccugcccaggccccu

SEQ ID NO: 3336174 - RNA, 20 nt, Human
auucugccugcccaggcccc

SEQ ID NO: 3336175 - RNA, 18 nt, Human
auucugcucacauaucug

SEQ ID NO: 3336176 - RNA, 19 nt, Human
auucugccugcccaggccc

SEQ ID NO: 3336177 - RNA, 18 nt, Human
auucugccugcccaggcc

SEQ ID NO: 3336178 - RNA, 17 nt, Human
auucugccugcccaggc

SEQ ID NO: 3336179 - RNA, 16 nt, Human
auucugccugcccagg

SEQ ID NO: 3336180 - RNA, 15 nt, Human
auucugccugcccag

SEQ ID NO: 3336181 - RNA, 14 nt, Human
auucugccugccca

SEQ ID NO: 3336182 - RNA, 13 nt, Human
auucugccugccc

SEQ ID NO: 3336183 - RNA, 11 nt, Human
auucugccugc

SEQ ID NO: 3336184 - RNA, 17 nt, Human
auucucauuugucacac

SEQ ID NO: 3336185 - RNA, 14 nt, Human
auucuuaaauaugu

SEQ ID NO: 3336186 - RNA, 17 nt, Human
auugaaaucuuuuugcu

SEQ ID NO: 3336187 - RNA, 18 nt, Human
auugaaaucuuuuugcuu

SEQ ID NO: 3336188 - RNA, 20 nt, Human
auugaaaucuuuuugcuuug

SEQ ID NO: 3336189 - RNA, 12 nt, Human
auugaaaucuuu

SEQ ID NO: 3336190 - RNA, 17 nt, Human
auugaccugaggcccuu

SEQ ID NO: 3336191 - RNA, 15 nt, Human
ugcccaggcaggucu

SEQ ID NO: 3336192 - RNA, 14 nt, Human
ugcccacaggauca

SEQ ID NO: 3336193 - RNA, 11 nt, Human
ugcccaggccc

SEQ ID NO: 3336194 - RNA, 20 nt, Human
ugcccaggcaggucuugaac

SEQ ID NO: 3336195 - RNA, 17 nt, Human
ugcccaggcaggucuug

SEQ ID NO: 3336196 - RNA, 16 nt, Human
ugcccaggcaggucuu

SEQ ID NO: 3336197 - RNA, 22 nt, Human
ugcccaggccccugccacccug

SEQ ID NO: 3336198 - RNA, 20 nt, Human
ugcccaggccccugccaccc

SEQ ID NO: 3336199 - RNA, 12 nt, Human
ugcccaggcccc

SEQ ID NO: 3336200 - RNA, 14 nt, Human
agcucagggccugg

SEQ ID NO: 3336201 - RNA, 15 nt, Human
agcucagggccuggc

SEQ ID NO: 3336202 - RNA, 16 nt, Human
agcucagggccuggcu

SEQ ID NO: 3336203 - RNA, 19 nt, Human
ugccauguuggccaggcug

SEQ ID NO: 3336204 - RNA, 18 nt, Human
ugccauguuggccaggcu

SEQ ID NO: 3336205 - RNA, 17 nt, Human
agcucagggccuggcuc

SEQ ID NO: 3336206 - RNA, 17 nt, Human
ugccauguuggccaggc

SEQ ID NO: 3336207 - RNA, 20 nt, Human
ugccauguuggccaggcugg

SEQ ID NO: 3336208 - RNA, 21 nt, Human
ugccauguuggccaggcuggu

SEQ ID NO: 3336209 - RNA, 16 nt, Human
ugccauguuggccagg

SEQ ID NO: 3336210 - RNA, 19 nt, Human
ugcauuugaaaauuuugau

SEQ ID NO: 3336211 - RNA, 23 nt, Human
ugcauuugaaaauuuugauguuu

SEQ ID NO: 3336212 - RNA, 14 nt, Human
agcgcccaguuggg

SEQ ID NO: 3336213 - RNA, 15 nt, Human
ugccagucaccccgg

SEQ ID NO: 3336214 - RNA, 16 nt, Human
ugccagucaccccggc

SEQ ID NO: 3336215 - RNA, 18 nt, Human
ugccagucaccccggcca

SEQ ID NO: 3336216 - RNA, 20 nt, Human
ugccagucaccccggccacc

SEQ ID NO: 3336217 - RNA, 15 nt, Human
ugccauauucuguug

SEQ ID NO: 3336218 - RNA, 17 nt, Human
ugccauauucuguuggc

SEQ ID NO: 3336219 - RNA, 16 nt, Human
ugccauauucuguugg

SEQ ID NO: 3336220 - RNA, 22 nt, Human
ugccagucaccccggccaccug

SEQ ID NO: 3336221 - RNA, 23 nt, Human
ugccagucaccccggccaccugc

SEQ ID NO: 3336222 - RNA, 21 nt, Human
ugccauauucuguuggccagu

SEQ ID NO: 3336223 - RNA, 20 nt, Human
ugccauauucuguuggccag

SEQ ID NO: 3336224 - RNA, 15 nt, Human
agcggggacagcucc

SEQ ID NO: 3336225 - RNA, 17 nt, Human
agcggggacagcuccuu

SEQ ID NO: 3336226 - RNA, 16 nt, Human
agcggggacagcuccu

SEQ ID NO: 3336227 - RNA, 15 nt, Human
agcgugagccacugc

SEQ ID NO: 3336228 - RNA, 13 nt, Human
agcgugagccacu

SEQ ID NO: 3336229 - RNA, 20 nt, Human
agcgugguggacaugcacag

SEQ ID NO: 3336230 - RNA, 15 nt, Human
agcgugcauaaguua

SEQ ID NO: 3336231 - RNA, 16 nt, Human
agcgugagccacugca

SEQ ID NO: 3336232 - RNA, 23 nt, Human
agcgugguggacaugcacagcua

SEQ ID NO: 3336233 - RNA, 12 nt, Human
ugcacuccccug

SEQ ID NO: 3336234 - RNA, 13 nt, Human
ugcacuccccugc

SEQ ID NO: 3336235 - RNA, 19 nt, Human
ugcacguacacacacauac

SEQ ID NO: 3336236 - RNA, 14 nt, Human
ugcaccacugcacu

SEQ ID NO: 3336237 - RNA, 18 nt, Human
ugcacaagcuccaagcuc

SEQ ID NO: 3336238 - RNA, 20 nt, Human
ugcacaagcuccaagcuccc

SEQ ID NO: 3336239 - RNA, 22 nt, Human
ugcacaagcuccaagcucccag

SEQ ID NO: 3336240 - RNA, 23 nt, Human
ugcacaagcuccaagcucccagg

SEQ ID NO: 3336241 - RNA, 15 nt, Human
ugcacaagcuccaag

SEQ ID NO: 3336242 - RNA, 16 nt, Human
ugcacaagcuccaagc

SEQ ID NO: 3336243 - RNA, 15 nt, Human
ugcacacaccagagc

SEQ ID NO: 3336244 - RNA, 20 nt, Human
ugcacuuuguucuggcucuu

SEQ ID NO: 3336245 - RNA, 18 nt, Human
ugcagacucuacagaggc

SEQ ID NO: 3336246 - RNA, 20 nt, Human
ugcagacucuacagaggcca

SEQ ID NO: 3336247 - RNA, 19 nt, Human
ugcagacucuacagaggcc

SEQ ID NO: 3336248 - RNA, 22 nt, Human
ugcagacucuacagaggccaug

SEQ ID NO: 3336249 - RNA, 17 nt, Human
agccuaggugacagagu

SEQ ID NO: 3336250 - RNA, 15 nt, Human
agccuaggugacaga

SEQ ID NO: 3336251 - RNA, 15 nt, Human
agccucaaccuccug

SEQ ID NO: 3336252 - RNA, 22 nt, Human
ugcauaccacuuuuguucuugg

SEQ ID NO: 3336253 - RNA, 21 nt, Human
ugcauaccacuuuuguucuug

SEQ ID NO: 3336254 - RNA, 20 nt, Human
ugcaugaaguaauaugcaca

SEQ ID NO: 3336255 - RNA, 22 nt, Human
ugcaugaaguaauaugcacaca

SEQ ID NO: 3336256 - RNA, 21 nt, Human
ugcaugaggcuaguguggugu

SEQ ID NO: 3336257 - RNA, 14 nt, Human
ugcaugcugucccu

SEQ ID NO: 3336258 - RNA, 15 nt, Human
ugcaugcugucccuu

SEQ ID NO: 3336259 - RNA, 13 nt, Human
ugcaugcuguccc

SEQ ID NO: 3336260 - RNA, 16 nt, Human
agccugccucuucucu

SEQ ID NO: 3336261 - RNA, 19 nt, Human
agccugccucuucucuacu

SEQ ID NO: 3336262 - RNA, 23 nt, Human
agccugcaguuauuaacacuaac

SEQ ID NO: 3336263 - RNA, 19 nt, Human
ugcagccucaaccuccugg

SEQ ID NO: 3336264 - RNA, 18 nt, Human
ugcagccucaaccuccug

SEQ ID NO: 3336265 - RNA, 14 nt, Human
agccucagcauccu

SEQ ID NO: 3336266 - RNA, 13 nt, Human
agccucagcaucc

SEQ ID NO: 3336267 - RNA, 18 nt, Human
agccucaaccuccugggc

SEQ ID NO: 3336268 - RNA, 17 nt, Human
agccucaaccuccuggg

SEQ ID NO: 3336269 - RNA, 15 nt, Human
agccucagcauccug

SEQ ID NO: 3336270 - RNA, 17 nt, Human
ugcauaaguuaacuucc

SEQ ID NO: 3336271 - RNA, 14 nt, Human
ugcagugagccgag

SEQ ID NO: 3336272 - RNA, 15 nt, Human
ugccucucucaggcc

SEQ ID NO: 3336273 - RNA, 21 nt, Human
ugccucugacacacagcucug

SEQ ID NO: 3336274 - RNA, 20 nt, Human
ugccucugacacacagcucu

SEQ ID NO: 3336275 - RNA, 13 nt, Human
ugccucccaucac

SEQ ID NO: 3336276 - RNA, 14 nt, Human
ugccucccaucacc

SEQ ID NO: 3336277 - RNA, 13 nt, Human
ugccucucucagg

SEQ ID NO: 3336278 - RNA, 14 nt, Human
ugccucucucaggc

SEQ ID NO: 3336279 - RNA, 18 nt, Human
agcugcauacaguuugca

SEQ ID NO: 3336280 - RNA, 13 nt, Human
agcugccaccugc

SEQ ID NO: 3336281 - RNA, 19 nt, Human
ugcccuccaagaccuucuc

SEQ ID NO: 3336282 - RNA, 20 nt, Human
ugcccuccaagaccuucucc

SEQ ID NO: 3336283 - RNA, 22 nt, Human
ugcccuccaagaccuucuccuu

SEQ ID NO: 3336284 - RNA, 20 nt, Human
agcucugguccauagagagc

SEQ ID NO: 3336285 - RNA, 22 nt, Human
agcucugcuccucuccccagca

SEQ ID NO: 3336286 - RNA, 12 nt, Human
agcucugcuccu

SEQ ID NO: 3336287 - RNA, 12 nt, Human
agcucuguccug

SEQ ID NO: 3336288 - RNA, 17 nt, Human
agcucuucuccaggcug

SEQ ID NO: 3336289 - RNA, 18 nt, Human
agcucuucuccaggcugu

SEQ ID NO: 3336290 - RNA, 18 nt, Human
agcugcacccucaggcag

SEQ ID NO: 3336291 - RNA, 19 nt, Human
agcugcacccucaggcagg

SEQ ID NO: 3336292 - RNA, 20 nt, Human
agcugcacccucaggcaggu

SEQ ID NO: 3336293 - RNA, 22 nt, Human
agcugcacccucaggcaggugg

SEQ ID NO: 3336294 - RNA, 13 nt, Human
agcugcacccuca

SEQ ID NO: 3336295 - RNA, 17 nt, Human
agcugcacccucaggca

SEQ ID NO: 3336296 - RNA, 14 nt, Human
agcugggcagguug

SEQ ID NO: 3336297 - RNA, 19 nt, Human
agcugggacuacaggugug

SEQ ID NO: 3336298 - RNA, 17 nt, Human
agcugggacuacaggug

SEQ ID NO: 3336299 - RNA, 23 nt, Human
agcugggaugauuggagggggga

SEQ ID NO: 3336300 - RNA, 22 nt, Human
ugccucugacacacagcucugu

SEQ ID NO: 3336301 - RNA, 21 nt, Human
agcugccugggaucccucauc

SEQ ID NO: 3336302 - RNA, 13 nt, Human
agcugccugggau

SEQ ID NO: 3336303 - RNA, 19 nt, Human
agcugccugggaucccuca

SEQ ID NO: 3336304 - RNA, 13 nt, Human
ugcgaaaggauga

SEQ ID NO: 3336305 - RNA, 17 nt, Human
ugcggacagccacggcc

SEQ ID NO: 3336306 - RNA, 18 nt, Human
ugcggacagccacggcca

SEQ ID NO: 3336307 - RNA, 19 nt, Human
ugcgaaaggaugaaaguga

SEQ ID NO: 3336308 - RNA, 16 nt, Human
ugccuguucagcucca

SEQ ID NO: 3336309 - RNA, 15 nt, Human
ugccuguucagcucc

SEQ ID NO: 3336310 - RNA, 20 nt, Human
ugcggacagccacggccagg

SEQ ID NO: 3336311 - RNA, 12 nt, Human
agcuuaucucag

SEQ ID NO: 3336312 - RNA, 14 nt, Human
agcuuaucucaggg

SEQ ID NO: 3336313 - RNA, 15 nt, Human
agcuuaucucagggg

SEQ ID NO: 3336314 - RNA, 20 nt, Human
agcuuguaaauagcucaggu

SEQ ID NO: 3336315 - RNA, 19 nt, Human
agcuuguaaauagcucagg

SEQ ID NO: 3336316 - RNA, 18 nt, Human
agcuuguaaauagcucag

SEQ ID NO: 3336317 - RNA, 21 nt, Human
aggaaacccagcucuggucca

SEQ ID NO: 3336318 - RNA, 18 nt, Human
aggaaacccagcucuggu

SEQ ID NO: 3336319 - RNA, 20 nt, Human
aggaaacccagcucuggucc

SEQ ID NO: 3336320 - RNA, 16 nt, Human
aggaaacccagcucug

SEQ ID NO: 3336321 - RNA, 17 nt, Human
aggaaacccagcucugg

SEQ ID NO: 3336322 - RNA, 15 nt, Human
aggaaacccagcucu

SEQ ID NO: 3336323 - RNA, 16 nt, Human
aggaaaagcugcugac

SEQ ID NO: 3336324 - RNA, 12 nt, Human
agcuuugaaaau

SEQ ID NO: 3336325 - RNA, 16 nt, Human
agcuuugaaaauucag

SEQ ID NO: 3336326 - RNA, 18 nt, Human
agcuuugaaaauucagug

SEQ ID NO: 3336327 - RNA, 19 nt, Human
agcuuugaaaauucagugg

SEQ ID NO: 3336328 - RNA, 16 nt, Human
aggaaagaggcucugg

SEQ ID NO: 3336329 - RNA, 17 nt, Human
aggaaagcaaaggagau

SEQ ID NO: 3336330 - RNA, 12 nt, Human
aggaaagaggcu

SEQ ID NO: 3336331 - RNA, 13 nt, Human
aggaaagaggcuc

SEQ ID NO: 3336332 - RNA, 17 nt, Human
ugcugacuguuuucucu

SEQ ID NO: 3336333 - RNA, 18 nt, Human
ugcucugcauguuacaua

SEQ ID NO: 3336334 - RNA, 15 nt, Human
ugcucugcauguuac

SEQ ID NO: 3336335 - RNA, 17 nt, Human
ugcucuggacaggcaug

SEQ ID NO: 3336336 - RNA, 22 nt, Human
ugcucugaucauccacugugcc

SEQ ID NO: 3336337 - RNA, 19 nt, Human
ugcucugaucauccacugu

SEQ ID NO: 3336338 - RNA, 21 nt, Human
ugcugacuguuuucucuugag

SEQ ID NO: 3336339 - RNA, 24 nt, Human
ugcugacuguuuucucuugagagg

SEQ ID NO: 3336340 - RNA, 16 nt, Human
ugcugacuguuuucuc

SEQ ID NO: 3336341 - RNA, 19 nt, Human
aggaaagcaaaggagauug

SEQ ID NO: 3336342 - RNA, 16 nt, Human
aggaaaggcuccagga

SEQ ID NO: 3336343 - RNA, 18 nt, Human
aggaaaggcuccaggagc

SEQ ID NO: 3336344 - RNA, 20 nt, Human
aggaaaggcuccaggagcag

SEQ ID NO: 3336345 - RNA, 22 nt, Human
aggaaaggcuccaggagcagcc

SEQ ID NO: 3336346 - RNA, 11 nt, Human
ugcugccaucc

SEQ ID NO: 3336347 - RNA, 15 nt, Human
ugcugccauccaggu

SEQ ID NO: 3336348 - RNA, 14 nt, Human
ugcugccauccagg

SEQ ID NO: 3336349 - RNA, 13 nt, Human
ugcugccauccag

SEQ ID NO: 3336350 - RNA, 12 nt, Human
ugcugccaucca

SEQ ID NO: 3336351 - RNA, 22 nt, Human
ugcugccauccagguucagcuu

SEQ ID NO: 3336352 - RNA, 21 nt, Human
ugcugccauccagguucagcu

SEQ ID NO: 3336353 - RNA, 15 nt, Human
aggaagacuuuggaa

SEQ ID NO: 3336354 - RNA, 14 nt, Human
aggaagacuuugga

SEQ ID NO: 3336355 - RNA, 14 nt, Human
aggaagagaaaaaa

SEQ ID NO: 3336356 - RNA, 18 nt, Human
aggaagcucagggccugg

SEQ ID NO: 3336357 - RNA, 22 nt, Human
aggaagcucagggccuggcuca

SEQ ID NO: 3336358 - RNA, 17 nt, Human
aggaagcucagggccug

SEQ ID NO: 3336359 - RNA, 16 nt, Human
aggaagcucagggccu

SEQ ID NO: 3336360 - RNA, 20 nt, Human
aggaauccagacccggcugc

SEQ ID NO: 3336361 - RNA, 23 nt, Human
aggaauccagacccggcugcgug

SEQ ID NO: 3336362 - RNA, 13 nt, Human
uggcccacugcau

SEQ ID NO: 3336363 - RNA, 14 nt, Human
uggcccacugcauc

SEQ ID NO: 3336364 - RNA, 13 nt, Human
uggcccacgcacu

SEQ ID NO: 3336365 - RNA, 19 nt, Human
uggcccacgcacuucggga

SEQ ID NO: 3336366 - RNA, 22 nt, Human
uggcaugggaaugaaugucagu

SEQ ID NO: 3336367 - RNA, 19 nt, Human
uggccucugcacuccccug

SEQ ID NO: 3336368 - RNA, 18 nt, Human
uggccucugcacuccccu

SEQ ID NO: 3336369 - RNA, 20 nt, Human
uggccucugcacuccccugc

SEQ ID NO: 3336370 - RNA, 18 nt, Human
uggccugagcugggauga

SEQ ID NO: 3336371 - RNA, 18 nt, Human
aggccuucucugaaggac

SEQ ID NO: 3336372 - RNA, 17 nt, Human
aggccuucucugaagga

SEQ ID NO: 3336373 - RNA, 14 nt, Human
aggcuccaggagca

SEQ ID NO: 3336374 - RNA, 16 nt, Human
aggcuccaggagcagc

SEQ ID NO: 3336375 - RNA, 13 nt, Human
aggcuccaggagc

SEQ ID NO: 3336376 - RNA, 16 nt, Human
uggcaccagcagccug

SEQ ID NO: 3336377 - RNA, 17 nt, Human
uggcaccagcagccugg

SEQ ID NO: 3336378 - RNA, 12 nt, Human
aggccagagaca

SEQ ID NO: 3336379 - RNA, 16 nt, Human
uggcagcucagagagg

SEQ ID NO: 3336380 - RNA, 13 nt, Human
aggccagagacac

SEQ ID NO: 3336381 - RNA, 18 nt, Human
aggccagagacacaagcc

SEQ ID NO: 3336382 - RNA, 14 nt, Human
uggcagcucagaga

SEQ ID NO: 3336383 - RNA, 15 nt, Human
uggcagcucagagag

SEQ ID NO: 3336384 - RNA, 13 nt, Human
uggcagcucagag

SEQ ID NO: 3336385 - RNA, 23 nt, Human
aggccagagacacaagccuucgg

SEQ ID NO: 3336386 - RNA, 18 nt, Human
aggccaugggccuccugu

SEQ ID NO: 3336387 - RNA, 17 nt, Human
aggccaugggccuccug

SEQ ID NO: 3336388 - RNA, 15 nt, Human
aggcccagagggccu

SEQ ID NO: 3336389 - RNA, 16 nt, Human
aggcccagagggccug

SEQ ID NO: 3336390 - RNA, 16 nt, Human
aggcccggcuccaggc

SEQ ID NO: 3336391 - RNA, 15 nt, Human
aggcccggcuccagg

SEQ ID NO: 3336392 - RNA, 14 nt, Human
aggcccggcuccag

SEQ ID NO: 3336393 - RNA, 21 nt, Human
aggccccugccacccugggga

SEQ ID NO: 3336394 - RNA, 12 nt, Human
aggccccugcca

SEQ ID NO: 3336395 - RNA, 18 nt, Human
aggccccugccacccugg

SEQ ID NO: 3336396 - RNA, 17 nt, Human
aggccccugccacccug

SEQ ID NO: 3336397 - RNA, 19 nt, Human
aggcccagagggccugcaa

SEQ ID NO: 3336398 - RNA, 15 nt, Human
aggccccugccaccc

SEQ ID NO: 3336399 - RNA, 13 nt, Human
aggccccugccac

SEQ ID NO: 3336400 - RNA, 13 nt, Human
aggccuggccaga

SEQ ID NO: 3336401 - RNA, 12 nt, Human
aggccuggccag

SEQ ID NO: 3336402 - RNA, 21 nt, Human
aggcagccccauucugccugc

SEQ ID NO: 3336403 - RNA, 20 nt, Human
aggcagccccauucugccug

SEQ ID NO: 3336404 - RNA, 19 nt, Human
aggcagccccauucugccu

SEQ ID NO: 3336405 - RNA, 22 nt, Human
aggcagccccauucugccugcc

SEQ ID NO: 3336406 - RNA, 14 nt, Human
aggcagguccaggg

SEQ ID NO: 3336407 - RNA, 22 nt, Human
aggcagggucucacucugucgc

SEQ ID NO: 3336408 - RNA, 21 nt, Human
aggcagggucucacucugucg

SEQ ID NO: 3336409 - RNA, 20 nt, Human
aggcagggucucacucuguc

SEQ ID NO: 3336410 - RNA, 18 nt, Human
aggcagggucucacucug

SEQ ID NO: 3336411 - RNA, 19 nt, Human
aggcagggucucacucugu

SEQ ID NO: 3336412 - RNA, 21 nt, Human
aggcaggucuugaacuccugg

SEQ ID NO: 3336413 - RNA, 11 nt, Human
uggacuuuguu

SEQ ID NO: 3336414 - RNA, 22 nt, Human
uggacuuuguuaguuucuccaa

SEQ ID NO: 3336415 - RNA, 24 nt, Human
uggacuuuguuaguuucuccaagc

SEQ ID NO: 3336416 - RNA, 16 nt, Human
aggcaaugcuggcugu

SEQ ID NO: 3336417 - RNA, 15 nt, Human
aggcaaugcuggcug

SEQ ID NO: 3336418 - RNA, 15 nt, Human
aggaugcuuguacau

SEQ ID NO: 3336419 - RNA, 16 nt, Human
aggaugcuuguacaua

SEQ ID NO: 3336420 - RNA, 21 nt, Human
aggauccugagccagauuuca

SEQ ID NO: 3336421 - RNA, 18 nt, Human
aggauccugagccagauu

SEQ ID NO: 3336422 - RNA, 22 nt, Human
aggauugcuacuguccuaccca

SEQ ID NO: 3336423 - RNA, 15 nt, Human
uggacaccggaaaca

SEQ ID NO: 3336424 - RNA, 19 nt, Human
aggcaacugcauuggcuuu

SEQ ID NO: 3336425 - RNA, 14 nt, Human
aggcaagcaccucc

SEQ ID NO: 3336426 - RNA, 12 nt, Human
uggaacacucug

SEQ ID NO: 3336427 - RNA, 13 nt, Human
uggaagcuccgcu

SEQ ID NO: 3336428 - RNA, 20 nt, Human
uggaaguacuauaauuuacc

SEQ ID NO: 3336429 - RNA, 18 nt, Human
uggaaguacuauaauuua

SEQ ID NO: 3336430 - RNA, 10 nt, Human
ugcugcccug

SEQ ID NO: 3336431 - RNA, 21 nt, Human
aggaguuugagaccaaccugg

SEQ ID NO: 3336432 - RNA, 15 nt, Human
aggaggccagccuug

SEQ ID NO: 3336433 - RNA, 22 nt, Human
aggcugggggaagaagcucucu

SEQ ID NO: 3336434 - RNA, 14 nt, Human
aggcuggguucuga

SEQ ID NO: 3336435 - RNA, 21 nt, Human
aggcugggcuucaguggcagc

SEQ ID NO: 3336436 - RNA, 20 nt, Human
aggcugggcuucaguggcag

SEQ ID NO: 3336437 - RNA, 19 nt, Human
aggcugggcuucaguggca

SEQ ID NO: 3336438 - RNA, 18 nt, Human
aggcugggcuucaguggc

SEQ ID NO: 3336439 - RNA, 23 nt, Human
aggcugggcuucaguggcagcug

SEQ ID NO: 3336440 - RNA, 22 nt, Human
aggcugggcuucaguggcagcu

SEQ ID NO: 3336441 - RNA, 17 nt, Human
aggcugggggaagaagc

SEQ ID NO: 3336442 - RNA, 21 nt, Human
aggcugggcucccuucccacc

SEQ ID NO: 3336443 - RNA, 23 nt, Human
aggcugggcucccuucccaccuc

SEQ ID NO: 3336444 - RNA, 14 nt, Human
aggcugggcuucag

SEQ ID NO: 3336445 - RNA, 14 nt, Human
aggcugggcucccu

SEQ ID NO: 3336446 - RNA, 18 nt, Human
aggcugggcucccuuccc

SEQ ID NO: 3336447 - RNA, 13 nt, Human
aggcugggcuccc

SEQ ID NO: 3336448 - RNA, 20 nt, Human
aggcugggagagccuuccag

SEQ ID NO: 3336449 - RNA, 21 nt, Human
aggcugggagagccuuccagg

SEQ ID NO: 3336450 - RNA, 22 nt, Human
aggcugggagagccuuccaggg

SEQ ID NO: 3336451 - RNA, 19 nt, Human
aggcugggagagccuucca

SEQ ID NO: 3336452 - RNA, 16 nt, Human
aggcugggagagccuu

SEQ ID NO: 3336453 - RNA, 21 nt, Human
aggcuuagucacugagacagc

SEQ ID NO: 3336454 - RNA, 22 nt, Human
aggcuuagucacugagacagcc

SEQ ID NO: 3336455 - RNA, 23 nt, Human
aggcuuagucacugagacagccc

SEQ ID NO: 3336456 - RNA, 15 nt, Human
aggcuuauauucaac

SEQ ID NO: 3336457 - RNA, 17 nt, Human
aggcuuauauucaacca

SEQ ID NO: 3336458 - RNA, 16 nt, Human
aggcuuauauucaacc

SEQ ID NO: 3336459 - RNA, 21 nt, Human
aggcuuauauucaaccaugga

SEQ ID NO: 3336460 - RNA, 18 nt, Human
aggcuuauauucaaccau

SEQ ID NO: 3336461 - RNA, 15 nt, Human
uggcuuuugugcauu

SEQ ID NO: 3336462 - RNA, 16 nt, Human
uggcuuuugugcauua

SEQ ID NO: 3336463 - RNA, 17 nt, Human
uggcuucacggaagagc

SEQ ID NO: 3336464 - RNA, 20 nt, Human
uggcuucacggaagagccuu

SEQ ID NO: 3336465 - RNA, 21 nt, Human
uggcuuuugugcauuaucuag

SEQ ID NO: 3336466 - RNA, 23 nt, Human
uggcugcaaaggguaucaggugc

SEQ ID NO: 3336467 - RNA, 18 nt, Human
uggcuguuggcugggggc

SEQ ID NO: 3336468 - RNA, 16 nt, Human
uggcuguuggcugggg

SEQ ID NO: 3336469 - RNA, 14 nt, Human
uggcuucacggaag

SEQ ID NO: 3336470 - RNA, 23 nt, Human
uggcuguuggcugggggccucag

SEQ ID NO: 3336471 - RNA, 15 nt, Human
uggcuguuggcuggg

SEQ ID NO: 3336472 - RNA, 13 nt, Human
uggcucacgccug

SEQ ID NO: 3336473 - RNA, 18 nt, Human
uggcucaaguccucuuuu

SEQ ID NO: 3336474 - RNA, 19 nt, Human
uggcuaauguacugcauau

SEQ ID NO: 3336475 - RNA, 17 nt, Human
uggcuaauguacugcau

SEQ ID NO: 3336476 - RNA, 17 nt, Human
aggcuccaggagcagcc

SEQ ID NO: 3336477 - RNA, 18 nt, Human
aggcuccaggagcagcca

SEQ ID NO: 3336478 - RNA, 19 nt, Human
aggcuccaggagcagccac

SEQ ID NO: 3336479 - RNA, 23 nt, Human
aggcuccaggagcagccacauuc

SEQ ID NO: 3336480 - RNA, 14 nt, Human
uggcuaaauucaug

SEQ ID NO: 3336481 - RNA, 17 nt, Human
agggagggcuccagaca

SEQ ID NO: 3336482 - RNA, 19 nt, Human
agggagggcuccagacaca

SEQ ID NO: 3336483 - RNA, 12 nt, Human
agggagggcucc

SEQ ID NO: 3336484 - RNA, 17 nt, Human
agggagggagggcucca

SEQ ID NO: 3336485 - RNA, 22 nt, Human
agggagggcuccagacacaugu

SEQ ID NO: 3336486 - RNA, 20 nt, Human
agggaguccgaaagggacuu

SEQ ID NO: 3336487 - RNA, 20 nt, Human
agggagugaguugauagcac

SEQ ID NO: 3336488 - RNA, 20 nt, Human
agggagugacagaggcagcc

SEQ ID NO: 3336489 - RNA, 23 nt, Human
agggaguccgaaagggacuugga

SEQ ID NO: 3336490 - RNA, 13 nt, Human
agggcccagagag

SEQ ID NO: 3336491 - RNA, 12 nt, Human
agggcccagaga

SEQ ID NO: 3336492 - RNA, 20 nt, Human
agggcuccagacacaugucc

SEQ ID NO: 3336493 - RNA, 15 nt, Human
agggcuccagacaca

SEQ ID NO: 3336494 - RNA, 14 nt, Human
agggcccagagagg

SEQ ID NO: 3336495 - RNA, 14 nt, Human
ugggcucccuuccc

SEQ ID NO: 3336496 - RNA, 21 nt, Human
ugggcucccuucccaccucuc

SEQ ID NO: 3336497 - RNA, 16 nt, Human
ugggacuacaggugug

SEQ ID NO: 3336498 - RNA, 16 nt, Human
ugggacuacaggcacc

SEQ ID NO: 3336499 - RNA, 18 nt, Human
ugggacuacaggcaccca

SEQ ID NO: 3336500 - RNA, 20 nt, Human
agggacuuggaagcuccgcu

SEQ ID NO: 3336501 - RNA, 19 nt, Human
agggacuuggaagcuccgc

SEQ ID NO: 3336502 - RNA, 18 nt, Human
agggacuuggaagcuccg

SEQ ID NO: 3336503 - RNA, 15 nt, Human
agggacuuggaagcu

SEQ ID NO: 3336504 - RNA, 21 nt, Human
ugggcaacccccagccugcua

SEQ ID NO: 3336505 - RNA, 16 nt, Human
ugggcagaaggaagac

SEQ ID NO: 3336506 - RNA, 20 nt, Human
ugggcagaaggaagacuuca

SEQ ID NO: 3336507 - RNA, 13 nt, Human
ugggcagaaggaa

SEQ ID NO: 3336508 - RNA, 12 nt, Human
ugggcagaagga

SEQ ID NO: 3336509 - RNA, 21 nt, Human
ugggagaaccaaaaagaggcu

SEQ ID NO: 3336510 - RNA, 22 nt, Human
ugggaggaucucuugagccugg

SEQ ID NO: 3336511 - RNA, 18 nt, Human
ugggaggauugcuugagc

SEQ ID NO: 3336512 - RNA, 21 nt, Human
ugggaggauugcuugagcuca

SEQ ID NO: 3336513 - RNA, 22 nt, Human
uguguuaucacccagaagaaaa

SEQ ID NO: 3336514 - RNA, 22 nt, Human
agugggcccaaugcacuuuguu

SEQ ID NO: 3336515 - RNA, 18 nt, Human
agugggggaucacagccu

SEQ ID NO: 3336516 - RNA, 20 nt, Human
ugugucagguggggcagcuu

SEQ ID NO: 3336517 - RNA, 12 nt, Human
ugugguuucauu

SEQ ID NO: 3336518 - RNA, 22 nt, Human
ugugucucuugguccugcugca

SEQ ID NO: 3336519 - RNA, 20 nt, Human
agugugguguuuccuggcac

SEQ ID NO: 3336520 - RNA, 21 nt, Human
agugugccugaagucccagau

SEQ ID NO: 3336521 - RNA, 20 nt, Human
agugugccugaagucccaga

SEQ ID NO: 3336522 - RNA, 20 nt, Human
agugugacugaucucucgug

SEQ ID NO: 3336523 - RNA, 17 nt, Human
uguuaugacuccagaau

SEQ ID NO: 3336524 - RNA, 13 nt, Human
uguuaugacucca

SEQ ID NO: 3336525 - RNA, 22 nt, Human
agugugguguuuccuggcacug

SEQ ID NO: 3336526 - RNA, 19 nt, Human
aguguuguggauuuaacag

SEQ ID NO: 3336527 - RNA, 20 nt, Human
aguguuguggauuuaacaga

SEQ ID NO: 3336528 - RNA, 13 nt, Human
aguuacucagaau

SEQ ID NO: 3336529 - RNA, 16 nt, Human
aguguuguggauuuaa

SEQ ID NO: 3336530 - RNA, 20 nt, Human
uguugcccaggcuggcgugc

SEQ ID NO: 3336531 - RNA, 23 nt, Human
uguugcccaggcuggcgugcagu

SEQ ID NO: 3336532 - RNA, 22 nt, Human
uguugccuaaguauuaaaacau

SEQ ID NO: 3336533 - RNA, 12 nt, Human
uguugccuaagu

SEQ ID NO: 3336534 - RNA, 14 nt, Human
uguggaugauaaaa

SEQ ID NO: 3336535 - RNA, 19 nt, Human
uguggauuuaacagaaaug

SEQ ID NO: 3336536 - RNA, 20 nt, Human
uguggauuuaacagaaaugu

SEQ ID NO: 3336537 - RNA, 23 nt, Human
agugagcugguuuuuagcggaga

SEQ ID NO: 3336538 - RNA, 18 nt, Human
ugugcugcccugcccacc

SEQ ID NO: 3336539 - RNA, 19 nt, Human
ugugcugcccugcccaccu

SEQ ID NO: 3336540 - RNA, 20 nt, Human
ugugcugcccugcccaccug

SEQ ID NO: 3336541 - RNA, 19 nt, Human
ugugcucuggacaggcaug

SEQ ID NO: 3336542 - RNA, 19 nt, Human
ugugcugagucugaaggcu

SEQ ID NO: 3336543 - RNA, 18 nt, Human
ugugcugagucugaaggc

SEQ ID NO: 3336544 - RNA, 16 nt, Human
agugaggaugaaaaaa

SEQ ID NO: 3336545 - RNA, 13 nt, Human
agugaggcucugc

SEQ ID NO: 3336546 - RNA, 12 nt, Human
agugaggcucug

SEQ ID NO: 3336547 - RNA, 17 nt, Human
agugcagugagccgaga

SEQ ID NO: 3336548 - RNA, 14 nt, Human
agugcaugcugucc

SEQ ID NO: 3336549 - RNA, 16 nt, Human
agugcaugcugucccu

SEQ ID NO: 3336550 - RNA, 16 nt, Human
ugugacugaucucucg

SEQ ID NO: 3336551 - RNA, 11 nt, Human
ugugaggaagc

SEQ ID NO: 3336552 - RNA, 16 nt, Human
agucuuagauguauau

SEQ ID NO: 3336553 - RNA, 14 nt, Human
agucuuagauguau

SEQ ID NO: 3336554 - RNA, 13 nt, Human
agucuuagaugua

SEQ ID NO: 3336555 - RNA, 16 nt, Human
agucucuugauucaua

SEQ ID NO: 3336556 - RNA, 17 nt, Human
agucucuugauucauaa

SEQ ID NO: 3336557 - RNA, 21 nt, Human
agugacugauggcuaauguac

SEQ ID NO: 3336558 - RNA, 16 nt, Human
agugaacuugggccac

SEQ ID NO: 3336559 - RNA, 12 nt, Human
agugagcugguu

SEQ ID NO: 3336560 - RNA, 22 nt, Human
ugugaugaugaaaugaggucag

SEQ ID NO: 3336561 - RNA, 19 nt, Human
ugugaugagaggaaaucac

SEQ ID NO: 3336562 - RNA, 18 nt, Human
ugugaugagaggaaauca

SEQ ID NO: 3336563 - RNA, 14 nt, Human
agugagagcugggu

SEQ ID NO: 3336564 - RNA, 14 nt, Human
agugagcacuaagg

SEQ ID NO: 3336565 - RNA, 21 nt, Human
uguacauggaauaacauguaa

SEQ ID NO: 3336566 - RNA, 21 nt, Human
aguacacuguuucaaacuuua

SEQ ID NO: 3336567 - RNA, 23 nt, Human
aguacacuguuucaaacuuuacu

SEQ ID NO: 3336568 - RNA, 20 nt, Human
aguacacuguuucaaacuuu

SEQ ID NO: 3336569 - RNA, 18 nt, Human
uguauauauuuccuauau

SEQ ID NO: 3336570 - RNA, 22 nt, Human
uguauauauuuccuauauuguu

SEQ ID NO: 3336571 - RNA, 17 nt, Human
uguaggguuauaauaau

SEQ ID NO: 3336572 - RNA, 16 nt, Human
uguaggguuauaauaa

SEQ ID NO: 3336573 - RNA, 20 nt, Human
uguacaugaaaacacauuuu

SEQ ID NO: 3336574 - RNA, 14 nt, Human
uguacaugaaaaca

SEQ ID NO: 3336575 - RNA, 19 nt, Human
uguacauaaugcgugcaua

SEQ ID NO: 3336576 - RNA, 20 nt, Human
uguacauaaugcgugcauac

SEQ ID NO: 3336577 - RNA, 20 nt, Human
uguaauuuuuuuaucgucac

SEQ ID NO: 3336578 - RNA, 17 nt, Human
uguaauuaaguacuaug

SEQ ID NO: 3336579 - RNA, 21 nt, Human
uguaauuaaguacuauguauc

SEQ ID NO: 3336580 - RNA, 19 nt, Human
uguaauuaaguacuaugua

SEQ ID NO: 3336581 - RNA, 18 nt, Human
uguaauuaaguacuaugu

SEQ ID NO: 3336582 - RNA, 20 nt, Human
agguuggcaaaaaggcagga

SEQ ID NO: 3336583 - RNA, 12 nt, Human
aggugggaggau

SEQ ID NO: 3336584 - RNA, 22 nt, Human
aggugugagucaccaagcccag

SEQ ID NO: 3336585 - RNA, 21 nt, Human
aggugugagucaccaagccca

SEQ ID NO: 3336586 - RNA, 16 nt, Human
aggugucccugcacuu

SEQ ID NO: 3336587 - RNA, 20 nt, Human
aggugugagucaccaagccc

SEQ ID NO: 3336588 - RNA, 14 nt, Human
agguugaagcacca

SEQ ID NO: 3336589 - RNA, 19 nt, Human
ugucccuuacgugaguccu

SEQ ID NO: 3336590 - RNA, 23 nt, Human
ugucccuuacgugaguccuggca

SEQ ID NO: 3336591 - RNA, 14 nt, Human
ugucccugcacuug

SEQ ID NO: 3336592 - RNA, 19 nt, Human
agucccaccuuggcugcag

SEQ ID NO: 3336593 - RNA, 18 nt, Human
agucccaccuuggcugca

SEQ ID NO: 3336594 - RNA, 16 nt, Human
agucccaccuuggcug

SEQ ID NO: 3336595 - RNA, 15 nt, Human
agucccaccuuggcu

SEQ ID NO: 3336596 - RNA, 14 nt, Human
aguccucccaucuc

SEQ ID NO: 3336597 - RNA, 16 nt, Human
aguccucccaucucac

SEQ ID NO: 3336598 - RNA, 23 nt, Human
agucucacuguugcccaggcugg

SEQ ID NO: 3336599 - RNA, 21 nt, Human
agucucacuguugcccaggcu

SEQ ID NO: 3336600 - RNA, 16 nt, Human
uguccaagaagcccag

SEQ ID NO: 3336601 - RNA, 17 nt, Human
uguccaagaagcccagg

SEQ ID NO: 3336602 - RNA, 18 nt, Human
uguccaagaagcccagga

SEQ ID NO: 3336603 - RNA, 22 nt, Human
uguccaagaagcccaggaaagg

SEQ ID NO: 3336604 - RNA, 23 nt, Human
ugucccugcacuugcagacucua

SEQ ID NO: 3336605 - RNA, 22 nt, Human
ugucccugcacuugcagacucu

SEQ ID NO: 3336606 - RNA, 20 nt, Human
ugucccugcacuugcagacu

SEQ ID NO: 3336607 - RNA, 22 nt, Human
ugucauuugagcagggcucagc

SEQ ID NO: 3336608 - RNA, 21 nt, Human
ugucauuugagcagggcucag

SEQ ID NO: 3336609 - RNA, 20 nt, Human
ugucauuugagcagggcuca

SEQ ID NO: 3336610 - RNA, 20 nt, Human
ugucagguggggcagcuuga

SEQ ID NO: 3336611 - RNA, 18 nt, Human
ugucagguggggcagcuu

SEQ ID NO: 3336612 - RNA, 17 nt, Human
ugucagguggggcagcu

SEQ ID NO: 3336613 - RNA, 14 nt, Human
uguccaagaagccc

SEQ ID NO: 3336614 - RNA, 15 nt, Human
uguccaagaagccca

SEQ ID NO: 3336615 - RNA, 16 nt, Human
ugucagguggggcagc

SEQ ID NO: 3336616 - RNA, 19 nt, Human
ugucauuugagcagggcuc

SEQ ID NO: 3336617 - RNA, 15 nt, Human
agucaccaagcccag

SEQ ID NO: 3336618 - RNA, 14 nt, Human
agucaccaagccca

SEQ ID NO: 3336619 - RNA, 19 nt, Human
aguauucuuauuuaaugaa

SEQ ID NO: 3336620 - RNA, 23 nt, Human
aguauuaaaacauuggauuaucc

SEQ ID NO: 3336621 - RNA, 22 nt, Human
aguauuaaaacauuggauuauc

SEQ ID NO: 3336622 - RNA, 19 nt, Human
aguauuaaaacauuggauu

SEQ ID NO: 3336623 - RNA, 16 nt, Human
aguauuaaaacauugg

SEQ ID NO: 3336624 - RNA, 15 nt, Human
aguauuaaaacauug

SEQ ID NO: 3336625 - RNA, 14 nt, Human
aguauuaaaacauu

SEQ ID NO: 3336626 - RNA, 13 nt, Human
aguauuaaaacau

SEQ ID NO: 3336627 - RNA, 14 nt, Human
auagagagagacca

SEQ ID NO: 3336628 - RNA, 16 nt, Human
auagacaauuuauuau

SEQ ID NO: 3336629 - RNA, 22 nt, Human
auagacaauuuauuauggcaca

SEQ ID NO: 3336630 - RNA, 23 nt, Human
auagacaauuuauuauggcacau

SEQ ID NO: 3336631 - RNA, 13 nt, Human
uuauuaugcauga

SEQ ID NO: 3336632 - RNA, 12 nt, Human
uuauuaugcaug

SEQ ID NO: 3336633 - RNA, 17 nt, Human
auacuccuccaagguua

SEQ ID NO: 3336634 - RNA, 14 nt, Human
auacucccaucugu

SEQ ID NO: 3336635 - RNA, 16 nt, Human
auacucugcuuagaau

SEQ ID NO: 3336636 - RNA, 11 nt, Human
auacucccauc

SEQ ID NO: 3336637 - RNA, 17 nt, Human
uuauaaacuuuaccuuu

SEQ ID NO: 3336638 - RNA, 18 nt, Human
uuauaaacuuuaccuuuu

SEQ ID NO: 3336639 - RNA, 16 nt, Human
auacagaggcaacugc

SEQ ID NO: 3336640 - RNA, 17 nt, Human
auacagaggcaacugca

SEQ ID NO: 3336641 - RNA, 18 nt, Human
auacaguuacucagaauu

SEQ ID NO: 3336642 - RNA, 23 nt, Human
auacaggaaaagcugcugacagu

SEQ ID NO: 3336643 - RNA, 22 nt, Human
auacaggaaaagcugcugacag

SEQ ID NO: 3336644 - RNA, 23 nt, Human
auacagauagauauaugcucugc

SEQ ID NO: 3336645 - RNA, 20 nt, Human
auacaguuacucagaauucu

SEQ ID NO: 3336646 - RNA, 20 nt, Human
auacauaaacaagaccacgu

SEQ ID NO: 3336647 - RNA, 19 nt, Human
auacuaaccagcagaaaug

SEQ ID NO: 3336648 - RNA, 20 nt, Human
auacuaaccagcagaaaugc

SEQ ID NO: 3336649 - RNA, 13 nt, Human
auacuaaccagca

SEQ ID NO: 3336650 - RNA, 14 nt, Human
auaccuuuuuuaga

SEQ ID NO: 3336651 - RNA, 11 nt, Human
auacgaacaaa

SEQ ID NO: 3336652 - RNA, 17 nt, Human
auaccacuuuuguucuu

SEQ ID NO: 3336653 - RNA, 18 nt, Human
auaccacuuuuguucuug

SEQ ID NO: 3336654 - RNA, 14 nt, Human
auacguacacauuu

SEQ ID NO: 3336655 - RNA, 15 nt, Human
auacguacacauuuu

SEQ ID NO: 3336656 - RNA, 16 nt, Human
auacguacacauuuua

SEQ ID NO: 3336657 - RNA, 13 nt, Human
auacguacacauu

SEQ ID NO: 3336658 - RNA, 13 nt, Human
auacgaacaaaac

SEQ ID NO: 3336659 - RNA, 17 nt, Human
uuaucacccagaagaaa

SEQ ID NO: 3336660 - RNA, 18 nt, Human
uuaucacccagaagaaaa

SEQ ID NO: 3336661 - RNA, 19 nt, Human
uuaucacccagaagaaaau

SEQ ID NO: 3336662 - RNA, 21 nt, Human
uuaucacccagaagaaaauag

SEQ ID NO: 3336663 - RNA, 11 nt, Human
uuaugacucca

SEQ ID NO: 3336664 - RNA, 22 nt, Human
uuaugggcuggguucuacccag

SEQ ID NO: 3336665 - RNA, 19 nt, Human
uuauggcuuuugugcauua

SEQ ID NO: 3336666 - RNA, 18 nt, Human
uuauggcuuuugugcauu

SEQ ID NO: 3336667 - RNA, 13 nt, Human
uuaugggcugggu

SEQ ID NO: 3336668 - RNA, 17 nt, Human
uuaaaaaucucaaauuu

SEQ ID NO: 3336669 - RNA, 20 nt, Human
uuaaaaaucucaaauuucua

SEQ ID NO: 3336670 - RNA, 19 nt, Human
uuaaaaaucucaaauuucu

SEQ ID NO: 3336671 - RNA, 22 nt, Human
aguuuguuaguaugaggcauuu

SEQ ID NO: 3336672 - RNA, 19 nt, Human
aguuucugccgcagcccug

SEQ ID NO: 3336673 - RNA, 15 nt, Human
aguuucugccgcagc

SEQ ID NO: 3336674 - RNA, 21 nt, Human
aguuucuccaagcaggacaug

SEQ ID NO: 3336675 - RNA, 14 nt, Human
aguuucucuuuuca

SEQ ID NO: 3336676 - RNA, 13 nt, Human
uuaacagaaaugu

SEQ ID NO: 3336677 - RNA, 14 nt, Human
uuaacagaaaugua

SEQ ID NO: 3336678 - RNA, 12 nt, Human
uuaacagaaaug

SEQ ID NO: 3336679 - RNA, 15 nt, Human
uuaaucuaaauggaa

SEQ ID NO: 3336680 - RNA, 23 nt, Human
uuaacuuuuauaaacuuuaccuu

SEQ ID NO: 3336681 - RNA, 22 nt, Human
uuaacuuuuauaaacuuuaccu

SEQ ID NO: 3336682 - RNA, 18 nt, Human
uuaacuuuuauaaacuuu

SEQ ID NO: 3336683 - RNA, 14 nt, Human
uuaccagcagagca

SEQ ID NO: 3336684 - RNA, 19 nt, Human
uuaccagcagagcaccuua

SEQ ID NO: 3336685 - RNA, 14 nt, Human
uuacaggugugaac

SEQ ID NO: 3336686 - RNA, 13 nt, Human
uuacuguacauga

SEQ ID NO: 3336687 - RNA, 14 nt, Human
uuacuguacaugaa

SEQ ID NO: 3336688 - RNA, 22 nt, Human
uuacuguacaugaaaacacauu

SEQ ID NO: 3336689 - RNA, 23 nt, Human
uuacuguacaugaaaacacauuu

SEQ ID NO: 3336690 - RNA, 12 nt, Human
uuacuguacaug

SEQ ID NO: 3336691 - RNA, 15 nt, Human
uuacugcagcuuugu

SEQ ID NO: 3336692 - RNA, 14 nt, Human
auaagauucauauu

SEQ ID NO: 3336693 - RNA, 16 nt, Human
uuagaagucacacagu

SEQ ID NO: 3336694 - RNA, 13 nt, Human
uuaguagagacag

SEQ ID NO: 3336695 - RNA, 14 nt, Human
uuaguagagacagg

SEQ ID NO: 3336696 - RNA, 13 nt, Human
uuauaaacuuuac

SEQ ID NO: 3336697 - RNA, 21 nt, Human
uuaggugugacugaauuucuu

SEQ ID NO: 3336698 - RNA, 19 nt, Human
uuaggugugggggaagcac

SEQ ID NO: 3336699 - RNA, 18 nt, Human
auaauuuaccugaagucu

SEQ ID NO: 3336700 - RNA, 21 nt, Human
auaagauucauauuuacuucu

SEQ ID NO: 3336701 - RNA, 22 nt, Human
auaagccaaaaaaugcuugcuu

SEQ ID NO: 3336702 - RNA, 13 nt, Human
ugaggggccucuu

SEQ ID NO: 3336703 - RNA, 12 nt, Human
ugaggggccucu

SEQ ID NO: 3336704 - RNA, 20 nt, Human
ugaggcccuucucuccagcc

SEQ ID NO: 3336705 - RNA, 22 nt, Human
ugaggcccuucucuccagcccc

SEQ ID NO: 3336706 - RNA, 23 nt, Human
ugaggcccuucucuccagccccu

SEQ ID NO: 3336707 - RNA, 24 nt, Human
ugaggcccuucucuccagccccug

SEQ ID NO: 3336708 - RNA, 18 nt, Human
ugaggcccuucucuccag

SEQ ID NO: 3336709 - RNA, 19 nt, Human
ugaggcccuucucuccagc

SEQ ID NO: 3336710 - RNA, 16 nt, Human
ugaggcccuucucucc

SEQ ID NO: 3336711 - RNA, 19 nt, Human
ugagggauacccaucccau

SEQ ID NO: 3336712 - RNA, 17 nt, Human
agcagaggaaggagagg

SEQ ID NO: 3336713 - RNA, 19 nt, Human
agcagauggagaccccuug

SEQ ID NO: 3336714 - RNA, 18 nt, Human
agcagagaccaucccuga

SEQ ID NO: 3336715 - RNA, 19 nt, Human
agcagagaccaucccugaa

SEQ ID NO: 3336716 - RNA, 17 nt, Human
agcagagaccaucccug

SEQ ID NO: 3336717 - RNA, 20 nt, Human
agcagagcaccuuagacagu

SEQ ID NO: 3336718 - RNA, 20 nt, Human
agcagagaccaucccugaag

SEQ ID NO: 3336719 - RNA, 20 nt, Human
ugaggguugggcugguguca

SEQ ID NO: 3336720 - RNA, 16 nt, Human
ugaggucagagccugc

SEQ ID NO: 3336721 - RNA, 14 nt, Human
ugaggucagagccu

SEQ ID NO: 3336722 - RNA, 13 nt, Human
ugaggucagagcc

SEQ ID NO: 3336723 - RNA, 23 nt, Human
ugaggcccagagggccugcaagg

SEQ ID NO: 3336724 - RNA, 21 nt, Human
ugaggcccagagggccugcaa

SEQ ID NO: 3336725 - RNA, 22 nt, Human
ugaggcccagagggccugcaag

SEQ ID NO: 3336726 - RNA, 15 nt, Human
ugaggcccagagggc

SEQ ID NO: 3336727 - RNA, 17 nt, Human
ugaggcccagagggccu

SEQ ID NO: 3336728 - RNA, 18 nt, Human
ugaggcccagagggccug

SEQ ID NO: 3336729 - RNA, 20 nt, Human
ugaggcccagagggccugca

SEQ ID NO: 3336730 - RNA, 20 nt, Human
ugaggccagagacacaagcc

SEQ ID NO: 3336731 - RNA, 14 nt, Human
ugaggccagagaca

SEQ ID NO: 3336732 - RNA, 16 nt, Human
ugaggccagagacaca

SEQ ID NO: 3336733 - RNA, 12 nt, Human
ugaggcccagag

SEQ ID NO: 3336734 - RNA, 13 nt, Human
ugaggcccagagg

SEQ ID NO: 3336735 - RNA, 22 nt, Human
ugaggaauccagacccggcugc

SEQ ID NO: 3336736 - RNA, 21 nt, Human
ugaggaauccagacccggcug

SEQ ID NO: 3336737 - RNA, 23 nt, Human
ugaggcauuuguuugaacugaua

SEQ ID NO: 3336738 - RNA, 12 nt, Human
ugaggccagaga

SEQ ID NO: 3336739 - RNA, 21 nt, Human
ugaggacacuaaccacgcugg

SEQ ID NO: 3336740 - RNA, 15 nt, Human
ugaggaagcaaaagc

SEQ ID NO: 3336741 - RNA, 22 nt, Human
ugaggaagcaaaagcaucuaug

SEQ ID NO: 3336742 - RNA, 14 nt, Human
ugaggaagccgcug

SEQ ID NO: 3336743 - RNA, 17 nt, Human
ugaggaagccgcugggg

SEQ ID NO: 3336744 - RNA, 18 nt, Human
ugaggaagccgcuggggc

SEQ ID NO: 3336745 - RNA, 19 nt, Human
ugaggaagccgcuggggcc

SEQ ID NO: 3336746 - RNA, 21 nt, Human
ugaggaagccgcuggggccag

SEQ ID NO: 3336747 - RNA, 15 nt, Human
ugagcaauccugcaa

SEQ ID NO: 3336748 - RNA, 23 nt, Human
ugagcacuaaggugugcucugau

SEQ ID NO: 3336749 - RNA, 22 nt, Human
ugagcacuaaggugugcucuga

SEQ ID NO: 3336750 - RNA, 21 nt, Human
ugagcacuaaggugugcucug

SEQ ID NO: 3336751 - RNA, 20 nt, Human
ugagcacuaaggugugcucu

SEQ ID NO: 3336752 - RNA, 14 nt, Human
ugagccagauuuca

SEQ ID NO: 3336753 - RNA, 16 nt, Human
ugagccagauuucacu

SEQ ID NO: 3336754 - RNA, 13 nt, Human
ugagccagauuuc

SEQ ID NO: 3336755 - RNA, 23 nt, Human
ugagccacugcaccgggccacag

SEQ ID NO: 3336756 - RNA, 18 nt, Human
ugagccacugcaccgggc

SEQ ID NO: 3336757 - RNA, 21 nt, Human
ugagccacugcaccgggccac

SEQ ID NO: 3336758 - RNA, 21 nt, Human
ugagcaucaggccaggcccuc

SEQ ID NO: 3336759 - RNA, 22 nt, Human
ugagcaucaggccaggcccucu

SEQ ID NO: 3336760 - RNA, 24 nt, Human
ugagcaucaggccaggcccucugc

SEQ ID NO: 3336761 - RNA, 17 nt, Human
ugagccagauuucacuc

SEQ ID NO: 3336762 - RNA, 22 nt, Human
ugagccagauuucacucuccuu

SEQ ID NO: 3336763 - RNA, 21 nt, Human
ugagccagauuucacucuccu

SEQ ID NO: 3336764 - RNA, 13 nt, Human
agcaagugagagc

SEQ ID NO: 3336765 - RNA, 16 nt, Human
agcaagugagacccug

SEQ ID NO: 3336766 - RNA, 20 nt, Human
agcaagugagacccugucuc

SEQ ID NO: 3336767 - RNA, 18 nt, Human
agcaagugagagcugggu

SEQ ID NO: 3336768 - RNA, 22 nt, Human
agcaagugagagcuggguguca

SEQ ID NO: 3336769 - RNA, 13 nt, Human
agcacaugccucu

SEQ ID NO: 3336770 - RNA, 14 nt, Human
agcacaugccucuc

SEQ ID NO: 3336771 - RNA, 22 nt, Human
agcaccaaaagcuuaccaaggg

SEQ ID NO: 3336772 - RNA, 14 nt, Human
agcacgauuucugu

SEQ ID NO: 3336773 - RNA, 15 nt, Human
agcacgauuucuguu

SEQ ID NO: 3336774 - RNA, 16 nt, Human
agcacgauuucuguuu

SEQ ID NO: 3336775 - RNA, 13 nt, Human
agcacgauuucug

SEQ ID NO: 3336776 - RNA, 23 nt, Human
agcaccuuagacagucccugcca

SEQ ID NO: 3336777 - RNA, 19 nt, Human
agcaccuuagacagucccu

SEQ ID NO: 3336778 - RNA, 20 nt, Human
agcaccuuagacagucccug

SEQ ID NO: 3336779 - RNA, 21 nt, Human
agcaccuuagacagucccugc

SEQ ID NO: 3336780 - RNA, 22 nt, Human
agcaccuuagacagucccugcc

SEQ ID NO: 3336781 - RNA, 23 nt, Human
agcacuuugggaggccaaggugg

SEQ ID NO: 3336782 - RNA, 22 nt, Human
agcacuuugggaggccaaggug

SEQ ID NO: 3336783 - RNA, 12 nt, Human
agcagaaaugcc

SEQ ID NO: 3336784 - RNA, 13 nt, Human
agcagaaaugccu

SEQ ID NO: 3336785 - RNA, 19 nt, Human
agcagaaaugccuuacccu

SEQ ID NO: 3336786 - RNA, 21 nt, Human
agcagagaaugaaagggccca

SEQ ID NO: 3336787 - RNA, 21 nt, Human
agcagagaauucucuuaucca

SEQ ID NO: 3336788 - RNA, 14 nt, Human
agcagagaauucuc

SEQ ID NO: 3336789 - RNA, 23 nt, Human
agcagagaaugaaagggcccaga

SEQ ID NO: 3336790 - RNA, 22 nt, Human
agcagagaaugaaagggcccag

SEQ ID NO: 3336791 - RNA, 15 nt, Human
agcagagaccauccc

SEQ ID NO: 3336792 - RNA, 16 nt, Human
agcagagaccaucccu

SEQ ID NO: 3336793 - RNA, 10 nt, Human
ugagccuggc

SEQ ID NO: 3336794 - RNA, 14 nt, Human
ugagccuugaacuu

SEQ ID NO: 3336795 - RNA, 19 nt, Human
ugagccugggaggucaagg

SEQ ID NO: 3336796 - RNA, 22 nt, Human
ugagccugggaggucaaggcug

SEQ ID NO: 3336797 - RNA, 11 nt, Human
ugagccuggca

SEQ ID NO: 3336798 - RNA, 16 nt, Human
ugagccuggcaagaau

SEQ ID NO: 3336799 - RNA, 14 nt, Human
ugagccugggaggu

SEQ ID NO: 3336800 - RNA, 15 nt, Human
ugagccuugaacuuu

SEQ ID NO: 3336801 - RNA, 17 nt, Human
ugagccuugaacuuuga

SEQ ID NO: 3336802 - RNA, 18 nt, Human
ugagccuugaacuuugac

SEQ ID NO: 3336803 - RNA, 19 nt, Human
ugagccuugaacuuugacc

SEQ ID NO: 3336804 - RNA, 13 nt, Human
ugaccucugccug

SEQ ID NO: 3336805 - RNA, 14 nt, Human
ugaccucugccuga

SEQ ID NO: 3336806 - RNA, 12 nt, Human
ugaccugaggcc

SEQ ID NO: 3336807 - RNA, 18 nt, Human
agaugcuucucacugcca

SEQ ID NO: 3336808 - RNA, 16 nt, Human
agaugcuucucacugc

SEQ ID NO: 3336809 - RNA, 14 nt, Human
ugaccugaggcccu

SEQ ID NO: 3336810 - RNA, 15 nt, Human
ugaccugaggcccuu

SEQ ID NO: 3336811 - RNA, 17 nt, Human
ugacuccagaauuuccc

SEQ ID NO: 3336812 - RNA, 19 nt, Human
ugacuccagaauuucccaa

SEQ ID NO: 3336813 - RNA, 20 nt, Human
ugacuccagaauuucccaaa

SEQ ID NO: 3336814 - RNA, 23 nt, Human
ugacuccagaauuucccaaagca

SEQ ID NO: 3336815 - RNA, 17 nt, Human
agauuugaacucuucaa

SEQ ID NO: 3336816 - RNA, 13 nt, Human
agauuucacucuc

SEQ ID NO: 3336817 - RNA, 14 nt, Human
agauuucacucucc

SEQ ID NO: 3336818 - RNA, 18 nt, Human
agaggcaacugcauuggc

SEQ ID NO: 3336819 - RNA, 11 nt, Human
agaggaaauca

SEQ ID NO: 3336820 - RNA, 12 nt, Human
agaggaaaucac

SEQ ID NO: 3336821 - RNA, 12 nt, Human
agaggaaagcaa

SEQ ID NO: 3336822 - RNA, 16 nt, Human
agaggaaagcaaagga

SEQ ID NO: 3336823 - RNA, 18 nt, Human
agaggaaagcaaaggaga

SEQ ID NO: 3336824 - RNA, 19 nt, Human
agaggaaagcaaaggagau

SEQ ID NO: 3336825 - RNA, 19 nt, Human
agagcugggugucaagagg

SEQ ID NO: 3336826 - RNA, 13 nt, Human
ugaagacaaugac

SEQ ID NO: 3336827 - RNA, 17 nt, Human
ugaagacaaugacuuac

SEQ ID NO: 3336828 - RNA, 11 nt, Human
ugaagacaaug

SEQ ID NO: 3336829 - RNA, 16 nt, Human
ugaacuuugaccucug

SEQ ID NO: 3336830 - RNA, 14 nt, Human
ucuuuggucuacac

SEQ ID NO: 3336831 - RNA, 21 nt, Human
ucuuuggucuacacugugcug

SEQ ID NO: 3336832 - RNA, 11 nt, Human
ugaacuuugac

SEQ ID NO: 3336833 - RNA, 22 nt, Human
agagggagggagggcuccagac

SEQ ID NO: 3336834 - RNA, 21 nt, Human
agagggagggagggcuccaga

SEQ ID NO: 3336835 - RNA, 20 nt, Human
agagggagggagggcuccag

SEQ ID NO: 3336836 - RNA, 21 nt, Human
agaucaaccccuucgcuccug

SEQ ID NO: 3336837 - RNA, 19 nt, Human
agaucaaccccuucgcucc

SEQ ID NO: 3336838 - RNA, 14 nt, Human
agaucaaccccuuc

SEQ ID NO: 3336839 - RNA, 22 nt, Human
agauauuuugcuuugugauuuu

SEQ ID NO: 3336840 - RNA, 19 nt, Human
agagugagacucugucuca

SEQ ID NO: 3336841 - RNA, 19 nt, Human
agauaaggguaucugguga

SEQ ID NO: 3336842 - RNA, 17 nt, Human
agauaaggguaucuggu

SEQ ID NO: 3336843 - RNA, 15 nt, Human
ugaaugucaguguga

SEQ ID NO: 3336844 - RNA, 14 nt, Human
ugaaugucagugug

SEQ ID NO: 3336845 - RNA, 20 nt, Human
agagucucacuguugcccag

SEQ ID NO: 3336846 - RNA, 16 nt, Human
agagugagacucuguc

SEQ ID NO: 3336847 - RNA, 15 nt, Human
agagugagacucugu

SEQ ID NO: 3336848 - RNA, 14 nt, Human
agacagucccugcc

SEQ ID NO: 3336849 - RNA, 16 nt, Human
agacagucccugccaa

SEQ ID NO: 3336850 - RNA, 17 nt, Human
agacagucccugccaau

SEQ ID NO: 3336851 - RNA, 15 nt, Human
agacagucccugcca

SEQ ID NO: 3336852 - RNA, 21 nt, Human
agacaggguuuugccauguug

SEQ ID NO: 3336853 - RNA, 15 nt, Human
agacaggaccaggga

SEQ ID NO: 3336854 - RNA, 22 nt, Human
agacaggcaagcaccuccugcc

SEQ ID NO: 3336855 - RNA, 23 nt, Human
agacaggcaagcaccuccugccu

SEQ ID NO: 3336856 - RNA, 16 nt, Human
agacagcugccuggga

SEQ ID NO: 3336857 - RNA, 22 nt, Human
ucuuccaggcugggagagccuu

SEQ ID NO: 3336858 - RNA, 21 nt, Human
ucuuccaggcugggagagccu

SEQ ID NO: 3336859 - RNA, 22 nt, Human
ucuucccuacaguugaaaaaca

SEQ ID NO: 3336860 - RNA, 15 nt, Human
ucuuaugggcugggu

SEQ ID NO: 3336861 - RNA, 16 nt, Human
ucuuaugggcuggguu

SEQ ID NO: 3336862 - RNA, 13 nt, Human
ucuuaugggcugg

SEQ ID NO: 3336863 - RNA, 14 nt, Human
ucuuaugggcuggg

SEQ ID NO: 3336864 - RNA, 22 nt, Human
ucuuauugcccacgcuggagug

SEQ ID NO: 3336865 - RNA, 18 nt, Human
ucuuauugcccacgcugg

SEQ ID NO: 3336866 - RNA, 14 nt, Human
ucuuauugcccacg

SEQ ID NO: 3336867 - RNA, 15 nt, Human
ucugucauuugagca

SEQ ID NO: 3336868 - RNA, 23 nt, Human
ucugucauuugagcagggcucag

SEQ ID NO: 3336869 - RNA, 20 nt, Human
ucugucauuugagcagggcu

SEQ ID NO: 3336870 - RNA, 18 nt, Human
ucugguccauagagagca

SEQ ID NO: 3336871 - RNA, 16 nt, Human
ucuggguucacugcaa

SEQ ID NO: 3336872 - RNA, 14 nt, Human
ucuggguucacugc

SEQ ID NO: 3336873 - RNA, 11 nt, Human
ucuggggcugu

SEQ ID NO: 3336874 - RNA, 20 nt, Human
ucuguuggccagugugacaa

SEQ ID NO: 3336875 - RNA, 19 nt, Human
ucuguuggccagugugaca

SEQ ID NO: 3336876 - RNA, 18 nt, Human
ucuguuggccagugugac

SEQ ID NO: 3336877 - RNA, 15 nt, Human
ucugugaaaggaaag

SEQ ID NO: 3336878 - RNA, 21 nt, Human
ucugugaaaggaaagagggag

SEQ ID NO: 3336879 - RNA, 23 nt, Human
agaauuucccaaagcagugcaug

SEQ ID NO: 3336880 - RNA, 17 nt, Human
agaauuucccaaagcag

SEQ ID NO: 3336881 - RNA, 18 nt, Human
agaauuucccaaagcagu

SEQ ID NO: 3336882 - RNA, 13 nt, Human
agacccugcccug

SEQ ID NO: 3336883 - RNA, 14 nt, Human
agacccugcccugu

SEQ ID NO: 3336884 - RNA, 12 nt, Human
agacccugcccu

SEQ ID NO: 3336885 - RNA, 19 nt, Human
agacccuuguggucccacc

SEQ ID NO: 3336886 - RNA, 20 nt, Human
agacccuuguggucccaccc

SEQ ID NO: 3336887 - RNA, 22 nt, Human
agacccuuguggucccacccca

SEQ ID NO: 3336888 - RNA, 23 nt, Human
agacccuuguggucccaccccac

SEQ ID NO: 3336889 - RNA, 16 nt, Human
agacccugcccugugg

SEQ ID NO: 3336890 - RNA, 19 nt, Human
agacccugcccugugggcc

SEQ ID NO: 3336891 - RNA, 21 nt, Human
agacccugcccugugggcccc

SEQ ID NO: 3336892 - RNA, 23 nt, Human
agacccugcccugugggccccca

SEQ ID NO: 3336893 - RNA, 13 nt, Human
agacccuuguggu

SEQ ID NO: 3336894 - RNA, 15 nt, Human
agacccuuguggucc

SEQ ID NO: 3336895 - RNA, 17 nt, Human
agacucauucuucugua

SEQ ID NO: 3336896 - RNA, 18 nt, Human
agacucauucuucuguac

SEQ ID NO: 3336897 - RNA, 15 nt, Human
agacuaucuaaaugu

SEQ ID NO: 3336898 - RNA, 18 nt, Human
agacuaucuaaauguuga

SEQ ID NO: 3336899 - RNA, 17 nt, Human
agacuaucuaaauguug

SEQ ID NO: 3336900 - RNA, 19 nt, Human
agacuaucuaaauguugaa

SEQ ID NO: 3336901 - RNA, 16 nt, Human
ucuugcaauggcagcc

SEQ ID NO: 3336902 - RNA, 13 nt, Human
ucuugcaauggca

SEQ ID NO: 3336903 - RNA, 17 nt, Human
ucuugcaauggcagccu

SEQ ID NO: 3336904 - RNA, 15 nt, Human
agacucauucuucug

SEQ ID NO: 3336905 - RNA, 21 nt, Human
agacucgcgacaaugcaaacc

SEQ ID NO: 3336906 - RNA, 17 nt, Human
agacucuacagaggcca

SEQ ID NO: 3336907 - RNA, 18 nt, Human
agacuccugcaggcagcc

SEQ ID NO: 3336908 - RNA, 19 nt, Human
agacuccugcaggcagcca

SEQ ID NO: 3336909 - RNA, 20 nt, Human
agacuccugcaggcagccag

SEQ ID NO: 3336910 - RNA, 13 nt, Human
ucuuuccugaggc

SEQ ID NO: 3336911 - RNA, 14 nt, Human
ucuuuccugaggcu

SEQ ID NO: 3336912 - RNA, 15 nt, Human
ucuuuccugaggcug

SEQ ID NO: 3336913 - RNA, 12 nt, Human
ucuuuccugagg

SEQ ID NO: 3336914 - RNA, 14 nt, Human
agacuccugcaggc

SEQ ID NO: 3336915 - RNA, 15 nt, Human
agacuccugcaggca

SEQ ID NO: 3336916 - RNA, 16 nt, Human
agacuccugcaggcag

SEQ ID NO: 3336917 - RNA, 17 nt, Human
agacuccugcaggcagc

SEQ ID NO: 3336918 - RNA, 15 nt, Human
ucuuuacuucaugga

SEQ ID NO: 3336919 - RNA, 15 nt, Human
agagaccaucccuga

SEQ ID NO: 3336920 - RNA, 13 nt, Human
agagaccaucccu

SEQ ID NO: 3336921 - RNA, 14 nt, Human
agagaccaucccug

SEQ ID NO: 3336922 - RNA, 12 nt, Human
agacuuuggaaa

SEQ ID NO: 3336923 - RNA, 14 nt, Human
agacuuuggaaaga

SEQ ID NO: 3336924 - RNA, 18 nt, Human
agagaaugaaagggccca

SEQ ID NO: 3336925 - RNA, 14 nt, Human
agacuucaucccuc

SEQ ID NO: 3336926 - RNA, 17 nt, Human
agacuucaucccucugg

SEQ ID NO: 3336927 - RNA, 16 nt, Human
ucugcucacauaucug

SEQ ID NO: 3336928 - RNA, 14 nt, Human
ucugcccuccaaga

SEQ ID NO: 3336929 - RNA, 23 nt, Human
ucugccgcagcccugcagagggc

SEQ ID NO: 3336930 - RNA, 14 nt, Human
ucuggcagcucaga

SEQ ID NO: 3336931 - RNA, 15 nt, Human
ucuggcagcucagag

SEQ ID NO: 3336932 - RNA, 23 nt, Human
ucuggcagaguugaagacagagc

SEQ ID NO: 3336933 - RNA, 23 nt, Human
ucugcuuuuuaaagaaugcucuu

SEQ ID NO: 3336934 - RNA, 18 nt, Human
ucuggagguacgaaaaga

SEQ ID NO: 3336935 - RNA, 15 nt, Human
agaagcggcuggcag

SEQ ID NO: 3336936 - RNA, 16 nt, Human
agaagcggcuggcagc

SEQ ID NO: 3336937 - RNA, 22 nt, Human
ucugcacuccccugcugggugu

SEQ ID NO: 3336938 - RNA, 20 nt, Human
ucugauucccaagcucugcu

SEQ ID NO: 3336939 - RNA, 19 nt, Human
ucugauucccaagcucugc

SEQ ID NO: 3336940 - RNA, 18 nt, Human
ucugauucccaagcucug

SEQ ID NO: 3336941 - RNA, 19 nt, Human
ucugacccugcuucaaaua

SEQ ID NO: 3336942 - RNA, 23 nt, Human
ucugacccaugcugcccugugag

SEQ ID NO: 3336943 - RNA, 17 nt, Human
agaaauguacagcaagg

SEQ ID NO: 3336944 - RNA, 16 nt, Human
agaaauguacagcaag

SEQ ID NO: 3336945 - RNA, 11 nt, Human
agaaauguguu

SEQ ID NO: 3336946 - RNA, 12 nt, Human
ucuccucugcug

SEQ ID NO: 3336947 - RNA, 19 nt, Human
ucucccuuggauugucccc

SEQ ID NO: 3336948 - RNA, 23 nt, Human
ucuccgaccagacaccuugacag

SEQ ID NO: 3336949 - RNA, 13 nt, Human
ucuccucugcugc

SEQ ID NO: 3336950 - RNA, 14 nt, Human
ucuccucugcugcu

SEQ ID NO: 3336951 - RNA, 11 nt, Human
ucucccuugga

SEQ ID NO: 3336952 - RNA, 18 nt, Human
ucucccuuggauuguccc

SEQ ID NO: 3336953 - RNA, 17 nt, Human
acuuuggaaagacuuuu

SEQ ID NO: 3336954 - RNA, 13 nt, Human
acuuuggaaagac

SEQ ID NO: 3336955 - RNA, 14 nt, Human
acuuuggaaagacu

SEQ ID NO: 3336956 - RNA, 12 nt, Human
acuuuggaaaga

SEQ ID NO: 3336957 - RNA, 19 nt, Human
acuuuaccuuuuuuauaca

SEQ ID NO: 3336958 - RNA, 22 nt, Human
acuuuaccuuuuuuauacauaa

SEQ ID NO: 3336959 - RNA, 18 nt, Human
acuuuaccuuuuuuauac

SEQ ID NO: 3336960 - RNA, 12 nt, Human
acuuuaccuuuu

SEQ ID NO: 3336961 - RNA, 23 nt, Human
acuuugaccucugcagcaauaaa

SEQ ID NO: 3336962 - RNA, 19 nt, Human
acuuugaccucugcagcaa

SEQ ID NO: 3336963 - RNA, 22 nt, Human
ucucuuuaaugucacaggcagg

SEQ ID NO: 3336964 - RNA, 13 nt, Human
ucucuugagccug

SEQ ID NO: 3336965 - RNA, 14 nt, Human
ucucuugagccugg

SEQ ID NO: 3336966 - RNA, 15 nt, Human
ucucuugagccuggg

SEQ ID NO: 3336967 - RNA, 21 nt, Human
ucucuuuaaugucacaggcag

SEQ ID NO: 3336968 - RNA, 18 nt, Human
agaaaaaggaugcacaga

SEQ ID NO: 3336969 - RNA, 13 nt, Human
ucucuccagcccc

SEQ ID NO: 3336970 - RNA, 14 nt, Human
ucucuccagccccu

SEQ ID NO: 3336971 - RNA, 20 nt, Human
ucuccuucaccuuugucccc

SEQ ID NO: 3336972 - RNA, 18 nt, Human
ucuccuucaccuuugucc

SEQ ID NO: 3336973 - RNA, 20 nt, Human
ucucuccuguaccucuugag

SEQ ID NO: 3336974 - RNA, 22 nt, Human
ucucuccuguaccucuugagcc

SEQ ID NO: 3336975 - RNA, 17 nt, Human
ucucuccuguaccucuu

SEQ ID NO: 3336976 - RNA, 15 nt, Human
ucucuccagccccug

SEQ ID NO: 3336977 - RNA, 14 nt, Human
ucucuugagagggu

SEQ ID NO: 3336978 - RNA, 11 nt, Human
uccaagcuggu

SEQ ID NO: 3336979 - RNA, 12 nt, Human
uccaagcuccca

SEQ ID NO: 3336980 - RNA, 13 nt, Human
uccaagcucccag

SEQ ID NO: 3336981 - RNA, 14 nt, Human
uccaagcucccagg

SEQ ID NO: 3336982 - RNA, 15 nt, Human
uccaagcucccaggc

SEQ ID NO: 3336983 - RNA, 16 nt, Human
uccaagcucccaggca

SEQ ID NO: 3336984 - RNA, 13 nt, Human
ucauuuuuuuuaa

SEQ ID NO: 3336985 - RNA, 21 nt, Human
ucauuugagcagggcucagcg

SEQ ID NO: 3336986 - RNA, 14 nt, Human
accuggaauauaua

SEQ ID NO: 3336987 - RNA, 19 nt, Human
ucauuugagcagggcucag

SEQ ID NO: 3336988 - RNA, 19 nt, Human
accugcggugcuaucuccc

SEQ ID NO: 3336989 - RNA, 22 nt, Human
accugcggugcuaucuccccca

SEQ ID NO: 3336990 - RNA, 15 nt, Human
accugaagucuuugu

SEQ ID NO: 3336991 - RNA, 22 nt, Human
accugaagucuuuguacagaca

SEQ ID NO: 3336992 - RNA, 18 nt, Human
accugcggugcuaucucc

SEQ ID NO: 3336993 - RNA, 15 nt, Human
uccaccaucaagcca

SEQ ID NO: 3336994 - RNA, 12 nt, Human
accuucuccuuc

SEQ ID NO: 3336995 - RNA, 13 nt, Human
accuucuccuuca

SEQ ID NO: 3336996 - RNA, 15 nt, Human
accuugaaugaugcc

SEQ ID NO: 3336997 - RNA, 14 nt, Human
accuugacagggca

SEQ ID NO: 3336998 - RNA, 15 nt, Human
accuugacagggcac

SEQ ID NO: 3336999 - RNA, 15 nt, Human
accuuuguauucucu

SEQ ID NO: 3337000 - RNA, 19 nt, Human
accuuuguauucucuccug

SEQ ID NO: 3337001 - RNA, 23 nt, Human
accuuuguauucucuccuguacc

SEQ ID NO: 3337002 - RNA, 22 nt, Human
uccagaaguuugagaucagccu

SEQ ID NO: 3337003 - RNA, 16 nt, Human
uccagccccuggaugc

SEQ ID NO: 3337004 - RNA, 17 nt, Human
uccagccccuggaugca

SEQ ID NO: 3337005 - RNA, 19 nt, Human
uccagccccuggaugcagc

SEQ ID NO: 3337006 - RNA, 21 nt, Human
uccagccccuggaugcagccu

SEQ ID NO: 3337007 - RNA, 15 nt, Human
uccagccccuggaug

SEQ ID NO: 3337008 - RNA, 14 nt, Human
uccagccccuggau

SEQ ID NO: 3337009 - RNA, 11 nt, Human
uccagccuggg

SEQ ID NO: 3337010 - RNA, 22 nt, Human
uccagccccuggaugcagccuc

SEQ ID NO: 3337011 - RNA, 13 nt, Human
accuagccuuaga

SEQ ID NO: 3337012 - RNA, 20 nt, Human
accuccgccucuuggguuca

SEQ ID NO: 3337013 - RNA, 18 nt, Human
ucauccacugugccaugu

SEQ ID NO: 3337014 - RNA, 20 nt, Human
accgcagacaggaccaggga

SEQ ID NO: 3337015 - RNA, 17 nt, Human
accgccaaggcuggggg

SEQ ID NO: 3337016 - RNA, 17 nt, Human
accgcagacaggaccag

SEQ ID NO: 3337017 - RNA, 16 nt, Human
ucauauuuacuucuua

SEQ ID NO: 3337018 - RNA, 21 nt, Human
ucauauuuacuucuuauacau

SEQ ID NO: 3337019 - RNA, 20 nt, Human
ucauauuuacuucuuauaca

SEQ ID NO: 3337020 - RNA, 10 nt, Human
acccuuuucu

SEQ ID NO: 3337021 - RNA, 23 nt, Human
accucucccuuggauuguccccg

SEQ ID NO: 3337022 - RNA, 14 nt, Human
accucucucacucc

SEQ ID NO: 3337023 - RNA, 19 nt, Human
accucucucacuccuugaa

SEQ ID NO: 3337024 - RNA, 13 nt, Human
accucucccuugg

SEQ ID NO: 3337025 - RNA, 14 nt, Human
accucucccuugga

SEQ ID NO: 3337026 - RNA, 15 nt, Human
accucucccuuggau

SEQ ID NO: 3337027 - RNA, 22 nt, Human
ucauugaccugaggcccuucuc

SEQ ID NO: 3337028 - RNA, 21 nt, Human
ucauucuccuuguguuacuaa

SEQ ID NO: 3337029 - RNA, 19 nt, Human
ucauugaccugaggcccuu

SEQ ID NO: 3337030 - RNA, 13 nt, Human
ucaugucuggcua

SEQ ID NO: 3337031 - RNA, 11 nt, Human
ucauguucuua

SEQ ID NO: 3337032 - RNA, 17 nt, Human
ucauguucuuaauucuu

SEQ ID NO: 3337033 - RNA, 21 nt, Human
ucauccacugugccaugugcc

SEQ ID NO: 3337034 - RNA, 19 nt, Human
ucauccacugugccaugug

SEQ ID NO: 3337035 - RNA, 19 nt, Human
ucaugacaaagacugagua

SEQ ID NO: 3337036 - RNA, 19 nt, Human
ucaccugaagacucauucu

SEQ ID NO: 3337037 - RNA, 16 nt, Human
ucaccugaagacucau

SEQ ID NO: 3337038 - RNA, 23 nt, Human
ucaccugaagacucauucuucug

SEQ ID NO: 3337039 - RNA, 17 nt, Human
accagagcccaccuugg

SEQ ID NO: 3337040 - RNA, 22 nt, Human
accagagcccaccuuggcucaa

SEQ ID NO: 3337041 - RNA, 19 nt, Human
accagagcccaccuuggcu

SEQ ID NO: 3337042 - RNA, 12 nt, Human
accacuuuuguu

SEQ ID NO: 3337043 - RNA, 17 nt, Human
accagacaccuugacag

SEQ ID NO: 3337044 - RNA, 23 nt, Human
accagacaccuugacagggcaca

SEQ ID NO: 3337045 - RNA, 22 nt, Human
accagacaccuugacagggcac

SEQ ID NO: 3337046 - RNA, 21 nt, Human
accacagacauacuaaccagc

SEQ ID NO: 3337047 - RNA, 22 nt, Human
accacagacauacuaaccagca

SEQ ID NO: 3337048 - RNA, 14 nt, Human
accacaucuugcuc

SEQ ID NO: 3337049 - RNA, 24 nt, Human
accacaucuugcucugcugacaga

SEQ ID NO: 3337050 - RNA, 21 nt, Human
accacaucuugcucugcugac

SEQ ID NO: 3337051 - RNA, 20 nt, Human
accacaucuugcucugcuga

SEQ ID NO: 3337052 - RNA, 19 nt, Human
accacaucuugcucugcug

SEQ ID NO: 3337053 - RNA, 20 nt, Human
accacucuaucaaguauuau

SEQ ID NO: 3337054 - RNA, 13 nt, Human
accacuucagcug

SEQ ID NO: 3337055 - RNA, 14 nt, Human
accacuucagcuga

SEQ ID NO: 3337056 - RNA, 18 nt, Human
acccagcccacuucugcc

SEQ ID NO: 3337057 - RNA, 15 nt, Human
acccagcccacuucu

SEQ ID NO: 3337058 - RNA, 17 nt, Human
acccagcccacuucugc

SEQ ID NO: 3337059 - RNA, 16 nt, Human
acccagcccacuucug

SEQ ID NO: 3337060 - RNA, 16 nt, Human
acccagaagaaaauag

SEQ ID NO: 3337061 - RNA, 13 nt, Human
accauucuccacc

SEQ ID NO: 3337062 - RNA, 16 nt, Human
accauucuccaccugc

SEQ ID NO: 3337063 - RNA, 22 nt, Human
accaugauuaaccacuucagcu

SEQ ID NO: 3337064 - RNA, 23 nt, Human
accaugauuaaccacuucagcug

SEQ ID NO: 3337065 - RNA, 22 nt, Human
accauuuugggguacccacugc

SEQ ID NO: 3337066 - RNA, 23 nt, Human
accauuuugggguacccacugcu

SEQ ID NO: 3337067 - RNA, 16 nt, Human
ucaccugccccucaac

SEQ ID NO: 3337068 - RNA, 14 nt, Human
ucacugagacagcc

SEQ ID NO: 3337069 - RNA, 15 nt, Human
ucacugagacagccc

SEQ ID NO: 3337070 - RNA, 13 nt, Human
ucacugagacagc

SEQ ID NO: 3337071 - RNA, 16 nt, Human
ucacuguugcccaggc

SEQ ID NO: 3337072 - RNA, 12 nt, Human
ucacugcagccu

SEQ ID NO: 3337073 - RNA, 18 nt, Human
accaguguuguggauuua

SEQ ID NO: 3337074 - RNA, 21 nt, Human
accaguguuguggauuuaaca

SEQ ID NO: 3337075 - RNA, 18 nt, Human
ucacuguugcccaggcug

SEQ ID NO: 3337076 - RNA, 17 nt, Human
ucacuguugcccaggcu

SEQ ID NO: 3337077 - RNA, 10 nt, Human
ucagccuggg

SEQ ID NO: 3337078 - RNA, 12 nt, Human
ucagccugggca

SEQ ID NO: 3337079 - RNA, 14 nt, Human
acccccagccugcu

SEQ ID NO: 3337080 - RNA, 15 nt, Human
acccccagccugcua

SEQ ID NO: 3337081 - RNA, 13 nt, Human
ucagaagacacug

SEQ ID NO: 3337082 - RNA, 13 nt, Human
ucagaucuucugu

SEQ ID NO: 3337083 - RNA, 23 nt, Human
acccaggugcuaggaacacuccu

SEQ ID NO: 3337084 - RNA, 13 nt, Human
acccagcucuggu

SEQ ID NO: 3337085 - RNA, 15 nt, Human
acccagcucuggucc

SEQ ID NO: 3337086 - RNA, 20 nt, Human
accccuucgcuccugugucu

SEQ ID NO: 3337087 - RNA, 23 nt, Human
ucaggguuggccccugcccggcu

SEQ ID NO: 3337088 - RNA, 16 nt, Human
acccuuguggucccac

SEQ ID NO: 3337089 - RNA, 17 nt, Human
acccuuguggucccacc

SEQ ID NO: 3337090 - RNA, 19 nt, Human
acccuuguggucccacccc

SEQ ID NO: 3337091 - RNA, 15 nt, Human
acccuugugguccca

SEQ ID NO: 3337092 - RNA, 11 nt, Human
acccugcccug

SEQ ID NO: 3337093 - RNA, 12 nt, Human
acccugcccugu

SEQ ID NO: 3337094 - RNA, 13 nt, Human
acccugcccugug

SEQ ID NO: 3337095 - RNA, 14 nt, Human
acccucuuagaaaa

SEQ ID NO: 3337096 - RNA, 20 nt, Human
ucaggccaaacucaccugcc

SEQ ID NO: 3337097 - RNA, 16 nt, Human
ucaggaagcucagggc

SEQ ID NO: 3337098 - RNA, 17 nt, Human
ucaggaagcucagggcc

SEQ ID NO: 3337099 - RNA, 19 nt, Human
ucaggaagcucagggccug

SEQ ID NO: 3337100 - RNA, 20 nt, Human
ucaggaagcucagggccugg

SEQ ID NO: 3337101 - RNA, 17 nt, Human
ucagcggggacagcucc

SEQ ID NO: 3337102 - RNA, 16 nt, Human
ucagcggggacagcuc

SEQ ID NO: 3337103 - RNA, 15 nt, Human
ucagcggggacagcu

SEQ ID NO: 3337104 - RNA, 19 nt, Human
accccuucgcuccuguguc

SEQ ID NO: 3337105 - RNA, 16 nt, Human
accccuucgcuccugu

SEQ ID NO: 3337106 - RNA, 15 nt, Human
ucagguaacaggcag

SEQ ID NO: 3337107 - RNA, 13 nt, Human
ucagguaacaggc

SEQ ID NO: 3337108 - RNA, 14 nt, Human
ucagggucccuggu

SEQ ID NO: 3337109 - RNA, 23 nt, Human
ucaggggugugcggccuuuggcu

SEQ ID NO: 3337110 - RNA, 13 nt, Human
ucagggucccugg

SEQ ID NO: 3337111 - RNA, 15 nt, Human
ucaggccagcugcuu

SEQ ID NO: 3337112 - RNA, 20 nt, Human
ucaggccagcugcuugggcu

SEQ ID NO: 3337113 - RNA, 11 nt, Human
ucaggccaggc

SEQ ID NO: 3337114 - RNA, 14 nt, Human
ucaggccagcugcu

SEQ ID NO: 3337115 - RNA, 23 nt, Human
ucaggccaggcccucugcccacu

SEQ ID NO: 3337116 - RNA, 22 nt, Human
ucccuuugacgccaucccagcc

SEQ ID NO: 3337117 - RNA, 23 nt, Human
ucccuuugacgccaucccagccc

SEQ ID NO: 3337118 - RNA, 21 nt, Human
ucccuuugacgccaucccagc

SEQ ID NO: 3337119 - RNA, 14 nt, Human
uccuaggcauuugc

SEQ ID NO: 3337120 - RNA, 22 nt, Human
ucccuuuccaaaugcccagcuu

SEQ ID NO: 3337121 - RNA, 18 nt, Human
ucccuuacgugaguccug

SEQ ID NO: 3337122 - RNA, 22 nt, Human
ucccuuacgugaguccuggcau

SEQ ID NO: 3337123 - RNA, 17 nt, Human
ucccuuacgugaguccu

SEQ ID NO: 3337124 - RNA, 23 nt, Human
ucccugguggcagcucaccucuc

SEQ ID NO: 3337125 - RNA, 22 nt, Human
ucccucauccucauacccaccc

SEQ ID NO: 3337126 - RNA, 21 nt, Human
ucccucagucuggcccuuccu

SEQ ID NO: 3337127 - RNA, 20 nt, Human
ucccucagucuggcccuucc

SEQ ID NO: 3337128 - RNA, 22 nt, Human
acucauugaccugaggcccuuc

SEQ ID NO: 3337129 - RNA, 18 nt, Human
acucuccucugcugcugg

SEQ ID NO: 3337130 - RNA, 19 nt, Human
acucuccucugcugcuggc

SEQ ID NO: 3337131 - RNA, 16 nt, Human
acucuccucugcugcu

SEQ ID NO: 3337132 - RNA, 17 nt, Human
acucuccucugcugcug

SEQ ID NO: 3337133 - RNA, 18 nt, Human
acucgcgacaaugcaaac

SEQ ID NO: 3337134 - RNA, 19 nt, Human
uccuaggcauuugcugaau

SEQ ID NO: 3337135 - RNA, 20 nt, Human
acucgcgacaaugcaaacca

SEQ ID NO: 3337136 - RNA, 23 nt, Human
acucgcgacaaugcaaaccauca

SEQ ID NO: 3337137 - RNA, 17 nt, Human
acucgcgacaaugcaaa

SEQ ID NO: 3337138 - RNA, 14 nt, Human
uccucauacccacc

SEQ ID NO: 3337139 - RNA, 18 nt, Human
uccucauacccaccccca

SEQ ID NO: 3337140 - RNA, 15 nt, Human
uccucccucccucuu

SEQ ID NO: 3337141 - RNA, 17 nt, Human
uccucccucccucuuuc

SEQ ID NO: 3337142 - RNA, 19 nt, Human
uccucccucccucuuuccc

SEQ ID NO: 3337143 - RNA, 12 nt, Human
uccucuccccag

SEQ ID NO: 3337144 - RNA, 20 nt, Human
uccucagaucuucugugggu

SEQ ID NO: 3337145 - RNA, 16 nt, Human
acucuuauugcccacg

SEQ ID NO: 3337146 - RNA, 18 nt, Human
acuauguugcccaggcag

SEQ ID NO: 3337147 - RNA, 17 nt, Human
acuauguugcccaggca

SEQ ID NO: 3337148 - RNA, 20 nt, Human
acuauguugcccaggcaggu

SEQ ID NO: 3337149 - RNA, 19 nt, Human
acuauguugcccaggcagg

SEQ ID NO: 3337150 - RNA, 23 nt, Human
acuauguugcccaggcaggucuu

SEQ ID NO: 3337151 - RNA, 23 nt, Human
uccccaggaggccagccuugacc

SEQ ID NO: 3337152 - RNA, 24 nt, Human
uccccaccgcagacaggaccaggg

SEQ ID NO: 3337153 - RNA, 23 nt, Human
acuauaauuuaccugaagucuuu

SEQ ID NO: 3337154 - RNA, 21 nt, Human
acuauaauguaagcucuacug

SEQ ID NO: 3337155 - RNA, 17 nt, Human
acuauagccuaggugac

SEQ ID NO: 3337156 - RNA, 16 nt, Human
ucccgaauagcuggga

SEQ ID NO: 3337157 - RNA, 15 nt, Human
ucccgaauagcuggg

SEQ ID NO: 3337158 - RNA, 20 nt, Human
ucccgaguagcugggacuac

SEQ ID NO: 3337159 - RNA, 18 nt, Human
ucccuauuagagaagaga

SEQ ID NO: 3337160 - RNA, 16 nt, Human
ucccuauuagagaaga

SEQ ID NO: 3337161 - RNA, 14 nt, Human
ucccaucucacaca

SEQ ID NO: 3337162 - RNA, 19 nt, Human
ucccaucucacacaugagc

SEQ ID NO: 3337163 - RNA, 13 nt, Human
ucccaucucacac

SEQ ID NO: 3337164 - RNA, 15 nt, Human
ucccauaugccuggg

SEQ ID NO: 3337165 - RNA, 22 nt, Human
uccccaccgcagacaggaccag

SEQ ID NO: 3337166 - RNA, 15 nt, Human
acuacaguuuguuag

SEQ ID NO: 3337167 - RNA, 16 nt, Human
acuacaguccucccau

SEQ ID NO: 3337168 - RNA, 19 nt, Human
ucccagugccgagaaggaa

SEQ ID NO: 3337169 - RNA, 22 nt, Human
ucccagugccgagaaggaagcc

SEQ ID NO: 3337170 - RNA, 12 nt, Human
acuaaccacgcu

SEQ ID NO: 3337171 - RNA, 16 nt, Human
acuaaccagcagaaau

SEQ ID NO: 3337172 - RNA, 13 nt, Human
acuaaccacgcug

SEQ ID NO: 3337173 - RNA, 17 nt, Human
acuaaccagcagaaaug

SEQ ID NO: 3337174 - RNA, 23 nt, Human
acuacaggugugagucaccaagc

SEQ ID NO: 3337175 - RNA, 15 nt, Human
acuacaguccuccca

SEQ ID NO: 3337176 - RNA, 14 nt, Human
acuaaaauauauau

SEQ ID NO: 3337177 - RNA, 12 nt, Human
acuaaaauauau

SEQ ID NO: 3337178 - RNA, 12 nt, Human
acguuucuaaag

SEQ ID NO: 3337179 - RNA, 14 nt, Human
uccagcucaccagc

SEQ ID NO: 3337180 - RNA, 24 nt, Human
uccagccugggugacagagcaagu

SEQ ID NO: 3337181 - RNA, 13 nt, Human
uccagccugggug

SEQ ID NO: 3337182 - RNA, 14 nt, Human
acguuucuaaaggc

SEQ ID NO: 3337183 - RNA, 13 nt, Human
ucgaacuggcugc

SEQ ID NO: 3337184 - RNA, 14 nt, Human
ucgaacuggcugca

SEQ ID NO: 3337185 - RNA, 15 nt, Human
ucgaacuggcugcaa

SEQ ID NO: 3337186 - RNA, 23 nt, Human
uccuuuagcgcccaguugggugg

SEQ ID NO: 3337187 - RNA, 15 nt, Human
uccuuucaccacaug

SEQ ID NO: 3337188 - RNA, 13 nt, Human
ucgcgacaaugca

SEQ ID NO: 3337189 - RNA, 17 nt, Human
ucgaggacagggaggug

SEQ ID NO: 3337190 - RNA, 14 nt, Human
ucgaggacagggag

SEQ ID NO: 3337191 - RNA, 14 nt, Human
ucgagcaugccugg

SEQ ID NO: 3337192 - RNA, 13 nt, Human
ucgaggacaggga

SEQ ID NO: 3337193 - RNA, 14 nt, Human
acuguacaaaguag

SEQ ID NO: 3337194 - RNA, 19 nt, Human
acuguaauuugugauacaa

SEQ ID NO: 3337195 - RNA, 13 nt, Human
acuguacaaagua

SEQ ID NO: 3337196 - RNA, 23 nt, Human
acuguacaugaaaacacauuuuu

SEQ ID NO: 3337197 - RNA, 21 nt, Human
acuguacaugaaaacacauuu

SEQ ID NO: 3337198 - RNA, 13 nt, Human
acuguacaugaaa

SEQ ID NO: 3337199 - RNA, 14 nt, Human
acuguacaugaaaa

SEQ ID NO: 3337200 - RNA, 22 nt, Human
acugggcuuggggaccagagcu

SEQ ID NO: 3337201 - RNA, 13 nt, Human
ucgcuccuguguc

SEQ ID NO: 3337202 - RNA, 12 nt, Human
ucgcuccugugu

SEQ ID NO: 3337203 - RNA, 18 nt, Human
acuggguacuuguggaca

SEQ ID NO: 3337204 - RNA, 20 nt, Human
acuggguacuuguggacaca

SEQ ID NO: 3337205 - RNA, 19 nt, Human
acuggguacuuguggacac

SEQ ID NO: 3337206 - RNA, 22 nt, Human
acuggauuaaacuuaaucuaaa

SEQ ID NO: 3337207 - RNA, 17 nt, Human
acugcuuccagugaggc

SEQ ID NO: 3337208 - RNA, 18 nt, Human
acugcuuccagugaggcu

SEQ ID NO: 3337209 - RNA, 21 nt, Human
acugcuuccagugaggcucug

SEQ ID NO: 3337210 - RNA, 22 nt, Human
acugcuuccagugaggcucugc

SEQ ID NO: 3337211 - RNA, 23 nt, Human
acugcuuccagugaggcucugcc

SEQ ID NO: 3337212 - RNA, 22 nt, Human
acuggcugcaaaggguaucagg

SEQ ID NO: 3337213 - RNA, 13 nt, Human
uccuucagugccu

SEQ ID NO: 3337214 - RNA, 20 nt, Human
uccuucagugccuuauggaa

SEQ ID NO: 3337215 - RNA, 22 nt, Human
uccuucagugccuuauggaaca

SEQ ID NO: 3337216 - RNA, 12 nt, Human
uccuucagugcc

SEQ ID NO: 3337217 - RNA, 11 nt, Human
uccuucagugc

SEQ ID NO: 3337218 - RNA, 13 nt, Human
uccugcugcaguu

SEQ ID NO: 3337219 - RNA, 23 nt, Human
acugcagccucaaccuccugggc

SEQ ID NO: 3337220 - RNA, 13 nt, Human
acugcacuguuuu

SEQ ID NO: 3337221 - RNA, 22 nt, Human
acugcagccucaaccuccuggg

SEQ ID NO: 3337222 - RNA, 21 nt, Human
acugcagccucaaccuccugg

SEQ ID NO: 3337223 - RNA, 19 nt, Human
acugcagccucaaccuccu

SEQ ID NO: 3337224 - RNA, 24 nt, Human
uccugugucuugcaauggcagccu

SEQ ID NO: 3337225 - RNA, 23 nt, Human
uccugugucuugcaauggcagcc

SEQ ID NO: 3337226 - RNA, 14 nt, Human
uccugugugugcgc

SEQ ID NO: 3337227 - RNA, 13 nt, Human
uccugugugugcg

SEQ ID NO: 3337228 - RNA, 18 nt, Human
uccugugugugcgccuac

SEQ ID NO: 3337229 - RNA, 19 nt, Human
uccuguucccaugagauga

SEQ ID NO: 3337230 - RNA, 16 nt, Human
uccugcaggcagccag

SEQ ID NO: 3337231 - RNA, 17 nt, Human
uccugcaggcagccagg

SEQ ID NO: 3337232 - RNA, 19 nt, Human
uccugcaggcagccaggcc

SEQ ID NO: 3337233 - RNA, 20 nt, Human
uccugcaggcagccaggcca

SEQ ID NO: 3337234 - RNA, 19 nt, Human
uccugccucagccucccaa

SEQ ID NO: 3337235 - RNA, 22 nt, Human
uccugcaggcagccaggccaca

SEQ ID NO: 3337236 - RNA, 20 nt, Human
uccugccucgaacuggcugc

SEQ ID NO: 3337237 - RNA, 17 nt, Human
uccugccucagccuccc

SEQ ID NO: 3337238 - RNA, 21 nt, Human
uccugaugcuucuucagagac

SEQ ID NO: 3337239 - RNA, 15 nt, Human
uccugcaggcagcca

SEQ ID NO: 3337240 - RNA, 22 nt, Human
acugcaaccuccgccucuuggg

SEQ ID NO: 3337241 - RNA, 16 nt, Human
acugcaaccuccgccu

SEQ ID NO: 3337242 - RNA, 14 nt, Human
acugcaaccuccgc

SEQ ID NO: 3337243 - RNA, 13 nt, Human
acugcaaccuccg

SEQ ID NO: 3337244 - RNA, 18 nt, Human
acugaguacguugugcau

SEQ ID NO: 3337245 - RNA, 19 nt, Human
acugaguacguugugcauu

SEQ ID NO: 3337246 - RNA, 21 nt, Human
acugaguacguugugcauuug

SEQ ID NO: 3337247 - RNA, 22 nt, Human
acugaguacguugugcauuugg

SEQ ID NO: 3337248 - RNA, 23 nt, Human
acugaguacguugugcauuuggu

SEQ ID NO: 3337249 - RNA, 15 nt, Human
uccucuccccagcaa

SEQ ID NO: 3337250 - RNA, 17 nt, Human
aagucuuagauguauau

SEQ ID NO: 3337251 - RNA, 19 nt, Human
aagucuuagauguauauau

SEQ ID NO: 3337252 - RNA, 18 nt, Human
aagucuuagauguauaua

SEQ ID NO: 3337253 - RNA, 18 nt, Human
guuuuucuaggccugggg

SEQ ID NO: 3337254 - RNA, 16 nt, Human
guuuuugucuuaaaaa

SEQ ID NO: 3337255 - RNA, 21 nt, Human
aagucaagugaaaaaggagga

SEQ ID NO: 3337256 - RNA, 24 nt, Human
aagucacacaguauuacuucugcu

SEQ ID NO: 3337257 - RNA, 18 nt, Human
aaguauucuuauuuaaug

SEQ ID NO: 3337258 - RNA, 13 nt, Human
aagucacacagug

SEQ ID NO: 3337259 - RNA, 16 nt, Human
aaguacuauguaucaa

SEQ ID NO: 3337260 - RNA, 15 nt, Human
aaguacuggagaaaa

SEQ ID NO: 3337261 - RNA, 21 nt, Human
aaguacuucuccacccugcuc

SEQ ID NO: 3337262 - RNA, 15 nt, Human
aaguacuauguauca

SEQ ID NO: 3337263 - RNA, 22 nt, Human
aaguacuucuccacccugcucu

SEQ ID NO: 3337264 - RNA, 20 nt, Human
aaguacuucuccacccugcu

SEQ ID NO: 3337265 - RNA, 13 nt, Human
aaguauuaaaaca

SEQ ID NO: 3337266 - RNA, 14 nt, Human
aaguauuaaaacau

SEQ ID NO: 3337267 - RNA, 17 nt, Human
aaguauuaaaacauugg

SEQ ID NO: 3337268 - RNA, 15 nt, Human
aaguauuaaaacauu

SEQ ID NO: 3337269 - RNA, 21 nt, Human
aaguauuaaaacauuggauua

SEQ ID NO: 3337270 - RNA, 18 nt, Human
guuucugccgcagcccug

SEQ ID NO: 3337271 - RNA, 22 nt, Human
guuucugccgcagcccugcaga

SEQ ID NO: 3337272 - RNA, 13 nt, Human
guuugcuaaguga

SEQ ID NO: 3337273 - RNA, 17 nt, Human
guuugccucugccucug

SEQ ID NO: 3337274 - RNA, 16 nt, Human
guuugccucugccucu

SEQ ID NO: 3337275 - RNA, 16 nt, Human
guuuuaagaggcaggg

SEQ ID NO: 3337276 - RNA, 14 nt, Human
guuuuaagaggcag

SEQ ID NO: 3337277 - RNA, 16 nt, Human
guuuuacugcagcuuu

SEQ ID NO: 3337278 - RNA, 18 nt, Human
guuuuacugcagcuuugu

SEQ ID NO: 3337279 - RNA, 15 nt, Human
guuuuacugcagcuu

SEQ ID NO: 3337280 - RNA, 13 nt, Human
aagggcccagaga

SEQ ID NO: 3337281 - RNA, 15 nt, Human
aagggcccagagagg

SEQ ID NO: 3337282 - RNA, 16 nt, Human
aaggguaucuggugac

SEQ ID NO: 3337283 - RNA, 19 nt, Human
aaggguaucaggugcugcc

SEQ ID NO: 3337284 - RNA, 14 nt, Human
aaggggcaguggug

SEQ ID NO: 3337285 - RNA, 17 nt, Human
aaggguaucaggugcug

SEQ ID NO: 3337286 - RNA, 20 nt, Human
aaggaggaagagaaaaaaua

SEQ ID NO: 3337287 - RNA, 18 nt, Human
aaggaggaagagaaaaaa

SEQ ID NO: 3337288 - RNA, 11 nt, Human
aaggauccuga

SEQ ID NO: 3337289 - RNA, 12 nt, Human
aaggauccugag

SEQ ID NO: 3337290 - RNA, 20 nt, Human
aaggauccugagccagauuu

SEQ ID NO: 3337291 - RNA, 22 nt, Human
aaggauccugagccagauuuca

SEQ ID NO: 3337292 - RNA, 18 nt, Human
aaggagauuuacaacugg

SEQ ID NO: 3337293 - RNA, 17 nt, Human
aaggagauuuacaacug

SEQ ID NO: 3337294 - RNA, 15 nt, Human
aaggaaacccagcuc

SEQ ID NO: 3337295 - RNA, 14 nt, Human
aaggaugcccaaag

SEQ ID NO: 3337296 - RNA, 24 nt, Human
aaggaugcacagaguuguuacauu

SEQ ID NO: 3337297 - RNA, 22 nt, Human
aaggaugcacagaguuguuaca

SEQ ID NO: 3337298 - RNA, 14 nt, Human
aaggccccgcccag

SEQ ID NO: 3337299 - RNA, 16 nt, Human
aaggccccgcccaggc

SEQ ID NO: 3337300 - RNA, 19 nt, Human
aaggccccgcccaggcuua

SEQ ID NO: 3337301 - RNA, 14 nt, Human
guugcccaggcugg

SEQ ID NO: 3337302 - RNA, 13 nt, Human
aaggcuaccuuug

SEQ ID NO: 3337303 - RNA, 23 nt, Human
guuggcugggggccucagugcca

SEQ ID NO: 3337304 - RNA, 15 nt, Human
guugcccaggcuggc

SEQ ID NO: 3337305 - RNA, 16 nt, Human
guugcccaggcuggcg

SEQ ID NO: 3337306 - RNA, 15 nt, Human
guugggcugguguca

SEQ ID NO: 3337307 - RNA, 17 nt, Human
guugggcuggugucacc

SEQ ID NO: 3337308 - RNA, 12 nt, Human
guucucugcccu

SEQ ID NO: 3337309 - RNA, 11 nt, Human
guucucugccc

SEQ ID NO: 3337310 - RNA, 16 nt, Human
guucucugaggacacu

SEQ ID NO: 3337311 - RNA, 14 nt, Human
guucucugaggaca

SEQ ID NO: 3337312 - RNA, 23 nt, Human
guugauagcacagacccugcccu

SEQ ID NO: 3337313 - RNA, 22 nt, Human
guugauagcacagacccugccc

SEQ ID NO: 3337314 - RNA, 18 nt, Human
aagcuguuacugucuuca

SEQ ID NO: 3337315 - RNA, 13 nt, Human
aagcucugcuccu

SEQ ID NO: 3337316 - RNA, 12 nt, Human
aagcucccaggc

SEQ ID NO: 3337317 - RNA, 22 nt, Human
aagcucccaggcauuccccagg

SEQ ID NO: 3337318 - RNA, 23 nt, Human
aagcucccaggcauuccccagga

SEQ ID NO: 3337319 - RNA, 21 nt, Human
aagcucuacugaggugcuaug

SEQ ID NO: 3337320 - RNA, 13 nt, Human
guguuuauuguca

SEQ ID NO: 3337321 - RNA, 11 nt, Human
aagcucccagg

SEQ ID NO: 3337322 - RNA, 13 nt, Human
uaaagucaggggu

SEQ ID NO: 3337323 - RNA, 14 nt, Human
uaaaguguauuuuu

SEQ ID NO: 3337324 - RNA, 15 nt, Human
uaaaguguauuuuuu

SEQ ID NO: 3337325 - RNA, 19 nt, Human
uaaaguguauuuuuuuacu

SEQ ID NO: 3337326 - RNA, 14 nt, Human
aauaaaguaauuau

SEQ ID NO: 3337327 - RNA, 15 nt, Human
aauaacuaaaaggua

SEQ ID NO: 3337328 - RNA, 12 nt, Human
aauaaauuauuu

SEQ ID NO: 3337329 - RNA, 12 nt, Human
aauaacauguaa

SEQ ID NO: 3337330 - RNA, 19 nt, Human
aauaacauguaauuaagua

SEQ ID NO: 3337331 - RNA, 16 nt, Human
aauacaccacuacauu

SEQ ID NO: 3337332 - RNA, 18 nt, Human
aauacaccacuacauucu

SEQ ID NO: 3337333 - RNA, 20 nt, Human
aauacaccacuacauucugu

SEQ ID NO: 3337334 - RNA, 15 nt, Human
aauacaccacuacau

SEQ ID NO: 3337335 - RNA, 19 nt, Human
uaaaucuccaaaauaaaac

SEQ ID NO: 3337336 - RNA, 13 nt, Human
uaacaagccaccc

SEQ ID NO: 3337337 - RNA, 22 nt, Human
uaaauuaacuuuuauaaacuuu

SEQ ID NO: 3337338 - RNA, 18 nt, Human
uaaaucuccaaaauaaaa

SEQ ID NO: 3337339 - RNA, 20 nt, Human
uaaaucuccaaaauaaaacu

SEQ ID NO: 3337340 - RNA, 21 nt, Human
uaaaucuccaaaauaaaacuu

SEQ ID NO: 3337341 - RNA, 21 nt, Human
uaaaggcuaccuuuguauucu

SEQ ID NO: 3337342 - RNA, 19 nt, Human
uaaaggcuaccuuuguauu

SEQ ID NO: 3337343 - RNA, 16 nt, Human
uaaaccgccaaggcug

SEQ ID NO: 3337344 - RNA, 18 nt, Human
uaaaccgccaaggcuggg

SEQ ID NO: 3337345 - RNA, 14 nt, Human
aaguuaaauaaauc

SEQ ID NO: 3337346 - RNA, 12 nt, Human
aaguuaaauaaa

SEQ ID NO: 3337347 - RNA, 23 nt, Human
aacguggcugcuucaaggauccu

SEQ ID NO: 3337348 - RNA, 22 nt, Human
aacguggcugcuucaaggaucc

SEQ ID NO: 3337349 - RNA, 16 nt, Human
gucuucaguaagccgu

SEQ ID NO: 3337350 - RNA, 15 nt, Human
gucuuuguacagaca

SEQ ID NO: 3337351 - RNA, 16 nt, Human
gucuuuguacagacaa

SEQ ID NO: 3337352 - RNA, 12 nt, Human
aaccugugucuc

SEQ ID NO: 3337353 - RNA, 19 nt, Human
aaccugauugugucucuug

SEQ ID NO: 3337354 - RNA, 18 nt, Human
aaccugauugugucucuu

SEQ ID NO: 3337355 - RNA, 13 nt, Human
gucucuugguccu

SEQ ID NO: 3337356 - RNA, 20 nt, Human
gucucuugguccugcugcag

SEQ ID NO: 3337357 - RNA, 18 nt, Human
gucucuugguccugcugc

SEQ ID NO: 3337358 - RNA, 19 nt, Human
gucucuugguccugcugca

SEQ ID NO: 3337359 - RNA, 17 nt, Human
gucucuugguccugcug

SEQ ID NO: 3337360 - RNA, 13 nt, Human
aaccauggacuuu

SEQ ID NO: 3337361 - RNA, 22 nt, Human
gucucuuuaaugucacaggcag

SEQ ID NO: 3337362 - RNA, 19 nt, Human
gucugaaggcuggguucug

SEQ ID NO: 3337363 - RNA, 14 nt, Human
gucugaaggcuggg

SEQ ID NO: 3337364 - RNA, 20 nt, Human
gucucuuuaaugucacaggc

SEQ ID NO: 3337365 - RNA, 19 nt, Human
gucucuuuaaugucacagg

SEQ ID NO: 3337366 - RNA, 18 nt, Human
gucucuuuaaugucacag

SEQ ID NO: 3337367 - RNA, 15 nt, Human
aaccauggacuuuau

SEQ ID NO: 3337368 - RNA, 23 nt, Human
gucugacaggcaaugcuggcugu

SEQ ID NO: 3337369 - RNA, 22 nt, Human
gucugacaggcaaugcuggcug

SEQ ID NO: 3337370 - RNA, 21 nt, Human
gucugacaggcaaugcuggcu

SEQ ID NO: 3337371 - RNA, 18 nt, Human
gucuggaaugcaguggua

SEQ ID NO: 3337372 - RNA, 20 nt, Human
gucugacaggcaaugcuggc

SEQ ID NO: 3337373 - RNA, 17 nt, Human
gugaguacuacaguccu

SEQ ID NO: 3337374 - RNA, 21 nt, Human
gugagcacuaaggugugcucu

SEQ ID NO: 3337375 - RNA, 16 nt, Human
gugagaggggaacaga

SEQ ID NO: 3337376 - RNA, 13 nt, Human
gugagagcugggu

SEQ ID NO: 3337377 - RNA, 15 nt, Human
gugagcaauccugca

SEQ ID NO: 3337378 - RNA, 12 nt, Human
gugaccccaggu

SEQ ID NO: 3337379 - RNA, 12 nt, Human
gugagagcuggg

SEQ ID NO: 3337380 - RNA, 17 nt, Human
gugaguccuggcauggg

SEQ ID NO: 3337381 - RNA, 19 nt, Human
gugaguacuacaguccucc

SEQ ID NO: 3337382 - RNA, 19 nt, Human
gugagucaccaagcccagu

SEQ ID NO: 3337383 - RNA, 20 nt, Human
gugaguccuggcaugggaau

SEQ ID NO: 3337384 - RNA, 19 nt, Human
gugacagaggcagccccau

SEQ ID NO: 3337385 - RNA, 18 nt, Human
gugacagaggcagcccca

SEQ ID NO: 3337386 - RNA, 16 nt, Human
gugacagaggcagccc

SEQ ID NO: 3337387 - RNA, 15 nt, Human
gugacagaggcagcc

SEQ ID NO: 3337388 - RNA, 17 nt, Human
gugaccaaugaugguca

SEQ ID NO: 3337389 - RNA, 18 nt, Human
gugaccagcaccaucucu

SEQ ID NO: 3337390 - RNA, 21 nt, Human
gugaccagcaccaucucuccu

SEQ ID NO: 3337391 - RNA, 18 nt, Human
gugaccauguuuuguuua

SEQ ID NO: 3337392 - RNA, 23 nt, Human
gugaagacaaugacuuacuguac

SEQ ID NO: 3337393 - RNA, 14 nt, Human
gugaagugaagaca

SEQ ID NO: 3337394 - RNA, 14 nt, Human
gucuaugggacuca

SEQ ID NO: 3337395 - RNA, 22 nt, Human
gucucaaacucuugaccucagg

SEQ ID NO: 3337396 - RNA, 19 nt, Human
gucucaaaaaaagaaaaag

SEQ ID NO: 3337397 - RNA, 13 nt, Human
aaccacaucuugc

SEQ ID NO: 3337398 - RNA, 23 nt, Human
aaccaucauugaaaucuuuuugc

SEQ ID NO: 3337399 - RNA, 23 nt, Human
gucgcccagucuggaaugcagug

SEQ ID NO: 3337400 - RNA, 20 nt, Human
gucuaccugaggggccucuu

SEQ ID NO: 3337401 - RNA, 14 nt, Human
gucgaggacaggga

SEQ ID NO: 3337402 - RNA, 14 nt, Human
gucgcccagucugg

SEQ ID NO: 3337403 - RNA, 13 nt, Human
gucgcccagucug

SEQ ID NO: 3337404 - RNA, 13 nt, Human
guccugcugcagu

SEQ ID NO: 3337405 - RNA, 16 nt, Human
guccugcugcaguugc

SEQ ID NO: 3337406 - RNA, 20 nt, Human
aacagacuggaagcacagcu

SEQ ID NO: 3337407 - RNA, 13 nt, Human
guccuacccaccc

SEQ ID NO: 3337408 - RNA, 22 nt, Human
aacauguuuuucuucucccuca

SEQ ID NO: 3337409 - RNA, 18 nt, Human
aacauacucccaucugug

SEQ ID NO: 3337410 - RNA, 16 nt, Human
aacauacucccaucug

SEQ ID NO: 3337411 - RNA, 20 nt, Human
aacauacucccaucugugaa

SEQ ID NO: 3337412 - RNA, 13 nt, Human
gucccuuuuccuu

SEQ ID NO: 3337413 - RNA, 21 nt, Human
guccgaaagggacuuggaagc

SEQ ID NO: 3337414 - RNA, 22 nt, Human
guccgaaagggacuuggaagcu

SEQ ID NO: 3337415 - RNA, 13 nt, Human
gucccccugacaa

SEQ ID NO: 3337416 - RNA, 15 nt, Human
guccccgcacugggc

SEQ ID NO: 3337417 - RNA, 16 nt, Human
guccccgcacugggcu

SEQ ID NO: 3337418 - RNA, 23 nt, Human
guccccuguuuguuucugaaagg

SEQ ID NO: 3337419 - RNA, 22 nt, Human
guccccuguuuguuucugaaag

SEQ ID NO: 3337420 - RNA, 18 nt, Human
gucccaccuuggcugcag

SEQ ID NO: 3337421 - RNA, 17 nt, Human
gucccaccuuggcugca

SEQ ID NO: 3337422 - RNA, 19 nt, Human
gucccaccuuggcugcagg

SEQ ID NO: 3337423 - RNA, 23 nt, Human
gugcacaagcuccaagcucccag

SEQ ID NO: 3337424 - RNA, 17 nt, Human
gugcacacaccagagcc

SEQ ID NO: 3337425 - RNA, 18 nt, Human
gugcacguacacacacau

SEQ ID NO: 3337426 - RNA, 14 nt, Human
gugcacacaccaga

SEQ ID NO: 3337427 - RNA, 12 nt, Human
gugcacacacca

SEQ ID NO: 3337428 - RNA, 20 nt, Human
gugcauuugaggucuguucu

SEQ ID NO: 3337429 - RNA, 21 nt, Human
gugcauuugaggucuguucuu

SEQ ID NO: 3337430 - RNA, 22 nt, Human
gugcauuugaggucuguucuuu

SEQ ID NO: 3337431 - RNA, 14 nt, Human
gugccaagcagagg

SEQ ID NO: 3337432 - RNA, 15 nt, Human
gugccucugggacug

SEQ ID NO: 3337433 - RNA, 14 nt, Human
gugccucugggacu

SEQ ID NO: 3337434 - RNA, 23 nt, Human
aacuugguucccauuugcuccuu

SEQ ID NO: 3337435 - RNA, 22 nt, Human
aacuugucuuuggacccugagg

SEQ ID NO: 3337436 - RNA, 14 nt, Human
aacuuggcgcugcc

SEQ ID NO: 3337437 - RNA, 19 nt, Human
aagaaaaaggaugcacaga

SEQ ID NO: 3337438 - RNA, 20 nt, Human
aagaaaaaggaugcacagag

SEQ ID NO: 3337439 - RNA, 22 nt, Human
aagaaaaaggaugcacagaguu

SEQ ID NO: 3337440 - RNA, 14 nt, Human
aagaagcucucucc

SEQ ID NO: 3337441 - RNA, 15 nt, Human
aagaagcucucuccu

SEQ ID NO: 3337442 - RNA, 16 nt, Human
aagaagcccaggaaag

SEQ ID NO: 3337443 - RNA, 17 nt, Human
aagaagcccaggaaagg

SEQ ID NO: 3337444 - RNA, 22 nt, Human
aagaaaauaguggugugauuug

SEQ ID NO: 3337445 - RNA, 19 nt, Human
gugcugcccugcccaccug

SEQ ID NO: 3337446 - RNA, 20 nt, Human
gugcugcccugcccaccugg

SEQ ID NO: 3337447 - RNA, 18 nt, Human
gugcugcccugcccaccu

SEQ ID NO: 3337448 - RNA, 24 nt, Human
guggacacagcucuucuccaggcu

SEQ ID NO: 3337449 - RNA, 23 nt, Human
guggacacagcucuucuccaggc

SEQ ID NO: 3337450 - RNA, 15 nt, Human
guggacacagcucuu

SEQ ID NO: 3337451 - RNA, 14 nt, Human
guggacacagcucu

SEQ ID NO: 3337452 - RNA, 21 nt, Human
guggauuuaacagaaauguac

SEQ ID NO: 3337453 - RNA, 20 nt, Human
guggauuuaacagaaaugua

SEQ ID NO: 3337454 - RNA, 23 nt, Human
guggauuuaacagaaauguacag

SEQ ID NO: 3337455 - RNA, 22 nt, Human
guggcagcucaccucucccuug

SEQ ID NO: 3337456 - RNA, 14 nt, Human
guggcagcugcggu

SEQ ID NO: 3337457 - RNA, 13 nt, Human
guggcaccagcag

SEQ ID NO: 3337458 - RNA, 14 nt, Human
guggcaccagcagc

SEQ ID NO: 3337459 - RNA, 20 nt, Human
guggcagcucaccucucccu

SEQ ID NO: 3337460 - RNA, 17 nt, Human
guggcagcugcggucca

SEQ ID NO: 3337461 - RNA, 21 nt, Human
aagacgcugugcugcccugcc

SEQ ID NO: 3337462 - RNA, 22 nt, Human
aagacgcugugcugcccugccc

SEQ ID NO: 3337463 - RNA, 23 nt, Human
aagacgcugugcugcccugccca

SEQ ID NO: 3337464 - RNA, 20 nt, Human
aagacgcugugcugcccugc

SEQ ID NO: 3337465 - RNA, 17 nt, Human
aagacucauucuucugu

SEQ ID NO: 3337466 - RNA, 16 nt, Human
aagagauugugguuuc

SEQ ID NO: 3337467 - RNA, 12 nt, Human
aagagcccaggc

SEQ ID NO: 3337468 - RNA, 14 nt, Human
aagagcccaggccu

SEQ ID NO: 3337469 - RNA, 16 nt, Human
aagagcccaggccucc

SEQ ID NO: 3337470 - RNA, 13 nt, Human
guggccucccaac

SEQ ID NO: 3337471 - RNA, 14 nt, Human
guggccucccaacu

SEQ ID NO: 3337472 - RNA, 13 nt, Human
gugggauccucca

SEQ ID NO: 3337473 - RNA, 15 nt, Human
gugggauccuccagg

SEQ ID NO: 3337474 - RNA, 18 nt, Human
gugggauccuccaggugc

SEQ ID NO: 3337475 - RNA, 12 nt, Human
gugggagcugag

SEQ ID NO: 3337476 - RNA, 20 nt, Human
guggugguuuucuguucuuu

SEQ ID NO: 3337477 - RNA, 15 nt, Human
gugguguuuccuggc

SEQ ID NO: 3337478 - RNA, 16 nt, Human
gugguguuuccuggca

SEQ ID NO: 3337479 - RNA, 16 nt, Human
gugugguagagugugc

SEQ ID NO: 3337480 - RNA, 15 nt, Human
gugugguguuuccug

SEQ ID NO: 3337481 - RNA, 18 nt, Human
gugugagucaccaagccc

SEQ ID NO: 3337482 - RNA, 13 nt, Human
gugugagucacca

SEQ ID NO: 3337483 - RNA, 21 nt, Human
gugucuugcaauggcagccuu

SEQ ID NO: 3337484 - RNA, 19 nt, Human
gugucuugcaauggcagcc

SEQ ID NO: 3337485 - RNA, 19 nt, Human
gugugguguuuccuggcac

SEQ ID NO: 3337486 - RNA, 14 nt, Human
aagaguaggaagac

SEQ ID NO: 3337487 - RNA, 18 nt, Human
gugguuauggagagggug

SEQ ID NO: 3337488 - RNA, 19 nt, Human
gugguguuuccuggcacug

SEQ ID NO: 3337489 - RNA, 16 nt, Human
aagaguaggaagacuu

SEQ ID NO: 3337490 - RNA, 18 nt, Human
aagaguaggaagacuuug

SEQ ID NO: 3337491 - RNA, 15 nt, Human
aagauauuuugcuuu

SEQ ID NO: 3337492 - RNA, 19 nt, Human
aagaguaggaagacuuugg

SEQ ID NO: 3337493 - RNA, 17 nt, Human
aagauauuuugcuuugu

SEQ ID NO: 3337494 - RNA, 20 nt, Human
aagauauuuugcuuugugau

SEQ ID NO: 3337495 - RNA, 21 nt, Human
acacaugcaaggucauuuuuu

SEQ ID NO: 3337496 - RNA, 21 nt, Human
acacccagcccacuucugcca

SEQ ID NO: 3337497 - RNA, 20 nt, Human
acacccagcccacuucugcc

SEQ ID NO: 3337498 - RNA, 19 nt, Human
acacccagcccacuucugc

SEQ ID NO: 3337499 - RNA, 12 nt, Human
acacccugugau

SEQ ID NO: 3337500 - RNA, 18 nt, Human
acacccugugauggggcc

SEQ ID NO: 3337501 - RNA, 11 nt, Human
acacccuguga

SEQ ID NO: 3337502 - RNA, 18 nt, Human
acacaugcaaggucauuu

SEQ ID NO: 3337503 - RNA, 19 nt, Human
acacaugcaaggucauuuu

SEQ ID NO: 3337504 - RNA, 20 nt, Human
acacaugcaaggucauuuuu

SEQ ID NO: 3337505 - RNA, 19 nt, Human
acaagcugcacccucaggc

SEQ ID NO: 3337506 - RNA, 21 nt, Human
acaagcugcacccucaggcag

SEQ ID NO: 3337507 - RNA, 22 nt, Human
acaagcugcacccucaggcagg

SEQ ID NO: 3337508 - RNA, 23 nt, Human
acaagcugcacccucaggcaggu

SEQ ID NO: 3337509 - RNA, 21 nt, Human
uagucaggugccucaagagaa

SEQ ID NO: 3337510 - RNA, 20 nt, Human
uagucacugagacagcccgg

SEQ ID NO: 3337511 - RNA, 20 nt, Human
uaguuccucauuagcauuuu

SEQ ID NO: 3337512 - RNA, 14 nt, Human
uauacauuugauaa

SEQ ID NO: 3337513 - RNA, 13 nt, Human
uauacauaaacaa

SEQ ID NO: 3337514 - RNA, 14 nt, Human
uauacauaaacaag

SEQ ID NO: 3337515 - RNA, 21 nt, Human
uauaauuuaccugaagucuuu

SEQ ID NO: 3337516 - RNA, 21 nt, Human
uauaagccaguguugccuaag

SEQ ID NO: 3337517 - RNA, 20 nt, Human
uauaagccaguguugccuaa

SEQ ID NO: 3337518 - RNA, 21 nt, Human
acacucauugaccugaggccc

SEQ ID NO: 3337519 - RNA, 23 nt, Human
acacucauugaccugaggcccuu

SEQ ID NO: 3337520 - RNA, 19 nt, Human
acacucauugaccugaggc

SEQ ID NO: 3337521 - RNA, 20 nt, Human
uauagccuaggugacagagu

SEQ ID NO: 3337522 - RNA, 18 nt, Human
uauagccuaggugacaga

SEQ ID NO: 3337523 - RNA, 15 nt, Human
uauauauagaaauau

SEQ ID NO: 3337524 - RNA, 14 nt, Human
uaucuugaagacuu

SEQ ID NO: 3337525 - RNA, 22 nt, Human
acagaguuguuacauuuuuaag

SEQ ID NO: 3337526 - RNA, 18 nt, Human
acagaguuuucacucuua

SEQ ID NO: 3337527 - RNA, 20 nt, Human
acagaguuuucacucuuauu

SEQ ID NO: 3337528 - RNA, 23 nt, Human
uaugaucacggcucacugcagcc

SEQ ID NO: 3337529 - RNA, 21 nt, Human
uaugaucacggcucacugcag

SEQ ID NO: 3337530 - RNA, 14 nt, Human
uaugaucacggcuc

SEQ ID NO: 3337531 - RNA, 15 nt, Human
uaucuugaagacuuu

SEQ ID NO: 3337532 - RNA, 23 nt, Human
uaugaggcauuuguuugaacuga

SEQ ID NO: 3337533 - RNA, 14 nt, Human
uaugcucugcaugu

SEQ ID NO: 3337534 - RNA, 18 nt, Human
uaugcucugcauguuaca

SEQ ID NO: 3337535 - RNA, 22 nt, Human
uauggcccuggccuagcauacg

SEQ ID NO: 3337536 - RNA, 19 nt, Human
uaugcucugcauguuacau

SEQ ID NO: 3337537 - RNA, 14 nt, Human
acagcuaacaugga

SEQ ID NO: 3337538 - RNA, 15 nt, Human
acagcuaacauggaa

SEQ ID NO: 3337539 - RNA, 17 nt, Human
acagcuaacauggaagu

SEQ ID NO: 3337540 - RNA, 10 nt, Human
uaugggagag

SEQ ID NO: 3337541 - RNA, 21 nt, Human
acagagugagacucugucuca

SEQ ID NO: 3337542 - RNA, 16 nt, Human
acagagcuacacaggg

SEQ ID NO: 3337543 - RNA, 20 nt, Human
acagagcccacgcccccacu

SEQ ID NO: 3337544 - RNA, 22 nt, Human
acagacuggaagcacagcuuca

SEQ ID NO: 3337545 - RNA, 15 nt, Human
uaucuagauacugua

SEQ ID NO: 3337546 - RNA, 16 nt, Human
uaucuagauacuguau

SEQ ID NO: 3337547 - RNA, 16 nt, Human
uaucucccccagcccc

SEQ ID NO: 3337548 - RNA, 18 nt, Human
uaucucccccagccccau

SEQ ID NO: 3337549 - RNA, 17 nt, Human
uaucucccccagcccca

SEQ ID NO: 3337550 - RNA, 19 nt, Human
uaucuagauacuguaucau

SEQ ID NO: 3337551 - RNA, 18 nt, Human
uaucacccagaagaaaau

SEQ ID NO: 3337552 - RNA, 21 nt, Human
uaucaaguauuauaccuuuuu

SEQ ID NO: 3337553 - RNA, 18 nt, Human
uaucaaguauuauaccuu

SEQ ID NO: 3337554 - RNA, 14 nt, Human
acagacuggaagca

SEQ ID NO: 3337555 - RNA, 18 nt, Human
acagacccugcccugugg

SEQ ID NO: 3337556 - RNA, 11 nt, Human
acacuccuuca

SEQ ID NO: 3337557 - RNA, 23 nt, Human
acagacacaggcccggcuccagg

SEQ ID NO: 3337558 - RNA, 22 nt, Human
acagacacaggcccggcuccag

SEQ ID NO: 3337559 - RNA, 17 nt, Human
acagacccugcccugug

SEQ ID NO: 3337560 - RNA, 16 nt, Human
acagacccugcccugu

SEQ ID NO: 3337561 - RNA, 13 nt, Human
uauugucaaagug

SEQ ID NO: 3337562 - RNA, 17 nt, Human
uauugucaaagugguga

SEQ ID NO: 3337563 - RNA, 21 nt, Human
uauuuaaugaaagacuguaca

SEQ ID NO: 3337564 - RNA, 15 nt, Human
uauuuaaugaaagac

SEQ ID NO: 3337565 - RNA, 13 nt, Human
uauuuauuuaaau

SEQ ID NO: 3337566 - RNA, 14 nt, Human
uauuuauuuaaauu

SEQ ID NO: 3337567 - RNA, 18 nt, Human
uauuuacuucuuauacau

SEQ ID NO: 3337568 - RNA, 23 nt, Human
uauuuaauuuuuuugagacagag

SEQ ID NO: 3337569 - RNA, 17 nt, Human
acaguucucuccuucuu

SEQ ID NO: 3337570 - RNA, 20 nt, Human
uauucucuccuguaccucuu

SEQ ID NO: 3337571 - RNA, 24 nt, Human
uauucucuccuguaccucuugagc

SEQ ID NO: 3337572 - RNA, 18 nt, Human
uauucucuccuguaccuc

SEQ ID NO: 3337573 - RNA, 16 nt, Human
uauucuguuggccagu

SEQ ID NO: 3337574 - RNA, 15 nt, Human
uauucuuauuuaaug

SEQ ID NO: 3337575 - RNA, 20 nt, Human
acaguucaauucucauuugu

SEQ ID NO: 3337576 - RNA, 13 nt, Human
acaguuacucaga

SEQ ID NO: 3337577 - RNA, 20 nt, Human
acaguuacucagaauucucu

SEQ ID NO: 3337578 - RNA, 16 nt, Human
acaguucucuccuucu

SEQ ID NO: 3337579 - RNA, 23 nt, Human
uauuaaaaaucucaaauuucuaa

SEQ ID NO: 3337580 - RNA, 12 nt, Human
uauuaaaacauu

SEQ ID NO: 3337581 - RNA, 18 nt, Human
uauuaaaacauuggauua

SEQ ID NO: 3337582 - RNA, 17 nt, Human
uauuaaaacauuggauu

SEQ ID NO: 3337583 - RNA, 19 nt, Human
uauuaaaacauuggauuau

SEQ ID NO: 3337584 - RNA, 16 nt, Human
uauuaaaaaucucaaa

SEQ ID NO: 3337585 - RNA, 18 nt, Human
uauuaaaaaucucaaauu

SEQ ID NO: 3337586 - RNA, 20 nt, Human
uauuaaaaaucucaaauuuc

SEQ ID NO: 3337587 - RNA, 22 nt, Human
uauuaaaaaucucaaauuucua

SEQ ID NO: 3337588 - RNA, 19 nt, Human
uauguuuuaagaggcaggg

SEQ ID NO: 3337589 - RNA, 17 nt, Human
uauguuuuaagaggcag

SEQ ID NO: 3337590 - RNA, 12 nt, Human
uauuagagaaga

SEQ ID NO: 3337591 - RNA, 16 nt, Human
uauuaccacagacaua

SEQ ID NO: 3337592 - RNA, 16 nt, Human
uauucaggaagcucag

SEQ ID NO: 3337593 - RNA, 17 nt, Human
uauucaaccauggacuu

SEQ ID NO: 3337594 - RNA, 16 nt, Human
uauucaaccauggacu

SEQ ID NO: 3337595 - RNA, 14 nt, Human
uauucaaccaugga

SEQ ID NO: 3337596 - RNA, 18 nt, Human
uauucaggaagcucaggg

SEQ ID NO: 3337597 - RNA, 22 nt, Human
uauucaggaagcucagggccug

SEQ ID NO: 3337598 - RNA, 21 nt, Human
acaguccuuaccagcagagca

SEQ ID NO: 3337599 - RNA, 22 nt, Human
acaguccuuaccagcagagcac

SEQ ID NO: 3337600 - RNA, 15 nt, Human
acaguuaagagaaau

SEQ ID NO: 3337601 - RNA, 12 nt, Human
acagucccugcc

SEQ ID NO: 3337602 - RNA, 13 nt, Human
acagucccugcca

SEQ ID NO: 3337603 - RNA, 19 nt, Human
acaguauuacuucugcuac

SEQ ID NO: 3337604 - RNA, 17 nt, Human
acaguauuacuucugcu

SEQ ID NO: 3337605 - RNA, 16 nt, Human
acaguauuacuucugc

SEQ ID NO: 3337606 - RNA, 15 nt, Human
acaguauuacuucug

SEQ ID NO: 3337607 - RNA, 15 nt, Human
acagucccugccaau

SEQ ID NO: 3337608 - RNA, 13 nt, Human
acaguccucccau

SEQ ID NO: 3337609 - RNA, 14 nt, Human
acaguccucccauc

SEQ ID NO: 3337610 - RNA, 15 nt, Human
acaguccucccaucu

SEQ ID NO: 3337611 - RNA, 18 nt, Human
acaguccuuaccagcaga

SEQ ID NO: 3337612 - RNA, 20 nt, Human
acaguccuuaccagcagagc

SEQ ID NO: 3337613 - RNA, 17 nt, Human
acaguccucccaucuca

SEQ ID NO: 3337614 - RNA, 17 nt, Human
acaggcugggcuucagu

SEQ ID NO: 3337615 - RNA, 14 nt, Human
acaggcugggcuuc

SEQ ID NO: 3337616 - RNA, 20 nt, Human
acagggcacaccgggcacuc

SEQ ID NO: 3337617 - RNA, 12 nt, Human
acaggcugggcu

SEQ ID NO: 3337618 - RNA, 22 nt, Human
acagguuuuccugaagaauuga

SEQ ID NO: 3337619 - RNA, 22 nt, Human
acagggcacaccgggcacucag

SEQ ID NO: 3337620 - RNA, 13 nt, Human
aauuuaaaagucu

SEQ ID NO: 3337621 - RNA, 19 nt, Human
aauuuacauacucugcuua

SEQ ID NO: 3337622 - RNA, 15 nt, Human
aauuuacauacucug

SEQ ID NO: 3337623 - RNA, 22 nt, Human
aauuguuuggggaugagaaagg

SEQ ID NO: 3337624 - RNA, 17 nt, Human
aauuuagaaauauaauu

SEQ ID NO: 3337625 - RNA, 13 nt, Human
aauuucuaaaucu

SEQ ID NO: 3337626 - RNA, 21 nt, Human
aauuucuaaaucuccaaaaua

SEQ ID NO: 3337627 - RNA, 21 nt, Human
uacucugugucagguggggca

SEQ ID NO: 3337628 - RNA, 13 nt, Human
uacgugaguccug

SEQ ID NO: 3337629 - RNA, 13 nt, Human
uacguugugcauu

SEQ ID NO: 3337630 - RNA, 16 nt, Human
uacuauaauuuaccug

SEQ ID NO: 3337631 - RNA, 16 nt, Human
uacuauguaucaauga

SEQ ID NO: 3337632 - RNA, 14 nt, Human
uacuauguaucaau

SEQ ID NO: 3337633 - RNA, 13 nt, Human
aauucuuaaauau

SEQ ID NO: 3337634 - RNA, 22 nt, Human
aauucuucuccacuuucuagcc

SEQ ID NO: 3337635 - RNA, 14 nt, Human
aauucuugcaaagu

SEQ ID NO: 3337636 - RNA, 20 nt, Human
aauucuugcaaaguaucccu

SEQ ID NO: 3337637 - RNA, 15 nt, Human
uacguacacauuuua

SEQ ID NO: 3337638 - RNA, 14 nt, Human
uacguacacauuuu

SEQ ID NO: 3337639 - RNA, 16 nt, Human
uagcacagacccugcc

SEQ ID NO: 3337640 - RNA, 17 nt, Human
uagcacagacccugccc

SEQ ID NO: 3337641 - RNA, 18 nt, Human
uagcacagacccugcccu

SEQ ID NO: 3337642 - RNA, 22 nt, Human
uagauuuuagacccuauugcug

SEQ ID NO: 3337643 - RNA, 24 nt, Human
uagcacagacccugcccugugggc

SEQ ID NO: 3337644 - RNA, 12 nt, Human
acaagccacccc

SEQ ID NO: 3337645 - RNA, 21 nt, Human
acaagcgugagccacugcacc

SEQ ID NO: 3337646 - RNA, 20 nt, Human
acaagcgugagccacugcac

SEQ ID NO: 3337647 - RNA, 13 nt, Human
acaagcugcaccc

SEQ ID NO: 3337648 - RNA, 18 nt, Human
acaagcgugagccacugc

SEQ ID NO: 3337649 - RNA, 17 nt, Human
acaagagcccaggccuc

SEQ ID NO: 3337650 - RNA, 15 nt, Human
acaacaacaaaauga

SEQ ID NO: 3337651 - RNA, 12 nt, Human
acaacacucaca

SEQ ID NO: 3337652 - RNA, 12 nt, Human
uagacagucccu

SEQ ID NO: 3337653 - RNA, 14 nt, Human
uagacagucccugc

SEQ ID NO: 3337654 - RNA, 18 nt, Human
aauuuuuauuaaauuaug

SEQ ID NO: 3337655 - RNA, 17 nt, Human
aauuuuuauuaaauuau

SEQ ID NO: 3337656 - RNA, 22 nt, Human
aauuuuuuuaucgucacugcuu

SEQ ID NO: 3337657 - RNA, 13 nt, Human
acaaaaacauggc

SEQ ID NO: 3337658 - RNA, 17 nt, Human
aauuuuuuugagacaga

SEQ ID NO: 3337659 - RNA, 19 nt, Human
uagaagucuuagauguaua

SEQ ID NO: 3337660 - RNA, 18 nt, Human
uagaagucuuagauguau

SEQ ID NO: 3337661 - RNA, 17 nt, Human
uagaagucuuagaugua

SEQ ID NO: 3337662 - RNA, 16 nt, Human
uagaagucuuagaugu

SEQ ID NO: 3337663 - RNA, 16 nt, Human
uagaagucacacagua

SEQ ID NO: 3337664 - RNA, 16 nt, Human
uagacaauuuauuaug

SEQ ID NO: 3337665 - RNA, 21 nt, Human
uagacagagucucacuguugc

SEQ ID NO: 3337666 - RNA, 15 nt, Human
uagaagucacacagu

SEQ ID NO: 3337667 - RNA, 17 nt, Human
uaccauccccuguagag

SEQ ID NO: 3337668 - RNA, 17 nt, Human
uaccacuuuuguucuug

SEQ ID NO: 3337669 - RNA, 22 nt, Human
uacccuggcacuauaauguaag

SEQ ID NO: 3337670 - RNA, 20 nt, Human
uacccuggcacuauaaugua

SEQ ID NO: 3337671 - RNA, 15 nt, Human
uacccucauguucuu

SEQ ID NO: 3337672 - RNA, 16 nt, Human
uacccucauguucuua

SEQ ID NO: 3337673 - RNA, 20 nt, Human
uacccgggaagggggcuggg

SEQ ID NO: 3337674 - RNA, 18 nt, Human
aauuaacuuuuauaaacu

SEQ ID NO: 3337675 - RNA, 20 nt, Human
aauuaacuuuuauaaacuuu

SEQ ID NO: 3337676 - RNA, 22 nt, Human
aauuaacuuuuauaaacuuuac

SEQ ID NO: 3337677 - RNA, 16 nt, Human
aauuaacuuuuauaaa

SEQ ID NO: 3337678 - RNA, 22 nt, Human
aaugugaaacuggauuaaacuu

SEQ ID NO: 3337679 - RNA, 14 nt, Human
aaugucacaggcag

SEQ ID NO: 3337680 - RNA, 13 nt, Human
aaugucacaggca

SEQ ID NO: 3337681 - RNA, 18 nt, Human
aauguacugcauaugaaa

SEQ ID NO: 3337682 - RNA, 15 nt, Human
uacaguaucucaggg

SEQ ID NO: 3337683 - RNA, 18 nt, Human
uacaguaucucagggccu

SEQ ID NO: 3337684 - RNA, 12 nt, Human
uacaguccuccc

SEQ ID NO: 3337685 - RNA, 15 nt, Human
uacaguccucccauc

SEQ ID NO: 3337686 - RNA, 17 nt, Human
uacaguccucccaucuc

SEQ ID NO: 3337687 - RNA, 18 nt, Human
uacaguccucccaucuca

SEQ ID NO: 3337688 - RNA, 22 nt, Human
uacagcaaggagauuuacaacu

SEQ ID NO: 3337689 - RNA, 21 nt, Human
aauguacagcaaggagauuua

SEQ ID NO: 3337690 - RNA, 23 nt, Human
aauguacagcaaggagauuuaca

SEQ ID NO: 3337691 - RNA, 16 nt, Human
uacacgaaagagagag

SEQ ID NO: 3337692 - RNA, 15 nt, Human
uacacgaaagagaga

SEQ ID NO: 3337693 - RNA, 14 nt, Human
uacacgaaagagag

SEQ ID NO: 3337694 - RNA, 15 nt, Human
aauguaagcucuacu

SEQ ID NO: 3337695 - RNA, 13 nt, Human
aauguaagcucua

SEQ ID NO: 3337696 - RNA, 17 nt, Human
aaugguuuucuugugug

SEQ ID NO: 3337697 - RNA, 18 nt, Human
aaugguuuucuugugugu

SEQ ID NO: 3337698 - RNA, 22 nt, Human
aaugguuuucuuguguguuuau

SEQ ID NO: 3337699 - RNA, 16 nt, Human
aaugguuuucuugugu

SEQ ID NO: 3337700 - RNA, 19 nt, Human
aaugcacaaacagaggccg

SEQ ID NO: 3337701 - RNA, 13 nt, Human
aaugcacuuuguu

SEQ ID NO: 3337702 - RNA, 16 nt, Human
aaugcacuuuguucug

SEQ ID NO: 3337703 - RNA, 19 nt, Human
aaugcacuuuguucuggcu

SEQ ID NO: 3337704 - RNA, 23 nt, Human
uaauuaguuccucauuagcauuu

SEQ ID NO: 3337705 - RNA, 13 nt, Human
aaugaccuuucaa

SEQ ID NO: 3337706 - RNA, 14 nt, Human
aaugaccuuucaau

SEQ ID NO: 3337707 - RNA, 14 nt, Human
aaugcaaaccauca

SEQ ID NO: 3337708 - RNA, 16 nt, Human
aaugcaaaccaucauu

SEQ ID NO: 3337709 - RNA, 20 nt, Human
aaugaaugucagugugacug

SEQ ID NO: 3337710 - RNA, 21 nt, Human
aaugaaugucagugugacuga

SEQ ID NO: 3337711 - RNA, 18 nt, Human
aaugcacaaacagaggcc

SEQ ID NO: 3337712 - RNA, 22 nt, Human
aaugcaaaccaucauugaaauc

SEQ ID NO: 3337713 - RNA, 23 nt, Human
aaugcaaaccaucauugaaaucu

SEQ ID NO: 3337714 - RNA, 17 nt, Human
uaauuuaccugaagucu

SEQ ID NO: 3337715 - RNA, 18 nt, Human
uaauuuaccugaagucuu

SEQ ID NO: 3337716 - RNA, 20 nt, Human
uacaagcgugagccacugca

SEQ ID NO: 3337717 - RNA, 19 nt, Human
uacaagcgugagccacugc

SEQ ID NO: 3337718 - RNA, 18 nt, Human
uacaagcgugagccacug

SEQ ID NO: 3337719 - RNA, 16 nt, Human
uacaagcgugagccac

SEQ ID NO: 3337720 - RNA, 16 nt, Human
uacaaaaacauggccu

SEQ ID NO: 3337721 - RNA, 22 nt, Human
uaauacaccacuacauucuguu

SEQ ID NO: 3337722 - RNA, 21 nt, Human
uaauacaccacuacauucugu

SEQ ID NO: 3337723 - RNA, 23 nt, Human
uaauacaccacuacauucuguua

SEQ ID NO: 3337724 - RNA, 20 nt, Human
aauacaguaucucagggccu

SEQ ID NO: 3337725 - RNA, 21 nt, Human
uaauauugauaugcuuauaca

SEQ ID NO: 3337726 - RNA, 17 nt, Human
uaauguaagcucuacug

SEQ ID NO: 3337727 - RNA, 16 nt, Human
uaauguaagcucuacu

SEQ ID NO: 3337728 - RNA, 12 nt, Human
uaaugugaaacu

SEQ ID NO: 3337729 - RNA, 20 nt, Human
uaaugugaaacuggauuaaa

SEQ ID NO: 3337730 - RNA, 22 nt, Human
uaaugugaaacuggauuaaacu

SEQ ID NO: 3337731 - RNA, 23 nt, Human
uaaugugaaacuggauuaaacuu

SEQ ID NO: 3337732 - RNA, 16 nt, Human
uaaugucacaggcagg

SEQ ID NO: 3337733 - RNA, 15 nt, Human
uaaugucacaggcag

SEQ ID NO: 3337734 - RNA, 23 nt, Human
aaucuucugaacuuggcgcugcc

SEQ ID NO: 3337735 - RNA, 15 nt, Human
aaugaaugucagugu

SEQ ID NO: 3337736 - RNA, 14 nt, Human
aaugaaugucagug

SEQ ID NO: 3337737 - RNA, 14 nt, Human
aaugaaugaaacau

SEQ ID NO: 3337738 - RNA, 15 nt, Human
aaaaaauauuuuccu

SEQ ID NO: 3337739 - RNA, 23 nt, Human
aagauacaguuacucagaauucu

SEQ ID NO: 3337740 - RNA, 13 nt, Human
aagauaaaugugc

SEQ ID NO: 3337741 - RNA, 12 nt, Human
aagauaaaugug

SEQ ID NO: 3337742 - RNA, 20 nt, Human
aagccagcaggcucucaggc

SEQ ID NO: 3337743 - RNA, 23 nt, Human
aagccagcaggcucucaggccag

SEQ ID NO: 3337744 - RNA, 21 nt, Human
aagcagcguuucuaugacaca

SEQ ID NO: 3337745 - RNA, 22 nt, Human
aagcagcguuucuaugacacau

SEQ ID NO: 3337746 - RNA, 19 nt, Human
aagccagcaggcucucagg

SEQ ID NO: 3337747 - RNA, 17 nt, Human
aagcagcguuucuauga

SEQ ID NO: 3337748 - RNA, 20 nt, Human
aagcagcguuucuaugacac

SEQ ID NO: 3337749 - RNA, 14 nt, Human
aagcagcguuucua

SEQ ID NO: 3337750 - RNA, 17 nt, Human
aagcgauucuucugcuu

SEQ ID NO: 3337751 - RNA, 21 nt, Human
aagcgauucuucugcuucagc

SEQ ID NO: 3337752 - RNA, 21 nt, Human
aagcuggucccacucagucca

SEQ ID NO: 3337753 - RNA, 18 nt, Human
aagcuggucccacucagu

SEQ ID NO: 3337754 - RNA, 15 nt, Human
aagcugggcagguug

SEQ ID NO: 3337755 - RNA, 13 nt, Human
aaggacacuagaa

SEQ ID NO: 3337756 - RNA, 15 nt, Human
aaggauugcuacugu

SEQ ID NO: 3337757 - RNA, 15 nt, Human
aaggauguucuagca

SEQ ID NO: 3337758 - RNA, 19 nt, Human
aaguggaaaaauagccugc

SEQ ID NO: 3337759 - RNA, 21 nt, Human
aaguggaaaaauagccugccu

SEQ ID NO: 3337760 - RNA, 18 nt, Human
aaggucauuuuuuuuaag

SEQ ID NO: 3337761 - RNA, 19 nt, Human
aaggucauuuuuuuuaaga

SEQ ID NO: 3337762 - RNA, 22 nt, Human
aaguccucuuuucugagaggac

SEQ ID NO: 3337763 - RNA, 18 nt, Human
aaguccucuuuucugaga

SEQ ID NO: 3337764 - RNA, 20 nt, Human
aaguagaagucuuagaugua

SEQ ID NO: 3337765 - RNA, 19 nt, Human
aaguagaagucuuagaugu

SEQ ID NO: 3337766 - RNA, 17 nt, Human
aaguaucccuacuguaa

SEQ ID NO: 3337767 - RNA, 18 nt, Human
aaguaucccuacuguaau

SEQ ID NO: 3337768 - RNA, 23 nt, Human
aaguaucccuacuguaauuugug

SEQ ID NO: 3337769 - RNA, 21 nt, Human
aaguagaagucuuagauguau

SEQ ID NO: 3337770 - RNA, 16 nt, Human
aaucucaaauuucuaa

SEQ ID NO: 3337771 - RNA, 15 nt, Human
aaucucaaauuucua

SEQ ID NO: 3337772 - RNA, 17 nt, Human
aauccagacccggcugc

SEQ ID NO: 3337773 - RNA, 19 nt, Human
aauccagacccggcugcgu

SEQ ID NO: 3337774 - RNA, 17 nt, Human
aaucucaaauuucuaaa

SEQ ID NO: 3337775 - RNA, 18 nt, Human
aaucucaaauuucuaaau

SEQ ID NO: 3337776 - RNA, 16 nt, Human
aaugauuaauuaaaac

SEQ ID NO: 3337777 - RNA, 20 nt, Human
aauacucuacccucuuagaa

SEQ ID NO: 3337778 - RNA, 22 nt, Human
aauacucuacccucuuagaaaa

SEQ ID NO: 3337779 - RNA, 14 nt, Human
aaucaccgaaaacg

SEQ ID NO: 3337780 - RNA, 13 nt, Human
aauagacaauuua

SEQ ID NO: 3337781 - RNA, 23 nt, Human
aaugccuuacccucauguucuua

SEQ ID NO: 3337782 - RNA, 18 nt, Human
aaugcgugcauaccacuu

SEQ ID NO: 3337783 - RNA, 19 nt, Human
aaugcgugcauaccacuuu

SEQ ID NO: 3337784 - RNA, 15 nt, Human
aaugugaaaagaaaa

SEQ ID NO: 3337785 - RNA, 15 nt, Human
aauguuugccucugc

SEQ ID NO: 3337786 - RNA, 23 nt, Human
aaugcucuuuacuucauggacuu

SEQ ID NO: 3337787 - RNA, 13 nt, Human
aaccacgcuggac

SEQ ID NO: 3337788 - RNA, 15 nt, Human
aaccacuucagcuga

SEQ ID NO: 3337789 - RNA, 23 nt, Human
aaaugccuuacccucauguucuu

SEQ ID NO: 3337790 - RNA, 18 nt, Human
aaauucuugcaaaguauc

SEQ ID NO: 3337791 - RNA, 21 nt, Human
aaauucuugcaaaguaucccu

SEQ ID NO: 3337792 - RNA, 15 nt, Human
aacuuaaucuaaaug

SEQ ID NO: 3337793 - RNA, 16 nt, Human
aacuuaaucuaaaugg

SEQ ID NO: 3337794 - RNA, 18 nt, Human
aacuuaaucuaaauggaa

SEQ ID NO: 3337795 - RNA, 14 nt, Human
aacugauaaagaug

SEQ ID NO: 3337796 - RNA, 19 nt, Human
aacuuaaauaaugugaaac

SEQ ID NO: 3337797 - RNA, 24 nt, Human
aaauagcucaggugucccugcacu

SEQ ID NO: 3337798 - RNA, 19 nt, Human
aaauaguggugugauuugg

SEQ ID NO: 3337799 - RNA, 18 nt, Human
aaaucugcuuuuuaaaga

SEQ ID NO: 3337800 - RNA, 19 nt, Human
aaauaaaacuuuuuaaaau

SEQ ID NO: 3337801 - RNA, 13 nt, Human
aaauaaaacuuuu

SEQ ID NO: 3337802 - RNA, 16 nt, Human
aaauaaaacuuuuuaa

SEQ ID NO: 3337803 - RNA, 13 nt, Human
aaaguggaaaaau

SEQ ID NO: 3337804 - RNA, 14 nt, Human
aaagugcugggauu

SEQ ID NO: 3337805 - RNA, 19 nt, Human
aaaggcuccaggagcagcc

SEQ ID NO: 3337806 - RNA, 15 nt, Human
aaaggcuccaggagc

SEQ ID NO: 3337807 - RNA, 16 nt, Human
aaaggcuccaggagca

SEQ ID NO: 3337808 - RNA, 18 nt, Human
aaacucuccucugcugcu

SEQ ID NO: 3337809 - RNA, 13 nt, Human
aaacucuccucug

SEQ ID NO: 3337810 - RNA, 18 nt, Human
aaaccaucauugaaaucu

SEQ ID NO: 3337811 - RNA, 17 nt, Human
aaagauauuuugcuuug

SEQ ID NO: 3337812 - RNA, 12 nt, Human
aaagauauuuug

SEQ ID NO: 3337813 - RNA, 16 nt, Human
aaagauauuuugcuuu

SEQ ID NO: 3337814 - RNA, 14 nt, Human
aaagaguaggaaga

SEQ ID NO: 3337815 - RNA, 19 nt, Human
aaaaucucaaauuucuaaa

SEQ ID NO: 3337816 - RNA, 22 nt, Human
aaaaucucaaauuucuaaaucu

SEQ ID NO: 3337817 - RNA, 15 nt, Human
aaaaagaaaggaggg

SEQ ID NO: 3337818 - RNA, 22 nt, Human
aaaaucccuuaccucggugccu

SEQ ID NO: 3337819 - RNA, 16 nt, Human
aaaauaaaacuuuuua

SEQ ID NO: 3337820 - RNA, 17 nt, Human
aaaauaaaacuuuuuaa

SEQ ID NO: 3337821 - RNA, 14 nt, Human
acgucugacaggca

SEQ ID NO: 3337822 - RNA, 13 nt, Human
acgucugacaggc

SEQ ID NO: 3337823 - RNA, 12 nt, Human
acgcugugcugc

SEQ ID NO: 3337824 - RNA, 14 nt, Human
acgcugugcugccc

SEQ ID NO: 3337825 - RNA, 11 nt, Human
acgcugugcug

SEQ ID NO: 3337826 - RNA, 11 nt, Human
acgugaguccu

SEQ ID NO: 3337827 - RNA, 15 nt, Human
accucugcagcaaua

SEQ ID NO: 3337828 - RNA, 18 nt, Human
accucugcagcaauaaag

SEQ ID NO: 3337829 - RNA, 20 nt, Human
accucugcagcaauaaagca

SEQ ID NO: 3337830 - RNA, 21 nt, Human
accucugcagcaauaaagcag

SEQ ID NO: 3337831 - RNA, 23 nt, Human
accucugccugaagucacacagu

SEQ ID NO: 3337832 - RNA, 15 nt, Human
accuuuaagagaaau

SEQ ID NO: 3337833 - RNA, 18 nt, Human
accuuucccaucuuccaa

SEQ ID NO: 3337834 - RNA, 13 nt, Human
accuuucccaucu

SEQ ID NO: 3337835 - RNA, 17 nt, Human
accuuggcugcagggag

SEQ ID NO: 3337836 - RNA, 14 nt, Human
accuuggcugcagg

SEQ ID NO: 3337837 - RNA, 18 nt, Human
accuuggcugcagggagu

SEQ ID NO: 3337838 - RNA, 12 nt, Human
accugucccccu

SEQ ID NO: 3337839 - RNA, 15 nt, Human
accugucccccugac

SEQ ID NO: 3337840 - RNA, 16 nt, Human
accugucccccugaca

SEQ ID NO: 3337841 - RNA, 19 nt, Human
acucaguccauagcagaga

SEQ ID NO: 3337842 - RNA, 13 nt, Human
acucaaaagcugg

SEQ ID NO: 3337843 - RNA, 15 nt, Human
acucuagggaaaaac

SEQ ID NO: 3337844 - RNA, 17 nt, Human
acucuagggaaaaacca

SEQ ID NO: 3337845 - RNA, 19 nt, Human
acucugucgcccagucugg

SEQ ID NO: 3337846 - RNA, 23 nt, Human
acucuaucaaguauuauaccuuu

SEQ ID NO: 3337847 - RNA, 21 nt, Human
acucuaucaaguauuauaccu

SEQ ID NO: 3337848 - RNA, 14 nt, Human
acuggagaaaaugg

SEQ ID NO: 3337849 - RNA, 15 nt, Human
acuggagaaaaugga

SEQ ID NO: 3337850 - RNA, 17 nt, Human
acuggaagcacagcuuc

SEQ ID NO: 3337851 - RNA, 19 nt, Human
acuggaagcacagcuucau

SEQ ID NO: 3337852 - RNA, 16 nt, Human
acuggaagcacagcuu

SEQ ID NO: 3337853 - RNA, 18 nt, Human
acugguuccauggccucu

SEQ ID NO: 3337854 - RNA, 16 nt, Human
acugugaagagaacca

SEQ ID NO: 3337855 - RNA, 20 nt, Human
acugugcugagucugaaggc

SEQ ID NO: 3337856 - RNA, 23 nt, Human
acuucacauauugauuuccguua

SEQ ID NO: 3337857 - RNA, 18 nt, Human
acuucuuauacauuugau

SEQ ID NO: 3337858 - RNA, 14 nt, Human
acuugggccacugu

SEQ ID NO: 3337859 - RNA, 15 nt, Human
acuugggccacugug

SEQ ID NO: 3337860 - RNA, 16 nt, Human
acuugguuuuuaaaaa

SEQ ID NO: 3337861 - RNA, 23 nt, Human
agaaaguacuucuccacccugcu

SEQ ID NO: 3337862 - RNA, 22 nt, Human
agaaaguacuucuccacccugc

SEQ ID NO: 3337863 - RNA, 13 nt, Human
acuuuuauaaacu

SEQ ID NO: 3337864 - RNA, 14 nt, Human
acuuuguucuggcu

SEQ ID NO: 3337865 - RNA, 19 nt, Human
acuuuguucuggcucuucc

SEQ ID NO: 3337866 - RNA, 16 nt, Human
acuuuguucuggcucu

SEQ ID NO: 3337867 - RNA, 17 nt, Human
acuuuguucuggcucuu

SEQ ID NO: 3337868 - RNA, 20 nt, Human
acuuuucauaaccuagccuu

SEQ ID NO: 3337869 - RNA, 22 nt, Human
acuuuucaaggcuuauauucaa

SEQ ID NO: 3337870 - RNA, 16 nt, Human
acuuuucuuucagcca

SEQ ID NO: 3337871 - RNA, 23 nt, Human
acuuuucaaggcuuauauucaac

SEQ ID NO: 3337872 - RNA, 14 nt, Human
acuuuucuuugugg

SEQ ID NO: 3337873 - RNA, 19 nt, Human
agaaaauaguggugugauu

SEQ ID NO: 3337874 - RNA, 15 nt, Human
agaaaauaccaagga

SEQ ID NO: 3337875 - RNA, 12 nt, Human
acaaggcaaggc

SEQ ID NO: 3337876 - RNA, 14 nt, Human
acaaggcaaggcug

SEQ ID NO: 3337877 - RNA, 17 nt, Human
acaaggauugcuacugu

SEQ ID NO: 3337878 - RNA, 16 nt, Human
acaaggauugcuacug

SEQ ID NO: 3337879 - RNA, 20 nt, Human
acaaaauguaggguuauaau

SEQ ID NO: 3337880 - RNA, 22 nt, Human
acaaaauguaggguuauaauaa

SEQ ID NO: 3337881 - RNA, 20 nt, Human
acaaggcaaggcugucaauu

SEQ ID NO: 3337882 - RNA, 16 nt, Human
aauuuugugcccccau

SEQ ID NO: 3337883 - RNA, 20 nt, Human
acacauuuuuuaaaugcacc

SEQ ID NO: 3337884 - RNA, 22 nt, Human
acacauuuuuuaaaugcaccug

SEQ ID NO: 3337885 - RNA, 21 nt, Human
acacauuuuauuuuauuaugc

SEQ ID NO: 3337886 - RNA, 22 nt, Human
acacauuuuauuuuauuaugca

SEQ ID NO: 3337887 - RNA, 11 nt, Human
acacagcucuu

SEQ ID NO: 3337888 - RNA, 19 nt, Human
acacagaggcugccucucc

SEQ ID NO: 3337889 - RNA, 14 nt, Human
acacagcucugucc

SEQ ID NO: 3337890 - RNA, 20 nt, Human
acacagcucuguccugggag

SEQ ID NO: 3337891 - RNA, 17 nt, Human
acacgcgugcacacacc

SEQ ID NO: 3337892 - RNA, 15 nt, Human
acacgcgugcacaca

SEQ ID NO: 3337893 - RNA, 17 nt, Human
acacgcgcgcacacaca

SEQ ID NO: 3337894 - RNA, 19 nt, Human
acacauuuuuuaaaugcac

SEQ ID NO: 3337895 - RNA, 22 nt, Human
acacgcgcgcacacacacacau

SEQ ID NO: 3337896 - RNA, 14 nt, Human
acaggauuauugga

SEQ ID NO: 3337897 - RNA, 12 nt, Human
acaggcaagcac

SEQ ID NO: 3337898 - RNA, 18 nt, Human
acaggcaaugcuggcugu

SEQ ID NO: 3337899 - RNA, 15 nt, Human
acaggaucagucuga

SEQ ID NO: 3337900 - RNA, 17 nt, Human
acagcucuucuccaggc

SEQ ID NO: 3337901 - RNA, 16 nt, Human
acagcucuucuccagg

SEQ ID NO: 3337902 - RNA, 17 nt, Human
acagcucuguccuggga

SEQ ID NO: 3337903 - RNA, 15 nt, Human
acagccacggccagg

SEQ ID NO: 3337904 - RNA, 17 nt, Human
acagccacggccaggcc

SEQ ID NO: 3337905 - RNA, 16 nt, Human
acagccacggccaggc

SEQ ID NO: 3337906 - RNA, 18 nt, Human
acagccacggccaggcca

SEQ ID NO: 3337907 - RNA, 14 nt, Human
acacugcauguuug

SEQ ID NO: 3337908 - RNA, 15 nt, Human
acacugcauguuugu

SEQ ID NO: 3337909 - RNA, 11 nt, Human
acagacacagg

SEQ ID NO: 3337910 - RNA, 15 nt, Human
acacuguacugcaau

SEQ ID NO: 3337911 - RNA, 15 nt, Human
acagaggcagcccca

SEQ ID NO: 3337912 - RNA, 14 nt, Human
acagaggcagcccc

SEQ ID NO: 3337913 - RNA, 14 nt, Human
acagacacaggccc

SEQ ID NO: 3337914 - RNA, 13 nt, Human
acagacacaggcc

SEQ ID NO: 3337915 - RNA, 23 nt, Human
acagaggccaugggccuccugug

SEQ ID NO: 3337916 - RNA, 19 nt, Human
acagaggcagccccauucu

SEQ ID NO: 3337917 - RNA, 15 nt, Human
acagagugagacucu

SEQ ID NO: 3337918 - RNA, 23 nt, Human
acagagucucacuguugcccagg

SEQ ID NO: 3337919 - RNA, 19 nt, Human
acagagugagacucugucu

SEQ ID NO: 3337920 - RNA, 19 nt, Human
accccuccaugugggcuag

SEQ ID NO: 3337921 - RNA, 16 nt, Human
accccuccaugugggc

SEQ ID NO: 3337922 - RNA, 20 nt, Human
accccucaacaccucugcac

SEQ ID NO: 3337923 - RNA, 14 nt, Human
accauauuaccaca

SEQ ID NO: 3337924 - RNA, 16 nt, Human
accauauuaccacaga

SEQ ID NO: 3337925 - RNA, 16 nt, Human
acccaccucagccucc

SEQ ID NO: 3337926 - RNA, 11 nt, Human
acccccugaau

SEQ ID NO: 3337927 - RNA, 20 nt, Human
accauauuaccacagacaua

SEQ ID NO: 3337928 - RNA, 19 nt, Human
acccaagggccuggccuga

SEQ ID NO: 3337929 - RNA, 22 nt, Human
acccaagggccuggccugagcu

SEQ ID NO: 3337930 - RNA, 18 nt, Human
acccaagggccuggccug

SEQ ID NO: 3337931 - RNA, 15 nt, Human
acccaccucagccuc

SEQ ID NO: 3337932 - RNA, 14 nt, Human
acccaccucagccu

SEQ ID NO: 3337933 - RNA, 13 nt, Human
acccaccucagcc

SEQ ID NO: 3337934 - RNA, 16 nt, Human
acaugugcacaugcac

SEQ ID NO: 3337935 - RNA, 18 nt, Human
acaucagcacgauuucug

SEQ ID NO: 3337936 - RNA, 15 nt, Human
acaucagcacgauuu

SEQ ID NO: 3337937 - RNA, 17 nt, Human
acaucagcacgauuucu

SEQ ID NO: 3337938 - RNA, 19 nt, Human
acaugaucuucuuuauaau

SEQ ID NO: 3337939 - RNA, 23 nt, Human
acauaaugcgugcauaccacuuu

SEQ ID NO: 3337940 - RNA, 22 nt, Human
acauaaugcgugcauaccacuu

SEQ ID NO: 3337941 - RNA, 21 nt, Human
acauaaugcgugcauaccacu

SEQ ID NO: 3337942 - RNA, 23 nt, Human
acaggcaaugcuggcuguuggcu

SEQ ID NO: 3337943 - RNA, 19 nt, Human
acaggcaaugcuggcuguu

SEQ ID NO: 3337944 - RNA, 19 nt, Human
acaggguuuugccauguug

SEQ ID NO: 3337945 - RNA, 14 nt, Human
acauuuauucugcu

SEQ ID NO: 3337946 - RNA, 19 nt, Human
accagagcugccaccugcc

SEQ ID NO: 3337947 - RNA, 13 nt, Human
accagcagaaaug

SEQ ID NO: 3337948 - RNA, 17 nt, Human
accagccaguaaauggg

SEQ ID NO: 3337949 - RNA, 15 nt, Human
acauuuauucugcuc

SEQ ID NO: 3337950 - RNA, 23 nt, Human
agcauccuggcacccggccccug

SEQ ID NO: 3337951 - RNA, 22 nt, Human
agcauccuggcacccggccccu

SEQ ID NO: 3337952 - RNA, 18 nt, Human
agcauccuggcacccggc

SEQ ID NO: 3337953 - RNA, 23 nt, Human
agccaagugugguagagugugcc

SEQ ID NO: 3337954 - RNA, 20 nt, Human
agcaugccuggauggggcug

SEQ ID NO: 3337955 - RNA, 23 nt, Human
agcaugccuggauggggcugcac

SEQ ID NO: 3337956 - RNA, 23 nt, Human
agccaaagcuaggccuggccaga

SEQ ID NO: 3337957 - RNA, 13 nt, Human
agcagcguuucua

SEQ ID NO: 3337958 - RNA, 18 nt, Human
agcagugcaugcuguccc

SEQ ID NO: 3337959 - RNA, 19 nt, Human
agcagugcaugcugucccu

SEQ ID NO: 3337960 - RNA, 20 nt, Human
agcagugcaugcugucccuu

SEQ ID NO: 3337961 - RNA, 17 nt, Human
agcacagacccugcccu

SEQ ID NO: 3337962 - RNA, 23 nt, Human
agcacacuugacaucaacugcau

SEQ ID NO: 3337963 - RNA, 18 nt, Human
agcacagacccugcccug

SEQ ID NO: 3337964 - RNA, 19 nt, Human
agcacagacccugcccugu

SEQ ID NO: 3337965 - RNA, 18 nt, Human
agccagcaggcucucagg

SEQ ID NO: 3337966 - RNA, 19 nt, Human
agccagcaggcucucaggc

SEQ ID NO: 3337967 - RNA, 17 nt, Human
agccagcaggcucucag

SEQ ID NO: 3337968 - RNA, 20 nt, Human
agccagcaggcucucaggcc

SEQ ID NO: 3337969 - RNA, 15 nt, Human
agccccagugcccac

SEQ ID NO: 3337970 - RNA, 14 nt, Human
agccccagugccca

SEQ ID NO: 3337971 - RNA, 13 nt, Human
agccccagugccc

SEQ ID NO: 3337972 - RNA, 21 nt, Human
agcccgggcucugccucccau

SEQ ID NO: 3337973 - RNA, 16 nt, Human
agccccauucugccug

SEQ ID NO: 3337974 - RNA, 13 nt, Human
agccccauucugc

SEQ ID NO: 3337975 - RNA, 19 nt, Human
agccucccgaguagcuggg

SEQ ID NO: 3337976 - RNA, 18 nt, Human
agccucccgaguagcugg

SEQ ID NO: 3337977 - RNA, 20 nt, Human
agccucccgaguagcuggga

SEQ ID NO: 3337978 - RNA, 14 nt, Human
agccuccuccagcc

SEQ ID NO: 3337979 - RNA, 17 nt, Human
agccucccgaguagcug

SEQ ID NO: 3337980 - RNA, 20 nt, Human
agccucccaaagugcuggga

SEQ ID NO: 3337981 - RNA, 21 nt, Human
agccucccaaagugcugggau

SEQ ID NO: 3337982 - RNA, 22 nt, Human
agccucccacgacugcccggca

SEQ ID NO: 3337983 - RNA, 21 nt, Human
agccgccaugcuccuggccca

SEQ ID NO: 3337984 - RNA, 18 nt, Human
agacgggggcagagaggg

SEQ ID NO: 3337985 - RNA, 20 nt, Human
agacgcugugcugcccugcc

SEQ ID NO: 3337986 - RNA, 22 nt, Human
agacgcugugcugcccugccca

SEQ ID NO: 3337987 - RNA, 21 nt, Human
agacgcugugcugcccugccc

SEQ ID NO: 3337988 - RNA, 11 nt, Human
agacagcucuu

SEQ ID NO: 3337989 - RNA, 12 nt, Human
agacagcucuua

SEQ ID NO: 3337990 - RNA, 21 nt, Human
agacagauacuccuccaaggu

SEQ ID NO: 3337991 - RNA, 15 nt, Human
agacagauacuccuc

SEQ ID NO: 3337992 - RNA, 14 nt, Human
agacagcccgggcu

SEQ ID NO: 3337993 - RNA, 15 nt, Human
agacagcccgggcuc

SEQ ID NO: 3337994 - RNA, 23 nt, Human
agacagagucucacuguugccca

SEQ ID NO: 3337995 - RNA, 21 nt, Human
agagaggguggugaccucugc

SEQ ID NO: 3337996 - RNA, 20 nt, Human
agagaggguggugaccucug

SEQ ID NO: 3337997 - RNA, 22 nt, Human
agagaggguggugaccucugcc

SEQ ID NO: 3337998 - RNA, 13 nt, Human
agagcccaccuug

SEQ ID NO: 3337999 - RNA, 16 nt, Human
agagcccacgccccca

SEQ ID NO: 3338000 - RNA, 13 nt, Human
agagcccacgccc

SEQ ID NO: 3338001 - RNA, 19 nt, Human
agagcccaccuuggcucaa

SEQ ID NO: 3338002 - RNA, 23 nt, Human
agagagcaagacgcugugcugcc

SEQ ID NO: 3338003 - RNA, 16 nt, Human
agacuggaagcacagc

SEQ ID NO: 3338004 - RNA, 17 nt, Human
agacuggaagcacagcu

SEQ ID NO: 3338005 - RNA, 19 nt, Human
agacuggaagcacagcuuc

SEQ ID NO: 3338006 - RNA, 14 nt, Human
agaucuucuguggg

SEQ ID NO: 3338007 - RNA, 19 nt, Human
agauauaugcucugcaugu

SEQ ID NO: 3338008 - RNA, 15 nt, Human
agagcccaggccucc

SEQ ID NO: 3338009 - RNA, 13 nt, Human
agagcccaggccu

SEQ ID NO: 3338010 - RNA, 14 nt, Human
agagcccaggccuc

SEQ ID NO: 3338011 - RNA, 12 nt, Human
agagggcacaga

SEQ ID NO: 3338012 - RNA, 22 nt, Human
agaggguggugaccucugccug

SEQ ID NO: 3338013 - RNA, 20 nt, Human
agaggguggugaccucugcc

SEQ ID NO: 3338014 - RNA, 19 nt, Human
agaggguggugaccucugc

SEQ ID NO: 3338015 - RNA, 14 nt, Human
agagugugccugaa

SEQ ID NO: 3338016 - RNA, 11 nt, Human
agagugggagc

SEQ ID NO: 3338017 - RNA, 21 nt, Human
agaggaaaucaccgaaaacgu

SEQ ID NO: 3338018 - RNA, 16 nt, Human
agaggaaggagaggag

SEQ ID NO: 3338019 - RNA, 15 nt, Human
agaggagagaggacc

SEQ ID NO: 3338020 - RNA, 16 nt, Human
agaggagagaggaccc

SEQ ID NO: 3338021 - RNA, 23 nt, Human
agaggacuuuucuuuguggcuuc

SEQ ID NO: 3338022 - RNA, 23 nt, Human
agcugcgguccacccaggagccc

SEQ ID NO: 3338023 - RNA, 21 nt, Human
agcuccgcuuucuacccagcg

SEQ ID NO: 3338024 - RNA, 20 nt, Human
agcuccgcuuucuacccagc

SEQ ID NO: 3338025 - RNA, 23 nt, Human
agcuccgcuuucuacccagcgag

SEQ ID NO: 3338026 - RNA, 12 nt, Human
agcuccuucugu

SEQ ID NO: 3338027 - RNA, 21 nt, Human
agcugacuuuucuguccgagc

SEQ ID NO: 3338028 - RNA, 21 nt, Human
agcugcgguccacccaggagc

SEQ ID NO: 3338029 - RNA, 21 nt, Human
aggaaucaugugccaagcaga

SEQ ID NO: 3338030 - RNA, 17 nt, Human
aggaauccagacccggc

SEQ ID NO: 3338031 - RNA, 13 nt, Human
aggaccucaggug

SEQ ID NO: 3338032 - RNA, 21 nt, Human
aggaugcuuguacauaaugcg

SEQ ID NO: 3338033 - RNA, 23 nt, Human
aggaugcuuguacauaaugcgug

SEQ ID NO: 3338034 - RNA, 22 nt, Human
aggauguucuagcauggcugcc

SEQ ID NO: 3338035 - RNA, 16 nt, Human
aggauguucugggaca

SEQ ID NO: 3338036 - RNA, 15 nt, Human
aggauguucugggac

SEQ ID NO: 3338037 - RNA, 18 nt, Human
aggaugcuuguacauaau

SEQ ID NO: 3338038 - RNA, 14 nt, Human
aggauuauuggaaa

SEQ ID NO: 3338039 - RNA, 14 nt, Human
agguucaaagauau

SEQ ID NO: 3338040 - RNA, 22 nt, Human
agguucccuuugacgccauccc

SEQ ID NO: 3338041 - RNA, 13 nt, Human
agguucccuuuga

SEQ ID NO: 3338042 - RNA, 23 nt, Human
agguucccuuugacgccauccca

SEQ ID NO: 3338043 - RNA, 19 nt, Human
aggugcuaggaacacuccu

SEQ ID NO: 3338044 - RNA, 22 nt, Human
aggugcuaggaacacuccuuca

SEQ ID NO: 3338045 - RNA, 23 nt, Human
aggugcuaggaacacuccuucac

SEQ ID NO: 3338046 - RNA, 18 nt, Human
aggucuguucuuuccaaa

SEQ ID NO: 3338047 - RNA, 22 nt, Human
aggucuguucuuuccaaaguac

SEQ ID NO: 3338048 - RNA, 23 nt, Human
aggucuguucuuuccaaaguaca

SEQ ID NO: 3338049 - RNA, 23 nt, Human
aggguuuugccauguuggccagg

SEQ ID NO: 3338050 - RNA, 11 nt, Human
agggucccugg

SEQ ID NO: 3338051 - RNA, 21 nt, Human
aggguaucaggugcugccauc

SEQ ID NO: 3338052 - RNA, 18 nt, Human
aggguaucaggugcugcc

SEQ ID NO: 3338053 - RNA, 19 nt, Human
aggguaucaggugcugcca

SEQ ID NO: 3338054 - RNA, 20 nt, Human
aggggccucuuaugggcugg

SEQ ID NO: 3338055 - RNA, 19 nt, Human
aggggccucuuaugggcug

SEQ ID NO: 3338056 - RNA, 21 nt, Human
aggcugucaauuacaggaagu

SEQ ID NO: 3338057 - RNA, 22 nt, Human
agggacagaggggguggccucc

SEQ ID NO: 3338058 - RNA, 20 nt, Human
agggacagaggggguggccu

SEQ ID NO: 3338059 - RNA, 23 nt, Human
agggacagaggggguggccuccc

SEQ ID NO: 3338060 - RNA, 19 nt, Human
aggcugucaauuacaggaa

SEQ ID NO: 3338061 - RNA, 20 nt, Human
aggcugucaauuacaggaag

SEQ ID NO: 3338062 - RNA, 13 nt, Human
aggcuguauccca

SEQ ID NO: 3338063 - RNA, 20 nt, Human
aggcccuucucuccagcccc

SEQ ID NO: 3338064 - RNA, 21 nt, Human
aggcccuucucuccagccccu

SEQ ID NO: 3338065 - RNA, 22 nt, Human
aggcccuucucuccagccccug

SEQ ID NO: 3338066 - RNA, 23 nt, Human
aggcccuucucuccagccccugg

SEQ ID NO: 3338067 - RNA, 19 nt, Human
aggcccuucucuccagccc

SEQ ID NO: 3338068 - RNA, 22 nt, Human
aucuucugaacuuggcgcugcc

SEQ ID NO: 3338069 - RNA, 18 nt, Human
aucuugaagacuuuucuu

SEQ ID NO: 3338070 - RNA, 22 nt, Human
aucugcuuuuuaaagaaugcuc

SEQ ID NO: 3338071 - RNA, 21 nt, Human
aucucccccagccccauccuc

SEQ ID NO: 3338072 - RNA, 17 nt, Human
augaaagacuguacaaa

SEQ ID NO: 3338073 - RNA, 16 nt, Human
augaaagacuguacaa

SEQ ID NO: 3338074 - RNA, 13 nt, Human
augaaagacugua

SEQ ID NO: 3338075 - RNA, 21 nt, Human
augaccuuucaauaggaaaaa

SEQ ID NO: 3338076 - RNA, 18 nt, Human
augaccuuucaauaggaa

SEQ ID NO: 3338077 - RNA, 22 nt, Human
augaccuuucaauaggaaaaac

SEQ ID NO: 3338078 - RNA, 23 nt, Human
augaccuuucaauaggaaaaacu

SEQ ID NO: 3338079 - RNA, 14 nt, Human
aucccauuuaaaaa

SEQ ID NO: 3338080 - RNA, 15 nt, Human
aucccauuuaaaaaa

SEQ ID NO: 3338081 - RNA, 15 nt, Human
auccccuguagagug

SEQ ID NO: 3338082 - RNA, 23 nt, Human
auccucauacccacccccaccca

SEQ ID NO: 3338083 - RNA, 11 nt, Human
auccuccaggu

SEQ ID NO: 3338084 - RNA, 23 nt, Human
auccuccaggugcacaagcucca

SEQ ID NO: 3338085 - RNA, 15 nt, Human
auccucccaccucag

SEQ ID NO: 3338086 - RNA, 19 nt, Human
auccucccaccucagccuc

SEQ ID NO: 3338087 - RNA, 18 nt, Human
auccucccaccucagccu

SEQ ID NO: 3338088 - RNA, 20 nt, Human
auccucccaccucagccucc

SEQ ID NO: 3338089 - RNA, 19 nt, Human
aucaccaacgucugugcca

SEQ ID NO: 3338090 - RNA, 23 nt, Human
aucacccgcuaagagggagggag

SEQ ID NO: 3338091 - RNA, 18 nt, Human
aucaccaacgucugugcc

SEQ ID NO: 3338092 - RNA, 21 nt, Human
aucacagccucugaaaaccaa

SEQ ID NO: 3338093 - RNA, 13 nt, Human
aucacagccucug

SEQ ID NO: 3338094 - RNA, 23 nt, Human
aucagcacgauuucuguuuagau

SEQ ID NO: 3338095 - RNA, 19 nt, Human
aucagcacgauuucuguuu

SEQ ID NO: 3338096 - RNA, 20 nt, Human
aucagcacgauuucuguuua

SEQ ID NO: 3338097 - RNA, 19 nt, Human
aucaccgaaaacguggcug

SEQ ID NO: 3338098 - RNA, 18 nt, Human
aucagcacgauuucuguu

SEQ ID NO: 3338099 - RNA, 14 nt, Human
aucaccgaaaacgu

SEQ ID NO: 3338100 - RNA, 19 nt, Human
aucagccugcuccagcugu

SEQ ID NO: 3338101 - RNA, 17 nt, Human
aucagccugcuccagcu

SEQ ID NO: 3338102 - RNA, 18 nt, Human
aucagccugcuccagcug

SEQ ID NO: 3338103 - RNA, 11 nt, Human
augcugcccug

SEQ ID NO: 3338104 - RNA, 16 nt, Human
augcucuuuacuucau

SEQ ID NO: 3338105 - RNA, 15 nt, Human
auggauuuccagcca

SEQ ID NO: 3338106 - RNA, 13 nt, Human
augcuuguacaua

SEQ ID NO: 3338107 - RNA, 14 nt, Human
augcuuguacauaa

SEQ ID NO: 3338108 - RNA, 12 nt, Human
augcuuguacau

SEQ ID NO: 3338109 - RNA, 16 nt, Human
augaugccaugaggaa

SEQ ID NO: 3338110 - RNA, 17 nt, Human
augaugccaugaggaac

SEQ ID NO: 3338111 - RNA, 24 nt, Human
augauguuuuccaugaguccccug

SEQ ID NO: 3338112 - RNA, 15 nt, Human
augcacaaacagagg

SEQ ID NO: 3338113 - RNA, 16 nt, Human
augcaugaaguaauau

SEQ ID NO: 3338114 - RNA, 17 nt, Human
augccucucucaggcca

SEQ ID NO: 3338115 - RNA, 19 nt, Human
augccucucucaggccaaa

SEQ ID NO: 3338116 - RNA, 23 nt, Human
augcacacauuuuuuaaaugcac

SEQ ID NO: 3338117 - RNA, 16 nt, Human
augcacagaguuguua

SEQ ID NO: 3338118 - RNA, 16 nt, Human
augcacaaacagaggc

SEQ ID NO: 3338119 - RNA, 17 nt, Human
augcacaaacagaggcc

SEQ ID NO: 3338120 - RNA, 17 nt, Human
augcacagaguuguuac

SEQ ID NO: 3338121 - RNA, 22 nt, Human
augugaaacuggauuaaacuua

SEQ ID NO: 3338122 - RNA, 14 nt, Human
augucuuuucuugc

SEQ ID NO: 3338123 - RNA, 19 nt, Human
auggucaccaaaucagcug

SEQ ID NO: 3338124 - RNA, 17 nt, Human
auguaauuaaguacuau

SEQ ID NO: 3338125 - RNA, 15 nt, Human
auguaauuaaguacu

SEQ ID NO: 3338126 - RNA, 18 nt, Human
auguuugccucugccucu

SEQ ID NO: 3338127 - RNA, 22 nt, Human
auguuugccucugccucugaca

SEQ ID NO: 3338128 - RNA, 19 nt, Human
auguuugccucugccucug

SEQ ID NO: 3338129 - RNA, 12 nt, Human
auguucugggac

SEQ ID NO: 3338130 - RNA, 11 nt, Human
auguucuggga

SEQ ID NO: 3338131 - RNA, 20 nt, Human
agugaacuugggccacugug

SEQ ID NO: 3338132 - RNA, 17 nt, Human
agucuggaaugcagugg

SEQ ID NO: 3338133 - RNA, 18 nt, Human
agucugauucccaagcuc

SEQ ID NO: 3338134 - RNA, 16 nt, Human
agucugauucccaagc

SEQ ID NO: 3338135 - RNA, 14 nt, Human
agugaagacaauga

SEQ ID NO: 3338136 - RNA, 16 nt, Human
agugaagacaaugacu

SEQ ID NO: 3338137 - RNA, 20 nt, Human
aguccuggcaugggaaugaa

SEQ ID NO: 3338138 - RNA, 21 nt, Human
aguccuggcaugggaaugaau

SEQ ID NO: 3338139 - RNA, 22 nt, Human
aguccuggcaugggaaugaaug

SEQ ID NO: 3338140 - RNA, 12 nt, Human
agucugaaggcu

SEQ ID NO: 3338141 - RNA, 16 nt, Human
agucugaaggcugggu

SEQ ID NO: 3338142 - RNA, 13 nt, Human
agucugaaggcug

SEQ ID NO: 3338143 - RNA, 15 nt, Human
agucugaaggcuggg

SEQ ID NO: 3338144 - RNA, 11 nt, Human
aguaucuugaa

SEQ ID NO: 3338145 - RNA, 12 nt, Human
aguaucuugaag

SEQ ID NO: 3338146 - RNA, 15 nt, Human
aguaucuugaagacu

SEQ ID NO: 3338147 - RNA, 15 nt, Human
aguaucucagggccu

SEQ ID NO: 3338148 - RNA, 15 nt, Human
aguaugaggcauuug

SEQ ID NO: 3338149 - RNA, 16 nt, Human
aguaugaggcauuugu

SEQ ID NO: 3338150 - RNA, 14 nt, Human
agugggagcugccu

SEQ ID NO: 3338151 - RNA, 15 nt, Human
agugggagcugccug

SEQ ID NO: 3338152 - RNA, 17 nt, Human
aguguauuuuuuuacua

SEQ ID NO: 3338153 - RNA, 18 nt, Human
aguguauuuuuuuacuaa

SEQ ID NO: 3338154 - RNA, 23 nt, Human
aguggcuuaaaacaacacucaca

SEQ ID NO: 3338155 - RNA, 20 nt, Human
aguuguuugauucagacagc

SEQ ID NO: 3338156 - RNA, 14 nt, Human
aguugaagacagag

SEQ ID NO: 3338157 - RNA, 14 nt, Human
aguuacagacaaag

SEQ ID NO: 3338158 - RNA, 16 nt, Human
aguuacagacaaagcg

SEQ ID NO: 3338159 - RNA, 18 nt, Human
aguuacacuaaaagguga

SEQ ID NO: 3338160 - RNA, 12 nt, Human
aguuaaauaaau

SEQ ID NO: 3338161 - RNA, 22 nt, Human
aguucaucuugaauuguaagga

SEQ ID NO: 3338162 - RNA, 19 nt, Human
aguucagguaacaggcaga

SEQ ID NO: 3338163 - RNA, 18 nt, Human
aguucagguaacaggcag

SEQ ID NO: 3338164 - RNA, 20 nt, Human
aguucagguaacaggcagau

SEQ ID NO: 3338165 - RNA, 14 nt, Human
auaaagcagcguuu

SEQ ID NO: 3338166 - RNA, 18 nt, Human
auaaagcagcguuucuau

SEQ ID NO: 3338167 - RNA, 19 nt, Human
auaaagcagcguuucuaug

SEQ ID NO: 3338168 - RNA, 20 nt, Human
auaaagcagcguuucuauga

SEQ ID NO: 3338169 - RNA, 13 nt, Human
auaaagcagcguu

SEQ ID NO: 3338170 - RNA, 17 nt, Human
auaaaacuuuuuaaaau

SEQ ID NO: 3338171 - RNA, 21 nt, Human
auaaacuuuaccuuuuuuaua

SEQ ID NO: 3338172 - RNA, 16 nt, Human
auaaacuuuaccuuuu

SEQ ID NO: 3338173 - RNA, 24 nt, Human
auaaacuuuaccuuuuuuauacau

SEQ ID NO: 3338174 - RNA, 15 nt, Human
auaaaacuuuuuaaa

SEQ ID NO: 3338175 - RNA, 11 nt, Human
auaaaacuuuu

SEQ ID NO: 3338176 - RNA, 12 nt, Human
auacccaccccc

SEQ ID NO: 3338177 - RNA, 11 nt, Human
auacccacccc

SEQ ID NO: 3338178 - RNA, 18 nt, Human
auaccugucccccugaca

SEQ ID NO: 3338179 - RNA, 17 nt, Human
auaccugucccccugac

SEQ ID NO: 3338180 - RNA, 21 nt, Human
auaaugcgugcauaccacuuu

SEQ ID NO: 3338181 - RNA, 20 nt, Human
auaaugcgugcauaccacuu

SEQ ID NO: 3338182 - RNA, 14 nt, Human
auaauguaagcucu

SEQ ID NO: 3338183 - RNA, 19 nt, Human
auacaccacuacauucugu

SEQ ID NO: 3338184 - RNA, 20 nt, Human
auacaccacuacauucuguu

SEQ ID NO: 3338185 - RNA, 18 nt, Human
auacaccacuacauucug

SEQ ID NO: 3338186 - RNA, 15 nt, Human
auaauguaagcucua

SEQ ID NO: 3338187 - RNA, 19 nt, Human
auauuaccacagacauacu

SEQ ID NO: 3338188 - RNA, 22 nt, Human
auauuaccacagacauacuaac

SEQ ID NO: 3338189 - RNA, 21 nt, Human
auaugcuuauacacuuacacu

SEQ ID NO: 3338190 - RNA, 19 nt, Human
auauuuacuucuuauacau

SEQ ID NO: 3338191 - RNA, 16 nt, Human
auaguaugguggcugg

SEQ ID NO: 3338192 - RNA, 18 nt, Human
auaguaugguggcugggu

SEQ ID NO: 3338193 - RNA, 17 nt, Human
auaguaugguggcuggg

SEQ ID NO: 3338194 - RNA, 15 nt, Human
auagccaaggccaaa

SEQ ID NO: 3338195 - RNA, 21 nt, Human
auagccaaggccaaaggaagc

SEQ ID NO: 3338196 - RNA, 14 nt, Human
auauagaaauauau

SEQ ID NO: 3338197 - RNA, 16 nt, Human
cacccaagggccuggc

SEQ ID NO: 3338198 - RNA, 17 nt, Human
cacccaagggccuggcc

SEQ ID NO: 3338199 - RNA, 18 nt, Human
cacccaagggccuggccu

SEQ ID NO: 3338200 - RNA, 19 nt, Human
cacccaagggccuggccug

SEQ ID NO: 3338201 - RNA, 20 nt, Human
cacccaagggccuggccuga

SEQ ID NO: 3338202 - RNA, 21 nt, Human
cacccaagggccuggccugag

SEQ ID NO: 3338203 - RNA, 23 nt, Human
cacccaagggccuggccugagcu

SEQ ID NO: 3338204 - RNA, 22 nt, Human
cacccaccaucaugucuggcua

SEQ ID NO: 3338205 - RNA, 20 nt, Human
cacccaccaucaugucuggc

SEQ ID NO: 3338206 - RNA, 16 nt, Human
cacccaccucagccuc

SEQ ID NO: 3338207 - RNA, 14 nt, Human
cacccaccucagcc

SEQ ID NO: 3338208 - RNA, 13 nt, Human
cacccaccucagc

SEQ ID NO: 3338209 - RNA, 12 nt, Human
cacccaccucag

SEQ ID NO: 3338210 - RNA, 12 nt, Human
caccccagcccc

SEQ ID NO: 3338211 - RNA, 13 nt, Human
caccccagcccca

SEQ ID NO: 3338212 - RNA, 14 nt, Human
caccccggccaccu

SEQ ID NO: 3338213 - RNA, 15 nt, Human
caccccggccaccug

SEQ ID NO: 3338214 - RNA, 16 nt, Human
caccccggccaccugc

SEQ ID NO: 3338215 - RNA, 17 nt, Human
caccccggccaccugcg

SEQ ID NO: 3338216 - RNA, 22 nt, Human
cacccccacccaagggccuggc

SEQ ID NO: 3338217 - RNA, 15 nt, Human
caaagcuaggccugg

SEQ ID NO: 3338218 - RNA, 21 nt, Human
caaagccaaagcuaggccugg

SEQ ID NO: 3338219 - RNA, 20 nt, Human
caaagccaaagcuaggccug

SEQ ID NO: 3338220 - RNA, 17 nt, Human
caaagcuaggccuggcc

SEQ ID NO: 3338221 - RNA, 16 nt, Human
caaagcuaggccuggc

SEQ ID NO: 3338222 - RNA, 16 nt, Human
caaagcuuguuaagau

SEQ ID NO: 3338223 - RNA, 18 nt, Human
auuuuuuuacuaauagac

SEQ ID NO: 3338224 - RNA, 19 nt, Human
caaacuuuucaaggcuuau

SEQ ID NO: 3338225 - RNA, 17 nt, Human
caaacuuuucaaggcuu

SEQ ID NO: 3338226 - RNA, 21 nt, Human
caaacuuuucaaggcuuauau

SEQ ID NO: 3338227 - RNA, 20 nt, Human
caaacuuuucaaggcuuaua

SEQ ID NO: 3338228 - RNA, 21 nt, Human
caaaggaugcccaaagaugca

SEQ ID NO: 3338229 - RNA, 13 nt, Human
caaaucagcugcu

SEQ ID NO: 3338230 - RNA, 16 nt, Human
caaaucagcugcuacu

SEQ ID NO: 3338231 - RNA, 22 nt, Human
caaauucugcuugcuugcuuuu

SEQ ID NO: 3338232 - RNA, 17 nt, Human
caagugauucuccugcc

SEQ ID NO: 3338233 - RNA, 16 nt, Human
caagugauucuccugc

SEQ ID NO: 3338234 - RNA, 21 nt, Human
caagugauucuccugccucag

SEQ ID NO: 3338235 - RNA, 22 nt, Human
caagugauucuccugccucagc

SEQ ID NO: 3338236 - RNA, 22 nt, Human
caagugugguagagugugccug

SEQ ID NO: 3338237 - RNA, 23 nt, Human
caaggugggaggauugcuugagc

SEQ ID NO: 3338238 - RNA, 12 nt, Human
caaggugggagg

SEQ ID NO: 3338239 - RNA, 19 nt, Human
caagggccuggccugagcu

SEQ ID NO: 3338240 - RNA, 16 nt, Human
caagggccuggccuga

SEQ ID NO: 3338241 - RNA, 15 nt, Human
caaggauugcuacug

SEQ ID NO: 3338242 - RNA, 21 nt, Human
caaggaugaucuaggaagacu

SEQ ID NO: 3338243 - RNA, 22 nt, Human
caaggauccugagccagauuuc

SEQ ID NO: 3338244 - RNA, 17 nt, Human
caagcgugagccacugc

SEQ ID NO: 3338245 - RNA, 21 nt, Human
caagccaccaacauacuccca

SEQ ID NO: 3338246 - RNA, 16 nt, Human
caagcgugagccacug

SEQ ID NO: 3338247 - RNA, 18 nt, Human
caagcaccuccugccucg

SEQ ID NO: 3338248 - RNA, 17 nt, Human
caaccccuucgcuccug

SEQ ID NO: 3338249 - RNA, 12 nt, Human
caacccucauca

SEQ ID NO: 3338250 - RNA, 15 nt, Human
caacccucaucacca

SEQ ID NO: 3338251 - RNA, 19 nt, Human
caacucuccuccagaguca

SEQ ID NO: 3338252 - RNA, 20 nt, Human
caacucuccuccagagucag

SEQ ID NO: 3338253 - RNA, 16 nt, Human
caacugcauuggcuuu

SEQ ID NO: 3338254 - RNA, 19 nt, Human
caaccccuucgcuccugug

SEQ ID NO: 3338255 - RNA, 18 nt, Human
caaccccuucgcuccugu

SEQ ID NO: 3338256 - RNA, 21 nt, Human
caaccccuucgcuccuguguc

SEQ ID NO: 3338257 - RNA, 19 nt, Human
caacagguuuuccugaaga

SEQ ID NO: 3338258 - RNA, 18 nt, Human
caacaggguuuuuuucca

SEQ ID NO: 3338259 - RNA, 15 nt, Human
caacagguuuuccug

SEQ ID NO: 3338260 - RNA, 22 nt, Human
caacaucuuggucagauuugaa

SEQ ID NO: 3338261 - RNA, 24 nt, Human
caacaggcugggcuucaguggcag

SEQ ID NO: 3338262 - RNA, 23 nt, Human
caacaggcugggcuucaguggca

SEQ ID NO: 3338263 - RNA, 23 nt, Human
cacauguccaagaagcccaggaa

SEQ ID NO: 3338264 - RNA, 13 nt, Human
cacaugccucucu

SEQ ID NO: 3338265 - RNA, 17 nt, Human
cacaugccucucucagg

SEQ ID NO: 3338266 - RNA, 18 nt, Human
cacaugccucucucaggc

SEQ ID NO: 3338267 - RNA, 18 nt, Human
cacaucagcacgauuucu

SEQ ID NO: 3338268 - RNA, 20 nt, Human
cacauauugauuuccguuaa

SEQ ID NO: 3338269 - RNA, 12 nt, Human
cacauaucuguc

SEQ ID NO: 3338270 - RNA, 15 nt, Human
cacaugugcacaugc

SEQ ID NO: 3338271 - RNA, 14 nt, Human
cacaugugcacaug

SEQ ID NO: 3338272 - RNA, 17 nt, Human
cacaugugcacaugcac

SEQ ID NO: 3338273 - RNA, 16 nt, Human
cacauuccugaugcuu

SEQ ID NO: 3338274 - RNA, 15 nt, Human
caccacacccagccc

SEQ ID NO: 3338275 - RNA, 13 nt, Human
caccacacccagc

SEQ ID NO: 3338276 - RNA, 15 nt, Human
caccaagcccaguua

SEQ ID NO: 3338277 - RNA, 19 nt, Human
caccacuacauucuguuaa

SEQ ID NO: 3338278 - RNA, 20 nt, Human
caccacuacauucuguuaau

SEQ ID NO: 3338279 - RNA, 17 nt, Human
caccacuacauucuguu

SEQ ID NO: 3338280 - RNA, 18 nt, Human
caccacuacauucuguua

SEQ ID NO: 3338281 - RNA, 16 nt, Human
caccacuacauucugu

SEQ ID NO: 3338282 - RNA, 18 nt, Human
caccacaugugcacaugc

SEQ ID NO: 3338283 - RNA, 15 nt, Human
caccacaugugcaca

SEQ ID NO: 3338284 - RNA, 19 nt, Human
caccacaugugcacaugca

SEQ ID NO: 3338285 - RNA, 20 nt, Human
cacagaugggugcuuggagg

SEQ ID NO: 3338286 - RNA, 14 nt, Human
cacagaugggugcu

SEQ ID NO: 3338287 - RNA, 18 nt, Human
cacagaugggugcuugga

SEQ ID NO: 3338288 - RNA, 20 nt, Human
cacagaguuguuacauuuuu

SEQ ID NO: 3338289 - RNA, 10 nt, Human
cacaggcagg

SEQ ID NO: 3338290 - RNA, 19 nt, Human
cacaggcccggcuccaggc

SEQ ID NO: 3338291 - RNA, 18 nt, Human
cacaggcccggcuccagg

SEQ ID NO: 3338292 - RNA, 17 nt, Human
cacaggcccggcuccag

SEQ ID NO: 3338293 - RNA, 16 nt, Human
cacaggcccggcucca

SEQ ID NO: 3338294 - RNA, 16 nt, Human
cacaggaucagucuga

SEQ ID NO: 3338295 - RNA, 15 nt, Human
cacaggaucagucug

SEQ ID NO: 3338296 - RNA, 12 nt, Human
cacaggaucagu

SEQ ID NO: 3338297 - RNA, 23 nt, Human
cacaggcccggcuccaggcuccu

SEQ ID NO: 3338298 - RNA, 20 nt, Human
cacaggcccggcuccaggcu

SEQ ID NO: 3338299 - RNA, 18 nt, Human
cacagugagucgaggaca

SEQ ID NO: 3338300 - RNA, 20 nt, Human
cacagugagucgaggacagg

SEQ ID NO: 3338301 - RNA, 19 nt, Human
cacagugagucgaggacag

SEQ ID NO: 3338302 - RNA, 14 nt, Human
cacaggcccggcuc

SEQ ID NO: 3338303 - RNA, 17 nt, Human
cacauacacacacacgc

SEQ ID NO: 3338304 - RNA, 15 nt, Human
cacauacacgaaaga

SEQ ID NO: 3338305 - RNA, 20 nt, Human
cacauacacgaaagagagag

SEQ ID NO: 3338306 - RNA, 21 nt, Human
cacacuugacaucaacugcau

SEQ ID NO: 3338307 - RNA, 22 nt, Human
cacagacccugcccugugggcc

SEQ ID NO: 3338308 - RNA, 16 nt, Human
cacagaguuguuacau

SEQ ID NO: 3338309 - RNA, 17 nt, Human
cacagaguuguuacauu

SEQ ID NO: 3338310 - RNA, 21 nt, Human
cacagagaaaguacuucucca

SEQ ID NO: 3338311 - RNA, 13 nt, Human
cacaccagagccc

SEQ ID NO: 3338312 - RNA, 12 nt, Human
cacaccagagcc

SEQ ID NO: 3338313 - RNA, 15 nt, Human
cacaccagagcccac

SEQ ID NO: 3338314 - RNA, 19 nt, Human
cacacagaggcugccucuc

SEQ ID NO: 3338315 - RNA, 14 nt, Human
cacacaccagagcc

SEQ ID NO: 3338316 - RNA, 13 nt, Human
cacacacauacac

SEQ ID NO: 3338317 - RNA, 12 nt, Human
cacacacauaca

SEQ ID NO: 3338318 - RNA, 16 nt, Human
cacaaaaguuucucuu

SEQ ID NO: 3338319 - RNA, 20 nt, Human
caauaggaaaaacugauuuu

SEQ ID NO: 3338320 - RNA, 18 nt, Human
caauaggaaaaacugauu

SEQ ID NO: 3338321 - RNA, 21 nt, Human
caauaggaaaaacugauuuuu

SEQ ID NO: 3338322 - RNA, 19 nt, Human
caaugcaaaccaucauuga

SEQ ID NO: 3338323 - RNA, 22 nt, Human
caaugcacuuuguucuggcucu

SEQ ID NO: 3338324 - RNA, 23 nt, Human
caaugcacuuuguucuggcucuu

SEQ ID NO: 3338325 - RNA, 14 nt, Human
caaugcaaaccauc

SEQ ID NO: 3338326 - RNA, 17 nt, Human
caaugcaaaccaucauu

SEQ ID NO: 3338327 - RNA, 18 nt, Human
caaugcaaaccaucauug

SEQ ID NO: 3338328 - RNA, 19 nt, Human
uugccauguuggccaggcu

SEQ ID NO: 3338329 - RNA, 18 nt, Human
uugccauguuggccaggc

SEQ ID NO: 3338330 - RNA, 17 nt, Human
uugccauguuggccagg

SEQ ID NO: 3338331 - RNA, 16 nt, Human
uugccauguuggccag

SEQ ID NO: 3338332 - RNA, 23 nt, Human
uugcagacaggcaagcaccuccu

SEQ ID NO: 3338333 - RNA, 13 nt, Human
uugauucauaaug

SEQ ID NO: 3338334 - RNA, 17 nt, Human
uugauucauaaugacuu

SEQ ID NO: 3338335 - RNA, 22 nt, Human
uugcagacaggcaagcaccucc

SEQ ID NO: 3338336 - RNA, 15 nt, Human
uugagccuugaacuu

SEQ ID NO: 3338337 - RNA, 16 nt, Human
uugagccuugaacuuu

SEQ ID NO: 3338338 - RNA, 14 nt, Human
uugagccuugaacu

SEQ ID NO: 3338339 - RNA, 14 nt, Human
uugagccugggagg

SEQ ID NO: 3338340 - RNA, 19 nt, Human
uugagccuugaacuuugac

SEQ ID NO: 3338341 - RNA, 16 nt, Human
uugauucagcucugca

SEQ ID NO: 3338342 - RNA, 23 nt, Human
uugauucagacagcugccuggga

SEQ ID NO: 3338343 - RNA, 17 nt, Human
uugauucagacagcugc

SEQ ID NO: 3338344 - RNA, 21 nt, Human
uugauucagacagcugccugg

SEQ ID NO: 3338345 - RNA, 16 nt, Human
uugauaugcuuauaca

SEQ ID NO: 3338346 - RNA, 23 nt, Human
uugauauccucuuugagugaagc

SEQ ID NO: 3338347 - RNA, 20 nt, Human
uucuggcagaguugaagaca

SEQ ID NO: 3338348 - RNA, 13 nt, Human
uucuucagagacu

SEQ ID NO: 3338349 - RNA, 17 nt, Human
uucuuagggaaggauac

SEQ ID NO: 3338350 - RNA, 15 nt, Human
uugaacuuugaccuc

SEQ ID NO: 3338351 - RNA, 21 nt, Human
uucuuuccugaggcugggcuc

SEQ ID NO: 3338352 - RNA, 17 nt, Human
uugaacuuugaccucug

SEQ ID NO: 3338353 - RNA, 18 nt, Human
uugaacuuugaccucugc

SEQ ID NO: 3338354 - RNA, 13 nt, Human
uugaacuuugacc

SEQ ID NO: 3338355 - RNA, 12 nt, Human
uugaaugaugcc

SEQ ID NO: 3338356 - RNA, 16 nt, Human
uugaaugaugccauga

SEQ ID NO: 3338357 - RNA, 21 nt, Human
uugccauguuggccaggcugg

SEQ ID NO: 3338358 - RNA, 20 nt, Human
uugccauguuggccaggcug

SEQ ID NO: 3338359 - RNA, 18 nt, Human
uugcugucccuuuuccuu

SEQ ID NO: 3338360 - RNA, 16 nt, Human
uugcugucccuuuucc

SEQ ID NO: 3338361 - RNA, 14 nt, Human
uugcugcuugaggc

SEQ ID NO: 3338362 - RNA, 16 nt, Human
uugcugcuugaggcaa

SEQ ID NO: 3338363 - RNA, 19 nt, Human
uuggaagcuccgcuuucua

SEQ ID NO: 3338364 - RNA, 14 nt, Human
uuggauuguccccg

SEQ ID NO: 3338365 - RNA, 15 nt, Human
uuggauuguccccga

SEQ ID NO: 3338366 - RNA, 15 nt, Human
uuggacccugaggcc

SEQ ID NO: 3338367 - RNA, 18 nt, Human
uuggacccugaggcccag

SEQ ID NO: 3338368 - RNA, 19 nt, Human
uuggacccugaggcccaga

SEQ ID NO: 3338369 - RNA, 23 nt, Human
uuggcuucacggaagagccuugc

SEQ ID NO: 3338370 - RNA, 20 nt, Human
uuggucugacccacugcuuu

SEQ ID NO: 3338371 - RNA, 13 nt, Human
uugguccugcugc

SEQ ID NO: 3338372 - RNA, 22 nt, Human
uugucaaaguggugagaggcau

SEQ ID NO: 3338373 - RNA, 14 nt, Human
uugucuaugggacu

SEQ ID NO: 3338374 - RNA, 20 nt, Human
uuguauuuuacuaauaaaau

SEQ ID NO: 3338375 - RNA, 22 nt, Human
uugucuuaaaaaguggaaaaau

SEQ ID NO: 3338376 - RNA, 20 nt, Human
uugucuaugggacucaaugc

SEQ ID NO: 3338377 - RNA, 16 nt, Human
uuugcuugaaagaaaa

SEQ ID NO: 3338378 - RNA, 14 nt, Human
uuugcuugaaagaa

SEQ ID NO: 3338379 - RNA, 15 nt, Human
uuuggacccugaggc

SEQ ID NO: 3338380 - RNA, 19 nt, Human
uuuggacccugaggcccag

SEQ ID NO: 3338381 - RNA, 13 nt, Human
uuuggacccugag

SEQ ID NO: 3338382 - RNA, 19 nt, Human
uuucuuguguguuuauugu

SEQ ID NO: 3338383 - RNA, 16 nt, Human
uuugagaucagccugg

SEQ ID NO: 3338384 - RNA, 17 nt, Human
uuugagaucagccuggg

SEQ ID NO: 3338385 - RNA, 19 nt, Human
uuucuaaaucuccaaaaua

SEQ ID NO: 3338386 - RNA, 19 nt, Human
uuuccuggcacugcuucca

SEQ ID NO: 3338387 - RNA, 23 nt, Human
uuuccuggcacugcuuccaguga

SEQ ID NO: 3338388 - RNA, 14 nt, Human
uuucugaaauaaca

SEQ ID NO: 3338389 - RNA, 18 nt, Human
uuucuacccagcgagccc

SEQ ID NO: 3338390 - RNA, 15 nt, Human
uuucuacccagcgag

SEQ ID NO: 3338391 - RNA, 22 nt, Human
uuucuacccagcgagcccuggu

SEQ ID NO: 3338392 - RNA, 17 nt, Human
uuucagccaagaauucu

SEQ ID NO: 3338393 - RNA, 16 nt, Human
uuucagccaagaauuc

SEQ ID NO: 3338394 - RNA, 22 nt, Human
uuuagacccuauugcugcuuga

SEQ ID NO: 3338395 - RNA, 19 nt, Human
uuuagacccuauugcugcu

SEQ ID NO: 3338396 - RNA, 18 nt, Human
uuuauaaacuuuaccuuu

SEQ ID NO: 3338397 - RNA, 12 nt, Human
uuuauacauaaa

SEQ ID NO: 3338398 - RNA, 20 nt, Human
uuuauacauaaacaagacca

SEQ ID NO: 3338399 - RNA, 14 nt, Human
uuuaacagaaaugu

SEQ ID NO: 3338400 - RNA, 15 nt, Human
uuuaacagaaaugua

SEQ ID NO: 3338401 - RNA, 20 nt, Human
uuguuuggggaugagaaagg

SEQ ID NO: 3338402 - RNA, 15 nt, Human
uugucuuuggacccu

SEQ ID NO: 3338403 - RNA, 20 nt, Human
uugucuuuggacccugaggc

SEQ ID NO: 3338404 - RNA, 24 nt, Human
uugucuuuggacccugaggcccag

SEQ ID NO: 3338405 - RNA, 13 nt, Human
uuuaaaagauaca

SEQ ID NO: 3338406 - RNA, 13 nt, Human
uuuaacagaaaug

SEQ ID NO: 3338407 - RNA, 23 nt, Human
uuauuaaaaaucucaaauuucua

SEQ ID NO: 3338408 - RNA, 11 nt, Human
uuauucugcuc

SEQ ID NO: 3338409 - RNA, 15 nt, Human
uuauugcccacgcug

SEQ ID NO: 3338410 - RNA, 16 nt, Human
uuaucuagauacugua

SEQ ID NO: 3338411 - RNA, 14 nt, Human
uuaucuagauacug

SEQ ID NO: 3338412 - RNA, 16 nt, Human
uuaguuccucauuagc

SEQ ID NO: 3338413 - RNA, 14 nt, Human
uuaguuccuugagu

SEQ ID NO: 3338414 - RNA, 17 nt, Human
uuaucuagauacuguau

SEQ ID NO: 3338415 - RNA, 16 nt, Human
uuaugcaugaaguaau

SEQ ID NO: 3338416 - RNA, 22 nt, Human
uuaugcaugaaguaauaugcac

SEQ ID NO: 3338417 - RNA, 14 nt, Human
uuauggcacaucag

SEQ ID NO: 3338418 - RNA, 17 nt, Human
uuauuuuaauucaguug

SEQ ID NO: 3338419 - RNA, 17 nt, Human
uuauugucaaaguggug

SEQ ID NO: 3338420 - RNA, 18 nt, Human
uuauugucaaagugguga

SEQ ID NO: 3338421 - RNA, 15 nt, Human
uucacgugguccuaa

SEQ ID NO: 3338422 - RNA, 18 nt, Human
uucacggaagagccuugc

SEQ ID NO: 3338423 - RNA, 13 nt, Human
uucaauaggaaaa

SEQ ID NO: 3338424 - RNA, 15 nt, Human
uucaauaggaaaaac

SEQ ID NO: 3338425 - RNA, 18 nt, Human
uucaauaggaaaaacuga

SEQ ID NO: 3338426 - RNA, 22 nt, Human
uucagcuuguaaauagcucagg

SEQ ID NO: 3338427 - RNA, 13 nt, Human
uucacucuccuug

SEQ ID NO: 3338428 - RNA, 19 nt, Human
uucagagacuccugcaggc

SEQ ID NO: 3338429 - RNA, 21 nt, Human
uucagacagcugccugggauc

SEQ ID NO: 3338430 - RNA, 17 nt, Human
uuccccaggaggccagc

SEQ ID NO: 3338431 - RNA, 18 nt, Human
uuccccaggaggccagcc

SEQ ID NO: 3338432 - RNA, 19 nt, Human
uuccccaggaggccagccu

SEQ ID NO: 3338433 - RNA, 20 nt, Human
uuccccaggaggccagccuu

SEQ ID NO: 3338434 - RNA, 21 nt, Human
uuccccaggaggccagccuug

SEQ ID NO: 3338435 - RNA, 20 nt, Human
uucccucccuuccucuuucc

SEQ ID NO: 3338436 - RNA, 17 nt, Human
uucccucccuuccucuu

SEQ ID NO: 3338437 - RNA, 11 nt, Human
uucccucccuu

SEQ ID NO: 3338438 - RNA, 16 nt, Human
uucccauuugcuccuu

SEQ ID NO: 3338439 - RNA, 15 nt, Human
uuccccaggaggcca

SEQ ID NO: 3338440 - RNA, 16 nt, Human
uuccccaggaggccag

SEQ ID NO: 3338441 - RNA, 15 nt, Human
uuccaaauucugcuu

SEQ ID NO: 3338442 - RNA, 11 nt, Human
uucaggaagcu

SEQ ID NO: 3338443 - RNA, 13 nt, Human
uucaggaagcuca

SEQ ID NO: 3338444 - RNA, 17 nt, Human
uucaucuugaauuguaa

SEQ ID NO: 3338445 - RNA, 21 nt, Human
uucaucuugaauuguaaggaa

SEQ ID NO: 3338446 - RNA, 16 nt, Human
uucauuuccugugucu

SEQ ID NO: 3338447 - RNA, 15 nt, Human
uucauuuccuguguc

SEQ ID NO: 3338448 - RNA, 20 nt, Human
uucccuuugacgccauccca

SEQ ID NO: 3338449 - RNA, 21 nt, Human
uucccuuugacgccaucccag

SEQ ID NO: 3338450 - RNA, 22 nt, Human
uucccuuugacgccaucccagc

SEQ ID NO: 3338451 - RNA, 13 nt, Human
uuccucauuagca

SEQ ID NO: 3338452 - RNA, 18 nt, Human
uuccugaugcuucuucag

SEQ ID NO: 3338453 - RNA, 19 nt, Human
uuccugaugcuucuucaga

SEQ ID NO: 3338454 - RNA, 15 nt, Human
uuccugaugcuucuu

SEQ ID NO: 3338455 - RNA, 17 nt, Human
uuccugccaggcauggu

SEQ ID NO: 3338456 - RNA, 14 nt, Human
uuccuggcacugcu

SEQ ID NO: 3338457 - RNA, 13 nt, Human
uucuaaagcugcc

SEQ ID NO: 3338458 - RNA, 20 nt, Human
uucgggaggucgaggcagga

SEQ ID NO: 3338459 - RNA, 18 nt, Human
uguuuuaaggaugcuugu

SEQ ID NO: 3338460 - RNA, 22 nt, Human
uguuuuaagaggcagggucuca

SEQ ID NO: 3338461 - RNA, 14 nt, Human
uuaaaagauacagu

SEQ ID NO: 3338462 - RNA, 17 nt, Human
uuaaaagauacaguuac

SEQ ID NO: 3338463 - RNA, 21 nt, Human
uuaaaauaccagccaguaaau

SEQ ID NO: 3338464 - RNA, 20 nt, Human
uguuuuaagaggcagggucu

SEQ ID NO: 3338465 - RNA, 13 nt, Human
uguuugugauuga

SEQ ID NO: 3338466 - RNA, 23 nt, Human
uguuuccuggcacugcuuccagu

SEQ ID NO: 3338467 - RNA, 19 nt, Human
uguuuggggaugagaaagg

SEQ ID NO: 3338468 - RNA, 15 nt, Human
uguuucaaacuuuac

SEQ ID NO: 3338469 - RNA, 16 nt, Human
uguuuagauaauacac

SEQ ID NO: 3338470 - RNA, 20 nt, Human
uuacaagcgugagccacugc

SEQ ID NO: 3338471 - RNA, 21 nt, Human
uuacaagcgugagccacugca

SEQ ID NO: 3338472 - RNA, 17 nt, Human
uuaagcuguuacugucu

SEQ ID NO: 3338473 - RNA, 18 nt, Human
uuaauauugauaugcuua

SEQ ID NO: 3338474 - RNA, 17 nt, Human
uuaaccacuucagcuga

SEQ ID NO: 3338475 - RNA, 15 nt, Human
uuaacuuuuauaaac

SEQ ID NO: 3338476 - RNA, 16 nt, Human
uuaacuucacauauug

SEQ ID NO: 3338477 - RNA, 16 nt, Human
uuaacuuuuauaaacu

SEQ ID NO: 3338478 - RNA, 17 nt, Human
uuaacuuuuauaaacuu

SEQ ID NO: 3338479 - RNA, 14 nt, Human
uuaacuuuuauaaa

SEQ ID NO: 3338480 - RNA, 16 nt, Human
uuagacagucccugcc

SEQ ID NO: 3338481 - RNA, 17 nt, Human
uuagacagucccugcca

SEQ ID NO: 3338482 - RNA, 18 nt, Human
uuagacagucccugccaa

SEQ ID NO: 3338483 - RNA, 14 nt, Human
uuagacagucccug

SEQ ID NO: 3338484 - RNA, 15 nt, Human
uuagacagucccugc

SEQ ID NO: 3338485 - RNA, 14 nt, Human
uuacuuuguguuca

SEQ ID NO: 3338486 - RNA, 18 nt, Human
uuacuuuaaaaggagcca

SEQ ID NO: 3338487 - RNA, 17 nt, Human
uuacuuuaaaaggagcc

SEQ ID NO: 3338488 - RNA, 21 nt, Human
uuacuuaaaccgccaaggcug

SEQ ID NO: 3338489 - RNA, 23 nt, Human
uuacuucuuauacauuugauaaa

SEQ ID NO: 3338490 - RNA, 12 nt, Human
uuacuucugcua

SEQ ID NO: 3338491 - RNA, 11 nt, Human
uuacuucugcu

SEQ ID NO: 3338492 - RNA, 18 nt, Human
uuacuuagguguggggga

SEQ ID NO: 3338493 - RNA, 13 nt, Human
uuacuaaguuuuu

SEQ ID NO: 3338494 - RNA, 14 nt, Human
uuacuaaguuuuua

SEQ ID NO: 3338495 - RNA, 16 nt, Human
uuacuaauagacaauu

SEQ ID NO: 3338496 - RNA, 14 nt, Human
uuagaguugauacu

SEQ ID NO: 3338497 - RNA, 22 nt, Human
uuagauaauacaccacuacauu

SEQ ID NO: 3338498 - RNA, 14 nt, Human
uuagcggagacgga

SEQ ID NO: 3338499 - RNA, 18 nt, Human
uuaguaugaggcauuugu

SEQ ID NO: 3338500 - RNA, 16 nt, Human
uuaguaugaggcauuu

SEQ ID NO: 3338501 - RNA, 17 nt, Human
uuaguagagacaggguu

SEQ ID NO: 3338502 - RNA, 15 nt, Human
uauugcccacgcugg

SEQ ID NO: 3338503 - RNA, 14 nt, Human
uauugcccacgcug

SEQ ID NO: 3338504 - RNA, 13 nt, Human
uauugcccacgcu

SEQ ID NO: 3338505 - RNA, 23 nt, Human
uauugcugauggugcaaugaccu

SEQ ID NO: 3338506 - RNA, 22 nt, Human
uauugcugauggugcaaugacc

SEQ ID NO: 3338507 - RNA, 20 nt, Human
uauugauaugcuuauacacu

SEQ ID NO: 3338508 - RNA, 17 nt, Human
uauuuaugggauccugg

SEQ ID NO: 3338509 - RNA, 14 nt, Human
uauuaaggaagaca

SEQ ID NO: 3338510 - RNA, 12 nt, Human
uauuauaccuuu

SEQ ID NO: 3338511 - RNA, 13 nt, Human
uauuauaccuuuu

SEQ ID NO: 3338512 - RNA, 14 nt, Human
uauuauaccuuuuu

SEQ ID NO: 3338513 - RNA, 16 nt, Human
uauuaagaaagacuau

SEQ ID NO: 3338514 - RNA, 17 nt, Human
uauuaaaugcccagccc

SEQ ID NO: 3338515 - RNA, 19 nt, Human
uauuaaaugcccagccccu

SEQ ID NO: 3338516 - RNA, 15 nt, Human
uauuaaaugcccagc

SEQ ID NO: 3338517 - RNA, 21 nt, Human
uauguugcccaggcaggucuu

SEQ ID NO: 3338518 - RNA, 20 nt, Human
uauguugcccaggcaggucu

SEQ ID NO: 3338519 - RNA, 22 nt, Human
uauguucuuaguggauguucug

SEQ ID NO: 3338520 - RNA, 13 nt, Human
ucaaggauccuga

SEQ ID NO: 3338521 - RNA, 14 nt, Human
ucaaggauccugag

SEQ ID NO: 3338522 - RNA, 15 nt, Human
ucaaggauccugagc

SEQ ID NO: 3338523 - RNA, 16 nt, Human
ucaaggauccugagcc

SEQ ID NO: 3338524 - RNA, 19 nt, Human
ucaagcgauucuucugcuu

SEQ ID NO: 3338525 - RNA, 18 nt, Human
ucaagcgauucuucugcu

SEQ ID NO: 3338526 - RNA, 12 nt, Human
ucaagccaccaa

SEQ ID NO: 3338527 - RNA, 20 nt, Human
ucaagccaccaacauacucc

SEQ ID NO: 3338528 - RNA, 17 nt, Human
ucaagcgauucuucugc

SEQ ID NO: 3338529 - RNA, 19 nt, Human
ucaaccccuucgcuccugu

SEQ ID NO: 3338530 - RNA, 18 nt, Human
ucaaccccuucgcuccug

SEQ ID NO: 3338531 - RNA, 15 nt, Human
ucaaccuccugggcu

SEQ ID NO: 3338532 - RNA, 14 nt, Human
ucaaccuccugggc

SEQ ID NO: 3338533 - RNA, 16 nt, Human
ucaaccuccugggcua

SEQ ID NO: 3338534 - RNA, 20 nt, Human
ucaacucuccuccagaguca

SEQ ID NO: 3338535 - RNA, 12 nt, Human
ucaaagagguuu

SEQ ID NO: 3338536 - RNA, 12 nt, Human
ucacccuuuucu

SEQ ID NO: 3338537 - RNA, 14 nt, Human
ucaccgaaaacgug

SEQ ID NO: 3338538 - RNA, 19 nt, Human
ucacccgcuaagagggagg

SEQ ID NO: 3338539 - RNA, 15 nt, Human
ucaccgaaaacgugg

SEQ ID NO: 3338540 - RNA, 19 nt, Human
ucaccgaaaacguggcugc

SEQ ID NO: 3338541 - RNA, 20 nt, Human
ucaccgaaaacguggcugcu

SEQ ID NO: 3338542 - RNA, 21 nt, Human
ucaccgaaaacguggcugcuu

SEQ ID NO: 3338543 - RNA, 22 nt, Human
ucaccgaaaacguggcugcuuc

SEQ ID NO: 3338544 - RNA, 23 nt, Human
ucaccgaaaacguggcugcuuca

SEQ ID NO: 3338545 - RNA, 16 nt, Human
ucaccacaugugcaca

SEQ ID NO: 3338546 - RNA, 18 nt, Human
ucacccgcuaagagggag

SEQ ID NO: 3338547 - RNA, 17 nt, Human
ucaccaacgucugugcc

SEQ ID NO: 3338548 - RNA, 18 nt, Human
ucaccaacgucugugcca

SEQ ID NO: 3338549 - RNA, 21 nt, Human
ucaccaaaucagcugcuacua

SEQ ID NO: 3338550 - RNA, 14 nt, Human
ucacauuuauucug

SEQ ID NO: 3338551 - RNA, 22 nt, Human
ucacacaugagcaucaggccag

SEQ ID NO: 3338552 - RNA, 23 nt, Human
ucacacaugagcaucaggccagg

SEQ ID NO: 3338553 - RNA, 15 nt, Human
ucacacacuuuggcu

SEQ ID NO: 3338554 - RNA, 13 nt, Human
uauggaacacucu

SEQ ID NO: 3338555 - RNA, 16 nt, Human
uauggaacacucugag

SEQ ID NO: 3338556 - RNA, 17 nt, Human
uauggaacacucugaga

SEQ ID NO: 3338557 - RNA, 18 nt, Human
uauggaacacucugagac

SEQ ID NO: 3338558 - RNA, 19 nt, Human
uauggaacacucugagacu

SEQ ID NO: 3338559 - RNA, 17 nt, Human
uauggacaaugacccag

SEQ ID NO: 3338560 - RNA, 13 nt, Human
uaugcaugaagua

SEQ ID NO: 3338561 - RNA, 22 nt, Human
uaugcuuauacacuuacacuuu

SEQ ID NO: 3338562 - RNA, 13 nt, Human
uaugcacacauuu

SEQ ID NO: 3338563 - RNA, 14 nt, Human
uaugcacacauuuu

SEQ ID NO: 3338564 - RNA, 18 nt, Human
uaugcaaucaaaucugcu

SEQ ID NO: 3338565 - RNA, 16 nt, Human
uaugacuccagaauuu

SEQ ID NO: 3338566 - RNA, 17 nt, Human
uaugacuccagaauuuc

SEQ ID NO: 3338567 - RNA, 23 nt, Human
uaugacuccagaauuucccaaag

SEQ ID NO: 3338568 - RNA, 23 nt, Human
uaucugucauuugagcagggcuc

SEQ ID NO: 3338569 - RNA, 21 nt, Human
uaucugucauuugagcagggc

SEQ ID NO: 3338570 - RNA, 20 nt, Human
uaucugucauuugagcaggg

SEQ ID NO: 3338571 - RNA, 22 nt, Human
uaugacacaugcaaggucauuu

SEQ ID NO: 3338572 - RNA, 12 nt, Human
uaugacacaugc

SEQ ID NO: 3338573 - RNA, 21 nt, Human
uaucuaauauguaacaagcca

SEQ ID NO: 3338574 - RNA, 19 nt, Human
uauauguuuuaagaggcag

SEQ ID NO: 3338575 - RNA, 16 nt, Human
uaucuaaauguugaaa

SEQ ID NO: 3338576 - RNA, 18 nt, Human
uauaaacuuuaccuuuuu

SEQ ID NO: 3338577 - RNA, 21 nt, Human
uauaugcucugcauguuacau

SEQ ID NO: 3338578 - RNA, 20 nt, Human
uauaugcucugcauguuaca

SEQ ID NO: 3338579 - RNA, 17 nt, Human
uauacgaacaaaacaca

SEQ ID NO: 3338580 - RNA, 15 nt, Human
uauacgaacaaaaca

SEQ ID NO: 3338581 - RNA, 20 nt, Human
uagggaaaaaccagcgugug

SEQ ID NO: 3338582 - RNA, 21 nt, Human
uagggaaaaaccagcguguga

SEQ ID NO: 3338583 - RNA, 19 nt, Human
uagggaaaaaccagcgugu

SEQ ID NO: 3338584 - RNA, 11 nt, Human
uagggaaaaac

SEQ ID NO: 3338585 - RNA, 16 nt, Human
uaggugacagagugag

SEQ ID NO: 3338586 - RNA, 15 nt, Human
uaggccuggccagau

SEQ ID NO: 3338587 - RNA, 18 nt, Human
uaggccuggccagaugca

SEQ ID NO: 3338588 - RNA, 14 nt, Human
uaggccuggccaga

SEQ ID NO: 3338589 - RNA, 23 nt, Human
uaggugacagagugagacucugu

SEQ ID NO: 3338590 - RNA, 14 nt, Human
uccgccucuugggu

SEQ ID NO: 3338591 - RNA, 21 nt, Human
uccuaagcuauucaguaauaa

SEQ ID NO: 3338592 - RNA, 20 nt, Human
uccuaagcuauucaguaaua

SEQ ID NO: 3338593 - RNA, 18 nt, Human
uccuaagcuauucaguaa

SEQ ID NO: 3338594 - RNA, 18 nt, Human
uccgcuuucuacccagcg

SEQ ID NO: 3338595 - RNA, 16 nt, Human
uccgcuuucuacccag

SEQ ID NO: 3338596 - RNA, 15 nt, Human
ucccccuuccaugga

SEQ ID NO: 3338597 - RNA, 16 nt, Human
ucccuuccucuuucca

SEQ ID NO: 3338598 - RNA, 15 nt, Human
ucccuuccucuuucc

SEQ ID NO: 3338599 - RNA, 18 nt, Human
uccucauuagcauuuugc

SEQ ID NO: 3338600 - RNA, 17 nt, Human
uccucauuagcauuuug

SEQ ID NO: 3338601 - RNA, 12 nt, Human
uccucccaccuc

SEQ ID NO: 3338602 - RNA, 21 nt, Human
uccuauauuguuuucagugua

SEQ ID NO: 3338603 - RNA, 23 nt, Human
uccuauauuguuuucaguguaca

SEQ ID NO: 3338604 - RNA, 14 nt, Human
uccuggaguucugg

SEQ ID NO: 3338605 - RNA, 17 nt, Human
uccugcccuuaccugcc

SEQ ID NO: 3338606 - RNA, 20 nt, Human
uccugcccuuaccugccagg

SEQ ID NO: 3338607 - RNA, 12 nt, Human
uccuggccucaa

SEQ ID NO: 3338608 - RNA, 13 nt, Human
uccuggcacugcu

SEQ ID NO: 3338609 - RNA, 16 nt, Human
uccuggcacugcuucc

SEQ ID NO: 3338610 - RNA, 22 nt, Human
uccuggcacccggccccugcug

SEQ ID NO: 3338611 - RNA, 23 nt, Human
uccuggcacccggccccugcugg

SEQ ID NO: 3338612 - RNA, 22 nt, Human
uccuguaccucuugagccuuga

SEQ ID NO: 3338613 - RNA, 13 nt, Human
uccuguagcccua

SEQ ID NO: 3338614 - RNA, 11 nt, Human
uccuguagccc

SEQ ID NO: 3338615 - RNA, 21 nt, Human
uccugagccagauuucacucu

SEQ ID NO: 3338616 - RNA, 13 nt, Human
uccugccaggcau

SEQ ID NO: 3338617 - RNA, 14 nt, Human
uccugccaggcaug

SEQ ID NO: 3338618 - RNA, 18 nt, Human
ucuaaaggcuaccuuugu

SEQ ID NO: 3338619 - RNA, 17 nt, Human
ucuaaaggcuaccuuug

SEQ ID NO: 3338620 - RNA, 19 nt, Human
ucuaaaggcuaccuuugua

SEQ ID NO: 3338621 - RNA, 20 nt, Human
ucuaaaggcuaccuuuguau

SEQ ID NO: 3338622 - RNA, 13 nt, Human
ucgugacaacacu

SEQ ID NO: 3338623 - RNA, 14 nt, Human
ucuaccuuccugca

SEQ ID NO: 3338624 - RNA, 15 nt, Human
ucuacagaggccaug

SEQ ID NO: 3338625 - RNA, 21 nt, Human
ucuacacugugcugagucuga

SEQ ID NO: 3338626 - RNA, 22 nt, Human
ucuaucaaguauuauaccuuuu

SEQ ID NO: 3338627 - RNA, 12 nt, Human
ucuaggaagacu

SEQ ID NO: 3338628 - RNA, 19 nt, Human
ucuaggaagacuuuggaaa

SEQ ID NO: 3338629 - RNA, 15 nt, Human
ucuaggaagacuuug

SEQ ID NO: 3338630 - RNA, 16 nt, Human
ucuaggaagacuuugg

SEQ ID NO: 3338631 - RNA, 17 nt, Human
ucuaugacacaugcaag

SEQ ID NO: 3338632 - RNA, 14 nt, Human
ucuaugacacaugc

SEQ ID NO: 3338633 - RNA, 22 nt, Human
ucuccagccccuggaugcagcc

SEQ ID NO: 3338634 - RNA, 16 nt, Human
ucuccagccccuggau

SEQ ID NO: 3338635 - RNA, 18 nt, Human
ucuccagccccuggaugc

SEQ ID NO: 3338636 - RNA, 12 nt, Human
ucuccagccccu

SEQ ID NO: 3338637 - RNA, 13 nt, Human
ucuccagccccug

SEQ ID NO: 3338638 - RNA, 14 nt, Human
ucuccagccccugg

SEQ ID NO: 3338639 - RNA, 15 nt, Human
ucuccagccccugga

SEQ ID NO: 3338640 - RNA, 23 nt, Human
ucucccucagucuggcccuuccu

SEQ ID NO: 3338641 - RNA, 18 nt, Human
ucucccucagucuggccc

SEQ ID NO: 3338642 - RNA, 12 nt, Human
ucucccccagcc

SEQ ID NO: 3338643 - RNA, 14 nt, Human
ucuccaccugccag

SEQ ID NO: 3338644 - RNA, 15 nt, Human
ucuccaccugccagg

SEQ ID NO: 3338645 - RNA, 16 nt, Human
ucuccaccugccaggg

SEQ ID NO: 3338646 - RNA, 17 nt, Human
ucuccaccugccaggga

SEQ ID NO: 3338647 - RNA, 19 nt, Human
ucuccaccugccagggaca

SEQ ID NO: 3338648 - RNA, 22 nt, Human
ucuccaccugccagggacagag

SEQ ID NO: 3338649 - RNA, 16 nt, Human
ucuccacccugcucuc

SEQ ID NO: 3338650 - RNA, 14 nt, Human
ucuccacccugcuc

SEQ ID NO: 3338651 - RNA, 17 nt, Human
ucuccacccugcucucc

SEQ ID NO: 3338652 - RNA, 12 nt, Human
ucuccacccugc

SEQ ID NO: 3338653 - RNA, 13 nt, Human
ucuccacccugcu

SEQ ID NO: 3338654 - RNA, 18 nt, Human
ucucauacucaccucacc

SEQ ID NO: 3338655 - RNA, 16 nt, Human
ucucauacucaccuca

SEQ ID NO: 3338656 - RNA, 13 nt, Human
ucuaugggacuca

SEQ ID NO: 3338657 - RNA, 12 nt, Human
ucuaugggacuc

SEQ ID NO: 3338658 - RNA, 19 nt, Human
ucuaugggacucaaugcac

SEQ ID NO: 3338659 - RNA, 13 nt, Human
uccaaaguacacu

SEQ ID NO: 3338660 - RNA, 19 nt, Human
ucaucuugaauuguaagga

SEQ ID NO: 3338661 - RNA, 17 nt, Human
ucauccacugugccaug

SEQ ID NO: 3338662 - RNA, 14 nt, Human
ucauccacugugcc

SEQ ID NO: 3338663 - RNA, 14 nt, Human
ucaucauccuaagc

SEQ ID NO: 3338664 - RNA, 11 nt, Human
ucaguguacau

SEQ ID NO: 3338665 - RNA, 20 nt, Human
ucaguguacauggaauaaca

SEQ ID NO: 3338666 - RNA, 21 nt, Human
ucaggccugggggcugggcag

SEQ ID NO: 3338667 - RNA, 23 nt, Human
ucaggaagcucagggccuggcuc

SEQ ID NO: 3338668 - RNA, 23 nt, Human
ucagcucugcaagaauugaagca

SEQ ID NO: 3338669 - RNA, 22 nt, Human
ucagcuccagcucaccagcccc

SEQ ID NO: 3338670 - RNA, 24 nt, Human
ucagcuccagcucaccagccccag

SEQ ID NO: 3338671 - RNA, 23 nt, Human
ucagcuccagcucaccagcccca

SEQ ID NO: 3338672 - RNA, 19 nt, Human
ucagguggggcagcuugag

SEQ ID NO: 3338673 - RNA, 18 nt, Human
ucagguggggcagcuuga

SEQ ID NO: 3338674 - RNA, 17 nt, Human
ucagguggggcagcuug

SEQ ID NO: 3338675 - RNA, 23 nt, Human
ucaggugauccacccaccucagc

SEQ ID NO: 3338676 - RNA, 23 nt, Human
ucaggugagaagcagaggaagga

SEQ ID NO: 3338677 - RNA, 16 nt, Human
ucaggugauccaccca

SEQ ID NO: 3338678 - RNA, 20 nt, Human
ucagguggggcagcuugagg

SEQ ID NO: 3338679 - RNA, 22 nt, Human
ucagucugauucccaagcucug

SEQ ID NO: 3338680 - RNA, 21 nt, Human
ucagucugauucccaagcucu

SEQ ID NO: 3338681 - RNA, 19 nt, Human
ucagucugauucccaagcu

SEQ ID NO: 3338682 - RNA, 13 nt, Human
ucccaccuuggcu

SEQ ID NO: 3338683 - RNA, 20 nt, Human
ucccaccucucucacuccuu

SEQ ID NO: 3338684 - RNA, 20 nt, Human
ucccagcugugcucuggaca

SEQ ID NO: 3338685 - RNA, 17 nt, Human
ucccaccuuggcugcag

SEQ ID NO: 3338686 - RNA, 16 nt, Human
ucccaccuuggcugca

SEQ ID NO: 3338687 - RNA, 20 nt, Human
uccaugugggcuaguugggc

SEQ ID NO: 3338688 - RNA, 22 nt, Human
ucccaccucucucacuccuuga

SEQ ID NO: 3338689 - RNA, 19 nt, Human
ucccaugagccucagcauc

SEQ ID NO: 3338690 - RNA, 18 nt, Human
ucccaugagccucagcau

SEQ ID NO: 3338691 - RNA, 21 nt, Human
ucccaucugugaaaggaaaga

SEQ ID NO: 3338692 - RNA, 15 nt, Human
ucccaucuuccaagg

SEQ ID NO: 3338693 - RNA, 22 nt, Human
ucccagcugugcucuggacagg

SEQ ID NO: 3338694 - RNA, 21 nt, Human
ucccagcugugcucuggacag

SEQ ID NO: 3338695 - RNA, 23 nt, Human
ucccagcugugcucuggacaggc

SEQ ID NO: 3338696 - RNA, 23 nt, Human
ucccaggcauuccccaggaggcc

SEQ ID NO: 3338697 - RNA, 24 nt, Human
ucccaggcauuccccaggaggcca

SEQ ID NO: 3338698 - RNA, 17 nt, Human
ucccaugagccucagca

SEQ ID NO: 3338699 - RNA, 20 nt, Human
ucccaugagccucagcaucc

SEQ ID NO: 3338700 - RNA, 18 nt, Human
uccccagauugcaacagg

SEQ ID NO: 3338701 - RNA, 13 nt, Human
uccccagauugca

SEQ ID NO: 3338702 - RNA, 22 nt, Human
uccccagcaagugagagcuggg

SEQ ID NO: 3338703 - RNA, 21 nt, Human
uccccagcaagugagagcugg

SEQ ID NO: 3338704 - RNA, 20 nt, Human
uccccagcaagugagagcug

SEQ ID NO: 3338705 - RNA, 23 nt, Human
uccccagauugcaacaggcuggg

SEQ ID NO: 3338706 - RNA, 22 nt, Human
uccccagauugcaacaggcugg

SEQ ID NO: 3338707 - RNA, 20 nt, Human
uccccagauugcaacaggcu

SEQ ID NO: 3338708 - RNA, 19 nt, Human
uccccagauugcaacaggc

SEQ ID NO: 3338709 - RNA, 13 nt, Human
uccccaggaggcc

SEQ ID NO: 3338710 - RNA, 17 nt, Human
ucccccagccccauccu

SEQ ID NO: 3338711 - RNA, 15 nt, Human
uccccaggaggccag

SEQ ID NO: 3338712 - RNA, 16 nt, Human
uccccaggaggccagc

SEQ ID NO: 3338713 - RNA, 20 nt, Human
ucccccagccccauccucug

SEQ ID NO: 3338714 - RNA, 21 nt, Human
ucccccagccccauccucugu

SEQ ID NO: 3338715 - RNA, 14 nt, Human
uccccaggaggcca

SEQ ID NO: 3338716 - RNA, 20 nt, Human
uccagguuuaagcuguuacu

SEQ ID NO: 3338717 - RNA, 18 nt, Human
uccagguuuaagcuguua

SEQ ID NO: 3338718 - RNA, 14 nt, Human
uccauagagagcaa

SEQ ID NO: 3338719 - RNA, 12 nt, Human
uccaggagcagc

SEQ ID NO: 3338720 - RNA, 13 nt, Human
uccaggagcagcc

SEQ ID NO: 3338721 - RNA, 14 nt, Human
uccaggagcagcca

SEQ ID NO: 3338722 - RNA, 15 nt, Human
uccaggagcagccac

SEQ ID NO: 3338723 - RNA, 19 nt, Human
uccaggggugggacacccu

SEQ ID NO: 3338724 - RNA, 20 nt, Human
uccaggggugggacacccug

SEQ ID NO: 3338725 - RNA, 20 nt, Human
uccacuuucuagccagagga

SEQ ID NO: 3338726 - RNA, 21 nt, Human
uccacuuucuagccagaggag

SEQ ID NO: 3338727 - RNA, 19 nt, Human
uccacuuucuagccagagg

SEQ ID NO: 3338728 - RNA, 14 nt, Human
uccaaaguacacug

SEQ ID NO: 3338729 - RNA, 16 nt, Human
uccaaaguacacuguu

SEQ ID NO: 3338730 - RNA, 17 nt, Human
ugagccucagcauccug

SEQ ID NO: 3338731 - RNA, 21 nt, Human
ugagccgagaucacgccacug

SEQ ID NO: 3338732 - RNA, 19 nt, Human
ugagccgagaucacgccac

SEQ ID NO: 3338733 - RNA, 21 nt, Human
ugagccucagcauccuggcac

SEQ ID NO: 3338734 - RNA, 18 nt, Human
ugagccucagcauccugg

SEQ ID NO: 3338735 - RNA, 22 nt, Human
ugagccucagcauccuggcacc

SEQ ID NO: 3338736 - RNA, 15 nt, Human
ugagccucagcaucc

SEQ ID NO: 3338737 - RNA, 16 nt, Human
ugagcaucaggccagg

SEQ ID NO: 3338738 - RNA, 17 nt, Human
ugagcagggcucagcgg

SEQ ID NO: 3338739 - RNA, 16 nt, Human
ugagcagggcucagcg

SEQ ID NO: 3338740 - RNA, 19 nt, Human
ugagcagggcucagcgggg

SEQ ID NO: 3338741 - RNA, 18 nt, Human
ugagcaucaggccaggcc

SEQ ID NO: 3338742 - RNA, 19 nt, Human
ugagcaucaggccaggccc

SEQ ID NO: 3338743 - RNA, 20 nt, Human
ugagcaucaggccaggcccu

SEQ ID NO: 3338744 - RNA, 20 nt, Human
ugaccucaggugauccaccc

SEQ ID NO: 3338745 - RNA, 19 nt, Human
ugagacucgcgacaaugca

SEQ ID NO: 3338746 - RNA, 15 nt, Human
ugagaucaaaacggu

SEQ ID NO: 3338747 - RNA, 14 nt, Human
ugagaucagccugg

SEQ ID NO: 3338748 - RNA, 15 nt, Human
ugagcagggcucagc

SEQ ID NO: 3338749 - RNA, 14 nt, Human
ugagcagggcucag

SEQ ID NO: 3338750 - RNA, 13 nt, Human
ugagcagggcuca

SEQ ID NO: 3338751 - RNA, 12 nt, Human
ugagcagggcuc

SEQ ID NO: 3338752 - RNA, 20 nt, Human
ugagacucgcgacaaugcaa

SEQ ID NO: 3338753 - RNA, 21 nt, Human
ugagacucgcgacaaugcaaa

SEQ ID NO: 3338754 - RNA, 22 nt, Human
ugagacucgcgacaaugcaaac

SEQ ID NO: 3338755 - RNA, 13 nt, Human
ugagucugaaggc

SEQ ID NO: 3338756 - RNA, 15 nt, Human
ugagucugaaggcug

SEQ ID NO: 3338757 - RNA, 17 nt, Human
ugagucugaaggcuggg

SEQ ID NO: 3338758 - RNA, 18 nt, Human
ugagucugaaggcugggu

SEQ ID NO: 3338759 - RNA, 19 nt, Human
ugagucgaggacagggagg

SEQ ID NO: 3338760 - RNA, 18 nt, Human
ugagucgaggacagggag

SEQ ID NO: 3338761 - RNA, 13 nt, Human
ugaguccagaagu

SEQ ID NO: 3338762 - RNA, 19 nt, Human
ugaguccagaaguuugaga

SEQ ID NO: 3338763 - RNA, 16 nt, Human
ugaguugauagcacag

SEQ ID NO: 3338764 - RNA, 20 nt, Human
ugaguugauagcacagaccc

SEQ ID NO: 3338765 - RNA, 23 nt, Human
ugaggcuagugugguguuuccug

SEQ ID NO: 3338766 - RNA, 21 nt, Human
ugaggcauuuguuugaacuga

SEQ ID NO: 3338767 - RNA, 17 nt, Human
ugaggcuaguguggugu

SEQ ID NO: 3338768 - RNA, 19 nt, Human
ugaggcauuuguuugaacu

SEQ ID NO: 3338769 - RNA, 20 nt, Human
ugaggcauuuguuugaacug

SEQ ID NO: 3338770 - RNA, 12 nt, Human
ugaggcauuugu

SEQ ID NO: 3338771 - RNA, 13 nt, Human
ugagcugggauga

SEQ ID NO: 3338772 - RNA, 12 nt, Human
ugaggugggagg

SEQ ID NO: 3338773 - RNA, 13 nt, Human
ugaggugggagga

SEQ ID NO: 3338774 - RNA, 17 nt, Human
ugagggaacagagaggu

SEQ ID NO: 3338775 - RNA, 13 nt, Human
ugaggcucugccc

SEQ ID NO: 3338776 - RNA, 14 nt, Human
ugaggcucugcccu

SEQ ID NO: 3338777 - RNA, 16 nt, Human
ugauccacccaccuca

SEQ ID NO: 3338778 - RNA, 15 nt, Human
ugauccaagcugguc

SEQ ID NO: 3338779 - RNA, 14 nt, Human
ugauccaagcuggu

SEQ ID NO: 3338780 - RNA, 13 nt, Human
ugauccaagcugg

SEQ ID NO: 3338781 - RNA, 13 nt, Human
ugauagcacagac

SEQ ID NO: 3338782 - RNA, 18 nt, Human
ugauccacccaccucagc

SEQ ID NO: 3338783 - RNA, 17 nt, Human
ugauccacccaccucag

SEQ ID NO: 3338784 - RNA, 20 nt, Human
ugaucuucuuuauaauucua

SEQ ID NO: 3338785 - RNA, 16 nt, Human
ugaucuuugcagacag

SEQ ID NO: 3338786 - RNA, 16 nt, Human
ugaugcuucuucagag

SEQ ID NO: 3338787 - RNA, 17 nt, Human
ugaugcuucuucagaga

SEQ ID NO: 3338788 - RNA, 16 nt, Human
ugauguguuaucucuu

SEQ ID NO: 3338789 - RNA, 18 nt, Human
ugauucagacagcugccu

SEQ ID NO: 3338790 - RNA, 19 nt, Human
ugauucagacagcugccug

SEQ ID NO: 3338791 - RNA, 20 nt, Human
ugauucagacagcugccugg

SEQ ID NO: 3338792 - RNA, 21 nt, Human
ugauucagacagcugccuggg

SEQ ID NO: 3338793 - RNA, 23 nt, Human
ugauucagacagcugccugggau

SEQ ID NO: 3338794 - RNA, 21 nt, Human
ugauucuccugccucagccuc

SEQ ID NO: 3338795 - RNA, 20 nt, Human
ugauucuccugccucagccu

SEQ ID NO: 3338796 - RNA, 16 nt, Human
ugauugugucucuugg

SEQ ID NO: 3338797 - RNA, 13 nt, Human
ugauuggaggggg

SEQ ID NO: 3338798 - RNA, 21 nt, Human
ugauuggaggggggagguggg

SEQ ID NO: 3338799 - RNA, 13 nt, Human
ugauucagacagc

SEQ ID NO: 3338800 - RNA, 14 nt, Human
ugauucagacagcu

SEQ ID NO: 3338801 - RNA, 15 nt, Human
ugauucagacagcug

SEQ ID NO: 3338802 - RNA, 16 nt, Human
ugauucagacagcugc

SEQ ID NO: 3338803 - RNA, 20 nt, Human
ugauucaacagguuuuccug

SEQ ID NO: 3338804 - RNA, 20 nt, Human
ugauguucuuucacccuuuu

SEQ ID NO: 3338805 - RNA, 17 nt, Human
ugacagaggcagcccca

SEQ ID NO: 3338806 - RNA, 16 nt, Human
ugacagaggcagcccc

SEQ ID NO: 3338807 - RNA, 15 nt, Human
ugacagaggcagccc

SEQ ID NO: 3338808 - RNA, 14 nt, Human
ugacagaggcagcc

SEQ ID NO: 3338809 - RNA, 23 nt, Human
ugacagacacaggcccggcucca

SEQ ID NO: 3338810 - RNA, 20 nt, Human
ugacagacacaggcccggcu

SEQ ID NO: 3338811 - RNA, 13 nt, Human
ugacagaggcagc

SEQ ID NO: 3338812 - RNA, 17 nt, Human
ugacagagugagacucu

SEQ ID NO: 3338813 - RNA, 14 nt, Human
ugacagagugagac

SEQ ID NO: 3338814 - RNA, 23 nt, Human
ugacagaggcagccccauucugc

SEQ ID NO: 3338815 - RNA, 18 nt, Human
ugacagaggcagccccau

SEQ ID NO: 3338816 - RNA, 19 nt, Human
ugacagagugagacucugu

SEQ ID NO: 3338817 - RNA, 14 nt, Human
ugaccauucuccac

SEQ ID NO: 3338818 - RNA, 13 nt, Human
ugaccgugaggcc

SEQ ID NO: 3338819 - RNA, 14 nt, Human
ugaccgugaggcca

SEQ ID NO: 3338820 - RNA, 16 nt, Human
ugaccgugaggccaga

SEQ ID NO: 3338821 - RNA, 20 nt, Human
ugaccgugaggccagagaca

SEQ ID NO: 3338822 - RNA, 17 nt, Human
ugaccauucuccaccug

SEQ ID NO: 3338823 - RNA, 18 nt, Human
ugaccauucuccaccugc

SEQ ID NO: 3338824 - RNA, 16 nt, Human
ugaccauucuccaccu

SEQ ID NO: 3338825 - RNA, 13 nt, Human
ugacaugucuuuu

SEQ ID NO: 3338826 - RNA, 15 nt, Human
ugacaugucuuuucu

SEQ ID NO: 3338827 - RNA, 19 nt, Human
ugaccagcaccaucucucc

SEQ ID NO: 3338828 - RNA, 20 nt, Human
ugaaggacauugcggacagc

SEQ ID NO: 3338829 - RNA, 19 nt, Human
ugaaggacauugcggacag

SEQ ID NO: 3338830 - RNA, 22 nt, Human
ugaaggacauugcggacagcca

SEQ ID NO: 3338831 - RNA, 15 nt, Human
ugaaggccccgccca

SEQ ID NO: 3338832 - RNA, 16 nt, Human
ugaaggccccgcccag

SEQ ID NO: 3338833 - RNA, 17 nt, Human
ugaacuccuggccucaa

SEQ ID NO: 3338834 - RNA, 13 nt, Human
ucuuuccaaagua

SEQ ID NO: 3338835 - RNA, 14 nt, Human
ucuuuccaaaguac

SEQ ID NO: 3338836 - RNA, 16 nt, Human
ucuuucagccaagaau

SEQ ID NO: 3338837 - RNA, 19 nt, Human
ucuuucagccaagaauucu

SEQ ID NO: 3338838 - RNA, 20 nt, Human
ucuuucagccaagaauucuu

SEQ ID NO: 3338839 - RNA, 21 nt, Human
ucuuucagccaagaauucuua

SEQ ID NO: 3338840 - RNA, 17 nt, Human
ucuuuggacacucacac

SEQ ID NO: 3338841 - RNA, 23 nt, Human
ucuuugagugaagcugggagaac

SEQ ID NO: 3338842 - RNA, 16 nt, Human
ucucccuucauccuuc

SEQ ID NO: 3338843 - RNA, 20 nt, Human
ucuccucugcugcuggcugg

SEQ ID NO: 3338844 - RNA, 23 nt, Human
ucuugcaauggcagccuuggcaa

SEQ ID NO: 3338845 - RNA, 16 nt, Human
ucuuguguguuuauug

SEQ ID NO: 3338846 - RNA, 21 nt, Human
ucuuguguguuuauugucaaa

SEQ ID NO: 3338847 - RNA, 23 nt, Human
ucuuucacccuuuucuguuugcu

SEQ ID NO: 3338848 - RNA, 16 nt, Human
ugaacuccuggccuca

SEQ ID NO: 3338849 - RNA, 20 nt, Human
ugaaccaccacacccagccc

SEQ ID NO: 3338850 - RNA, 17 nt, Human
ugaaccaccacacccag

SEQ ID NO: 3338851 - RNA, 23 nt, Human
ugaaccacaucuugcucugcuga

SEQ ID NO: 3338852 - RNA, 22 nt, Human
ugaaccaagaacuuuccaggaa

SEQ ID NO: 3338853 - RNA, 22 nt, Human
ugaaccacaucuugcucugcug

SEQ ID NO: 3338854 - RNA, 19 nt, Human
ugaaaauuuugauguuuua

SEQ ID NO: 3338855 - RNA, 21 nt, Human
ugaaaauuuugauguuuuaag

SEQ ID NO: 3338856 - RNA, 12 nt, Human
ugaaaauuuuga

SEQ ID NO: 3338857 - RNA, 13 nt, Human
ugaaaauuuugau

SEQ ID NO: 3338858 - RNA, 14 nt, Human
ugaaacauuuuguc

SEQ ID NO: 3338859 - RNA, 23 nt, Human
ugaaagggaguauuacaaaaaca

SEQ ID NO: 3338860 - RNA, 13 nt, Human
ugaaagggcccag

SEQ ID NO: 3338861 - RNA, 18 nt, Human
ugaaagggcccagagagg

SEQ ID NO: 3338862 - RNA, 18 nt, Human
ugaaagcccugagcuuuc

SEQ ID NO: 3338863 - RNA, 14 nt, Human
ugggccuggcuccc

SEQ ID NO: 3338864 - RNA, 23 nt, Human
ugggcagagcagagaccaucccu

SEQ ID NO: 3338865 - RNA, 22 nt, Human
ugggcagagcagagaccauccc

SEQ ID NO: 3338866 - RNA, 18 nt, Human
ugggcagagcagagacca

SEQ ID NO: 3338867 - RNA, 22 nt, Human
ugggauuacaagcgugagccac

SEQ ID NO: 3338868 - RNA, 12 nt, Human
ugggauccucca

SEQ ID NO: 3338869 - RNA, 13 nt, Human
ugggauccuccag

SEQ ID NO: 3338870 - RNA, 17 nt, Human
uggcugggggccucagu

SEQ ID NO: 3338871 - RNA, 16 nt, Human
uggcugggggccucag

SEQ ID NO: 3338872 - RNA, 14 nt, Human
ugggagugggccca

SEQ ID NO: 3338873 - RNA, 16 nt, Human
ugggagugggcccaau

SEQ ID NO: 3338874 - RNA, 20 nt, Human
uggggccaguuggucccccu

SEQ ID NO: 3338875 - RNA, 23 nt, Human
uggggaugagaaagguugaagca

SEQ ID NO: 3338876 - RNA, 15 nt, Human
uggggaugagaaagg

SEQ ID NO: 3338877 - RNA, 22 nt, Human
ugggcuucauccuccucagauc

SEQ ID NO: 3338878 - RNA, 18 nt, Human
uggguacuuguggacaca

SEQ ID NO: 3338879 - RNA, 17 nt, Human
uggguacuuguggacac

SEQ ID NO: 3338880 - RNA, 16 nt, Human
uggguaacuagggaag

SEQ ID NO: 3338881 - RNA, 16 nt, Human
ugggggaguggccaca

SEQ ID NO: 3338882 - RNA, 19 nt, Human
uggugacuuuccucuuugg

SEQ ID NO: 3338883 - RNA, 22 nt, Human
uggugaccucugccugaaguca

SEQ ID NO: 3338884 - RNA, 17 nt, Human
uggugaccucugccuga

SEQ ID NO: 3338885 - RNA, 16 nt, Human
uggugaccucugccug

SEQ ID NO: 3338886 - RNA, 15 nt, Human
uggugaccucugccu

SEQ ID NO: 3338887 - RNA, 14 nt, Human
uggugagaggcauc

SEQ ID NO: 3338888 - RNA, 21 nt, Human
uggugcaaugaccuuucaaua

SEQ ID NO: 3338889 - RNA, 20 nt, Human
uggugcaaugaccuuucaau

SEQ ID NO: 3338890 - RNA, 14 nt, Human
uggugaccucugcc

SEQ ID NO: 3338891 - RNA, 13 nt, Human
uggugaccucugc

SEQ ID NO: 3338892 - RNA, 15 nt, Human
uggucuacacugugc

SEQ ID NO: 3338893 - RNA, 16 nt, Human
uggucuacacugugcu

SEQ ID NO: 3338894 - RNA, 17 nt, Human
uggucuacacugugcug

SEQ ID NO: 3338895 - RNA, 18 nt, Human
uggucuacacugugcuga

SEQ ID NO: 3338896 - RNA, 17 nt, Human
uggucggaaaacaugcu

SEQ ID NO: 3338897 - RNA, 14 nt, Human
uggucggaaaacau

SEQ ID NO: 3338898 - RNA, 17 nt, Human
ugguccuaaucuucuga

SEQ ID NO: 3338899 - RNA, 19 nt, Human
ugguccuaaucuucugaac

SEQ ID NO: 3338900 - RNA, 13 nt, Human
ugguccugcugca

SEQ ID NO: 3338901 - RNA, 15 nt, Human
ugguccugcugcagu

SEQ ID NO: 3338902 - RNA, 23 nt, Human
ugguccugcugcaguugccaguc

SEQ ID NO: 3338903 - RNA, 15 nt, Human
uggucccccuuccau

SEQ ID NO: 3338904 - RNA, 16 nt, Human
uggucccccuuccaug

SEQ ID NO: 3338905 - RNA, 18 nt, Human
uggucccccuuccaugga

SEQ ID NO: 3338906 - RNA, 23 nt, Human
uggucccccuuccauggacuuug

SEQ ID NO: 3338907 - RNA, 18 nt, Human
ugguaugaucacggcuca

SEQ ID NO: 3338908 - RNA, 13 nt, Human
uggucccacucag

SEQ ID NO: 3338909 - RNA, 14 nt, Human
uggucccccuucca

SEQ ID NO: 3338910 - RNA, 23 nt, Human
uggacaggcauguucucugagga

SEQ ID NO: 3338911 - RNA, 16 nt, Human
uggcacuauaauguaa

SEQ ID NO: 3338912 - RNA, 15 nt, Human
uggcacuauaaugua

SEQ ID NO: 3338913 - RNA, 16 nt, Human
uggcaaaaaggcagga

SEQ ID NO: 3338914 - RNA, 12 nt, Human
uggcaaaaaggc

SEQ ID NO: 3338915 - RNA, 21 nt, Human
uggaggaaggaaacccagcuc

SEQ ID NO: 3338916 - RNA, 23 nt, Human
uggaggaaggaaacccagcucug

SEQ ID NO: 3338917 - RNA, 20 nt, Human
uggaggaaggaaacccagcu

SEQ ID NO: 3338918 - RNA, 15 nt, Human
uggcagaguugaaga

SEQ ID NO: 3338919 - RNA, 21 nt, Human
uggcagaguggauucuugaac

SEQ ID NO: 3338920 - RNA, 17 nt, Human
uggcagaguugaagaca

SEQ ID NO: 3338921 - RNA, 18 nt, Human
uggccagaugcaccagcc

SEQ ID NO: 3338922 - RNA, 17 nt, Human
uggccagaugcaccagc

SEQ ID NO: 3338923 - RNA, 15 nt, Human
uggccagaugcacca

SEQ ID NO: 3338924 - RNA, 19 nt, Human
uggccagaugcaccagccc

SEQ ID NO: 3338925 - RNA, 13 nt, Human
uggccaggcuggu

SEQ ID NO: 3338926 - RNA, 16 nt, Human
uggccccugcccggcu

SEQ ID NO: 3338927 - RNA, 15 nt, Human
uggccccugcccggc

SEQ ID NO: 3338928 - RNA, 14 nt, Human
uggccccugcccgg

SEQ ID NO: 3338929 - RNA, 15 nt, Human
uggcgcugccccugg

SEQ ID NO: 3338930 - RNA, 23 nt, Human
uggcgcugccccuggcagccccu

SEQ ID NO: 3338931 - RNA, 16 nt, Human
uggcgcugccccuggc

SEQ ID NO: 3338932 - RNA, 22 nt, Human
uggcgcagcauauucaggaagc

SEQ ID NO: 3338933 - RNA, 23 nt, Human
uggcgcagcauauucaggaagcu

SEQ ID NO: 3338934 - RNA, 23 nt, Human
uggccucccaacucaccccagcc

SEQ ID NO: 3338935 - RNA, 15 nt, Human
uggcugcuucaagga

SEQ ID NO: 3338936 - RNA, 15 nt, Human
uggcugggggccuca

SEQ ID NO: 3338937 - RNA, 11 nt, Human
uggcugcuuca

SEQ ID NO: 3338938 - RNA, 16 nt, Human
uggcugcugaaggcuc

SEQ ID NO: 3338939 - RNA, 19 nt, Human
ugcccaggcuggcgugcag

SEQ ID NO: 3338940 - RNA, 18 nt, Human
ugcccaggcuggcgugca

SEQ ID NO: 3338941 - RNA, 20 nt, Human
ugcccaggcuggcgugcagu

SEQ ID NO: 3338942 - RNA, 13 nt, Human
ugcccaggcuggc

SEQ ID NO: 3338943 - RNA, 14 nt, Human
ugcccggcugcgga

SEQ ID NO: 3338944 - RNA, 12 nt, Human
ugcccggcugcg

SEQ ID NO: 3338945 - RNA, 16 nt, Human
ugccccuggcagcccc

SEQ ID NO: 3338946 - RNA, 14 nt, Human
ugccucaagagaag

SEQ ID NO: 3338947 - RNA, 15 nt, Human
ugccucaagagaagg

SEQ ID NO: 3338948 - RNA, 16 nt, Human
ugcccugcccaccugg

SEQ ID NO: 3338949 - RNA, 20 nt, Human
ugcccugcccaccuggccuc

SEQ ID NO: 3338950 - RNA, 15 nt, Human
ugcccugcccaccug

SEQ ID NO: 3338951 - RNA, 14 nt, Human
ugcccugcccaccu

SEQ ID NO: 3338952 - RNA, 21 nt, Human
ugcaguuacacuaaaagguga

SEQ ID NO: 3338953 - RNA, 21 nt, Human
ugcaguggugcgaucuggguu

SEQ ID NO: 3338954 - RNA, 20 nt, Human
ugcaguggugcgaucugggu

SEQ ID NO: 3338955 - RNA, 13 nt, Human
ugcagggaguccg

SEQ ID NO: 3338956 - RNA, 19 nt, Human
ugcaucaagaugugacaug

SEQ ID NO: 3338957 - RNA, 16 nt, Human
ugcaguugccagucac

SEQ ID NO: 3338958 - RNA, 15 nt, Human
ugcaguugccaguca

SEQ ID NO: 3338959 - RNA, 23 nt, Human
ugcauuuggugguuucagaaaug

SEQ ID NO: 3338960 - RNA, 21 nt, Human
ugcauuuggugguuucagaaa

SEQ ID NO: 3338961 - RNA, 20 nt, Human
ugccacccuggggagaaagu

SEQ ID NO: 3338962 - RNA, 19 nt, Human
ugccaggaagccagcaggc

SEQ ID NO: 3338963 - RNA, 10 nt, Human
ugccaggcau

SEQ ID NO: 3338964 - RNA, 14 nt, Human
ugccaggcauggug

SEQ ID NO: 3338965 - RNA, 20 nt, Human
ugccaggaagccagcaggcu

SEQ ID NO: 3338966 - RNA, 22 nt, Human
ugccaggaagccagcaggcucu

SEQ ID NO: 3338967 - RNA, 22 nt, Human
ugcuacuguccuacccacccuc

SEQ ID NO: 3338968 - RNA, 21 nt, Human
ugcuacuguccuacccacccu

SEQ ID NO: 3338969 - RNA, 23 nt, Human
ugcucuccgaccagacaccuuga

SEQ ID NO: 3338970 - RNA, 17 nt, Human
ugcucacauaucuguca

SEQ ID NO: 3338971 - RNA, 21 nt, Human
ugcuaggaacacuccuucaca

SEQ ID NO: 3338972 - RNA, 20 nt, Human
ugcuaggaacacuccuucac

SEQ ID NO: 3338973 - RNA, 22 nt, Human
ugcuaggaacacuccuucacag

SEQ ID NO: 3338974 - RNA, 19 nt, Human
ugcugcuugaggcaacuca

SEQ ID NO: 3338975 - RNA, 20 nt, Human
ugcugggauuacagguguga

SEQ ID NO: 3338976 - RNA, 12 nt, Human
ugcugcuugagg

SEQ ID NO: 3338977 - RNA, 17 nt, Human
ugcugcauuuaaaagau

SEQ ID NO: 3338978 - RNA, 18 nt, Human
ugcugcauuuaaaagaua

SEQ ID NO: 3338979 - RNA, 19 nt, Human
ugcugcauuuaaaagauac

SEQ ID NO: 3338980 - RNA, 23 nt, Human
ugcugcauuuaaaagauacaguu

SEQ ID NO: 3338981 - RNA, 14 nt, Human
ugcugcauuuaaaa

SEQ ID NO: 3338982 - RNA, 13 nt, Human
ugcuggguguggc

SEQ ID NO: 3338983 - RNA, 17 nt, Human
ugcugggcuugucugua

SEQ ID NO: 3338984 - RNA, 17 nt, Human
guggaguucaucuugaa

SEQ ID NO: 3338985 - RNA, 18 nt, Human
guggaugccugguggcag

SEQ ID NO: 3338986 - RNA, 16 nt, Human
guggaugccugguggc

SEQ ID NO: 3338987 - RNA, 20 nt, Human
guggagaagcggcuggcagc

SEQ ID NO: 3338988 - RNA, 15 nt, Human
guggcagugggagcu

SEQ ID NO: 3338989 - RNA, 17 nt, Human
guggcagugggagcugc

SEQ ID NO: 3338990 - RNA, 16 nt, Human
guggcagugggagcug

SEQ ID NO: 3338991 - RNA, 19 nt, Human
guggcagcugcuuuugucu

SEQ ID NO: 3338992 - RNA, 13 nt, Human
guggcagcugcuu

SEQ ID NO: 3338993 - RNA, 12 nt, Human
guggcagcugcu

SEQ ID NO: 3338994 - RNA, 23 nt, Human
guggcagcugcgguccacccagg

SEQ ID NO: 3338995 - RNA, 22 nt, Human
guggcagcugcgguccacccag

SEQ ID NO: 3338996 - RNA, 21 nt, Human
guggcagcugcgguccaccca

SEQ ID NO: 3338997 - RNA, 19 nt, Human
guggcagcugcgguccacc

SEQ ID NO: 3338998 - RNA, 21 nt, Human
guggcagugggagcugccugu

SEQ ID NO: 3338999 - RNA, 19 nt, Human
guggcagugggagcugccu

SEQ ID NO: 3339000 - RNA, 18 nt, Human
guggaaaaauagccugcc

SEQ ID NO: 3339001 - RNA, 22 nt, Human
gugcugccauccagguucagcu

SEQ ID NO: 3339002 - RNA, 11 nt, Human
gugcugcccug

SEQ ID NO: 3339003 - RNA, 13 nt, Human
gugcuuggaggaa

SEQ ID NO: 3339004 - RNA, 15 nt, Human
gugcuuggaggaagg

SEQ ID NO: 3339005 - RNA, 12 nt, Human
gugcuuggagga

SEQ ID NO: 3339006 - RNA, 16 nt, Human
gugcugagucugaagg

SEQ ID NO: 3339007 - RNA, 17 nt, Human
gugcugagucugaaggc

SEQ ID NO: 3339008 - RNA, 18 nt, Human
gugcugagucugaaggcu

SEQ ID NO: 3339009 - RNA, 19 nt, Human
gugcugagucugaaggcug

SEQ ID NO: 3339010 - RNA, 12 nt, Human
gugcugagucug

SEQ ID NO: 3339011 - RNA, 12 nt, Human
gugcugcauuua

SEQ ID NO: 3339012 - RNA, 19 nt, Human
gugcugcauuuaaaagaua

SEQ ID NO: 3339013 - RNA, 20 nt, Human
gugcugcauuuaaaagauac

SEQ ID NO: 3339014 - RNA, 19 nt, Human
gugcugccauccagguuca

SEQ ID NO: 3339015 - RNA, 18 nt, Human
gugcugccauccagguuc

SEQ ID NO: 3339016 - RNA, 15 nt, Human
gugcugccauccagg

SEQ ID NO: 3339017 - RNA, 14 nt, Human
gugcucuggacagg

SEQ ID NO: 3339018 - RNA, 18 nt, Human
gugcucuggacaggcaug

SEQ ID NO: 3339019 - RNA, 17 nt, Human
gugcucuggacaggcau

SEQ ID NO: 3339020 - RNA, 23 nt, Human
gugcugaaugguuuucaaaauaa

SEQ ID NO: 3339021 - RNA, 20 nt, Human
gugcugaaugguuuucaaaa

SEQ ID NO: 3339022 - RNA, 19 nt, Human
gugcugaaugguuuucaaa

SEQ ID NO: 3339023 - RNA, 21 nt, Human
gugccuuggggacaagagcag

SEQ ID NO: 3339024 - RNA, 16 nt, Human
gugcucuggacaggca

SEQ ID NO: 3339025 - RNA, 15 nt, Human
gugcucuggacaggc

SEQ ID NO: 3339026 - RNA, 14 nt, Human
gugaaaagaaaaau

SEQ ID NO: 3339027 - RNA, 23 nt, Human
gugaaaagaaaaaugagccuggc

SEQ ID NO: 3339028 - RNA, 12 nt, Human
gugaaacuggau

SEQ ID NO: 3339029 - RNA, 19 nt, Human
gugaaaggaaagagggagg

SEQ ID NO: 3339030 - RNA, 13 nt, Human
gugagccacugca

SEQ ID NO: 3339031 - RNA, 17 nt, Human
gugacugaucucucgug

SEQ ID NO: 3339032 - RNA, 16 nt, Human
gugaggaagccgcugg

SEQ ID NO: 3339033 - RNA, 19 nt, Human
gugaggaagccgcuggggc

SEQ ID NO: 3339034 - RNA, 11 nt, Human
gugaggaagcc

SEQ ID NO: 3339035 - RNA, 16 nt, Human
gugacaacacuugugu

SEQ ID NO: 3339036 - RNA, 15 nt, Human
gugaccucugccuga

SEQ ID NO: 3339037 - RNA, 16 nt, Human
gugacugaauuucuuu

SEQ ID NO: 3339038 - RNA, 18 nt, Human
gugacugaauuucuuuug

SEQ ID NO: 3339039 - RNA, 15 nt, Human
gugacugaauuucuu

SEQ ID NO: 3339040 - RNA, 20 nt, Human
gugcccacaggaucagucug

SEQ ID NO: 3339041 - RNA, 13 nt, Human
gugcauaccacuu

SEQ ID NO: 3339042 - RNA, 14 nt, Human
gugcauaccacuuu

SEQ ID NO: 3339043 - RNA, 22 nt, Human
gugccagguuuuuggucugacc

SEQ ID NO: 3339044 - RNA, 20 nt, Human
gugccagguuuuuggucuga

SEQ ID NO: 3339045 - RNA, 19 nt, Human
gugcauaaguuaacuucca

SEQ ID NO: 3339046 - RNA, 22 nt, Human
gugauucuccugccucagccuc

SEQ ID NO: 3339047 - RNA, 20 nt, Human
gugauucuccugccucagcc

SEQ ID NO: 3339048 - RNA, 19 nt, Human
gugauucuccugccucagc

SEQ ID NO: 3339049 - RNA, 18 nt, Human
gugauucuccugccucag

SEQ ID NO: 3339050 - RNA, 17 nt, Human
gugauucuccugccuca

SEQ ID NO: 3339051 - RNA, 16 nt, Human
gugauucuccugccuc

SEQ ID NO: 3339052 - RNA, 14 nt, Human
gugauucuccugcc

SEQ ID NO: 3339053 - RNA, 23 nt, Human
gugauucuccugccucagccucc

SEQ ID NO: 3339054 - RNA, 12 nt, Human
gugauuuucauu

SEQ ID NO: 3339055 - RNA, 18 nt, Human
gugauccucccaccucag

SEQ ID NO: 3339056 - RNA, 15 nt, Human
gugauccucccaccu

SEQ ID NO: 3339057 - RNA, 14 nt, Human
gugauccucccacc

SEQ ID NO: 3339058 - RNA, 22 nt, Human
gugauccucccaccucagccuc

SEQ ID NO: 3339059 - RNA, 20 nt, Human
gugauccucccaccucagcc

SEQ ID NO: 3339060 - RNA, 20 nt, Human
gugauccacccaccucagcc

SEQ ID NO: 3339061 - RNA, 18 nt, Human
gugauccacccaccucag

SEQ ID NO: 3339062 - RNA, 15 nt, Human
gugauccacccaccu

SEQ ID NO: 3339063 - RNA, 11 nt, Human
gugaggccaga

SEQ ID NO: 3339064 - RNA, 19 nt, Human
gucugaggaauccagaccc

SEQ ID NO: 3339065 - RNA, 18 nt, Human
gucugaggaauccagacc

SEQ ID NO: 3339066 - RNA, 15 nt, Human
gucugacccacugcu

SEQ ID NO: 3339067 - RNA, 14 nt, Human
gucugacccacugc

SEQ ID NO: 3339068 - RNA, 13 nt, Human
gucugacccacug

SEQ ID NO: 3339069 - RNA, 21 nt, Human
gucugauucccaagcucugcu

SEQ ID NO: 3339070 - RNA, 20 nt, Human
gucugauucccaagcucugc

SEQ ID NO: 3339071 - RNA, 21 nt, Human
gucugaggaauccagacccgg

SEQ ID NO: 3339072 - RNA, 19 nt, Human
gucugauucccaagcucug

SEQ ID NO: 3339073 - RNA, 18 nt, Human
gucugauucccaagcucu

SEQ ID NO: 3339074 - RNA, 17 nt, Human
gucugauucccaagcuc

SEQ ID NO: 3339075 - RNA, 23 nt, Human
gucucacuguugcccaggcuggc

SEQ ID NO: 3339076 - RNA, 22 nt, Human
gucucacuguugcccaggcugg

SEQ ID NO: 3339077 - RNA, 21 nt, Human
gucucacuguugcccaggcug

SEQ ID NO: 3339078 - RNA, 20 nt, Human
gucucacuguugcccaggcu

SEQ ID NO: 3339079 - RNA, 19 nt, Human
gucucacuauguugcccag

SEQ ID NO: 3339080 - RNA, 19 nt, Human
gucucacuguugcccaggc

SEQ ID NO: 3339081 - RNA, 18 nt, Human
gucucacuguugcccagg

SEQ ID NO: 3339082 - RNA, 17 nt, Human
gucucacuguugcccag

SEQ ID NO: 3339083 - RNA, 16 nt, Human
gucucacuguugccca

SEQ ID NO: 3339084 - RNA, 23 nt, Human
gucucacuauguugcccaggcag

SEQ ID NO: 3339085 - RNA, 13 nt, Human
gucucacuguugc

SEQ ID NO: 3339086 - RNA, 21 nt, Human
gucucacuauguugcccaggc

SEQ ID NO: 3339087 - RNA, 20 nt, Human
gucucacuauguugcccagg

SEQ ID NO: 3339088 - RNA, 16 nt, Human
guccuuaccagcagag

SEQ ID NO: 3339089 - RNA, 17 nt, Human
guccuuaccagcagagc

SEQ ID NO: 3339090 - RNA, 15 nt, Human
guccuuaccagcaga

SEQ ID NO: 3339091 - RNA, 15 nt, Human
gucuacacugugcug

SEQ ID NO: 3339092 - RNA, 18 nt, Human
guccugggagugagcugg

SEQ ID NO: 3339093 - RNA, 17 nt, Human
guccugggagugagcug

SEQ ID NO: 3339094 - RNA, 19 nt, Human
guccugggagugagcuggu

SEQ ID NO: 3339095 - RNA, 23 nt, Human
guccucccaucucacacaugagc

SEQ ID NO: 3339096 - RNA, 13 nt, Human
guccucccaucuc

SEQ ID NO: 3339097 - RNA, 14 nt, Human
guccucccaucuca

SEQ ID NO: 3339098 - RNA, 12 nt, Human
guccucccaucu

SEQ ID NO: 3339099 - RNA, 17 nt, Human
guccuggcaugggaaug

SEQ ID NO: 3339100 - RNA, 16 nt, Human
guccugggagugagcu

SEQ ID NO: 3339101 - RNA, 15 nt, Human
guccugggagugagc

SEQ ID NO: 3339102 - RNA, 23 nt, Human
guccuagaaauuccccacccuga

SEQ ID NO: 3339103 - RNA, 23 nt, Human
guccuacucugugucaggugggg

SEQ ID NO: 3339104 - RNA, 15 nt, Human
guccuacucuguguc

SEQ ID NO: 3339105 - RNA, 16 nt, Human
gucccugguggcagcu

SEQ ID NO: 3339106 - RNA, 17 nt, Human
gucccugguggcagcuc

SEQ ID NO: 3339107 - RNA, 13 nt, Human
guccuacucugug

SEQ ID NO: 3339108 - RNA, 12 nt, Human
gucccagugccg

SEQ ID NO: 3339109 - RNA, 19 nt, Human
gucaagugaaaaaggagga

SEQ ID NO: 3339110 - RNA, 16 nt, Human
gucaagugaaaaagga

SEQ ID NO: 3339111 - RNA, 18 nt, Human
gucaagugaaaaaggagg

SEQ ID NO: 3339112 - RNA, 19 nt, Human
gucaagagggucugaggaa

SEQ ID NO: 3339113 - RNA, 18 nt, Human
gucaagagggucugagga

SEQ ID NO: 3339114 - RNA, 13 nt, Human
gucaccccggcca

SEQ ID NO: 3339115 - RNA, 20 nt, Human
gucaccugaagacucauucu

SEQ ID NO: 3339116 - RNA, 13 nt, Human
gucaauuacagga

SEQ ID NO: 3339117 - RNA, 15 nt, Human
gucaauuacaggaag

SEQ ID NO: 3339118 - RNA, 14 nt, Human
guauuauaccuuuu

SEQ ID NO: 3339119 - RNA, 15 nt, Human
guauuacuucugcua

SEQ ID NO: 3339120 - RNA, 14 nt, Human
guauuacuucugcu

SEQ ID NO: 3339121 - RNA, 13 nt, Human
guauuacuucugc

SEQ ID NO: 3339122 - RNA, 15 nt, Human
guagagugggagcug

SEQ ID NO: 3339123 - RNA, 13 nt, Human
guagagugggagc

SEQ ID NO: 3339124 - RNA, 21 nt, Human
gucauauaagauucauauuua

SEQ ID NO: 3339125 - RNA, 16 nt, Human
guccacccaggagccc

SEQ ID NO: 3339126 - RNA, 15 nt, Human
guccacccaggagcc

SEQ ID NO: 3339127 - RNA, 13 nt, Human
guccacccaggag

SEQ ID NO: 3339128 - RNA, 14 nt, Human
guccacccaggagc

SEQ ID NO: 3339129 - RNA, 14 nt, Human
gucccacucagucc

SEQ ID NO: 3339130 - RNA, 15 nt, Human
gucccacucagucca

SEQ ID NO: 3339131 - RNA, 17 nt, Human
gucccagauacuugggg

SEQ ID NO: 3339132 - RNA, 22 nt, Human
ggucccaccccacacacgccag

SEQ ID NO: 3339133 - RNA, 11 nt, Human
ggucagagccu

SEQ ID NO: 3339134 - RNA, 14 nt, Human
ggucccacucaguc

SEQ ID NO: 3339135 - RNA, 12 nt, Human
ggucccacucag

SEQ ID NO: 3339136 - RNA, 22 nt, Human
ggucccacucaguccauagcag

SEQ ID NO: 3339137 - RNA, 18 nt, Human
ggucccccuuccauggac

SEQ ID NO: 3339138 - RNA, 23 nt, Human
ggucccccuuccauggacuuugu

SEQ ID NO: 3339139 - RNA, 13 nt, Human
ggucccccuucca

SEQ ID NO: 3339140 - RNA, 16 nt, Human
ggucagagccugcagu

SEQ ID NO: 3339141 - RNA, 15 nt, Human
ggucagagccugcag

SEQ ID NO: 3339142 - RNA, 14 nt, Human
ggucagagccugca

SEQ ID NO: 3339143 - RNA, 13 nt, Human
ggucagagccugc

SEQ ID NO: 3339144 - RNA, 16 nt, Human
ggucacucuggcagcu

SEQ ID NO: 3339145 - RNA, 20 nt, Human
ggucacucuggcagcucaga

SEQ ID NO: 3339146 - RNA, 22 nt, Human
ggucacucuggcagcucagaga

SEQ ID NO: 3339147 - RNA, 12 nt, Human
ggucagagccug

SEQ ID NO: 3339148 - RNA, 12 nt, Human
ggucacucuggc

SEQ ID NO: 3339149 - RNA, 19 nt, Human
ggguuggccccugcccggc

SEQ ID NO: 3339150 - RNA, 16 nt, Human
ggguuggccccugccc

SEQ ID NO: 3339151 - RNA, 17 nt, Human
ggguucuacccaggugc

SEQ ID NO: 3339152 - RNA, 22 nt, Human
ggguucuacccaggugcuagga

SEQ ID NO: 3339153 - RNA, 23 nt, Human
ggguucccuuuuuuggcugcuga

SEQ ID NO: 3339154 - RNA, 15 nt, Human
ggguugggcuggugu

SEQ ID NO: 3339155 - RNA, 16 nt, Human
gguacccacugcucug

SEQ ID NO: 3339156 - RNA, 17 nt, Human
gguacccacugcucugg

SEQ ID NO: 3339157 - RNA, 22 nt, Human
gguacuuguggacacagcucuu

SEQ ID NO: 3339158 - RNA, 20 nt, Human
gguacuuguggacacagcuc

SEQ ID NO: 3339159 - RNA, 21 nt, Human
gguacuuguggacacagcucu

SEQ ID NO: 3339160 - RNA, 14 nt, Human
ggucccugguggca

SEQ ID NO: 3339161 - RNA, 22 nt, Human
ggucucacuauguugcccaggc

SEQ ID NO: 3339162 - RNA, 22 nt, Human
ggucccugguggcagcucaccu

SEQ ID NO: 3339163 - RNA, 18 nt, Human
ggugaagugaagacaaug

SEQ ID NO: 3339164 - RNA, 16 nt, Human
ggugaacuugguuccc

SEQ ID NO: 3339165 - RNA, 19 nt, Human
ggucugaggaauccagacc

SEQ ID NO: 3339166 - RNA, 14 nt, Human
ggucugacccacug

SEQ ID NO: 3339167 - RNA, 12 nt, Human
ggucucacucug

SEQ ID NO: 3339168 - RNA, 21 nt, Human
ggucucacuauguugcccagg

SEQ ID NO: 3339169 - RNA, 16 nt, Human
ggucugacccacugcu

SEQ ID NO: 3339170 - RNA, 15 nt, Human
ggucugacccacugc

SEQ ID NO: 3339171 - RNA, 14 nt, Human
ggugaccucugccu

SEQ ID NO: 3339172 - RNA, 16 nt, Human
ggugaccucugccuga

SEQ ID NO: 3339173 - RNA, 13 nt, Human
gguggcagcugcg

SEQ ID NO: 3339174 - RNA, 12 nt, Human
gguggcagcugc

SEQ ID NO: 3339175 - RNA, 13 nt, Human
gguggcagcucac

SEQ ID NO: 3339176 - RNA, 11 nt, Human
gguggcagcug

SEQ ID NO: 3339177 - RNA, 23 nt, Human
gguggcagcugcgguccacccag

SEQ ID NO: 3339178 - RNA, 15 nt, Human
gguggcagcugcggu

SEQ ID NO: 3339179 - RNA, 23 nt, Human
ggugcuaucucccccagccccau

SEQ ID NO: 3339180 - RNA, 21 nt, Human
ggugcuaucucccccagcccc

SEQ ID NO: 3339181 - RNA, 22 nt, Human
ggugcuaucucccccagcccca

SEQ ID NO: 3339182 - RNA, 15 nt, Human
ggugcgaucuggguu

SEQ ID NO: 3339183 - RNA, 14 nt, Human
gggcuucaguggca

SEQ ID NO: 3339184 - RNA, 16 nt, Human
gggcugaggugggagg

SEQ ID NO: 3339185 - RNA, 14 nt, Human
gggcugcaccggcu

SEQ ID NO: 3339186 - RNA, 15 nt, Human
gggcucugccuccca

SEQ ID NO: 3339187 - RNA, 16 nt, Human
gggcucugccucccau

SEQ ID NO: 3339188 - RNA, 17 nt, Human
gggcucugccucccauc

SEQ ID NO: 3339189 - RNA, 20 nt, Human
gggcucugccucccaucacc

SEQ ID NO: 3339190 - RNA, 13 nt, Human
gggcucugccucc

SEQ ID NO: 3339191 - RNA, 18 nt, Human
gggccuggucguuuucaa

SEQ ID NO: 3339192 - RNA, 14 nt, Human
gggccuggcucagg

SEQ ID NO: 3339193 - RNA, 16 nt, Human
gggccuggcucaggug

SEQ ID NO: 3339194 - RNA, 12 nt, Human
gggccuggcuca

SEQ ID NO: 3339195 - RNA, 19 nt, Human
gggccuggccugagcuggg

SEQ ID NO: 3339196 - RNA, 14 nt, Human
gggcucccuuccca

SEQ ID NO: 3339197 - RNA, 17 nt, Human
gggcucccuucccaccu

SEQ ID NO: 3339198 - RNA, 18 nt, Human
gggcucccuucccaccuc

SEQ ID NO: 3339199 - RNA, 23 nt, Human
gggcucccuucccaccucucuca

SEQ ID NO: 3339200 - RNA, 13 nt, Human
gggcucccuuccc

SEQ ID NO: 3339201 - RNA, 16 nt, Human
gggcgcgguggcucac

SEQ ID NO: 3339202 - RNA, 13 nt, Human
ggggcugggacau

SEQ ID NO: 3339203 - RNA, 16 nt, Human
ggggcugggcagagga

SEQ ID NO: 3339204 - RNA, 17 nt, Human
ggggcugggcagaggaa

SEQ ID NO: 3339205 - RNA, 23 nt, Human
ggggcugcaccggcuggccuggc

SEQ ID NO: 3339206 - RNA, 18 nt, Human
ggguacccacugcucugg

SEQ ID NO: 3339207 - RNA, 15 nt, Human
ggguacccacugcuc

SEQ ID NO: 3339208 - RNA, 13 nt, Human
ggguacccacugc

SEQ ID NO: 3339209 - RNA, 23 nt, Human
ggguagagcggagaaaggaaggg

SEQ ID NO: 3339210 - RNA, 23 nt, Human
ggguacuuguggacacagcucuu

SEQ ID NO: 3339211 - RNA, 22 nt, Human
ggguacuuguggacacagcucu

SEQ ID NO: 3339212 - RNA, 19 nt, Human
ggguacuuguggacacagc

SEQ ID NO: 3339213 - RNA, 23 nt, Human
gggguucccuuuuuuggcugcug

SEQ ID NO: 3339214 - RNA, 19 nt, Human
gggcuucauccuccucaga

SEQ ID NO: 3339215 - RNA, 20 nt, Human
gggcuucaguggcagcugcu

SEQ ID NO: 3339216 - RNA, 19 nt, Human
gggcuucaguggcagcugc

SEQ ID NO: 3339217 - RNA, 18 nt, Human
gggcuucaguggcagcug

SEQ ID NO: 3339218 - RNA, 17 nt, Human
gggcuucaguggcagcu

SEQ ID NO: 3339219 - RNA, 16 nt, Human
gggcuucaguggcagc

SEQ ID NO: 3339220 - RNA, 15 nt, Human
gggcuucaguggcag

SEQ ID NO: 3339221 - RNA, 20 nt, Human
gggcuucauccuccucagau

SEQ ID NO: 3339222 - RNA, 20 nt, Human
gggcuuggggaccagagcug

SEQ ID NO: 3339223 - RNA, 13 nt, Human
ggggaguggccac

SEQ ID NO: 3339224 - RNA, 21 nt, Human
gggcuuggggaccagagcugc

SEQ ID NO: 3339225 - RNA, 11 nt, Human
ggggagaaagu

SEQ ID NO: 3339226 - RNA, 17 nt, Human
ggggaucacagccucug

SEQ ID NO: 3339227 - RNA, 23 nt, Human
guaaauuaacuuuuauaaacuuu

SEQ ID NO: 3339228 - RNA, 20 nt, Human
guaaggaauaccuguccccc

SEQ ID NO: 3339229 - RNA, 21 nt, Human
guaaggaauaccugucccccu

SEQ ID NO: 3339230 - RNA, 23 nt, Human
guaaggaauaccugucccccuga

SEQ ID NO: 3339231 - RNA, 13 nt, Human
guaaggaaugauu

SEQ ID NO: 3339232 - RNA, 18 nt, Human
guaaggaauaccuguccc

SEQ ID NO: 3339233 - RNA, 22 nt, Human
guaaguauucuuauuuaaugaa

SEQ ID NO: 3339234 - RNA, 19 nt, Human
guaaaugggggugcauuug

SEQ ID NO: 3339235 - RNA, 20 nt, Human
guaaaugggggugcauuuga

SEQ ID NO: 3339236 - RNA, 18 nt, Human
guaaaugggggugcauuu

SEQ ID NO: 3339237 - RNA, 16 nt, Human
guaaauuaacuuuuau

SEQ ID NO: 3339238 - RNA, 17 nt, Human
guaaauuaacuuuuaua

SEQ ID NO: 3339239 - RNA, 21 nt, Human
guaaauuaacuuuuauaaacu

SEQ ID NO: 3339240 - RNA, 22 nt, Human
guaaauuaacuuuuauaaacuu

SEQ ID NO: 3339241 - RNA, 15 nt, Human
guaaauuaacuuuua

SEQ ID NO: 3339242 - RNA, 23 nt, Human
gguuuugccauguuggccaggcu

SEQ ID NO: 3339243 - RNA, 12 nt, Human
gguuuucuguuc

SEQ ID NO: 3339244 - RNA, 13 nt, Human
gguuuucuguucu

SEQ ID NO: 3339245 - RNA, 15 nt, Human
gguuuucuguucuuu

SEQ ID NO: 3339246 - RNA, 14 nt, Human
gguugaagcaccaa

SEQ ID NO: 3339247 - RNA, 22 nt, Human
gguucaagcgauucuucugcuu

SEQ ID NO: 3339248 - RNA, 20 nt, Human
gguucacugcaaccuccgcc

SEQ ID NO: 3339249 - RNA, 21 nt, Human
gguucaagcgauucuucugcu

SEQ ID NO: 3339250 - RNA, 13 nt, Human
gguggccucccaa

SEQ ID NO: 3339251 - RNA, 13 nt, Human
gguuuaagcuguu

SEQ ID NO: 3339252 - RNA, 13 nt, Human
gguuggugggggc

SEQ ID NO: 3339253 - RNA, 14 nt, Human
gguugggcuggugu

SEQ ID NO: 3339254 - RNA, 20 nt, Human
guacauaaugcgugcauacc

SEQ ID NO: 3339255 - RNA, 15 nt, Human
guacccacugcucug

SEQ ID NO: 3339256 - RNA, 12 nt, Human
guacagagccca

SEQ ID NO: 3339257 - RNA, 18 nt, Human
guacagagcccacgcccc

SEQ ID NO: 3339258 - RNA, 22 nt, Human
guacagagcccacgcccccacu

SEQ ID NO: 3339259 - RNA, 20 nt, Human
guacagcaaggagauuuaca

SEQ ID NO: 3339260 - RNA, 16 nt, Human
guacagacaacaaacc

SEQ ID NO: 3339261 - RNA, 19 nt, Human
guacacuguuucaaacuuu

SEQ ID NO: 3339262 - RNA, 20 nt, Human
guacacuguuucaaacuuua

SEQ ID NO: 3339263 - RNA, 21 nt, Human
guacacuguuucaaacuuuac

SEQ ID NO: 3339264 - RNA, 21 nt, Human
guaauuaaguacuauguauca

SEQ ID NO: 3339265 - RNA, 20 nt, Human
guaauuaaguacuauguauc

SEQ ID NO: 3339266 - RNA, 17 nt, Human
guaauuaaguacuaugu

SEQ ID NO: 3339267 - RNA, 14 nt, Human
guaauuaaguacua

SEQ ID NO: 3339268 - RNA, 18 nt, Human
guacacuguuucaaacuu

SEQ ID NO: 3339269 - RNA, 21 nt, Human
guacuucuccacccugcucuc

SEQ ID NO: 3339270 - RNA, 20 nt, Human
guacuucuccacccugcucu

SEQ ID NO: 3339271 - RNA, 19 nt, Human
guacuucuccacccugcuc

SEQ ID NO: 3339272 - RNA, 18 nt, Human
guacuucuccacccugcu

SEQ ID NO: 3339273 - RNA, 17 nt, Human
guacuucuccacccugc

SEQ ID NO: 3339274 - RNA, 16 nt, Human
guacuucuccacccug

SEQ ID NO: 3339275 - RNA, 20 nt, Human
guacuuguggacacagcucu

SEQ ID NO: 3339276 - RNA, 16 nt, Human
guacuuguggacacag

SEQ ID NO: 3339277 - RNA, 21 nt, Human
guacuuguggacacagcucuu

SEQ ID NO: 3339278 - RNA, 18 nt, Human
guagagccagggucucac

SEQ ID NO: 3339279 - RNA, 16 nt, Human
guagagcggagaaagg

SEQ ID NO: 3339280 - RNA, 17 nt, Human
guacguugugcauuugg

SEQ ID NO: 3339281 - RNA, 23 nt, Human
guacuaaggaaucuuucugcuuu

SEQ ID NO: 3339282 - RNA, 15 nt, Human
guacuaaggaaucuu

SEQ ID NO: 3339283 - RNA, 15 nt, Human
guacuucuccacccu

SEQ ID NO: 3339284 - RNA, 14 nt, Human
guacuucuccaccc

SEQ ID NO: 3339285 - RNA, 15 nt, Human
guacguugugcauuu

SEQ ID NO: 3339286 - RNA, 16 nt, Human
guacguugugcauuug

SEQ ID NO: 3339287 - RNA, 14 nt, Human
guacguugugcauu

SEQ ID NO: 3339288 - RNA, 17 nt, Human
guacgucugacaggcaa

SEQ ID NO: 3339289 - RNA, 15 nt, Human
guacgucugacaggc

SEQ ID NO: 3339290 - RNA, 14 nt, Human
guacgucugacagg

SEQ ID NO: 3339291 - RNA, 13 nt, Human
guaccucuugagc

SEQ ID NO: 3339292 - RNA, 21 nt, Human
guaccucuugagccuugaacu

SEQ ID NO: 3339293 - RNA, 22 nt, Human
guaccucuugagccuugaacuu

SEQ ID NO: 3339294 - RNA, 16 nt, Human
guacccacugcucugg

SEQ ID NO: 3339295 - RNA, 18 nt, Human
gcuucaguggcagcugcu

SEQ ID NO: 3339296 - RNA, 17 nt, Human
gcuucaguggcagcugc

SEQ ID NO: 3339297 - RNA, 12 nt, Human
gcuucauccucc

SEQ ID NO: 3339298 - RNA, 15 nt, Human
gcuucauccuccuca

SEQ ID NO: 3339299 - RNA, 16 nt, Human
gcuucauuuccugugu

SEQ ID NO: 3339300 - RNA, 13 nt, Human
gcuucauuuccug

SEQ ID NO: 3339301 - RNA, 12 nt, Human
gcuuauacacuu

SEQ ID NO: 3339302 - RNA, 13 nt, Human
gcuuaucucaggg

SEQ ID NO: 3339303 - RNA, 19 nt, Human
gcuuaucucaggggugugc

SEQ ID NO: 3339304 - RNA, 15 nt, Human
gcuucaguggcagcu

SEQ ID NO: 3339305 - RNA, 16 nt, Human
gcuucaguggcagcug

SEQ ID NO: 3339306 - RNA, 16 nt, Human
gcuuccagugaggcuc

SEQ ID NO: 3339307 - RNA, 17 nt, Human
gcuucauuuccuguguc

SEQ ID NO: 3339308 - RNA, 15 nt, Human
gcuuccagugaggcu

SEQ ID NO: 3339309 - RNA, 16 nt, Human
gcuugaggguugggcu

SEQ ID NO: 3339310 - RNA, 15 nt, Human
gcuuagucacugaga

SEQ ID NO: 3339311 - RNA, 17 nt, Human
gcuuagucacugagaca

SEQ ID NO: 3339312 - RNA, 21 nt, Human
gcuuagucacugagacagccc

SEQ ID NO: 3339313 - RNA, 19 nt, Human
gcuuagucacugagacagc

SEQ ID NO: 3339314 - RNA, 20 nt, Human
gcuuagucacugagacagcc

SEQ ID NO: 3339315 - RNA, 14 nt, Human
gcuguucagcuggu

SEQ ID NO: 3339316 - RNA, 13 nt, Human
gcuguucagcugg

SEQ ID NO: 3339317 - RNA, 15 nt, Human
gcugccaaugggagc

SEQ ID NO: 3339318 - RNA, 16 nt, Human
gcugccaaugggagcu

SEQ ID NO: 3339319 - RNA, 19 nt, Human
gcugccaaugggagcucau

SEQ ID NO: 3339320 - RNA, 22 nt, Human
ggaaaggcuccaggagcagcca

SEQ ID NO: 3339321 - RNA, 17 nt, Human
ggaaaggcuccaggagc

SEQ ID NO: 3339322 - RNA, 19 nt, Human
ggaaaggcuccaggagcag

SEQ ID NO: 3339323 - RNA, 20 nt, Human
ggaaaggcuccaggagcagc

SEQ ID NO: 3339324 - RNA, 21 nt, Human
ggaaaggcuccaggagcagcc

SEQ ID NO: 3339325 - RNA, 12 nt, Human
ggaaaggcucca

SEQ ID NO: 3339326 - RNA, 13 nt, Human
ggaaaggcuccag

SEQ ID NO: 3339327 - RNA, 14 nt, Human
ggaaaggcuccagg

SEQ ID NO: 3339328 - RNA, 19 nt, Human
ggaaaaucagccugcucca

SEQ ID NO: 3339329 - RNA, 15 nt, Human
ggaaaaucagccugc

SEQ ID NO: 3339330 - RNA, 23 nt, Human
ggaaaaucagccugcuccagcug

SEQ ID NO: 3339331 - RNA, 16 nt, Human
ggaacaggaaacugau

SEQ ID NO: 3339332 - RNA, 21 nt, Human
ggaaaucaccgaaaacguggc

SEQ ID NO: 3339333 - RNA, 14 nt, Human
ggaaaucaccgaaa

SEQ ID NO: 3339334 - RNA, 14 nt, Human
ggaaaagcugcuga

SEQ ID NO: 3339335 - RNA, 20 nt, Human
ggaaaagcugcugacagugu

SEQ ID NO: 3339336 - RNA, 18 nt, Human
ggaaaagcugcugacagu

SEQ ID NO: 3339337 - RNA, 18 nt, Human
ggaaaacaugcuacacac

SEQ ID NO: 3339338 - RNA, 21 nt, Human
gcuuuguuuguugucagcuga

SEQ ID NO: 3339339 - RNA, 20 nt, Human
gcuugaggguugggcuggug

SEQ ID NO: 3339340 - RNA, 18 nt, Human
gcuugaggguugggcugg

SEQ ID NO: 3339341 - RNA, 15 nt, Human
gcuuugugauuuuug

SEQ ID NO: 3339342 - RNA, 22 nt, Human
ggacacuaaccacgcuggaccu

SEQ ID NO: 3339343 - RNA, 19 nt, Human
ggaauguuugccucugccu

SEQ ID NO: 3339344 - RNA, 24 nt, Human
ggaaugauuaauuaaaacacaaca

SEQ ID NO: 3339345 - RNA, 12 nt, Human
ggaaugcagugg

SEQ ID NO: 3339346 - RNA, 23 nt, Human
ggaaggggagauaaggguaucug

SEQ ID NO: 3339347 - RNA, 12 nt, Human
ggaaguacugga

SEQ ID NO: 3339348 - RNA, 16 nt, Human
ggaaguacuggagaaa

SEQ ID NO: 3339349 - RNA, 18 nt, Human
ggaaguacuggagaaaau

SEQ ID NO: 3339350 - RNA, 14 nt, Human
ggaaugauuaauua

SEQ ID NO: 3339351 - RNA, 20 nt, Human
ggacauugcggacagccacg

SEQ ID NO: 3339352 - RNA, 14 nt, Human
ggacauggacaagg

SEQ ID NO: 3339353 - RNA, 21 nt, Human
ggacagccacggccaggccag

SEQ ID NO: 3339354 - RNA, 20 nt, Human
ggacagccacggccaggcca

SEQ ID NO: 3339355 - RNA, 19 nt, Human
ggacagccacggccaggcc

SEQ ID NO: 3339356 - RNA, 15 nt, Human
ggacagccacggcca

SEQ ID NO: 3339357 - RNA, 20 nt, Human
ggacagaggggguggccucc

SEQ ID NO: 3339358 - RNA, 17 nt, Human
ggacacucaaaagcugg

SEQ ID NO: 3339359 - RNA, 19 nt, Human
ggacgcuacccgggaaggg

SEQ ID NO: 3339360 - RNA, 20 nt, Human
ggacgcuacccgggaagggg

SEQ ID NO: 3339361 - RNA, 17 nt, Human
ggacgcuacccgggaag

SEQ ID NO: 3339362 - RNA, 17 nt, Human
ggaccuugaacugggua

SEQ ID NO: 3339363 - RNA, 15 nt, Human
ggaccuugaacuggg

SEQ ID NO: 3339364 - RNA, 19 nt, Human
ggaccucaggugagaagca

SEQ ID NO: 3339365 - RNA, 20 nt, Human
ggaccucaggccugggggcu

SEQ ID NO: 3339366 - RNA, 23 nt, Human
ggaccucaggugagaagcagagg

SEQ ID NO: 3339367 - RNA, 13 nt, Human
ggaccagagcugc

SEQ ID NO: 3339368 - RNA, 17 nt, Human
ggagaagcggcuggcag

SEQ ID NO: 3339369 - RNA, 13 nt, Human
ggcagcucagaga

SEQ ID NO: 3339370 - RNA, 21 nt, Human
ggcagcucagagaggguggga

SEQ ID NO: 3339371 - RNA, 18 nt, Human
ggcagggucucacucugu

SEQ ID NO: 3339372 - RNA, 22 nt, Human
ggcagcugcuuuugucuauggg

SEQ ID NO: 3339373 - RNA, 12 nt, Human
ggcagcucaccu

SEQ ID NO: 3339374 - RNA, 14 nt, Human
ggcagcucaccucu

SEQ ID NO: 3339375 - RNA, 15 nt, Human
ggcaugaagacagau

SEQ ID NO: 3339376 - RNA, 18 nt, Human
ggcaugacacgaauauug

SEQ ID NO: 3339377 - RNA, 16 nt, Human
ggcagugggagcugcc

SEQ ID NO: 3339378 - RNA, 14 nt, Human
ggcagugggagcug

SEQ ID NO: 3339379 - RNA, 13 nt, Human
ggcagugggagcu

SEQ ID NO: 3339380 - RNA, 20 nt, Human
ggcagggucucacucugucg

SEQ ID NO: 3339381 - RNA, 19 nt, Human
ggcagggucucacucuguc

SEQ ID NO: 3339382 - RNA, 18 nt, Human
ggcauuccccaggaggcc

SEQ ID NO: 3339383 - RNA, 19 nt, Human
ggcauuccccaggaggcca

SEQ ID NO: 3339384 - RNA, 16 nt, Human
ggcauuccccaggagg

SEQ ID NO: 3339385 - RNA, 22 nt, Human
ggcaugggaaugaaugucagug

SEQ ID NO: 3339386 - RNA, 17 nt, Human
ggcauuccccaggaggc

SEQ ID NO: 3339387 - RNA, 18 nt, Human
ggcaugggaaugaauguc

SEQ ID NO: 3339388 - RNA, 23 nt, Human
ggccagcugcuugggcuucaucc

SEQ ID NO: 3339389 - RNA, 18 nt, Human
ggccaggcccucugccca

SEQ ID NO: 3339390 - RNA, 22 nt, Human
ggccagccuugaccauucucca

SEQ ID NO: 3339391 - RNA, 17 nt, Human
ggccagcugcuugggcu

SEQ ID NO: 3339392 - RNA, 20 nt, Human
ggccagccuugaccauucuc

SEQ ID NO: 3339393 - RNA, 16 nt, Human
ggccaugggccuccug

SEQ ID NO: 3339394 - RNA, 18 nt, Human
ggcaacccccagccugcu

SEQ ID NO: 3339395 - RNA, 23 nt, Human
ggcaaugcuggcuguuggcuggg

SEQ ID NO: 3339396 - RNA, 15 nt, Human
ggcaaugcuggcugu

SEQ ID NO: 3339397 - RNA, 14 nt, Human
ggcaaugcuggcug

SEQ ID NO: 3339398 - RNA, 22 nt, Human
ggcacccggccccugcugguuc

SEQ ID NO: 3339399 - RNA, 20 nt, Human
ggcacccggccccugcuggu

SEQ ID NO: 3339400 - RNA, 23 nt, Human
ggcacccaccaucaugucuggcu

SEQ ID NO: 3339401 - RNA, 20 nt, Human
ggcacccaccaucaugucug

SEQ ID NO: 3339402 - RNA, 17 nt, Human
ggauugcuacuguccua

SEQ ID NO: 3339403 - RNA, 17 nt, Human
ggcaacccccagccugc

SEQ ID NO: 3339404 - RNA, 16 nt, Human
ggcaacccccagccug

SEQ ID NO: 3339405 - RNA, 16 nt, Human
ggauucuuauggacaa

SEQ ID NO: 3339406 - RNA, 23 nt, Human
ggauuacaagcgugagccacugc

SEQ ID NO: 3339407 - RNA, 22 nt, Human
ggaucccucauccucauaccca

SEQ ID NO: 3339408 - RNA, 13 nt, Human
ggaucccucaucc

SEQ ID NO: 3339409 - RNA, 17 nt, Human
ggaucccucauccucau

SEQ ID NO: 3339410 - RNA, 23 nt, Human
ggagugaguugauagcacagacc

SEQ ID NO: 3339411 - RNA, 12 nt, Human
ggagugcaguga

SEQ ID NO: 3339412 - RNA, 14 nt, Human
ggagugcagugagc

SEQ ID NO: 3339413 - RNA, 18 nt, Human
ggauacaaaagcauguga

SEQ ID NO: 3339414 - RNA, 12 nt, Human
ggauccuccagg

SEQ ID NO: 3339415 - RNA, 13 nt, Human
ggauccuccaggu

SEQ ID NO: 3339416 - RNA, 23 nt, Human
ggaugcacagaguuguuacauuu

SEQ ID NO: 3339417 - RNA, 21 nt, Human
ggaugauuggaggggggaggu

SEQ ID NO: 3339418 - RNA, 16 nt, Human
ggaugcagccucacag

SEQ ID NO: 3339419 - RNA, 17 nt, Human
ggaugcagccucacagu

SEQ ID NO: 3339420 - RNA, 21 nt, Human
ggaugccugguggcagcugcg

SEQ ID NO: 3339421 - RNA, 19 nt, Human
ggaugcagccucacagucc

SEQ ID NO: 3339422 - RNA, 15 nt, Human
ggaugcuuguacaua

SEQ ID NO: 3339423 - RNA, 19 nt, Human
ggauuacaagcgugagcca

SEQ ID NO: 3339424 - RNA, 13 nt, Human
ggcccugccuccu

SEQ ID NO: 3339425 - RNA, 14 nt, Human
ggcccugccuccuu

SEQ ID NO: 3339426 - RNA, 15 nt, Human
ggcccugccuccuuu

SEQ ID NO: 3339427 - RNA, 21 nt, Human
ggcccucugcccacucccugc

SEQ ID NO: 3339428 - RNA, 19 nt, Human
ggcccucugcccacucccu

SEQ ID NO: 3339429 - RNA, 20 nt, Human
ggcccucugcccacucccug

SEQ ID NO: 3339430 - RNA, 13 nt, Human
ggcccucugccca

SEQ ID NO: 3339431 - RNA, 15 nt, Human
ggcccucugcccacu

SEQ ID NO: 3339432 - RNA, 16 nt, Human
ggcccucugcccacuc

SEQ ID NO: 3339433 - RNA, 17 nt, Human
ggcccucugcccacucc

SEQ ID NO: 3339434 - RNA, 11 nt, Human
ggcccagagag

SEQ ID NO: 3339435 - RNA, 13 nt, Human
ggccucugcacuc

SEQ ID NO: 3339436 - RNA, 14 nt, Human
ggccucugcacucc

SEQ ID NO: 3339437 - RNA, 15 nt, Human
ggccucugcacuccc

SEQ ID NO: 3339438 - RNA, 18 nt, Human
ggccucuuaugggcuggg

SEQ ID NO: 3339439 - RNA, 17 nt, Human
ggccucuuaugggcugg

SEQ ID NO: 3339440 - RNA, 23 nt, Human
ggccuagcauacguacacauuuu

SEQ ID NO: 3339441 - RNA, 18 nt, Human
ggcgcugccccuggcagc

SEQ ID NO: 3339442 - RNA, 19 nt, Human
ggcgcugccccuggcagcc

SEQ ID NO: 3339443 - RNA, 21 nt, Human
ggcgcugccccuggcagcccc

SEQ ID NO: 3339444 - RNA, 23 nt, Human
ggcgcugccccuggcagccccug

SEQ ID NO: 3339445 - RNA, 20 nt, Human
ggccugggggcugggcagag

SEQ ID NO: 3339446 - RNA, 14 nt, Human
ggccugggggcugg

SEQ ID NO: 3339447 - RNA, 19 nt, Human
ggccuggccugagcuggga

SEQ ID NO: 3339448 - RNA, 18 nt, Human
ggcuccaggagcagccac

SEQ ID NO: 3339449 - RNA, 15 nt, Human
ggcuccaggcuccuu

SEQ ID NO: 3339450 - RNA, 16 nt, Human
ggcuccaggcuccuuu

SEQ ID NO: 3339451 - RNA, 19 nt, Human
ggcuccaggagcagccaca

SEQ ID NO: 3339452 - RNA, 12 nt, Human
ggcuccaggagc

SEQ ID NO: 3339453 - RNA, 21 nt, Human
ggcucaaguccucuuuucuga

SEQ ID NO: 3339454 - RNA, 15 nt, Human
ggcucaaguccucuu

SEQ ID NO: 3339455 - RNA, 22 nt, Human
ggcuagagguucaaagauauuu

SEQ ID NO: 3339456 - RNA, 17 nt, Human
ggcuagagguucaaaga

SEQ ID NO: 3339457 - RNA, 16 nt, Human
ggcuagagguucaaag

SEQ ID NO: 3339458 - RNA, 16 nt, Human
ggcuaggaccccucca

SEQ ID NO: 3339459 - RNA, 22 nt, Human
ggcuaggaccccuccauguggg

SEQ ID NO: 3339460 - RNA, 23 nt, Human
ggcuagugugguguuuccuggca

SEQ ID NO: 3339461 - RNA, 15 nt, Human
ggcuaguugggcuuc

SEQ ID NO: 3339462 - RNA, 14 nt, Human
ggcuaugcauuuga

SEQ ID NO: 3339463 - RNA, 16 nt, Human
ggcuaguugggcuucc

SEQ ID NO: 3339464 - RNA, 15 nt, Human
ggcuaugcauuugaa

SEQ ID NO: 3339465 - RNA, 23 nt, Human
gcuccaggcuccuuuagcgccca

SEQ ID NO: 3339466 - RNA, 16 nt, Human
gcuccaggcuccuuua

SEQ ID NO: 3339467 - RNA, 11 nt, Human
gcuccagcugu

SEQ ID NO: 3339468 - RNA, 13 nt, Human
gcuccaggcuccu

SEQ ID NO: 3339469 - RNA, 16 nt, Human
gcuccaagcucccagg

SEQ ID NO: 3339470 - RNA, 17 nt, Human
gcuccaagcucccaggc

SEQ ID NO: 3339471 - RNA, 18 nt, Human
gcuccaagcucccaggca

SEQ ID NO: 3339472 - RNA, 19 nt, Human
gcuccaagcucccaggcau

SEQ ID NO: 3339473 - RNA, 21 nt, Human
gcuccaagcucccaggcauuc

SEQ ID NO: 3339474 - RNA, 21 nt, Human
gcuccagcucaccagccccag

SEQ ID NO: 3339475 - RNA, 14 nt, Human
gcuccaagcuccca

SEQ ID NO: 3339476 - RNA, 15 nt, Human
gcuccaagcucccag

SEQ ID NO: 3339477 - RNA, 13 nt, Human
gcuccaagcuccc

SEQ ID NO: 3339478 - RNA, 19 nt, Human
gcucaggugucccugcacu

SEQ ID NO: 3339479 - RNA, 17 nt, Human
gcucaggugucccugca

SEQ ID NO: 3339480 - RNA, 18 nt, Human
gcucaggugucccugcac

SEQ ID NO: 3339481 - RNA, 21 nt, Human
gcucagcggggacagcuccuu

SEQ ID NO: 3339482 - RNA, 15 nt, Human
gcucagcggggacag

SEQ ID NO: 3339483 - RNA, 19 nt, Human
gcucagcggggacagcucc

SEQ ID NO: 3339484 - RNA, 20 nt, Human
gcucagcggggacagcuccu

SEQ ID NO: 3339485 - RNA, 17 nt, Human
gcucagcaaaagaugcu

SEQ ID NO: 3339486 - RNA, 20 nt, Human
gcucagcaaaagaugcuucu

SEQ ID NO: 3339487 - RNA, 22 nt, Human
gcucagcaaaagaugcuucuca

SEQ ID NO: 3339488 - RNA, 23 nt, Human
gcucagcaaaagaugcuucucac

SEQ ID NO: 3339489 - RNA, 23 nt, Human
gcucaccagccccagugcccaca

SEQ ID NO: 3339490 - RNA, 20 nt, Human
gcucaccagccccagugccc

SEQ ID NO: 3339491 - RNA, 19 nt, Human
gcucaccagccccagugcc

SEQ ID NO: 3339492 - RNA, 18 nt, Human
gcucaccagccccagugc

SEQ ID NO: 3339493 - RNA, 16 nt, Human
gcgguccacccaggag

SEQ ID NO: 3339494 - RNA, 15 nt, Human
gcgggcuuccuccug

SEQ ID NO: 3339495 - RNA, 12 nt, Human
gcggggacagcu

SEQ ID NO: 3339496 - RNA, 19 nt, Human
gcgguccacccaggagccc

SEQ ID NO: 3339497 - RNA, 18 nt, Human
gcgguccacccaggagcc

SEQ ID NO: 3339498 - RNA, 23 nt, Human
gcgugagccacugcaccgggcca

SEQ ID NO: 3339499 - RNA, 18 nt, Human
gcgugagccacugcaccg

SEQ ID NO: 3339500 - RNA, 16 nt, Human
gcgugagccacugcac

SEQ ID NO: 3339501 - RNA, 21 nt, Human
gcuaagagggagggagggcuc

SEQ ID NO: 3339502 - RNA, 22 nt, Human
gcuaagagggagggagggcucc

SEQ ID NO: 3339503 - RNA, 13 nt, Human
gcuaaaugugaau

SEQ ID NO: 3339504 - RNA, 16 nt, Human
gcuaaaugugaaugau

SEQ ID NO: 3339505 - RNA, 16 nt, Human
gcuaucucccccagcc

SEQ ID NO: 3339506 - RNA, 17 nt, Human
gcuaucucccccagccc

SEQ ID NO: 3339507 - RNA, 18 nt, Human
gcuaucucccccagcccc

SEQ ID NO: 3339508 - RNA, 22 nt, Human
gcuagcagcagggagggcuucu

SEQ ID NO: 3339509 - RNA, 19 nt, Human
gcuaucucccccagcccca

SEQ ID NO: 3339510 - RNA, 20 nt, Human
gcuaucucccccagccccau

SEQ ID NO: 3339511 - RNA, 21 nt, Human
gcuaucucccccagccccauc

SEQ ID NO: 3339512 - RNA, 22 nt, Human
gcuaucucccccagccccaucc

SEQ ID NO: 3339513 - RNA, 23 nt, Human
gcuaucucccccagccccauccu

SEQ ID NO: 3339514 - RNA, 15 nt, Human
gcuaucucccccagc

SEQ ID NO: 3339515 - RNA, 19 nt, Human
gcuagagguucaaagauau

SEQ ID NO: 3339516 - RNA, 21 nt, Human
gcuagagguucaaagauauuu

SEQ ID NO: 3339517 - RNA, 18 nt, Human
gcuagagguucaaagaua

SEQ ID NO: 3339518 - RNA, 21 nt, Human
gcuacccgggaagggggcugg

SEQ ID NO: 3339519 - RNA, 20 nt, Human
gcuaccuuuguauucucucc

SEQ ID NO: 3339520 - RNA, 14 nt, Human
gcuacccgggaagg

SEQ ID NO: 3339521 - RNA, 15 nt, Human
gcuacccgggaaggg

SEQ ID NO: 3339522 - RNA, 23 nt, Human
gcuaagagggagggagggcucca

SEQ ID NO: 3339523 - RNA, 16 nt, Human
gcucuucuccaggcug

SEQ ID NO: 3339524 - RNA, 14 nt, Human
gcucuucuccaggc

SEQ ID NO: 3339525 - RNA, 19 nt, Human
gcucuuccaggcugggaga

SEQ ID NO: 3339526 - RNA, 18 nt, Human
gcucuuccaggcugggag

SEQ ID NO: 3339527 - RNA, 12 nt, Human
gcucuucuccag

SEQ ID NO: 3339528 - RNA, 22 nt, Human
gcucuuccaggcugggagagcc

SEQ ID NO: 3339529 - RNA, 20 nt, Human
gcugacagacacaggcccgg

SEQ ID NO: 3339530 - RNA, 21 nt, Human
gcugacagacacaggcccggc

SEQ ID NO: 3339531 - RNA, 18 nt, Human
gcugauggugcaaugacc

SEQ ID NO: 3339532 - RNA, 21 nt, Human
gcugauggugcaaugaccuuu

SEQ ID NO: 3339533 - RNA, 18 nt, Human
gcugcaguugccagucac

SEQ ID NO: 3339534 - RNA, 20 nt, Human
gcugcaguugccagucaccc

SEQ ID NO: 3339535 - RNA, 21 nt, Human
gcugcaguugccagucacccc

SEQ ID NO: 3339536 - RNA, 17 nt, Human
gcugcaguugccaguca

SEQ ID NO: 3339537 - RNA, 19 nt, Human
gcugagucugaaggcuggg

SEQ ID NO: 3339538 - RNA, 16 nt, Human
gcugagucugaaggcu

SEQ ID NO: 3339539 - RNA, 18 nt, Human
gcugagucugaaggcugg

SEQ ID NO: 3339540 - RNA, 15 nt, Human
gcugagucugaaggc

SEQ ID NO: 3339541 - RNA, 15 nt, Human
gcugauggugcaaug

SEQ ID NO: 3339542 - RNA, 16 nt, Human
gcugauggugcaauga

SEQ ID NO: 3339543 - RNA, 22 nt, Human
gcugagugggggaucacagccu

SEQ ID NO: 3339544 - RNA, 23 nt, Human
gcugagugggggaucacagccuc

SEQ ID NO: 3339545 - RNA, 23 nt, Human
gcucugcugacagacacaggccc

SEQ ID NO: 3339546 - RNA, 20 nt, Human
gcucugcugacagacacagg

SEQ ID NO: 3339547 - RNA, 19 nt, Human
gcucugcugacagacacag

SEQ ID NO: 3339548 - RNA, 18 nt, Human
gcucugcugacagacaca

SEQ ID NO: 3339549 - RNA, 14 nt, Human
gcucugcugacaga

SEQ ID NO: 3339550 - RNA, 13 nt, Human
gcucugcugacag

SEQ ID NO: 3339551 - RNA, 21 nt, Human
gcucugcuccucuccccagca

SEQ ID NO: 3339552 - RNA, 19 nt, Human
gcucugcuccucuccccag

SEQ ID NO: 3339553 - RNA, 22 nt, Human
gcucuggacaggcauguucucu

SEQ ID NO: 3339554 - RNA, 21 nt, Human
gcucuggacaggcauguucuc

SEQ ID NO: 3339555 - RNA, 16 nt, Human
gcucuggacaggcaug

SEQ ID NO: 3339556 - RNA, 15 nt, Human
gcucuggacaggcau

SEQ ID NO: 3339557 - RNA, 14 nt, Human
gcucuggacaggca

SEQ ID NO: 3339558 - RNA, 13 nt, Human
gcucugccuccca

SEQ ID NO: 3339559 - RNA, 14 nt, Human
gcucugccucccau

SEQ ID NO: 3339560 - RNA, 15 nt, Human
gcucugccucccauc

SEQ ID NO: 3339561 - RNA, 22 nt, Human
gcucugccucccaucacccgcu

SEQ ID NO: 3339562 - RNA, 14 nt, Human
gcucugcuccucuc

SEQ ID NO: 3339563 - RNA, 13 nt, Human
gcucugcuccucu

SEQ ID NO: 3339564 - RNA, 23 nt, Human
gcucugcccuugguuaggcauug

SEQ ID NO: 3339565 - RNA, 11 nt, Human
gcucugccucc

SEQ ID NO: 3339566 - RNA, 13 nt, Human
gcucugcccuugg

SEQ ID NO: 3339567 - RNA, 14 nt, Human
gcucugcccuuggu

SEQ ID NO: 3339568 - RNA, 21 nt, Human
gcuccuucuguccuacucugu

SEQ ID NO: 3339569 - RNA, 15 nt, Human
gcuccuucuguccua

SEQ ID NO: 3339570 - RNA, 16 nt, Human
gcucccuucccaccuc

SEQ ID NO: 3339571 - RNA, 18 nt, Human
gcucccuucccaccucuc

SEQ ID NO: 3339572 - RNA, 15 nt, Human
gcucccuucccaccu

SEQ ID NO: 3339573 - RNA, 16 nt, Human
gcucgagcaugccugg

SEQ ID NO: 3339574 - RNA, 17 nt, Human
gcucuccgaccagacac

SEQ ID NO: 3339575 - RNA, 13 nt, Human
gcucuccgaccag

SEQ ID NO: 3339576 - RNA, 19 nt, Human
gcucuccgaccagacaccu

SEQ ID NO: 3339577 - RNA, 16 nt, Human
gcccugagcuuucugc

SEQ ID NO: 3339578 - RNA, 14 nt, Human
gcccugagcuuucu

SEQ ID NO: 3339579 - RNA, 18 nt, Human
gcccggcuccaggcuccu

SEQ ID NO: 3339580 - RNA, 17 nt, Human
gcccggcuccaggcucc

SEQ ID NO: 3339581 - RNA, 15 nt, Human
gcagacucuacagag

SEQ ID NO: 3339582 - RNA, 21 nt, Human
gccccuguucuggcagaguug

SEQ ID NO: 3339583 - RNA, 17 nt, Human
gccccuguucuggcaga

SEQ ID NO: 3339584 - RNA, 15 nt, Human
gccccugccacccug

SEQ ID NO: 3339585 - RNA, 14 nt, Human
gccccugccacccu

SEQ ID NO: 3339586 - RNA, 13 nt, Human
gccccugccaccc

SEQ ID NO: 3339587 - RNA, 16 nt, Human
gcccggcuccaggcuc

SEQ ID NO: 3339588 - RNA, 15 nt, Human
gcccggcuccaggcu

SEQ ID NO: 3339589 - RNA, 18 nt, Human
gcccuucucuccagcccc

SEQ ID NO: 3339590 - RNA, 19 nt, Human
gcccuucucuccagccccu

SEQ ID NO: 3339591 - RNA, 21 nt, Human
gcccuucucuccagccccugg

SEQ ID NO: 3339592 - RNA, 22 nt, Human
gcccuucucuccagccccugga

SEQ ID NO: 3339593 - RNA, 18 nt, Human
gccgagauugcaccacug

SEQ ID NO: 3339594 - RNA, 17 nt, Human
gccgagauugcaccacu

SEQ ID NO: 3339595 - RNA, 18 nt, Human
gccgagaucacgccacug

SEQ ID NO: 3339596 - RNA, 16 nt, Human
gccgagaucacgccac

SEQ ID NO: 3339597 - RNA, 23 nt, Human
gcccugguggcagugggagcugc

SEQ ID NO: 3339598 - RNA, 22 nt, Human
gcccugguggcagugggagcug

SEQ ID NO: 3339599 - RNA, 21 nt, Human
gcccugguggcagugggagcu

SEQ ID NO: 3339600 - RNA, 20 nt, Human
gcccugguggcagugggagc

SEQ ID NO: 3339601 - RNA, 19 nt, Human
gcccugguggcagugggag

SEQ ID NO: 3339602 - RNA, 18 nt, Human
gcccugguggcaguggga

SEQ ID NO: 3339603 - RNA, 17 nt, Human
gcccugguggcaguggg

SEQ ID NO: 3339604 - RNA, 14 nt, Human
gcccugguggcagu

SEQ ID NO: 3339605 - RNA, 22 nt, Human
gccuggccagaugcaccagccc

SEQ ID NO: 3339606 - RNA, 15 nt, Human
gccuggccagaugca

SEQ ID NO: 3339607 - RNA, 14 nt, Human
gccuggccagaugc

SEQ ID NO: 3339608 - RNA, 15 nt, Human
gccugggcagaagga

SEQ ID NO: 3339609 - RNA, 15 nt, Human
gccuggauggggcug

SEQ ID NO: 3339610 - RNA, 14 nt, Human
gccuggauggggcu

SEQ ID NO: 3339611 - RNA, 11 nt, Human
gccugggcaga

SEQ ID NO: 3339612 - RNA, 16 nt, Human
gccugggcagaaggaa

SEQ ID NO: 3339613 - RNA, 17 nt, Human
gccugggcagaaggaag

SEQ ID NO: 3339614 - RNA, 20 nt, Human
gccugggggcugggcagagg

SEQ ID NO: 3339615 - RNA, 18 nt, Human
gccucugccucugacaca

SEQ ID NO: 3339616 - RNA, 22 nt, Human
gccugaagucacacagugaguc

SEQ ID NO: 3339617 - RNA, 18 nt, Human
gccugaagucacacagug

SEQ ID NO: 3339618 - RNA, 16 nt, Human
gccugcuccagcuguu

SEQ ID NO: 3339619 - RNA, 18 nt, Human
gccugcuccagcuguuca

SEQ ID NO: 3339620 - RNA, 13 nt, Human
gccugcuccagcu

SEQ ID NO: 3339621 - RNA, 15 nt, Human
gccugcuccagcugu

SEQ ID NO: 3339622 - RNA, 15 nt, Human
gccucccgaguagcu

SEQ ID NO: 3339623 - RNA, 23 nt, Human
gccucccgaauagcugggacuac

SEQ ID NO: 3339624 - RNA, 21 nt, Human
gccucccaacucaccccagcc

SEQ ID NO: 3339625 - RNA, 15 nt, Human
gccucagugccacua

SEQ ID NO: 3339626 - RNA, 22 nt, Human
gccucccaacucaccccagccc

SEQ ID NO: 3339627 - RNA, 23 nt, Human
gccucccaacucaccccagcccc

SEQ ID NO: 3339628 - RNA, 21 nt, Human
gccucccacgacugcccggca

SEQ ID NO: 3339629 - RNA, 14 nt, Human
gccucccacgacug

SEQ ID NO: 3339630 - RNA, 21 nt, Human
gccucccgaauagcugggacu

SEQ ID NO: 3339631 - RNA, 21 nt, Human
gccucacaguccuuaccagca

SEQ ID NO: 3339632 - RNA, 22 nt, Human
gccucagccucccaaagugcug

SEQ ID NO: 3339633 - RNA, 23 nt, Human
gccucagccucccaaagugcugg

SEQ ID NO: 3339634 - RNA, 14 nt, Human
gccucagugccacu

SEQ ID NO: 3339635 - RNA, 12 nt, Human
gccucagugcca

SEQ ID NO: 3339636 - RNA, 21 nt, Human
gccucaagugauucuccugcc

SEQ ID NO: 3339637 - RNA, 20 nt, Human
gccucaagugauucuccugc

SEQ ID NO: 3339638 - RNA, 19 nt, Human
gccucaagugauucuccug

SEQ ID NO: 3339639 - RNA, 16 nt, Human
gccucaaccuccuggg

SEQ ID NO: 3339640 - RNA, 14 nt, Human
gccucaaccuccug

SEQ ID NO: 3339641 - RNA, 19 nt, Human
gccgagauagccaaggcca

SEQ ID NO: 3339642 - RNA, 12 nt, Human
gccuaaguauua

SEQ ID NO: 3339643 - RNA, 14 nt, Human
gccuaaguauuaaa

SEQ ID NO: 3339644 - RNA, 18 nt, Human
gccuaaguauuaaaacau

SEQ ID NO: 3339645 - RNA, 15 nt, Human
gacucauucuucugu

SEQ ID NO: 3339646 - RNA, 14 nt, Human
gacucauucuucug

SEQ ID NO: 3339647 - RNA, 21 nt, Human
gacuacaggugugagucacca

SEQ ID NO: 3339648 - RNA, 18 nt, Human
gacuacaggugugaguca

SEQ ID NO: 3339649 - RNA, 13 nt, Human
gacuacaggugug

SEQ ID NO: 3339650 - RNA, 12 nt, Human
gacuccugcagg

SEQ ID NO: 3339651 - RNA, 13 nt, Human
gacuccugcaggc

SEQ ID NO: 3339652 - RNA, 21 nt, Human
gacuccugcaggcagccaggc

SEQ ID NO: 3339653 - RNA, 13 nt, Human
gacucgcgacaau

SEQ ID NO: 3339654 - RNA, 18 nt, Human
gacuggaagcacagcuuc

SEQ ID NO: 3339655 - RNA, 16 nt, Human
gacuggaagcacagcu

SEQ ID NO: 3339656 - RNA, 15 nt, Human
gacuggaagcacagc

SEQ ID NO: 3339657 - RNA, 14 nt, Human
gacuggaagcacag

SEQ ID NO: 3339658 - RNA, 17 nt, Human
gacucgcgacaaugcaa

SEQ ID NO: 3339659 - RNA, 21 nt, Human
gacugaguacguugugcauuu

SEQ ID NO: 3339660 - RNA, 22 nt, Human
gacugaguacguugugcauuug

SEQ ID NO: 3339661 - RNA, 18 nt, Human
gacugaguacguugugca

SEQ ID NO: 3339662 - RNA, 15 nt, Human
gacugcccggcaggg

SEQ ID NO: 3339663 - RNA, 13 nt, Human
gacugcccggcag

SEQ ID NO: 3339664 - RNA, 23 nt, Human
gacugaguacguugugcauuugg

SEQ ID NO: 3339665 - RNA, 19 nt, Human
gacuuaagcacacuugaca

SEQ ID NO: 3339666 - RNA, 16 nt, Human
gagaagagaaugcaca

SEQ ID NO: 3339667 - RNA, 16 nt, Human
gagaagcagaggaagg

SEQ ID NO: 3339668 - RNA, 14 nt, Human
gagaagagaaugca

SEQ ID NO: 3339669 - RNA, 16 nt, Human
gagaaagguugaagca

SEQ ID NO: 3339670 - RNA, 14 nt, Human
gagaaaugagcuug

SEQ ID NO: 3339671 - RNA, 19 nt, Human
gagccagggucucacuaug

SEQ ID NO: 3339672 - RNA, 23 nt, Human
gagccagauuucacucuccuugg

SEQ ID NO: 3339673 - RNA, 14 nt, Human
gagccagggucuca

SEQ ID NO: 3339674 - RNA, 18 nt, Human
gagcccugguggcagugg

SEQ ID NO: 3339675 - RNA, 19 nt, Human
gagccaauuuaaagaaaac

SEQ ID NO: 3339676 - RNA, 20 nt, Human
gagccagauuucacucuccu

SEQ ID NO: 3339677 - RNA, 12 nt, Human
gagcagagacca

SEQ ID NO: 3339678 - RNA, 16 nt, Human
gagcagagaauucucu

SEQ ID NO: 3339679 - RNA, 21 nt, Human
gagcaccuuagacagucccug

SEQ ID NO: 3339680 - RNA, 22 nt, Human
gagcaccuuagacagucccugc

SEQ ID NO: 3339681 - RNA, 15 nt, Human
gagcacuaaggugug

SEQ ID NO: 3339682 - RNA, 19 nt, Human
gagcaccuuagacaguccc

SEQ ID NO: 3339683 - RNA, 21 nt, Human
gagcacuaaggugugcucuga

SEQ ID NO: 3339684 - RNA, 20 nt, Human
gagcaccuuagacagucccu

SEQ ID NO: 3339685 - RNA, 23 nt, Human
gagcaagacgcugugcugcccug

SEQ ID NO: 3339686 - RNA, 16 nt, Human
gagauagccaaggcca

SEQ ID NO: 3339687 - RNA, 23 nt, Human
gagaucaaccccuucgcuccugu

SEQ ID NO: 3339688 - RNA, 14 nt, Human
gagauagccaaggc

SEQ ID NO: 3339689 - RNA, 18 nt, Human
gagaucacgccacugcac

SEQ ID NO: 3339690 - RNA, 19 nt, Human
gagaucacgccacugcacu

SEQ ID NO: 3339691 - RNA, 14 nt, Human
gagagggugggagu

SEQ ID NO: 3339692 - RNA, 16 nt, Human
gagagggugggagugg

SEQ ID NO: 3339693 - RNA, 13 nt, Human
gagaggggcacag

SEQ ID NO: 3339694 - RNA, 18 nt, Human
gagaggggaacagacugg

SEQ ID NO: 3339695 - RNA, 19 nt, Human
gagaggggaacagacugga

SEQ ID NO: 3339696 - RNA, 19 nt, Human
gagagagaaacaaacuuuu

SEQ ID NO: 3339697 - RNA, 20 nt, Human
gagacucgcgacaaugcaaa

SEQ ID NO: 3339698 - RNA, 21 nt, Human
gagacucgcgacaaugcaaac

SEQ ID NO: 3339699 - RNA, 18 nt, Human
gagacucgcgacaaugca

SEQ ID NO: 3339700 - RNA, 20 nt, Human
gagacuccugcaggcagcca

SEQ ID NO: 3339701 - RNA, 21 nt, Human
gagacuccugcaggcagccag

SEQ ID NO: 3339702 - RNA, 19 nt, Human
gagacuccugcaggcagcc

SEQ ID NO: 3339703 - RNA, 18 nt, Human
gagacuccugcaggcagc

SEQ ID NO: 3339704 - RNA, 13 nt, Human
gagagaaacaaac

SEQ ID NO: 3339705 - RNA, 18 nt, Human
gagaccaucccugaaggc

SEQ ID NO: 3339706 - RNA, 21 nt, Human
gagaccaucccugaaggcccc

SEQ ID NO: 3339707 - RNA, 14 nt, Human
gagaccaucccuga

SEQ ID NO: 3339708 - RNA, 12 nt, Human
gagaccaucccu

SEQ ID NO: 3339709 - RNA, 22 nt, Human
gagacaggguuuugccauguug

SEQ ID NO: 3339710 - RNA, 23 nt, Human
gagaaugcacaaacagaggccgc

SEQ ID NO: 3339711 - RNA, 22 nt, Human
gagaaugcacaaacagaggccg

SEQ ID NO: 3339712 - RNA, 22 nt, Human
gaauuucuuuugccguuauuaa

SEQ ID NO: 3339713 - RNA, 22 nt, Human
gacaacacucauugaccugagg

SEQ ID NO: 3339714 - RNA, 23 nt, Human
gacaacacucauugaccugaggc

SEQ ID NO: 3339715 - RNA, 12 nt, Human
gacaaugugaaa

SEQ ID NO: 3339716 - RNA, 18 nt, Human
gacaaugugaaaagaaaa

SEQ ID NO: 3339717 - RNA, 22 nt, Human
gacaaugcaaaccaucauugaa

SEQ ID NO: 3339718 - RNA, 19 nt, Human
gacaaugugaaaagaaaaa

SEQ ID NO: 3339719 - RNA, 20 nt, Human
gacaaugugaaaagaaaaau

SEQ ID NO: 3339720 - RNA, 19 nt, Human
gacaaggauugcuacuguc

SEQ ID NO: 3339721 - RNA, 18 nt, Human
gacaaugcaaaccaucau

SEQ ID NO: 3339722 - RNA, 21 nt, Human
gacaaggaugaucuaggaaga

SEQ ID NO: 3339723 - RNA, 18 nt, Human
gacaaggauugcuacugu

SEQ ID NO: 3339724 - RNA, 19 nt, Human
gacacaugcaaggucauuu

SEQ ID NO: 3339725 - RNA, 15 nt, Human
gacacauguccaaga

SEQ ID NO: 3339726 - RNA, 20 nt, Human
gacacauguccaagaagccc

SEQ ID NO: 3339727 - RNA, 23 nt, Human
gacacauguccaagaagcccagg

SEQ ID NO: 3339728 - RNA, 21 nt, Human
gacacaggcccggcuccaggc

SEQ ID NO: 3339729 - RNA, 20 nt, Human
gacacaggcccggcuccagg

SEQ ID NO: 3339730 - RNA, 14 nt, Human
gacacaugcaaggu

SEQ ID NO: 3339731 - RNA, 16 nt, Human
gacacaagccuucggc

SEQ ID NO: 3339732 - RNA, 19 nt, Human
gacacaggcccggcuccag

SEQ ID NO: 3339733 - RNA, 21 nt, Human
gaaugcacaaacagaggccgc

SEQ ID NO: 3339734 - RNA, 20 nt, Human
gaaugcacaaacagaggccg

SEQ ID NO: 3339735 - RNA, 21 nt, Human
gaaugaaagggcccagagagg

SEQ ID NO: 3339736 - RNA, 20 nt, Human
gaauccagacccggcugcgu

SEQ ID NO: 3339737 - RNA, 18 nt, Human
gaauccagacccggcugc

SEQ ID NO: 3339738 - RNA, 14 nt, Human
gaauugaagcagga

SEQ ID NO: 3339739 - RNA, 13 nt, Human
gaccagagcugcc

SEQ ID NO: 3339740 - RNA, 14 nt, Human
gaccagagcugcca

SEQ ID NO: 3339741 - RNA, 15 nt, Human
gaccagagcugccac

SEQ ID NO: 3339742 - RNA, 17 nt, Human
gaccagagcugccaccu

SEQ ID NO: 3339743 - RNA, 18 nt, Human
gaccagagcugccaccug

SEQ ID NO: 3339744 - RNA, 21 nt, Human
gaccauucuccaccugccagg

SEQ ID NO: 3339745 - RNA, 22 nt, Human
gaccauucuccaccugccaggg

SEQ ID NO: 3339746 - RNA, 17 nt, Human
gaccauucuccaccugc

SEQ ID NO: 3339747 - RNA, 19 nt, Human
gaccauucuccaccugcca

SEQ ID NO: 3339748 - RNA, 20 nt, Human
gaccauucuccaccugccag

SEQ ID NO: 3339749 - RNA, 18 nt, Human
gacaugggaaaggggaag

SEQ ID NO: 3339750 - RNA, 11 nt, Human
gaccagagcug

SEQ ID NO: 3339751 - RNA, 24 nt, Human
gaccagacaccuugacagggcaca

SEQ ID NO: 3339752 - RNA, 14 nt, Human
gaccacguuucuaa

SEQ ID NO: 3339753 - RNA, 15 nt, Human
gaccgugaggccaga

SEQ ID NO: 3339754 - RNA, 18 nt, Human
gaccgugaggccagagac

SEQ ID NO: 3339755 - RNA, 16 nt, Human
gaccgugaggccagag

SEQ ID NO: 3339756 - RNA, 17 nt, Human
gaccgugaggccagaga

SEQ ID NO: 3339757 - RNA, 15 nt, Human
gacccuugugguccc

SEQ ID NO: 3339758 - RNA, 21 nt, Human
gacccuuguggucccacccca

SEQ ID NO: 3339759 - RNA, 19 nt, Human
gacccuuguggucccaccc

SEQ ID NO: 3339760 - RNA, 20 nt, Human
gacccuuguggucccacccc

SEQ ID NO: 3339761 - RNA, 12 nt, Human
gacccugucuca

SEQ ID NO: 3339762 - RNA, 22 nt, Human
gacccugaggcccagagggccu

SEQ ID NO: 3339763 - RNA, 21 nt, Human
gaccccuccaugugggcuagu

SEQ ID NO: 3339764 - RNA, 18 nt, Human
gaccccuccaugugggcu

SEQ ID NO: 3339765 - RNA, 14 nt, Human
gaccccuccaugug

SEQ ID NO: 3339766 - RNA, 23 nt, Human
gacccugaggcccagagggccug

SEQ ID NO: 3339767 - RNA, 13 nt, Human
gaccccuccaugu

SEQ ID NO: 3339768 - RNA, 21 nt, Human
gacagagcaagugagacccug

SEQ ID NO: 3339769 - RNA, 16 nt, Human
gacagaggcagcccca

SEQ ID NO: 3339770 - RNA, 14 nt, Human
gacagaggcagccc

SEQ ID NO: 3339771 - RNA, 12 nt, Human
gacagaggcagc

SEQ ID NO: 3339772 - RNA, 21 nt, Human
gacagaggggguggccuccca

SEQ ID NO: 3339773 - RNA, 22 nt, Human
gacagaggggguggccucccaa

SEQ ID NO: 3339774 - RNA, 19 nt, Human
gacagagugagacucuguc

SEQ ID NO: 3339775 - RNA, 23 nt, Human
gacagaggggguggccucccaac

SEQ ID NO: 3339776 - RNA, 18 nt, Human
gacagaggggguggccuc

SEQ ID NO: 3339777 - RNA, 19 nt, Human
gacagaggggguggccucc

SEQ ID NO: 3339778 - RNA, 15 nt, Human
gacagaggggguggc

SEQ ID NO: 3339779 - RNA, 17 nt, Human
gacagaggcagccccau

SEQ ID NO: 3339780 - RNA, 16 nt, Human
gacagcugccugggau

SEQ ID NO: 3339781 - RNA, 17 nt, Human
gacagcugccugggauc

SEQ ID NO: 3339782 - RNA, 21 nt, Human
gacagccacggccaggccaga

SEQ ID NO: 3339783 - RNA, 20 nt, Human
gacagccacggccaggccag

SEQ ID NO: 3339784 - RNA, 18 nt, Human
gacagcugccugggaucc

SEQ ID NO: 3339785 - RNA, 19 nt, Human
gacagccacggccaggcca

SEQ ID NO: 3339786 - RNA, 18 nt, Human
gacagccacggccaggcc

SEQ ID NO: 3339787 - RNA, 17 nt, Human
gacagccacggccaggc

SEQ ID NO: 3339788 - RNA, 14 nt, Human
gacagccacggcca

SEQ ID NO: 3339789 - RNA, 22 nt, Human
gacagagugagacucugucuca

SEQ ID NO: 3339790 - RNA, 20 nt, Human
gacagagugagacucugucu

SEQ ID NO: 3339791 - RNA, 13 nt, Human
gacagagggggug

SEQ ID NO: 3339792 - RNA, 13 nt, Human
gacagccacggcc

SEQ ID NO: 3339793 - RNA, 14 nt, Human
gacaguuaagagaa

SEQ ID NO: 3339794 - RNA, 23 nt, Human
gacagggcacaccgggcacucag

SEQ ID NO: 3339795 - RNA, 16 nt, Human
gacagggaggugaccc

SEQ ID NO: 3339796 - RNA, 15 nt, Human
gacaggaccagggau

SEQ ID NO: 3339797 - RNA, 23 nt, Human
gacaggaccagggauuuccauga

SEQ ID NO: 3339798 - RNA, 14 nt, Human
gacaggaccaggga

SEQ ID NO: 3339799 - RNA, 14 nt, Human
gacaugggaaaggg

SEQ ID NO: 3339800 - RNA, 14 nt, Human
gacaugaucuucuu

SEQ ID NO: 3339801 - RNA, 23 nt, Human
gacauacuaaccagcagaaaugc

SEQ ID NO: 3339802 - RNA, 13 nt, Human
gaguuacagacaa

SEQ ID NO: 3339803 - RNA, 15 nt, Human
gaguuacagacaaag

SEQ ID NO: 3339804 - RNA, 19 nt, Human
gaguucaucuugaauugua

SEQ ID NO: 3339805 - RNA, 14 nt, Human
gaguucaucuugaa

SEQ ID NO: 3339806 - RNA, 20 nt, Human
gaguucauacccuguuacca

SEQ ID NO: 3339807 - RNA, 15 nt, Human
gaguugaagacagag

SEQ ID NO: 3339808 - RNA, 17 nt, Human
gaguugaagacagagcu

SEQ ID NO: 3339809 - RNA, 21 nt, Human
gaguugaagacagagcuacac

SEQ ID NO: 3339810 - RNA, 14 nt, Human
gaguugaagacaga

SEQ ID NO: 3339811 - RNA, 23 nt, Human
gagugggggaucacagccucuga

SEQ ID NO: 3339812 - RNA, 13 nt, Human
gagugggugaaua

SEQ ID NO: 3339813 - RNA, 12 nt, Human
gaguuacagaca

SEQ ID NO: 3339814 - RNA, 17 nt, Human
gagugugccugaagucc

SEQ ID NO: 3339815 - RNA, 20 nt, Human
gagugugccugaagucccag

SEQ ID NO: 3339816 - RNA, 16 nt, Human
gaucacggcucacugc

SEQ ID NO: 3339817 - RNA, 15 nt, Human
gaucacggcucacug

SEQ ID NO: 3339818 - RNA, 18 nt, Human
gaucacggcucacugcag

SEQ ID NO: 3339819 - RNA, 12 nt, Human
gaucacggcuca

SEQ ID NO: 3339820 - RNA, 22 nt, Human
gauagccaaggccaaaggaagc

SEQ ID NO: 3339821 - RNA, 14 nt, Human
gauagccaaggcca

SEQ ID NO: 3339822 - RNA, 15 nt, Human
gauagcacagacccu

SEQ ID NO: 3339823 - RNA, 22 nt, Human
gauaagaaccuuuugagugccu

SEQ ID NO: 3339824 - RNA, 20 nt, Human
gauacaggaaaagcugcuga

SEQ ID NO: 3339825 - RNA, 21 nt, Human
gauacaggaaaagcugcugac

SEQ ID NO: 3339826 - RNA, 19 nt, Human
gauacaggaaaagcugcug

SEQ ID NO: 3339827 - RNA, 15 nt, Human
gagguugggaggcca

SEQ ID NO: 3339828 - RNA, 17 nt, Human
gagguugggaggccauu

SEQ ID NO: 3339829 - RNA, 16 nt, Human
gagguuucaaaccucc

SEQ ID NO: 3339830 - RNA, 20 nt, Human
gaggucagagccugcaguua

SEQ ID NO: 3339831 - RNA, 17 nt, Human
gaggucagagccugcag

SEQ ID NO: 3339832 - RNA, 20 nt, Human
gaguacuacaguccucccau

SEQ ID NO: 3339833 - RNA, 21 nt, Human
gaguacuacaguccucccauc

SEQ ID NO: 3339834 - RNA, 23 nt, Human
gaguacuacaguccucccaucuc

SEQ ID NO: 3339835 - RNA, 13 nt, Human
gaguaggaagacu

SEQ ID NO: 3339836 - RNA, 17 nt, Human
gaguaggaagacuuugg

SEQ ID NO: 3339837 - RNA, 12 nt, Human
gaguaggaagac

SEQ ID NO: 3339838 - RNA, 22 nt, Human
gaguagcugggacuacaggcac

SEQ ID NO: 3339839 - RNA, 19 nt, Human
gaguagcugggacuacagg

SEQ ID NO: 3339840 - RNA, 14 nt, Human
gagucgaggacagg

SEQ ID NO: 3339841 - RNA, 19 nt, Human
gaguccgaaagggacuugg

SEQ ID NO: 3339842 - RNA, 15 nt, Human
gagucgaggacaggg

SEQ ID NO: 3339843 - RNA, 18 nt, Human
gaguaggaagacuuugga

SEQ ID NO: 3339844 - RNA, 19 nt, Human
gaguaggaagacuuuggaa

SEQ ID NO: 3339845 - RNA, 11 nt, Human
gaguauauguc

SEQ ID NO: 3339846 - RNA, 12 nt, Human
gagucugaaggc

SEQ ID NO: 3339847 - RNA, 13 nt, Human
gagucugaaggcu

SEQ ID NO: 3339848 - RNA, 14 nt, Human
gagucugaaggcug

SEQ ID NO: 3339849 - RNA, 16 nt, Human
gagugacagaggcagc

SEQ ID NO: 3339850 - RNA, 15 nt, Human
gagugacagaggcag

SEQ ID NO: 3339851 - RNA, 14 nt, Human
gagugacagaggca

SEQ ID NO: 3339852 - RNA, 17 nt, Human
gagugaagcugggagaa

SEQ ID NO: 3339853 - RNA, 20 nt, Human
gaggcugggcucccuuccca

SEQ ID NO: 3339854 - RNA, 19 nt, Human
gagggagggcuccagacac

SEQ ID NO: 3339855 - RNA, 20 nt, Human
gagggagggcuccagacaca

SEQ ID NO: 3339856 - RNA, 16 nt, Human
gagggagggcuccaga

SEQ ID NO: 3339857 - RNA, 16 nt, Human
gagggagugacagagg

SEQ ID NO: 3339858 - RNA, 18 nt, Human
gagggagugacagaggca

SEQ ID NO: 3339859 - RNA, 22 nt, Human
gagggagugacagaggcagccc

SEQ ID NO: 3339860 - RNA, 21 nt, Human
gagggagugacagaggcagcc

SEQ ID NO: 3339861 - RNA, 13 nt, Human
gaggguaaggcug

SEQ ID NO: 3339862 - RNA, 15 nt, Human
gaggggguggccucc

SEQ ID NO: 3339863 - RNA, 17 nt, Human
gaggggguggccuccca

SEQ ID NO: 3339864 - RNA, 14 nt, Human
gagggucugaggaa

SEQ ID NO: 3339865 - RNA, 13 nt, Human
gagggucugagga

SEQ ID NO: 3339866 - RNA, 22 nt, Human
gagggugucccaaaaagaaagg

SEQ ID NO: 3339867 - RNA, 21 nt, Human
gaggguggugaccucugccug

SEQ ID NO: 3339868 - RNA, 15 nt, Human
gagggugggaguggg

SEQ ID NO: 3339869 - RNA, 14 nt, Human
gaggguggugaccu

SEQ ID NO: 3339870 - RNA, 21 nt, Human
gagggugaagugaagacaaug

SEQ ID NO: 3339871 - RNA, 12 nt, Human
gaggguggaaua

SEQ ID NO: 3339872 - RNA, 17 nt, Human
gaggucaaggcugcagu

SEQ ID NO: 3339873 - RNA, 13 nt, Human
gaggucagagccu

SEQ ID NO: 3339874 - RNA, 12 nt, Human
gaggucagagcc

SEQ ID NO: 3339875 - RNA, 21 nt, Human
gagguaaggaauaccuguccc

SEQ ID NO: 3339876 - RNA, 24 nt, Human
gagguaaggaauaccugucccccu

SEQ ID NO: 3339877 - RNA, 15 nt, Human
gaggguugggcuggu

SEQ ID NO: 3339878 - RNA, 14 nt, Human
gaggguugggcugg

SEQ ID NO: 3339879 - RNA, 13 nt, Human
gaggaucucuuga

SEQ ID NO: 3339880 - RNA, 16 nt, Human
gaggaucucuugagcc

SEQ ID NO: 3339881 - RNA, 19 nt, Human
gaggaucucuugagccugg

SEQ ID NO: 3339882 - RNA, 22 nt, Human
gaggaucucuugagccugggag

SEQ ID NO: 3339883 - RNA, 16 nt, Human
gaggauugcuugagcu

SEQ ID NO: 3339884 - RNA, 20 nt, Human
gaggauugcuugagcucagg

SEQ ID NO: 3339885 - RNA, 23 nt, Human
gaggccaugggccuccugugugu

SEQ ID NO: 3339886 - RNA, 21 nt, Human
gaggccaugggccuccugugu

SEQ ID NO: 3339887 - RNA, 20 nt, Human
gaggccaugggccuccugug

SEQ ID NO: 3339888 - RNA, 18 nt, Human
gaggccaugggccuccug

SEQ ID NO: 3339889 - RNA, 17 nt, Human
gaggccaugggccuccu

SEQ ID NO: 3339890 - RNA, 14 nt, Human
gaggccaugggccu

SEQ ID NO: 3339891 - RNA, 18 nt, Human
gaggcagccccauucugc

SEQ ID NO: 3339892 - RNA, 19 nt, Human
gaggcagccccauucugcc

SEQ ID NO: 3339893 - RNA, 9 nt, Human
gaggcaggg

SEQ ID NO: 3339894 - RNA, 20 nt, Human
gaggcagccccauucugccu

SEQ ID NO: 3339895 - RNA, 11 nt, Human
gaggcccagag

SEQ ID NO: 3339896 - RNA, 13 nt, Human
gaggcccagaggg

SEQ ID NO: 3339897 - RNA, 14 nt, Human
gaggcccagagggc

SEQ ID NO: 3339898 - RNA, 19 nt, Human
gaggcccagagggccugca

SEQ ID NO: 3339899 - RNA, 15 nt, Human
gaggcccagagggcc

SEQ ID NO: 3339900 - RNA, 16 nt, Human
gaggcccagagggccu

SEQ ID NO: 3339901 - RNA, 21 nt, Human
gaggcccuucucuccagcccc

SEQ ID NO: 3339902 - RNA, 15 nt, Human
gaggcccuucucucc

SEQ ID NO: 3339903 - RNA, 20 nt, Human
gaggcccuucucuccagccc

SEQ ID NO: 3339904 - RNA, 14 nt, Human
gaggcccuucucuc

SEQ ID NO: 3339905 - RNA, 16 nt, Human
gaggcugggcucccuu

SEQ ID NO: 3339906 - RNA, 14 nt, Human
gaggcugccucucc

SEQ ID NO: 3339907 - RNA, 19 nt, Human
gaggccuucucugaaggac

SEQ ID NO: 3339908 - RNA, 18 nt, Human
gaggccuucucugaagga

SEQ ID NO: 3339909 - RNA, 14 nt, Human
gaggccuucucuga

SEQ ID NO: 3339910 - RNA, 16 nt, Human
gaggccuucucugaag

SEQ ID NO: 3339911 - RNA, 18 nt, Human
gcacaagcuccaagcucc

SEQ ID NO: 3339912 - RNA, 15 nt, Human
gcacaagcuccaagc

SEQ ID NO: 3339913 - RNA, 17 nt, Human
gcacaagcuccaagcuc

SEQ ID NO: 3339914 - RNA, 20 nt, Human
gcacagaaaauggaagacag

SEQ ID NO: 3339915 - RNA, 20 nt, Human
gcacaccgggcacucagaag

SEQ ID NO: 3339916 - RNA, 15 nt, Human
gcacagaguuguuac

SEQ ID NO: 3339917 - RNA, 22 nt, Human
gcacagacccugcccugugggc

SEQ ID NO: 3339918 - RNA, 18 nt, Human
gcacagacccugcccugu

SEQ ID NO: 3339919 - RNA, 19 nt, Human
gcacagacccugcccugug

SEQ ID NO: 3339920 - RNA, 20 nt, Human
gcacagacccugcccugugg

SEQ ID NO: 3339921 - RNA, 21 nt, Human
gcacagacccugcccuguggg

SEQ ID NO: 3339922 - RNA, 14 nt, Human
gcacagacccugcc

SEQ ID NO: 3339923 - RNA, 15 nt, Human
gcacagacccugccc

SEQ ID NO: 3339924 - RNA, 16 nt, Human
gcacagacccugcccu

SEQ ID NO: 3339925 - RNA, 17 nt, Human
gcacagacccugcccug

SEQ ID NO: 3339926 - RNA, 21 nt, Human
gcacagaaaauggaagacagc

SEQ ID NO: 3339927 - RNA, 22 nt, Human
gcacagaaaauggaagacagcu

SEQ ID NO: 3339928 - RNA, 23 nt, Human
gcacagaaaauggaagacagcuc

SEQ ID NO: 3339929 - RNA, 14 nt, Human
gcaaugugauaaaa

SEQ ID NO: 3339930 - RNA, 14 nt, Human
gcaacucaucuuag

SEQ ID NO: 3339931 - RNA, 15 nt, Human
gcaauggcagccuug

SEQ ID NO: 3339932 - RNA, 14 nt, Human
gcaauggcagccuu

SEQ ID NO: 3339933 - RNA, 14 nt, Human
gcacaaacagaggc

SEQ ID NO: 3339934 - RNA, 15 nt, Human
gcacaaacagaggcc

SEQ ID NO: 3339935 - RNA, 16 nt, Human
gcacaaacagaggccg

SEQ ID NO: 3339936 - RNA, 12 nt, Human
gcaccauaacuu

SEQ ID NO: 3339937 - RNA, 20 nt, Human
gcaccuuagacagucccugc

SEQ ID NO: 3339938 - RNA, 21 nt, Human
gcaccuuagacagucccugcc

SEQ ID NO: 3339939 - RNA, 13 nt, Human
gcacgauuucugu

SEQ ID NO: 3339940 - RNA, 15 nt, Human
gcacgauuucuguuu

SEQ ID NO: 3339941 - RNA, 19 nt, Human
gcaccuuagacagucccug

SEQ ID NO: 3339942 - RNA, 16 nt, Human
gcacagaguuguuaca

SEQ ID NO: 3339943 - RNA, 18 nt, Human
gcacagaguuguuacauu

SEQ ID NO: 3339944 - RNA, 19 nt, Human
gcacagaguuguuacauuu

SEQ ID NO: 3339945 - RNA, 21 nt, Human
gcacagaguuguuacauuuuu

SEQ ID NO: 3339946 - RNA, 22 nt, Human
gcacagaguuguuacauuuuua

SEQ ID NO: 3339947 - RNA, 18 nt, Human
gcagacaggaccagggau

SEQ ID NO: 3339948 - RNA, 12 nt, Human
gcagacaggcaa

SEQ ID NO: 3339949 - RNA, 13 nt, Human
gcagacaggcaag

SEQ ID NO: 3339950 - RNA, 18 nt, Human
gcagaaggaagacuucau

SEQ ID NO: 3339951 - RNA, 16 nt, Human
gcacgauuucuguuua

SEQ ID NO: 3339952 - RNA, 23 nt, Human
gcacugcuuccagugaggcucug

SEQ ID NO: 3339953 - RNA, 22 nt, Human
gcacugcuuccagugaggcucu

SEQ ID NO: 3339954 - RNA, 12 nt, Human
gcaaaccaucau

SEQ ID NO: 3339955 - RNA, 21 nt, Human
gauuuugaaauuuuuauuaaa

SEQ ID NO: 3339956 - RNA, 19 nt, Human
gauuuugauccaagcuggu

SEQ ID NO: 3339957 - RNA, 13 nt, Human
gauuuaacagaaa

SEQ ID NO: 3339958 - RNA, 14 nt, Human
gauuuaacagaaau

SEQ ID NO: 3339959 - RNA, 12 nt, Human
gauuuaaaucag

SEQ ID NO: 3339960 - RNA, 15 nt, Human
gauuuaacagaaaug

SEQ ID NO: 3339961 - RNA, 22 nt, Human
gauuuccguuaaaauaccagcc

SEQ ID NO: 3339962 - RNA, 18 nt, Human
gauuuccguuaaaauacc

SEQ ID NO: 3339963 - RNA, 24 nt, Human
gauggggcccugccuccuuuguga

SEQ ID NO: 3339964 - RNA, 21 nt, Human
gaugggcaacccccagccugc

SEQ ID NO: 3339965 - RNA, 20 nt, Human
gaugggcaacccccagccug

SEQ ID NO: 3339966 - RNA, 15 nt, Human
gauggggcugcaccg

SEQ ID NO: 3339967 - RNA, 13 nt, Human
gauggggcugcac

SEQ ID NO: 3339968 - RNA, 19 nt, Human
gaugggugcuuggaggaag

SEQ ID NO: 3339969 - RNA, 19 nt, Human
gaugcccaaagaugcagcc

SEQ ID NO: 3339970 - RNA, 20 nt, Human
gaugcccaaagaugcagccg

SEQ ID NO: 3339971 - RNA, 15 nt, Human
gauggugcaaugacc

SEQ ID NO: 3339972 - RNA, 16 nt, Human
gauggugcaaugaccu

SEQ ID NO: 3339973 - RNA, 12 nt, Human
gauggugcaaug

SEQ ID NO: 3339974 - RNA, 14 nt, Human
gauggugcaaugac

SEQ ID NO: 3339975 - RNA, 21 nt, Human
gauuacaagcgugagccacug

SEQ ID NO: 3339976 - RNA, 23 nt, Human
gauuacaagcgugagccacugca

SEQ ID NO: 3339977 - RNA, 15 nt, Human
gauuaaacuuaaucu

SEQ ID NO: 3339978 - RNA, 22 nt, Human
gauuacaagcgugagccacugc

SEQ ID NO: 3339979 - RNA, 23 nt, Human
gauguuuuccaugaguccccugu

SEQ ID NO: 3339980 - RNA, 22 nt, Human
cuuuaccuuuuuuauacauaaa

SEQ ID NO: 3339981 - RNA, 13 nt, Human
cuuuacuauggcc

SEQ ID NO: 3339982 - RNA, 15 nt, Human
cuuuaugcacaaaau

SEQ ID NO: 3339983 - RNA, 19 nt, Human
cuuuauaauucuacuuuga

SEQ ID NO: 3339984 - RNA, 13 nt, Human
cuuuauaauucua

SEQ ID NO: 3339985 - RNA, 14 nt, Human
cuuuagcgcccagu

SEQ ID NO: 3339986 - RNA, 22 nt, Human
cuuguacauaaugcgugcauac

SEQ ID NO: 3339987 - RNA, 19 nt, Human
cuuguacauaaugcgugca

SEQ ID NO: 3339988 - RNA, 21 nt, Human
cuuguacauaaugcgugcaua

SEQ ID NO: 3339989 - RNA, 15 nt, Human
cuuguacauaaugcg

SEQ ID NO: 3339990 - RNA, 12 nt, Human
cuuguacauaau

SEQ ID NO: 3339991 - RNA, 18 nt, Human
cuuguaaauagcucaggu

SEQ ID NO: 3339992 - RNA, 17 nt, Human
cuuguaaauagcucagg

SEQ ID NO: 3339993 - RNA, 22 nt, Human
cuuggggggcugaggugggagg

SEQ ID NO: 3339994 - RNA, 16 nt, Human
cuuguaaauagcucag

SEQ ID NO: 3339995 - RNA, 23 nt, Human
cuuggggggcugaggugggagga

SEQ ID NO: 3339996 - RNA, 19 nt, Human
cuuuggcuauuagagauca

SEQ ID NO: 3339997 - RNA, 14 nt, Human
cuuuguccccaccg

SEQ ID NO: 3339998 - RNA, 19 nt, Human
cuuugugauuuuuguaauu

SEQ ID NO: 3339999 - RNA, 15 nt, Human
cuuugugaggaagcc

SEQ ID NO: 3340000 - RNA, 17 nt, Human
cuuugaccucugcagca

SEQ ID NO: 3340001 - RNA, 18 nt, Human
cuuugaccucugcagcaa

SEQ ID NO: 3340002 - RNA, 20 nt, Human
cuuugaccucugcagcaaua

SEQ ID NO: 3340003 - RNA, 24 nt, Human
cuuugaccucugcagcaauaaagc

SEQ ID NO: 3340004 - RNA, 14 nt, Human
cuuugaccucugca

SEQ ID NO: 3340005 - RNA, 15 nt, Human
cuuugaccucugcag

SEQ ID NO: 3340006 - RNA, 13 nt, Human
cuuugaccucugc

SEQ ID NO: 3340007 - RNA, 16 nt, Human
cuuugcagacaggcaa

SEQ ID NO: 3340008 - RNA, 20 nt, Human
cuuugcagacaggcaagcac

SEQ ID NO: 3340009 - RNA, 15 nt, Human
cuuuccaucuacccu

SEQ ID NO: 3340010 - RNA, 15 nt, Human
cuuuccaggaaggcu

SEQ ID NO: 3340011 - RNA, 16 nt, Human
cuuucccucccuuccu

SEQ ID NO: 3340012 - RNA, 14 nt, Human
cuuucccucccuuc

SEQ ID NO: 3340013 - RNA, 13 nt, Human
cuuucccucccuu

SEQ ID NO: 3340014 - RNA, 11 nt, Human
cuuucccuccc

SEQ ID NO: 3340015 - RNA, 12 nt, Human
cuuuccugaggc

SEQ ID NO: 3340016 - RNA, 16 nt, Human
cuuuccucuuuggucu

SEQ ID NO: 3340017 - RNA, 13 nt, Human
cuuuccugaggcu

SEQ ID NO: 3340018 - RNA, 15 nt, Human
cuuuccugaggcugg

SEQ ID NO: 3340019 - RNA, 17 nt, Human
cuuucuggcuaugcauu

SEQ ID NO: 3340020 - RNA, 18 nt, Human
cuuucuggcuaugcauuu

SEQ ID NO: 3340021 - RNA, 19 nt, Human
cuuucuggcuaugcauuug

SEQ ID NO: 3340022 - RNA, 20 nt, Human
cuuucuggcuaugcauuuga

SEQ ID NO: 3340023 - RNA, 20 nt, Human
cuuuuuuggcugcugaaggc

SEQ ID NO: 3340024 - RNA, 22 nt, Human
cuuuuuuggcugcugaaggcuc

SEQ ID NO: 3340025 - RNA, 17 nt, Human
cuuuuuuggcugcugaa

SEQ ID NO: 3340026 - RNA, 14 nt, Human
gaaaacacauuuuu

SEQ ID NO: 3340027 - RNA, 18 nt, Human
gaaaacacauuuuucuua

SEQ ID NO: 3340028 - RNA, 19 nt, Human
gaaaacacauuuuucuuag

SEQ ID NO: 3340029 - RNA, 12 nt, Human
gaaaaaggagga

SEQ ID NO: 3340030 - RNA, 15 nt, Human
gaaaaaggaggaaga

SEQ ID NO: 3340031 - RNA, 16 nt, Human
cuuuuuuggcugcuga

SEQ ID NO: 3340032 - RNA, 11 nt, Human
cuuuuguucuu

SEQ ID NO: 3340033 - RNA, 12 nt, Human
cuuuuguucuug

SEQ ID NO: 3340034 - RNA, 18 nt, Human
cuuuguuaguuucuccaa

SEQ ID NO: 3340035 - RNA, 20 nt, Human
gaaaacguggcugcuucaag

SEQ ID NO: 3340036 - RNA, 22 nt, Human
gaaaacguggcugcuucaagga

SEQ ID NO: 3340037 - RNA, 19 nt, Human
gaaaacguggcugcuucaa

SEQ ID NO: 3340038 - RNA, 19 nt, Human
gaaaagcugcugacagugu

SEQ ID NO: 3340039 - RNA, 22 nt, Human
gaaaacacuguucucugcccuc

SEQ ID NO: 3340040 - RNA, 24 nt, Human
gaaaacacuguucucugcccucca

SEQ ID NO: 3340041 - RNA, 20 nt, Human
gaaaaucagccugcuccagc

SEQ ID NO: 3340042 - RNA, 22 nt, Human
gaaaaucagccugcuccagcug

SEQ ID NO: 3340043 - RNA, 18 nt, Human
gaaaaucagccugcucca

SEQ ID NO: 3340044 - RNA, 15 nt, Human
gaaacccagcucugg

SEQ ID NO: 3340045 - RNA, 16 nt, Human
gaaacccagcucuggu

SEQ ID NO: 3340046 - RNA, 18 nt, Human
gaaacccagcucuggucc

SEQ ID NO: 3340047 - RNA, 19 nt, Human
gaaacccagcucuggucca

SEQ ID NO: 3340048 - RNA, 13 nt, Human
gaaacccagcucu

SEQ ID NO: 3340049 - RNA, 14 nt, Human
gaaacccagcucug

SEQ ID NO: 3340050 - RNA, 23 nt, Human
gaaacccagcucugguccauaga

SEQ ID NO: 3340051 - RNA, 15 nt, Human
gaaagaguaggaaga

SEQ ID NO: 3340052 - RNA, 17 nt, Human
gaaagacuguacaaagu

SEQ ID NO: 3340053 - RNA, 19 nt, Human
gaaagacuuuuccaacccu

SEQ ID NO: 3340054 - RNA, 21 nt, Human
gaaagcccugagcuuucugcu

SEQ ID NO: 3340055 - RNA, 22 nt, Human
gaaagcccugagcuuucugcua

SEQ ID NO: 3340056 - RNA, 17 nt, Human
gaaagcccugagcuuuc

SEQ ID NO: 3340057 - RNA, 15 nt, Human
cuuccaggcugggag

SEQ ID NO: 3340058 - RNA, 16 nt, Human
cuuccaggcugggaga

SEQ ID NO: 3340059 - RNA, 19 nt, Human
cuuccaggcugggagagcc

SEQ ID NO: 3340060 - RNA, 14 nt, Human
cuuccagggguggg

SEQ ID NO: 3340061 - RNA, 15 nt, Human
cuuccagggguggga

SEQ ID NO: 3340062 - RNA, 17 nt, Human
cuuccaggggugggaca

SEQ ID NO: 3340063 - RNA, 16 nt, Human
cuucaguaagccguga

SEQ ID NO: 3340064 - RNA, 23 nt, Human
cuucaguaagccgugauuuucau

SEQ ID NO: 3340065 - RNA, 16 nt, Human
cuucaguggcagcugc

SEQ ID NO: 3340066 - RNA, 15 nt, Human
cuucaguggcagcug

SEQ ID NO: 3340067 - RNA, 14 nt, Human
cuucaguggcagcu

SEQ ID NO: 3340068 - RNA, 13 nt, Human
cuucaguggcagc

SEQ ID NO: 3340069 - RNA, 18 nt, Human
cuucagugccuuauggaa

SEQ ID NO: 3340070 - RNA, 22 nt, Human
cuucagugccuuauggaacacu

SEQ ID NO: 3340071 - RNA, 14 nt, Human
cuucagugccuuau

SEQ ID NO: 3340072 - RNA, 15 nt, Human
cuucaguaagccgug

SEQ ID NO: 3340073 - RNA, 20 nt, Human
cuucauucaacccaccugcg

SEQ ID NO: 3340074 - RNA, 19 nt, Human
cuuccacaagagcccaggc

SEQ ID NO: 3340075 - RNA, 21 nt, Human
cuuccacaagagcccaggccu

SEQ ID NO: 3340076 - RNA, 17 nt, Human
cuuccacaagagcccag

SEQ ID NO: 3340077 - RNA, 16 nt, Human
cuuccacaagagccca

SEQ ID NO: 3340078 - RNA, 12 nt, Human
cuuccaggcugg

SEQ ID NO: 3340079 - RNA, 14 nt, Human
cuuccaggcuggga

SEQ ID NO: 3340080 - RNA, 23 nt, Human
cuucacagaugggugcuuggagg

SEQ ID NO: 3340081 - RNA, 13 nt, Human
cuucaaggauccu

SEQ ID NO: 3340082 - RNA, 15 nt, Human
cuucaaggauccuga

SEQ ID NO: 3340083 - RNA, 10 nt, Human
cuucaaggau

SEQ ID NO: 3340084 - RNA, 17 nt, Human
cuuauuuaaugaaagac

SEQ ID NO: 3340085 - RNA, 15 nt, Human
cuuauuuaaugaaag

SEQ ID NO: 3340086 - RNA, 18 nt, Human
cuuauuuaaugaaagacu

SEQ ID NO: 3340087 - RNA, 15 nt, Human
cuuauacauuugaua

SEQ ID NO: 3340088 - RNA, 18 nt, Human
cuuagucacugagacagc

SEQ ID NO: 3340089 - RNA, 19 nt, Human
cuuagucacugagacagcc

SEQ ID NO: 3340090 - RNA, 14 nt, Human
cuuagucacugaga

SEQ ID NO: 3340091 - RNA, 16 nt, Human
cuguucuggcagaguu

SEQ ID NO: 3340092 - RNA, 16 nt, Human
cuuagucacugagaca

SEQ ID NO: 3340093 - RNA, 13 nt, Human
cuuagauguauau

SEQ ID NO: 3340094 - RNA, 20 nt, Human
cuucugccauuucugagauc

SEQ ID NO: 3340095 - RNA, 13 nt, Human
cuucucugaagga

SEQ ID NO: 3340096 - RNA, 13 nt, Human
cuucucuccagcc

SEQ ID NO: 3340097 - RNA, 15 nt, Human
cuucucuccagcccc

SEQ ID NO: 3340098 - RNA, 17 nt, Human
cuucucuccagccccug

SEQ ID NO: 3340099 - RNA, 19 nt, Human
cuucucuccagccccugga

SEQ ID NO: 3340100 - RNA, 12 nt, Human
cuucucuccagc

SEQ ID NO: 3340101 - RNA, 13 nt, Human
cuucuccaggcug

SEQ ID NO: 3340102 - RNA, 12 nt, Human
cuucuccaggcu

SEQ ID NO: 3340103 - RNA, 11 nt, Human
cuucuccacuu

SEQ ID NO: 3340104 - RNA, 20 nt, Human
cuucuccacuuucuagccag

SEQ ID NO: 3340105 - RNA, 21 nt, Human
cuucuccacccugcucuccga

SEQ ID NO: 3340106 - RNA, 20 nt, Human
cuucuguacgucugacaggc

SEQ ID NO: 3340107 - RNA, 18 nt, Human
cuucuguacgucugacag

SEQ ID NO: 3340108 - RNA, 15 nt, Human
cuucuguacgucuga

SEQ ID NO: 3340109 - RNA, 14 nt, Human
cuucuguacgucug

SEQ ID NO: 3340110 - RNA, 21 nt, Human
cuucuguacgucugacaggca

SEQ ID NO: 3340111 - RNA, 19 nt, Human
cuucuguccuacucugugu

SEQ ID NO: 3340112 - RNA, 18 nt, Human
cuucuguccuacucugug

SEQ ID NO: 3340113 - RNA, 17 nt, Human
cuucuguccuacucugu

SEQ ID NO: 3340114 - RNA, 16 nt, Human
cuucuguccuacucug

SEQ ID NO: 3340115 - RNA, 21 nt, Human
cuucuguccuacucuguguca

SEQ ID NO: 3340116 - RNA, 14 nt, Human
cuugaaaacacugu

SEQ ID NO: 3340117 - RNA, 23 nt, Human
cuugaaaacacuguucucugccc

SEQ ID NO: 3340118 - RNA, 14 nt, Human
cuucuguggguuuc

SEQ ID NO: 3340119 - RNA, 21 nt, Human
cuucuguggguuucuaaagcu

SEQ ID NO: 3340120 - RNA, 13 nt, Human
cuucuguggguuu

SEQ ID NO: 3340121 - RNA, 20 nt, Human
cuugaggguugggcuggugu

SEQ ID NO: 3340122 - RNA, 19 nt, Human
cuugaggguugggcuggug

SEQ ID NO: 3340123 - RNA, 17 nt, Human
cuugaggguugggcugg

SEQ ID NO: 3340124 - RNA, 21 nt, Human
cuugaguugauucagcucugc

SEQ ID NO: 3340125 - RNA, 21 nt, Human
cuugaggguugggcugguguc

SEQ ID NO: 3340126 - RNA, 13 nt, Human
cuugagcucagga

SEQ ID NO: 3340127 - RNA, 15 nt, Human
cuugagccuugaacu

SEQ ID NO: 3340128 - RNA, 17 nt, Human
cuugagccuugaacuuu

SEQ ID NO: 3340129 - RNA, 16 nt, Human
cuugagccugggaggu

SEQ ID NO: 3340130 - RNA, 21 nt, Human
cuugaccauucuccaccugcc

SEQ ID NO: 3340131 - RNA, 17 nt, Human
cuugaccgugaggccag

SEQ ID NO: 3340132 - RNA, 22 nt, Human
cuugaccauucuccaccugcca

SEQ ID NO: 3340133 - RNA, 23 nt, Human
cuugaccauucuccaccugccag

SEQ ID NO: 3340134 - RNA, 18 nt, Human
cuugaccgugaggccaga

SEQ ID NO: 3340135 - RNA, 20 nt, Human
cuugaccgugaggccagaga

SEQ ID NO: 3340136 - RNA, 21 nt, Human
cuugaccgugaggccagagac

SEQ ID NO: 3340137 - RNA, 13 nt, Human
cuugaccucaggu

SEQ ID NO: 3340138 - RNA, 17 nt, Human
cuugaacuuugaccucu

SEQ ID NO: 3340139 - RNA, 21 nt, Human
cuugaacuuugaccucugcag

SEQ ID NO: 3340140 - RNA, 13 nt, Human
cuugaacuccugg

SEQ ID NO: 3340141 - RNA, 15 nt, Human
cuugaacuuugaccu

SEQ ID NO: 3340142 - RNA, 13 nt, Human
cuguucucugccc

SEQ ID NO: 3340143 - RNA, 14 nt, Human
cuguucucugcccu

SEQ ID NO: 3340144 - RNA, 15 nt, Human
cuguucucugcccuc

SEQ ID NO: 3340145 - RNA, 16 nt, Human
cuguucucugcccucc

SEQ ID NO: 3340146 - RNA, 17 nt, Human
cuguucucugcccucca

SEQ ID NO: 3340147 - RNA, 18 nt, Human
cuguucucugcccuccaa

SEQ ID NO: 3340148 - RNA, 19 nt, Human
cuguucucugcccuccaag

SEQ ID NO: 3340149 - RNA, 20 nt, Human
cuguucucugcccuccaaga

SEQ ID NO: 3340150 - RNA, 18 nt, Human
cuguucagcugguugagg

SEQ ID NO: 3340151 - RNA, 19 nt, Human
cuguucagcugguugaggu

SEQ ID NO: 3340152 - RNA, 21 nt, Human
cuguucagcugguugagguuu

SEQ ID NO: 3340153 - RNA, 22 nt, Human
cugugucuugcaauggcagccu

SEQ ID NO: 3340154 - RNA, 20 nt, Human
cugugucuugcaauggcagc

SEQ ID NO: 3340155 - RNA, 21 nt, Human
cugugucuugcaauggcagcc

SEQ ID NO: 3340156 - RNA, 20 nt, Human
cugugugugcgccuacagga

SEQ ID NO: 3340157 - RNA, 18 nt, Human
cugugugugcgccuacag

SEQ ID NO: 3340158 - RNA, 17 nt, Human
cuguggaugauaaaaca

SEQ ID NO: 3340159 - RNA, 14 nt, Human
cugugggcccccaa

SEQ ID NO: 3340160 - RNA, 16 nt, Human
cugugccucugggacu

SEQ ID NO: 3340161 - RNA, 14 nt, Human
cugugccucuggga

SEQ ID NO: 3340162 - RNA, 21 nt, Human
cugugcugcccugcccaccug

SEQ ID NO: 3340163 - RNA, 17 nt, Human
cugugccucugggacug

SEQ ID NO: 3340164 - RNA, 22 nt, Human
cugugcugcccugcccaccugg

SEQ ID NO: 3340165 - RNA, 18 nt, Human
cugugccaugugccaggu

SEQ ID NO: 3340166 - RNA, 16 nt, Human
cugugccaugugccag

SEQ ID NO: 3340167 - RNA, 14 nt, Human
cugugccauuuugu

SEQ ID NO: 3340168 - RNA, 15 nt, Human
cugugccaugugcca

SEQ ID NO: 3340169 - RNA, 19 nt, Human
cugugauggggcccugccu

SEQ ID NO: 3340170 - RNA, 18 nt, Human
cugugauggggcccugcc

SEQ ID NO: 3340171 - RNA, 17 nt, Human
cugugauggggcccugc

SEQ ID NO: 3340172 - RNA, 20 nt, Human
cugugaguacuacaguccuc

SEQ ID NO: 3340173 - RNA, 21 nt, Human
cugugaguacuacaguccucc

SEQ ID NO: 3340174 - RNA, 23 nt, Human
cugugaguacuacaguccuccca

SEQ ID NO: 3340175 - RNA, 18 nt, Human
cugucuccauguuugaug

SEQ ID NO: 3340176 - RNA, 13 nt, Human
cuguacagagccc

SEQ ID NO: 3340177 - RNA, 22 nt, Human
cuguaucccaugagccucagca

SEQ ID NO: 3340178 - RNA, 23 nt, Human
cuguaucccaugagccucagcau

SEQ ID NO: 3340179 - RNA, 17 nt, Human
cuguccccgcacugggc

SEQ ID NO: 3340180 - RNA, 18 nt, Human
cuguccccgcacugggcu

SEQ ID NO: 3340181 - RNA, 19 nt, Human
cuguccccgcacugggcuu

SEQ ID NO: 3340182 - RNA, 22 nt, Human
cuguccccgcacugggcuuggg

SEQ ID NO: 3340183 - RNA, 14 nt, Human
cuguccgagcuuug

SEQ ID NO: 3340184 - RNA, 20 nt, Human
cugucccuuacgugaguccu

SEQ ID NO: 3340185 - RNA, 18 nt, Human
cugucucaaaaaaagaaa

SEQ ID NO: 3340186 - RNA, 16 nt, Human
cugucucaaaaaaaga

SEQ ID NO: 3340187 - RNA, 23 nt, Human
cugucucaaaaaaacacaaaagu

SEQ ID NO: 3340188 - RNA, 15 nt, Human
cuguccgagcuuuga

SEQ ID NO: 3340189 - RNA, 14 nt, Human
cuguccuacccacc

SEQ ID NO: 3340190 - RNA, 22 nt, Human
cuggguaacuagggaagauaau

SEQ ID NO: 3340191 - RNA, 20 nt, Human
cuggguaacuagggaagaua

SEQ ID NO: 3340192 - RNA, 14 nt, Human
cuggguucuaccca

SEQ ID NO: 3340193 - RNA, 15 nt, Human
cuggguucuacccag

SEQ ID NO: 3340194 - RNA, 16 nt, Human
cuggguucuacccagg

SEQ ID NO: 3340195 - RNA, 17 nt, Human
cuggguucuacccaggu

SEQ ID NO: 3340196 - RNA, 24 nt, Human
cugggcuucaguggcagcugcuuu

SEQ ID NO: 3340197 - RNA, 23 nt, Human
cugggcuucaguggcagcugcuu

SEQ ID NO: 3340198 - RNA, 13 nt, Human
cugggggaagaag

SEQ ID NO: 3340199 - RNA, 15 nt, Human
cugggggaagaagcu

SEQ ID NO: 3340200 - RNA, 18 nt, Human
cugggggcugggcagagg

SEQ ID NO: 3340201 - RNA, 19 nt, Human
cugggggcugggcagagga

SEQ ID NO: 3340202 - RNA, 13 nt, Human
cugguggcagcug

SEQ ID NO: 3340203 - RNA, 21 nt, Human
cugguggcagcucaccucucc

SEQ ID NO: 3340204 - RNA, 23 nt, Human
cugguggcagcucaccucucccu

SEQ ID NO: 3340205 - RNA, 13 nt, Human
cuguacaaaguag

SEQ ID NO: 3340206 - RNA, 22 nt, Human
cuguaauuugugauacaaugcu

SEQ ID NO: 3340207 - RNA, 15 nt, Human
cuguacaaaguagaa

SEQ ID NO: 3340208 - RNA, 20 nt, Human
cuguaauccuagcacuuugg

SEQ ID NO: 3340209 - RNA, 19 nt, Human
cuguaauccuagcacuuug

SEQ ID NO: 3340210 - RNA, 16 nt, Human
cugguuccauggccuc

SEQ ID NO: 3340211 - RNA, 15 nt, Human
cugccucuucucuac

SEQ ID NO: 3340212 - RNA, 14 nt, Human
cugccucuucucua

SEQ ID NO: 3340213 - RNA, 17 nt, Human
cugccugcccaggcccc

SEQ ID NO: 3340214 - RNA, 16 nt, Human
cugccugcccaggccc

SEQ ID NO: 3340215 - RNA, 15 nt, Human
cugccugcccaggcc

SEQ ID NO: 3340216 - RNA, 15 nt, Human
cugccugaagucaca

SEQ ID NO: 3340217 - RNA, 21 nt, Human
cugccugggaucccucauccu

SEQ ID NO: 3340218 - RNA, 20 nt, Human
cugccugcccaggccccugc

SEQ ID NO: 3340219 - RNA, 23 nt, Human
cugccucugacacacagcucugu

SEQ ID NO: 3340220 - RNA, 22 nt, Human
cugccucugacacacagcucug

SEQ ID NO: 3340221 - RNA, 11 nt, Human
cugccucccau

SEQ ID NO: 3340222 - RNA, 12 nt, Human
cugccucccauc

SEQ ID NO: 3340223 - RNA, 14 nt, Human
cugccucccaucac

SEQ ID NO: 3340224 - RNA, 16 nt, Human
cugccucccaucaccc

SEQ ID NO: 3340225 - RNA, 19 nt, Human
cugccucccaucacccgcu

SEQ ID NO: 3340226 - RNA, 12 nt, Human
cugcccuccaag

SEQ ID NO: 3340227 - RNA, 14 nt, Human
cucccuucccaccu

SEQ ID NO: 3340228 - RNA, 15 nt, Human
cucccuucccaccuc

SEQ ID NO: 3340229 - RNA, 16 nt, Human
cucccuucccaccucu

SEQ ID NO: 3340230 - RNA, 17 nt, Human
cucccuucccaccucuc

SEQ ID NO: 3340231 - RNA, 17 nt, Human
cugccgcagcccugcag

SEQ ID NO: 3340232 - RNA, 18 nt, Human
cugccgcagcccugcaga

SEQ ID NO: 3340233 - RNA, 14 nt, Human
cugccgcagcccug

SEQ ID NO: 3340234 - RNA, 15 nt, Human
cugccgcagcccugc

SEQ ID NO: 3340235 - RNA, 19 nt, Human
cugcucuccgaccagacac

SEQ ID NO: 3340236 - RNA, 19 nt, Human
cugcuccagcuguucagcu

SEQ ID NO: 3340237 - RNA, 20 nt, Human
cugcuccagcuguucagcug

SEQ ID NO: 3340238 - RNA, 15 nt, Human
cugcuccagcuguuc

SEQ ID NO: 3340239 - RNA, 19 nt, Human
cugcgaccacaagaaggau

SEQ ID NO: 3340240 - RNA, 15 nt, Human
cugcugcaguugcca

SEQ ID NO: 3340241 - RNA, 11 nt, Human
cugcugaaggc

SEQ ID NO: 3340242 - RNA, 14 nt, Human
cugcugcuggcugg

SEQ ID NO: 3340243 - RNA, 15 nt, Human
cugcugcuggcuggu

SEQ ID NO: 3340244 - RNA, 19 nt, Human
cugcuuccagugaggcucu

SEQ ID NO: 3340245 - RNA, 20 nt, Human
cugcuuccagugaggcucug

SEQ ID NO: 3340246 - RNA, 21 nt, Human
cugcuuccagugaggcucugc

SEQ ID NO: 3340247 - RNA, 23 nt, Human
cugcuuccagugaggcucugccc

SEQ ID NO: 3340248 - RNA, 16 nt, Human
cugcuuccagugaggc

SEQ ID NO: 3340249 - RNA, 18 nt, Human
cugcuuccagugaggcuc

SEQ ID NO: 3340250 - RNA, 15 nt, Human
cugcuuccagugagg

SEQ ID NO: 3340251 - RNA, 23 nt, Human
cugcugguucaggguuggccccu

SEQ ID NO: 3340252 - RNA, 15 nt, Human
cugcugguucagggu

SEQ ID NO: 3340253 - RNA, 13 nt, Human
cugcugguucagg

SEQ ID NO: 3340254 - RNA, 20 nt, Human
cuggaccuugaacuggguac

SEQ ID NO: 3340255 - RNA, 17 nt, Human
cuggaccuugaacuggg

SEQ ID NO: 3340256 - RNA, 21 nt, Human
cuggaccuugaacuggguacu

SEQ ID NO: 3340257 - RNA, 15 nt, Human
cuggacccuguggau

SEQ ID NO: 3340258 - RNA, 16 nt, Human
cuggaccuugaacugg

SEQ ID NO: 3340259 - RNA, 17 nt, Human
cuggacaggcauguucu

SEQ ID NO: 3340260 - RNA, 14 nt, Human
cuggacaggcaugu

SEQ ID NO: 3340261 - RNA, 23 nt, Human
cuggacaggcauguucucugagg

SEQ ID NO: 3340262 - RNA, 17 nt, Human
cuggagguacgaaaaga

SEQ ID NO: 3340263 - RNA, 22 nt, Human
cuggagguacgaaaagagggga

SEQ ID NO: 3340264 - RNA, 17 nt, Human
cuggagugcagugagcc

SEQ ID NO: 3340265 - RNA, 16 nt, Human
cuggagugcagugagc

SEQ ID NO: 3340266 - RNA, 15 nt, Human
cuggagugcagugag

SEQ ID NO: 3340267 - RNA, 14 nt, Human
cuggagugcaguga

SEQ ID NO: 3340268 - RNA, 19 nt, Human
cuggcacugcuuccaguga

SEQ ID NO: 3340269 - RNA, 20 nt, Human
cuggcacugcuuccagugag

SEQ ID NO: 3340270 - RNA, 23 nt, Human
cuggcacugcuuccagugaggcu

SEQ ID NO: 3340271 - RNA, 18 nt, Human
cuggcacugcuuccagug

SEQ ID NO: 3340272 - RNA, 19 nt, Human
cuggcacccggccccugcu

SEQ ID NO: 3340273 - RNA, 21 nt, Human
cuggcacccggccccugcugg

SEQ ID NO: 3340274 - RNA, 20 nt, Human
cuggcacccggccccugcug

SEQ ID NO: 3340275 - RNA, 20 nt, Human
cuggagugcagugagccgag

SEQ ID NO: 3340276 - RNA, 15 nt, Human
cuggcccacugcauc

SEQ ID NO: 3340277 - RNA, 20 nt, Human
cuggcucuuccaggcuggga

SEQ ID NO: 3340278 - RNA, 24 nt, Human
cuggcucuuccaggcugggagagc

SEQ ID NO: 3340279 - RNA, 21 nt, Human
cuggcucuuccaggcugggag

SEQ ID NO: 3340280 - RNA, 22 nt, Human
cuggcucuuccaggcugggaga

SEQ ID NO: 3340281 - RNA, 15 nt, Human
cuggcgugcaguggu

SEQ ID NO: 3340282 - RNA, 14 nt, Human
cuggcgugcagugg

SEQ ID NO: 3340283 - RNA, 18 nt, Human
cuggccucugcacucccc

SEQ ID NO: 3340284 - RNA, 20 nt, Human
cuggccucugcacuccccug

SEQ ID NO: 3340285 - RNA, 21 nt, Human
cuggccucugcacuccccugc

SEQ ID NO: 3340286 - RNA, 16 nt, Human
cuggccucugcacucc

SEQ ID NO: 3340287 - RNA, 19 nt, Human
cuggccuggccccucaggg

SEQ ID NO: 3340288 - RNA, 24 nt, Human
cuggccuggccccucagggucccu

SEQ ID NO: 3340289 - RNA, 21 nt, Human
cccugcucuccgaccagacac

SEQ ID NO: 3340290 - RNA, 22 nt, Human
cccugcucuccgaccagacacc

SEQ ID NO: 3340291 - RNA, 11 nt, Human
cccugccuccu

SEQ ID NO: 3340292 - RNA, 21 nt, Human
cccugcccugugggcccccaa

SEQ ID NO: 3340293 - RNA, 12 nt, Human
cccugaggccca

SEQ ID NO: 3340294 - RNA, 20 nt, Human
cccugcagagggcacagaaa

SEQ ID NO: 3340295 - RNA, 12 nt, Human
cccuuccaugga

SEQ ID NO: 3340296 - RNA, 15 nt, Human
cccuuacgugagucc

SEQ ID NO: 3340297 - RNA, 17 nt, Human
cccuuacgugaguccug

SEQ ID NO: 3340298 - RNA, 14 nt, Human
cccuuagcagggaa

SEQ ID NO: 3340299 - RNA, 23 nt, Human
cccuuagcagggaaacagcuaau

SEQ ID NO: 3340300 - RNA, 22 nt, Human
cccuugccgucuaccugagggg

SEQ ID NO: 3340301 - RNA, 20 nt, Human
cccuuaccugccaggaagcc

SEQ ID NO: 3340302 - RNA, 23 nt, Human
cccuuaccugccaggaagccagc

SEQ ID NO: 3340303 - RNA, 17 nt, Human
cccuuaccugccaggaa

SEQ ID NO: 3340304 - RNA, 19 nt, Human
cccuuaccucggugccuuc

SEQ ID NO: 3340305 - RNA, 19 nt, Human
cccuguuuguuucugaaag

SEQ ID NO: 3340306 - RNA, 16 nt, Human
cccuguuuguuucuga

SEQ ID NO: 3340307 - RNA, 13 nt, Human
cccuguucuggca

SEQ ID NO: 3340308 - RNA, 14 nt, Human
cccuguucuggcag

SEQ ID NO: 3340309 - RNA, 20 nt, Human
cccugguggcagcucaccuc

SEQ ID NO: 3340310 - RNA, 21 nt, Human
cccuggugaccagcaccaucu

SEQ ID NO: 3340311 - RNA, 21 nt, Human
cccugguggcagcucaccucu

SEQ ID NO: 3340312 - RNA, 13 nt, Human
cccugguggcagu

SEQ ID NO: 3340313 - RNA, 21 nt, Human
cccuguagagugggagcugag

SEQ ID NO: 3340314 - RNA, 14 nt, Human
cccugguggcagug

SEQ ID NO: 3340315 - RNA, 23 nt, Human
cccucccucuuucccucccuucc

SEQ ID NO: 3340316 - RNA, 11 nt, Human
cccucugccca

SEQ ID NO: 3340317 - RNA, 15 nt, Human
cccucugcccacucc

SEQ ID NO: 3340318 - RNA, 18 nt, Human
cccucugcccacucccug

SEQ ID NO: 3340319 - RNA, 19 nt, Human
cccucugcccacucccugc

SEQ ID NO: 3340320 - RNA, 12 nt, Human
cccucuuucccu

SEQ ID NO: 3340321 - RNA, 20 nt, Human
cccucuuucccucccuuccu

SEQ ID NO: 3340322 - RNA, 17 nt, Human
cccucuuucccucccuu

SEQ ID NO: 3340323 - RNA, 18 nt, Human
ccuaggugacagagugag

SEQ ID NO: 3340324 - RNA, 23 nt, Human
ccuaggcauuugcugaauacaga

SEQ ID NO: 3340325 - RNA, 16 nt, Human
ccgugaggccagagac

SEQ ID NO: 3340326 - RNA, 12 nt, Human
ccguuauuaaaa

SEQ ID NO: 3340327 - RNA, 18 nt, Human
ccuacaggagugagcacu

SEQ ID NO: 3340328 - RNA, 23 nt, Human
ccgcacugggcuuggggaccaga

SEQ ID NO: 3340329 - RNA, 19 nt, Human
ccgcacugggcuuggggac

SEQ ID NO: 3340330 - RNA, 14 nt, Human
ccgaguagcuggga

SEQ ID NO: 3340331 - RNA, 19 nt, Human
ccgagcuuugaaaauucag

SEQ ID NO: 3340332 - RNA, 15 nt, Human
ccgagauugcaccac

SEQ ID NO: 3340333 - RNA, 19 nt, Human
ccgagauugcaccacugca

SEQ ID NO: 3340334 - RNA, 21 nt, Human
ccgagauugcaccacugcacu

SEQ ID NO: 3340335 - RNA, 11 nt, Human
ccgcuggggcc

SEQ ID NO: 3340336 - RNA, 13 nt, Human
ccgggccacagag

SEQ ID NO: 3340337 - RNA, 22 nt, Human
ccgggcacucagaagacacuga

SEQ ID NO: 3340338 - RNA, 20 nt, Human
ccgggcacucagaagacacu

SEQ ID NO: 3340339 - RNA, 21 nt, Human
ccggcuccaggcuccuuuagc

SEQ ID NO: 3340340 - RNA, 16 nt, Human
ccggcuccaggcuccu

SEQ ID NO: 3340341 - RNA, 15 nt, Human
ccggcuccaggcucc

SEQ ID NO: 3340342 - RNA, 18 nt, Human
ccgugaggccagagacac

SEQ ID NO: 3340343 - RNA, 14 nt, Human
ccgggcucugccuc

SEQ ID NO: 3340344 - RNA, 15 nt, Human
ccgggcucugccucc

SEQ ID NO: 3340345 - RNA, 18 nt, Human
ccgggcucugccucccau

SEQ ID NO: 3340346 - RNA, 13 nt, Human
ccgggcucugccu

SEQ ID NO: 3340347 - RNA, 21 nt, Human
ccccacccaagggccuggccu

SEQ ID NO: 3340348 - RNA, 15 nt, Human
ccccaccgcagacag

SEQ ID NO: 3340349 - RNA, 19 nt, Human
ccccaccgcagacaggacc

SEQ ID NO: 3340350 - RNA, 14 nt, Human
ccccacuggugaca

SEQ ID NO: 3340351 - RNA, 19 nt, Human
cccaucucuacaaaaagca

SEQ ID NO: 3340352 - RNA, 14 nt, Human
cccaguugggugga

SEQ ID NO: 3340353 - RNA, 18 nt, Human
cccaugcugcccugugag

SEQ ID NO: 3340354 - RNA, 14 nt, Human
cccaugagccucag

SEQ ID NO: 3340355 - RNA, 22 nt, Human
cccaugagccucagcauccugg

SEQ ID NO: 3340356 - RNA, 14 nt, Human
ccccauccucugua

SEQ ID NO: 3340357 - RNA, 13 nt, Human
cccccacccaagg

SEQ ID NO: 3340358 - RNA, 24 nt, Human
cccccacccaagggccuggccuga

SEQ ID NO: 3340359 - RNA, 15 nt, Human
cccccacuggugaca

SEQ ID NO: 3340360 - RNA, 11 nt, Human
cccccacuggu

SEQ ID NO: 3340361 - RNA, 13 nt, Human
cccccacugguga

SEQ ID NO: 3340362 - RNA, 22 nt, Human
ccccaggugguuauggagaggg

SEQ ID NO: 3340363 - RNA, 20 nt, Human
ccccagugcccacaggauca

SEQ ID NO: 3340364 - RNA, 16 nt, Human
ccccagugcccacagg

SEQ ID NO: 3340365 - RNA, 15 nt, Human
ccccagugcccacag

SEQ ID NO: 3340366 - RNA, 14 nt, Human
ccccagugcccaca

SEQ ID NO: 3340367 - RNA, 15 nt, Human
ccccucaacaccucu

SEQ ID NO: 3340368 - RNA, 16 nt, Human
ccccucaacaccucug

SEQ ID NO: 3340369 - RNA, 23 nt, Human
ccccucaacucuccuccagaguc

SEQ ID NO: 3340370 - RNA, 12 nt, Human
cccccagccugc

SEQ ID NO: 3340371 - RNA, 19 nt, Human
cccccugacaacacucauu

SEQ ID NO: 3340372 - RNA, 17 nt, Human
cccccugacaacacuca

SEQ ID NO: 3340373 - RNA, 22 nt, Human
ccccucagggucccugguggca

SEQ ID NO: 3340374 - RNA, 12 nt, Human
ccccuccaugug

SEQ ID NO: 3340375 - RNA, 19 nt, Human
ccccugcccggcugcggaa

SEQ ID NO: 3340376 - RNA, 17 nt, Human
ccccugcccggcugcgg

SEQ ID NO: 3340377 - RNA, 20 nt, Human
ccccugcugguucaggguug

SEQ ID NO: 3340378 - RNA, 15 nt, Human
ccccugcugguucag

SEQ ID NO: 3340379 - RNA, 13 nt, Human
ccccugcugguuc

SEQ ID NO: 3340380 - RNA, 11 nt, Human
ccccugcuggu

SEQ ID NO: 3340381 - RNA, 14 nt, Human
ccccugcugggugu

SEQ ID NO: 3340382 - RNA, 17 nt, Human
ccccugcuggguguggc

SEQ ID NO: 3340383 - RNA, 18 nt, Human
ccccuggaugcagccuca

SEQ ID NO: 3340384 - RNA, 19 nt, Human
ccccuggaugcagccucac

SEQ ID NO: 3340385 - RNA, 15 nt, Human
ccccuggaugcagcc

SEQ ID NO: 3340386 - RNA, 22 nt, Human
cccgcuaagagggagggagggc

SEQ ID NO: 3340387 - RNA, 23 nt, Human
cccgcuaagagggagggagggcu

SEQ ID NO: 3340388 - RNA, 20 nt, Human
cccgcccaggcuuagucacu

SEQ ID NO: 3340389 - RNA, 13 nt, Human
ccccuuccaugga

SEQ ID NO: 3340390 - RNA, 20 nt, Human
ccccuuccauggacuuuguu

SEQ ID NO: 3340391 - RNA, 22 nt, Human
cccgaauagcugggacuacagg

SEQ ID NO: 3340392 - RNA, 13 nt, Human
ccauuugcuccuu

SEQ ID NO: 3340393 - RNA, 15 nt, Human
ccauucugccugccc

SEQ ID NO: 3340394 - RNA, 18 nt, Human
ccauguuuuguuuacggu

SEQ ID NO: 3340395 - RNA, 16 nt, Human
cccaagggccuggccu

SEQ ID NO: 3340396 - RNA, 13 nt, Human
cccacaggaucag

SEQ ID NO: 3340397 - RNA, 17 nt, Human
cccacaggaucagucug

SEQ ID NO: 3340398 - RNA, 12 nt, Human
cccaagggccug

SEQ ID NO: 3340399 - RNA, 14 nt, Human
cccaagggccuggc

SEQ ID NO: 3340400 - RNA, 20 nt, Human
ccauuuugcugucccuuuuc

SEQ ID NO: 3340401 - RNA, 21 nt, Human
ccauuuuguauuuuacuaaua

SEQ ID NO: 3340402 - RNA, 14 nt, Human
cccaccucucucac

SEQ ID NO: 3340403 - RNA, 17 nt, Human
cccaccucucucacucc

SEQ ID NO: 3340404 - RNA, 13 nt, Human
cccaccucucuca

SEQ ID NO: 3340405 - RNA, 21 nt, Human
cccaccucagccucccaaagu

SEQ ID NO: 3340406 - RNA, 12 nt, Human
cccaccuuggcu

SEQ ID NO: 3340407 - RNA, 15 nt, Human
cccaccucagccucc

SEQ ID NO: 3340408 - RNA, 14 nt, Human
cccaccucagccuc

SEQ ID NO: 3340409 - RNA, 12 nt, Human
cccaccucagcc

SEQ ID NO: 3340410 - RNA, 15 nt, Human
cccaccuuggcugca

SEQ ID NO: 3340411 - RNA, 14 nt, Human
cccaccuuggcugc

SEQ ID NO: 3340412 - RNA, 22 nt, Human
cccaccuuggcucaaguccucu

SEQ ID NO: 3340413 - RNA, 15 nt, Human
cccaccuuggcucaa

SEQ ID NO: 3340414 - RNA, 15 nt, Human
cccacgcccccacug

SEQ ID NO: 3340415 - RNA, 17 nt, Human
cccacgcccccacuggu

SEQ ID NO: 3340416 - RNA, 19 nt, Human
cccacgcccccacugguga

SEQ ID NO: 3340417 - RNA, 21 nt, Human
cccacgcuggagugcagugag

SEQ ID NO: 3340418 - RNA, 15 nt, Human
ccaggcccucugccc

SEQ ID NO: 3340419 - RNA, 23 nt, Human
ccaggcugggagagccuuccagg

SEQ ID NO: 3340420 - RNA, 22 nt, Human
ccaggcuuagucacugagacag

SEQ ID NO: 3340421 - RNA, 23 nt, Human
ccaggcuuagucacugagacagc

SEQ ID NO: 3340422 - RNA, 21 nt, Human
ccaggcuuagucacugagaca

SEQ ID NO: 3340423 - RNA, 21 nt, Human
ccaggccacaagacccuugug

SEQ ID NO: 3340424 - RNA, 20 nt, Human
ccaggaggccagccuugacc

SEQ ID NO: 3340425 - RNA, 15 nt, Human
ccaggaggccagccu

SEQ ID NO: 3340426 - RNA, 18 nt, Human
ccaggaggccagccuuga

SEQ ID NO: 3340427 - RNA, 14 nt, Human
ccaggaggccagcc

SEQ ID NO: 3340428 - RNA, 13 nt, Human
ccaggcccucugc

SEQ ID NO: 3340429 - RNA, 14 nt, Human
ccaggcccucugcc

SEQ ID NO: 3340430 - RNA, 16 nt, Human
ccaggccccugccacc

SEQ ID NO: 3340431 - RNA, 15 nt, Human
ccaggccccugccac

SEQ ID NO: 3340432 - RNA, 13 nt, Human
ccaggccccugcc

SEQ ID NO: 3340433 - RNA, 14 nt, Human
ccaggccccugcca

SEQ ID NO: 3340434 - RNA, 21 nt, Human
ccaguaaaugggggugcauuu

SEQ ID NO: 3340435 - RNA, 22 nt, Human
ccaguaaaugggggugcauuug

SEQ ID NO: 3340436 - RNA, 20 nt, Human
ccaguaaaugggggugcauu

SEQ ID NO: 3340437 - RNA, 13 nt, Human
ccagguuuaagcu

SEQ ID NO: 3340438 - RNA, 16 nt, Human
ccagguuucuaugugu

SEQ ID NO: 3340439 - RNA, 24 nt, Human
ccaggugcacaagcuccaagcucc

SEQ ID NO: 3340440 - RNA, 21 nt, Human
ccaggugcuaggaacacuccu

SEQ ID NO: 3340441 - RNA, 23 nt, Human
ccagugugacaaggauugcuacu

SEQ ID NO: 3340442 - RNA, 14 nt, Human
ccagugugacaagg

SEQ ID NO: 3340443 - RNA, 13 nt, Human
ccauaugccuggg

SEQ ID NO: 3340444 - RNA, 12 nt, Human
ccaucaagccac

SEQ ID NO: 3340445 - RNA, 15 nt, Human
ccauaugccugggca

SEQ ID NO: 3340446 - RNA, 16 nt, Human
ccaucaagccaccaac

SEQ ID NO: 3340447 - RNA, 13 nt, Human
ccaucaagccacc

SEQ ID NO: 3340448 - RNA, 14 nt, Human
ccaucaagccacca

SEQ ID NO: 3340449 - RNA, 12 nt, Human
ccaucauugaaa

SEQ ID NO: 3340450 - RNA, 13 nt, Human
ccaucaugucugg

SEQ ID NO: 3340451 - RNA, 12 nt, Human
ccaucaugucug

SEQ ID NO: 3340452 - RNA, 14 nt, Human
ccaucucacacaug

SEQ ID NO: 3340453 - RNA, 15 nt, Human
ccaucucacacauga

SEQ ID NO: 3340454 - RNA, 17 nt, Human
ccaucucacacaugagc

SEQ ID NO: 3340455 - RNA, 18 nt, Human
ccaucucacacaugagca

SEQ ID NO: 3340456 - RNA, 20 nt, Human
ccaucucacacaugagcauc

SEQ ID NO: 3340457 - RNA, 21 nt, Human
ccaucucacacaugagcauca

SEQ ID NO: 3340458 - RNA, 15 nt, Human
ccaucucuccuccuu

SEQ ID NO: 3340459 - RNA, 13 nt, Human
ccaucuacccucc

SEQ ID NO: 3340460 - RNA, 14 nt, Human
ccaucauugaaauc

SEQ ID NO: 3340461 - RNA, 16 nt, Human
ccaucauugaaaucuu

SEQ ID NO: 3340462 - RNA, 18 nt, Human
ccagauuucacucuccuu

SEQ ID NO: 3340463 - RNA, 19 nt, Human
ccagauuucacucuccuug

SEQ ID NO: 3340464 - RNA, 15 nt, Human
ccagauuucacucuc

SEQ ID NO: 3340465 - RNA, 22 nt, Human
ccagauugcaacaggcugggcu

SEQ ID NO: 3340466 - RNA, 21 nt, Human
ccagauugcaacaggcugggc

SEQ ID NO: 3340467 - RNA, 23 nt, Human
ccagauugcaacaggcugggcuu

SEQ ID NO: 3340468 - RNA, 16 nt, Human
ccagauugcaacaggc

SEQ ID NO: 3340469 - RNA, 14 nt, Human
ccagauugcaacag

SEQ ID NO: 3340470 - RNA, 23 nt, Human
ccagauucuuuccugaggcuggg

SEQ ID NO: 3340471 - RNA, 17 nt, Human
ccagcaggcucucaggc

SEQ ID NO: 3340472 - RNA, 18 nt, Human
ccagcaggcucucaggcc

SEQ ID NO: 3340473 - RNA, 16 nt, Human
ccagcaggcucucagg

SEQ ID NO: 3340474 - RNA, 15 nt, Human
ccagcaggcucucag

SEQ ID NO: 3340475 - RNA, 17 nt, Human
ccagcaccaucucuccu

SEQ ID NO: 3340476 - RNA, 18 nt, Human
ccagcaccaucucuccuc

SEQ ID NO: 3340477 - RNA, 16 nt, Human
ccagcaagugagagcu

SEQ ID NO: 3340478 - RNA, 19 nt, Human
ccagcaagugagagcuggg

SEQ ID NO: 3340479 - RNA, 18 nt, Human
ccagcaagugagagcugg

SEQ ID NO: 3340480 - RNA, 17 nt, Human
ccagcaagugagagcug

SEQ ID NO: 3340481 - RNA, 20 nt, Human
ccagccgagauagccaaggc

SEQ ID NO: 3340482 - RNA, 22 nt, Human
ccagccgagauagccaaggcca

SEQ ID NO: 3340483 - RNA, 17 nt, Human
ccagccgagauagccaa

SEQ ID NO: 3340484 - RNA, 19 nt, Human
ccagccgccaugcuccugg

SEQ ID NO: 3340485 - RNA, 19 nt, Human
ccagcaggcucucaggcca

SEQ ID NO: 3340486 - RNA, 20 nt, Human
ccagcaggcucucaggccag

SEQ ID NO: 3340487 - RNA, 21 nt, Human
ccagcaggcucucaggccagc

SEQ ID NO: 3340488 - RNA, 23 nt, Human
ccagcaggcucucaggccagcug

SEQ ID NO: 3340489 - RNA, 17 nt, Human
ccagcccacuucugcca

SEQ ID NO: 3340490 - RNA, 16 nt, Human
ccagcccacuucugcc

SEQ ID NO: 3340491 - RNA, 13 nt, Human
ccagccuggguga

SEQ ID NO: 3340492 - RNA, 23 nt, Human
ccagccuugaccauucuccaccu

SEQ ID NO: 3340493 - RNA, 22 nt, Human
ccagccuugaccauucuccacc

SEQ ID NO: 3340494 - RNA, 19 nt, Human
ccacccccacccaagggcc

SEQ ID NO: 3340495 - RNA, 19 nt, Human
ccaccccucaacaccucug

SEQ ID NO: 3340496 - RNA, 18 nt, Human
ccacccugaaagcccuga

SEQ ID NO: 3340497 - RNA, 14 nt, Human
ccacccuccuuuca

SEQ ID NO: 3340498 - RNA, 12 nt, Human
ccacccugcucu

SEQ ID NO: 3340499 - RNA, 11 nt, Human
ccacccugcuc

SEQ ID NO: 3340500 - RNA, 14 nt, Human
ccaccucucucacu

SEQ ID NO: 3340501 - RNA, 16 nt, Human
ccaccucucucacucc

SEQ ID NO: 3340502 - RNA, 19 nt, Human
ccaccucucucacuccuug

SEQ ID NO: 3340503 - RNA, 20 nt, Human
ccaccucucucacuccuuga

SEQ ID NO: 3340504 - RNA, 13 nt, Human
ccaccuggccucu

SEQ ID NO: 3340505 - RNA, 18 nt, Human
ccaccuggccucugcacu

SEQ ID NO: 3340506 - RNA, 20 nt, Human
ccaccuggccucugcacucc

SEQ ID NO: 3340507 - RNA, 13 nt, Human
ccaccugccaggg

SEQ ID NO: 3340508 - RNA, 14 nt, Human
ccaccugccaggga

SEQ ID NO: 3340509 - RNA, 12 nt, Human
ccaccugccagg

SEQ ID NO: 3340510 - RNA, 15 nt, Human
ccaccugccagggac

SEQ ID NO: 3340511 - RNA, 22 nt, Human
ccagaagaaaauagugguguga

SEQ ID NO: 3340512 - RNA, 16 nt, Human
ccacugugccaugugc

SEQ ID NO: 3340513 - RNA, 15 nt, Human
ccacugugccaugug

SEQ ID NO: 3340514 - RNA, 19 nt, Human
ccacugugccaugugccag

SEQ ID NO: 3340515 - RNA, 22 nt, Human
ccacuuuuguucuugguuugua

SEQ ID NO: 3340516 - RNA, 21 nt, Human
ccacugcaucguuucaucuuc

SEQ ID NO: 3340517 - RNA, 23 nt, Human
ccacugcaucguuucaucuucca

SEQ ID NO: 3340518 - RNA, 15 nt, Human
ccacugcucugguua

SEQ ID NO: 3340519 - RNA, 13 nt, Human
ccacugcucuggu

SEQ ID NO: 3340520 - RNA, 12 nt, Human
ccacugcucugg

SEQ ID NO: 3340521 - RNA, 11 nt, Human
ccacugcucug

SEQ ID NO: 3340522 - RNA, 20 nt, Human
ccacugcuuuuggucugugu

SEQ ID NO: 3340523 - RNA, 22 nt, Human
ccacugcuuuuggucuguguga

SEQ ID NO: 3340524 - RNA, 14 nt, Human
ccacugugaagaga

SEQ ID NO: 3340525 - RNA, 15 nt, Human
ccacugugaagagaa

SEQ ID NO: 3340526 - RNA, 23 nt, Human
ccacuggugacaugucuuuucuu

SEQ ID NO: 3340527 - RNA, 15 nt, Human
ccagacccggcugcg

SEQ ID NO: 3340528 - RNA, 14 nt, Human
ccagacccggcugc

SEQ ID NO: 3340529 - RNA, 17 nt, Human
ccagacacauguccaag

SEQ ID NO: 3340530 - RNA, 20 nt, Human
ccagacacauguccaagaag

SEQ ID NO: 3340531 - RNA, 22 nt, Human
ccagacacauguccaagaagcc

SEQ ID NO: 3340532 - RNA, 16 nt, Human
cgaggacagggaggug

SEQ ID NO: 3340533 - RNA, 19 nt, Human
cgagcccugguggcagugg

SEQ ID NO: 3340534 - RNA, 14 nt, Human
cgaggacagggagg

SEQ ID NO: 3340535 - RNA, 18 nt, Human
cgagcccugguggcagug

SEQ ID NO: 3340536 - RNA, 13 nt, Human
cgcacugggcuug

SEQ ID NO: 3340537 - RNA, 19 nt, Human
cgcagcauauucaggaagc

SEQ ID NO: 3340538 - RNA, 20 nt, Human
cgcagcauauucaggaagcu

SEQ ID NO: 3340539 - RNA, 15 nt, Human
cgcagcccugcagag

SEQ ID NO: 3340540 - RNA, 17 nt, Human
cgcagcccugcagaggg

SEQ ID NO: 3340541 - RNA, 17 nt, Human
cgcacugggcuugggga

SEQ ID NO: 3340542 - RNA, 20 nt, Human
cggacagccacggccaggcc

SEQ ID NO: 3340543 - RNA, 14 nt, Human
cggaauaguuggcu

SEQ ID NO: 3340544 - RNA, 17 nt, Human
cggaauaguuggcuagg

SEQ ID NO: 3340545 - RNA, 16 nt, Human
cggaauaguuggcuag

SEQ ID NO: 3340546 - RNA, 16 nt, Human
cgcuuucuacccagcg

SEQ ID NO: 3340547 - RNA, 14 nt, Human
cgcuuucuacccag

SEQ ID NO: 3340548 - RNA, 22 nt, Human
cggacagccacggccaggccag

SEQ ID NO: 3340549 - RNA, 21 nt, Human
cggacagccacggccaggcca

SEQ ID NO: 3340550 - RNA, 15 nt, Human
cggagaaaggaaggg

SEQ ID NO: 3340551 - RNA, 13 nt, Human
cgcugugcugccc

SEQ ID NO: 3340552 - RNA, 11 nt, Human
cgcugugcugc

SEQ ID NO: 3340553 - RNA, 21 nt, Human
cgcugugcugcccugcccacc

SEQ ID NO: 3340554 - RNA, 23 nt, Human
cgcugugcugcccugcccaccug

SEQ ID NO: 3340555 - RNA, 19 nt, Human
cgcugugcugcccugccca

SEQ ID NO: 3340556 - RNA, 18 nt, Human
cgcugugcugcccugccc

SEQ ID NO: 3340557 - RNA, 12 nt, Human
cgcccagucugg

SEQ ID NO: 3340558 - RNA, 19 nt, Human
cgcccagucuggaaugcag

SEQ ID NO: 3340559 - RNA, 13 nt, Human
cgcccagucugga

SEQ ID NO: 3340560 - RNA, 18 nt, Human
cgcagcccugcagagggc

SEQ ID NO: 3340561 - RNA, 19 nt, Human
cgcagcccugcagagggca

SEQ ID NO: 3340562 - RNA, 17 nt, Human
cgcuacccgggaagggg

SEQ ID NO: 3340563 - RNA, 18 nt, Human
cgcuacccgggaaggggg

SEQ ID NO: 3340564 - RNA, 21 nt, Human
cgcuacccgggaagggggcug

SEQ ID NO: 3340565 - RNA, 24 nt, Human
cgcuacccgggaagggggcuggga

SEQ ID NO: 3340566 - RNA, 14 nt, Human
cgcgacaaugcaaa

SEQ ID NO: 3340567 - RNA, 19 nt, Human
cgcgguggcucacgccugu

SEQ ID NO: 3340568 - RNA, 14 nt, Human
cggcuggcagccca

SEQ ID NO: 3340569 - RNA, 11 nt, Human
cggccaggcca

SEQ ID NO: 3340570 - RNA, 20 nt, Human
cggccaggccagagggagug

SEQ ID NO: 3340571 - RNA, 12 nt, Human
cggccaggccag

SEQ ID NO: 3340572 - RNA, 23 nt, Human
cggcuggcagcccaccccucaac

SEQ ID NO: 3340573 - RNA, 13 nt, Human
cggcuggccuggc

SEQ ID NO: 3340574 - RNA, 19 nt, Human
cgggaagggggcugggaca

SEQ ID NO: 3340575 - RNA, 20 nt, Human
cgggaagggggcugggacau

SEQ ID NO: 3340576 - RNA, 16 nt, Human
cgggaagggggcuggg

SEQ ID NO: 3340577 - RNA, 15 nt, Human
cgaauauugcugaug

SEQ ID NO: 3340578 - RNA, 17 nt, Human
cgaauauugcugauggu

SEQ ID NO: 3340579 - RNA, 12 nt, Human
cgaauauugcug

SEQ ID NO: 3340580 - RNA, 14 nt, Human
cgaauauugcugau

SEQ ID NO: 3340581 - RNA, 11 nt, Human
cgaauauugcu

SEQ ID NO: 3340582 - RNA, 16 nt, Human
cgaauagcugggacua

SEQ ID NO: 3340583 - RNA, 15 nt, Human
cgaauagcugggacu

SEQ ID NO: 3340584 - RNA, 17 nt, Human
ccuuuuuuggcugcuga

SEQ ID NO: 3340585 - RNA, 18 nt, Human
ccuuuuuuggcugcugaa

SEQ ID NO: 3340586 - RNA, 20 nt, Human
ccuuuuuuggcugcugaagg

SEQ ID NO: 3340587 - RNA, 22 nt, Human
ccuuuuuuggcugcugaaggcu

SEQ ID NO: 3340588 - RNA, 23 nt, Human
cgaaagggacuuggaagcuccgc

SEQ ID NO: 3340589 - RNA, 21 nt, Human
cgaacauguuuuucuucuccc

SEQ ID NO: 3340590 - RNA, 11 nt, Human
cgaacaaaaca

SEQ ID NO: 3340591 - RNA, 15 nt, Human
ccuuuuuuggcugcu

SEQ ID NO: 3340592 - RNA, 19 nt, Human
ccuuuuuuauacauaaaca

SEQ ID NO: 3340593 - RNA, 15 nt, Human
ccuuugugaggaagc

SEQ ID NO: 3340594 - RNA, 16 nt, Human
ccuuugugaggaagcc

SEQ ID NO: 3340595 - RNA, 17 nt, Human
ccuuugugaggaagccg

SEQ ID NO: 3340596 - RNA, 23 nt, Human
ccuuugugaggaagccgcugggg

SEQ ID NO: 3340597 - RNA, 22 nt, Human
ccuuuguccccaccgcagacag

SEQ ID NO: 3340598 - RNA, 23 nt, Human
ccuuuguccccaccgcagacagg

SEQ ID NO: 3340599 - RNA, 14 nt, Human
ccuuugugaggaag

SEQ ID NO: 3340600 - RNA, 22 nt, Human
ccuuuguauucucuccuguacc

SEQ ID NO: 3340601 - RNA, 23 nt, Human
ccuuuguauucucuccuguaccu

SEQ ID NO: 3340602 - RNA, 24 nt, Human
ccuuuguauucucuccuguaccuc

SEQ ID NO: 3340603 - RNA, 20 nt, Human
ccuuuguauucucuccugua

SEQ ID NO: 3340604 - RNA, 16 nt, Human
ccuuuguccccaccgc

SEQ ID NO: 3340605 - RNA, 18 nt, Human
ccuuuguccccaccgcag

SEQ ID NO: 3340606 - RNA, 14 nt, Human
ccuuuguccccacc

SEQ ID NO: 3340607 - RNA, 19 nt, Human
ccuuggugucgggcaugac

SEQ ID NO: 3340608 - RNA, 20 nt, Human
ccuuggugucgggcaugaca

SEQ ID NO: 3340609 - RNA, 14 nt, Human
ccuuggggagcagg

SEQ ID NO: 3340610 - RNA, 16 nt, Human
ccuuggcugcagggag

SEQ ID NO: 3340611 - RNA, 14 nt, Human
ccuuggcugcaggg

SEQ ID NO: 3340612 - RNA, 17 nt, Human
ccuucucuccagccccu

SEQ ID NO: 3340613 - RNA, 18 nt, Human
ccuucucuccagccccug

SEQ ID NO: 3340614 - RNA, 21 nt, Human
ccuugacagggcacaccgggc

SEQ ID NO: 3340615 - RNA, 18 nt, Human
ccuugacagggcacaccg

SEQ ID NO: 3340616 - RNA, 22 nt, Human
ccuuggcucaaguccucuuuuc

SEQ ID NO: 3340617 - RNA, 15 nt, Human
ccuuggauugucccc

SEQ ID NO: 3340618 - RNA, 20 nt, Human
ccuguggaugauaaaacaca

SEQ ID NO: 3340619 - RNA, 20 nt, Human
ccugugggcccccaaaugga

SEQ ID NO: 3340620 - RNA, 20 nt, Human
ccugugccucugggacugga

SEQ ID NO: 3340621 - RNA, 19 nt, Human
ccugugccucugggacugg

SEQ ID NO: 3340622 - RNA, 12 nt, Human
ccuucucuccag

SEQ ID NO: 3340623 - RNA, 13 nt, Human
ccuucucuccagc

SEQ ID NO: 3340624 - RNA, 15 nt, Human
ccuucucuccagccc

SEQ ID NO: 3340625 - RNA, 16 nt, Human
ccuucucuccagcccc

SEQ ID NO: 3340626 - RNA, 17 nt, Human
ccuuccauggacuuugu

SEQ ID NO: 3340627 - RNA, 22 nt, Human
ccuuccaggggugggacacccu

SEQ ID NO: 3340628 - RNA, 13 nt, Human
ccuuccaggggug

SEQ ID NO: 3340629 - RNA, 18 nt, Human
ccugguggcagcugcggu

SEQ ID NO: 3340630 - RNA, 17 nt, Human
ccugguggcagcugcgg

SEQ ID NO: 3340631 - RNA, 16 nt, Human
ccugguggcagcugcg

SEQ ID NO: 3340632 - RNA, 15 nt, Human
ccugguggcagcugc

SEQ ID NO: 3340633 - RNA, 19 nt, Human
ccugguggcagcucaccuc

SEQ ID NO: 3340634 - RNA, 21 nt, Human
ccugguggcagcucaccucuc

SEQ ID NO: 3340635 - RNA, 22 nt, Human
ccugguggcagcucaccucucc

SEQ ID NO: 3340636 - RNA, 14 nt, Human
ccugguggcagcug

SEQ ID NO: 3340637 - RNA, 12 nt, Human
ccugucccccug

SEQ ID NO: 3340638 - RNA, 13 nt, Human
ccugucccccuga

SEQ ID NO: 3340639 - RNA, 14 nt, Human
ccugucccccugac

SEQ ID NO: 3340640 - RNA, 15 nt, Human
ccugucccccugaca

SEQ ID NO: 3340641 - RNA, 13 nt, Human
ccuguagcccuaa

SEQ ID NO: 3340642 - RNA, 15 nt, Human
ccuguagagugggag

SEQ ID NO: 3340643 - RNA, 16 nt, Human
ccuguagagugggagc

SEQ ID NO: 3340644 - RNA, 10 nt, Human
ccuguaccuc

SEQ ID NO: 3340645 - RNA, 14 nt, Human
ccugguggcagugg

SEQ ID NO: 3340646 - RNA, 13 nt, Human
ccugguggcagug

SEQ ID NO: 3340647 - RNA, 19 nt, Human
ccugggggcugggcagagg

SEQ ID NO: 3340648 - RNA, 20 nt, Human
ccugggggcugggcagagga

SEQ ID NO: 3340649 - RNA, 21 nt, Human
ccugggggcugggcagaggaa

SEQ ID NO: 3340650 - RNA, 18 nt, Human
ccugggggcugggcagag

SEQ ID NO: 3340651 - RNA, 15 nt, Human
ccugggcagaaggaa

SEQ ID NO: 3340652 - RNA, 20 nt, Human
ccugggaggucaaggcugca

SEQ ID NO: 3340653 - RNA, 18 nt, Human
ccugggagugagcugguu

SEQ ID NO: 3340654 - RNA, 16 nt, Human
ccugggcagaaggaag

SEQ ID NO: 3340655 - RNA, 22 nt, Human
ccugggaggucaaggcugcagu

SEQ ID NO: 3340656 - RNA, 16 nt, Human
ccugggagugagcugg

SEQ ID NO: 3340657 - RNA, 16 nt, Human
ccuggcccacugcauc

SEQ ID NO: 3340658 - RNA, 13 nt, Human
ccuggcacugcuu

SEQ ID NO: 3340659 - RNA, 16 nt, Human
ccuggcacugcuucca

SEQ ID NO: 3340660 - RNA, 13 nt, Human
ccuggcaugggaa

SEQ ID NO: 3340661 - RNA, 23 nt, Human
ccuggcaugggaaugaaugucag

SEQ ID NO: 3340662 - RNA, 20 nt, Human
ccuggccagaugcaccagcc

SEQ ID NO: 3340663 - RNA, 23 nt, Human
ccuggccagaugcaccagcccuu

SEQ ID NO: 3340664 - RNA, 21 nt, Human
ccuggccagaugcaccagccc

SEQ ID NO: 3340665 - RNA, 13 nt, Human
ccuggcccacugc

SEQ ID NO: 3340666 - RNA, 14 nt, Human
ccuggcccacugca

SEQ ID NO: 3340667 - RNA, 12 nt, Human
ccuggcacugcu

SEQ ID NO: 3340668 - RNA, 22 nt, Human
ccuggcacuauaauguaagcuc

SEQ ID NO: 3340669 - RNA, 18 nt, Human
ccuggcacccggccccug

SEQ ID NO: 3340670 - RNA, 20 nt, Human
ccuggcacccggccccugcu

SEQ ID NO: 3340671 - RNA, 19 nt, Human
ccuggcacccggccccugc

SEQ ID NO: 3340672 - RNA, 18 nt, Human
ccugccuguugggccagg

SEQ ID NO: 3340673 - RNA, 19 nt, Human
ccugccuguugggccagga

SEQ ID NO: 3340674 - RNA, 20 nt, Human
ccugccuguugggccaggag

SEQ ID NO: 3340675 - RNA, 21 nt, Human
ccugcuaauuccccagauugc

SEQ ID NO: 3340676 - RNA, 17 nt, Human
ccugcuaauuccccaga

SEQ ID NO: 3340677 - RNA, 13 nt, Human
ccugccacccugg

SEQ ID NO: 3340678 - RNA, 12 nt, Human
ccugccacccug

SEQ ID NO: 3340679 - RNA, 14 nt, Human
ccugccacccuggg

SEQ ID NO: 3340680 - RNA, 22 nt, Human
ccugccacccuggggagaaagu

SEQ ID NO: 3340681 - RNA, 16 nt, Human
ccugccacccugggga

SEQ ID NO: 3340682 - RNA, 19 nt, Human
ccugccaauggacuaacuu

SEQ ID NO: 3340683 - RNA, 15 nt, Human
ccugagccagauuuc

SEQ ID NO: 3340684 - RNA, 12 nt, Human
ccugagccagau

SEQ ID NO: 3340685 - RNA, 16 nt, Human
ccugagccagauuuca

SEQ ID NO: 3340686 - RNA, 18 nt, Human
ccugagccagauuucacu

SEQ ID NO: 3340687 - RNA, 19 nt, Human
ccugaagucacacagugag

SEQ ID NO: 3340688 - RNA, 20 nt, Human
ccugaagucacacagugagu

SEQ ID NO: 3340689 - RNA, 22 nt, Human
ccugaagucuuuguacagacaa

SEQ ID NO: 3340690 - RNA, 12 nt, Human
ccugagcuggga

SEQ ID NO: 3340691 - RNA, 15 nt, Human
ccugaggcccagagg

SEQ ID NO: 3340692 - RNA, 16 nt, Human
ccugaggcccagaggg

SEQ ID NO: 3340693 - RNA, 17 nt, Human
ccugaggcccagagggc

SEQ ID NO: 3340694 - RNA, 13 nt, Human
ccugaggcugggc

SEQ ID NO: 3340695 - RNA, 14 nt, Human
ccugaggcugggcu

SEQ ID NO: 3340696 - RNA, 15 nt, Human
ccugaggcugggcuc

SEQ ID NO: 3340697 - RNA, 14 nt, Human
ccugaggcccagag

SEQ ID NO: 3340698 - RNA, 15 nt, Human
ccugagcugggauga

SEQ ID NO: 3340699 - RNA, 22 nt, Human
ccugaaggccccgcccaggcuu

SEQ ID NO: 3340700 - RNA, 20 nt, Human
ccugaaggccccgcccaggc

SEQ ID NO: 3340701 - RNA, 21 nt, Human
ccugaaggccccgcccaggcu

SEQ ID NO: 3340702 - RNA, 18 nt, Human
ccugaaggccccgcccag

SEQ ID NO: 3340703 - RNA, 19 nt, Human
ccugaaggccccgcccagg

SEQ ID NO: 3340704 - RNA, 14 nt, Human
ccugaaggccccgc

SEQ ID NO: 3340705 - RNA, 13 nt, Human
ccugaaagcccug

SEQ ID NO: 3340706 - RNA, 14 nt, Human
ccugaaagcccuga

SEQ ID NO: 3340707 - RNA, 21 nt, Human
ccugaagacucauucuucugu

SEQ ID NO: 3340708 - RNA, 18 nt, Human
ccugaaagcccugagcuu

SEQ ID NO: 3340709 - RNA, 22 nt, Human
ccugccuguugggccaggagcc

SEQ ID NO: 3340710 - RNA, 12 nt, Human
ccugcccugugg

SEQ ID NO: 3340711 - RNA, 14 nt, Human
ccugcccugugggc

SEQ ID NO: 3340712 - RNA, 11 nt, Human
ccugcccugug

SEQ ID NO: 3340713 - RNA, 14 nt, Human
ccugccuguugggc

SEQ ID NO: 3340714 - RNA, 11 nt, Human
ccugccucagc

SEQ ID NO: 3340715 - RNA, 12 nt, Human
ccugccucagcc

SEQ ID NO: 3340716 - RNA, 13 nt, Human
ccugccucagccu

SEQ ID NO: 3340717 - RNA, 15 nt, Human
ccugcccugugggcc

SEQ ID NO: 3340718 - RNA, 19 nt, Human
ccugcccuuaccugccagg

SEQ ID NO: 3340719 - RNA, 21 nt, Human
ccugcccuuaccugccaggaa

SEQ ID NO: 3340720 - RNA, 22 nt, Human
ccugcccuuaccugccaggaag

SEQ ID NO: 3340721 - RNA, 12 nt, Human
ccugccaggcau

SEQ ID NO: 3340722 - RNA, 22 nt, Human
ccugccagggacagagggggug

SEQ ID NO: 3340723 - RNA, 16 nt, Human
ccugcccggcugcgga

SEQ ID NO: 3340724 - RNA, 14 nt, Human
ccugcccggcugcg

SEQ ID NO: 3340725 - RNA, 21 nt, Human
cucagcggggacagcuccuuc

SEQ ID NO: 3340726 - RNA, 20 nt, Human
cucagcggggacagcuccuu

SEQ ID NO: 3340727 - RNA, 19 nt, Human
cucagcggggacagcuccu

SEQ ID NO: 3340728 - RNA, 18 nt, Human
cucagcggggacagcucc

SEQ ID NO: 3340729 - RNA, 16 nt, Human
cucagcggggacagcu

SEQ ID NO: 3340730 - RNA, 15 nt, Human
cucagcggggacagc

SEQ ID NO: 3340731 - RNA, 14 nt, Human
cucagcggggacag

SEQ ID NO: 3340732 - RNA, 23 nt, Human
cucagcggggacagcuccuucug

SEQ ID NO: 3340733 - RNA, 13 nt, Human
cucagcggggaca

SEQ ID NO: 3340734 - RNA, 16 nt, Human
cucagcaggggagggu

SEQ ID NO: 3340735 - RNA, 19 nt, Human
cucagcaaaagaugcuucu

SEQ ID NO: 3340736 - RNA, 20 nt, Human
cucagcaaaagaugcuucuc

SEQ ID NO: 3340737 - RNA, 22 nt, Human
cucagcauccuggcacccggcc

SEQ ID NO: 3340738 - RNA, 21 nt, Human
cucagcauccuggcacccggc

SEQ ID NO: 3340739 - RNA, 13 nt, Human
cucagcauccugg

SEQ ID NO: 3340740 - RNA, 14 nt, Human
cucacugcagccuc

SEQ ID NO: 3340741 - RNA, 16 nt, Human
cucacugcagccucaa

SEQ ID NO: 3340742 - RNA, 15 nt, Human
cucacugcagccuca

SEQ ID NO: 3340743 - RNA, 15 nt, Human
cucacuguugcccag

SEQ ID NO: 3340744 - RNA, 14 nt, Human
cucacuguugccca

SEQ ID NO: 3340745 - RNA, 18 nt, Human
cucacuguugcccaggcu

SEQ ID NO: 3340746 - RNA, 17 nt, Human
cucacuguugcccaggc

SEQ ID NO: 3340747 - RNA, 16 nt, Human
cucacuguugcccagg

SEQ ID NO: 3340748 - RNA, 23 nt, Human
cucagagagggugggagugggcc

SEQ ID NO: 3340749 - RNA, 19 nt, Human
cucagagagggugggagug

SEQ ID NO: 3340750 - RNA, 18 nt, Human
cucagagagggugggagu

SEQ ID NO: 3340751 - RNA, 16 nt, Human
cucagaucuucugugg

SEQ ID NO: 3340752 - RNA, 18 nt, Human
cucaggcaggugggaugg

SEQ ID NO: 3340753 - RNA, 15 nt, Human
cucaggcagguggga

SEQ ID NO: 3340754 - RNA, 18 nt, Human
cucagggccuggcucagg

SEQ ID NO: 3340755 - RNA, 19 nt, Human
cucagggccuggcucaggu

SEQ ID NO: 3340756 - RNA, 20 nt, Human
cucagggccuggcucaggug

SEQ ID NO: 3340757 - RNA, 23 nt, Human
cucaggugauccacccaccucag

SEQ ID NO: 3340758 - RNA, 22 nt, Human
cucaggugauccacccaccuca

SEQ ID NO: 3340759 - RNA, 19 nt, Human
cucagguggggucacucug

SEQ ID NO: 3340760 - RNA, 20 nt, Human
cucagguggggucacucugg

SEQ ID NO: 3340761 - RNA, 21 nt, Human
cucagguggggucacucuggc

SEQ ID NO: 3340762 - RNA, 20 nt, Human
cucagggucccugguggcag

SEQ ID NO: 3340763 - RNA, 21 nt, Human
cucagggucccugguggcagc

SEQ ID NO: 3340764 - RNA, 22 nt, Human
cucagggucccugguggcagcu

SEQ ID NO: 3340765 - RNA, 24 nt, Human
cucagggucccugguggcagcuca

SEQ ID NO: 3340766 - RNA, 18 nt, Human
cucagggucccugguggc

SEQ ID NO: 3340767 - RNA, 23 nt, Human
cucccaaagugcugggauuacag

SEQ ID NO: 3340768 - RNA, 16 nt, Human
cucccaaagugcuggg

SEQ ID NO: 3340769 - RNA, 14 nt, Human
cucccaacucaccc

SEQ ID NO: 3340770 - RNA, 15 nt, Human
cucccaacucacccc

SEQ ID NO: 3340771 - RNA, 15 nt, Human
cucccacaaaggaga

SEQ ID NO: 3340772 - RNA, 16 nt, Human
cucccaucacuucccu

SEQ ID NO: 3340773 - RNA, 14 nt, Human
cucccaucacccgc

SEQ ID NO: 3340774 - RNA, 15 nt, Human
cucccuucauccuuc

SEQ ID NO: 3340775 - RNA, 19 nt, Human
cucccgaauagcugggacu

SEQ ID NO: 3340776 - RNA, 23 nt, Human
cucccgaauagcugggacuacag

SEQ ID NO: 3340777 - RNA, 20 nt, Human
cucccgaauagcugggacua

SEQ ID NO: 3340778 - RNA, 14 nt, Human
cuccccugcugggu

SEQ ID NO: 3340779 - RNA, 21 nt, Human
cuccccugcuggguguggcgc

SEQ ID NO: 3340780 - RNA, 23 nt, Human
cuccccugcuggguguggcgcag

SEQ ID NO: 3340781 - RNA, 18 nt, Human
cucauucuccuuguguua

SEQ ID NO: 3340782 - RNA, 22 nt, Human
cucauucuccuuguguuacuaa

SEQ ID NO: 3340783 - RNA, 17 nt, Human
cucauugaccugaggcc

SEQ ID NO: 3340784 - RNA, 19 nt, Human
cucauugaccugaggcccu

SEQ ID NO: 3340785 - RNA, 21 nt, Human
cucauugaccugaggcccuuc

SEQ ID NO: 3340786 - RNA, 18 nt, Human
cuccaaaauaaaacuuuu

SEQ ID NO: 3340787 - RNA, 17 nt, Human
cuccaagcucccaggca

SEQ ID NO: 3340788 - RNA, 21 nt, Human
cucauuugucacacacuuugg

SEQ ID NO: 3340789 - RNA, 18 nt, Human
cucauuugucacacacuu

SEQ ID NO: 3340790 - RNA, 16 nt, Human
cuccagagucagaagu

SEQ ID NO: 3340791 - RNA, 13 nt, Human
cuccagccccugg

SEQ ID NO: 3340792 - RNA, 14 nt, Human
cuccagccccugga

SEQ ID NO: 3340793 - RNA, 11 nt, Human
cuccagccccu

SEQ ID NO: 3340794 - RNA, 18 nt, Human
cuccagcucaccagcccc

SEQ ID NO: 3340795 - RNA, 16 nt, Human
cuccagcucaccagcc

SEQ ID NO: 3340796 - RNA, 15 nt, Human
cuccagcucaccagc

SEQ ID NO: 3340797 - RNA, 14 nt, Human
cuccagcucaccag

SEQ ID NO: 3340798 - RNA, 24 nt, Human
cuagauacuguaucaugacaaaga

SEQ ID NO: 3340799 - RNA, 13 nt, Human
cuagauacuguau

SEQ ID NO: 3340800 - RNA, 16 nt, Human
cuagauacuguaucau

SEQ ID NO: 3340801 - RNA, 19 nt, Human
cuagccugugccucuggga

SEQ ID NO: 3340802 - RNA, 21 nt, Human
cuagccugugccucugggacu

SEQ ID NO: 3340803 - RNA, 22 nt, Human
cuagccugugccucugggacug

SEQ ID NO: 3340804 - RNA, 21 nt, Human
cuagccuuagaagucacacag

SEQ ID NO: 3340805 - RNA, 23 nt, Human
cuagccuuagaagucacacagua

SEQ ID NO: 3340806 - RNA, 22 nt, Human
cuagccuuagaagucacacagu

SEQ ID NO: 3340807 - RNA, 20 nt, Human
cuacuguccuacccacccuc

SEQ ID NO: 3340808 - RNA, 18 nt, Human
cuagagguucaaagauau

SEQ ID NO: 3340809 - RNA, 21 nt, Human
cuagagguucaaagauauuuu

SEQ ID NO: 3340810 - RNA, 17 nt, Human
cuagagguucaaagaua

SEQ ID NO: 3340811 - RNA, 15 nt, Human
cuagagguucaaaga

SEQ ID NO: 3340812 - RNA, 21 nt, Human
cuagagugaacuugggccacu

SEQ ID NO: 3340813 - RNA, 16 nt, Human
cuacucgaguuacaga

SEQ ID NO: 3340814 - RNA, 19 nt, Human
cuacucgaguuacagacaa

SEQ ID NO: 3340815 - RNA, 15 nt, Human
cuacucgaguuacag

SEQ ID NO: 3340816 - RNA, 21 nt, Human
cuacuguaauuugugauacaa

SEQ ID NO: 3340817 - RNA, 19 nt, Human
cuacuguccuacccacccu

SEQ ID NO: 3340818 - RNA, 12 nt, Human
cuacucuguguc

SEQ ID NO: 3340819 - RNA, 14 nt, Human
cuacugaggugcua

SEQ ID NO: 3340820 - RNA, 23 nt, Human
cucacacggacacucaaaagcug

SEQ ID NO: 3340821 - RNA, 16 nt, Human
cucaacucuccuccag

SEQ ID NO: 3340822 - RNA, 18 nt, Human
cucaacucuccuccagag

SEQ ID NO: 3340823 - RNA, 14 nt, Human
cucaaauuucuaaa

SEQ ID NO: 3340824 - RNA, 15 nt, Human
cucaaauuucuaaau

SEQ ID NO: 3340825 - RNA, 17 nt, Human
cucaaauuucuaaaucu

SEQ ID NO: 3340826 - RNA, 13 nt, Human
cucaaauuucuaa

SEQ ID NO: 3340827 - RNA, 14 nt, Human
cucaacucuccucc

SEQ ID NO: 3340828 - RNA, 18 nt, Human
cuauuguuagucucuuga

SEQ ID NO: 3340829 - RNA, 16 nt, Human
cuauugcugcuugagg

SEQ ID NO: 3340830 - RNA, 21 nt, Human
cuauagccuaggugacagagu

SEQ ID NO: 3340831 - RNA, 20 nt, Human
cuauagccuaggugacagag

SEQ ID NO: 3340832 - RNA, 18 nt, Human
cuauagccuaggugacag

SEQ ID NO: 3340833 - RNA, 19 nt, Human
cuauagccuaggugacaga

SEQ ID NO: 3340834 - RNA, 20 nt, Human
cuaggaacacuccuucacag

SEQ ID NO: 3340835 - RNA, 15 nt, Human
cuaggaagacuuugg

SEQ ID NO: 3340836 - RNA, 21 nt, Human
cuaugcauuugaaaauuuuga

SEQ ID NO: 3340837 - RNA, 23 nt, Human
cuauucaguaauaacucuacccu

SEQ ID NO: 3340838 - RNA, 13 nt, Human
cuauguaucaaug

SEQ ID NO: 3340839 - RNA, 17 nt, Human
cuauucaguaauaacuc

SEQ ID NO: 3340840 - RNA, 22 nt, Human
cuacauuauaaaugucucuuua

SEQ ID NO: 3340841 - RNA, 13 nt, Human
cuacauucuguua

SEQ ID NO: 3340842 - RNA, 14 nt, Human
cuacauucuguuaa

SEQ ID NO: 3340843 - RNA, 18 nt, Human
cuaccauccccuguagag

SEQ ID NO: 3340844 - RNA, 17 nt, Human
cuacccagcgagcccug

SEQ ID NO: 3340845 - RNA, 15 nt, Human
cuacccagcgagccc

SEQ ID NO: 3340846 - RNA, 12 nt, Human
cuacccaggugc

SEQ ID NO: 3340847 - RNA, 13 nt, Human
cuacccaggugcu

SEQ ID NO: 3340848 - RNA, 18 nt, Human
cuacccagcgagcccugg

SEQ ID NO: 3340849 - RNA, 17 nt, Human
cuacccucuuagaaaaa

SEQ ID NO: 3340850 - RNA, 13 nt, Human
cuacacugugcug

SEQ ID NO: 3340851 - RNA, 14 nt, Human
cuacacugugcuga

SEQ ID NO: 3340852 - RNA, 17 nt, Human
cuacacugugcugaguc

SEQ ID NO: 3340853 - RNA, 17 nt, Human
cuacagaggccaugggc

SEQ ID NO: 3340854 - RNA, 20 nt, Human
cuacagaggccaugggccuc

SEQ ID NO: 3340855 - RNA, 18 nt, Human
cuacagaggccaugggcc

SEQ ID NO: 3340856 - RNA, 22 nt, Human
cuacagaggccaugggccuccu

SEQ ID NO: 3340857 - RNA, 19 nt, Human
cuacagcuugaccgugagg

SEQ ID NO: 3340858 - RNA, 22 nt, Human
cuacagcuugaccgugaggcca

SEQ ID NO: 3340859 - RNA, 23 nt, Human
cuacagcuugaccgugaggccag

SEQ ID NO: 3340860 - RNA, 16 nt, Human
cuacaggagugagcac

SEQ ID NO: 3340861 - RNA, 15 nt, Human
cuacaggagugagca

SEQ ID NO: 3340862 - RNA, 14 nt, Human
cuacaggagugagc

SEQ ID NO: 3340863 - RNA, 17 nt, Human
cuacaggcacccaccau

SEQ ID NO: 3340864 - RNA, 15 nt, Human
cuacaggcacccacc

SEQ ID NO: 3340865 - RNA, 20 nt, Human
cuacauggaguauaugucaa

SEQ ID NO: 3340866 - RNA, 18 nt, Human
cuacauggaguauauguc

SEQ ID NO: 3340867 - RNA, 14 nt, Human
cuacaggugugagu

SEQ ID NO: 3340868 - RNA, 16 nt, Human
cuacaggugugaguca

SEQ ID NO: 3340869 - RNA, 13 nt, Human
cuaaugggacacu

SEQ ID NO: 3340870 - RNA, 12 nt, Human
cuaaugggacac

SEQ ID NO: 3340871 - RNA, 21 nt, Human
cuacacaggggaaaagaggag

SEQ ID NO: 3340872 - RNA, 21 nt, Human
cuacacacugcauguuuguga

SEQ ID NO: 3340873 - RNA, 19 nt, Human
cuaauagacaauuuauuau

SEQ ID NO: 3340874 - RNA, 23 nt, Human
cuaauagacaauuuauuauggca

SEQ ID NO: 3340875 - RNA, 17 nt, Human
cuaauagacaauuuauu

SEQ ID NO: 3340876 - RNA, 22 nt, Human
cuaagcuauucaguaauaacuc

SEQ ID NO: 3340877 - RNA, 21 nt, Human
cuaaaucuccaaaauaaaacu

SEQ ID NO: 3340878 - RNA, 20 nt, Human
cuaaaucuccaaaauaaaac

SEQ ID NO: 3340879 - RNA, 22 nt, Human
cuaaaugaaaaucgugacaaca

SEQ ID NO: 3340880 - RNA, 11 nt, Human
cuaaaauauau

SEQ ID NO: 3340881 - RNA, 21 nt, Human
cgggaggauguucugggacac

SEQ ID NO: 3340882 - RNA, 23 nt, Human
cgggaggauguucugggacacag

SEQ ID NO: 3340883 - RNA, 15 nt, Human
cuaagagggagggag

SEQ ID NO: 3340884 - RNA, 22 nt, Human
cuaagagggagggagggcucca

SEQ ID NO: 3340885 - RNA, 13 nt, Human
cuaagagggaggg

SEQ ID NO: 3340886 - RNA, 23 nt, Human
cuaagagggagggagggcuccag

SEQ ID NO: 3340887 - RNA, 12 nt, Human
cuaaccacgcug

SEQ ID NO: 3340888 - RNA, 16 nt, Human
cuaaauucaugcugcu

SEQ ID NO: 3340889 - RNA, 15 nt, Human
acccacccccaccca

SEQ ID NO: 3340890 - RNA, 17 nt, Human
acccacccccacccaag

SEQ ID NO: 3340891 - RNA, 15 nt, Human
acccacccuccuuuc

SEQ ID NO: 3340892 - RNA, 13 nt, Human
acccaugcugccc

SEQ ID NO: 3340893 - RNA, 14 nt, Human
accaucaagccacc

SEQ ID NO: 3340894 - RNA, 15 nt, Human
accaucauugaaauc

SEQ ID NO: 3340895 - RNA, 12 nt, Human
accaucauugaa

SEQ ID NO: 3340896 - RNA, 15 nt, Human
accaucaagccacca

SEQ ID NO: 3340897 - RNA, 23 nt, Human
accaucauugaaaucuuuuugcu

SEQ ID NO: 3340898 - RNA, 23 nt, Human
acaugucuuuucuugcaugaggc

SEQ ID NO: 3340899 - RNA, 21 nt, Human
acaugucuuuucuugcaugag

SEQ ID NO: 3340900 - RNA, 19 nt, Human
acaugccucucucaggcca

SEQ ID NO: 3340901 - RNA, 14 nt, Human
accagcagaaaugc

SEQ ID NO: 3340902 - RNA, 12 nt, Human
accagcagagca

SEQ ID NO: 3340903 - RNA, 13 nt, Human
accagcagagcac

SEQ ID NO: 3340904 - RNA, 17 nt, Human
accagccccagugccca

SEQ ID NO: 3340905 - RNA, 16 nt, Human
accagccccagugccc

SEQ ID NO: 3340906 - RNA, 19 nt, Human
accagccccagugcccaca

SEQ ID NO: 3340907 - RNA, 18 nt, Human
accagccccagugcccac

SEQ ID NO: 3340908 - RNA, 20 nt, Human
accagccccagugcccacag

SEQ ID NO: 3340909 - RNA, 17 nt, Human
acaugcaaggucauuuu

SEQ ID NO: 3340910 - RNA, 15 nt, Human
acaugccucucucag

SEQ ID NO: 3340911 - RNA, 16 nt, Human
acaugccucucucagg

SEQ ID NO: 3340912 - RNA, 17 nt, Human
acaugccucucucaggc

SEQ ID NO: 3340913 - RNA, 18 nt, Human
acaugccucucucaggcc

SEQ ID NO: 3340914 - RNA, 16 nt, Human
acaugcaaggucauuu

SEQ ID NO: 3340915 - RNA, 16 nt, Human
acauaagauaaaugug

SEQ ID NO: 3340916 - RNA, 15 nt, Human
acauaagauaaaugu

SEQ ID NO: 3340917 - RNA, 13 nt, Human
acagcucuguccu

SEQ ID NO: 3340918 - RNA, 16 nt, Human
acagcucuguccuggg

SEQ ID NO: 3340919 - RNA, 23 nt, Human
acaggcaagcaccuccugccucg

SEQ ID NO: 3340920 - RNA, 20 nt, Human
acaggcaagcaccuccugcc

SEQ ID NO: 3340921 - RNA, 14 nt, Human
acagcucuguccug

SEQ ID NO: 3340922 - RNA, 18 nt, Human
acagcuccuucuguccua

SEQ ID NO: 3340923 - RNA, 16 nt, Human
acagcuccuucugucc

SEQ ID NO: 3340924 - RNA, 17 nt, Human
acagaggggguggccuc

SEQ ID NO: 3340925 - RNA, 18 nt, Human
acagaggggguggccucc

SEQ ID NO: 3340926 - RNA, 19 nt, Human
acagaggggguggccuccc

SEQ ID NO: 3340927 - RNA, 15 nt, Human
acagcuccuucuguc

SEQ ID NO: 3340928 - RNA, 19 nt, Human
acaggcaagcaccuccugc

SEQ ID NO: 3340929 - RNA, 23 nt, Human
acaggugugagucaccaagccca

SEQ ID NO: 3340930 - RNA, 22 nt, Human
acaggugugagucaccaagccc

SEQ ID NO: 3340931 - RNA, 22 nt, Human
acagugagucgaggacagggag

SEQ ID NO: 3340932 - RNA, 15 nt, Human
acacgaauauugcug

SEQ ID NO: 3340933 - RNA, 21 nt, Human
acacgaauauugcugauggug

SEQ ID NO: 3340934 - RNA, 16 nt, Human
acacauuuuuuaaaug

SEQ ID NO: 3340935 - RNA, 18 nt, Human
acacauuuuuuaaaugca

SEQ ID NO: 3340936 - RNA, 14 nt, Human
acaccacuacauuc

SEQ ID NO: 3340937 - RNA, 15 nt, Human
acaccacuacauucu

SEQ ID NO: 3340938 - RNA, 17 nt, Human
acaccacuacauucugu

SEQ ID NO: 3340939 - RNA, 20 nt, Human
acaccacuacauucuguuaa

SEQ ID NO: 3340940 - RNA, 12 nt, Human
acacgaauauug

SEQ ID NO: 3340941 - RNA, 14 nt, Human
acacgaauauugcu

SEQ ID NO: 3340942 - RNA, 14 nt, Human
acacauuuuuuaaa

SEQ ID NO: 3340943 - RNA, 12 nt, Human
acacauuuuucu

SEQ ID NO: 3340944 - RNA, 21 nt, Human
acacagcucuucuccaggcug

SEQ ID NO: 3340945 - RNA, 20 nt, Human
acacagcucuucuccaggcu

SEQ ID NO: 3340946 - RNA, 19 nt, Human
acacaaaaguuucucuuuu

SEQ ID NO: 3340947 - RNA, 19 nt, Human
acacagcucuucuccaggc

SEQ ID NO: 3340948 - RNA, 13 nt, Human
acaauuuauuaug

SEQ ID NO: 3340949 - RNA, 20 nt, Human
acaaggaugaucuaggaaga

SEQ ID NO: 3340950 - RNA, 17 nt, Human
acacugugcugagucug

SEQ ID NO: 3340951 - RNA, 22 nt, Human
acacugugcugagucugaaggc

SEQ ID NO: 3340952 - RNA, 14 nt, Human
acagacaaagcgug

SEQ ID NO: 3340953 - RNA, 13 nt, Human
acagacaaagcgu

SEQ ID NO: 3340954 - RNA, 21 nt, Human
acagaggccaugggccuccug

SEQ ID NO: 3340955 - RNA, 14 nt, Human
acagaggggguggc

SEQ ID NO: 3340956 - RNA, 17 nt, Human
acagaggccaugggccu

SEQ ID NO: 3340957 - RNA, 23 nt, Human
acagaggcagccccauucugccu

SEQ ID NO: 3340958 - RNA, 13 nt, Human
acagaggcagccc

SEQ ID NO: 3340959 - RNA, 19 nt, Human
aaugucacaggcaggucca

SEQ ID NO: 3340960 - RNA, 16 nt, Human
aaugucacaggcaggu

SEQ ID NO: 3340961 - RNA, 12 nt, Human
aauuguaaggaa

SEQ ID NO: 3340962 - RNA, 20 nt, Human
aauuuauuuaugggauccug

SEQ ID NO: 3340963 - RNA, 17 nt, Human
aauuuauuauggcacau

SEQ ID NO: 3340964 - RNA, 14 nt, Human
aauuuugauguuuu

SEQ ID NO: 3340965 - RNA, 13 nt, Human
acaaaaugaaacg

SEQ ID NO: 3340966 - RNA, 22 nt, Human
acaaaaugaaacgcaaccacca

SEQ ID NO: 3340967 - RNA, 18 nt, Human
acaaacuuuucaaggcuu

SEQ ID NO: 3340968 - RNA, 11 nt, Human
accugccaggg

SEQ ID NO: 3340969 - RNA, 12 nt, Human
accugccaggga

SEQ ID NO: 3340970 - RNA, 13 nt, Human
accugccagggac

SEQ ID NO: 3340971 - RNA, 15 nt, Human
accugccagggacag

SEQ ID NO: 3340972 - RNA, 16 nt, Human
accugccagggacaga

SEQ ID NO: 3340973 - RNA, 18 nt, Human
accugccagggacagagg

SEQ ID NO: 3340974 - RNA, 17 nt, Human
accucuugagccuugaa

SEQ ID NO: 3340975 - RNA, 19 nt, Human
accucuugagccuugaacu

SEQ ID NO: 3340976 - RNA, 20 nt, Human
accucuugagccuugaacuu

SEQ ID NO: 3340977 - RNA, 16 nt, Human
accgugaggccagaga

SEQ ID NO: 3340978 - RNA, 11 nt, Human
accucaggccu

SEQ ID NO: 3340979 - RNA, 12 nt, Human
accucaggccug

SEQ ID NO: 3340980 - RNA, 13 nt, Human
accucaggccugg

SEQ ID NO: 3340981 - RNA, 14 nt, Human
accucaggccuggg

SEQ ID NO: 3340982 - RNA, 22 nt, Human
accucaggccugggggcugggc

SEQ ID NO: 3340983 - RNA, 18 nt, Human
accucaggugagaagcag

SEQ ID NO: 3340984 - RNA, 17 nt, Human
acccuguuaccauuuug

SEQ ID NO: 3340985 - RNA, 22 nt, Human
acccugugauggggcccugccu

SEQ ID NO: 3340986 - RNA, 21 nt, Human
acccugugauggggcccugcc

SEQ ID NO: 3340987 - RNA, 16 nt, Human
accccacacacgccag

SEQ ID NO: 3340988 - RNA, 14 nt, Human
acccaugcugcccu

SEQ ID NO: 3340989 - RNA, 15 nt, Human
acccaugcugcccug

SEQ ID NO: 3340990 - RNA, 14 nt, Human
accggcuggccugg

SEQ ID NO: 3340991 - RNA, 15 nt, Human
accggcuggccuggc

SEQ ID NO: 3340992 - RNA, 17 nt, Human
accggcuggccuggccc

SEQ ID NO: 3340993 - RNA, 18 nt, Human
accggcuggccuggcccc

SEQ ID NO: 3340994 - RNA, 20 nt, Human
accgggcacucagaagacac

SEQ ID NO: 3340995 - RNA, 14 nt, Human
accgugaggccaga

SEQ ID NO: 3340996 - RNA, 19 nt, Human
accgggccacagagaaagu

SEQ ID NO: 3340997 - RNA, 15 nt, Human
accgggccacagaga

SEQ ID NO: 3340998 - RNA, 17 nt, Human
acuagggaagauaauau

SEQ ID NO: 3340999 - RNA, 16 nt, Human
acuauuguuagucucu

SEQ ID NO: 3341000 - RNA, 11 nt, Human
accugugucuc

SEQ ID NO: 3341001 - RNA, 15 nt, Human
acuaauagacaauuu

SEQ ID NO: 3341002 - RNA, 23 nt, Human
acgucugacaggcaaugcuggcu

SEQ ID NO: 3341003 - RNA, 15 nt, Human
acgucugacaggcaa

SEQ ID NO: 3341004 - RNA, 18 nt, Human
acgcuggagugcagugag

SEQ ID NO: 3341005 - RNA, 19 nt, Human
acgcuggagugcagugagc

SEQ ID NO: 3341006 - RNA, 15 nt, Human
acggaagagccuugc

SEQ ID NO: 3341007 - RNA, 16 nt, Human
acggaagagccuugcg

SEQ ID NO: 3341008 - RNA, 19 nt, Human
acggacacucaaaagcugg

SEQ ID NO: 3341009 - RNA, 15 nt, Human
acugcccggcagggu

SEQ ID NO: 3341010 - RNA, 16 nt, Human
acugcuuuuggucugu

SEQ ID NO: 3341011 - RNA, 15 nt, Human
acugcuuuuggucug

SEQ ID NO: 3341012 - RNA, 14 nt, Human
acugcuuuuggucu

SEQ ID NO: 3341013 - RNA, 22 nt, Human
acugcccggcaggguccuagaa

SEQ ID NO: 3341014 - RNA, 23 nt, Human
acugauuuuuuuuuccuucagug

SEQ ID NO: 3341015 - RNA, 20 nt, Human
acugauuuuuuuuuccuuca

SEQ ID NO: 3341016 - RNA, 21 nt, Human
acugauuuuuuuuuccuucag

SEQ ID NO: 3341017 - RNA, 22 nt, Human
acugauuuuuuuuuccuucagu

SEQ ID NO: 3341018 - RNA, 23 nt, Human
acugacauuguuggccaaagcca

SEQ ID NO: 3341019 - RNA, 22 nt, Human
acugacauuguuggccaaagcc

SEQ ID NO: 3341020 - RNA, 13 nt, Human
acugaucucucgu

SEQ ID NO: 3341021 - RNA, 22 nt, Human
acugauggcuaauguacugcau

SEQ ID NO: 3341022 - RNA, 22 nt, Human
acugaugggcaacccccagccu

SEQ ID NO: 3341023 - RNA, 12 nt, Human
acugaugggcaa

SEQ ID NO: 3341024 - RNA, 19 nt, Human
acucugucucaaaaaaaca

SEQ ID NO: 3341025 - RNA, 19 nt, Human
acucugugucagguggggc

SEQ ID NO: 3341026 - RNA, 21 nt, Human
acucugugucagguggggcag

SEQ ID NO: 3341027 - RNA, 17 nt, Human
acuucuuauacauuuga

SEQ ID NO: 3341028 - RNA, 20 nt, Human
acuucugccauauucuguug

SEQ ID NO: 3341029 - RNA, 19 nt, Human
acuucugccauauucuguu

SEQ ID NO: 3341030 - RNA, 14 nt, Human
acuuaaauaaugug

SEQ ID NO: 3341031 - RNA, 16 nt, Human
aagacuuuggaaagag

SEQ ID NO: 3341032 - RNA, 16 nt, Human
aagacuuuggaaagac

SEQ ID NO: 3341033 - RNA, 21 nt, Human
aagagagagaaacaaacuuuu

SEQ ID NO: 3341034 - RNA, 20 nt, Human
aagagagagaaacaaacuuu

SEQ ID NO: 3341035 - RNA, 19 nt, Human
aagagagagaaacaaacuu

SEQ ID NO: 3341036 - RNA, 20 nt, Human
aagauucauauuuacuucuu

SEQ ID NO: 3341037 - RNA, 19 nt, Human
aagauuuugaaauuuuuau

SEQ ID NO: 3341038 - RNA, 19 nt, Human
aagccaccaacauacuccc

SEQ ID NO: 3341039 - RNA, 21 nt, Human
aagcagaggaaggagaggaga

SEQ ID NO: 3341040 - RNA, 23 nt, Human
aaggaaugauuaauuaaaacaca

SEQ ID NO: 3341041 - RNA, 16 nt, Human
aagcugcugacagugu

SEQ ID NO: 3341042 - RNA, 11 nt, Human
aagcugccagc

SEQ ID NO: 3341043 - RNA, 12 nt, Human
aagcugccagcc

SEQ ID NO: 3341044 - RNA, 22 nt, Human
aagcugccagccgagauagcca

SEQ ID NO: 3341045 - RNA, 14 nt, Human
aagcugcugacagu

SEQ ID NO: 3341046 - RNA, 20 nt, Human
aagcgugagccacugcaccg

SEQ ID NO: 3341047 - RNA, 17 nt, Human
aagcgugagccacugca

SEQ ID NO: 3341048 - RNA, 16 nt, Human
aagcgauucuucugcu

SEQ ID NO: 3341049 - RNA, 16 nt, Human
aagcgugagccacugc

SEQ ID NO: 3341050 - RNA, 14 nt, Human
aagcgauucuucug

SEQ ID NO: 3341051 - RNA, 15 nt, Human
aagcgauucuucugc

SEQ ID NO: 3341052 - RNA, 15 nt, Human
aagccagcaggcucu

SEQ ID NO: 3341053 - RNA, 18 nt, Human
aagccagcaggcucucag

SEQ ID NO: 3341054 - RNA, 21 nt, Human
aagccaccaacauacucccau

SEQ ID NO: 3341055 - RNA, 18 nt, Human
aagggacgcuacccggga

SEQ ID NO: 3341056 - RNA, 20 nt, Human
aagggacuuggaagcuccgc

SEQ ID NO: 3341057 - RNA, 20 nt, Human
aagguuaauguucaucaucc

SEQ ID NO: 3341058 - RNA, 15 nt, Human
aaugucacaggcagg

SEQ ID NO: 3341059 - RNA, 15 nt, Human
aaugggggugcauuu

SEQ ID NO: 3341060 - RNA, 17 nt, Human
aaugggggugcauuuga

SEQ ID NO: 3341061 - RNA, 14 nt, Human
aaugggagcucaug

SEQ ID NO: 3341062 - RNA, 13 nt, Human
aaugggacacuaa

SEQ ID NO: 3341063 - RNA, 21 nt, Human
aaugcgugcauaccacuuuug

SEQ ID NO: 3341064 - RNA, 23 nt, Human
aaugcgugcauaccacuuuuguu

SEQ ID NO: 3341065 - RNA, 12 nt, Human
aaugauuaauua

SEQ ID NO: 3341066 - RNA, 13 nt, Human
aaugauuaauuaa

SEQ ID NO: 3341067 - RNA, 15 nt, Human
aaugauagcuacugu

SEQ ID NO: 3341068 - RNA, 18 nt, Human
aaucuccaaaauaaaacu

SEQ ID NO: 3341069 - RNA, 21 nt, Human
aauaccugucccccugacaac

SEQ ID NO: 3341070 - RNA, 19 nt, Human
aauaauguuaacauggaca

SEQ ID NO: 3341071 - RNA, 13 nt, Human
aagugcugcauuu

SEQ ID NO: 3341072 - RNA, 16 nt, Human
aacagcuaaugggaca

SEQ ID NO: 3341073 - RNA, 19 nt, Human
aaccaguguuguggauuua

SEQ ID NO: 3341074 - RNA, 17 nt, Human
aaccaguguuguggauu

SEQ ID NO: 3341075 - RNA, 13 nt, Human
aacccuucagugc

SEQ ID NO: 3341076 - RNA, 15 nt, Human
aacauggaaguacua

SEQ ID NO: 3341077 - RNA, 22 nt, Human
aacaugcuacacacugcauguu

SEQ ID NO: 3341078 - RNA, 15 nt, Human
aacucaccccagccc

SEQ ID NO: 3341079 - RNA, 18 nt, Human
aacucaccccagccccaa

SEQ ID NO: 3341080 - RNA, 16 nt, Human
aacucaccccagcccc

SEQ ID NO: 3341081 - RNA, 17 nt, Human
aacucaccccagcccca

SEQ ID NO: 3341082 - RNA, 17 nt, Human
aacucaaacucuuaaaa

SEQ ID NO: 3341083 - RNA, 15 nt, Human
aaauggacguguuau

SEQ ID NO: 3341084 - RNA, 17 nt, Human
aaauggacguguuauga

SEQ ID NO: 3341085 - RNA, 14 nt, Human
aaauggacguguua

SEQ ID NO: 3341086 - RNA, 22 nt, Human
aaaucuccaaaauaaaacuuuu

SEQ ID NO: 3341087 - RNA, 19 nt, Human
aaaucuccaaaauaaaacu

SEQ ID NO: 3341088 - RNA, 21 nt, Human
aacacauacaggaagguagaa

SEQ ID NO: 3341089 - RNA, 22 nt, Human
aacaaaccuguuucugcagcca

SEQ ID NO: 3341090 - RNA, 12 nt, Human
aaauuaacuuuu

SEQ ID NO: 3341091 - RNA, 13 nt, Human
aaauuaacuuuua

SEQ ID NO: 3341092 - RNA, 14 nt, Human
aaauuaacuuuuau

SEQ ID NO: 3341093 - RNA, 17 nt, Human
aaacagcuaaugggaca

SEQ ID NO: 3341094 - RNA, 15 nt, Human
aaaauuagccaagug

SEQ ID NO: 3341095 - RNA, 15 nt, Human
aaagauacaguuacu

SEQ ID NO: 3341096 - RNA, 20 nt, Human
aaacugauuuuuuuuuccuu

SEQ ID NO: 3341097 - RNA, 13 nt, Human
aaacugauuuuuu

SEQ ID NO: 3341098 - RNA, 19 nt, Human
aaacugauuuuuuuuuccu

SEQ ID NO: 3341099 - RNA, 14 nt, Human
aaacccuucagugc

SEQ ID NO: 3341100 - RNA, 17 nt, Human
aaacucuugaccucagg

SEQ ID NO: 3341101 - RNA, 18 nt, Human
aaacccagcucuggucca

SEQ ID NO: 3341102 - RNA, 17 nt, Human
aaaccccaucucuacaa

SEQ ID NO: 3341103 - RNA, 11 nt, Human
aaauaaauuau

SEQ ID NO: 3341104 - RNA, 15 nt, Human
aaagccaaagcuagg

SEQ ID NO: 3341105 - RNA, 22 nt, Human
aaaggcuccaggagcagccaca

SEQ ID NO: 3341106 - RNA, 20 nt, Human
aaaggcuccaggagcagcca

SEQ ID NO: 3341107 - RNA, 21 nt, Human
aaaggcuccaggagcagccac

SEQ ID NO: 3341108 - RNA, 17 nt, Human
aaaggcuaccuuuguau

SEQ ID NO: 3341109 - RNA, 14 nt, Human
aaaggcuaccuuug

SEQ ID NO: 3341110 - RNA, 14 nt, Human
aaaggcuccaggag

SEQ ID NO: 3341111 - RNA, 22 nt, Human
agaggacuuuucuuuguggcuu

SEQ ID NO: 3341112 - RNA, 21 nt, Human
agaggacuuuucuuuguggcu

SEQ ID NO: 3341113 - RNA, 14 nt, Human
agaggacuuuucuu

SEQ ID NO: 3341114 - RNA, 17 nt, Human
agaggggguggccuccc

SEQ ID NO: 3341115 - RNA, 19 nt, Human
agaggggguggccucccaa

SEQ ID NO: 3341116 - RNA, 13 nt, Human
agagggccugcaa

SEQ ID NO: 3341117 - RNA, 16 nt, Human
agagggccugcaaggg

SEQ ID NO: 3341118 - RNA, 16 nt, Human
agagagaccacuuuuc

SEQ ID NO: 3341119 - RNA, 13 nt, Human
agagccagggucu

SEQ ID NO: 3341120 - RNA, 13 nt, Human
agacucugucuca

SEQ ID NO: 3341121 - RNA, 18 nt, Human
agacucugucucaaaaaa

SEQ ID NO: 3341122 - RNA, 22 nt, Human
agacugaguacguugugcauuu

SEQ ID NO: 3341123 - RNA, 20 nt, Human
agacugaguacguugugcau

SEQ ID NO: 3341124 - RNA, 21 nt, Human
agacaaugacuuacuguacau

SEQ ID NO: 3341125 - RNA, 22 nt, Human
agacaaugacuuacuguacaug

SEQ ID NO: 3341126 - RNA, 19 nt, Human
agacaaugacuuacuguac

SEQ ID NO: 3341127 - RNA, 15 nt, Human
agacagagcuacaca

SEQ ID NO: 3341128 - RNA, 20 nt, Human
agacagagucucacuguugc

SEQ ID NO: 3341129 - RNA, 19 nt, Human
agacagagucucacuguug

SEQ ID NO: 3341130 - RNA, 13 nt, Human
agacagagcuaca

SEQ ID NO: 3341131 - RNA, 11 nt, Human
agacagagucu

SEQ ID NO: 3341132 - RNA, 20 nt, Human
agacaaugacuuacuguaca

SEQ ID NO: 3341133 - RNA, 15 nt, Human
agaccacguuucuaa

SEQ ID NO: 3341134 - RNA, 22 nt, Human
agacagauacuccuccaagguu

SEQ ID NO: 3341135 - RNA, 21 nt, Human
agacagagucucacuguugcc

SEQ ID NO: 3341136 - RNA, 14 nt, Human
agaaguaacuuacu

SEQ ID NO: 3341137 - RNA, 21 nt, Human
agaagacacugaugggcaacc

SEQ ID NO: 3341138 - RNA, 13 nt, Human
agaagacacugau

SEQ ID NO: 3341139 - RNA, 23 nt, Human
agaagagaaugcacaaacagagg

SEQ ID NO: 3341140 - RNA, 19 nt, Human
agaaugcacaaacagaggc

SEQ ID NO: 3341141 - RNA, 16 nt, Human
agaaugaaagggccca

SEQ ID NO: 3341142 - RNA, 18 nt, Human
agaaugaaagggcccaga

SEQ ID NO: 3341143 - RNA, 16 nt, Human
agccaaagcuaggccu

SEQ ID NO: 3341144 - RNA, 17 nt, Human
agcauccuggcacccgg

SEQ ID NO: 3341145 - RNA, 14 nt, Human
agcauccuggcacc

SEQ ID NO: 3341146 - RNA, 14 nt, Human
agccagcaggcucu

SEQ ID NO: 3341147 - RNA, 17 nt, Human
agccagaggagagagga

SEQ ID NO: 3341148 - RNA, 13 nt, Human
agccagaggagag

SEQ ID NO: 3341149 - RNA, 15 nt, Human
agccagaggagagag

SEQ ID NO: 3341150 - RNA, 11 nt, Human
agccagaggag

SEQ ID NO: 3341151 - RNA, 16 nt, Human
agccagcaggcucuca

SEQ ID NO: 3341152 - RNA, 14 nt, Human
agcccaccuuggcu

SEQ ID NO: 3341153 - RNA, 16 nt, Human
agcccaccuuggcuca

SEQ ID NO: 3341154 - RNA, 14 nt, Human
agcccacgccccca

SEQ ID NO: 3341155 - RNA, 20 nt, Human
agcccacgcccccacuggug

SEQ ID NO: 3341156 - RNA, 23 nt, Human
agcccacgcccccacuggugaca

SEQ ID NO: 3341157 - RNA, 13 nt, Human
agcauccuggcac

SEQ ID NO: 3341158 - RNA, 19 nt, Human
agccccauucugccugccc

SEQ ID NO: 3341159 - RNA, 18 nt, Human
agccccauucugccugcc

SEQ ID NO: 3341160 - RNA, 17 nt, Human
agccccauucugccugc

SEQ ID NO: 3341161 - RNA, 11 nt, Human
agccccauccu

SEQ ID NO: 3341162 - RNA, 17 nt, Human
agccccauccucuguac

SEQ ID NO: 3341163 - RNA, 23 nt, Human
agccccauccucuguacagagcc

SEQ ID NO: 3341164 - RNA, 15 nt, Human
agccccauccucugu

SEQ ID NO: 3341165 - RNA, 17 nt, Human
agcccgggcucugccuc

SEQ ID NO: 3341166 - RNA, 18 nt, Human
agcccgggcucugccucc

SEQ ID NO: 3341167 - RNA, 20 nt, Human
agcccgggcucugccuccca

SEQ ID NO: 3341168 - RNA, 24 nt, Human
agccccaaaacucuccucugcugc

SEQ ID NO: 3341169 - RNA, 19 nt, Human
agcacgauuucuguuuaga

SEQ ID NO: 3341170 - RNA, 21 nt, Human
agcacgauuucuguuuagaua

SEQ ID NO: 3341171 - RNA, 17 nt, Human
agcacgauuucuguuua

SEQ ID NO: 3341172 - RNA, 16 nt, Human
agcacagacccugccc

SEQ ID NO: 3341173 - RNA, 14 nt, Human
agcacagacccugc

SEQ ID NO: 3341174 - RNA, 15 nt, Human
agcacagacccugcc

SEQ ID NO: 3341175 - RNA, 12 nt, Human
agcacagacccu

SEQ ID NO: 3341176 - RNA, 21 nt, Human
agauugcaacaggcugggcuu

SEQ ID NO: 3341177 - RNA, 20 nt, Human
agauugcaacaggcugggcu

SEQ ID NO: 3341178 - RNA, 19 nt, Human
agauugcaacaggcugggc

SEQ ID NO: 3341179 - RNA, 19 nt, Human
agauucuuuccugaggcug

SEQ ID NO: 3341180 - RNA, 21 nt, Human
agauucuuuccugaggcuggg

SEQ ID NO: 3341181 - RNA, 18 nt, Human
agauucuuuccugaggcu

SEQ ID NO: 3341182 - RNA, 18 nt, Human
agcaaaagaugcuucuca

SEQ ID NO: 3341183 - RNA, 20 nt, Human
agcaaaggagauuggaagga

SEQ ID NO: 3341184 - RNA, 14 nt, Human
agaugagugagcau

SEQ ID NO: 3341185 - RNA, 17 nt, Human
agcuggucccacucagu

SEQ ID NO: 3341186 - RNA, 16 nt, Human
agcuggucccacucag

SEQ ID NO: 3341187 - RNA, 14 nt, Human
agcugcugacagug

SEQ ID NO: 3341188 - RNA, 13 nt, Human
agcugcugacagu

SEQ ID NO: 3341189 - RNA, 18 nt, Human
agcuggucccacucaguc

SEQ ID NO: 3341190 - RNA, 16 nt, Human
agcugguugagguuuc

SEQ ID NO: 3341191 - RNA, 22 nt, Human
agcugguuuuuagcggagacgg

SEQ ID NO: 3341192 - RNA, 18 nt, Human
agcugcgguccacccagg

SEQ ID NO: 3341193 - RNA, 17 nt, Human
agcugcgguccacccag

SEQ ID NO: 3341194 - RNA, 16 nt, Human
agcugcgguccaccca

SEQ ID NO: 3341195 - RNA, 13 nt, Human
agcugcgguccac

SEQ ID NO: 3341196 - RNA, 20 nt, Human
agcugcgguccacccaggag

SEQ ID NO: 3341197 - RNA, 19 nt, Human
agcugcgguccacccagga

SEQ ID NO: 3341198 - RNA, 12 nt, Human
agcugcugacag

SEQ ID NO: 3341199 - RNA, 15 nt, Human
agcugaaccugggua

SEQ ID NO: 3341200 - RNA, 15 nt, Human
agcucaccucucccu

SEQ ID NO: 3341201 - RNA, 18 nt, Human
agcucaccucucccuugg

SEQ ID NO: 3341202 - RNA, 19 nt, Human
agcucaccucucccuugga

SEQ ID NO: 3341203 - RNA, 12 nt, Human
agcucaccucuc

SEQ ID NO: 3341204 - RNA, 15 nt, Human
agcucaccagcccca

SEQ ID NO: 3341205 - RNA, 19 nt, Human
agcucaccagccccagugc

SEQ ID NO: 3341206 - RNA, 18 nt, Human
agcucagagaggguggga

SEQ ID NO: 3341207 - RNA, 14 nt, Human
agcucagagagggu

SEQ ID NO: 3341208 - RNA, 12 nt, Human
agcucagagagg

SEQ ID NO: 3341209 - RNA, 15 nt, Human
agcuaaugggacacu

SEQ ID NO: 3341210 - RNA, 16 nt, Human
agcucaccagccccag

SEQ ID NO: 3341211 - RNA, 12 nt, Human
agccugggaggu

SEQ ID NO: 3341212 - RNA, 13 nt, Human
agcgagcccuggu

SEQ ID NO: 3341213 - RNA, 19 nt, Human
agcgagcccugguggcagu

SEQ ID NO: 3341214 - RNA, 15 nt, Human
aggagaggagagggg

SEQ ID NO: 3341215 - RNA, 18 nt, Human
agcuucauuuccuguguc

SEQ ID NO: 3341216 - RNA, 19 nt, Human
agcuucauuuccugugucu

SEQ ID NO: 3341217 - RNA, 22 nt, Human
agcuuuguuuguugucagcuga

SEQ ID NO: 3341218 - RNA, 23 nt, Human
agcuuuguuuguugucagcugaa

SEQ ID NO: 3341219 - RNA, 12 nt, Human
aggaacaaggca

SEQ ID NO: 3341220 - RNA, 13 nt, Human
aggaacaaggcaa

SEQ ID NO: 3341221 - RNA, 16 nt, Human
aggaacaaggcaaggc

SEQ ID NO: 3341222 - RNA, 17 nt, Human
aggaacaaggcaaggcu

SEQ ID NO: 3341223 - RNA, 19 nt, Human
aggaacaaggcaaggcugu

SEQ ID NO: 3341224 - RNA, 20 nt, Human
aggaacaaggcaaggcuguc

SEQ ID NO: 3341225 - RNA, 21 nt, Human
aggaacuuaaauaaugugaaa

SEQ ID NO: 3341226 - RNA, 15 nt, Human
aggaauaccuguccc

SEQ ID NO: 3341227 - RNA, 18 nt, Human
aggaauaccugucccccu

SEQ ID NO: 3341228 - RNA, 22 nt, Human
aggaauaccugucccccugaca

SEQ ID NO: 3341229 - RNA, 14 nt, Human
agguacucuccugg

SEQ ID NO: 3341230 - RNA, 13 nt, Human
agguacucuccug

SEQ ID NO: 3341231 - RNA, 14 nt, Human
agguaacaggcaga

SEQ ID NO: 3341232 - RNA, 13 nt, Human
agguaacaggcag

SEQ ID NO: 3341233 - RNA, 16 nt, Human
agguaacaggcagaua

SEQ ID NO: 3341234 - RNA, 22 nt, Human
agguacgaaaagaggggaagag

SEQ ID NO: 3341235 - RNA, 22 nt, Human
aggguuuugccauguuggccag

SEQ ID NO: 3341236 - RNA, 21 nt, Human
aggggccucuuaugggcuggg

SEQ ID NO: 3341237 - RNA, 22 nt, Human
aggggcccaaauucuuucagug

SEQ ID NO: 3341238 - RNA, 16 nt, Human
agggucccugguggca

SEQ ID NO: 3341239 - RNA, 17 nt, Human
agggucccugguggcag

SEQ ID NO: 3341240 - RNA, 20 nt, Human
agggucccugguggcagcuc

SEQ ID NO: 3341241 - RNA, 22 nt, Human
agggucccugguggcagcucac

SEQ ID NO: 3341242 - RNA, 12 nt, Human
agggucccuggu

SEQ ID NO: 3341243 - RNA, 14 nt, Human
agggucccuggugg

SEQ ID NO: 3341244 - RNA, 13 nt, Human
aggguauuccaga

SEQ ID NO: 3341245 - RNA, 21 nt, Human
aggguaucuggugacuuuccu

SEQ ID NO: 3341246 - RNA, 15 nt, Human
aggguaucuggugac

SEQ ID NO: 3341247 - RNA, 16 nt, Human
agggauacccauccca

SEQ ID NO: 3341248 - RNA, 12 nt, Human
agggccuggccu

SEQ ID NO: 3341249 - RNA, 13 nt, Human
agggccuggccug

SEQ ID NO: 3341250 - RNA, 15 nt, Human
agggccugcaaggga

SEQ ID NO: 3341251 - RNA, 14 nt, Human
agggccugcaaggg

SEQ ID NO: 3341252 - RNA, 18 nt, Human
aggcauuccccaggaggc

SEQ ID NO: 3341253 - RNA, 17 nt, Human
aggcauuccccaggagg

SEQ ID NO: 3341254 - RNA, 12 nt, Human
aggcauguucuc

SEQ ID NO: 3341255 - RNA, 19 nt, Human
aggcauguucucugaggac

SEQ ID NO: 3341256 - RNA, 18 nt, Human
aggcauguucucugagga

SEQ ID NO: 3341257 - RNA, 19 nt, Human
aggcaugugaugagaggaa

SEQ ID NO: 3341258 - RNA, 20 nt, Human
aggcaugugaugagaggaaa

SEQ ID NO: 3341259 - RNA, 17 nt, Human
aggcauguucucugagg

SEQ ID NO: 3341260 - RNA, 17 nt, Human
aggcaugugaugagagg

SEQ ID NO: 3341261 - RNA, 15 nt, Human
aggcaugguggccca

SEQ ID NO: 3341262 - RNA, 19 nt, Human
aggcauuccccaggaggcc

SEQ ID NO: 3341263 - RNA, 20 nt, Human
aggcauuccccaggaggcca

SEQ ID NO: 3341264 - RNA, 23 nt, Human
aggccagcugcuugggcuucauc

SEQ ID NO: 3341265 - RNA, 13 nt, Human
aggccaggcccuc

SEQ ID NO: 3341266 - RNA, 14 nt, Human
aggccaggcccucu

SEQ ID NO: 3341267 - RNA, 15 nt, Human
aggccaggcccucug

SEQ ID NO: 3341268 - RNA, 15 nt, Human
aggcccuucucucca

SEQ ID NO: 3341269 - RNA, 12 nt, Human
aggcccuucucu

SEQ ID NO: 3341270 - RNA, 22 nt, Human
aggcccucugcccacucccugc

SEQ ID NO: 3341271 - RNA, 23 nt, Human
aggcccucugcccacucccugca

SEQ ID NO: 3341272 - RNA, 21 nt, Human
aggcccucugcccacucccug

SEQ ID NO: 3341273 - RNA, 18 nt, Human
aggcuggguucugauccu

SEQ ID NO: 3341274 - RNA, 13 nt, Human
aggcuaccuuugu

SEQ ID NO: 3341275 - RNA, 14 nt, Human
aggcuaccuuugua

SEQ ID NO: 3341276 - RNA, 15 nt, Human
aggcuaccuuuguau

SEQ ID NO: 3341277 - RNA, 17 nt, Human
aggcuuagucacugaga

SEQ ID NO: 3341278 - RNA, 18 nt, Human
aggcuguaucccaugagc

SEQ ID NO: 3341279 - RNA, 22 nt, Human
aggcuguaucccaugagccuca

SEQ ID NO: 3341280 - RNA, 21 nt, Human
aggcuguaucccaugagccuc

SEQ ID NO: 3341281 - RNA, 20 nt, Human
aggcuguaucccaugagccu

SEQ ID NO: 3341282 - RNA, 17 nt, Human
aggcuggguucugaucc

SEQ ID NO: 3341283 - RNA, 18 nt, Human
aggcuuagucacugagac

SEQ ID NO: 3341284 - RNA, 15 nt, Human
agggacccuccacca

SEQ ID NO: 3341285 - RNA, 14 nt, Human
aguacuauguauca

SEQ ID NO: 3341286 - RNA, 12 nt, Human
aguacuauguau

SEQ ID NO: 3341287 - RNA, 22 nt, Human
aguacuucuccacccugcucuc

SEQ ID NO: 3341288 - RNA, 12 nt, Human
aguacuucuuuu

SEQ ID NO: 3341289 - RNA, 17 nt, Human
aguacuucuccacccug

SEQ ID NO: 3341290 - RNA, 19 nt, Human
aguacuacaguccucccau

SEQ ID NO: 3341291 - RNA, 22 nt, Human
aguacuacaguccucccaucuc

SEQ ID NO: 3341292 - RNA, 14 nt, Human
aguacuauaauuua

SEQ ID NO: 3341293 - RNA, 16 nt, Human
aguacguugugcauuu

SEQ ID NO: 3341294 - RNA, 17 nt, Human
aguacguugugcauuug

SEQ ID NO: 3341295 - RNA, 18 nt, Human
aguacguugugcauuugg

SEQ ID NO: 3341296 - RNA, 15 nt, Human
aguacguugugcauu

SEQ ID NO: 3341297 - RNA, 14 nt, Human
aguacguugugcau

SEQ ID NO: 3341298 - RNA, 13 nt, Human
aggucuguucuuu

SEQ ID NO: 3341299 - RNA, 15 nt, Human
aggucuguucuuucc

SEQ ID NO: 3341300 - RNA, 16 nt, Human
aggucuguucuuucca

SEQ ID NO: 3341301 - RNA, 22 nt, Human
agucacacaguauuacuucugc

SEQ ID NO: 3341302 - RNA, 20 nt, Human
aguaugaggcauuuguuuga

SEQ ID NO: 3341303 - RNA, 21 nt, Human
aguaugaggcauuuguuugaa

SEQ ID NO: 3341304 - RNA, 23 nt, Human
aguaugaggcauuuguuugaacu

SEQ ID NO: 3341305 - RNA, 17 nt, Human
aguaugaggcauuuguu

SEQ ID NO: 3341306 - RNA, 14 nt, Human
aguccucuuuucug

SEQ ID NO: 3341307 - RNA, 19 nt, Human
aguccucuuuucugagagg

SEQ ID NO: 3341308 - RNA, 20 nt, Human
aguccuuaccagcagagcac

SEQ ID NO: 3341309 - RNA, 22 nt, Human
aguccucuuuucugagaggacu

SEQ ID NO: 3341310 - RNA, 19 nt, Human
aguccuuaccagcagagca

SEQ ID NO: 3341311 - RNA, 17 nt, Human
agucugaaggcuggguu

SEQ ID NO: 3341312 - RNA, 15 nt, Human
aguucaucuugaauu

SEQ ID NO: 3341313 - RNA, 19 nt, Human
aguucaucuugaauuguaa

SEQ ID NO: 3341314 - RNA, 13 nt, Human
aguucaucuugaa

SEQ ID NO: 3341315 - RNA, 16 nt, Human
aguugauacuacaguu

SEQ ID NO: 3341316 - RNA, 16 nt, Human
agugccuuauggaaca

SEQ ID NO: 3341317 - RNA, 10 nt, Human
agugccuuau

SEQ ID NO: 3341318 - RNA, 13 nt, Human
agugccuuaugga

SEQ ID NO: 3341319 - RNA, 14 nt, Human
agugccuuauggaa

SEQ ID NO: 3341320 - RNA, 15 nt, Human
agugccuuauggaac

SEQ ID NO: 3341321 - RNA, 24 nt, Human
agugauccucccaccucagccucc

SEQ ID NO: 3341322 - RNA, 23 nt, Human
agugauccucccaccucagccuc

SEQ ID NO: 3341323 - RNA, 18 nt, Human
agugauccucccaccuca

SEQ ID NO: 3341324 - RNA, 15 nt, Human
agugauccucccacc

SEQ ID NO: 3341325 - RNA, 14 nt, Human
agugauccucccac

SEQ ID NO: 3341326 - RNA, 17 nt, Human
agugccuuacacaaugg

SEQ ID NO: 3341327 - RNA, 15 nt, Human
agugauucuccugcc

SEQ ID NO: 3341328 - RNA, 18 nt, Human
agugccuuacacaauggu

SEQ ID NO: 3341329 - RNA, 14 nt, Human
agugauucuccugc

SEQ ID NO: 3341330 - RNA, 13 nt, Human
agugauccuccca

SEQ ID NO: 3341331 - RNA, 16 nt, Human
agugggagcugccugu

SEQ ID NO: 3341332 - RNA, 19 nt, Human
auauucaggaagcucaggg

SEQ ID NO: 3341333 - RNA, 17 nt, Human
auauucaggaagcucag

SEQ ID NO: 3341334 - RNA, 23 nt, Human
auauucaaccauggacuuuauaa

SEQ ID NO: 3341335 - RNA, 21 nt, Human
auauucaaccauggacuuuau

SEQ ID NO: 3341336 - RNA, 17 nt, Human
auauucaaccauggacu

SEQ ID NO: 3341337 - RNA, 12 nt, Human
auauucaaccau

SEQ ID NO: 3341338 - RNA, 11 nt, Human
auauucaacca

SEQ ID NO: 3341339 - RNA, 22 nt, Human
auaugcacacauuuuuuaaaug

SEQ ID NO: 3341340 - RNA, 17 nt, Human
auaugcucugcauguua

SEQ ID NO: 3341341 - RNA, 16 nt, Human
auaugcucugcauguu

SEQ ID NO: 3341342 - RNA, 20 nt, Human
auaugcucugcauguuacau

SEQ ID NO: 3341343 - RNA, 17 nt, Human
auagccuaggugacaga

SEQ ID NO: 3341344 - RNA, 15 nt, Human
auagccuaggugaca

SEQ ID NO: 3341345 - RNA, 17 nt, Human
auagcacagacccugcc

SEQ ID NO: 3341346 - RNA, 18 nt, Human
auagcacagacccugccc

SEQ ID NO: 3341347 - RNA, 18 nt, Human
auagaaauauauacgaac

SEQ ID NO: 3341348 - RNA, 15 nt, Human
auagcacagacccug

SEQ ID NO: 3341349 - RNA, 14 nt, Human
auagaaauauauac

SEQ ID NO: 3341350 - RNA, 18 nt, Human
auaacauguaauuaagua

SEQ ID NO: 3341351 - RNA, 13 nt, Human
auaacauguaauu

SEQ ID NO: 3341352 - RNA, 12 nt, Human
auaacauguaau

SEQ ID NO: 3341353 - RNA, 17 nt, Human
aguuugauuaaauucuu

SEQ ID NO: 3341354 - RNA, 18 nt, Human
aguuugauuaaauucuug

SEQ ID NO: 3341355 - RNA, 20 nt, Human
aguuugauuaaauucuugca

SEQ ID NO: 3341356 - RNA, 22 nt, Human
aguuugauuaaauucuugcaaa

SEQ ID NO: 3341357 - RNA, 16 nt, Human
aguuugauuaaauucu

SEQ ID NO: 3341358 - RNA, 20 nt, Human
aguuugagaucagccugggc

SEQ ID NO: 3341359 - RNA, 18 nt, Human
aguuugagaucagccugg

SEQ ID NO: 3341360 - RNA, 19 nt, Human
aguuugagaucagccuggg

SEQ ID NO: 3341361 - RNA, 19 nt, Human
aguuguuacauuuuuaagu

SEQ ID NO: 3341362 - RNA, 20 nt, Human
aguuguuacauuuuuaagug

SEQ ID NO: 3341363 - RNA, 22 nt, Human
aguuguuacauuuuuaagugcu

SEQ ID NO: 3341364 - RNA, 23 nt, Human
aguuugauuaaauucuugcaaag

SEQ ID NO: 3341365 - RNA, 13 nt, Human
auaccuguccccc

SEQ ID NO: 3341366 - RNA, 14 nt, Human
auaccugucccccu

SEQ ID NO: 3341367 - RNA, 15 nt, Human
auaccugucccccug

SEQ ID NO: 3341368 - RNA, 16 nt, Human
auaccugucccccuga

SEQ ID NO: 3341369 - RNA, 14 nt, Human
auacaaugcugugc

SEQ ID NO: 3341370 - RNA, 22 nt, Human
auacacuuacacuuuaugcaca

SEQ ID NO: 3341371 - RNA, 13 nt, Human
auacacuuacacu

SEQ ID NO: 3341372 - RNA, 14 nt, Human
auacccacccccac

SEQ ID NO: 3341373 - RNA, 16 nt, Human
auacccacccccaccc

SEQ ID NO: 3341374 - RNA, 13 nt, Human
auacccaccccca

SEQ ID NO: 3341375 - RNA, 17 nt, Human
auacccacccccaccca

SEQ ID NO: 3341376 - RNA, 18 nt, Human
auaaggguaucuggugac

SEQ ID NO: 3341377 - RNA, 20 nt, Human
auaagccaguguugccuaag

SEQ ID NO: 3341378 - RNA, 18 nt, Human
auaagccaguguugccua

SEQ ID NO: 3341379 - RNA, 20 nt, Human
aucaaagagguuuuaaaaaa

SEQ ID NO: 3341380 - RNA, 23 nt, Human
aucaaagagguuuuaaaaaaauc

SEQ ID NO: 3341381 - RNA, 24 nt, Human
aucaaaagguuaauaaaguaauua

SEQ ID NO: 3341382 - RNA, 13 nt, Human
aucaccagacagg

SEQ ID NO: 3341383 - RNA, 20 nt, Human
aucaccaacgucugugccau

SEQ ID NO: 3341384 - RNA, 21 nt, Human
aucaccgaaaacguggcugcu

SEQ ID NO: 3341385 - RNA, 14 nt, Human
aucaugucuggcua

SEQ ID NO: 3341386 - RNA, 19 nt, Human
auccagacccggcugcgug

SEQ ID NO: 3341387 - RNA, 15 nt, Human
auccagacccggcug

SEQ ID NO: 3341388 - RNA, 18 nt, Human
aucccaugagccucagca

SEQ ID NO: 3341389 - RNA, 19 nt, Human
aucccaugagccucagcau

SEQ ID NO: 3341390 - RNA, 14 nt, Human
augaaaacacauuu

SEQ ID NO: 3341391 - RNA, 15 nt, Human
augaaaacacauuuu

SEQ ID NO: 3341392 - RNA, 16 nt, Human
augaaaacacauuuuu

SEQ ID NO: 3341393 - RNA, 13 nt, Human
augaggcauuugu

SEQ ID NO: 3341394 - RNA, 14 nt, Human
augaggcauuuguu

SEQ ID NO: 3341395 - RNA, 21 nt, Human
augaggcauuuguuugaacug

SEQ ID NO: 3341396 - RNA, 17 nt, Human
auguuugccucugccuc

SEQ ID NO: 3341397 - RNA, 15 nt, Human
auguuugccucugcc

SEQ ID NO: 3341398 - RNA, 14 nt, Human
auguuugccucugc

SEQ ID NO: 3341399 - RNA, 14 nt, Human
auguucugggacac

SEQ ID NO: 3341400 - RNA, 13 nt, Human
auguucugggaca

SEQ ID NO: 3341401 - RNA, 15 nt, Human
auguucugggacaca

SEQ ID NO: 3341402 - RNA, 17 nt, Human
auguucucucuucucca

SEQ ID NO: 3341403 - RNA, 13 nt, Human
auguucucugagg

SEQ ID NO: 3341404 - RNA, 16 nt, Human
auguucucucuucucc

SEQ ID NO: 3341405 - RNA, 13 nt, Human
auguguaaguauu

SEQ ID NO: 3341406 - RNA, 20 nt, Human
augggugcuuggaggaagga

SEQ ID NO: 3341407 - RNA, 21 nt, Human
augggugcuuggaggaaggaa

SEQ ID NO: 3341408 - RNA, 23 nt, Human
augggugcuuggaggaaggaaac

SEQ ID NO: 3341409 - RNA, 23 nt, Human
auguaauuaaguacuauguauca

SEQ ID NO: 3341410 - RNA, 13 nt, Human
augucacaggcag

SEQ ID NO: 3341411 - RNA, 19 nt, Human
augucacaggcagguccag

SEQ ID NO: 3341412 - RNA, 17 nt, Human
augucacaggcaggucc

SEQ ID NO: 3341413 - RNA, 16 nt, Human
auggcuuuugugcauu

SEQ ID NO: 3341414 - RNA, 17 nt, Human
auggcuuuugugcauua

SEQ ID NO: 3341415 - RNA, 16 nt, Human
augcuuguacauaaug

SEQ ID NO: 3341416 - RNA, 15 nt, Human
augcuuguacauaau

SEQ ID NO: 3341417 - RNA, 13 nt, Human
augcugcccugug

SEQ ID NO: 3341418 - RNA, 12 nt, Human
augcugcccugu

SEQ ID NO: 3341419 - RNA, 14 nt, Human
augcugcccuguga

SEQ ID NO: 3341420 - RNA, 15 nt, Human
augcugcccugugag

SEQ ID NO: 3341421 - RNA, 16 nt, Human
augcugcccugugagu

SEQ ID NO: 3341422 - RNA, 18 nt, Human
augcacagaguuguuaca

SEQ ID NO: 3341423 - RNA, 13 nt, Human
augcacacauuuu

SEQ ID NO: 3341424 - RNA, 14 nt, Human
augcacacauuuuu

SEQ ID NO: 3341425 - RNA, 19 nt, Human
augcacagaguuguuacau

SEQ ID NO: 3341426 - RNA, 21 nt, Human
augcacagaguuguuacauuu

SEQ ID NO: 3341427 - RNA, 22 nt, Human
augcacagaguuguuacauuuu

SEQ ID NO: 3341428 - RNA, 19 nt, Human
augccuggauggggcugca

SEQ ID NO: 3341429 - RNA, 20 nt, Human
augccuggauggggcugcac

SEQ ID NO: 3341430 - RNA, 21 nt, Human
augaucuuugcagacaggcaa

SEQ ID NO: 3341431 - RNA, 19 nt, Human
augaucuuugcagacaggc

SEQ ID NO: 3341432 - RNA, 18 nt, Human
augaucuuugcagacagg

SEQ ID NO: 3341433 - RNA, 18 nt, Human
augaucuucuuuauaauu

SEQ ID NO: 3341434 - RNA, 17 nt, Human
augaucuuugcagacag

SEQ ID NO: 3341435 - RNA, 18 nt, Human
augaugaaaugaggucag

SEQ ID NO: 3341436 - RNA, 23 nt, Human
augaugaaaugaggucagagccu

SEQ ID NO: 3341437 - RNA, 15 nt, Human
augaugauccuaggc

SEQ ID NO: 3341438 - RNA, 18 nt, Human
augcacaaacagaggccg

SEQ ID NO: 3341439 - RNA, 23 nt, Human
cuucuucagagacuccugcaggc

SEQ ID NO: 3341440 - RNA, 21 nt, Human
cuucugacccaugcugcccug

SEQ ID NO: 3341441 - RNA, 22 nt, Human
cuucugacccaugcugcccugu

SEQ ID NO: 3341442 - RNA, 20 nt, Human
cuucugacccaugcugcccu

SEQ ID NO: 3341443 - RNA, 17 nt, Human
cuuccugcaacaccuug

SEQ ID NO: 3341444 - RNA, 18 nt, Human
cuuccucccucccucuuu

SEQ ID NO: 3341445 - RNA, 14 nt, Human
cuuggcgcugcccc

SEQ ID NO: 3341446 - RNA, 17 nt, Human
cuuggcgcugccccugg

SEQ ID NO: 3341447 - RNA, 12 nt, Human
cuuggcgcugcc

SEQ ID NO: 3341448 - RNA, 13 nt, Human
cuugacagggcac

SEQ ID NO: 3341449 - RNA, 15 nt, Human
cuugacagggcacac

SEQ ID NO: 3341450 - RNA, 14 nt, Human
cuugacagggcaca

SEQ ID NO: 3341451 - RNA, 19 nt, Human
cuugaauuguaaggaauga

SEQ ID NO: 3341452 - RNA, 18 nt, Human
cuugaauuguaaggaaug

SEQ ID NO: 3341453 - RNA, 16 nt, Human
cuugaagacuuuucuu

SEQ ID NO: 3341454 - RNA, 11 nt, Human
cuucccaccuc

SEQ ID NO: 3341455 - RNA, 21 nt, Human
cuucccaccucucucacuccu

SEQ ID NO: 3341456 - RNA, 23 nt, Human
cuucccaccucucucacuccuug

SEQ ID NO: 3341457 - RNA, 18 nt, Human
cuucagagacuccugcag

SEQ ID NO: 3341458 - RNA, 19 nt, Human
cuucagagacuccugcagg

SEQ ID NO: 3341459 - RNA, 17 nt, Human
cuucagagacuccugca

SEQ ID NO: 3341460 - RNA, 22 nt, Human
cuuccagugaggcucugcccuu

SEQ ID NO: 3341461 - RNA, 23 nt, Human
cuuccagugaggcucugcccuug

SEQ ID NO: 3341462 - RNA, 20 nt, Human
cuuccagugaggcucugccc

SEQ ID NO: 3341463 - RNA, 21 nt, Human
cuuccagugaggcucugcccu

SEQ ID NO: 3341464 - RNA, 14 nt, Human
cugugcugagucug

SEQ ID NO: 3341465 - RNA, 12 nt, Human
cugugcugaguc

SEQ ID NO: 3341466 - RNA, 17 nt, Human
cuuauggaacacucuga

SEQ ID NO: 3341467 - RNA, 19 nt, Human
cuuauggaacacucugaga

SEQ ID NO: 3341468 - RNA, 20 nt, Human
cuuauggaacacucugagac

SEQ ID NO: 3341469 - RNA, 15 nt, Human
cuucacggaagagcc

SEQ ID NO: 3341470 - RNA, 19 nt, Human
cuucacggaagagccuugc

SEQ ID NO: 3341471 - RNA, 22 nt, Human
cuucaccuuuguccccaccgca

SEQ ID NO: 3341472 - RNA, 21 nt, Human
cuucaccuuuguccccaccgc

SEQ ID NO: 3341473 - RNA, 20 nt, Human
cuucaccuuuguccccaccg

SEQ ID NO: 3341474 - RNA, 13 nt, Human
cuuauggaacacu

SEQ ID NO: 3341475 - RNA, 16 nt, Human
cuuauggaacacucug

SEQ ID NO: 3341476 - RNA, 16 nt, Human
cuuucuagccagagga

SEQ ID NO: 3341477 - RNA, 15 nt, Human
cuuucuagccagagg

SEQ ID NO: 3341478 - RNA, 17 nt, Human
cuuucuacccagcgagc

SEQ ID NO: 3341479 - RNA, 17 nt, Human
cuuugggccuggcuccc

SEQ ID NO: 3341480 - RNA, 13 nt, Human
cuuuuauaaacuu

SEQ ID NO: 3341481 - RNA, 21 nt, Human
cuuuccugaggcugggcuccc

SEQ ID NO: 3341482 - RNA, 22 nt, Human
cuuuccugaggcugggcucccu

SEQ ID NO: 3341483 - RNA, 23 nt, Human
cuuucaauaggaaaaacugauuu

SEQ ID NO: 3341484 - RNA, 23 nt, Human
cuuucagccaagaauucuuaaau

SEQ ID NO: 3341485 - RNA, 20 nt, Human
cuuucagccaagaauucuua

SEQ ID NO: 3341486 - RNA, 22 nt, Human
gaaagggacuuggaagcuccgc

SEQ ID NO: 3341487 - RNA, 20 nt, Human
gaaagggacgcuacccggga

SEQ ID NO: 3341488 - RNA, 19 nt, Human
gaaagggacuuggaagcuc

SEQ ID NO: 3341489 - RNA, 19 nt, Human
gaaaucaccgaaaacgugg

SEQ ID NO: 3341490 - RNA, 21 nt, Human
gaaaggcuccaggagcagcca

SEQ ID NO: 3341491 - RNA, 20 nt, Human
gaaaggcuccaggagcagcc

SEQ ID NO: 3341492 - RNA, 22 nt, Human
gaaaggcuccaggagcagccac

SEQ ID NO: 3341493 - RNA, 20 nt, Human
gaaagacuaucuaaauguug

SEQ ID NO: 3341494 - RNA, 12 nt, Human
cuuuugugcauu

SEQ ID NO: 3341495 - RNA, 13 nt, Human
cuuuugugcauua

SEQ ID NO: 3341496 - RNA, 23 nt, Human
cuuuuuuggcugcugaaggcucg

SEQ ID NO: 3341497 - RNA, 17 nt, Human
cuuuugucuaugggacu

SEQ ID NO: 3341498 - RNA, 18 nt, Human
cuuuugucuaugggacuc

SEQ ID NO: 3341499 - RNA, 23 nt, Human
cuuuugcccacacuugggagcaa

SEQ ID NO: 3341500 - RNA, 15 nt, Human
gaaaauguaugugua

SEQ ID NO: 3341501 - RNA, 19 nt, Human
gaaaauggacguguuauga

SEQ ID NO: 3341502 - RNA, 23 nt, Human
gaaaauggacguguuaugacucc

SEQ ID NO: 3341503 - RNA, 21 nt, Human
gaaaauggaagacagcucuua

SEQ ID NO: 3341504 - RNA, 18 nt, Human
gaaaagaaaaaugagccu

SEQ ID NO: 3341505 - RNA, 14 nt, Human
gaaaaacugauuuu

SEQ ID NO: 3341506 - RNA, 14 nt, Human
cugccccucaacuc

SEQ ID NO: 3341507 - RNA, 22 nt, Human
cugccccucaacucuccuccag

SEQ ID NO: 3341508 - RNA, 15 nt, Human
cugcccugugggccc

SEQ ID NO: 3341509 - RNA, 16 nt, Human
cugcccugugggcccc

SEQ ID NO: 3341510 - RNA, 18 nt, Human
cugcccugugggccccca

SEQ ID NO: 3341511 - RNA, 12 nt, Human
cugcccugugag

SEQ ID NO: 3341512 - RNA, 23 nt, Human
cugccauauucuguuggccagug

SEQ ID NO: 3341513 - RNA, 22 nt, Human
cugccauauucuguuggccagu

SEQ ID NO: 3341514 - RNA, 21 nt, Human
cugccauauucuguuggccag

SEQ ID NO: 3341515 - RNA, 20 nt, Human
cugccauauucuguuggcca

SEQ ID NO: 3341516 - RNA, 12 nt, Human
cugccagggaca

SEQ ID NO: 3341517 - RNA, 15 nt, Human
cugccagggacagag

SEQ ID NO: 3341518 - RNA, 11 nt, Human
cugccagggac

SEQ ID NO: 3341519 - RNA, 15 nt, Human
cugccaaugggagcu

SEQ ID NO: 3341520 - RNA, 18 nt, Human
cugcauuuaaaagauaca

SEQ ID NO: 3341521 - RNA, 20 nt, Human
cugcauuuaaaagauacagu

SEQ ID NO: 3341522 - RNA, 22 nt, Human
cugcauuuaaaagauacaguua

SEQ ID NO: 3341523 - RNA, 15 nt, Human
cugcauguuugugau

SEQ ID NO: 3341524 - RNA, 13 nt, Human
cugcauguuacau

SEQ ID NO: 3341525 - RNA, 17 nt, Human
cugagacucgcgacaau

SEQ ID NO: 3341526 - RNA, 19 nt, Human
cugagacucgcgacaaugc

SEQ ID NO: 3341527 - RNA, 15 nt, Human
cugcuacagagcaga

SEQ ID NO: 3341528 - RNA, 16 nt, Human
cugccuguugggccag

SEQ ID NO: 3341529 - RNA, 14 nt, Human
cugccuguugggcc

SEQ ID NO: 3341530 - RNA, 18 nt, Human
cugccuguugggccagga

SEQ ID NO: 3341531 - RNA, 19 nt, Human
cugccuguugggccaggag

SEQ ID NO: 3341532 - RNA, 16 nt, Human
cugcuaauuccccaga

SEQ ID NO: 3341533 - RNA, 14 nt, Human
cugccuguucagcu

SEQ ID NO: 3341534 - RNA, 23 nt, Human
cugccugggaucccucauccuca

SEQ ID NO: 3341535 - RNA, 22 nt, Human
cugccugggaucccucauccuc

SEQ ID NO: 3341536 - RNA, 18 nt, Human
cugccucgaacuggcugc

SEQ ID NO: 3341537 - RNA, 17 nt, Human
cugccucgaacuggcug

SEQ ID NO: 3341538 - RNA, 15 nt, Human
cugccucgaacuggc

SEQ ID NO: 3341539 - RNA, 14 nt, Human
cugcccugugggcc

SEQ ID NO: 3341540 - RNA, 17 nt, Human
cuggaacacuaaugagg

SEQ ID NO: 3341541 - RNA, 19 nt, Human
cugcuuuuuaaagaaugcu

SEQ ID NO: 3341542 - RNA, 16 nt, Human
cuggaaauauuaagaa

SEQ ID NO: 3341543 - RNA, 22 nt, Human
cugcuuuuuaaagaaugcucuu

SEQ ID NO: 3341544 - RNA, 16 nt, Human
cugcuucagccucccg

SEQ ID NO: 3341545 - RNA, 14 nt, Human
cugcuucagccucc

SEQ ID NO: 3341546 - RNA, 15 nt, Human
cugcuuaacuucaca

SEQ ID NO: 3341547 - RNA, 17 nt, Human
cugcuuaacuucacaua

SEQ ID NO: 3341548 - RNA, 13 nt, Human
cugcuucagccuc

SEQ ID NO: 3341549 - RNA, 13 nt, Human
cugcuuaacuuca

SEQ ID NO: 3341550 - RNA, 20 nt, Human
cugcugacagacacaggccc

SEQ ID NO: 3341551 - RNA, 19 nt, Human
cugcugacagacacaggcc

SEQ ID NO: 3341552 - RNA, 18 nt, Human
cugcugacagacacaggc

SEQ ID NO: 3341553 - RNA, 15 nt, Human
cugcugacagacaca

SEQ ID NO: 3341554 - RNA, 23 nt, Human
cugcugacagacacaggcccggc

SEQ ID NO: 3341555 - RNA, 21 nt, Human
cugcugacagacacaggcccg

SEQ ID NO: 3341556 - RNA, 13 nt, Human
cugucgcccaguc

SEQ ID NO: 3341557 - RNA, 19 nt, Human
cugugcucuggacaggcau

SEQ ID NO: 3341558 - RNA, 14 nt, Human
cugugcucuggaca

SEQ ID NO: 3341559 - RNA, 15 nt, Human
cugugaagagaacca

SEQ ID NO: 3341560 - RNA, 21 nt, Human
cuguaggaagguuaauguuca

SEQ ID NO: 3341561 - RNA, 18 nt, Human
cuguaggaagguuaaugu

SEQ ID NO: 3341562 - RNA, 18 nt, Human
cugucauuugagcagggc

SEQ ID NO: 3341563 - RNA, 17 nt, Human
cugucauuugagcaggg

SEQ ID NO: 3341564 - RNA, 16 nt, Human
cugucauuugagcagg

SEQ ID NO: 3341565 - RNA, 18 nt, Human
cugucagccauuccuguu

SEQ ID NO: 3341566 - RNA, 12 nt, Human
cuggcagcucag

SEQ ID NO: 3341567 - RNA, 13 nt, Human
cuggcagcucaga

SEQ ID NO: 3341568 - RNA, 14 nt, Human
cuggcagcucagag

SEQ ID NO: 3341569 - RNA, 13 nt, Human
cuggccccucagg

SEQ ID NO: 3341570 - RNA, 11 nt, Human
cugggacacag

SEQ ID NO: 3341571 - RNA, 13 nt, Human
cugggacacaguu

SEQ ID NO: 3341572 - RNA, 12 nt, Human
cugggacacagu

SEQ ID NO: 3341573 - RNA, 17 nt, Human
cuggccccucagggucc

SEQ ID NO: 3341574 - RNA, 18 nt, Human
cuggccccucaggguccc

SEQ ID NO: 3341575 - RNA, 20 nt, Human
cuggccccucagggucccug

SEQ ID NO: 3341576 - RNA, 21 nt, Human
cuggccccucagggucccugg

SEQ ID NO: 3341577 - RNA, 23 nt, Human
cuggguggcaccagcagccugga

SEQ ID NO: 3341578 - RNA, 22 nt, Human
cuggguggcaccagcagccugg

SEQ ID NO: 3341579 - RNA, 17 nt, Human
cuggguguggcgcagca

SEQ ID NO: 3341580 - RNA, 16 nt, Human
cuggguguggcgcagc

SEQ ID NO: 3341581 - RNA, 15 nt, Human
cuggugacuuuccuc

SEQ ID NO: 3341582 - RNA, 20 nt, Human
cuggugacuuuccucuuugg

SEQ ID NO: 3341583 - RNA, 21 nt, Human
cuggugacuuuccucuuuggu

SEQ ID NO: 3341584 - RNA, 14 nt, Human
cuggguucacugca

SEQ ID NO: 3341585 - RNA, 23 nt, Human
cuggugacuuuccucuuuggucu

SEQ ID NO: 3341586 - RNA, 16 nt, Human
cuggggccgaaagaac

SEQ ID NO: 3341587 - RNA, 16 nt, Human
cugggcagaaggaaga

SEQ ID NO: 3341588 - RNA, 18 nt, Human
cugggcagaaggaagacu

SEQ ID NO: 3341589 - RNA, 17 nt, Human
cugggcagaaggaagac

SEQ ID NO: 3341590 - RNA, 13 nt, Human
gaggucuguucuu

SEQ ID NO: 3341591 - RNA, 14 nt, Human
gaggucuguucuuu

SEQ ID NO: 3341592 - RNA, 12 nt, Human
gaggugggaucc

SEQ ID NO: 3341593 - RNA, 11 nt, Human
gaggugggagg

SEQ ID NO: 3341594 - RNA, 14 nt, Human
gagucaccaagccc

SEQ ID NO: 3341595 - RNA, 13 nt, Human
gagucaccaagcc

SEQ ID NO: 3341596 - RNA, 20 nt, Human
gagucccaccuuggcugcag

SEQ ID NO: 3341597 - RNA, 16 nt, Human
gagucccaccuuggcu

SEQ ID NO: 3341598 - RNA, 12 nt, Human
gagugagcuggu

SEQ ID NO: 3341599 - RNA, 13 nt, Human
gagucccaccuug

SEQ ID NO: 3341600 - RNA, 24 nt, Human
gagugagcacuaaggugugcucug

SEQ ID NO: 3341601 - RNA, 12 nt, Human
gagugcagugag

SEQ ID NO: 3341602 - RNA, 11 nt, Human
gagugcaguga

SEQ ID NO: 3341603 - RNA, 18 nt, Human
gagugccuuacacaaugg

SEQ ID NO: 3341604 - RNA, 16 nt, Human
gaguuguuacauuuuu

SEQ ID NO: 3341605 - RNA, 20 nt, Human
gaguuguuacauuuuuaagu

SEQ ID NO: 3341606 - RNA, 20 nt, Human
gaguuugggguaugggagag

SEQ ID NO: 3341607 - RNA, 11 nt, Human
gauacuacagu

SEQ ID NO: 3341608 - RNA, 16 nt, Human
gauacuacaguuuguu

SEQ ID NO: 3341609 - RNA, 13 nt, Human
gauacccauccca

SEQ ID NO: 3341610 - RNA, 14 nt, Human
gauacccaucccau

SEQ ID NO: 3341611 - RNA, 20 nt, Human
gauuacaggugugaaccacc

SEQ ID NO: 3341612 - RNA, 15 nt, Human
gauauuuuuuucuuu

SEQ ID NO: 3341613 - RNA, 16 nt, Human
gauauuuugcuuugug

SEQ ID NO: 3341614 - RNA, 15 nt, Human
gauauuuugcuuugu

SEQ ID NO: 3341615 - RNA, 12 nt, Human
gaucucuugagc

SEQ ID NO: 3341616 - RNA, 16 nt, Human
gaucucuugagccugg

SEQ ID NO: 3341617 - RNA, 17 nt, Human
gaucucuugagccuggg

SEQ ID NO: 3341618 - RNA, 21 nt, Human
gaugaucuuugcagacaggca

SEQ ID NO: 3341619 - RNA, 20 nt, Human
gaugaucuuugcagacaggc

SEQ ID NO: 3341620 - RNA, 14 nt, Human
gaugaucuuugcag

SEQ ID NO: 3341621 - RNA, 16 nt, Human
gaugagaggaaaucac

SEQ ID NO: 3341622 - RNA, 12 nt, Human
gcagccaggcca

SEQ ID NO: 3341623 - RNA, 14 nt, Human
gcagccacuauugu

SEQ ID NO: 3341624 - RNA, 15 nt, Human
gcagccacauuccug

SEQ ID NO: 3341625 - RNA, 16 nt, Human
gcagccacauuccuga

SEQ ID NO: 3341626 - RNA, 13 nt, Human
gcagccaggccac

SEQ ID NO: 3341627 - RNA, 14 nt, Human
gcagccaggccaca

SEQ ID NO: 3341628 - RNA, 18 nt, Human
gcagcccaccccucaaca

SEQ ID NO: 3341629 - RNA, 20 nt, Human
gcaggcucucaggccagcug

SEQ ID NO: 3341630 - RNA, 22 nt, Human
gcaggcucucaggccagcugcu

SEQ ID NO: 3341631 - RNA, 17 nt, Human
gcagcugcgguccaccc

SEQ ID NO: 3341632 - RNA, 23 nt, Human
gcaggcucucaggccagcugcuu

SEQ ID NO: 3341633 - RNA, 18 nt, Human
gcaggcucucaggccagc

SEQ ID NO: 3341634 - RNA, 17 nt, Human
gcauaccacuuuuguuc

SEQ ID NO: 3341635 - RNA, 20 nt, Human
gcauaccacuuuuguucuug

SEQ ID NO: 3341636 - RNA, 16 nt, Human
gcauaccacuuuuguu

SEQ ID NO: 3341637 - RNA, 19 nt, Human
gcacaucagcacgauuucu

SEQ ID NO: 3341638 - RNA, 20 nt, Human
gcacaucagcacgauuucug

SEQ ID NO: 3341639 - RNA, 13 nt, Human
gcacaugccucuc

SEQ ID NO: 3341640 - RNA, 14 nt, Human
gcacacacacacau

SEQ ID NO: 3341641 - RNA, 15 nt, Human
gcacacacacacaua

SEQ ID NO: 3341642 - RNA, 14 nt, Human
gcacaugccucucu

SEQ ID NO: 3341643 - RNA, 17 nt, Human
gcacaugccucucucag

SEQ ID NO: 3341644 - RNA, 18 nt, Human
gcacaugccucucucagg

SEQ ID NO: 3341645 - RNA, 19 nt, Human
gcacaugccucucucaggc

SEQ ID NO: 3341646 - RNA, 20 nt, Human
gcacaugccucucucaggcc

SEQ ID NO: 3341647 - RNA, 21 nt, Human
gcacaugccucucucaggcca

SEQ ID NO: 3341648 - RNA, 19 nt, Human
gcaccggcuggccuggccc

SEQ ID NO: 3341649 - RNA, 21 nt, Human
gcaccggcuggccuggccccu

SEQ ID NO: 3341650 - RNA, 23 nt, Human
gcaccggcuggccuggccccuca

SEQ ID NO: 3341651 - RNA, 18 nt, Human
gcaccggcuggccuggcc

SEQ ID NO: 3341652 - RNA, 21 nt, Human
gcaauaaagcagcguuucuau

SEQ ID NO: 3341653 - RNA, 14 nt, Human
gcacaagcugcacc

SEQ ID NO: 3341654 - RNA, 23 nt, Human
gcacaagcuccaagcucccaggc

SEQ ID NO: 3341655 - RNA, 21 nt, Human
gcacaagcuccaagcucccag

SEQ ID NO: 3341656 - RNA, 22 nt, Human
gcacaagcuccaagcucccagg

SEQ ID NO: 3341657 - RNA, 13 nt, Human
gcaagugagagcu

SEQ ID NO: 3341658 - RNA, 19 nt, Human
gcagagcagagaccauccc

SEQ ID NO: 3341659 - RNA, 20 nt, Human
gcagagcagagaccaucccu

SEQ ID NO: 3341660 - RNA, 24 nt, Human
gcagagcaccuuagacagucccug

SEQ ID NO: 3341661 - RNA, 12 nt, Human
gcagagcagaga

SEQ ID NO: 3341662 - RNA, 14 nt, Human
gcagagcagagacc

SEQ ID NO: 3341663 - RNA, 15 nt, Human
gcagagcagagacca

SEQ ID NO: 3341664 - RNA, 22 nt, Human
gcagagcaccuuagacaguccc

SEQ ID NO: 3341665 - RNA, 23 nt, Human
gcagagcaccuuagacagucccu

SEQ ID NO: 3341666 - RNA, 19 nt, Human
gcagagcaccuuagacagu

SEQ ID NO: 3341667 - RNA, 12 nt, Human
gcacugacauug

SEQ ID NO: 3341668 - RNA, 11 nt, Human
gaaugaauguc

SEQ ID NO: 3341669 - RNA, 14 nt, Human
gaaugaaugucagu

SEQ ID NO: 3341670 - RNA, 18 nt, Human
gaaugaaugucaguguga

SEQ ID NO: 3341671 - RNA, 22 nt, Human
gaaugaaugucagugugacuga

SEQ ID NO: 3341672 - RNA, 19 nt, Human
gaagucuuuguacagacaa

SEQ ID NO: 3341673 - RNA, 20 nt, Human
gaagucuuuguacagacaac

SEQ ID NO: 3341674 - RNA, 18 nt, Human
gaagucuuuguacagaca

SEQ ID NO: 3341675 - RNA, 16 nt, Human
gaagucuuuguacaga

SEQ ID NO: 3341676 - RNA, 16 nt, Human
gaaggcucgagcaugc

SEQ ID NO: 3341677 - RNA, 17 nt, Human
gaaggcucgagcaugcc

SEQ ID NO: 3341678 - RNA, 16 nt, Human
gaagcucagggccugg

SEQ ID NO: 3341679 - RNA, 17 nt, Human
gaagcucagggccuggc

SEQ ID NO: 3341680 - RNA, 18 nt, Human
gaagcucagggccuggcu

SEQ ID NO: 3341681 - RNA, 19 nt, Human
gaagcucagggccuggcuc

SEQ ID NO: 3341682 - RNA, 20 nt, Human
gaagcucagggccuggcuca

SEQ ID NO: 3341683 - RNA, 21 nt, Human
gaagcucagggccuggcucag

SEQ ID NO: 3341684 - RNA, 23 nt, Human
gaagcucagggccuggcucaggu

SEQ ID NO: 3341685 - RNA, 14 nt, Human
gaagcucagggccu

SEQ ID NO: 3341686 - RNA, 15 nt, Human
gaagcucagggccug

SEQ ID NO: 3341687 - RNA, 21 nt, Human
gaauuuugugcccccauguaa

SEQ ID NO: 3341688 - RNA, 20 nt, Human
gaauuuugugcccccaugua

SEQ ID NO: 3341689 - RNA, 23 nt, Human
gaauuuuggcugugucucccuuc

SEQ ID NO: 3341690 - RNA, 19 nt, Human
gacacacagcucuguccug

SEQ ID NO: 3341691 - RNA, 18 nt, Human
gacacacagcucuguccu

SEQ ID NO: 3341692 - RNA, 17 nt, Human
gacacacagcucugucc

SEQ ID NO: 3341693 - RNA, 15 nt, Human
gacacacagcucugu

SEQ ID NO: 3341694 - RNA, 13 nt, Human
gacacacagcucu

SEQ ID NO: 3341695 - RNA, 14 nt, Human
gacacacagcucug

SEQ ID NO: 3341696 - RNA, 19 nt, Human
gaauuuuggcugugucucc

SEQ ID NO: 3341697 - RNA, 21 nt, Human
gacacacagcucuguccuggg

SEQ ID NO: 3341698 - RNA, 22 nt, Human
gacaggguuuugccauguuggc

SEQ ID NO: 3341699 - RNA, 20 nt, Human
gacaggguuuugccauguug

SEQ ID NO: 3341700 - RNA, 20 nt, Human
gacagcccgggcucugccuc

SEQ ID NO: 3341701 - RNA, 21 nt, Human
gacagcccgggcucugccucc

SEQ ID NO: 3341702 - RNA, 22 nt, Human
gacagcccgggcucugccuccc

SEQ ID NO: 3341703 - RNA, 23 nt, Human
gacagcccgggcucugccuccca

SEQ ID NO: 3341704 - RNA, 15 nt, Human
gacacugaugggcaa

SEQ ID NO: 3341705 - RNA, 13 nt, Human
gacacugaugggc

SEQ ID NO: 3341706 - RNA, 12 nt, Human
gagaaggaagcc

SEQ ID NO: 3341707 - RNA, 13 nt, Human
gagaagcggcugg

SEQ ID NO: 3341708 - RNA, 15 nt, Human
gagaagcggcuggca

SEQ ID NO: 3341709 - RNA, 23 nt, Human
gacuuuucuguccgagcuuugaa

SEQ ID NO: 3341710 - RNA, 23 nt, Human
gacuuuucuuucagccaagaauu

SEQ ID NO: 3341711 - RNA, 21 nt, Human
gacuuuucuuuguggcuuccu

SEQ ID NO: 3341712 - RNA, 12 nt, Human
gacucugucuca

SEQ ID NO: 3341713 - RNA, 22 nt, Human
gacuaucuaaauguugaaagau

SEQ ID NO: 3341714 - RNA, 14 nt, Human
gagcagggcucagc

SEQ ID NO: 3341715 - RNA, 22 nt, Human
gagcaugccuggauggggcugc

SEQ ID NO: 3341716 - RNA, 21 nt, Human
gagcaugccuggauggggcug

SEQ ID NO: 3341717 - RNA, 12 nt, Human
gagcaucaggcc

SEQ ID NO: 3341718 - RNA, 14 nt, Human
gagccuuccagggg

SEQ ID NO: 3341719 - RNA, 15 nt, Human
gagccuuccaggggu

SEQ ID NO: 3341720 - RNA, 16 nt, Human
gagccuuccaggggug

SEQ ID NO: 3341721 - RNA, 22 nt, Human
gagccuugaacuuugaccucug

SEQ ID NO: 3341722 - RNA, 19 nt, Human
gagccuugaacuuugaccu

SEQ ID NO: 3341723 - RNA, 22 nt, Human
gagcugccuguucagcuccagc

SEQ ID NO: 3341724 - RNA, 21 nt, Human
gagcugccuguucagcuccag

SEQ ID NO: 3341725 - RNA, 20 nt, Human
gagcugccuguucagcucca

SEQ ID NO: 3341726 - RNA, 18 nt, Human
gagcggagaaaggaaggg

SEQ ID NO: 3341727 - RNA, 21 nt, Human
gagcggagaaaggaagggcug

SEQ ID NO: 3341728 - RNA, 17 nt, Human
gagcggagaaaggaagg

SEQ ID NO: 3341729 - RNA, 18 nt, Human
gagcugggugucaagagg

SEQ ID NO: 3341730 - RNA, 21 nt, Human
gagaugaugccaugggcccuc

SEQ ID NO: 3341731 - RNA, 14 nt, Human
gagacuccugcagg

SEQ ID NO: 3341732 - RNA, 15 nt, Human
gagacuccugcaggc

SEQ ID NO: 3341733 - RNA, 16 nt, Human
gagacuccugcaggca

SEQ ID NO: 3341734 - RNA, 17 nt, Human
gagacuccugcaggcag

SEQ ID NO: 3341735 - RNA, 14 nt, Human
gagaggcauccagu

SEQ ID NO: 3341736 - RNA, 18 nt, Human
gagauugcaccacugcac

SEQ ID NO: 3341737 - RNA, 13 nt, Human
gagauuuacaacu

SEQ ID NO: 3341738 - RNA, 23 nt, Human
ggcucagcggggacagcuccuuc

SEQ ID NO: 3341739 - RNA, 22 nt, Human
ggcucagcggggacagcuccuu

SEQ ID NO: 3341740 - RNA, 21 nt, Human
ggcucagcggggacagcuccu

SEQ ID NO: 3341741 - RNA, 20 nt, Human
ggcucagcggggacagcucc

SEQ ID NO: 3341742 - RNA, 23 nt, Human
ggcucagcaaaagaugcuucuca

SEQ ID NO: 3341743 - RNA, 19 nt, Human
ggcucagcaaaagaugcuu

SEQ ID NO: 3341744 - RNA, 17 nt, Human
ggcucacugcagccuca

SEQ ID NO: 3341745 - RNA, 16 nt, Human
ggcucacugcagccuc

SEQ ID NO: 3341746 - RNA, 14 nt, Human
ggcgugcaguggug

SEQ ID NO: 3341747 - RNA, 19 nt, Human
ggcgugcaguggugcgauc

SEQ ID NO: 3341748 - RNA, 16 nt, Human
ggccuucucugaagga

SEQ ID NO: 3341749 - RNA, 15 nt, Human
ggccuucucugaagg

SEQ ID NO: 3341750 - RNA, 13 nt, Human
ggccuuuggcuuc

SEQ ID NO: 3341751 - RNA, 14 nt, Human
ggccuuuggcuuca

SEQ ID NO: 3341752 - RNA, 21 nt, Human
ggccuggccagaugcaccagc

SEQ ID NO: 3341753 - RNA, 16 nt, Human
ggccuggccagaugca

SEQ ID NO: 3341754 - RNA, 21 nt, Human
ggccugugucuaguuguuuga

SEQ ID NO: 3341755 - RNA, 12 nt, Human
ggccuucucuga

SEQ ID NO: 3341756 - RNA, 15 nt, Human
ggccugagcugggau

SEQ ID NO: 3341757 - RNA, 12 nt, Human
ggccugagcugg

SEQ ID NO: 3341758 - RNA, 17 nt, Human
ggcagugggagcugccu

SEQ ID NO: 3341759 - RNA, 15 nt, Human
ggcaccagcagccug

SEQ ID NO: 3341760 - RNA, 22 nt, Human
ggcacugcuuccagugaggcuc

SEQ ID NO: 3341761 - RNA, 24 nt, Human
ggcacugcuuccagugaggcucug

SEQ ID NO: 3341762 - RNA, 18 nt, Human
ggcauccaguaucuugaa

SEQ ID NO: 3341763 - RNA, 19 nt, Human
ggcagugggagcugccugu

SEQ ID NO: 3341764 - RNA, 18 nt, Human
ggcagugggagcugccug

SEQ ID NO: 3341765 - RNA, 14 nt, Human
ggccaggcuggucu

SEQ ID NO: 3341766 - RNA, 12 nt, Human
ggccaggcuggu

SEQ ID NO: 3341767 - RNA, 18 nt, Human
ggccaggcuggucucaaa

SEQ ID NO: 3341768 - RNA, 16 nt, Human
ggccaggcuggucuca

SEQ ID NO: 3341769 - RNA, 17 nt, Human
ggccaaacucaccugcc

SEQ ID NO: 3341770 - RNA, 18 nt, Human
ggcccuucucuccagccc

SEQ ID NO: 3341771 - RNA, 16 nt, Human
ggcccuucucuccagc

SEQ ID NO: 3341772 - RNA, 17 nt, Human
ggcccuucucuccagcc

SEQ ID NO: 3341773 - RNA, 14 nt, Human
ggcccuuccuuuuc

SEQ ID NO: 3341774 - RNA, 19 nt, Human
ggaggaaggaaacccagcu

SEQ ID NO: 3341775 - RNA, 20 nt, Human
ggaggaaggaaacccagcuc

SEQ ID NO: 3341776 - RNA, 23 nt, Human
ggaggaaggaaacccagcucugg

SEQ ID NO: 3341777 - RNA, 11 nt, Human
ggaggccagcc

SEQ ID NO: 3341778 - RNA, 20 nt, Human
ggaggccaaggugggaggau

SEQ ID NO: 3341779 - RNA, 22 nt, Human
ggagccccgaggccuucucuga

SEQ ID NO: 3341780 - RNA, 16 nt, Human
ggagccccgaggccuu

SEQ ID NO: 3341781 - RNA, 12 nt, Human
ggagcugccugu

SEQ ID NO: 3341782 - RNA, 16 nt, Human
ggagcugaguggggga

SEQ ID NO: 3341783 - RNA, 21 nt, Human
ggagcugccuguucagcucca

SEQ ID NO: 3341784 - RNA, 14 nt, Human
ggaggggggaggug

SEQ ID NO: 3341785 - RNA, 22 nt, Human
ggagguaaggaauaccuguccc

SEQ ID NO: 3341786 - RNA, 16 nt, Human
ggaggggggagguggg

SEQ ID NO: 3341787 - RNA, 20 nt, Human
ggaggucaaggcugcaguga

SEQ ID NO: 3341788 - RNA, 14 nt, Human
ggaggugaccccag

SEQ ID NO: 3341789 - RNA, 15 nt, Human
ggagugcagugagcc

SEQ ID NO: 3341790 - RNA, 18 nt, Human
ggaucucuugagccuggg

SEQ ID NO: 3341791 - RNA, 15 nt, Human
ggauccuccaggugc

SEQ ID NO: 3341792 - RNA, 14 nt, Human
ggauccuccaggug

SEQ ID NO: 3341793 - RNA, 13 nt, Human
ggauccugagcca

SEQ ID NO: 3341794 - RNA, 14 nt, Human
ggauccugagccag

SEQ ID NO: 3341795 - RNA, 16 nt, Human
ggauggggcugcaccg

SEQ ID NO: 3341796 - RNA, 18 nt, Human
ggauggauuuccagccaa

SEQ ID NO: 3341797 - RNA, 15 nt, Human
ggaguucugguuccu

SEQ ID NO: 3341798 - RNA, 15 nt, Human
ggauguucugggaca

SEQ ID NO: 3341799 - RNA, 16 nt, Human
ggauguucugggacac

SEQ ID NO: 3341800 - RNA, 13 nt, Human
ggauguucuggga

SEQ ID NO: 3341801 - RNA, 24 nt, Human
ggcacagaaaauggaagacagcuc

SEQ ID NO: 3341802 - RNA, 23 nt, Human
ggcacagaaaauggaagacagcu

SEQ ID NO: 3341803 - RNA, 14 nt, Human
gguaugcaaucaaa

SEQ ID NO: 3341804 - RNA, 22 nt, Human
gguaugaucacggcucacugca

SEQ ID NO: 3341805 - RNA, 16 nt, Human
gguccacccaggagcc

SEQ ID NO: 3341806 - RNA, 15 nt, Human
gguccacccaggagc

SEQ ID NO: 3341807 - RNA, 13 nt, Human
gguccacccagga

SEQ ID NO: 3341808 - RNA, 12 nt, Human
gguccacccagg

SEQ ID NO: 3341809 - RNA, 17 nt, Human
gguccacccaggagccc

SEQ ID NO: 3341810 - RNA, 17 nt, Human
aaacuuuaccuuuuuua

SEQ ID NO: 3341811 - RNA, 22 nt, Human
aaacuuuaccuuuuuuauacau

SEQ ID NO: 3341812 - RNA, 15 nt, Human
gguccauagagagca

SEQ ID NO: 3341813 - RNA, 12 nt, Human
aaacuuuacuau

SEQ ID NO: 3341814 - RNA, 17 nt, Human
aaagacuaucuaaaugu

SEQ ID NO: 3341815 - RNA, 13 nt, Human
gguaacaggcaga

SEQ ID NO: 3341816 - RNA, 20 nt, Human
gguaacaggcagauacagga

SEQ ID NO: 3341817 - RNA, 14 nt, Human
gguaacaggcagau

SEQ ID NO: 3341818 - RNA, 17 nt, Human
ggguuucuaaagcugcc

SEQ ID NO: 3341819 - RNA, 20 nt, Human
ggguggggaccucaggccug

SEQ ID NO: 3341820 - RNA, 19 nt, Human
gggugggacacccugugau

SEQ ID NO: 3341821 - RNA, 13 nt, Human
ggguggaugccug

SEQ ID NO: 3341822 - RNA, 15 nt, Human
ggguggcaccagcag

SEQ ID NO: 3341823 - RNA, 17 nt, Human
ggguggaugccuggugg

SEQ ID NO: 3341824 - RNA, 17 nt, Human
ggguguggcgcagcaua

SEQ ID NO: 3341825 - RNA, 21 nt, Human
gguccugcugcaguugccagu

SEQ ID NO: 3341826 - RNA, 23 nt, Human
gguccugcugcaguugccaguca

SEQ ID NO: 3341827 - RNA, 23 nt, Human
gguccuagaaauuccccacccug

SEQ ID NO: 3341828 - RNA, 13 nt, Human
aaagcaaaggaga

SEQ ID NO: 3341829 - RNA, 13 nt, Human
ggucggaaaacau

SEQ ID NO: 3341830 - RNA, 14 nt, Human
gguccugcugcagu

SEQ ID NO: 3341831 - RNA, 14 nt, Human
ggucggaaaacaug

SEQ ID NO: 3341832 - RNA, 17 nt, Human
ggucuacacugugcuga

SEQ ID NO: 3341833 - RNA, 15 nt, Human
aaagcagcguuucua

SEQ ID NO: 3341834 - RNA, 16 nt, Human
aaagcagcguuucuau

SEQ ID NO: 3341835 - RNA, 18 nt, Human
aaagcagcguuucuauga

SEQ ID NO: 3341836 - RNA, 22 nt, Human
aaagcagcguuucuaugacaca

SEQ ID NO: 3341837 - RNA, 21 nt, Human
gguggaugccugguggcagcu

SEQ ID NO: 3341838 - RNA, 14 nt, Human
gguggaugccuggu

SEQ ID NO: 3341839 - RNA, 21 nt, Human
ggugcauuugaggucuguucu

SEQ ID NO: 3341840 - RNA, 16 nt, Human
ggugcaaugaccuuuc

SEQ ID NO: 3341841 - RNA, 19 nt, Human
ggugcaaugaccuuucaau

SEQ ID NO: 3341842 - RNA, 20 nt, Human
ggugcaaugaccuuucaaua

SEQ ID NO: 3341843 - RNA, 18 nt, Human
ggugcaaugaccuuucaa

SEQ ID NO: 3341844 - RNA, 14 nt, Human
ggugggauccucca

SEQ ID NO: 3341845 - RNA, 15 nt, Human
ggugggauccuccag

SEQ ID NO: 3341846 - RNA, 20 nt, Human
ggugggaggauugcuugagc

SEQ ID NO: 3341847 - RNA, 20 nt, Human
ggugggaggaucucuugagc

SEQ ID NO: 3341848 - RNA, 19 nt, Human
ggugggauccuccaggugc

SEQ ID NO: 3341849 - RNA, 17 nt, Human
gguggggcagcuugagg

SEQ ID NO: 3341850 - RNA, 13 nt, Human
gguggggcagcuu

SEQ ID NO: 3341851 - RNA, 15 nt, Human
gguggggucacucug

SEQ ID NO: 3341852 - RNA, 23 nt, Human
gguggggucacucuggcagcuca

SEQ ID NO: 3341853 - RNA, 13 nt, Human
ggugucgggcaug

SEQ ID NO: 3341854 - RNA, 16 nt, Human
ggugucgggcaugaca

SEQ ID NO: 3341855 - RNA, 18 nt, Human
ggugugagucaccaagcc

SEQ ID NO: 3341856 - RNA, 16 nt, Human
ggugugacugaauuuc

SEQ ID NO: 3341857 - RNA, 21 nt, Human
ggugugcggccuuuggcuuca

SEQ ID NO: 3341858 - RNA, 13 nt, Human
ggugugcucugau

SEQ ID NO: 3341859 - RNA, 12 nt, Human
gguguggaagag

SEQ ID NO: 3341860 - RNA, 12 nt, Human
gguucagcuugu

SEQ ID NO: 3341861 - RNA, 21 nt, Human
gguucaggguuggccccugcc

SEQ ID NO: 3341862 - RNA, 18 nt, Human
gguucaggguuggccccu

SEQ ID NO: 3341863 - RNA, 22 nt, Human
gguucaggguuggccccugccc

SEQ ID NO: 3341864 - RNA, 21 nt, Human
gguucccuuugacgccauccc

SEQ ID NO: 3341865 - RNA, 14 nt, Human
gguuucagaaaugu

SEQ ID NO: 3341866 - RNA, 12 nt, Human
gguuucagaaau

SEQ ID NO: 3341867 - RNA, 13 nt, Human
gguuucagaaaug

SEQ ID NO: 3341868 - RNA, 23 nt, Human
aaaguuucucuuuucaaaacauu

SEQ ID NO: 3341869 - RNA, 21 nt, Human
aaaguuucucuuuucaaaaca

SEQ ID NO: 3341870 - RNA, 12 nt, Human
aaaguggugaga

SEQ ID NO: 3341871 - RNA, 12 nt, Human
aaauaaugugaa

SEQ ID NO: 3341872 - RNA, 13 nt, Human
aaauaaugugaaa

SEQ ID NO: 3341873 - RNA, 15 nt, Human
ggggccucagugcca

SEQ ID NO: 3341874 - RNA, 20 nt, Human
ggggacagcuccuucugucc

SEQ ID NO: 3341875 - RNA, 14 nt, Human
ggggacagcuccuu

SEQ ID NO: 3341876 - RNA, 12 nt, Human
ggggacagcucc

SEQ ID NO: 3341877 - RNA, 12 nt, Human
aaacacauuuuu

SEQ ID NO: 3341878 - RNA, 16 nt, Human
aaacacauuuuucuua

SEQ ID NO: 3341879 - RNA, 18 nt, Human
aaacaagaccacguuucu

SEQ ID NO: 3341880 - RNA, 20 nt, Human
aaacaagaccacguuucuaa

SEQ ID NO: 3341881 - RNA, 20 nt, Human
gggcuggguucuacccaggu

SEQ ID NO: 3341882 - RNA, 17 nt, Human
gggcuggguucuaccca

SEQ ID NO: 3341883 - RNA, 22 nt, Human
gggcugcaccggcuggccuggc

SEQ ID NO: 3341884 - RNA, 10 nt, Human
gggcucagca

SEQ ID NO: 3341885 - RNA, 21 nt, Human
gggcugcaugcgggcuuccuc

SEQ ID NO: 3341886 - RNA, 18 nt, Human
gggcugcaugcgggcuuc

SEQ ID NO: 3341887 - RNA, 22 nt, Human
gggcuggguucuacccaggugc

SEQ ID NO: 3341888 - RNA, 11 nt, Human
gggccaggagc

SEQ ID NO: 3341889 - RNA, 14 nt, Human
aaaaugagccuggc

SEQ ID NO: 3341890 - RNA, 21 nt, Human
aaaaugagccuggcaagaaug

SEQ ID NO: 3341891 - RNA, 14 nt, Human
gggccaguuggucc

SEQ ID NO: 3341892 - RNA, 18 nt, Human
gggccaguuggucccccu

SEQ ID NO: 3341893 - RNA, 22 nt, Human
gggccaguuggucccccuucca

SEQ ID NO: 3341894 - RNA, 23 nt, Human
gggccaguuggucccccuuccau

SEQ ID NO: 3341895 - RNA, 15 nt, Human
gggccucagugccac

SEQ ID NO: 3341896 - RNA, 13 nt, Human
gggccuccugugu

SEQ ID NO: 3341897 - RNA, 15 nt, Human
gggccuccugugugu

SEQ ID NO: 3341898 - RNA, 20 nt, Human
gggccucuuaugggcugggu

SEQ ID NO: 3341899 - RNA, 19 nt, Human
gggccucuuaugggcuggg

SEQ ID NO: 3341900 - RNA, 15 nt, Human
gggcgggaggauguu

SEQ ID NO: 3341901 - RNA, 18 nt, Human
gggcuaguugggcuuccu

SEQ ID NO: 3341902 - RNA, 14 nt, Human
gggcagaggaaagc

SEQ ID NO: 3341903 - RNA, 17 nt, Human
gggcagagcagagacca

SEQ ID NO: 3341904 - RNA, 22 nt, Human
gggcagagcagagaccaucccu

SEQ ID NO: 3341905 - RNA, 16 nt, Human
gggcagagcagagacc

SEQ ID NO: 3341906 - RNA, 12 nt, Human
gggcagagcaga

SEQ ID NO: 3341907 - RNA, 18 nt, Human
gggcaacccccagccugc

SEQ ID NO: 3341908 - RNA, 16 nt, Human
gggcaacccccagccu

SEQ ID NO: 3341909 - RNA, 15 nt, Human
gggauuacaggugug

SEQ ID NO: 3341910 - RNA, 19 nt, Human
gggaggccaaggugggagg

SEQ ID NO: 3341911 - RNA, 14 nt, Human
gggagggcuccaga

SEQ ID NO: 3341912 - RNA, 15 nt, Human
gggagggcuccagac

SEQ ID NO: 3341913 - RNA, 17 nt, Human
gggagggcuccagacac

SEQ ID NO: 3341914 - RNA, 17 nt, Human
gggaggucgaggcagga

SEQ ID NO: 3341915 - RNA, 18 nt, Human
gggaggucgaggcaggag

SEQ ID NO: 3341916 - RNA, 19 nt, Human
gggaggucgaggcaggagg

SEQ ID NO: 3341917 - RNA, 15 nt, Human
gggaggucgaggcag

SEQ ID NO: 3341918 - RNA, 13 nt, Human
gggagggcuccag

SEQ ID NO: 3341919 - RNA, 15 nt, Human
aaaacaugcuacaca

SEQ ID NO: 3341920 - RNA, 21 nt, Human
aaaaccaauguucucucuucu

SEQ ID NO: 3341921 - RNA, 14 nt, Human
aaaacauuggauua

SEQ ID NO: 3341922 - RNA, 21 nt, Human
aaaacauuggauuauccugag

SEQ ID NO: 3341923 - RNA, 14 nt, Human
aaaaaucucaaauu

SEQ ID NO: 3341924 - RNA, 23 nt, Human
aaaacugcugacuguuuucucuu

SEQ ID NO: 3341925 - RNA, 13 nt, Human
aaaagaugcuucu

SEQ ID NO: 3341926 - RNA, 20 nt, Human
aaaacugcugacuguuuucu

SEQ ID NO: 3341927 - RNA, 22 nt, Human
aaaacugcugacuguuuucucu

SEQ ID NO: 3341928 - RNA, 21 nt, Human
gggacagcuccuucuguccua

SEQ ID NO: 3341929 - RNA, 13 nt, Human
gggaaggauacaa

SEQ ID NO: 3341930 - RNA, 13 nt, Human
gggacagaggggg

SEQ ID NO: 3341931 - RNA, 22 nt, Human
gggacagaggggguggccuccc

SEQ ID NO: 3341932 - RNA, 23 nt, Human
gggacagaggggguggccuccca

SEQ ID NO: 3341933 - RNA, 16 nt, Human
gggacagcuccuucug

SEQ ID NO: 3341934 - RNA, 13 nt, Human
gggaagagacuug

SEQ ID NO: 3341935 - RNA, 14 nt, Human
gcuuugaucccuuc

SEQ ID NO: 3341936 - RNA, 17 nt, Human
gcuuugaucccuucuua

SEQ ID NO: 3341937 - RNA, 18 nt, Human
ggaaaauuuuaaaaauac

SEQ ID NO: 3341938 - RNA, 16 nt, Human
ggaaacccagcucugg

SEQ ID NO: 3341939 - RNA, 15 nt, Human
ggaaacccagcucug

SEQ ID NO: 3341940 - RNA, 15 nt, Human
gcuuuuuaauauuga

SEQ ID NO: 3341941 - RNA, 18 nt, Human
gcuuuugucuaugggacu

SEQ ID NO: 3341942 - RNA, 15 nt, Human
gcuuuuggucugugu

SEQ ID NO: 3341943 - RNA, 14 nt, Human
ggaaaugggcagag

SEQ ID NO: 3341944 - RNA, 16 nt, Human
ggaaaugggcagagca

SEQ ID NO: 3341945 - RNA, 17 nt, Human
ggaaaugggcagagcag

SEQ ID NO: 3341946 - RNA, 18 nt, Human
ggaaaugggcagagcaga

SEQ ID NO: 3341947 - RNA, 22 nt, Human
ggaaaugggcagagcagagacc

SEQ ID NO: 3341948 - RNA, 17 nt, Human
ggaacaaggcaaggcug

SEQ ID NO: 3341949 - RNA, 21 nt, Human
ggaacaaggcaaggcugucaa

SEQ ID NO: 3341950 - RNA, 15 nt, Human
ggaacaaggcaaggc

SEQ ID NO: 3341951 - RNA, 13 nt, Human
ggaacaccuccuc

SEQ ID NO: 3341952 - RNA, 23 nt, Human
ggaacaaggcaaggcugucaauu

SEQ ID NO: 3341953 - RNA, 15 nt, Human
ggaacacuccuucac

SEQ ID NO: 3341954 - RNA, 14 nt, Human
ggaagacaauguga

SEQ ID NO: 3341955 - RNA, 16 nt, Human
ggaagacaaugugaaa

SEQ ID NO: 3341956 - RNA, 17 nt, Human
ggaagacuucaucccuc

SEQ ID NO: 3341957 - RNA, 20 nt, Human
ggaagacuucaucccucugg

SEQ ID NO: 3341958 - RNA, 22 nt, Human
gcuuccagugaggcucugcccu

SEQ ID NO: 3341959 - RNA, 23 nt, Human
gcuugaccgugaggccagagaca

SEQ ID NO: 3341960 - RNA, 18 nt, Human
gcuugaccuuuaagagaa

SEQ ID NO: 3341961 - RNA, 17 nt, Human
gcuuguaaauagcucag

SEQ ID NO: 3341962 - RNA, 19 nt, Human
gcuuguaaauagcucaggu

SEQ ID NO: 3341963 - RNA, 18 nt, Human
gcuuguaaauagcucagg

SEQ ID NO: 3341964 - RNA, 23 nt, Human
gcuuucuacccagcgagcccugg

SEQ ID NO: 3341965 - RNA, 12 nt, Human
gcuucuucagag

SEQ ID NO: 3341966 - RNA, 20 nt, Human
gcuugaccgugaggccagag

SEQ ID NO: 3341967 - RNA, 23 nt, Human
gcuuccagugaggcucugcccuu

SEQ ID NO: 3341968 - RNA, 13 nt, Human
gcuguuggcuggg

SEQ ID NO: 3341969 - RNA, 14 nt, Human
gcuucaaggauccu

SEQ ID NO: 3341970 - RNA, 14 nt, Human
gcuucaguggcagc

SEQ ID NO: 3341971 - RNA, 23 nt, Human
gcugguucaggguuggccccugc

SEQ ID NO: 3341972 - RNA, 13 nt, Human
gcugccauccagg

SEQ ID NO: 3341973 - RNA, 12 nt, Human
gcugccauccag

SEQ ID NO: 3341974 - RNA, 13 nt, Human
gcugcacccucag

SEQ ID NO: 3341975 - RNA, 15 nt, Human
gcugcacccucaggc

SEQ ID NO: 3341976 - RNA, 15 nt, Human
gcugaggugggagga

SEQ ID NO: 3341977 - RNA, 12 nt, Human
gcugcugacagu

SEQ ID NO: 3341978 - RNA, 18 nt, Human
gcugcugaaggcucgagc

SEQ ID NO: 3341979 - RNA, 15 nt, Human
gcugccccuggcagc

SEQ ID NO: 3341980 - RNA, 16 nt, Human
gcugccccuggcagcc

SEQ ID NO: 3341981 - RNA, 13 nt, Human
gcugccccuggca

SEQ ID NO: 3341982 - RNA, 16 nt, Human
gcucucaggccagcug

SEQ ID NO: 3341983 - RNA, 18 nt, Human
gcucucaaguuaucaggg

SEQ ID NO: 3341984 - RNA, 19 nt, Human
gcuccucuccccagcaagu

SEQ ID NO: 3341985 - RNA, 16 nt, Human
gcuccucuccccagca

SEQ ID NO: 3341986 - RNA, 19 nt, Human
gcucuacugaggugcuaug

SEQ ID NO: 3341987 - RNA, 17 nt, Human
gcucucaggccagcugc

SEQ ID NO: 3341988 - RNA, 18 nt, Human
gcucucaggccagcugcu

SEQ ID NO: 3341989 - RNA, 19 nt, Human
gcucucaggccagcugcuu

SEQ ID NO: 3341990 - RNA, 23 nt, Human
gcucccaggcauuccccaggagg

SEQ ID NO: 3341991 - RNA, 14 nt, Human
gcuccagcucacca

SEQ ID NO: 3341992 - RNA, 13 nt, Human
gcuccagcucacc

SEQ ID NO: 3341993 - RNA, 15 nt, Human
gcuccucuccccagc

SEQ ID NO: 3341994 - RNA, 18 nt, Human
gcuccagacacaugucca

SEQ ID NO: 3341995 - RNA, 21 nt, Human
gcuccagacacauguccaaga

SEQ ID NO: 3341996 - RNA, 23 nt, Human
gcuccagacacauguccaagaag

SEQ ID NO: 3341997 - RNA, 9 nt, Human
gcuccagac

SEQ ID NO: 3341998 - RNA, 23 nt, Human
gcucugguccauagagagcaaga

SEQ ID NO: 3341999 - RNA, 23 nt, Human
gcugaaggcucgagcaugccugg

SEQ ID NO: 3342000 - RNA, 17 nt, Human
gcugaauacagaggcaa

SEQ ID NO: 3342001 - RNA, 22 nt, Human
gcucugaucauccacugugcca

SEQ ID NO: 3342002 - RNA, 21 nt, Human
gcucugaucauccacugugcc

SEQ ID NO: 3342003 - RNA, 20 nt, Human
gcucugaucauccacugugc

SEQ ID NO: 3342004 - RNA, 20 nt, Human
gccuccuuugugaggaagcc

SEQ ID NO: 3342005 - RNA, 19 nt, Human
gccuccuuugugaggaagc

SEQ ID NO: 3342006 - RNA, 23 nt, Human
gccugcuaauuccccagauugca

SEQ ID NO: 3342007 - RNA, 17 nt, Human
gccugcuaauuccccag

SEQ ID NO: 3342008 - RNA, 19 nt, Human
gcggagacggagucccacc

SEQ ID NO: 3342009 - RNA, 20 nt, Human
gcgugguggacaugcacagc

SEQ ID NO: 3342010 - RNA, 18 nt, Human
gcgugcacacaccagagc

SEQ ID NO: 3342011 - RNA, 14 nt, Human
gcgugcacacacca

SEQ ID NO: 3342012 - RNA, 16 nt, Human
gcuaauuuuucauuuu

SEQ ID NO: 3342013 - RNA, 17 nt, Human
gcguuucuaugacacau

SEQ ID NO: 3342014 - RNA, 20 nt, Human
gcuacuguccuacccacccu

SEQ ID NO: 3342015 - RNA, 19 nt, Human
gcuacuguccuacccaccc

SEQ ID NO: 3342016 - RNA, 14 nt, Human
gcgauucuucugcu

SEQ ID NO: 3342017 - RNA, 13 nt, Human
gcgauucuucugc

SEQ ID NO: 3342018 - RNA, 22 nt, Human
gccccugcugguucaggguugg

SEQ ID NO: 3342019 - RNA, 21 nt, Human
gccccugcugguucaggguug

SEQ ID NO: 3342020 - RNA, 15 nt, Human
gccccugcccggcug

SEQ ID NO: 3342021 - RNA, 12 nt, Human
gcccaggcaggu

SEQ ID NO: 3342022 - RNA, 13 nt, Human
gcccaggcagguc

SEQ ID NO: 3342023 - RNA, 13 nt, Human
gcccaggccccug

SEQ ID NO: 3342024 - RNA, 15 nt, Human
gcccaggccccugcc

SEQ ID NO: 3342025 - RNA, 14 nt, Human
gcccaggcaggucu

SEQ ID NO: 3342026 - RNA, 14 nt, Human
gccaugugccaggu

SEQ ID NO: 3342027 - RNA, 17 nt, Human
gcccaggccccugccac

SEQ ID NO: 3342028 - RNA, 21 nt, Human
gccaggccacaagacccuugu

SEQ ID NO: 3342029 - RNA, 15 nt, Human
gccaggccagaggga

SEQ ID NO: 3342030 - RNA, 22 nt, Human
gccaggccagagggagugacag

SEQ ID NO: 3342031 - RNA, 13 nt, Human
gccaggccagagg

SEQ ID NO: 3342032 - RNA, 13 nt, Human
gccaggccacaag

SEQ ID NO: 3342033 - RNA, 18 nt, Human
gccaggccacaagacccu

SEQ ID NO: 3342034 - RNA, 13 nt, Human
gccaggcccucug

SEQ ID NO: 3342035 - RNA, 14 nt, Human
gccaggcccucugc

SEQ ID NO: 3342036 - RNA, 23 nt, Human
gccagcaggcucucaggccagcu

SEQ ID NO: 3342037 - RNA, 16 nt, Human
gccaguuggucccccu

SEQ ID NO: 3342038 - RNA, 18 nt, Human
gccaguuggucccccuuc

SEQ ID NO: 3342039 - RNA, 20 nt, Human
gccaguuggucccccuucca

SEQ ID NO: 3342040 - RNA, 21 nt, Human
gccaguuggucccccuuccau

SEQ ID NO: 3342041 - RNA, 22 nt, Human
gccaguuggucccccuuccaug

SEQ ID NO: 3342042 - RNA, 23 nt, Human
gccaguuggucccccuuccaugg

SEQ ID NO: 3342043 - RNA, 13 nt, Human
gccaguugguccc

SEQ ID NO: 3342044 - RNA, 18 nt, Human
gccaguguugccuaagua

SEQ ID NO: 3342045 - RNA, 16 nt, Human
gccaguguugccuaag

SEQ ID NO: 3342046 - RNA, 15 nt, Human
gccaguguugccuaa

SEQ ID NO: 3342047 - RNA, 13 nt, Human
gccagugugacaa

SEQ ID NO: 3342048 - RNA, 18 nt, Human
caagcgugagccacugca

SEQ ID NO: 3342049 - RNA, 19 nt, Human
caauaaagcagcguuucua

SEQ ID NO: 3342050 - RNA, 14 nt, Human
caagcugcacccuc

SEQ ID NO: 3342051 - RNA, 18 nt, Human
caagcugcacccucaggc

SEQ ID NO: 3342052 - RNA, 13 nt, Human
caagcugcacccu

SEQ ID NO: 3342053 - RNA, 14 nt, Human
caagcucugcuccu

SEQ ID NO: 3342054 - RNA, 12 nt, Human
caagcuccaagc

SEQ ID NO: 3342055 - RNA, 13 nt, Human
caagcucugcucc

SEQ ID NO: 3342056 - RNA, 15 nt, Human
caaggccaaaggaag

SEQ ID NO: 3342057 - RNA, 16 nt, Human
caaggccaaaggaagc

SEQ ID NO: 3342058 - RNA, 17 nt, Human
caaggccaaaggaagca

SEQ ID NO: 3342059 - RNA, 18 nt, Human
caaggccaaaggaagcac

SEQ ID NO: 3342060 - RNA, 13 nt, Human
caagucaagugaa

SEQ ID NO: 3342061 - RNA, 17 nt, Human
caagucaagugaaaaag

SEQ ID NO: 3342062 - RNA, 18 nt, Human
cacagacauacuaaccag

SEQ ID NO: 3342063 - RNA, 23 nt, Human
cacagaaaauggaagacagcucu

SEQ ID NO: 3342064 - RNA, 19 nt, Human
cacagaaaauucuucucca

SEQ ID NO: 3342065 - RNA, 19 nt, Human
cacagacauacuaaccagc

SEQ ID NO: 3342066 - RNA, 21 nt, Human
cacagacauacuaaccagcag

SEQ ID NO: 3342067 - RNA, 11 nt, Human
cacagccucug

SEQ ID NO: 3342068 - RNA, 21 nt, Human
cacacaugagcaucaggccag

SEQ ID NO: 3342069 - RNA, 22 nt, Human
cacacaugagcaucaggccagg

SEQ ID NO: 3342070 - RNA, 18 nt, Human
cacagaaaauggaagaca

SEQ ID NO: 3342071 - RNA, 19 nt, Human
cacagaaaauggaagacag

SEQ ID NO: 3342072 - RNA, 20 nt, Human
cacagaaaauggaagacagc

SEQ ID NO: 3342073 - RNA, 22 nt, Human
cacagaaaauggaagacagcuc

SEQ ID NO: 3342074 - RNA, 16 nt, Human
cacacagcucuguccu

SEQ ID NO: 3342075 - RNA, 23 nt, Human
cacacaguauuacuucugcuaca

SEQ ID NO: 3342076 - RNA, 20 nt, Human
cacacaguauuacuucugcu

SEQ ID NO: 3342077 - RNA, 18 nt, Human
cacacagugagucgagga

SEQ ID NO: 3342078 - RNA, 23 nt, Human
cacacagugagucgaggacaggg

SEQ ID NO: 3342079 - RNA, 21 nt, Human
cacacagugagucgaggacag

SEQ ID NO: 3342080 - RNA, 15 nt, Human
cacacauacacacac

SEQ ID NO: 3342081 - RNA, 20 nt, Human
cacacaugagcaucaggcca

SEQ ID NO: 3342082 - RNA, 19 nt, Human
cacaguauuacuucugcua

SEQ ID NO: 3342083 - RNA, 21 nt, Human
cacaguauuacuucugcuaca

SEQ ID NO: 3342084 - RNA, 20 nt, Human
cacaguauuacuucugcuac

SEQ ID NO: 3342085 - RNA, 17 nt, Human
cacaggggaaaagagga

SEQ ID NO: 3342086 - RNA, 18 nt, Human
cacaggggaaaagaggag

SEQ ID NO: 3342087 - RNA, 19 nt, Human
cacaggggaaaagaggagu

SEQ ID NO: 3342088 - RNA, 20 nt, Human
cacacagcucuguccuggga

SEQ ID NO: 3342089 - RNA, 17 nt, Human
cacacagcucuguccug

SEQ ID NO: 3342090 - RNA, 17 nt, Human
cacaagcugcacccuca

SEQ ID NO: 3342091 - RNA, 23 nt, Human
cacaagcugcacccucaggcagg

SEQ ID NO: 3342092 - RNA, 17 nt, Human
cacaagcuccaagcucc

SEQ ID NO: 3342093 - RNA, 23 nt, Human
cacaagcuccaagcucccaggca

SEQ ID NO: 3342094 - RNA, 21 nt, Human
cacaagcuccaagcucccagg

SEQ ID NO: 3342095 - RNA, 16 nt, Human
cacaagagcccaggcc

SEQ ID NO: 3342096 - RNA, 13 nt, Human
cacaagcuccaag

SEQ ID NO: 3342097 - RNA, 14 nt, Human
cacaagcuccaagc

SEQ ID NO: 3342098 - RNA, 15 nt, Human
cacaagcuccaagcu

SEQ ID NO: 3342099 - RNA, 14 nt, Human
cacaagagcccagg

SEQ ID NO: 3342100 - RNA, 11 nt, Human
caauggcagcc

SEQ ID NO: 3342101 - RNA, 11 nt, Human
caccccagccc

SEQ ID NO: 3342102 - RNA, 14 nt, Human
cacccucaggcagg

SEQ ID NO: 3342103 - RNA, 16 nt, Human
cacccuggggagaaag

SEQ ID NO: 3342104 - RNA, 15 nt, Human
cacccuggggagaaa

SEQ ID NO: 3342105 - RNA, 17 nt, Human
cacccugaaagcccuga

SEQ ID NO: 3342106 - RNA, 15 nt, Human
caccugccccucaac

SEQ ID NO: 3342107 - RNA, 14 nt, Human
caccugccccucaa

SEQ ID NO: 3342108 - RNA, 13 nt, Human
caccucagccucc

SEQ ID NO: 3342109 - RNA, 12 nt, Human
caccucagccuc

SEQ ID NO: 3342110 - RNA, 14 nt, Human
caccucagccuccc

SEQ ID NO: 3342111 - RNA, 13 nt, Human
caccuuggcugca

SEQ ID NO: 3342112 - RNA, 15 nt, Human
caccuuggcucaagu

SEQ ID NO: 3342113 - RNA, 14 nt, Human
caccuuggcucaag

SEQ ID NO: 3342114 - RNA, 19 nt, Human
caccugccuguugggccag

SEQ ID NO: 3342115 - RNA, 17 nt, Human
caccugccuguugggcc

SEQ ID NO: 3342116 - RNA, 14 nt, Human
cacuccccugcugg

SEQ ID NO: 3342117 - RNA, 12 nt, Human
cacuccccugcu

SEQ ID NO: 3342118 - RNA, 13 nt, Human
cacuccccugcug

SEQ ID NO: 3342119 - RNA, 16 nt, Human
cacuccagccugggug

SEQ ID NO: 3342120 - RNA, 22 nt, Human
cacucauugaccugaggcccuu

SEQ ID NO: 3342121 - RNA, 16 nt, Human
cacugcauguuuguga

SEQ ID NO: 3342122 - RNA, 13 nt, Human
cacugcagccuca

SEQ ID NO: 3342123 - RNA, 19 nt, Human
cacugcacuauagccuagg

SEQ ID NO: 3342124 - RNA, 19 nt, Human
cacugcacuccagccuggg

SEQ ID NO: 3342125 - RNA, 18 nt, Human
cacugcacuccagccugg

SEQ ID NO: 3342126 - RNA, 15 nt, Human
cacugcacuccagcc

SEQ ID NO: 3342127 - RNA, 16 nt, Human
cacugcacuccagccu

SEQ ID NO: 3342128 - RNA, 20 nt, Human
cacugcacuccagccugggu

SEQ ID NO: 3342129 - RNA, 12 nt, Human
cacugcagccuc

SEQ ID NO: 3342130 - RNA, 18 nt, Human
cacuuacacuuuaugcac

SEQ ID NO: 3342131 - RNA, 16 nt, Human
cacuuacacuuuaugc

SEQ ID NO: 3342132 - RNA, 22 nt, Human
auugcuacuguccuacccaccc

SEQ ID NO: 3342133 - RNA, 20 nt, Human
auugcuacuguccuacccac

SEQ ID NO: 3342134 - RNA, 15 nt, Human
auugcuacuguccua

SEQ ID NO: 3342135 - RNA, 14 nt, Human
auugcuacuguccu

SEQ ID NO: 3342136 - RNA, 21 nt, Human
auugauaagaaccuuuugagu

SEQ ID NO: 3342137 - RNA, 12 nt, Human
auucuucugcuu

SEQ ID NO: 3342138 - RNA, 11 nt, Human
auucuucugcu

SEQ ID NO: 3342139 - RNA, 11 nt, Human
auucuuuccug

SEQ ID NO: 3342140 - RNA, 15 nt, Human
auugcugauggugca

SEQ ID NO: 3342141 - RNA, 16 nt, Human
auugcugauggugcaa

SEQ ID NO: 3342142 - RNA, 18 nt, Human
auugcugauggugcaaug

SEQ ID NO: 3342143 - RNA, 19 nt, Human
auugcugauggugcaauga

SEQ ID NO: 3342144 - RNA, 14 nt, Human
auugcuugagcuca

SEQ ID NO: 3342145 - RNA, 23 nt, Human
auugcugauggugcaaugaccuu

SEQ ID NO: 3342146 - RNA, 12 nt, Human
auugcugcuuga

SEQ ID NO: 3342147 - RNA, 18 nt, Human
auugugucucuugguccu

SEQ ID NO: 3342148 - RNA, 21 nt, Human
auugugucucuugguccugcu

SEQ ID NO: 3342149 - RNA, 23 nt, Human
auugugucucuugguccugcugc

SEQ ID NO: 3342150 - RNA, 16 nt, Human
auuguuagucucuuga

SEQ ID NO: 3342151 - RNA, 16 nt, Human
auuacaggugugaacc

SEQ ID NO: 3342152 - RNA, 17 nt, Human
auuacaggaaguacugg

SEQ ID NO: 3342153 - RNA, 14 nt, Human
auucauaaugacuu

SEQ ID NO: 3342154 - RNA, 15 nt, Human
auucauaaugacuua

SEQ ID NO: 3342155 - RNA, 19 nt, Human
auucauaaugacuuaagca

SEQ ID NO: 3342156 - RNA, 21 nt, Human
auuaggugugacugaauuucu

SEQ ID NO: 3342157 - RNA, 16 nt, Human
auuaggugugacugaa

SEQ ID NO: 3342158 - RNA, 18 nt, Human
auuaggugugacugaauu

SEQ ID NO: 3342159 - RNA, 15 nt, Human
auuugugauacaaug

SEQ ID NO: 3342160 - RNA, 17 nt, Human
auuugugauacaaugcu

SEQ ID NO: 3342161 - RNA, 20 nt, Human
auuugugauacaaugcugug

SEQ ID NO: 3342162 - RNA, 13 nt, Human
auuugcuccuuuc

SEQ ID NO: 3342163 - RNA, 20 nt, Human
auuuguuugaacugauaaag

SEQ ID NO: 3342164 - RNA, 22 nt, Human
auuuguuugaacugauaaagau

SEQ ID NO: 3342165 - RNA, 23 nt, Human
auuuguuugaacugauaaagaug

SEQ ID NO: 3342166 - RNA, 15 nt, Human
caaagcagugcaugc

SEQ ID NO: 3342167 - RNA, 17 nt, Human
caaagcagugcaugcug

SEQ ID NO: 3342168 - RNA, 22 nt, Human
caaaguacacuguuucaaacuu

SEQ ID NO: 3342169 - RNA, 21 nt, Human
caaaguagaagucuuagaugu

SEQ ID NO: 3342170 - RNA, 14 nt, Human
caaaguagaagucu

SEQ ID NO: 3342171 - RNA, 22 nt, Human
caaagauauuuugcuuugugau

SEQ ID NO: 3342172 - RNA, 23 nt, Human
caaagauauuuugcuuugugauu

SEQ ID NO: 3342173 - RNA, 14 nt, Human
caaagaugcagccg

SEQ ID NO: 3342174 - RNA, 21 nt, Human
caaauggaaaugggcagagca

SEQ ID NO: 3342175 - RNA, 20 nt, Human
caaauggaaaugggcagagc

SEQ ID NO: 3342176 - RNA, 18 nt, Human
caaagauauuuugcuuug

SEQ ID NO: 3342177 - RNA, 20 nt, Human
caaagauauuuugcuuugug

SEQ ID NO: 3342178 - RNA, 21 nt, Human
caaaccaucauugaaaucuuu

SEQ ID NO: 3342179 - RNA, 19 nt, Human
caaaccaucauugaaaucu

SEQ ID NO: 3342180 - RNA, 15 nt, Human
caaacagaggccgcc

SEQ ID NO: 3342181 - RNA, 23 nt, Human
auuuuuuuuuccuucagugccuu

SEQ ID NO: 3342182 - RNA, 18 nt, Human
caaaagaugcuucucacu

SEQ ID NO: 3342183 - RNA, 16 nt, Human
caaaagaugcuucuca

SEQ ID NO: 3342184 - RNA, 15 nt, Human
cagauuucacucucc

SEQ ID NO: 3342185 - RNA, 16 nt, Human
cagauuucacucuccu

SEQ ID NO: 3342186 - RNA, 19 nt, Human
cagauuugaacucuucaau

SEQ ID NO: 3342187 - RNA, 18 nt, Human
cagauuucacucuccuug

SEQ ID NO: 3342188 - RNA, 13 nt, Human
cagauuucacucu

SEQ ID NO: 3342189 - RNA, 21 nt, Human
cagauugcaacaggcugggcu

SEQ ID NO: 3342190 - RNA, 17 nt, Human
cagcauagaaguaacuu

SEQ ID NO: 3342191 - RNA, 16 nt, Human
cagcauauucaggaag

SEQ ID NO: 3342192 - RNA, 17 nt, Human
cagcauauucaggaagc

SEQ ID NO: 3342193 - RNA, 18 nt, Human
cagcauauucaggaagcu

SEQ ID NO: 3342194 - RNA, 22 nt, Human
cagccccauucugccugcccag

SEQ ID NO: 3342195 - RNA, 20 nt, Human
cagccccauucugccugccc

SEQ ID NO: 3342196 - RNA, 19 nt, Human
cagccccauucugccugcc

SEQ ID NO: 3342197 - RNA, 24 nt, Human
cagccccauucugccugcccaggc

SEQ ID NO: 3342198 - RNA, 23 nt, Human
cagccccauucugccugcccagg

SEQ ID NO: 3342199 - RNA, 18 nt, Human
cagccccauucugccugc

SEQ ID NO: 3342200 - RNA, 16 nt, Human
cagcguuucuaugaca

SEQ ID NO: 3342201 - RNA, 14 nt, Human
cagcguuucuauga

SEQ ID NO: 3342202 - RNA, 13 nt, Human
cagcccuuagcag

SEQ ID NO: 3342203 - RNA, 23 nt, Human
cagccgccaugcuccuggcccac

SEQ ID NO: 3342204 - RNA, 17 nt, Human
cagagcuacacagggga

SEQ ID NO: 3342205 - RNA, 22 nt, Human
cagagcuacacaggggaaaaga

SEQ ID NO: 3342206 - RNA, 16 nt, Human
cagagagggugggagu

SEQ ID NO: 3342207 - RNA, 13 nt, Human
cagagaggguggg

SEQ ID NO: 3342208 - RNA, 20 nt, Human
cagagagggugggagugggc

SEQ ID NO: 3342209 - RNA, 22 nt, Human
cagagagggugggagugggccc

SEQ ID NO: 3342210 - RNA, 14 nt, Human
cagagccugcaguu

SEQ ID NO: 3342211 - RNA, 13 nt, Human
cagagccugcagu

SEQ ID NO: 3342212 - RNA, 19 nt, Human
cagagacuccugcaggcag

SEQ ID NO: 3342213 - RNA, 21 nt, Human
cagagacuccugcaggcagcc

SEQ ID NO: 3342214 - RNA, 22 nt, Human
cagagacuccugcaggcagcca

SEQ ID NO: 3342215 - RNA, 20 nt, Human
cagagacuccugcaggcagc

SEQ ID NO: 3342216 - RNA, 23 nt, Human
cagauacaggaaaagcugcugac

SEQ ID NO: 3342217 - RNA, 23 nt, Human
cagggucucacucugucgcccag

SEQ ID NO: 3342218 - RNA, 22 nt, Human
cagggucucacucugucgccca

SEQ ID NO: 3342219 - RNA, 21 nt, Human
cagggucucuaccauccccug

SEQ ID NO: 3342220 - RNA, 16 nt, Human
caggguuggccccugc

SEQ ID NO: 3342221 - RNA, 15 nt, Human
caggguuggccccug

SEQ ID NO: 3342222 - RNA, 23 nt, Human
cagguuuuuggucugacccacug

SEQ ID NO: 3342223 - RNA, 21 nt, Human
caggguuggccccugcccggc

SEQ ID NO: 3342224 - RNA, 17 nt, Human
caggguuggccccugcc

SEQ ID NO: 3342225 - RNA, 14 nt, Human
caggguuggccccu

SEQ ID NO: 3342226 - RNA, 14 nt, Human
caggugcugccauc

SEQ ID NO: 3342227 - RNA, 13 nt, Human
caggugcugccau

SEQ ID NO: 3342228 - RNA, 19 nt, Human
caguaaaugggggugcauu

SEQ ID NO: 3342229 - RNA, 19 nt, Human
caguauuacuucugcuaca

SEQ ID NO: 3342230 - RNA, 18 nt, Human
caguaaaugggggugcau

SEQ ID NO: 3342231 - RNA, 16 nt, Human
cagucaccccggccac

SEQ ID NO: 3342232 - RNA, 17 nt, Human
cagucaccccggccacc

SEQ ID NO: 3342233 - RNA, 14 nt, Human
cagucaccccggcc

SEQ ID NO: 3342234 - RNA, 20 nt, Human
caggccugggggcugggcag

SEQ ID NO: 3342235 - RNA, 22 nt, Human
caggccugggggcugggcagag

SEQ ID NO: 3342236 - RNA, 19 nt, Human
caggcuggcgugcaguggu

SEQ ID NO: 3342237 - RNA, 18 nt, Human
caggcuggcgugcagugg

SEQ ID NO: 3342238 - RNA, 23 nt, Human
caggccugggggcugggcagagg

SEQ ID NO: 3342239 - RNA, 17 nt, Human
caggcuggcgugcagug

SEQ ID NO: 3342240 - RNA, 16 nt, Human
caggcugggagagccu

SEQ ID NO: 3342241 - RNA, 18 nt, Human
caggcugggagagccuuc

SEQ ID NO: 3342242 - RNA, 19 nt, Human
caggcugggagagccuucc

SEQ ID NO: 3342243 - RNA, 15 nt, Human
caggcuggcgugcag

SEQ ID NO: 3342244 - RNA, 15 nt, Human
cagggcucagcgggg

SEQ ID NO: 3342245 - RNA, 12 nt, Human
cagggcucagcg

SEQ ID NO: 3342246 - RNA, 16 nt, Human
cagggagggcuucugc

SEQ ID NO: 3342247 - RNA, 14 nt, Human
caggcugggcuuca

SEQ ID NO: 3342248 - RNA, 15 nt, Human
caggcugggagagcc

SEQ ID NO: 3342249 - RNA, 23 nt, Human
caggccagagggagugacagagg

SEQ ID NO: 3342250 - RNA, 13 nt, Human
caggccagcugcu

SEQ ID NO: 3342251 - RNA, 15 nt, Human
caggccagcugcuug

SEQ ID NO: 3342252 - RNA, 12 nt, Human
caggaggccagc

SEQ ID NO: 3342253 - RNA, 13 nt, Human
caggaggccagcc

SEQ ID NO: 3342254 - RNA, 20 nt, Human
caggcaaugcuggcuguugg

SEQ ID NO: 3342255 - RNA, 19 nt, Human
caggcaaugcuggcuguug

SEQ ID NO: 3342256 - RNA, 21 nt, Human
caggcaaugcuggcuguuggc

SEQ ID NO: 3342257 - RNA, 17 nt, Human
caggcaaugcuggcugu

SEQ ID NO: 3342258 - RNA, 13 nt, Human
caggccaggcccu

SEQ ID NO: 3342259 - RNA, 14 nt, Human
caggccaggcccuc

SEQ ID NO: 3342260 - RNA, 15 nt, Human
caggccaggcccucu

SEQ ID NO: 3342261 - RNA, 13 nt, Human
caggaccagggau

SEQ ID NO: 3342262 - RNA, 20 nt, Human
caggaaaggcuccaggagca

SEQ ID NO: 3342263 - RNA, 20 nt, Human
caggaaaagcugcugacagu

SEQ ID NO: 3342264 - RNA, 19 nt, Human
caggaaaagcugcugacag

SEQ ID NO: 3342265 - RNA, 21 nt, Human
caggaaaggcuccaggagcag

SEQ ID NO: 3342266 - RNA, 22 nt, Human
caggaaaggcuccaggagcagc

SEQ ID NO: 3342267 - RNA, 23 nt, Human
caggaaaggcuccaggagcagcc

SEQ ID NO: 3342268 - RNA, 15 nt, Human
cagcuguucagcugg

SEQ ID NO: 3342269 - RNA, 16 nt, Human
cagcuguucagcuggu

SEQ ID NO: 3342270 - RNA, 18 nt, Human
caggaaaagcugcugaca

SEQ ID NO: 3342271 - RNA, 18 nt, Human
caucugugaaaggaaaga

SEQ ID NO: 3342272 - RNA, 19 nt, Human
caucugugaaaggaaagag

SEQ ID NO: 3342273 - RNA, 21 nt, Human
caucuuagguuggcaaaaagg

SEQ ID NO: 3342274 - RNA, 22 nt, Human
caucuuagguuggcaaaaaggc

SEQ ID NO: 3342275 - RNA, 20 nt, Human
caucaggccaggcccucugc

SEQ ID NO: 3342276 - RNA, 21 nt, Human
caucaggccaggcccucugcc

SEQ ID NO: 3342277 - RNA, 22 nt, Human
caucaggccaggcccucugccc

SEQ ID NO: 3342278 - RNA, 23 nt, Human
caucaggccaggcccucugccca

SEQ ID NO: 3342279 - RNA, 12 nt, Human
caucccagcccc

SEQ ID NO: 3342280 - RNA, 16 nt, Human
caucccagccccaaug

SEQ ID NO: 3342281 - RNA, 14 nt, Human
caucccagccccaa

SEQ ID NO: 3342282 - RNA, 13 nt, Human
caucccagcccca

SEQ ID NO: 3342283 - RNA, 23 nt, Human
cauccuggcacccggccccugcu

SEQ ID NO: 3342284 - RNA, 17 nt, Human
caucagcacgauuucug

SEQ ID NO: 3342285 - RNA, 18 nt, Human
caucagcacgauuucugu

SEQ ID NO: 3342286 - RNA, 13 nt, Human
caucaggccaggc

SEQ ID NO: 3342287 - RNA, 16 nt, Human
caugcugcccugugag

SEQ ID NO: 3342288 - RNA, 18 nt, Human
caugcugcccugugagua

SEQ ID NO: 3342289 - RNA, 22 nt, Human
cauggccuuugcuugaaagaaa

SEQ ID NO: 3342290 - RNA, 19 nt, Human
cauggccuuugcuugaaag

SEQ ID NO: 3342291 - RNA, 15 nt, Human
caugcugcccuguga

SEQ ID NO: 3342292 - RNA, 17 nt, Human
caugcaaggucauuuuu

SEQ ID NO: 3342293 - RNA, 18 nt, Human
caugcaaggucauuuuuu

SEQ ID NO: 3342294 - RNA, 22 nt, Human
caugcaaggucauuuuuuuuaa

SEQ ID NO: 3342295 - RNA, 15 nt, Human
caugcaaggucauuu

SEQ ID NO: 3342296 - RNA, 17 nt, Human
caugacacgaauauugc

SEQ ID NO: 3342297 - RNA, 18 nt, Human
caugacacgaauauugcu

SEQ ID NO: 3342298 - RNA, 24 nt, Human
caugauuaaccacuucagcugacu

SEQ ID NO: 3342299 - RNA, 14 nt, Human
caugacacgaauau

SEQ ID NO: 3342300 - RNA, 18 nt, Human
cagucaccccggccaccu

SEQ ID NO: 3342301 - RNA, 14 nt, Human
cauaaugcgugcau

SEQ ID NO: 3342302 - RNA, 17 nt, Human
cauaaugcgugcauacc

SEQ ID NO: 3342303 - RNA, 20 nt, Human
cauauuaccacagacauacu

SEQ ID NO: 3342304 - RNA, 21 nt, Human
cauauuaccacagacauacua

SEQ ID NO: 3342305 - RNA, 17 nt, Human
cauauuaccacagacau

SEQ ID NO: 3342306 - RNA, 16 nt, Human
cauauuaccacagaca

SEQ ID NO: 3342307 - RNA, 15 nt, Human
cauacaauuccaaac

SEQ ID NO: 3342308 - RNA, 21 nt, Human
cauaaugcgugcauaccacuu

SEQ ID NO: 3342309 - RNA, 16 nt, Human
ccaccaucaagccacc

SEQ ID NO: 3342310 - RNA, 17 nt, Human
ccaccaucaagccacca

SEQ ID NO: 3342311 - RNA, 14 nt, Human
ccaccgcagacagg

SEQ ID NO: 3342312 - RNA, 17 nt, Human
ccaccgcagacaggacc

SEQ ID NO: 3342313 - RNA, 20 nt, Human
ccaccaucaagccaccaaca

SEQ ID NO: 3342314 - RNA, 15 nt, Human
ccaccaucaagccac

SEQ ID NO: 3342315 - RNA, 13 nt, Human
ccacccugcucuc

SEQ ID NO: 3342316 - RNA, 18 nt, Human
ccaccgcagacaggacca

SEQ ID NO: 3342317 - RNA, 13 nt, Human
ccaccgcagacag

SEQ ID NO: 3342318 - RNA, 15 nt, Human
ccaccuuggcucaag

SEQ ID NO: 3342319 - RNA, 14 nt, Human
ccaccuuggcucaa

SEQ ID NO: 3342320 - RNA, 13 nt, Human
ccaccuuggcuca

SEQ ID NO: 3342321 - RNA, 20 nt, Human
ccaauguucucucuucucca

SEQ ID NO: 3342322 - RNA, 20 nt, Human
ccaagcuggucccacucagu

SEQ ID NO: 3342323 - RNA, 20 nt, Human
ccaaugcacuuuguucuggc

SEQ ID NO: 3342324 - RNA, 22 nt, Human
ccaaugcacuuuguucuggcuc

SEQ ID NO: 3342325 - RNA, 23 nt, Human
ccaaugcacuuuguucuggcucu

SEQ ID NO: 3342326 - RNA, 14 nt, Human
ccaaugcacuuugu

SEQ ID NO: 3342327 - RNA, 14 nt, Human
ccaaagugcuggga

SEQ ID NO: 3342328 - RNA, 16 nt, Human
ccaacgucugugccau

SEQ ID NO: 3342329 - RNA, 16 nt, Human
ccaaaucauaguggcu

SEQ ID NO: 3342330 - RNA, 21 nt, Human
cauugcggacagccacggcca

SEQ ID NO: 3342331 - RNA, 17 nt, Human
cauugcggacagccacg

SEQ ID NO: 3342332 - RNA, 15 nt, Human
cauugcggacagcca

SEQ ID NO: 3342333 - RNA, 14 nt, Human
cauugcggacagcc

SEQ ID NO: 3342334 - RNA, 18 nt, Human
cauugcugggcuugucug

SEQ ID NO: 3342335 - RNA, 15 nt, Human
cauuuauucugcuca

SEQ ID NO: 3342336 - RNA, 16 nt, Human
cauuuauucugcucac

SEQ ID NO: 3342337 - RNA, 21 nt, Human
cauuuggugguuucagaaaug

SEQ ID NO: 3342338 - RNA, 22 nt, Human
cauuuggugguuucagaaaugu

SEQ ID NO: 3342339 - RNA, 23 nt, Human
cauuuggugguuucagaaaugug

SEQ ID NO: 3342340 - RNA, 23 nt, Human
cauuuuucuuagggaaggauaca

SEQ ID NO: 3342341 - RNA, 17 nt, Human
ccaaaaaaugcuugcuu

SEQ ID NO: 3342342 - RNA, 17 nt, Human
ccaaaacucuccucugc

SEQ ID NO: 3342343 - RNA, 16 nt, Human
cauucuccuuguguua

SEQ ID NO: 3342344 - RNA, 21 nt, Human
cauucuccaccugccagggac

SEQ ID NO: 3342345 - RNA, 17 nt, Human
cauggcugccaauggga

SEQ ID NO: 3342346 - RNA, 22 nt, Human
cauggcugccaaugggagcuca

SEQ ID NO: 3342347 - RNA, 22 nt, Human
cauggccucuucagaucucuaa

SEQ ID NO: 3342348 - RNA, 15 nt, Human
cauguucucugagga

SEQ ID NO: 3342349 - RNA, 16 nt, Human
cauuaucuagauacug

SEQ ID NO: 3342350 - RNA, 17 nt, Human
cauuaucuagauacugu

SEQ ID NO: 3342351 - RNA, 12 nt, Human
cauuaucuagau

SEQ ID NO: 3342352 - RNA, 18 nt, Human
ccaggcuggcgugcagug

SEQ ID NO: 3342353 - RNA, 17 nt, Human
ccaggcuggcgugcagu

SEQ ID NO: 3342354 - RNA, 21 nt, Human
ccaggcuccuuuagcgcccag

SEQ ID NO: 3342355 - RNA, 20 nt, Human
ccaggcuccuuuagcgccca

SEQ ID NO: 3342356 - RNA, 16 nt, Human
ccaggcuggcgugcag

SEQ ID NO: 3342357 - RNA, 23 nt, Human
ccaggggugggacacccugugau

SEQ ID NO: 3342358 - RNA, 14 nt, Human
ccaggggugggaca

SEQ ID NO: 3342359 - RNA, 17 nt, Human
ccaggggugggacaccc

SEQ ID NO: 3342360 - RNA, 20 nt, Human
ccaggggaaaaucagccugc

SEQ ID NO: 3342361 - RNA, 13 nt, Human
ccaggggugggac

SEQ ID NO: 3342362 - RNA, 19 nt, Human
ccaggggaaaaucagccug

SEQ ID NO: 3342363 - RNA, 20 nt, Human
ccauggucggaaaacaugcu

SEQ ID NO: 3342364 - RNA, 23 nt, Human
ccaugagccucagcauccuggca

SEQ ID NO: 3342365 - RNA, 21 nt, Human
ccaugagccucagcauccugg

SEQ ID NO: 3342366 - RNA, 14 nt, Human
ccaucccagcccca

SEQ ID NO: 3342367 - RNA, 13 nt, Human
ccaucccagcccc

SEQ ID NO: 3342368 - RNA, 15 nt, Human
ccaucccagccccaa

SEQ ID NO: 3342369 - RNA, 23 nt, Human
ccaguuggucccccuuccaugga

SEQ ID NO: 3342370 - RNA, 20 nt, Human
ccaguuggucccccuuccau

SEQ ID NO: 3342371 - RNA, 14 nt, Human
ccaucccugaaggc

SEQ ID NO: 3342372 - RNA, 15 nt, Human
ccaucccugaaggcc

SEQ ID NO: 3342373 - RNA, 17 nt, Human
ccaucccugaaggcccc

SEQ ID NO: 3342374 - RNA, 20 nt, Human
ccaguuggguggaugccugg

SEQ ID NO: 3342375 - RNA, 19 nt, Human
ccaguuggguggaugccug

SEQ ID NO: 3342376 - RNA, 17 nt, Human
ccaguuggguggaugcc

SEQ ID NO: 3342377 - RNA, 13 nt, Human
ccagcaggcucuc

SEQ ID NO: 3342378 - RNA, 20 nt, Human
ccagcagccuggacccugug

SEQ ID NO: 3342379 - RNA, 11 nt, Human
ccagccccugg

SEQ ID NO: 3342380 - RNA, 16 nt, Human
ccagcucaccagcccc

SEQ ID NO: 3342381 - RNA, 15 nt, Human
ccagcucaccagccc

SEQ ID NO: 3342382 - RNA, 16 nt, Human
ccagcuguucagcugg

SEQ ID NO: 3342383 - RNA, 22 nt, Human
ccagcucaccagccccagugcc

SEQ ID NO: 3342384 - RNA, 17 nt, Human
ccagcuguucagcuggu

SEQ ID NO: 3342385 - RNA, 19 nt, Human
ccagcuuaaaggggcuaga

SEQ ID NO: 3342386 - RNA, 13 nt, Human
ccaggaagccagc

SEQ ID NO: 3342387 - RNA, 12 nt, Human
ccaggaagccag

SEQ ID NO: 3342388 - RNA, 14 nt, Human
ccaggaaaggcucc

SEQ ID NO: 3342389 - RNA, 15 nt, Human
ccaggaaaggcucca

SEQ ID NO: 3342390 - RNA, 16 nt, Human
ccaggaaaggcuccag

SEQ ID NO: 3342391 - RNA, 19 nt, Human
ccaggaaaggauuuuauaa

SEQ ID NO: 3342392 - RNA, 15 nt, Human
ccagaugcaccagcc

SEQ ID NO: 3342393 - RNA, 17 nt, Human
ccagaugcaccagcccu

SEQ ID NO: 3342394 - RNA, 18 nt, Human
ccagaugcaccagcccuu

SEQ ID NO: 3342395 - RNA, 18 nt, Human
ccagagggccugcaaggg

SEQ ID NO: 3342396 - RNA, 19 nt, Human
ccagagggccugcaaggga

SEQ ID NO: 3342397 - RNA, 17 nt, Human
ccagagggccugcaagg

SEQ ID NO: 3342398 - RNA, 23 nt, Human
cccagcucugguccauagagagc

SEQ ID NO: 3342399 - RNA, 22 nt, Human
cccagcuuaaaggggcuagagu

SEQ ID NO: 3342400 - RNA, 17 nt, Human
cccaggcuggcgugcag

SEQ ID NO: 3342401 - RNA, 13 nt, Human
cccaggcuggcgu

SEQ ID NO: 3342402 - RNA, 13 nt, Human
cccacugcucugg

SEQ ID NO: 3342403 - RNA, 12 nt, Human
cccacugcucug

SEQ ID NO: 3342404 - RNA, 19 nt, Human
cccacugcuuuuggucugu

SEQ ID NO: 3342405 - RNA, 20 nt, Human
cccacccaagggccuggccu

SEQ ID NO: 3342406 - RNA, 21 nt, Human
cccacccaagggccuggccug

SEQ ID NO: 3342407 - RNA, 22 nt, Human
cccacccaagggccuggccuga

SEQ ID NO: 3342408 - RNA, 18 nt, Human
cccacccugaaagcccug

SEQ ID NO: 3342409 - RNA, 18 nt, Human
cccacccaagggccuggc

SEQ ID NO: 3342410 - RNA, 12 nt, Human
cccacccccacc

SEQ ID NO: 3342411 - RNA, 15 nt, Human
cccacccccacccaa

SEQ ID NO: 3342412 - RNA, 17 nt, Human
cccacccccacccaagg

SEQ ID NO: 3342413 - RNA, 22 nt, Human
ccccagcaagugagagcugggu

SEQ ID NO: 3342414 - RNA, 22 nt, Human
ccccauccucuguacagagccc

SEQ ID NO: 3342415 - RNA, 21 nt, Human
ccccagcaagugagagcuggg

SEQ ID NO: 3342416 - RNA, 22 nt, Human
cccccaaauggaaaugggcaga

SEQ ID NO: 3342417 - RNA, 23 nt, Human
ccccgacccuugccgucuaccug

SEQ ID NO: 3342418 - RNA, 21 nt, Human
ccccaaaacucuccucugcug

SEQ ID NO: 3342419 - RNA, 23 nt, Human
ccccaaaacucuccucugcugcu

SEQ ID NO: 3342420 - RNA, 22 nt, Human
ccccaaaacucuccucugcugc

SEQ ID NO: 3342421 - RNA, 14 nt, Human
cccgaauagcuggg

SEQ ID NO: 3342422 - RNA, 16 nt, Human
cccggcaggguccuag

SEQ ID NO: 3342423 - RNA, 16 nt, Human
cccggcuccaggcucc

SEQ ID NO: 3342424 - RNA, 15 nt, Human
cccggcuccaggcuc

SEQ ID NO: 3342425 - RNA, 14 nt, Human
cccggcuccaggcu

SEQ ID NO: 3342426 - RNA, 13 nt, Human
cccggcuccaggc

SEQ ID NO: 3342427 - RNA, 13 nt, Human
cccggccaccugc

SEQ ID NO: 3342428 - RNA, 14 nt, Human
cccggccaccugcg

SEQ ID NO: 3342429 - RNA, 12 nt, Human
cccggcuccagg

SEQ ID NO: 3342430 - RNA, 11 nt, Human
cccggcuccag

SEQ ID NO: 3342431 - RNA, 22 nt, Human
cccgggaagggggcugggacau

SEQ ID NO: 3342432 - RNA, 18 nt, Human
cccuauuagagaagagau

SEQ ID NO: 3342433 - RNA, 14 nt, Human
cccuggcagccccu

SEQ ID NO: 3342434 - RNA, 16 nt, Human
cccuggcagccccugu

SEQ ID NO: 3342435 - RNA, 12 nt, Human
cccuggcagccc

SEQ ID NO: 3342436 - RNA, 13 nt, Human
cccuggcagcccc

SEQ ID NO: 3342437 - RNA, 16 nt, Human
cccugcccugugggcc

SEQ ID NO: 3342438 - RNA, 20 nt, Human
cccugcccugugggccccca

SEQ ID NO: 3342439 - RNA, 15 nt, Human
cccugcccugugggc

SEQ ID NO: 3342440 - RNA, 14 nt, Human
cccugcccuguggg

SEQ ID NO: 3342441 - RNA, 11 nt, Human
cccugcccugu

SEQ ID NO: 3342442 - RNA, 12 nt, Human
cccugcccugug

SEQ ID NO: 3342443 - RNA, 13 nt, Human
cccugcccugugg

SEQ ID NO: 3342444 - RNA, 16 nt, Human
ccgacccuugccgucu

SEQ ID NO: 3342445 - RNA, 17 nt, Human
ccgccaaggcuggggga

SEQ ID NO: 3342446 - RNA, 18 nt, Human
ccgaccagacaccuugac

SEQ ID NO: 3342447 - RNA, 17 nt, Human
ccgaauagcugggacua

SEQ ID NO: 3342448 - RNA, 20 nt, Human
ccgaauagcugggacuacag

SEQ ID NO: 3342449 - RNA, 20 nt, Human
ccgcccaggcuuagucacug

SEQ ID NO: 3342450 - RNA, 12 nt, Human
ccgcccaggcuu

SEQ ID NO: 3342451 - RNA, 16 nt, Human
ccgccaugcuccuggc

SEQ ID NO: 3342452 - RNA, 21 nt, Human
cccuucugacccaugcugccc

SEQ ID NO: 3342453 - RNA, 22 nt, Human
cccuucugacccaugcugcccu

SEQ ID NO: 3342454 - RNA, 23 nt, Human
cccuucugacccaugcugcccug

SEQ ID NO: 3342455 - RNA, 16 nt, Human
cccuucuaccuuccug

SEQ ID NO: 3342456 - RNA, 18 nt, Human
cccuucgcuccugugucu

SEQ ID NO: 3342457 - RNA, 16 nt, Human
cccuucgcuccugugu

SEQ ID NO: 3342458 - RNA, 16 nt, Human
ccucaaccuccugggc

SEQ ID NO: 3342459 - RNA, 15 nt, Human
ccucaacucuccucc

SEQ ID NO: 3342460 - RNA, 15 nt, Human
ccucaagagaaggca

SEQ ID NO: 3342461 - RNA, 22 nt, Human
ccucagccucccaaagugcugg

SEQ ID NO: 3342462 - RNA, 11 nt, Human
ccucagccucc

SEQ ID NO: 3342463 - RNA, 22 nt, Human
ccucccaaggggcccaaauucu

SEQ ID NO: 3342464 - RNA, 23 nt, Human
ccucccaacucaccccagcccca

SEQ ID NO: 3342465 - RNA, 19 nt, Human
ccucauguucuuaauucuu

SEQ ID NO: 3342466 - RNA, 20 nt, Human
ccuccaagaccuucuccuuc

SEQ ID NO: 3342467 - RNA, 13 nt, Human
ccucauguucuua

SEQ ID NO: 3342468 - RNA, 22 nt, Human
ccucagccucccgaauagcugg

SEQ ID NO: 3342469 - RNA, 23 nt, Human
ccucagccucccaaagugcuggg

SEQ ID NO: 3342470 - RNA, 17 nt, Human
ccuaaguauuaaaacau

SEQ ID NO: 3342471 - RNA, 16 nt, Human
ccuaaguauuaaaaca

SEQ ID NO: 3342472 - RNA, 13 nt, Human
ccuaaguauuaaa

SEQ ID NO: 3342473 - RNA, 21 nt, Human
ccuaaguauuaaaacauugga

SEQ ID NO: 3342474 - RNA, 18 nt, Human
ccuaaguauuaaaacauu

SEQ ID NO: 3342475 - RNA, 16 nt, Human
ccuggaguucugguuc

SEQ ID NO: 3342476 - RNA, 17 nt, Human
ccuggaguucugguucc

SEQ ID NO: 3342477 - RNA, 15 nt, Human
ccuggaguucugguu

SEQ ID NO: 3342478 - RNA, 13 nt, Human
ccuggaugcagcc

SEQ ID NO: 3342479 - RNA, 14 nt, Human
ccuggaugcagccu

SEQ ID NO: 3342480 - RNA, 17 nt, Human
ccuggaugcagccucac

SEQ ID NO: 3342481 - RNA, 19 nt, Human
ccuggaugcagccucacag

SEQ ID NO: 3342482 - RNA, 14 nt, Human
ccugcugggugugg

SEQ ID NO: 3342483 - RNA, 20 nt, Human
ccugcuggguguggcgcagc

SEQ ID NO: 3342484 - RNA, 12 nt, Human
ccugcugggugu

SEQ ID NO: 3342485 - RNA, 13 nt, Human
ccugcccaggccc

SEQ ID NO: 3342486 - RNA, 16 nt, Human
ccugcccaggccccug

SEQ ID NO: 3342487 - RNA, 22 nt, Human
ccugcccaggccccugccaccc

SEQ ID NO: 3342488 - RNA, 15 nt, Human
ccugcccaggccccu

SEQ ID NO: 3342489 - RNA, 14 nt, Human
ccugcccaggcccc

SEQ ID NO: 3342490 - RNA, 14 nt, Human
ccuggccucugcac

SEQ ID NO: 3342491 - RNA, 15 nt, Human
ccuggccucugcacu

SEQ ID NO: 3342492 - RNA, 13 nt, Human
ccuggccugagcu

SEQ ID NO: 3342493 - RNA, 12 nt, Human
ccuggccucugc

SEQ ID NO: 3342494 - RNA, 14 nt, Human
ccucucucaggcca

SEQ ID NO: 3342495 - RNA, 12 nt, Human
ccucucucacuc

SEQ ID NO: 3342496 - RNA, 13 nt, Human
ccucucucacucc

SEQ ID NO: 3342497 - RNA, 14 nt, Human
ccucucucacuccu

SEQ ID NO: 3342498 - RNA, 15 nt, Human
ccucucucacuccuu

SEQ ID NO: 3342499 - RNA, 17 nt, Human
ccucucucacuccuuga

SEQ ID NO: 3342500 - RNA, 12 nt, Human
ccucucucaggc

SEQ ID NO: 3342501 - RNA, 21 nt, Human
ccucugccugaagucacacag

SEQ ID NO: 3342502 - RNA, 22 nt, Human
ccucugccugaagucacacagu

SEQ ID NO: 3342503 - RNA, 15 nt, Human
ccucugcugcuggcu

SEQ ID NO: 3342504 - RNA, 16 nt, Human
ccucugcugcuggcug

SEQ ID NO: 3342505 - RNA, 17 nt, Human
ccucugcugcuggcugg

SEQ ID NO: 3342506 - RNA, 18 nt, Human
ccucugcugcuggcuggu

SEQ ID NO: 3342507 - RNA, 13 nt, Human
ccucugcugcugg

SEQ ID NO: 3342508 - RNA, 14 nt, Human
ccucugcugcuggc

SEQ ID NO: 3342509 - RNA, 22 nt, Human
ccugcacuugcagacucuacag

SEQ ID NO: 3342510 - RNA, 19 nt, Human
ccugcacuugcagacucua

SEQ ID NO: 3342511 - RNA, 13 nt, Human
ccucuugagccuu

SEQ ID NO: 3342512 - RNA, 19 nt, Human
ccucuugagccuugaacuu

SEQ ID NO: 3342513 - RNA, 13 nt, Human
ccucuuggguuca

SEQ ID NO: 3342514 - RNA, 16 nt, Human
cuaacuuuccuucauu

SEQ ID NO: 3342515 - RNA, 16 nt, Human
cuaacuucaccauauu

SEQ ID NO: 3342516 - RNA, 15 nt, Human
cuaacuucaccauau

SEQ ID NO: 3342517 - RNA, 22 nt, Human
cuaagugauccucccaccucag

SEQ ID NO: 3342518 - RNA, 20 nt, Human
cuaagugauccucccaccuc

SEQ ID NO: 3342519 - RNA, 18 nt, Human
cuaagugaggaugaaaaa

SEQ ID NO: 3342520 - RNA, 13 nt, Human
cuacaguccuccc

SEQ ID NO: 3342521 - RNA, 15 nt, Human
cuacaguccucccau

SEQ ID NO: 3342522 - RNA, 16 nt, Human
cuacaguccucccauc

SEQ ID NO: 3342523 - RNA, 17 nt, Human
cuacaguccucccaucu

SEQ ID NO: 3342524 - RNA, 13 nt, Human
cuacaguugaaaa

SEQ ID NO: 3342525 - RNA, 19 nt, Human
cuagggaaaaaccagcgug

SEQ ID NO: 3342526 - RNA, 18 nt, Human
cuaguuccaccaucaagc

SEQ ID NO: 3342527 - RNA, 20 nt, Human
cuaguuccaccaucaagcca

SEQ ID NO: 3342528 - RNA, 14 nt, Human
cuaguuccaccauc

SEQ ID NO: 3342529 - RNA, 22 nt, Human
cuaguuccaccaucaagccacc

SEQ ID NO: 3342530 - RNA, 11 nt, Human
cuaccugaggg

SEQ ID NO: 3342531 - RNA, 14 nt, Human
cuaccugaggggcc

SEQ ID NO: 3342532 - RNA, 19 nt, Human
cuagaaauuccccacccug

SEQ ID NO: 3342533 - RNA, 17 nt, Human
cuagcauggcugccaau

SEQ ID NO: 3342534 - RNA, 23 nt, Human
cuagcagcagggagggcuucugc

SEQ ID NO: 3342535 - RNA, 22 nt, Human
cuagcagcagggagggcuucug

SEQ ID NO: 3342536 - RNA, 12 nt, Human
cuagcagcaggg

SEQ ID NO: 3342537 - RNA, 17 nt, Human
cgaguuacagacaaagc

SEQ ID NO: 3342538 - RNA, 18 nt, Human
cgaguuacagacaaagcg

SEQ ID NO: 3342539 - RNA, 15 nt, Human
cgaguagcugggacu

SEQ ID NO: 3342540 - RNA, 14 nt, Human
cgaguagcugggac

SEQ ID NO: 3342541 - RNA, 13 nt, Human
cgaguagcuggga

SEQ ID NO: 3342542 - RNA, 13 nt, Human
cgccaaggcuggg

SEQ ID NO: 3342543 - RNA, 16 nt, Human
cgccaaggcuggggga

SEQ ID NO: 3342544 - RNA, 12 nt, Human
cgccaaggcugg

SEQ ID NO: 3342545 - RNA, 15 nt, Human
cggccuuuggcuuca

SEQ ID NO: 3342546 - RNA, 18 nt, Human
cggcucacugcagccuca

SEQ ID NO: 3342547 - RNA, 19 nt, Human
cggcucacugcagccucaa

SEQ ID NO: 3342548 - RNA, 17 nt, Human
cggcucacugcagccuc

SEQ ID NO: 3342549 - RNA, 21 nt, Human
ccuucugacccaugcugcccu

SEQ ID NO: 3342550 - RNA, 22 nt, Human
ccuucugacccaugcugcccug

SEQ ID NO: 3342551 - RNA, 23 nt, Human
ccuucugacccaugcugcccugu

SEQ ID NO: 3342552 - RNA, 22 nt, Human
ccuucuggaauaaggagaauga

SEQ ID NO: 3342553 - RNA, 12 nt, Human
ccuucugaccca

SEQ ID NO: 3342554 - RNA, 16 nt, Human
ccuucugacccaugcu

SEQ ID NO: 3342555 - RNA, 17 nt, Human
ccuucugacccaugcug

SEQ ID NO: 3342556 - RNA, 20 nt, Human
ccuucugacccaugcugccc

SEQ ID NO: 3342557 - RNA, 14 nt, Human
ccuggccugagcug

SEQ ID NO: 3342558 - RNA, 15 nt, Human
ccuggccugagcugg

SEQ ID NO: 3342559 - RNA, 17 nt, Human
ccuugccgucuaccuga

SEQ ID NO: 3342560 - RNA, 20 nt, Human
ccuugccgucuaccugaggg

SEQ ID NO: 3342561 - RNA, 20 nt, Human
ccuuuucgcaggauucuucc

SEQ ID NO: 3342562 - RNA, 20 nt, Human
ccuuuagcgcccaguugggu

SEQ ID NO: 3342563 - RNA, 14 nt, Human
ccuuuagcgcccag

SEQ ID NO: 3342564 - RNA, 12 nt, Human
ccuuuuuuauac

SEQ ID NO: 3342565 - RNA, 21 nt, Human
ccuuuuuuagaguugauacua

SEQ ID NO: 3342566 - RNA, 23 nt, Human
cgaccagacaccuugacagggca

SEQ ID NO: 3342567 - RNA, 17 nt, Human
ccuuuuuuauacauaaa

SEQ ID NO: 3342568 - RNA, 18 nt, Human
ccuuuuuuauacauaaac

SEQ ID NO: 3342569 - RNA, 24 nt, Human
cucuccccagcaagugagagcugg

SEQ ID NO: 3342570 - RNA, 21 nt, Human
cucuccgaccagacaccuuga

SEQ ID NO: 3342571 - RNA, 15 nt, Human
cucugaaggacauug

SEQ ID NO: 3342572 - RNA, 12 nt, Human
cucucacuccuu

SEQ ID NO: 3342573 - RNA, 14 nt, Human
cucucacuccuuga

SEQ ID NO: 3342574 - RNA, 19 nt, Human
cucucagauuguaccauug

SEQ ID NO: 3342575 - RNA, 15 nt, Human
cucucacuccuugaa

SEQ ID NO: 3342576 - RNA, 13 nt, Human
cucugcagcaaua

SEQ ID NO: 3342577 - RNA, 18 nt, Human
cucugcagcaauaaagca

SEQ ID NO: 3342578 - RNA, 19 nt, Human
cucugcagcaauaaagcag

SEQ ID NO: 3342579 - RNA, 23 nt, Human
cucugcagcaauaaagcagcguu

SEQ ID NO: 3342580 - RNA, 16 nt, Human
cucugcugacagacac

SEQ ID NO: 3342581 - RNA, 15 nt, Human
cucugguccauagag

SEQ ID NO: 3342582 - RNA, 19 nt, Human
cucugcugacagacacagg

SEQ ID NO: 3342583 - RNA, 18 nt, Human
cucugcugacagacacag

SEQ ID NO: 3342584 - RNA, 17 nt, Human
cucugcugacagacaca

SEQ ID NO: 3342585 - RNA, 16 nt, Human
cucugguccauagaga

SEQ ID NO: 3342586 - RNA, 18 nt, Human
cucugguccauagagagc

SEQ ID NO: 3342587 - RNA, 19 nt, Human
cucugguccauagagagca

SEQ ID NO: 3342588 - RNA, 15 nt, Human
cucugguuaucuaau

SEQ ID NO: 3342589 - RNA, 17 nt, Human
cucuguacagagcccac

SEQ ID NO: 3342590 - RNA, 21 nt, Human
cucuguacagagcccacgccc

SEQ ID NO: 3342591 - RNA, 15 nt, Human
cucuuagaaaaacca

SEQ ID NO: 3342592 - RNA, 13 nt, Human
cugaaggccccgc

SEQ ID NO: 3342593 - RNA, 14 nt, Human
cugaaggccccgcc

SEQ ID NO: 3342594 - RNA, 17 nt, Human
cugaaggcuggguucug

SEQ ID NO: 3342595 - RNA, 17 nt, Human
cugaaggccccgcccag

SEQ ID NO: 3342596 - RNA, 20 nt, Human
cugaaggacauugcggacag

SEQ ID NO: 3342597 - RNA, 19 nt, Human
cugaaggacauugcggaca

SEQ ID NO: 3342598 - RNA, 16 nt, Human
cugaaaauguaugugu

SEQ ID NO: 3342599 - RNA, 14 nt, Human
cugaaaauguaugu

SEQ ID NO: 3342600 - RNA, 14 nt, Human
cugacagacacagg

SEQ ID NO: 3342601 - RNA, 12 nt, Human
cugacagacaca

SEQ ID NO: 3342602 - RNA, 18 nt, Human
cugacccaugcugcccug

SEQ ID NO: 3342603 - RNA, 17 nt, Human
cugacccaugcugcccu

SEQ ID NO: 3342604 - RNA, 19 nt, Human
cugacccaugcugcccugu

SEQ ID NO: 3342605 - RNA, 23 nt, Human
cugacccugcuucaaauauuucc

SEQ ID NO: 3342606 - RNA, 13 nt, Human
cucaggccugggg

SEQ ID NO: 3342607 - RNA, 14 nt, Human
cucaggccuggggg

SEQ ID NO: 3342608 - RNA, 20 nt, Human
cucaggccugggggcugggc

SEQ ID NO: 3342609 - RNA, 21 nt, Human
cucaggccugggggcugggca

SEQ ID NO: 3342610 - RNA, 14 nt, Human
cucaggccagcugc

SEQ ID NO: 3342611 - RNA, 20 nt, Human
cucaggccagcugcuugggc

SEQ ID NO: 3342612 - RNA, 21 nt, Human
cucaggccagcugcuugggcu

SEQ ID NO: 3342613 - RNA, 22 nt, Human
cucaggccagcugcuugggcuu

SEQ ID NO: 3342614 - RNA, 13 nt, Human
cucaggccagcug

SEQ ID NO: 3342615 - RNA, 13 nt, Human
cucagccucccaa

SEQ ID NO: 3342616 - RNA, 16 nt, Human
cucagccucccaaagu

SEQ ID NO: 3342617 - RNA, 14 nt, Human
cucagccucccaaa

SEQ ID NO: 3342618 - RNA, 21 nt, Human
cucagccucccaaagugcugg

SEQ ID NO: 3342619 - RNA, 22 nt, Human
cucagccucccaaagugcuggg

SEQ ID NO: 3342620 - RNA, 23 nt, Human
cucagccucccgaauagcuggga

SEQ ID NO: 3342621 - RNA, 12 nt, Human
cucauguucuua

SEQ ID NO: 3342622 - RNA, 14 nt, Human
cucauguucuuaau

SEQ ID NO: 3342623 - RNA, 18 nt, Human
cucauguucuuaauucuu

SEQ ID NO: 3342624 - RNA, 19 nt, Human
cucauguucuuaauucuua

SEQ ID NO: 3342625 - RNA, 18 nt, Human
cucagucuggcccuuccu

SEQ ID NO: 3342626 - RNA, 17 nt, Human
cucagucuggcccuucc

SEQ ID NO: 3342627 - RNA, 13 nt, Human
cucagugccacua

SEQ ID NO: 3342628 - RNA, 16 nt, Human
cuccagacacaugucc

SEQ ID NO: 3342629 - RNA, 17 nt, Human
cuccagacacaugucca

SEQ ID NO: 3342630 - RNA, 19 nt, Human
cuccagacacauguccaag

SEQ ID NO: 3342631 - RNA, 15 nt, Human
cuccagaauuuccca

SEQ ID NO: 3342632 - RNA, 18 nt, Human
cuccagaauuucccaaag

SEQ ID NO: 3342633 - RNA, 17 nt, Human
cuccaagaccuucuccu

SEQ ID NO: 3342634 - RNA, 18 nt, Human
cuccaagaccuucuccuu

SEQ ID NO: 3342635 - RNA, 16 nt, Human
cuccaagaccuucucc

SEQ ID NO: 3342636 - RNA, 15 nt, Human
cuccaagaccuucuc

SEQ ID NO: 3342637 - RNA, 22 nt, Human
cuccacuuucuagccagaggag

SEQ ID NO: 3342638 - RNA, 20 nt, Human
cuccacuuucuagccagagg

SEQ ID NO: 3342639 - RNA, 11 nt, Human
cuccaggugca

SEQ ID NO: 3342640 - RNA, 12 nt, Human
cucccaccucag

SEQ ID NO: 3342641 - RNA, 19 nt, Human
cuccgcuuucuacccagcg

SEQ ID NO: 3342642 - RNA, 23 nt, Human
auuucuuuugccguuauuaaaaa

SEQ ID NO: 3342643 - RNA, 16 nt, Human
auuuauuauggcacau

SEQ ID NO: 3342644 - RNA, 14 nt, Human
auuuccugugucuu

SEQ ID NO: 3342645 - RNA, 12 nt, Human
auuucuaaaucu

SEQ ID NO: 3342646 - RNA, 13 nt, Human
auuucuaaaucuc

SEQ ID NO: 3342647 - RNA, 21 nt, Human
auuucuaaaucuccaaaauaa

SEQ ID NO: 3342648 - RNA, 13 nt, Human
auuuauuauggca

SEQ ID NO: 3342649 - RNA, 20 nt, Human
auuuauuaaaugcccagccc

SEQ ID NO: 3342650 - RNA, 16 nt, Human
auuugagcagggcuca

SEQ ID NO: 3342651 - RNA, 20 nt, Human
auuucuuuugccguuauuaa

SEQ ID NO: 3342652 - RNA, 22 nt, Human
auuugaggucuguucuuuccaa

SEQ ID NO: 3342653 - RNA, 23 nt, Human
auuugaggucuguucuuuccaaa

SEQ ID NO: 3342654 - RNA, 17 nt, Human
auuugagcagggcucag

SEQ ID NO: 3342655 - RNA, 18 nt, Human
auuuggugguuucagaaa

SEQ ID NO: 3342656 - RNA, 20 nt, Human
auuuggugguuucagaaaug

SEQ ID NO: 3342657 - RNA, 17 nt, Human
auuuggugguuucagaa

SEQ ID NO: 3342658 - RNA, 13 nt, Human
auuuuauuaugca

SEQ ID NO: 3342659 - RNA, 14 nt, Human
auuuuauuaugcau

SEQ ID NO: 3342660 - RNA, 15 nt, Human
auuuuauuaugcaug

SEQ ID NO: 3342661 - RNA, 17 nt, Human
auuuuauuaugcaugaa

SEQ ID NO: 3342662 - RNA, 19 nt, Human
auugcggacagccacggcc

SEQ ID NO: 3342663 - RNA, 18 nt, Human
auugcggacagccacggc

SEQ ID NO: 3342664 - RNA, 16 nt, Human
auugcggacagccacg

SEQ ID NO: 3342665 - RNA, 21 nt, Human
auugcccacgcuggagugcag

SEQ ID NO: 3342666 - RNA, 17 nt, Human
auugcccacgcuggagu

SEQ ID NO: 3342667 - RNA, 23 nt, Human
auugccauuucuuccacaagagc

SEQ ID NO: 3342668 - RNA, 21 nt, Human
auugcaacaggcugggcuuca

SEQ ID NO: 3342669 - RNA, 19 nt, Human
auugcaacaggcugggcuu

SEQ ID NO: 3342670 - RNA, 15 nt, Human
auugcaacaggcugg

SEQ ID NO: 3342671 - RNA, 13 nt, Human
auugaccugaggc

SEQ ID NO: 3342672 - RNA, 16 nt, Human
auucuacuuugagugc

SEQ ID NO: 3342673 - RNA, 13 nt, Human
auucuacuuugag

SEQ ID NO: 3342674 - RNA, 14 nt, Human
auucucagaaucuc

SEQ ID NO: 3342675 - RNA, 20 nt, Human
auucucagaaucucaaauaa

SEQ ID NO: 3342676 - RNA, 18 nt, Human
auucucagaaucucaaau

SEQ ID NO: 3342677 - RNA, 13 nt, Human
auucuccaccugc

SEQ ID NO: 3342678 - RNA, 16 nt, Human
auucuccaccugccag

SEQ ID NO: 3342679 - RNA, 17 nt, Human
auucuccaccugccagg

SEQ ID NO: 3342680 - RNA, 23 nt, Human
auuuaauuuuuuugagacagagu

SEQ ID NO: 3342681 - RNA, 19 nt, Human
auuuaauuuuuuugagaca

SEQ ID NO: 3342682 - RNA, 17 nt, Human
auuuaacagaaauguac

SEQ ID NO: 3342683 - RNA, 19 nt, Human
auuuaacagaaauguacag

SEQ ID NO: 3342684 - RNA, 20 nt, Human
auuuaacagaaauguacagc

SEQ ID NO: 3342685 - RNA, 15 nt, Human
auuuaacagaaaugu

SEQ ID NO: 3342686 - RNA, 16 nt, Human
auuuaacagaaaugua

SEQ ID NO: 3342687 - RNA, 23 nt, Human
auuggcuuuggguugcaggaccu

SEQ ID NO: 3342688 - RNA, 17 nt, Human
auuaaacuuaaucuaaa

SEQ ID NO: 3342689 - RNA, 16 nt, Human
auuaaacuuaaucuaa

SEQ ID NO: 3342690 - RNA, 19 nt, Human
auuaaacuuaaucuaaaug

SEQ ID NO: 3342691 - RNA, 17 nt, Human
auuaaccacuucagcug

SEQ ID NO: 3342692 - RNA, 18 nt, Human
auuaaccacuucagcuga

SEQ ID NO: 3342693 - RNA, 20 nt, Human
auuaaccacuucagcugacu

SEQ ID NO: 3342694 - RNA, 16 nt, Human
auuaacuuuuauaaac

SEQ ID NO: 3342695 - RNA, 17 nt, Human
auuaacuuuuauaaacu

SEQ ID NO: 3342696 - RNA, 19 nt, Human
auuaacuuuuauaaacuuu

SEQ ID NO: 3342697 - RNA, 20 nt, Human
auuaacuuuuauaaacuuua

SEQ ID NO: 3342698 - RNA, 12 nt, Human
auuaacuuuuau

SEQ ID NO: 3342699 - RNA, 23 nt, Human
auuaacuuuuauaaacuuuaccu

SEQ ID NO: 3342700 - RNA, 14 nt, Human
auuaagaaagacua

SEQ ID NO: 3342701 - RNA, 13 nt, Human
auuaagaaagacu

SEQ ID NO: 3342702 - RNA, 17 nt, Human
auguuuuucuucucccu

SEQ ID NO: 3342703 - RNA, 18 nt, Human
auguuuuucuucucccuc

SEQ ID NO: 3342704 - RNA, 14 nt, Human
auguuuuccaugag

SEQ ID NO: 3342705 - RNA, 19 nt, Human
uuuuccagguuuaagcugu

SEQ ID NO: 3342706 - RNA, 14 nt, Human
uuuuauaaacuuua

SEQ ID NO: 3342707 - RNA, 17 nt, Human
uuuuauaaacuuuaccu

SEQ ID NO: 3342708 - RNA, 19 nt, Human
uuuuauaaacuuuaccuuu

SEQ ID NO: 3342709 - RNA, 21 nt, Human
uuuuauggcuuuugugcauua

SEQ ID NO: 3342710 - RNA, 12 nt, Human
uuuuauaaacuu

SEQ ID NO: 3342711 - RNA, 13 nt, Human
uuuuauaaacuuu

SEQ ID NO: 3342712 - RNA, 23 nt, Human
uuuuagaguugauacuacaguuu

SEQ ID NO: 3342713 - RNA, 14 nt, Human
auguuggccaggcu

SEQ ID NO: 3342714 - RNA, 13 nt, Human
auguuggccaggc

SEQ ID NO: 3342715 - RNA, 16 nt, Human
uuuuaagugcugcauu

SEQ ID NO: 3342716 - RNA, 17 nt, Human
uuuuaagugcugcauuu

SEQ ID NO: 3342717 - RNA, 21 nt, Human
uuuuaagugcugcauuuaaaa

SEQ ID NO: 3342718 - RNA, 21 nt, Human
auguucaucauccuaagcuau

SEQ ID NO: 3342719 - RNA, 14 nt, Human
uuuggggauauuuu

SEQ ID NO: 3342720 - RNA, 22 nt, Human
uuugggaggccaaggugggagg

SEQ ID NO: 3342721 - RNA, 13 nt, Human
uuuggggaagaac

SEQ ID NO: 3342722 - RNA, 22 nt, Human
uuugccauguuggccaggcugg

SEQ ID NO: 3342723 - RNA, 23 nt, Human
augucucuuuaaugucacaggca

SEQ ID NO: 3342724 - RNA, 19 nt, Human
auguccaagaagcccagga

SEQ ID NO: 3342725 - RNA, 18 nt, Human
auguccaagaagcccagg

SEQ ID NO: 3342726 - RNA, 23 nt, Human
auguccaagaagcccaggaaagg

SEQ ID NO: 3342727 - RNA, 15 nt, Human
augucagugugacug

SEQ ID NO: 3342728 - RNA, 16 nt, Human
augucagugugacuga

SEQ ID NO: 3342729 - RNA, 21 nt, Human
augucagugugacugaucucu

SEQ ID NO: 3342730 - RNA, 22 nt, Human
uuugggggaaaauuuagaaaua

SEQ ID NO: 3342731 - RNA, 15 nt, Human
auguaucaaugagua

SEQ ID NO: 3342732 - RNA, 15 nt, Human
auguaucugagcagg

SEQ ID NO: 3342733 - RNA, 12 nt, Human
auguauguguaa

SEQ ID NO: 3342734 - RNA, 21 nt, Human
uuuuaaaaaacugcugacugu

SEQ ID NO: 3342735 - RNA, 18 nt, Human
uuuguuugaacugauaaa

SEQ ID NO: 3342736 - RNA, 15 nt, Human
uuuuaagugcugcau

SEQ ID NO: 3342737 - RNA, 16 nt, Human
uuuuaagaggcagggu

SEQ ID NO: 3342738 - RNA, 15 nt, Human
uuuuaagaggcaggg

SEQ ID NO: 3342739 - RNA, 18 nt, Human
uuugugaggaagccgcug

SEQ ID NO: 3342740 - RNA, 19 nt, Human
uuugugaggaagccgcugg

SEQ ID NO: 3342741 - RNA, 13 nt, Human
uuuguuugaacug

SEQ ID NO: 3342742 - RNA, 14 nt, Human
uuuguuugaacuga

SEQ ID NO: 3342743 - RNA, 12 nt, Human
uuuguuugaacu

SEQ ID NO: 3342744 - RNA, 22 nt, Human
uuuguaaauuaacuuuuauaaa

SEQ ID NO: 3342745 - RNA, 13 nt, Human
uuuguagagccag

SEQ ID NO: 3342746 - RNA, 22 nt, Human
auuaccugaauuuuggcugugu

SEQ ID NO: 3342747 - RNA, 19 nt, Human
auuaccacagacauacuaa

SEQ ID NO: 3342748 - RNA, 22 nt, Human
uuuuuguuccacaaguuaaaua

SEQ ID NO: 3342749 - RNA, 23 nt, Human
auuauuuauuaaaugcccagccc

SEQ ID NO: 3342750 - RNA, 13 nt, Human
auuagagaagaga

SEQ ID NO: 3342751 - RNA, 14 nt, Human
auucagcucugcaa

SEQ ID NO: 3342752 - RNA, 18 nt, Human
auucagcucugcaagaau

SEQ ID NO: 3342753 - RNA, 21 nt, Human
auucaggaagcucagggccug

SEQ ID NO: 3342754 - RNA, 22 nt, Human
auucaggaagcucagggccugg

SEQ ID NO: 3342755 - RNA, 23 nt, Human
auucaggaagcucagggccuggc

SEQ ID NO: 3342756 - RNA, 16 nt, Human
auucaguuguuagugu

SEQ ID NO: 3342757 - RNA, 21 nt, Human
auucaguuguuagugugucuu

SEQ ID NO: 3342758 - RNA, 20 nt, Human
auucaggaagcucagggccu

SEQ ID NO: 3342759 - RNA, 16 nt, Human
auuccccaggaggcca

SEQ ID NO: 3342760 - RNA, 22 nt, Human
auuccccacccugaaagcccug

SEQ ID NO: 3342761 - RNA, 20 nt, Human
auuccccagauugcaacagg

SEQ ID NO: 3342762 - RNA, 15 nt, Human
auccuaguuccacca

SEQ ID NO: 3342763 - RNA, 19 nt, Human
auccuaguuccaccaucaa

SEQ ID NO: 3342764 - RNA, 15 nt, Human
aucucacacaugagc

SEQ ID NO: 3342765 - RNA, 12 nt, Human
aucucccccagc

SEQ ID NO: 3342766 - RNA, 13 nt, Human
aucucccccagcc

SEQ ID NO: 3342767 - RNA, 15 nt, Human
uugauucagacagcu

SEQ ID NO: 3342768 - RNA, 16 nt, Human
uugauucagacagcug

SEQ ID NO: 3342769 - RNA, 14 nt, Human
uugauucagacagc

SEQ ID NO: 3342770 - RNA, 14 nt, Human
uugccguuauuaaa

SEQ ID NO: 3342771 - RNA, 19 nt, Human
uugccgucuaccugagggg

SEQ ID NO: 3342772 - RNA, 15 nt, Human
uugccgucuaccuga

SEQ ID NO: 3342773 - RNA, 18 nt, Human
uugccgucuaccugaggg

SEQ ID NO: 3342774 - RNA, 14 nt, Human
uugccuaaguauua

SEQ ID NO: 3342775 - RNA, 20 nt, Human
uugccuaaguauuaaaacau

SEQ ID NO: 3342776 - RNA, 16 nt, Human
uugccuaaguauuaaa

SEQ ID NO: 3342777 - RNA, 13 nt, Human
uugccgucuaccu

SEQ ID NO: 3342778 - RNA, 23 nt, Human
uugccuaaguauuaaaacauugg

SEQ ID NO: 3342779 - RNA, 19 nt, Human
aucuugcucugcugacaga

SEQ ID NO: 3342780 - RNA, 17 nt, Human
aucuugcucugcugaca

SEQ ID NO: 3342781 - RNA, 17 nt, Human
aucuugaauuguaagga

SEQ ID NO: 3342782 - RNA, 18 nt, Human
aucuugaauuguaaggaa

SEQ ID NO: 3342783 - RNA, 17 nt, Human
aucuggguucacugcaa

SEQ ID NO: 3342784 - RNA, 19 nt, Human
aucuggguucacugcaacc

SEQ ID NO: 3342785 - RNA, 23 nt, Human
aucugugaaaggaaagagggagg

SEQ ID NO: 3342786 - RNA, 14 nt, Human
augacacaugcaag

SEQ ID NO: 3342787 - RNA, 22 nt, Human
augacacaugcaaggucauuuu

SEQ ID NO: 3342788 - RNA, 14 nt, Human
augacuuacuguac

SEQ ID NO: 3342789 - RNA, 22 nt, Human
augacuuaagcacacuugacau

SEQ ID NO: 3342790 - RNA, 18 nt, Human
augacacgaauauugcug

SEQ ID NO: 3342791 - RNA, 16 nt, Human
augacuuacuguacau

SEQ ID NO: 3342792 - RNA, 17 nt, Human
augacuuacuguacaug

SEQ ID NO: 3342793 - RNA, 22 nt, Human
augagaaagguugaagcaccaa

SEQ ID NO: 3342794 - RNA, 21 nt, Human
augagaaagguugaagcacca

SEQ ID NO: 3342795 - RNA, 22 nt, Human
uuggcgcugccccuggcagccc

SEQ ID NO: 3342796 - RNA, 23 nt, Human
uuggcgcugccccuggcagcccc

SEQ ID NO: 3342797 - RNA, 18 nt, Human
uuggcuagagguucaaag

SEQ ID NO: 3342798 - RNA, 15 nt, Human
uuggauuauccugag

SEQ ID NO: 3342799 - RNA, 18 nt, Human
aucuuugcagacaggcaa

SEQ ID NO: 3342800 - RNA, 22 nt, Human
uuggggggcugaggugggagga

SEQ ID NO: 3342801 - RNA, 14 nt, Human
uuggggauauuuuu

SEQ ID NO: 3342802 - RNA, 20 nt, Human
augaaugucagugugacuga

SEQ ID NO: 3342803 - RNA, 14 nt, Human
auggacaugaucuu

SEQ ID NO: 3342804 - RNA, 13 nt, Human
uuucagaaaugug

SEQ ID NO: 3342805 - RNA, 24 nt, Human
uuucacucuuauugcccacgcugg

SEQ ID NO: 3342806 - RNA, 16 nt, Human
auggaagacagcucuu

SEQ ID NO: 3342807 - RNA, 18 nt, Human
auggauuuccagccaaag

SEQ ID NO: 3342808 - RNA, 23 nt, Human
auggacguguuaugacuccagaa

SEQ ID NO: 3342809 - RNA, 19 nt, Human
auggacguguuaugacucc

SEQ ID NO: 3342810 - RNA, 20 nt, Human
auggacguguuaugacucca

SEQ ID NO: 3342811 - RNA, 17 nt, Human
auggcacaucagcacga

SEQ ID NO: 3342812 - RNA, 23 nt, Human
auggcacaucagcacgauuucug

SEQ ID NO: 3342813 - RNA, 21 nt, Human
auggccgggcgcgguggcuca

SEQ ID NO: 3342814 - RNA, 20 nt, Human
auggccuuugcuugaaagaa

SEQ ID NO: 3342815 - RNA, 18 nt, Human
auggcuaauguacugcau

SEQ ID NO: 3342816 - RNA, 15 nt, Human
uuuaguagagacagg

SEQ ID NO: 3342817 - RNA, 24 nt, Human
uuuauggcuuuugugcauuaucua

SEQ ID NO: 3342818 - RNA, 20 nt, Human
uuuauggcuuuugugcauua

SEQ ID NO: 3342819 - RNA, 11 nt, Human
auggaacacuc

SEQ ID NO: 3342820 - RNA, 14 nt, Human
auggaacacucuga

SEQ ID NO: 3342821 - RNA, 15 nt, Human
auggaacacucugag

SEQ ID NO: 3342822 - RNA, 16 nt, Human
auggaacacucugaga

SEQ ID NO: 3342823 - RNA, 15 nt, Human
auggaagacagcucu

SEQ ID NO: 3342824 - RNA, 19 nt, Human
augcugucccuuacgugag

SEQ ID NO: 3342825 - RNA, 23 nt, Human
augcugucccuuacgugaguccu

SEQ ID NO: 3342826 - RNA, 22 nt, Human
augcuguaacuuucugaaauaa

SEQ ID NO: 3342827 - RNA, 19 nt, Human
augcuccuggcccacugca

SEQ ID NO: 3342828 - RNA, 20 nt, Human
uuguucuggcucuuccaggc

SEQ ID NO: 3342829 - RNA, 22 nt, Human
uuguucuggcucuuccaggcug

SEQ ID NO: 3342830 - RNA, 17 nt, Human
uuguguguuuauuguca

SEQ ID NO: 3342831 - RNA, 19 nt, Human
uuguucuggcucuuccagg

SEQ ID NO: 3342832 - RNA, 13 nt, Human
uugugguuaaucu

SEQ ID NO: 3342833 - RNA, 18 nt, Human
uugugauacaaugcugug

SEQ ID NO: 3342834 - RNA, 21 nt, Human
uugugaggaagccgcuggggc

SEQ ID NO: 3342835 - RNA, 13 nt, Human
augcaccagcccu

SEQ ID NO: 3342836 - RNA, 12 nt, Human
augcacuuuguu

SEQ ID NO: 3342837 - RNA, 19 nt, Human
augauuaaccacuucagcu

SEQ ID NO: 3342838 - RNA, 20 nt, Human
augauuaaccacuucagcug

SEQ ID NO: 3342839 - RNA, 21 nt, Human
augauuaaccacuucagcuga

SEQ ID NO: 3342840 - RNA, 21 nt, Human
augauucaacagguuuuccug

SEQ ID NO: 3342841 - RNA, 12 nt, Human
uuuaauucaguu

SEQ ID NO: 3342842 - RNA, 15 nt, Human
uuuaagugcugcauu

SEQ ID NO: 3342843 - RNA, 16 nt, Human
uuuaagugcugcauuu

SEQ ID NO: 3342844 - RNA, 17 nt, Human
uuuaagugcugcauuua

SEQ ID NO: 3342845 - RNA, 23 nt, Human
uuuaaugaaagacuguacaaagu

SEQ ID NO: 3342846 - RNA, 14 nt, Human
uuuaagaggcaggg

SEQ ID NO: 3342847 - RNA, 16 nt, Human
uuguuuucaguguaca

SEQ ID NO: 3342848 - RNA, 13 nt, Human
uuguuuucagugu

SEQ ID NO: 3342849 - RNA, 15 nt, Human
augcacuuuguucug

SEQ ID NO: 3342850 - RNA, 13 nt, Human
augcagccucaca

SEQ ID NO: 3342851 - RNA, 14 nt, Human
augcagccucacag

SEQ ID NO: 3342852 - RNA, 15 nt, Human
augcagccucacagu

SEQ ID NO: 3342853 - RNA, 21 nt, Human
aucauugaaaucuuuuugcuu

SEQ ID NO: 3342854 - RNA, 21 nt, Human
aucaggccaggcccucugccc

SEQ ID NO: 3342855 - RNA, 22 nt, Human
aucaggccaggcccucugccca

SEQ ID NO: 3342856 - RNA, 23 nt, Human
aucaggccaggcccucugcccac

SEQ ID NO: 3342857 - RNA, 20 nt, Human
aucauugaaaucuuuuugcu

SEQ ID NO: 3342858 - RNA, 20 nt, Human
aucaggccaggcccucugcc

SEQ ID NO: 3342859 - RNA, 17 nt, Human
uucucuacucuagggaa

SEQ ID NO: 3342860 - RNA, 16 nt, Human
uucucuuuucaaaaca

SEQ ID NO: 3342861 - RNA, 14 nt, Human
uucugacccaugcu

SEQ ID NO: 3342862 - RNA, 13 nt, Human
uucugccgcagcc

SEQ ID NO: 3342863 - RNA, 16 nt, Human
uucuggcuaugcauuu

SEQ ID NO: 3342864 - RNA, 18 nt, Human
uucuggcuaugcauuuga

SEQ ID NO: 3342865 - RNA, 20 nt, Human
uucuggcuaugcauuugaaa

SEQ ID NO: 3342866 - RNA, 14 nt, Human
uucugccgcagccc

SEQ ID NO: 3342867 - RNA, 15 nt, Human
uucugccgcagcccu

SEQ ID NO: 3342868 - RNA, 21 nt, Human
auccaagcuggucccacucag

SEQ ID NO: 3342869 - RNA, 22 nt, Human
uucuuucuggcuaugcauuuga

SEQ ID NO: 3342870 - RNA, 12 nt, Human
uucuugcaaagu

SEQ ID NO: 3342871 - RNA, 23 nt, Human
uucuuccucccucccucuuuccc

SEQ ID NO: 3342872 - RNA, 13 nt, Human
uucuuaauucuua

SEQ ID NO: 3342873 - RNA, 18 nt, Human
uucuguucuuucuggcua

SEQ ID NO: 3342874 - RNA, 11 nt, Human
uucuguucuuu

SEQ ID NO: 3342875 - RNA, 20 nt, Human
uucuguuuuucuaggccugg

SEQ ID NO: 3342876 - RNA, 21 nt, Human
uugaaauuuuuauuaaauuau

SEQ ID NO: 3342877 - RNA, 11 nt, Human
uugaaaucuuu

SEQ ID NO: 3342878 - RNA, 20 nt, Human
uugaaauauaggaacuuaaa

SEQ ID NO: 3342879 - RNA, 21 nt, Human
auccuaagcuauucaguaaua

SEQ ID NO: 3342880 - RNA, 21 nt, Human
auccuaggcauuugcugaaua

SEQ ID NO: 3342881 - RNA, 13 nt, Human
auccuaguuccac

SEQ ID NO: 3342882 - RNA, 19 nt, Human
uucccuuuuuuggcugcug

SEQ ID NO: 3342883 - RNA, 18 nt, Human
uucccuuuuuuggcugcu

SEQ ID NO: 3342884 - RNA, 20 nt, Human
aucaaccccuucgcuccugu

SEQ ID NO: 3342885 - RNA, 19 nt, Human
aucaaccccuucgcuccug

SEQ ID NO: 3342886 - RNA, 21 nt, Human
uucgcaggauucuuccucccu

SEQ ID NO: 3342887 - RNA, 13 nt, Human
aucaggccaggcc

SEQ ID NO: 3342888 - RNA, 21 nt, Human
uucucacugccaugccagcuu

SEQ ID NO: 3342889 - RNA, 17 nt, Human
uuccaaggguacuaagg

SEQ ID NO: 3342890 - RNA, 15 nt, Human
uuccaaggguacuaa

SEQ ID NO: 3342891 - RNA, 15 nt, Human
auauguggaguucau

SEQ ID NO: 3342892 - RNA, 16 nt, Human
auauguggaguucauc

SEQ ID NO: 3342893 - RNA, 19 nt, Human
uuccaccaucaagccacca

SEQ ID NO: 3342894 - RNA, 22 nt, Human
uuccacaagagcccaggccucc

SEQ ID NO: 3342895 - RNA, 18 nt, Human
uuccaccaucaagccacc

SEQ ID NO: 3342896 - RNA, 17 nt, Human
uuccaggggugggacac

SEQ ID NO: 3342897 - RNA, 21 nt, Human
uuccaggggugggacacccug

SEQ ID NO: 3342898 - RNA, 17 nt, Human
uuccagugaggcucugc

SEQ ID NO: 3342899 - RNA, 19 nt, Human
uuccagugaggcucugccc

SEQ ID NO: 3342900 - RNA, 20 nt, Human
uuccagugaggcucugcccu

SEQ ID NO: 3342901 - RNA, 21 nt, Human
uuccagugaggcucugcccuu

SEQ ID NO: 3342902 - RNA, 22 nt, Human
uuccagugaggcucugcccuug

SEQ ID NO: 3342903 - RNA, 23 nt, Human
uucccaaagcagugcaugcuguc

SEQ ID NO: 3342904 - RNA, 12 nt, Human
uucccaccucuc

SEQ ID NO: 3342905 - RNA, 22 nt, Human
uucccaccucucucacuccuug

SEQ ID NO: 3342906 - RNA, 18 nt, Human
uucccaagcucugcuccu

SEQ ID NO: 3342907 - RNA, 16 nt, Human
uucccaagcucugcuc

SEQ ID NO: 3342908 - RNA, 15 nt, Human
uucccaagcucugcu

SEQ ID NO: 3342909 - RNA, 14 nt, Human
uucccaagcucugc

SEQ ID NO: 3342910 - RNA, 13 nt, Human
uucccaagcucug

SEQ ID NO: 3342911 - RNA, 11 nt, Human
uucagaaaugu

SEQ ID NO: 3342912 - RNA, 16 nt, Human
uucagugccaaaaaca

SEQ ID NO: 3342913 - RNA, 12 nt, Human
uucagugccuua

SEQ ID NO: 3342914 - RNA, 13 nt, Human
uucagugccuuau

SEQ ID NO: 3342915 - RNA, 21 nt, Human
uucaucccucuggggcuguuc

SEQ ID NO: 3342916 - RNA, 17 nt, Human
uucaucccucuggggcu

SEQ ID NO: 3342917 - RNA, 16 nt, Human
auauguaacaagccac

SEQ ID NO: 3342918 - RNA, 17 nt, Human
auauguaacaagccacc

SEQ ID NO: 3342919 - RNA, 14 nt, Human
auaugcacacauuu

SEQ ID NO: 3342920 - RNA, 15 nt, Human
auaugcacacauuuu

SEQ ID NO: 3342921 - RNA, 16 nt, Human
auaugcacacauuuuu

SEQ ID NO: 3342922 - RNA, 13 nt, Human
auaugcacacauu

SEQ ID NO: 3342923 - RNA, 20 nt, Human
auaucugaaaauguaugugu

SEQ ID NO: 3342924 - RNA, 17 nt, Human
auaucugaaaauguaug

SEQ ID NO: 3342925 - RNA, 16 nt, Human
auaucugaaaauguau

SEQ ID NO: 3342926 - RNA, 12 nt, Human
auauauaaccag

SEQ ID NO: 3342927 - RNA, 13 nt, Human
auauauaaccagu

SEQ ID NO: 3342928 - RNA, 17 nt, Human
auaguggcuuaaaacaa

SEQ ID NO: 3342929 - RNA, 15 nt, Human
auaguggugugauuu

SEQ ID NO: 3342930 - RNA, 22 nt, Human
auaguuaagcgugcauaaguua

SEQ ID NO: 3342931 - RNA, 22 nt, Human
auaguuggcuaggaccccucca

SEQ ID NO: 3342932 - RNA, 21 nt, Human
uucaagcgauucuucugcuuc

SEQ ID NO: 3342933 - RNA, 18 nt, Human
uuauuuuuagacagaguc

SEQ ID NO: 3342934 - RNA, 17 nt, Human
uuauuuuuagacagagu

SEQ ID NO: 3342935 - RNA, 12 nt, Human
auaggaaaaacu

SEQ ID NO: 3342936 - RNA, 14 nt, Human
auaggaaaaacuga

SEQ ID NO: 3342937 - RNA, 16 nt, Human
auaggaaaaacugauu

SEQ ID NO: 3342938 - RNA, 17 nt, Human
auaggaaaaacugauuu

SEQ ID NO: 3342939 - RNA, 20 nt, Human
uucacagaugggugcuugga

SEQ ID NO: 3342940 - RNA, 15 nt, Human
uucacaguucucucc

SEQ ID NO: 3342941 - RNA, 20 nt, Human
uucacaguucucuccuucuu

SEQ ID NO: 3342942 - RNA, 13 nt, Human
uucacaguucucu

SEQ ID NO: 3342943 - RNA, 17 nt, Human
ugaguacuacaguccuc

SEQ ID NO: 3342944 - RNA, 21 nt, Human
ugaguacuacaguccucccau

SEQ ID NO: 3342945 - RNA, 22 nt, Human
ugaguacuacaguccucccauc

SEQ ID NO: 3342946 - RNA, 23 nt, Human
ugaguacuacaguccucccaucu

SEQ ID NO: 3342947 - RNA, 14 nt, Human
ugaguacuacaguc

SEQ ID NO: 3342948 - RNA, 14 nt, Human
agcauauucaggaa

SEQ ID NO: 3342949 - RNA, 15 nt, Human
ugaguacuacagucc

SEQ ID NO: 3342950 - RNA, 12 nt, Human
ugagaauuaccc

SEQ ID NO: 3342951 - RNA, 15 nt, Human
agcauacguacacau

SEQ ID NO: 3342952 - RNA, 16 nt, Human
agcauacguacacauu

SEQ ID NO: 3342953 - RNA, 17 nt, Human
agcauacguacacauuu

SEQ ID NO: 3342954 - RNA, 18 nt, Human
agcauacguacacauuuu

SEQ ID NO: 3342955 - RNA, 19 nt, Human
agcauacguacacauuuua

SEQ ID NO: 3342956 - RNA, 20 nt, Human
agcauacguacacauuuuau

SEQ ID NO: 3342957 - RNA, 21 nt, Human
agcauacguacacauuuuauu

SEQ ID NO: 3342958 - RNA, 18 nt, Human
ugauacaaugcugugccc

SEQ ID NO: 3342959 - RNA, 20 nt, Human
ugauacaaugcugugcccua

SEQ ID NO: 3342960 - RNA, 21 nt, Human
ugauacaaugcugugcccuaa

SEQ ID NO: 3342961 - RNA, 14 nt, Human
ugauacuacaguuu

SEQ ID NO: 3342962 - RNA, 17 nt, Human
ugauacuacaguuuguu

SEQ ID NO: 3342963 - RNA, 20 nt, Human
ugauaagaaccuuuugagug

SEQ ID NO: 3342964 - RNA, 17 nt, Human
ugaguucauacccuguu

SEQ ID NO: 3342965 - RNA, 17 nt, Human
ugagugccuuacacaau

SEQ ID NO: 3342966 - RNA, 20 nt, Human
ugagugccuuacacaauggu

SEQ ID NO: 3342967 - RNA, 17 nt, Human
ugagucaccaagcccag

SEQ ID NO: 3342968 - RNA, 16 nt, Human
ugagucaccaagccca

SEQ ID NO: 3342969 - RNA, 14 nt, Human
ugagucaccaagcc

SEQ ID NO: 3342970 - RNA, 23 nt, Human
ugagugggggaucacagccucug

SEQ ID NO: 3342971 - RNA, 21 nt, Human
ugagugggugaauaauacagu

SEQ ID NO: 3342972 - RNA, 16 nt, Human
ugagugccuuacacaa

SEQ ID NO: 3342973 - RNA, 12 nt, Human
agcauggcugcc

SEQ ID NO: 3342974 - RNA, 14 nt, Human
agcaucaggccagg

SEQ ID NO: 3342975 - RNA, 16 nt, Human
agcaucaggccaggcc

SEQ ID NO: 3342976 - RNA, 17 nt, Human
agcaucaggccaggccc

SEQ ID NO: 3342977 - RNA, 18 nt, Human
agcaucaggccaggcccu

SEQ ID NO: 3342978 - RNA, 19 nt, Human
agcaucaggccaggcccuc

SEQ ID NO: 3342979 - RNA, 20 nt, Human
agcaucaggccaggcccucu

SEQ ID NO: 3342980 - RNA, 19 nt, Human
ugaucacggcucacugcag

SEQ ID NO: 3342981 - RNA, 18 nt, Human
ugaucacggcucacugca

SEQ ID NO: 3342982 - RNA, 13 nt, Human
agcaucaggccag

SEQ ID NO: 3342983 - RNA, 12 nt, Human
agcaucaggcca

SEQ ID NO: 3342984 - RNA, 20 nt, Human
ugaucacggcucacugcagc

SEQ ID NO: 3342985 - RNA, 22 nt, Human
agcauauucaggaagcucaggg

SEQ ID NO: 3342986 - RNA, 22 nt, Human
agcccacuucugccauauucug

SEQ ID NO: 3342987 - RNA, 19 nt, Human
agcccaggaaaggcuccag

SEQ ID NO: 3342988 - RNA, 20 nt, Human
agcccaggaaaggcuccagg

SEQ ID NO: 3342989 - RNA, 21 nt, Human
agcccaggaaaggcuccagga

SEQ ID NO: 3342990 - RNA, 19 nt, Human
ugauucccaagcucugcuc

SEQ ID NO: 3342991 - RNA, 18 nt, Human
ugauucccaagcucugcu

SEQ ID NO: 3342992 - RNA, 16 nt, Human
ugauucccaagcucug

SEQ ID NO: 3342993 - RNA, 15 nt, Human
ugauucccaagcucu

SEQ ID NO: 3342994 - RNA, 22 nt, Human
agcccaggaaaggcuccaggag

SEQ ID NO: 3342995 - RNA, 23 nt, Human
agcccaggaaaggcuccaggagc

SEQ ID NO: 3342996 - RNA, 24 nt, Human
agcccaggaaaggcuccaggagca

SEQ ID NO: 3342997 - RNA, 18 nt, Human
agcccaggaaaggcucca

SEQ ID NO: 3342998 - RNA, 13 nt, Human
ugauucagcucug

SEQ ID NO: 3342999 - RNA, 14 nt, Human
ugauucagcucugc

SEQ ID NO: 3343000 - RNA, 21 nt, Human
agccaggccacaagacccuug

SEQ ID NO: 3343001 - RNA, 22 nt, Human
agccaggccacaagacccuugu

SEQ ID NO: 3343002 - RNA, 12 nt, Human
agccagggucuc

SEQ ID NO: 3343003 - RNA, 23 nt, Human
agccaguaaaugggggugcauuu

SEQ ID NO: 3343004 - RNA, 22 nt, Human
agccaguaaaugggggugcauu

SEQ ID NO: 3343005 - RNA, 16 nt, Human
agccaguguugccuaa

SEQ ID NO: 3343006 - RNA, 12 nt, Human
agccaggccaca

SEQ ID NO: 3343007 - RNA, 14 nt, Human
agccaggccacaag

SEQ ID NO: 3343008 - RNA, 14 nt, Human
agccacauuccuga

SEQ ID NO: 3343009 - RNA, 18 nt, Human
agccacauuccugaugcu

SEQ ID NO: 3343010 - RNA, 20 nt, Human
agccaccaacauacucccau

SEQ ID NO: 3343011 - RNA, 23 nt, Human
agccaccaacauacucccaucug

SEQ ID NO: 3343012 - RNA, 19 nt, Human
agccaccaacauacuccca

SEQ ID NO: 3343013 - RNA, 14 nt, Human
agccacggccaggc

SEQ ID NO: 3343014 - RNA, 15 nt, Human
agccacggccaggcc

SEQ ID NO: 3343015 - RNA, 17 nt, Human
ugauggugcaaugaccu

SEQ ID NO: 3343016 - RNA, 23 nt, Human
ugauggugcaaugaccuuucaau

SEQ ID NO: 3343017 - RNA, 15 nt, Human
ugauggugcaaugac

SEQ ID NO: 3343018 - RNA, 16 nt, Human
ugauggugcaaugacc

SEQ ID NO: 3343019 - RNA, 14 nt, Human
ugaugauccuaggc

SEQ ID NO: 3343020 - RNA, 20 nt, Human
ugaugauccuaggcauuugc

SEQ ID NO: 3343021 - RNA, 17 nt, Human
ugauguuuuaaggaugc

SEQ ID NO: 3343022 - RNA, 23 nt, Human
ugauguuuuccaugaguccccug

SEQ ID NO: 3343023 - RNA, 22 nt, Human
agccacugcaccgggccacaga

SEQ ID NO: 3343024 - RNA, 21 nt, Human
agccacugcaccgggccacag

SEQ ID NO: 3343025 - RNA, 13 nt, Human
agccacugcaccg

SEQ ID NO: 3343026 - RNA, 20 nt, Human
agccacugcaccgggccaca

SEQ ID NO: 3343027 - RNA, 15 nt, Human
ugauuaauuaaaaca

SEQ ID NO: 3343028 - RNA, 22 nt, Human
agccugggugacagagcaagug

SEQ ID NO: 3343029 - RNA, 19 nt, Human
agccugcuccagcuguuca

SEQ ID NO: 3343030 - RNA, 22 nt, Human
agccugcuccagcuguucagcu

SEQ ID NO: 3343031 - RNA, 12 nt, Human
ugcauaccacuu

SEQ ID NO: 3343032 - RNA, 14 nt, Human
agccugcuccagcu

SEQ ID NO: 3343033 - RNA, 15 nt, Human
agccugcuccagcug

SEQ ID NO: 3343034 - RNA, 16 nt, Human
agccugcuccagcugu

SEQ ID NO: 3343035 - RNA, 17 nt, Human
agccugcuccagcuguu

SEQ ID NO: 3343036 - RNA, 22 nt, Human
agccuuagaagucacacaguau

SEQ ID NO: 3343037 - RNA, 21 nt, Human
agccugugccucugggacugg

SEQ ID NO: 3343038 - RNA, 19 nt, Human
agccugugccucugggacu

SEQ ID NO: 3343039 - RNA, 21 nt, Human
ugcauuaucuagauacuguau

SEQ ID NO: 3343040 - RNA, 22 nt, Human
ugcauuaucuagauacuguauc

SEQ ID NO: 3343041 - RNA, 18 nt, Human
ugcauuaucuagauacug

SEQ ID NO: 3343042 - RNA, 18 nt, Human
ugccaaugggagcucaug

SEQ ID NO: 3343043 - RNA, 16 nt, Human
agcggagaaaggaagg

SEQ ID NO: 3343044 - RNA, 20 nt, Human
ugcauuaucuagauacugua

SEQ ID NO: 3343045 - RNA, 20 nt, Human
agcggagaaaggaagggcug

SEQ ID NO: 3343046 - RNA, 18 nt, Human
agcggagacggaguccca

SEQ ID NO: 3343047 - RNA, 11 nt, Human
agccuuccagg

SEQ ID NO: 3343048 - RNA, 14 nt, Human
agccuuccaggggu

SEQ ID NO: 3343049 - RNA, 16 nt, Human
agccuuccaggggugg

SEQ ID NO: 3343050 - RNA, 17 nt, Human
agccuuccagggguggg

SEQ ID NO: 3343051 - RNA, 21 nt, Human
ugcccagccccuucugaccca

SEQ ID NO: 3343052 - RNA, 20 nt, Human
ugcccagccccuucugaccc

SEQ ID NO: 3343053 - RNA, 16 nt, Human
ugcccacaggaucagu

SEQ ID NO: 3343054 - RNA, 19 nt, Human
ugcccacaggaucagucug

SEQ ID NO: 3343055 - RNA, 20 nt, Human
ugcccacaggaucagucuga

SEQ ID NO: 3343056 - RNA, 20 nt, Human
agcucauucuccuuguguua

SEQ ID NO: 3343057 - RNA, 21 nt, Human
agcucauucuccuuguguuac

SEQ ID NO: 3343058 - RNA, 12 nt, Human
agcuaggccugg

SEQ ID NO: 3343059 - RNA, 15 nt, Human
agcuaggccuggcca

SEQ ID NO: 3343060 - RNA, 14 nt, Human
agcuaggccuggcc

SEQ ID NO: 3343061 - RNA, 21 nt, Human
agcucaggugucccugcacuu

SEQ ID NO: 3343062 - RNA, 20 nt, Human
agcucaggugucccugcacu

SEQ ID NO: 3343063 - RNA, 22 nt, Human
agcucaggugucccugcacuug

SEQ ID NO: 3343064 - RNA, 17 nt, Human
agcucaggugucccugc

SEQ ID NO: 3343065 - RNA, 18 nt, Human
agcucaggugucccugca

SEQ ID NO: 3343066 - RNA, 22 nt, Human
agcgugagccacugcaccgggc

SEQ ID NO: 3343067 - RNA, 19 nt, Human
agcgugagccacugcaccg

SEQ ID NO: 3343068 - RNA, 17 nt, Human
agcgugagccacugcac

SEQ ID NO: 3343069 - RNA, 18 nt, Human
agcuagacgagcaggcuu

SEQ ID NO: 3343070 - RNA, 14 nt, Human
ugcauaaguuaacu

SEQ ID NO: 3343071 - RNA, 16 nt, Human
ugcagccucacagucc

SEQ ID NO: 3343072 - RNA, 13 nt, Human
ugcagccucacag

SEQ ID NO: 3343073 - RNA, 15 nt, Human
ugcagccucacaguc

SEQ ID NO: 3343074 - RNA, 23 nt, Human
ugcagccucaaccuccugggcua

SEQ ID NO: 3343075 - RNA, 23 nt, Human
agcccuucuaccuuccugcaaca

SEQ ID NO: 3343076 - RNA, 23 nt, Human
ugcacuauagccuaggugacaga

SEQ ID NO: 3343077 - RNA, 22 nt, Human
ugcacuauagccuaggugacag

SEQ ID NO: 3343078 - RNA, 16 nt, Human
agccucagcauccugg

SEQ ID NO: 3343079 - RNA, 21 nt, Human
agccucagcauccuggcaccc

SEQ ID NO: 3343080 - RNA, 20 nt, Human
agccucagcauccuggcacc

SEQ ID NO: 3343081 - RNA, 19 nt, Human
agccucagcauccuggcac

SEQ ID NO: 3343082 - RNA, 17 nt, Human
agccucagcauccuggc

SEQ ID NO: 3343083 - RNA, 16 nt, Human
agccucccaaagugcu

SEQ ID NO: 3343084 - RNA, 23 nt, Human
agccucagcauccuggcacccgg

SEQ ID NO: 3343085 - RNA, 22 nt, Human
agccucagcauccuggcacccg

SEQ ID NO: 3343086 - RNA, 21 nt, Human
agcccugguggcagugggagc

SEQ ID NO: 3343087 - RNA, 20 nt, Human
agccccuucugacccaugcu

SEQ ID NO: 3343088 - RNA, 24 nt, Human
agccccuucugacccaugcugccc

SEQ ID NO: 3343089 - RNA, 18 nt, Human
ugcacaagcugcacccuc

SEQ ID NO: 3343090 - RNA, 21 nt, Human
ugcacaagcugcacccucagg

SEQ ID NO: 3343091 - RNA, 22 nt, Human
ugcacacaccagagcccaccuu

SEQ ID NO: 3343092 - RNA, 14 nt, Human
ugcacaagcugcac

SEQ ID NO: 3343093 - RNA, 15 nt, Human
ugcacaagcugcacc

SEQ ID NO: 3343094 - RNA, 23 nt, Human
agcccugguggcagugggagcug

SEQ ID NO: 3343095 - RNA, 22 nt, Human
agcccugguggcagugggagcu

SEQ ID NO: 3343096 - RNA, 15 nt, Human
ugcacgugugugcac

SEQ ID NO: 3343097 - RNA, 14 nt, Human
ugcacgugugugca

SEQ ID NO: 3343098 - RNA, 16 nt, Human
ugcacccucaggcagg

SEQ ID NO: 3343099 - RNA, 17 nt, Human
ugcacccucaggcaggu

SEQ ID NO: 3343100 - RNA, 10 nt, Human
ugcacacauu

SEQ ID NO: 3343101 - RNA, 20 nt, Human
ugcacacauuuuuuaaaugc

SEQ ID NO: 3343102 - RNA, 13 nt, Human
ugauucuccugcc

SEQ ID NO: 3343103 - RNA, 15 nt, Human
ugauucuccugccuc

SEQ ID NO: 3343104 - RNA, 19 nt, Human
ugauucuccugccucagcc

SEQ ID NO: 3343105 - RNA, 20 nt, Human
agccccaaaacucuccucug

SEQ ID NO: 3343106 - RNA, 21 nt, Human
agccccaaaacucuccucugc

SEQ ID NO: 3343107 - RNA, 22 nt, Human
agccccaaaacucuccucugcu

SEQ ID NO: 3343108 - RNA, 23 nt, Human
agccccauucugccugcccaggc

SEQ ID NO: 3343109 - RNA, 16 nt, Human
agccccgaggccuucu

SEQ ID NO: 3343110 - RNA, 22 nt, Human
agccccgaggccuucucugaag

SEQ ID NO: 3343111 - RNA, 17 nt, Human
agccccgaggccuucuc

SEQ ID NO: 3343112 - RNA, 19 nt, Human
agccccuggaugcagccuc

SEQ ID NO: 3343113 - RNA, 19 nt, Human
agccccuucugacccaugc

SEQ ID NO: 3343114 - RNA, 17 nt, Human
agccccuggaugcagcc

SEQ ID NO: 3343115 - RNA, 18 nt, Human
agccccuggaugcagccu

SEQ ID NO: 3343116 - RNA, 13 nt, Human
uggauuguccccg

SEQ ID NO: 3343117 - RNA, 14 nt, Human
uggauuauccugag

SEQ ID NO: 3343118 - RNA, 22 nt, Human
uggauuaaacuuaaucuaaaug

SEQ ID NO: 3343119 - RNA, 16 nt, Human
aggccaaaggaagcac

SEQ ID NO: 3343120 - RNA, 18 nt, Human
aggccaaaggaagcacau

SEQ ID NO: 3343121 - RNA, 19 nt, Human
aggccaaaggaagcacaug

SEQ ID NO: 3343122 - RNA, 15 nt, Human
aggccaaaggaagca

SEQ ID NO: 3343123 - RNA, 17 nt, Human
aggcagccccauucugc

SEQ ID NO: 3343124 - RNA, 16 nt, Human
aggcagccccauucug

SEQ ID NO: 3343125 - RNA, 18 nt, Human
aggcagccaggccacaag

SEQ ID NO: 3343126 - RNA, 16 nt, Human
aggccaaggugggagg

SEQ ID NO: 3343127 - RNA, 23 nt, Human
uggaggggggaggugggauccuc

SEQ ID NO: 3343128 - RNA, 20 nt, Human
aggccagagggagugacaga

SEQ ID NO: 3343129 - RNA, 21 nt, Human
aggcccagagggccugcaagg

SEQ ID NO: 3343130 - RNA, 16 nt, Human
aggccccgcccaggcu

SEQ ID NO: 3343131 - RNA, 20 nt, Human
aggcccagagggccugcaag

SEQ ID NO: 3343132 - RNA, 17 nt, Human
aggccacaagacccuug

SEQ ID NO: 3343133 - RNA, 18 nt, Human
aggccacaagacccuugu

SEQ ID NO: 3343134 - RNA, 19 nt, Human
aggccacaagacccuugug

SEQ ID NO: 3343135 - RNA, 14 nt, Human
aggccagagggagu

SEQ ID NO: 3343136 - RNA, 16 nt, Human
aggccacaagacccuu

SEQ ID NO: 3343137 - RNA, 19 nt, Human
uggcagcucaccucucccu

SEQ ID NO: 3343138 - RNA, 15 nt, Human
uggcagcucaccucu

SEQ ID NO: 3343139 - RNA, 17 nt, Human
uggcagccuuggcaaac

SEQ ID NO: 3343140 - RNA, 13 nt, Human
uggcagccuuggc

SEQ ID NO: 3343141 - RNA, 17 nt, Human
aggccccgcccaggcuu

SEQ ID NO: 3343142 - RNA, 23 nt, Human
uggccaaagccaaagcuaggccu

SEQ ID NO: 3343143 - RNA, 21 nt, Human
uggccaaagccaaagcuaggc

SEQ ID NO: 3343144 - RNA, 23 nt, Human
uggccagugugacaaggauugcu

SEQ ID NO: 3343145 - RNA, 13 nt, Human
uggccucuucaga

SEQ ID NO: 3343146 - RNA, 23 nt, Human
uggccgggcgcgguggcucacgc

SEQ ID NO: 3343147 - RNA, 12 nt, Human
aggccuggggac

SEQ ID NO: 3343148 - RNA, 18 nt, Human
aggccugggggcugggca

SEQ ID NO: 3343149 - RNA, 12 nt, Human
uggccuggcccc

SEQ ID NO: 3343150 - RNA, 18 nt, Human
uggccuggccccucaggg

SEQ ID NO: 3343151 - RNA, 21 nt, Human
uggccuggccccucagggucc

SEQ ID NO: 3343152 - RNA, 17 nt, Human
aggaucucuugagccug

SEQ ID NO: 3343153 - RNA, 18 nt, Human
aggaucucuugagccugg

SEQ ID NO: 3343154 - RNA, 19 nt, Human
aggaucucuugagccuggg

SEQ ID NO: 3343155 - RNA, 12 nt, Human
aggaucucuuga

SEQ ID NO: 3343156 - RNA, 14 nt, Human
uggacacagcucuu

SEQ ID NO: 3343157 - RNA, 13 nt, Human
uggacacagcucu

SEQ ID NO: 3343158 - RNA, 22 nt, Human
uggacacagcucuucuccaggc

SEQ ID NO: 3343159 - RNA, 21 nt, Human
uggacacagcucuucuccagg

SEQ ID NO: 3343160 - RNA, 23 nt, Human
uggacacagcucuucuccaggcu

SEQ ID NO: 3343161 - RNA, 16 nt, Human
uggacccugaggccca

SEQ ID NO: 3343162 - RNA, 18 nt, Human
uggacccugaggcccaga

SEQ ID NO: 3343163 - RNA, 23 nt, Human
uggacccuguggaugauaaaaca

SEQ ID NO: 3343164 - RNA, 21 nt, Human
uggacccugaggcccagaggg

SEQ ID NO: 3343165 - RNA, 19 nt, Human
uggacccugaggcccagag

SEQ ID NO: 3343166 - RNA, 20 nt, Human
uggacccugaggcccagagg

SEQ ID NO: 3343167 - RNA, 15 nt, Human
uggacccugaggccc

SEQ ID NO: 3343168 - RNA, 17 nt, Human
aggcaaggcugucaauu

SEQ ID NO: 3343169 - RNA, 22 nt, Human
aggcacccaccaucaugucugg

SEQ ID NO: 3343170 - RNA, 21 nt, Human
aggcacccaccaucaugucug

SEQ ID NO: 3343171 - RNA, 20 nt, Human
aggcacccaccaucaugucu

SEQ ID NO: 3343172 - RNA, 14 nt, Human
aggcaaugcuggcu

SEQ ID NO: 3343173 - RNA, 15 nt, Human
aggcacccaccauca

SEQ ID NO: 3343174 - RNA, 13 nt, Human
uggagaagcggcu

SEQ ID NO: 3343175 - RNA, 22 nt, Human
uggagaagcggcuggcagccca

SEQ ID NO: 3343176 - RNA, 17 nt, Human
uggaaaugggcagagca

SEQ ID NO: 3343177 - RNA, 21 nt, Human
aggauacaaaagcaugugaga

SEQ ID NO: 3343178 - RNA, 13 nt, Human
aggauccugagcc

SEQ ID NO: 3343179 - RNA, 14 nt, Human
aggauccugagcca

SEQ ID NO: 3343180 - RNA, 22 nt, Human
ugcuuguacauaaugcgugcau

SEQ ID NO: 3343181 - RNA, 14 nt, Human
ugcuuguacauaau

SEQ ID NO: 3343182 - RNA, 16 nt, Human
ugcuuguacauaaugc

SEQ ID NO: 3343183 - RNA, 14 nt, Human
ugcuuugugauuuu

SEQ ID NO: 3343184 - RNA, 16 nt, Human
ugcuuugugauuuuug

SEQ ID NO: 3343185 - RNA, 12 nt, Human
ugcuuugugauu

SEQ ID NO: 3343186 - RNA, 14 nt, Human
ugcuuuuggucugu

SEQ ID NO: 3343187 - RNA, 12 nt, Human
ugcuuguacaua

SEQ ID NO: 3343188 - RNA, 13 nt, Human
ugcuuguacauaa

SEQ ID NO: 3343189 - RNA, 15 nt, Human
ugcuuggaggaagga

SEQ ID NO: 3343190 - RNA, 14 nt, Human
ugcuuggaggaagg

SEQ ID NO: 3343191 - RNA, 21 nt, Human
ugcuugaggcaacucaucuua

SEQ ID NO: 3343192 - RNA, 22 nt, Human
aggacagggaggugaccccagg

SEQ ID NO: 3343193 - RNA, 22 nt, Human
ugcggacagccacggccaggcc

SEQ ID NO: 3343194 - RNA, 21 nt, Human
ugcggacagccacggccaggc

SEQ ID NO: 3343195 - RNA, 23 nt, Human
ugcggacagccacggccaggcca

SEQ ID NO: 3343196 - RNA, 17 nt, Human
ugcggugcuaucucccc

SEQ ID NO: 3343197 - RNA, 18 nt, Human
ugcgguccacccaggagc

SEQ ID NO: 3343198 - RNA, 17 nt, Human
ugcgguccacccaggag

SEQ ID NO: 3343199 - RNA, 20 nt, Human
ugcgggcuuccuccuggugu

SEQ ID NO: 3343200 - RNA, 17 nt, Human
ugcggccuuuggcuuca

SEQ ID NO: 3343201 - RNA, 19 nt, Human
ugcggccuuuggcuucacg

SEQ ID NO: 3343202 - RNA, 14 nt, Human
agcuguucagcugg

SEQ ID NO: 3343203 - RNA, 14 nt, Human
agcuugaggguugg

SEQ ID NO: 3343204 - RNA, 18 nt, Human
agcuugaggguugggcug

SEQ ID NO: 3343205 - RNA, 24 nt, Human
ugccugcccaggccccugccaccc

SEQ ID NO: 3343206 - RNA, 12 nt, Human
ugccucugccuc

SEQ ID NO: 3343207 - RNA, 15 nt, Human
ugccugcccaggccc

SEQ ID NO: 3343208 - RNA, 14 nt, Human
ugccugcccaggcc

SEQ ID NO: 3343209 - RNA, 15 nt, Human
ugccucugccucuga

SEQ ID NO: 3343210 - RNA, 13 nt, Human
ugccugcccaggc

SEQ ID NO: 3343211 - RNA, 14 nt, Human
ugccucugccucug

SEQ ID NO: 3343212 - RNA, 13 nt, Human
ugccucugccucu

SEQ ID NO: 3343213 - RNA, 14 nt, Human
ugcccaggcagguc

SEQ ID NO: 3343214 - RNA, 13 nt, Human
ugcccaggcaggu

SEQ ID NO: 3343215 - RNA, 12 nt, Human
ugcccaggcagg

SEQ ID NO: 3343216 - RNA, 15 nt, Human
ugccuggauggggcu

SEQ ID NO: 3343217 - RNA, 14 nt, Human
ugccuggauggggc

SEQ ID NO: 3343218 - RNA, 20 nt, Human
agcugccuguucagcuccag

SEQ ID NO: 3343219 - RNA, 20 nt, Human
agcugcuugggcuucauccu

SEQ ID NO: 3343220 - RNA, 21 nt, Human
agcugccuguucagcuccagc

SEQ ID NO: 3343221 - RNA, 21 nt, Human
agcugcuugggcuucauccuc

SEQ ID NO: 3343222 - RNA, 19 nt, Human
agcugccuguucagcucca

SEQ ID NO: 3343223 - RNA, 21 nt, Human
agcugcuuuugucuaugggac

SEQ ID NO: 3343224 - RNA, 15 nt, Human
ugccuuauggaacac

SEQ ID NO: 3343225 - RNA, 16 nt, Human
ugccuuauggaacacu

SEQ ID NO: 3343226 - RNA, 20 nt, Human
ugccuguugggccaggagcc

SEQ ID NO: 3343227 - RNA, 19 nt, Human
ugccuguugggccaggagc

SEQ ID NO: 3343228 - RNA, 20 nt, Human
ugccuguucagcuccagcuc

SEQ ID NO: 3343229 - RNA, 18 nt, Human
ugccuguucagcuccagc

SEQ ID NO: 3343230 - RNA, 13 nt, Human
agcuguucagcug

SEQ ID NO: 3343231 - RNA, 17 nt, Human
ugccuguucagcuccag

SEQ ID NO: 3343232 - RNA, 21 nt, Human
agcugugcucuggacaggcau

SEQ ID NO: 3343233 - RNA, 20 nt, Human
agcugugcucuggacaggca

SEQ ID NO: 3343234 - RNA, 19 nt, Human
agcugugcucuggacaggc

SEQ ID NO: 3343235 - RNA, 20 nt, Human
aggaaggaaacccagcucug

SEQ ID NO: 3343236 - RNA, 22 nt, Human
aggaaggaaacccagcucuggu

SEQ ID NO: 3343237 - RNA, 23 nt, Human
aggaaggaaacccagcucugguc

SEQ ID NO: 3343238 - RNA, 18 nt, Human
aggaagccagcaggcucu

SEQ ID NO: 3343239 - RNA, 18 nt, Human
aggaagccgcuggggcca

SEQ ID NO: 3343240 - RNA, 19 nt, Human
aggaagccgcuggggccag

SEQ ID NO: 3343241 - RNA, 20 nt, Human
aggaagccgcuggggccagu

SEQ ID NO: 3343242 - RNA, 22 nt, Human
aggaagccagcaggcucucagg

SEQ ID NO: 3343243 - RNA, 23 nt, Human
aggaagccagcaggcucucaggc

SEQ ID NO: 3343244 - RNA, 21 nt, Human
aggaagccagcaggcucucag

SEQ ID NO: 3343245 - RNA, 16 nt, Human
aggaagcacaugccuc

SEQ ID NO: 3343246 - RNA, 17 nt, Human
aggaagcacaugccucu

SEQ ID NO: 3343247 - RNA, 11 nt, Human
aggaagcacau

SEQ ID NO: 3343248 - RNA, 15 nt, Human
aggaaaucaccgaaa

SEQ ID NO: 3343249 - RNA, 19 nt, Human
aggaaaucaccgaaaacgu

SEQ ID NO: 3343250 - RNA, 13 nt, Human
aggaaaggcucca

SEQ ID NO: 3343251 - RNA, 14 nt, Human
aggaaaggcuccag

SEQ ID NO: 3343252 - RNA, 15 nt, Human
aggaaaggcuccagg

SEQ ID NO: 3343253 - RNA, 14 nt, Human
ugcucuggacaggc

SEQ ID NO: 3343254 - RNA, 16 nt, Human
ugcucuggacaggcau

SEQ ID NO: 3343255 - RNA, 15 nt, Human
ugcucuggacaggca

SEQ ID NO: 3343256 - RNA, 20 nt, Human
ugcuaucucccccagcccca

SEQ ID NO: 3343257 - RNA, 18 nt, Human
ugcuaucucccccagccc

SEQ ID NO: 3343258 - RNA, 19 nt, Human
ugcuaucucccccagcccc

SEQ ID NO: 3343259 - RNA, 19 nt, Human
ugcugucccuuacgugagu

SEQ ID NO: 3343260 - RNA, 15 nt, Human
ugcugucccuuuucc

SEQ ID NO: 3343261 - RNA, 17 nt, Human
ugcugucccuuacguga

SEQ ID NO: 3343262 - RNA, 20 nt, Human
ugcuucaaggauccugagcc

SEQ ID NO: 3343263 - RNA, 21 nt, Human
ugcuucaaggauccugagcca

SEQ ID NO: 3343264 - RNA, 23 nt, Human
ugcuucaaggauccugagccaga

SEQ ID NO: 3343265 - RNA, 18 nt, Human
aggacacuaaccacgcug

SEQ ID NO: 3343266 - RNA, 13 nt, Human
ugcugcccugccc

SEQ ID NO: 3343267 - RNA, 16 nt, Human
ugcugcccugcccacc

SEQ ID NO: 3343268 - RNA, 17 nt, Human
ugcugcccugcccaccu

SEQ ID NO: 3343269 - RNA, 18 nt, Human
ugcugcccugcccaccug

SEQ ID NO: 3343270 - RNA, 12 nt, Human
ugcugcccugcc

SEQ ID NO: 3343271 - RNA, 11 nt, Human
ugcugcccugu

SEQ ID NO: 3343272 - RNA, 19 nt, Human
ugcugcccugcccaccugg

SEQ ID NO: 3343273 - RNA, 21 nt, Human
ugcugcccugcccaccuggcc

SEQ ID NO: 3343274 - RNA, 21 nt, Human
ugcuggcuguuggcugggggc

SEQ ID NO: 3343275 - RNA, 19 nt, Human
ugcuggcuguuggcugggg

SEQ ID NO: 3343276 - RNA, 19 nt, Human
ugcugggauuacaagcgug

SEQ ID NO: 3343277 - RNA, 18 nt, Human
ugcuggcuguuggcuggg

SEQ ID NO: 3343278 - RNA, 17 nt, Human
ugcugggauuacaggug

SEQ ID NO: 3343279 - RNA, 21 nt, Human
ugcugggauuacaagcgugag

SEQ ID NO: 3343280 - RNA, 23 nt, Human
uggucucaaacucuugaccucag

SEQ ID NO: 3343281 - RNA, 17 nt, Human
uggucucaaacucuuga

SEQ ID NO: 3343282 - RNA, 16 nt, Human
uggucccaccccacac

SEQ ID NO: 3343283 - RNA, 19 nt, Human
uggucuacacugugcugag

SEQ ID NO: 3343284 - RNA, 16 nt, Human
uggucucaaacucuug

SEQ ID NO: 3343285 - RNA, 13 nt, Human
uggucccacccca

SEQ ID NO: 3343286 - RNA, 22 nt, Human
uggucagauuugaacucuucaa

SEQ ID NO: 3343287 - RNA, 18 nt, Human
uggucaccaaaucagcug

SEQ ID NO: 3343288 - RNA, 14 nt, Human
uggucccaccccac

SEQ ID NO: 3343289 - RNA, 15 nt, Human
uggucccaccccaca

SEQ ID NO: 3343290 - RNA, 13 nt, Human
aggguuauaauaa

SEQ ID NO: 3343291 - RNA, 22 nt, Human
aggguguccggucccuguccca

SEQ ID NO: 3343292 - RNA, 21 nt, Human
aggguggugaccucugccuga

SEQ ID NO: 3343293 - RNA, 17 nt, Human
uggucugacccacugcu

SEQ ID NO: 3343294 - RNA, 16 nt, Human
uggucugacccacugc

SEQ ID NO: 3343295 - RNA, 17 nt, Human
agguaugcaaucaaauc

SEQ ID NO: 3343296 - RNA, 21 nt, Human
agguaugcaaucaaaucugcu

SEQ ID NO: 3343297 - RNA, 23 nt, Human
agguagaaauaucugaaaaugua

SEQ ID NO: 3343298 - RNA, 17 nt, Human
aggguuggccccugccc

SEQ ID NO: 3343299 - RNA, 23 nt, Human
aggguuggccccugcccggcugc

SEQ ID NO: 3343300 - RNA, 18 nt, Human
aggguuggccccugcccg

SEQ ID NO: 3343301 - RNA, 19 nt, Human
agguagaaauaucugaaaa

SEQ ID NO: 3343302 - RNA, 17 nt, Human
agguagaaauaucugaa

SEQ ID NO: 3343303 - RNA, 17 nt, Human
aggucauuuuuuuuaag

SEQ ID NO: 3343304 - RNA, 12 nt, Human
aggucagagccu

SEQ ID NO: 3343305 - RNA, 18 nt, Human
aggggugggacacccugu

SEQ ID NO: 3343306 - RNA, 20 nt, Human
aggggugggacacccuguga

SEQ ID NO: 3343307 - RNA, 22 nt, Human
aggggugggacacccugugaug

SEQ ID NO: 3343308 - RNA, 17 nt, Human
aggggguggccucccaa

SEQ ID NO: 3343309 - RNA, 15 nt, Human
aggggguggccuccc

SEQ ID NO: 3343310 - RNA, 22 nt, Human
agggucucacuauguugcccag

SEQ ID NO: 3343311 - RNA, 21 nt, Human
agggucucacuauguugccca

SEQ ID NO: 3343312 - RNA, 20 nt, Human
agggucucacuauguugccc

SEQ ID NO: 3343313 - RNA, 24 nt, Human
agggguucccuuuuuuggcugcug

SEQ ID NO: 3343314 - RNA, 19 nt, Human
uggggucacucuggcagcu

SEQ ID NO: 3343315 - RNA, 16 nt, Human
ugguacuaacuuuccu

SEQ ID NO: 3343316 - RNA, 21 nt, Human
agggucucacucugucgccca

SEQ ID NO: 3343317 - RNA, 22 nt, Human
agggucucacucugucgcccag

SEQ ID NO: 3343318 - RNA, 15 nt, Human
ugggugcuuggagga

SEQ ID NO: 3343319 - RNA, 19 nt, Human
ugggugcuuggaggaagga

SEQ ID NO: 3343320 - RNA, 22 nt, Human
uggguggcaccagcagccugga

SEQ ID NO: 3343321 - RNA, 16 nt, Human
ugggcaacccccagcc

SEQ ID NO: 3343322 - RNA, 18 nt, Human
ugggaggucaaggcugca

SEQ ID NO: 3343323 - RNA, 19 nt, Human
ugggaggucaaggcugcag

SEQ ID NO: 3343324 - RNA, 20 nt, Human
ugggaggucaaggcugcagu

SEQ ID NO: 3343325 - RNA, 23 nt, Human
ugggaggucaaggcugcagugag

SEQ ID NO: 3343326 - RNA, 17 nt, Human
ugggaggucaaggcugc

SEQ ID NO: 3343327 - RNA, 13 nt, Human
ugggccaggagcc

SEQ ID NO: 3343328 - RNA, 14 nt, Human
ugggccaggagccu

SEQ ID NO: 3343329 - RNA, 16 nt, Human
ugggccaggagccucc

SEQ ID NO: 3343330 - RNA, 20 nt, Human
ugggcccaaugcacuuuguu

SEQ ID NO: 3343331 - RNA, 20 nt, Human
ugggcaacccccagccugcu

SEQ ID NO: 3343332 - RNA, 17 nt, Human
ugggcaacccccagccu

SEQ ID NO: 3343333 - RNA, 15 nt, Human
agggagggcuucugc

SEQ ID NO: 3343334 - RNA, 19 nt, Human
agggagugacagaggcagc

SEQ ID NO: 3343335 - RNA, 18 nt, Human
agggagugacagaggcag

SEQ ID NO: 3343336 - RNA, 17 nt, Human
agggagugacagaggca

SEQ ID NO: 3343337 - RNA, 17 nt, Human
agggaggugaccccagg

SEQ ID NO: 3343338 - RNA, 18 nt, Human
agggcccagagagggugg

SEQ ID NO: 3343339 - RNA, 23 nt, Human
agggcccagagaggguggugacc

SEQ ID NO: 3343340 - RNA, 14 nt, Human
uggggaccagagcu

SEQ ID NO: 3343341 - RNA, 15 nt, Human
uggggaccagagcug

SEQ ID NO: 3343342 - RNA, 17 nt, Human
uggggaccagagcugcc

SEQ ID NO: 3343343 - RNA, 18 nt, Human
uggggaccagagcugcca

SEQ ID NO: 3343344 - RNA, 13 nt, Human
uggggaccucagg

SEQ ID NO: 3343345 - RNA, 18 nt, Human
ugggcuggguucuaccca

SEQ ID NO: 3343346 - RNA, 19 nt, Human
ugggcuggguucuacccag

SEQ ID NO: 3343347 - RNA, 20 nt, Human
ugggcucccuucccaccucu

SEQ ID NO: 3343348 - RNA, 18 nt, Human
ugggcucccuucccaccu

SEQ ID NO: 3343349 - RNA, 19 nt, Human
ugggcucccuucccaccuc

SEQ ID NO: 3343350 - RNA, 15 nt, Human
ugggcucccuuccca

SEQ ID NO: 3343351 - RNA, 23 nt, Human
agggcuucugccauuucugagau

SEQ ID NO: 3343352 - RNA, 18 nt, Human
uggggcggugagagggga

SEQ ID NO: 3343353 - RNA, 15 nt, Human
uggggcccugccucc

SEQ ID NO: 3343354 - RNA, 16 nt, Human
uggggcccugccuccu

SEQ ID NO: 3343355 - RNA, 12 nt, Human
uggggagaaagu

SEQ ID NO: 3343356 - RNA, 17 nt, Human
uggggaccucaggccug

SEQ ID NO: 3343357 - RNA, 23 nt, Human
uggggaccucaggccugggggcu

SEQ ID NO: 3343358 - RNA, 14 nt, Human
uggggcccugccuc

SEQ ID NO: 3343359 - RNA, 20 nt, Human
ugggguacccacugcucugg

SEQ ID NO: 3343360 - RNA, 16 nt, Human
ugggguacccacugcu

SEQ ID NO: 3343361 - RNA, 15 nt, Human
ugggguacccacugc

SEQ ID NO: 3343362 - RNA, 17 nt, Human
uggggucacucuggcag

SEQ ID NO: 3343363 - RNA, 18 nt, Human
uggggucacucuggcagc

SEQ ID NO: 3343364 - RNA, 16 nt, Human
uggggucacucuggca

SEQ ID NO: 3343365 - RNA, 14 nt, Human
ugggguacccacug

SEQ ID NO: 3343366 - RNA, 20 nt, Human
uggggcugcaccggcuggcc

SEQ ID NO: 3343367 - RNA, 17 nt, Human
ugucccuuuuccuuuuu

SEQ ID NO: 3343368 - RNA, 13 nt, Human
uguccgagcuuug

SEQ ID NO: 3343369 - RNA, 14 nt, Human
uguccgagcuuuga

SEQ ID NO: 3343370 - RNA, 14 nt, Human
ugucgggcaugaca

SEQ ID NO: 3343371 - RNA, 15 nt, Human
ugucgggcaugacac

SEQ ID NO: 3343372 - RNA, 12 nt, Human
ugucgggcauga

SEQ ID NO: 3343373 - RNA, 15 nt, Human
ugucgcccagucugg

SEQ ID NO: 3343374 - RNA, 14 nt, Human
ugucgcccagucug

SEQ ID NO: 3343375 - RNA, 22 nt, Human
agucagaaguuucugccgcagc

SEQ ID NO: 3343376 - RNA, 23 nt, Human
aguccgaaagggacuuggaagcu

SEQ ID NO: 3343377 - RNA, 17 nt, Human
agucucacuguugccca

SEQ ID NO: 3343378 - RNA, 16 nt, Human
agucucacuguugccc

SEQ ID NO: 3343379 - RNA, 17 nt, Human
aguaggaagacuuugga

SEQ ID NO: 3343380 - RNA, 18 nt, Human
aguaggaagacuuuggaa

SEQ ID NO: 3343381 - RNA, 19 nt, Human
aguaggaagacuuuggaaa

SEQ ID NO: 3343382 - RNA, 22 nt, Human
aguaggaagacuuuggaaagac

SEQ ID NO: 3343383 - RNA, 16 nt, Human
aguaggaagacuuugg

SEQ ID NO: 3343384 - RNA, 14 nt, Human
uguauuuuuuuacu

SEQ ID NO: 3343385 - RNA, 15 nt, Human
ugucaagccauaauu

SEQ ID NO: 3343386 - RNA, 19 nt, Human
ugucaagagggucugagga

SEQ ID NO: 3343387 - RNA, 19 nt, Human
ugucagcugaaccugggua

SEQ ID NO: 3343388 - RNA, 19 nt, Human
agucacugagacagcccgg

SEQ ID NO: 3343389 - RNA, 18 nt, Human
agucacugagacagcccg

SEQ ID NO: 3343390 - RNA, 16 nt, Human
ugucagcugaaccugg

SEQ ID NO: 3343391 - RNA, 13 nt, Human
agucaccaagccc

SEQ ID NO: 3343392 - RNA, 17 nt, Human
aguaugguggcuggguu

SEQ ID NO: 3343393 - RNA, 16 nt, Human
aguacacuguuucaaa

SEQ ID NO: 3343394 - RNA, 14 nt, Human
aguacacuguuuca

SEQ ID NO: 3343395 - RNA, 20 nt, Human
uguaggaagguuaauguuca

SEQ ID NO: 3343396 - RNA, 18 nt, Human
uguaggaagguuaauguu

SEQ ID NO: 3343397 - RNA, 12 nt, Human
aguagagacagg

SEQ ID NO: 3343398 - RNA, 17 nt, Human
aguaauaugcacacauu

SEQ ID NO: 3343399 - RNA, 20 nt, Human
aguaauaugcacacauuuuu

SEQ ID NO: 3343400 - RNA, 18 nt, Human
aguaauaugcacacauuu

SEQ ID NO: 3343401 - RNA, 19 nt, Human
aguaauaugcacacauuuu

SEQ ID NO: 3343402 - RNA, 20 nt, Human
aguaagccgugauuuucauu

SEQ ID NO: 3343403 - RNA, 11 nt, Human
agguuuuccug

SEQ ID NO: 3343404 - RNA, 14 nt, Human
uguaauuugugaua

SEQ ID NO: 3343405 - RNA, 21 nt, Human
uguaccaggaaaggauuuuau

SEQ ID NO: 3343406 - RNA, 13 nt, Human
uguagagugggag

SEQ ID NO: 3343407 - RNA, 22 nt, Human
aggucuugaacuccuggccuca

SEQ ID NO: 3343408 - RNA, 23 nt, Human
aggucuugaacuccuggccucaa

SEQ ID NO: 3343409 - RNA, 15 nt, Human
aggugcacaagcucc

SEQ ID NO: 3343410 - RNA, 16 nt, Human
aggugcacaagcucca

SEQ ID NO: 3343411 - RNA, 17 nt, Human
aggugcacaagcuccaa

SEQ ID NO: 3343412 - RNA, 18 nt, Human
aggugcacaagcuccaag

SEQ ID NO: 3343413 - RNA, 20 nt, Human
aggugcacaagcuccaagcu

SEQ ID NO: 3343414 - RNA, 18 nt, Human
aggugggauccuccaggu

SEQ ID NO: 3343415 - RNA, 20 nt, Human
aggugggauccuccaggugc

SEQ ID NO: 3343416 - RNA, 21 nt, Human
aggugcacaagcuccaagcuc

SEQ ID NO: 3343417 - RNA, 23 nt, Human
uguaauuaaguacuauguaucaa

SEQ ID NO: 3343418 - RNA, 17 nt, Human
uguaacuuucugaaaua

SEQ ID NO: 3343419 - RNA, 14 nt, Human
agguuggugggggc

SEQ ID NO: 3343420 - RNA, 17 nt, Human
aggugguuauggagagg

SEQ ID NO: 3343421 - RNA, 16 nt, Human
agugccaaaaacaaca

SEQ ID NO: 3343422 - RNA, 14 nt, Human
agugccaaaaacaa

SEQ ID NO: 3343423 - RNA, 14 nt, Human
agugcccacaggau

SEQ ID NO: 3343424 - RNA, 24 nt, Human
agugauucuccugccucagccucc

SEQ ID NO: 3343425 - RNA, 22 nt, Human
agugauucuccugccucagccu

SEQ ID NO: 3343426 - RNA, 16 nt, Human
agugagucgaggacag

SEQ ID NO: 3343427 - RNA, 20 nt, Human
ugugcccuaaaguguauuuu

SEQ ID NO: 3343428 - RNA, 21 nt, Human
ugugcccuaaaguguauuuuu

SEQ ID NO: 3343429 - RNA, 19 nt, Human
agucucacuguugcccagg

SEQ ID NO: 3343430 - RNA, 18 nt, Human
agucucacuguugcccag

SEQ ID NO: 3343431 - RNA, 20 nt, Human
agucucacuguugcccaggc

SEQ ID NO: 3343432 - RNA, 15 nt, Human
ugugcucuggacagg

SEQ ID NO: 3343433 - RNA, 23 nt, Human
ugugcucugaucauccacugugc

SEQ ID NO: 3343434 - RNA, 12 nt, Human
ugugcucugauc

SEQ ID NO: 3343435 - RNA, 22 nt, Human
ugugcucugaucauccacugug

SEQ ID NO: 3343436 - RNA, 18 nt, Human
ugugcucuggacaggcau

SEQ ID NO: 3343437 - RNA, 16 nt, Human
ugugcucuggacaggc

SEQ ID NO: 3343438 - RNA, 12 nt, Human
ugugcugcccug

SEQ ID NO: 3343439 - RNA, 13 nt, Human
ugugcugcccugc

SEQ ID NO: 3343440 - RNA, 14 nt, Human
ugugcugcccugcc

SEQ ID NO: 3343441 - RNA, 21 nt, Human
uguggagaagcggcuggcagc

SEQ ID NO: 3343442 - RNA, 15 nt, Human
ugugcugcccugccc

SEQ ID NO: 3343443 - RNA, 22 nt, Human
uguggauuuaacagaaauguac

SEQ ID NO: 3343444 - RNA, 21 nt, Human
uguuaacauggacaugaucuu

SEQ ID NO: 3343445 - RNA, 19 nt, Human
uguuaaugauagcuacugu

SEQ ID NO: 3343446 - RNA, 18 nt, Human
aguggaaaaauagccugc

SEQ ID NO: 3343447 - RNA, 19 nt, Human
aguggaaaaauagccugcc

SEQ ID NO: 3343448 - RNA, 11 nt, Human
aguggaaaaau

SEQ ID NO: 3343449 - RNA, 19 nt, Human
ugugucagguggggcagcu

SEQ ID NO: 3343450 - RNA, 17 nt, Human
ugugucagguggggcag

SEQ ID NO: 3343451 - RNA, 13 nt, Human
ugugucucuuggu

SEQ ID NO: 3343452 - RNA, 14 nt, Human
uguguuaugaagca

SEQ ID NO: 3343453 - RNA, 23 nt, Human
uguguuaucacccagaagaaaau

SEQ ID NO: 3343454 - RNA, 20 nt, Human
ugugguguuuccuggcacug

SEQ ID NO: 3343455 - RNA, 19 nt, Human
ugugucagcauagaaguaa

SEQ ID NO: 3343456 - RNA, 16 nt, Human
uguggucccaccccac

SEQ ID NO: 3343457 - RNA, 16 nt, Human
agugcuuccaaggaug

SEQ ID NO: 3343458 - RNA, 22 nt, Human
agugcugcauuuaaaagauaca

SEQ ID NO: 3343459 - RNA, 20 nt, Human
agugcugggauuacaagcgu

SEQ ID NO: 3343460 - RNA, 19 nt, Human
agugcugggauuacaggug

SEQ ID NO: 3343461 - RNA, 20 nt, Human
agugcugcauuuaaaagaua

SEQ ID NO: 3343462 - RNA, 15 nt, Human
agugccuuacacaau

SEQ ID NO: 3343463 - RNA, 23 nt, Human
aguuccucauuagcauuuugcua

SEQ ID NO: 3343464 - RNA, 16 nt, Human
aguucaauucucauuu

SEQ ID NO: 3343465 - RNA, 14 nt, Human
uguuuauugucaaa

SEQ ID NO: 3343466 - RNA, 20 nt, Human
uguuuagauaauacaccacu

SEQ ID NO: 3343467 - RNA, 19 nt, Human
uguucuugguuuguaaauu

SEQ ID NO: 3343468 - RNA, 20 nt, Human
uguucuugguuuguaaauua

SEQ ID NO: 3343469 - RNA, 22 nt, Human
uguucuugguuuguaaauuaac

SEQ ID NO: 3343470 - RNA, 13 nt, Human
uguugcccaggcu

SEQ ID NO: 3343471 - RNA, 19 nt, Human
uguugcccaggcaggucuu

SEQ ID NO: 3343472 - RNA, 15 nt, Human
uguugcccaggcugg

SEQ ID NO: 3343473 - RNA, 23 nt, Human
aguguugccuaaguauuaaaaca

SEQ ID NO: 3343474 - RNA, 17 nt, Human
aguguugccuaaguauu

SEQ ID NO: 3343475 - RNA, 16 nt, Human
aguguugccuaaguau

SEQ ID NO: 3343476 - RNA, 14 nt, Human
aguguugccuaagu

SEQ ID NO: 3343477 - RNA, 13 nt, Human
aguguugccuaag

SEQ ID NO: 3343478 - RNA, 18 nt, Human
uguucuagcauggcugcc

SEQ ID NO: 3343479 - RNA, 18 nt, Human
uguucuuaguuugcaguu

SEQ ID NO: 3343480 - RNA, 23 nt, Human
aguuuuuauggcuuuugugcauu

SEQ ID NO: 3343481 - RNA, 21 nt, Human
uuaagaaaaaggaugcacaga

SEQ ID NO: 3343482 - RNA, 19 nt, Human
uuaagaaaaaggaugcaca

SEQ ID NO: 3343483 - RNA, 20 nt, Human
uuaagaaaaaggaugcacag

SEQ ID NO: 3343484 - RNA, 22 nt, Human
uuaaucugguuuauuuuuguuc

SEQ ID NO: 3343485 - RNA, 18 nt, Human
uuaaugaaagacuguaca

SEQ ID NO: 3343486 - RNA, 19 nt, Human
uuaaugaaagacuguacaa

SEQ ID NO: 3343487 - RNA, 13 nt, Human
uuaaucauuaggu

SEQ ID NO: 3343488 - RNA, 22 nt, Human
uuaaucauuaggugugacugaa

SEQ ID NO: 3343489 - RNA, 23 nt, Human
uuaaucauuaggugugacugaau

SEQ ID NO: 3343490 - RNA, 9 nt, Human
uuaaggugg

SEQ ID NO: 3343491 - RNA, 22 nt, Human
uuaagaaagacuaucuaaaugu

SEQ ID NO: 3343492 - RNA, 19 nt, Human
uuaagugcugcauuuaaaa

SEQ ID NO: 3343493 - RNA, 22 nt, Human
uuaauauugauaugcuuauaca

SEQ ID NO: 3343494 - RNA, 15 nt, Human
uuaagugcugcauuu

SEQ ID NO: 3343495 - RNA, 16 nt, Human
uuaagugcugcauuua

SEQ ID NO: 3343496 - RNA, 14 nt, Human
uuaagugcugcauu

SEQ ID NO: 3343497 - RNA, 19 nt, Human
uuaacagaaauguacagca

SEQ ID NO: 3343498 - RNA, 16 nt, Human
uuaacagaaauguaca

SEQ ID NO: 3343499 - RNA, 20 nt, Human
uuaacagaaauguacagcaa

SEQ ID NO: 3343500 - RNA, 13 nt, Human
uuaaauaauguga

SEQ ID NO: 3343501 - RNA, 16 nt, Human
uuaaauaaugugaaac

SEQ ID NO: 3343502 - RNA, 18 nt, Human
uuaaauaaugugaaacug

SEQ ID NO: 3343503 - RNA, 15 nt, Human
uuaaauaaugugaaa

SEQ ID NO: 3343504 - RNA, 16 nt, Human
uuaaaaaucucaaauu

SEQ ID NO: 3343505 - RNA, 14 nt, Human
uuaaaaaucucaaa

SEQ ID NO: 3343506 - RNA, 15 nt, Human
uuaaaaaucucaaau

SEQ ID NO: 3343507 - RNA, 19 nt, Human
aguugggcuuccucauagu

SEQ ID NO: 3343508 - RNA, 13 nt, Human
aguugggcuuccu

SEQ ID NO: 3343509 - RNA, 23 nt, Human
aguugccagucaccccggccacc

SEQ ID NO: 3343510 - RNA, 20 nt, Human
aguugccagucaccccggcc

SEQ ID NO: 3343511 - RNA, 13 nt, Human
uuaaaaaaaaucc

SEQ ID NO: 3343512 - RNA, 17 nt, Human
aguuggucccccuucca

SEQ ID NO: 3343513 - RNA, 11 nt, Human
aguuggucccc

SEQ ID NO: 3343514 - RNA, 13 nt, Human
aguuggucccccu

SEQ ID NO: 3343515 - RNA, 18 nt, Human
auaauacaccacuacauu

SEQ ID NO: 3343516 - RNA, 20 nt, Human
auaauacaccacuacauucu

SEQ ID NO: 3343517 - RNA, 12 nt, Human
auaauacaccac

SEQ ID NO: 3343518 - RNA, 22 nt, Human
auaauugacaggauuauuggaa

SEQ ID NO: 3343519 - RNA, 15 nt, Human
auaaugcgugcauac

SEQ ID NO: 3343520 - RNA, 15 nt, Human
auaaugaaugaaaca

SEQ ID NO: 3343521 - RNA, 15 nt, Human
uuaggugaggaagca

SEQ ID NO: 3343522 - RNA, 20 nt, Human
uuagggaaggauacaaaagc

SEQ ID NO: 3343523 - RNA, 16 nt, Human
uuaggugugacugaau

SEQ ID NO: 3343524 - RNA, 16 nt, Human
uuaggugaggaagcaa

SEQ ID NO: 3343525 - RNA, 18 nt, Human
uuagguuggcaaaaaggc

SEQ ID NO: 3343526 - RNA, 22 nt, Human
uuaguuugcaguuacacuaaaa

SEQ ID NO: 3343527 - RNA, 15 nt, Human
uuaguuucuccaagc

SEQ ID NO: 3343528 - RNA, 18 nt, Human
uuagcaaauucuguuuuu

SEQ ID NO: 3343529 - RNA, 18 nt, Human
uuagccaagugugguaga

SEQ ID NO: 3343530 - RNA, 19 nt, Human
uuacccucauguucuuaau

SEQ ID NO: 3343531 - RNA, 22 nt, Human
uuacaggaaguacuggagaaaa

SEQ ID NO: 3343532 - RNA, 13 nt, Human
uuagacagucccu

SEQ ID NO: 3343533 - RNA, 20 nt, Human
uuagacagagucucacuguu

SEQ ID NO: 3343534 - RNA, 13 nt, Human
uuagacagagucu

SEQ ID NO: 3343535 - RNA, 11 nt, Human
auaaauuauuu

SEQ ID NO: 3343536 - RNA, 20 nt, Human
auaaccaguguuguggauuu

SEQ ID NO: 3343537 - RNA, 14 nt, Human
acauggccuuugcu

SEQ ID NO: 3343538 - RNA, 19 nt, Human
acauggaguauaugucaag

SEQ ID NO: 3343539 - RNA, 15 nt, Human
acauggaguauaugu

SEQ ID NO: 3343540 - RNA, 18 nt, Human
acauggaauaacauguaa

SEQ ID NO: 3343541 - RNA, 14 nt, Human
acauggaaguacua

SEQ ID NO: 3343542 - RNA, 20 nt, Human
acauggaauaacauguaauu

SEQ ID NO: 3343543 - RNA, 20 nt, Human
acaugagcaucaggccaggc

SEQ ID NO: 3343544 - RNA, 23 nt, Human
acaugagcaucaggccaggcccu

SEQ ID NO: 3343545 - RNA, 23 nt, Human
acaugaaaacacauuuuucuuag

SEQ ID NO: 3343546 - RNA, 22 nt, Human
acaugaaaacacauuuuucuua

SEQ ID NO: 3343547 - RNA, 13 nt, Human
ucaaagauauuuu

SEQ ID NO: 3343548 - RNA, 20 nt, Human
ucaaagauauuuugcuuugu

SEQ ID NO: 3343549 - RNA, 22 nt, Human
ucaaagauauuuugcuuuguga

SEQ ID NO: 3343550 - RNA, 23 nt, Human
ucaaagagguuuuaaaaaaaucc

SEQ ID NO: 3343551 - RNA, 16 nt, Human
ucaaaagcugggcagg

SEQ ID NO: 3343552 - RNA, 20 nt, Human
uauuuugcuuugugauuuuu

SEQ ID NO: 3343553 - RNA, 13 nt, Human
uauuuugcuuugu

SEQ ID NO: 3343554 - RNA, 15 nt, Human
uauuuugcuuuguga

SEQ ID NO: 3343555 - RNA, 17 nt, Human
uauuuuuguagagccag

SEQ ID NO: 3343556 - RNA, 15 nt, Human
acaugaaaacacauu

SEQ ID NO: 3343557 - RNA, 22 nt, Human
acaucuugcucugcugacagac

SEQ ID NO: 3343558 - RNA, 19 nt, Human
acaucuuggucagauuuga

SEQ ID NO: 3343559 - RNA, 14 nt, Human
acaucuugcucugc

SEQ ID NO: 3343560 - RNA, 16 nt, Human
acaucuugcucugcug

SEQ ID NO: 3343561 - RNA, 15 nt, Human
acaucuugcucugcu

SEQ ID NO: 3343562 - RNA, 17 nt, Human
ucaagagggucugagga

SEQ ID NO: 3343563 - RNA, 23 nt, Human
ucaaggauccugagccagauuuc

SEQ ID NO: 3343564 - RNA, 18 nt, Human
ucaauaggaaaaacugau

SEQ ID NO: 3343565 - RNA, 19 nt, Human
ucaauaggaaaaacugauu

SEQ ID NO: 3343566 - RNA, 17 nt, Human
ucaauaggaaaaacuga

SEQ ID NO: 3343567 - RNA, 17 nt, Human
ucaagugauucuccugc

SEQ ID NO: 3343568 - RNA, 16 nt, Human
ucaagugauucuccug

SEQ ID NO: 3343569 - RNA, 22 nt, Human
ucaauaggaaaaacugauuuuu

SEQ ID NO: 3343570 - RNA, 15 nt, Human
acauuuuuaagugcu

SEQ ID NO: 3343571 - RNA, 18 nt, Human
acauuuuuaagugcugca

SEQ ID NO: 3343572 - RNA, 13 nt, Human
acauuuuucuuag

SEQ ID NO: 3343573 - RNA, 21 nt, Human
acauuuuuuaaaugcaccugg

SEQ ID NO: 3343574 - RNA, 22 nt, Human
acauugcggacagccacggcca

SEQ ID NO: 3343575 - RNA, 21 nt, Human
acauugcggacagccacggcc

SEQ ID NO: 3343576 - RNA, 18 nt, Human
acauuggauuauccugag

SEQ ID NO: 3343577 - RNA, 16 nt, Human
acauuggauuauccug

SEQ ID NO: 3343578 - RNA, 23 nt, Human
accacacccagcccacuucugcc

SEQ ID NO: 3343579 - RNA, 21 nt, Human
accacacccagcccacuucug

SEQ ID NO: 3343580 - RNA, 20 nt, Human
accacacccagcccacuucu

SEQ ID NO: 3343581 - RNA, 16 nt, Human
accacacccagcccac

SEQ ID NO: 3343582 - RNA, 15 nt, Human
accacacccagccca

SEQ ID NO: 3343583 - RNA, 17 nt, Human
accacacagaggcugcc

SEQ ID NO: 3343584 - RNA, 20 nt, Human
accaaccacugcgaccacaa

SEQ ID NO: 3343585 - RNA, 16 nt, Human
accaacauacucccau

SEQ ID NO: 3343586 - RNA, 19 nt, Human
accaaaucagcugcuacua

SEQ ID NO: 3343587 - RNA, 16 nt, Human
accaaaucagcugcua

SEQ ID NO: 3343588 - RNA, 16 nt, Human
ucacauauugauuucc

SEQ ID NO: 3343589 - RNA, 18 nt, Human
ucacauauugauuuccgu

SEQ ID NO: 3343590 - RNA, 20 nt, Human
ucacauauugauuuccguua

SEQ ID NO: 3343591 - RNA, 16 nt, Human
ucaccagccccagugc

SEQ ID NO: 3343592 - RNA, 17 nt, Human
ucaccagccccagugcc

SEQ ID NO: 3343593 - RNA, 14 nt, Human
ucacagaugggugc

SEQ ID NO: 3343594 - RNA, 15 nt, Human
ucacagaugggugcu

SEQ ID NO: 3343595 - RNA, 19 nt, Human
acccgcuaagagggaggga

SEQ ID NO: 3343596 - RNA, 19 nt, Human
ucaggguuggccccugccc

SEQ ID NO: 3343597 - RNA, 18 nt, Human
ucaggguuggccccugcc

SEQ ID NO: 3343598 - RNA, 19 nt, Human
ucaggccaggcccucugcc

SEQ ID NO: 3343599 - RNA, 17 nt, Human
ucaggccaggcccucug

SEQ ID NO: 3343600 - RNA, 18 nt, Human
ucaggccaggcccucugc

SEQ ID NO: 3343601 - RNA, 12 nt, Human
ucaggggugugc

SEQ ID NO: 3343602 - RNA, 19 nt, Human
ucaggggugugcggccuuu

SEQ ID NO: 3343603 - RNA, 17 nt, Human
ucaggguuggccccugc

SEQ ID NO: 3343604 - RNA, 13 nt, Human
ucaggccagcugc

SEQ ID NO: 3343605 - RNA, 12 nt, Human
ucaggccaggcc

SEQ ID NO: 3343606 - RNA, 13 nt, Human
ucaggccaggccc

SEQ ID NO: 3343607 - RNA, 14 nt, Human
ucaggccaggcccu

SEQ ID NO: 3343608 - RNA, 15 nt, Human
ucaggccaggcccuc

SEQ ID NO: 3343609 - RNA, 16 nt, Human
ucaggccaggcccucu

SEQ ID NO: 3343610 - RNA, 12 nt, Human
acccccagccug

SEQ ID NO: 3343611 - RNA, 13 nt, Human
acccccagccugc

SEQ ID NO: 3343612 - RNA, 23 nt, Human
ucaggccaaacucaccugccccu

SEQ ID NO: 3343613 - RNA, 18 nt, Human
ucaggcaggugggaugga

SEQ ID NO: 3343614 - RNA, 17 nt, Human
ucaggcaggugggaugg

SEQ ID NO: 3343615 - RNA, 23 nt, Human
acccugaggcccagagggccugc

SEQ ID NO: 3343616 - RNA, 11 nt, Human
acccugaggcc

SEQ ID NO: 3343617 - RNA, 17 nt, Human
acccugaggcccagagg

SEQ ID NO: 3343618 - RNA, 19 nt, Human
acccugaggcccagagggc

SEQ ID NO: 3343619 - RNA, 21 nt, Human
acccugaggcccagagggccu

SEQ ID NO: 3343620 - RNA, 19 nt, Human
acccgggaagggggcuggg

SEQ ID NO: 3343621 - RNA, 20 nt, Human
acccgggaagggggcuggga

SEQ ID NO: 3343622 - RNA, 13 nt, Human
acccgggaagggg

SEQ ID NO: 3343623 - RNA, 15 nt, Human
acccucauguucuua

SEQ ID NO: 3343624 - RNA, 17 nt, Human
acccucauguucuuaau

SEQ ID NO: 3343625 - RNA, 14 nt, Human
acccucauguucuu

SEQ ID NO: 3343626 - RNA, 22 nt, Human
acccgggaagggggcugggaca

SEQ ID NO: 3343627 - RNA, 21 nt, Human
acccuccuuucaccacaugug

SEQ ID NO: 3343628 - RNA, 21 nt, Human
ucagguggggucacucuggca

SEQ ID NO: 3343629 - RNA, 22 nt, Human
ucagguggggucacucuggcag

SEQ ID NO: 3343630 - RNA, 21 nt, Human
accgaaaacguggcugcuuca

SEQ ID NO: 3343631 - RNA, 22 nt, Human
accgaaaacguggcugcuucaa

SEQ ID NO: 3343632 - RNA, 18 nt, Human
ucaggugucccugcacuu

SEQ ID NO: 3343633 - RNA, 17 nt, Human
ucaggugucccugcacu

SEQ ID NO: 3343634 - RNA, 23 nt, Human
ucagguggggucacucuggcagc

SEQ ID NO: 3343635 - RNA, 15 nt, Human
ucaggugucccugca

SEQ ID NO: 3343636 - RNA, 20 nt, Human
accgaaaacguggcugcuuc

SEQ ID NO: 3343637 - RNA, 20 nt, Human
acccuugccgucuaccugag

SEQ ID NO: 3343638 - RNA, 13 nt, Human
ucaguaauaacuc

SEQ ID NO: 3343639 - RNA, 13 nt, Human
ucaguaagccgug

SEQ ID NO: 3343640 - RNA, 22 nt, Human
ucaggugucccugcacuugcag

SEQ ID NO: 3343641 - RNA, 19 nt, Human
ucaguuguuagugugucuu

SEQ ID NO: 3343642 - RNA, 18 nt, Human
ucagugccuuauggaaca

SEQ ID NO: 3343643 - RNA, 13 nt, Human
ucaguggcagcug

SEQ ID NO: 3343644 - RNA, 17 nt, Human
ucaguuguuaguguguc

SEQ ID NO: 3343645 - RNA, 15 nt, Human
ucaguggcagcugcu

SEQ ID NO: 3343646 - RNA, 14 nt, Human
ucaguggcagcugc

SEQ ID NO: 3343647 - RNA, 19 nt, Human
ucagugccuuauggaacac

SEQ ID NO: 3343648 - RNA, 20 nt, Human
ucagugccuuauggaacacu

SEQ ID NO: 3343649 - RNA, 22 nt, Human
ucagugccuuauggaacacucu

SEQ ID NO: 3343650 - RNA, 23 nt, Human
ucagugccuuauggaacacucug

SEQ ID NO: 3343651 - RNA, 23 nt, Human
ucagaaguuucugccgcagcccu

SEQ ID NO: 3343652 - RNA, 22 nt, Human
ucagagacuccugcaggcagcc

SEQ ID NO: 3343653 - RNA, 12 nt, Human
ucagaauucuca

SEQ ID NO: 3343654 - RNA, 10 nt, Human
ucagaauucu

SEQ ID NO: 3343655 - RNA, 20 nt, Human
ucagaauucucagaaucuca

SEQ ID NO: 3343656 - RNA, 23 nt, Human
ucagagagggugggagugggccc

SEQ ID NO: 3343657 - RNA, 23 nt, Human
ucagagacuccugcaggcagcca

SEQ ID NO: 3343658 - RNA, 16 nt, Human
ucagaucucuaacuuc

SEQ ID NO: 3343659 - RNA, 15 nt, Human
ucagaucucuaacuu

SEQ ID NO: 3343660 - RNA, 11 nt, Human
acccaggugcu

SEQ ID NO: 3343661 - RNA, 13 nt, Human
accccagguuucu

SEQ ID NO: 3343662 - RNA, 15 nt, Human
acccaggagccccga

SEQ ID NO: 3343663 - RNA, 13 nt, Human
acccaggagcccc

SEQ ID NO: 3343664 - RNA, 16 nt, Human
acccagcgagcccugg

SEQ ID NO: 3343665 - RNA, 13 nt, Human
acccagcgagccc

SEQ ID NO: 3343666 - RNA, 15 nt, Human
ucacuguugcccagg

SEQ ID NO: 3343667 - RNA, 14 nt, Human
ucacuguugcccag

SEQ ID NO: 3343668 - RNA, 18 nt, Human
ucacugcaaccuccgccu

SEQ ID NO: 3343669 - RNA, 23 nt, Human
ucacugagacagcccgggcucug

SEQ ID NO: 3343670 - RNA, 22 nt, Human
ucacugagacagcccgggcucu

SEQ ID NO: 3343671 - RNA, 21 nt, Human
ucacuauguugcccaggcagg

SEQ ID NO: 3343672 - RNA, 20 nt, Human
ucacuauguugcccaggcag

SEQ ID NO: 3343673 - RNA, 22 nt, Human
ucaccagccccagugcccacag

SEQ ID NO: 3343674 - RNA, 20 nt, Human
accauucuccaccugccagg

SEQ ID NO: 3343675 - RNA, 21 nt, Human
accauucuccaccugccaggg

SEQ ID NO: 3343676 - RNA, 19 nt, Human
accauucuccaccugccag

SEQ ID NO: 3343677 - RNA, 18 nt, Human
accauucuccaccugcca

SEQ ID NO: 3343678 - RNA, 22 nt, Human
accauuuugcugucccuuuucc

SEQ ID NO: 3343679 - RNA, 23 nt, Human
accauuuugcugucccuuuuccu

SEQ ID NO: 3343680 - RNA, 21 nt, Human
accauuuugggguacccacug

SEQ ID NO: 3343681 - RNA, 20 nt, Human
acccacugcuuuuggucugu

SEQ ID NO: 3343682 - RNA, 11 nt, Human
acccacugcuu

SEQ ID NO: 3343683 - RNA, 15 nt, Human
accauggacuuuaua

SEQ ID NO: 3343684 - RNA, 14 nt, Human
accauggacuuuau

SEQ ID NO: 3343685 - RNA, 16 nt, Human
accauggacuuuauaa

SEQ ID NO: 3343686 - RNA, 13 nt, Human
acguacacauuuu

SEQ ID NO: 3343687 - RNA, 12 nt, Human
acguacacauuu

SEQ ID NO: 3343688 - RNA, 13 nt, Human
acguacacacaca

SEQ ID NO: 3343689 - RNA, 18 nt, Human
acuacggaauaguuggcu

SEQ ID NO: 3343690 - RNA, 14 nt, Human
acucaaugcacuga

SEQ ID NO: 3343691 - RNA, 20 nt, Human
acucacauuuauucugcuca

SEQ ID NO: 3343692 - RNA, 19 nt, Human
acucacauuuauucugcuc

SEQ ID NO: 3343693 - RNA, 12 nt, Human
acuauguaucaa

SEQ ID NO: 3343694 - RNA, 14 nt, Human
acuauaauguaagc

SEQ ID NO: 3343695 - RNA, 13 nt, Human
acuauaauguaag

SEQ ID NO: 3343696 - RNA, 11 nt, Human
acuauaaugua

SEQ ID NO: 3343697 - RNA, 12 nt, Human
acuauaauguaa

SEQ ID NO: 3343698 - RNA, 13 nt, Human
ucccucuuucccu

SEQ ID NO: 3343699 - RNA, 11 nt, Human
ucccucuuucc

SEQ ID NO: 3343700 - RNA, 18 nt, Human
ucccucagucuggcccuu

SEQ ID NO: 3343701 - RNA, 21 nt, Human
ucccucuuucccucccuuccu

SEQ ID NO: 3343702 - RNA, 21 nt, Human
ucccugaaggccccgcccagg

SEQ ID NO: 3343703 - RNA, 22 nt, Human
ucccugaaggccccgcccaggc

SEQ ID NO: 3343704 - RNA, 18 nt, Human
ucccugaaggccccgccc

SEQ ID NO: 3343705 - RNA, 17 nt, Human
ucccugaaggccccgcc

SEQ ID NO: 3343706 - RNA, 17 nt, Human
acucaccccagccccaa

SEQ ID NO: 3343707 - RNA, 16 nt, Human
acucaccccagcccca

SEQ ID NO: 3343708 - RNA, 23 nt, Human
ucccugaaggccccgcccaggcu

SEQ ID NO: 3343709 - RNA, 12 nt, Human
acucaucuuagg

SEQ ID NO: 3343710 - RNA, 16 nt, Human
acucauugaccugagg

SEQ ID NO: 3343711 - RNA, 17 nt, Human
acucauugaccugaggc

SEQ ID NO: 3343712 - RNA, 18 nt, Human
acucauugaccugaggcc

SEQ ID NO: 3343713 - RNA, 15 nt, Human
acucauugaccugag

SEQ ID NO: 3343714 - RNA, 17 nt, Human
acucagaagacacugau

SEQ ID NO: 3343715 - RNA, 16 nt, Human
acucagaagacacuga

SEQ ID NO: 3343716 - RNA, 15 nt, Human
acucagaagacacug

SEQ ID NO: 3343717 - RNA, 14 nt, Human
acucagaagacacu

SEQ ID NO: 3343718 - RNA, 14 nt, Human
acucaccugccccu

SEQ ID NO: 3343719 - RNA, 19 nt, Human
acucaccugccccucaacu

SEQ ID NO: 3343720 - RNA, 21 nt, Human
acucaccugccccucaacucu

SEQ ID NO: 3343721 - RNA, 18 nt, Human
acucagaagacacugaug

SEQ ID NO: 3343722 - RNA, 21 nt, Human
acucagaauucucuaguuuga

SEQ ID NO: 3343723 - RNA, 22 nt, Human
acucagaauucucuaguuugau

SEQ ID NO: 3343724 - RNA, 14 nt, Human
acucagaauucucu

SEQ ID NO: 3343725 - RNA, 21 nt, Human
uccuagccugugccucuggga

SEQ ID NO: 3343726 - RNA, 20 nt, Human
uccuagcacuuugggaggcc

SEQ ID NO: 3343727 - RNA, 16 nt, Human
acucgaguuacagaca

SEQ ID NO: 3343728 - RNA, 15 nt, Human
uccguuaaaauacca

SEQ ID NO: 3343729 - RNA, 13 nt, Human
uccguuaaaauac

SEQ ID NO: 3343730 - RNA, 19 nt, Human
acucuggcagcucagagag

SEQ ID NO: 3343731 - RNA, 19 nt, Human
acucuuauugcccacgcug

SEQ ID NO: 3343732 - RNA, 21 nt, Human
acucuuauugcccacgcugga

SEQ ID NO: 3343733 - RNA, 16 nt, Human
acucuggcagcucaga

SEQ ID NO: 3343734 - RNA, 17 nt, Human
acucuggcagcucagag

SEQ ID NO: 3343735 - RNA, 15 nt, Human
acucgcgacaaugca

SEQ ID NO: 3343736 - RNA, 16 nt, Human
acucgcgacaaugcaa

SEQ ID NO: 3343737 - RNA, 14 nt, Human
uccucccaccucag

SEQ ID NO: 3343738 - RNA, 13 nt, Human
uccucccaccuca

SEQ ID NO: 3343739 - RNA, 20 nt, Human
uccucccaccucagccuccc

SEQ ID NO: 3343740 - RNA, 18 nt, Human
uccucccaccucagccuc

SEQ ID NO: 3343741 - RNA, 16 nt, Human
uccucccaccucagcc

SEQ ID NO: 3343742 - RNA, 15 nt, Human
uccucccaccucagc

SEQ ID NO: 3343743 - RNA, 21 nt, Human
uccucccaccucagccucccg

SEQ ID NO: 3343744 - RNA, 19 nt, Human
acucuuucuauuguuucuu

SEQ ID NO: 3343745 - RNA, 15 nt, Human
uccugaagaauugaa

SEQ ID NO: 3343746 - RNA, 23 nt, Human
uccucuuuggucuacacugugcu

SEQ ID NO: 3343747 - RNA, 11 nt, Human
ucccaccccac

SEQ ID NO: 3343748 - RNA, 16 nt, Human
ucccaaagugcuggga

SEQ ID NO: 3343749 - RNA, 15 nt, Human
ucccaaagugcuggg

SEQ ID NO: 3343750 - RNA, 14 nt, Human
ucccaaagugcugg

SEQ ID NO: 3343751 - RNA, 14 nt, Human
ucccacaaaggaga

SEQ ID NO: 3343752 - RNA, 14 nt, Human
acggcucacugcag

SEQ ID NO: 3343753 - RNA, 17 nt, Human
uccagugaggcucugcc

SEQ ID NO: 3343754 - RNA, 18 nt, Human
uccagugaggcucugccc

SEQ ID NO: 3343755 - RNA, 19 nt, Human
uccagugaggcucugcccu

SEQ ID NO: 3343756 - RNA, 20 nt, Human
uccagugaggcucugcccuu

SEQ ID NO: 3343757 - RNA, 15 nt, Human
uccaugaguccccug

SEQ ID NO: 3343758 - RNA, 16 nt, Human
uccaugaguccccugu

SEQ ID NO: 3343759 - RNA, 17 nt, Human
uccaugaguccccuguu

SEQ ID NO: 3343760 - RNA, 18 nt, Human
acgccaggggaaaaucag

SEQ ID NO: 3343761 - RNA, 15 nt, Human
acgacugcccggcag

SEQ ID NO: 3343762 - RNA, 23 nt, Human
acgccaggggaaaaucagccugc

SEQ ID NO: 3343763 - RNA, 11 nt, Human
acgccauccca

SEQ ID NO: 3343764 - RNA, 14 nt, Human
acgccaucccagcc

SEQ ID NO: 3343765 - RNA, 15 nt, Human
acgccaucccagccc

SEQ ID NO: 3343766 - RNA, 16 nt, Human
acgccaucccagcccc

SEQ ID NO: 3343767 - RNA, 17 nt, Human
acgccaucccagcccca

SEQ ID NO: 3343768 - RNA, 18 nt, Human
acgccaucccagccccaa

SEQ ID NO: 3343769 - RNA, 14 nt, Human
uccaggcugggaga

SEQ ID NO: 3343770 - RNA, 17 nt, Human
uccaggcugggagagcc

SEQ ID NO: 3343771 - RNA, 18 nt, Human
uccaggcugggagagccu

SEQ ID NO: 3343772 - RNA, 22 nt, Human
uccaggcuccuuuagcgcccag

SEQ ID NO: 3343773 - RNA, 16 nt, Human
acggccaggccagagg

SEQ ID NO: 3343774 - RNA, 13 nt, Human
acggccaggccag

SEQ ID NO: 3343775 - RNA, 19 nt, Human
acggagucccaccuuggcu

SEQ ID NO: 3343776 - RNA, 14 nt, Human
acgcccccacuggu

SEQ ID NO: 3343777 - RNA, 23 nt, Human
acgcgugcacacaccagagccca

SEQ ID NO: 3343778 - RNA, 20 nt, Human
acgcgugcacacaccagagc

SEQ ID NO: 3343779 - RNA, 13 nt, Human
acgcuacccggga

SEQ ID NO: 3343780 - RNA, 17 nt, Human
acgcuacccgggaaggg

SEQ ID NO: 3343781 - RNA, 16 nt, Human
accuuuuuuauacaua

SEQ ID NO: 3343782 - RNA, 17 nt, Human
accuuuuuuauacauaa

SEQ ID NO: 3343783 - RNA, 18 nt, Human
accuuuuuuauacauaaa

SEQ ID NO: 3343784 - RNA, 14 nt, Human
accuuuguccccac

SEQ ID NO: 3343785 - RNA, 15 nt, Human
accuuuguccccacc

SEQ ID NO: 3343786 - RNA, 14 nt, Human
accuuuuuuauaca

SEQ ID NO: 3343787 - RNA, 16 nt, Human
accuuuguccccaccg

SEQ ID NO: 3343788 - RNA, 13 nt, Human
accuuugucccca

SEQ ID NO: 3343789 - RNA, 16 nt, Human
accuugacagggcaca

SEQ ID NO: 3343790 - RNA, 22 nt, Human
accuucuccuucaccuuugucc

SEQ ID NO: 3343791 - RNA, 14 nt, Human
accuucuccuucac

SEQ ID NO: 3343792 - RNA, 12 nt, Human
accuggccucug

SEQ ID NO: 3343793 - RNA, 13 nt, Human
accuggccucugc

SEQ ID NO: 3343794 - RNA, 17 nt, Human
uccacccaggagccccg

SEQ ID NO: 3343795 - RNA, 13 nt, Human
uccacccaccuca

SEQ ID NO: 3343796 - RNA, 18 nt, Human
uccaccaucaagccacca

SEQ ID NO: 3343797 - RNA, 12 nt, Human
uccacccaccuc

SEQ ID NO: 3343798 - RNA, 20 nt, Human
uccacccaggagccccgagg

SEQ ID NO: 3343799 - RNA, 17 nt, Human
accuggaauauauaacc

SEQ ID NO: 3343800 - RNA, 20 nt, Human
accuggaauauauaaccagu

SEQ ID NO: 3343801 - RNA, 23 nt, Human
accugccuguugggccaggagcc

SEQ ID NO: 3343802 - RNA, 21 nt, Human
accugcgucucauacucaccu

SEQ ID NO: 3343803 - RNA, 16 nt, Human
accugcggugcuaucu

SEQ ID NO: 3343804 - RNA, 23 nt, Human
accugcggugcuaucucccccag

SEQ ID NO: 3343805 - RNA, 14 nt, Human
ucauuugucacaca

SEQ ID NO: 3343806 - RNA, 16 nt, Human
ucauuugucacacacu

SEQ ID NO: 3343807 - RNA, 19 nt, Human
ucauuuuuaguagagacag

SEQ ID NO: 3343808 - RNA, 18 nt, Human
ucauuuuuuuuaagaaaa

SEQ ID NO: 3343809 - RNA, 17 nt, Human
ucauuuuuuuuaagaaa

SEQ ID NO: 3343810 - RNA, 22 nt, Human
accugaggcccuucucuccagc

SEQ ID NO: 3343811 - RNA, 14 nt, Human
accugaggggccuc

SEQ ID NO: 3343812 - RNA, 15 nt, Human
accugccaggaagcc

SEQ ID NO: 3343813 - RNA, 18 nt, Human
accugccaggaagccagc

SEQ ID NO: 3343814 - RNA, 16 nt, Human
accugccaggaagcca

SEQ ID NO: 3343815 - RNA, 17 nt, Human
accugccaggaagccag

SEQ ID NO: 3343816 - RNA, 19 nt, Human
accugaauuuuggcugugu

SEQ ID NO: 3343817 - RNA, 18 nt, Human
accugaagacucauucuu

SEQ ID NO: 3343818 - RNA, 12 nt, Human
ucauaaugacuu

SEQ ID NO: 3343819 - RNA, 23 nt, Human
accugaggcccuucucuccagcc

SEQ ID NO: 3343820 - RNA, 21 nt, Human
ucuacccucuuagaaaaacca

SEQ ID NO: 3343821 - RNA, 14 nt, Human
ucuacccaggugcu

SEQ ID NO: 3343822 - RNA, 13 nt, Human
ucuaaaggcuacc

SEQ ID NO: 3343823 - RNA, 16 nt, Human
ucuaaaggcuaccuuu

SEQ ID NO: 3343824 - RNA, 16 nt, Human
ucuaaagcugccagcc

SEQ ID NO: 3343825 - RNA, 17 nt, Human
ucuaaagcugccagccg

SEQ ID NO: 3343826 - RNA, 22 nt, Human
ucuaacuucaccauauuaccac

SEQ ID NO: 3343827 - RNA, 17 nt, Human
acuguuaauaguucagg

SEQ ID NO: 3343828 - RNA, 21 nt, Human
acuguuaauaguucagguaac

SEQ ID NO: 3343829 - RNA, 20 nt, Human
acuguacaugaaaacacauu

SEQ ID NO: 3343830 - RNA, 14 nt, Human
acuguaucaugaca

SEQ ID NO: 3343831 - RNA, 19 nt, Human
acuguacaugaaaacacau

SEQ ID NO: 3343832 - RNA, 16 nt, Human
acuguacaugaaaaca

SEQ ID NO: 3343833 - RNA, 22 nt, Human
acuguacaaaguagaagucuua

SEQ ID NO: 3343834 - RNA, 16 nt, Human
acuguacaaaguagaa

SEQ ID NO: 3343835 - RNA, 17 nt, Human
acuggguacuuguggac

SEQ ID NO: 3343836 - RNA, 15 nt, Human
acuguacaaaguaga

SEQ ID NO: 3343837 - RNA, 16 nt, Human
acuguaucaugacaaa

SEQ ID NO: 3343838 - RNA, 20 nt, Human
acuguaucaugacaaagacu

SEQ ID NO: 3343839 - RNA, 23 nt, Human
acuguccuacccacccuccuuuc

SEQ ID NO: 3343840 - RNA, 14 nt, Human
ucgcuccugugucu

SEQ ID NO: 3343841 - RNA, 15 nt, Human
acuggguacuugugg

SEQ ID NO: 3343842 - RNA, 21 nt, Human
acugggcuuggggaccagagc

SEQ ID NO: 3343843 - RNA, 13 nt, Human
ucuagccagagga

SEQ ID NO: 3343844 - RNA, 24 nt, Human
ucuagauacuguaucaugacaaag

SEQ ID NO: 3343845 - RNA, 13 nt, Human
ucuagauacugua

SEQ ID NO: 3343846 - RNA, 22 nt, Human
ucuaguuugauuaaauucuugc

SEQ ID NO: 3343847 - RNA, 23 nt, Human
ucuaguuugauuaaauucuugca

SEQ ID NO: 3343848 - RNA, 16 nt, Human
acuucaucccucuggg

SEQ ID NO: 3343849 - RNA, 17 nt, Human
acuuccacugccauccu

SEQ ID NO: 3343850 - RNA, 18 nt, Human
acuuccaauuuacauacu

SEQ ID NO: 3343851 - RNA, 13 nt, Human
acuuacuguacau

SEQ ID NO: 3343852 - RNA, 14 nt, Human
acuuacuguacaug

SEQ ID NO: 3343853 - RNA, 15 nt, Human
acuuacuguacauga

SEQ ID NO: 3343854 - RNA, 20 nt, Human
acuuagagguggggagcaga

SEQ ID NO: 3343855 - RNA, 12 nt, Human
ucuaccugaggg

SEQ ID NO: 3343856 - RNA, 19 nt, Human
ucuaccugaggggccucuu

SEQ ID NO: 3343857 - RNA, 16 nt, Human
ucucaaaaaaagaaaa

SEQ ID NO: 3343858 - RNA, 16 nt, Human
ucuauuguuucuuuca

SEQ ID NO: 3343859 - RNA, 18 nt, Human
acuucuccacccugcucu

SEQ ID NO: 3343860 - RNA, 17 nt, Human
acuucgggaggucgagg

SEQ ID NO: 3343861 - RNA, 20 nt, Human
acuucgggaggucgaggcag

SEQ ID NO: 3343862 - RNA, 14 nt, Human
acuuggaagcuccg

SEQ ID NO: 3343863 - RNA, 14 nt, Human
acuugucuuuggac

SEQ ID NO: 3343864 - RNA, 22 nt, Human
agaaguuugagaucagccuggg

SEQ ID NO: 3343865 - RNA, 23 nt, Human
agaaguuucugccgcagcccugc

SEQ ID NO: 3343866 - RNA, 22 nt, Human
ucugcuuugggguuuaucagaa

SEQ ID NO: 3343867 - RNA, 18 nt, Human
ucuggcagcucagagagg

SEQ ID NO: 3343868 - RNA, 21 nt, Human
ucuggcagcucagagagggug

SEQ ID NO: 3343869 - RNA, 20 nt, Human
ucuggcagaguugaagacag

SEQ ID NO: 3343870 - RNA, 17 nt, Human
ucuggcagcucagagag

SEQ ID NO: 3343871 - RNA, 16 nt, Human
ucuggcagcucagaga

SEQ ID NO: 3343872 - RNA, 19 nt, Human
agaaccuuuugagugccuu

SEQ ID NO: 3343873 - RNA, 23 nt, Human
agaaccuuuugagugccuuacac

SEQ ID NO: 3343874 - RNA, 16 nt, Human
agaagcagaggaagga

SEQ ID NO: 3343875 - RNA, 12 nt, Human
ucugcccuuggu

SEQ ID NO: 3343876 - RNA, 23 nt, Human
agaagcccaggaaaggcuccagg

SEQ ID NO: 3343877 - RNA, 23 nt, Human
ucugcccacucccugcaaccuga

SEQ ID NO: 3343878 - RNA, 23 nt, Human
acuuuggaaagaguaggaagacu

SEQ ID NO: 3343879 - RNA, 13 nt, Human
acuuuggaaagag

SEQ ID NO: 3343880 - RNA, 14 nt, Human
acuuuggaaagagu

SEQ ID NO: 3343881 - RNA, 23 nt, Human
acuuuggaaagacuuuuccaacc

SEQ ID NO: 3343882 - RNA, 23 nt, Human
acuuuaccuuuuuuauacauaaa

SEQ ID NO: 3343883 - RNA, 14 nt, Human
acuuguggacacag

SEQ ID NO: 3343884 - RNA, 12 nt, Human
ucucucaggcca

SEQ ID NO: 3343885 - RNA, 16 nt, Human
acuuuguguucaccuu

SEQ ID NO: 3343886 - RNA, 21 nt, Human
ucuccuuggugucgggcauga

SEQ ID NO: 3343887 - RNA, 23 nt, Human
ucuccuuggugucgggcaugaca

SEQ ID NO: 3343888 - RNA, 19 nt, Human
ucuccuguaccucuugagc

SEQ ID NO: 3343889 - RNA, 16 nt, Human
ucucuugguccugcug

SEQ ID NO: 3343890 - RNA, 17 nt, Human
ucucuugguccugcugc

SEQ ID NO: 3343891 - RNA, 18 nt, Human
ucucuugguccugcugca

SEQ ID NO: 3343892 - RNA, 17 nt, Human
agaaaaaugagccuggc

SEQ ID NO: 3343893 - RNA, 18 nt, Human
agaaaaaugagccuggca

SEQ ID NO: 3343894 - RNA, 19 nt, Human
agaaaaaauauuuucccua

SEQ ID NO: 3343895 - RNA, 17 nt, Human
agaaaaaauauuuuccu

SEQ ID NO: 3343896 - RNA, 23 nt, Human
agaaaaaauauuuuccugccagg

SEQ ID NO: 3343897 - RNA, 15 nt, Human
agaaaugccuuaccc

SEQ ID NO: 3343898 - RNA, 18 nt, Human
ucugaaggcuggguucug

SEQ ID NO: 3343899 - RNA, 22 nt, Human
ucugaaggacauugcggacagc

SEQ ID NO: 3343900 - RNA, 22 nt, Human
agaaagacuaucuaaauguuga

SEQ ID NO: 3343901 - RNA, 20 nt, Human
agaaagacuaucuaaauguu

SEQ ID NO: 3343902 - RNA, 13 nt, Human
ucuugauucauaa

SEQ ID NO: 3343903 - RNA, 20 nt, Human
ucuugagccuugaacuuuga

SEQ ID NO: 3343904 - RNA, 13 nt, Human
ucuugagccuggg

SEQ ID NO: 3343905 - RNA, 16 nt, Human
ucuugagccugggagg

SEQ ID NO: 3343906 - RNA, 15 nt, Human
agaccuucuccuuca

SEQ ID NO: 3343907 - RNA, 18 nt, Human
agaccuucuccuucaccu

SEQ ID NO: 3343908 - RNA, 11 nt, Human
agaccuucucc

SEQ ID NO: 3343909 - RNA, 21 nt, Human
agaccuucuccuucaccuuug

SEQ ID NO: 3343910 - RNA, 23 nt, Human
agaccuucuccuucaccuuuguc

SEQ ID NO: 3343911 - RNA, 17 nt, Human
ucuuuccugaggcuggg

SEQ ID NO: 3343912 - RNA, 16 nt, Human
ucuuuccugaggcugg

SEQ ID NO: 3343913 - RNA, 15 nt, Human
ucuugguccugcugc

SEQ ID NO: 3343914 - RNA, 17 nt, Human
ucuugguccugcugcag

SEQ ID NO: 3343915 - RNA, 22 nt, Human
ucuugcaauggcagccuuggca

SEQ ID NO: 3343916 - RNA, 18 nt, Human
ucuugcaauggcagccuu

SEQ ID NO: 3343917 - RNA, 19 nt, Human
ucuugcaauggcagccuug

SEQ ID NO: 3343918 - RNA, 17 nt, Human
ucuuggucagauuugaa

SEQ ID NO: 3343919 - RNA, 14 nt, Human
ucuugguccugcug

SEQ ID NO: 3343920 - RNA, 21 nt, Human
ucuucugaacuuggcgcugcc

SEQ ID NO: 3343921 - RNA, 12 nt, Human
ucuucugcuuca

SEQ ID NO: 3343922 - RNA, 23 nt, Human
ucuucuguacgucugacaggcaa

SEQ ID NO: 3343923 - RNA, 15 nt, Human
ucuucuguacgucug

SEQ ID NO: 3343924 - RNA, 20 nt, Human
ucuucuguggguuucuaaag

SEQ ID NO: 3343925 - RNA, 19 nt, Human
agacauacuaaccagcaga

SEQ ID NO: 3343926 - RNA, 15 nt, Human
ucuuccucccucccu

SEQ ID NO: 3343927 - RNA, 19 nt, Human
ucuucccuacaguugaaaa

SEQ ID NO: 3343928 - RNA, 14 nt, Human
ucuuccucccuccc

SEQ ID NO: 3343929 - RNA, 14 nt, Human
ucuuccaggcuggg

SEQ ID NO: 3343930 - RNA, 15 nt, Human
ucuuccaggcuggga

SEQ ID NO: 3343931 - RNA, 17 nt, Human
ucuuccaggcugggaga

SEQ ID NO: 3343932 - RNA, 20 nt, Human
ucuuccaggcugggagagcc

SEQ ID NO: 3343933 - RNA, 17 nt, Human
ucuucagagacuccugc

SEQ ID NO: 3343934 - RNA, 18 nt, Human
ucuucagagacuccugca

SEQ ID NO: 3343935 - RNA, 12 nt, Human
ucuucagagacu

SEQ ID NO: 3343936 - RNA, 22 nt, Human
agagcaccuuagacagucccug

SEQ ID NO: 3343937 - RNA, 21 nt, Human
agagcaccuuagacagucccu

SEQ ID NO: 3343938 - RNA, 23 nt, Human
agagcaccuuagacagucccugc

SEQ ID NO: 3343939 - RNA, 13 nt, Human
agagccuuccagg

SEQ ID NO: 3343940 - RNA, 15 nt, Human
agagccuuccagggg

SEQ ID NO: 3343941 - RNA, 17 nt, Human
agagccuuccaggggug

SEQ ID NO: 3343942 - RNA, 20 nt, Human
agagcuagcagcagggaggg

SEQ ID NO: 3343943 - RNA, 22 nt, Human
agagaucaaccccuucgcuccu

SEQ ID NO: 3343944 - RNA, 19 nt, Human
agagcaagacgcugugcug

SEQ ID NO: 3343945 - RNA, 23 nt, Human
agagcaagacgcugugcugcccu

SEQ ID NO: 3343946 - RNA, 15 nt, Human
agagacuccugcagg

SEQ ID NO: 3343947 - RNA, 17 nt, Human
agagacuccugcaggca

SEQ ID NO: 3343948 - RNA, 18 nt, Human
agagacuccugcaggcag

SEQ ID NO: 3343949 - RNA, 19 nt, Human
agagacuccugcaggcagc

SEQ ID NO: 3343950 - RNA, 20 nt, Human
agagacuccugcaggcagcc

SEQ ID NO: 3343951 - RNA, 21 nt, Human
agagacuccugcaggcagcca

SEQ ID NO: 3343952 - RNA, 22 nt, Human
agagacuccugcaggcagccag

SEQ ID NO: 3343953 - RNA, 15 nt, Human
ugaaagacuguacaa

SEQ ID NO: 3343954 - RNA, 13 nt, Human
ugaaagacuguac

SEQ ID NO: 3343955 - RNA, 21 nt, Human
ucuuucuggcuaugcauuuga

SEQ ID NO: 3343956 - RNA, 19 nt, Human
ucuuucuggcuaugcauuu

SEQ ID NO: 3343957 - RNA, 20 nt, Human
ucuuucuggcuaugcauuug

SEQ ID NO: 3343958 - RNA, 22 nt, Human
ucuuuggucuacacugugcuga

SEQ ID NO: 3343959 - RNA, 14 nt, Human
ucuuuguggcuucc

SEQ ID NO: 3343960 - RNA, 16 nt, Human
ugaaaaaggaggaaga

SEQ ID NO: 3343961 - RNA, 16 nt, Human
ugaaacgcaaccacca

SEQ ID NO: 3343962 - RNA, 19 nt, Human
ugaaaaucgugacaacacu

SEQ ID NO: 3343963 - RNA, 17 nt, Human
ugaaaauguauguguaa

SEQ ID NO: 3343964 - RNA, 16 nt, Human
ugaaaaucgugacaac

SEQ ID NO: 3343965 - RNA, 20 nt, Human
ugaaaaaggaggaagagaaa

SEQ ID NO: 3343966 - RNA, 22 nt, Human
ugaaaaaggaggaagagaaaaa

SEQ ID NO: 3343967 - RNA, 15 nt, Human
ugaauuucuuuugcc

SEQ ID NO: 3343968 - RNA, 23 nt, Human
ugaauuucuuuugccguuauuaa

SEQ ID NO: 3343969 - RNA, 12 nt, Human
ugacacaugcaa

SEQ ID NO: 3343970 - RNA, 20 nt, Human
ugacacaugcaaggucauuu

SEQ ID NO: 3343971 - RNA, 18 nt, Human
ugacacacagcucugucc

SEQ ID NO: 3343972 - RNA, 16 nt, Human
ugacacacagcucugu

SEQ ID NO: 3343973 - RNA, 19 nt, Human
ugacaaagacugaguacgu

SEQ ID NO: 3343974 - RNA, 19 nt, Human
ugacacacagcucuguccu

SEQ ID NO: 3343975 - RNA, 22 nt, Human
agauacaguuacucagaauucu

SEQ ID NO: 3343976 - RNA, 19 nt, Human
agauacaggaaaagcugcu

SEQ ID NO: 3343977 - RNA, 11 nt, Human
agauacuguau

SEQ ID NO: 3343978 - RNA, 18 nt, Human
agauaauauuaaggaaga

SEQ ID NO: 3343979 - RNA, 22 nt, Human
agauaauauuaaggaagacaau

SEQ ID NO: 3343980 - RNA, 13 nt, Human
agauacaguuacu

SEQ ID NO: 3343981 - RNA, 20 nt, Human
agauacaggaaaagcugcug

SEQ ID NO: 3343982 - RNA, 15 nt, Human
agauacuguaucaug

SEQ ID NO: 3343983 - RNA, 20 nt, Human
agauauuuugcuuugugauu

SEQ ID NO: 3343984 - RNA, 21 nt, Human
agauauuuugcuuugugauuu

SEQ ID NO: 3343985 - RNA, 18 nt, Human
agaucaaaagguuaauaa

SEQ ID NO: 3343986 - RNA, 18 nt, Human
agauaauacaccacuaca

SEQ ID NO: 3343987 - RNA, 19 nt, Human
agaguuguuacauuuuuaa

SEQ ID NO: 3343988 - RNA, 20 nt, Human
agaguuguuacauuuuuaag

SEQ ID NO: 3343989 - RNA, 16 nt, Human
agaguuguuacauuuu

SEQ ID NO: 3343990 - RNA, 17 nt, Human
agaguuguuacauuuuu

SEQ ID NO: 3343991 - RNA, 15 nt, Human
agagucacuggaaca

SEQ ID NO: 3343992 - RNA, 14 nt, Human
ugaagucacacagu

SEQ ID NO: 3343993 - RNA, 16 nt, Human
agagguggggagcaga

SEQ ID NO: 3343994 - RNA, 15 nt, Human
agagguuaagguggg

SEQ ID NO: 3343995 - RNA, 16 nt, Human
agagggagggagggcu

SEQ ID NO: 3343996 - RNA, 17 nt, Human
agcaagacgcugugcug

SEQ ID NO: 3343997 - RNA, 20 nt, Human
agcaagacgcugugcugccc

SEQ ID NO: 3343998 - RNA, 21 nt, Human
agcaagacgcugugcugcccu

SEQ ID NO: 3343999 - RNA, 22 nt, Human
agcaagacgcugugcugcccug

SEQ ID NO: 3344000 - RNA, 23 nt, Human
agcaagacgcugugcugcccugc

SEQ ID NO: 3344001 - RNA, 13 nt, Human
agcaagacgcugu

SEQ ID NO: 3344002 - RNA, 16 nt, Human
agcaagacgcugugcu

SEQ ID NO: 3344003 - RNA, 21 nt, Human
agauuuugaaauuuuuauuaa

SEQ ID NO: 3344004 - RNA, 13 nt, Human
agauuggaaggaa

SEQ ID NO: 3344005 - RNA, 12 nt, Human
ugacuuacugua

SEQ ID NO: 3344006 - RNA, 22 nt, Human
agauucauauuuacuucuuaua

SEQ ID NO: 3344007 - RNA, 19 nt, Human
agauucauauuuacuucuu

SEQ ID NO: 3344008 - RNA, 18 nt, Human
ugaccugaggcccuucuc

SEQ ID NO: 3344009 - RNA, 19 nt, Human
ugaccugaggcccuucucu

SEQ ID NO: 3344010 - RNA, 17 nt, Human
ugaccugaggcccuucu

SEQ ID NO: 3344011 - RNA, 15 nt, Human
ugacuuacuguacau

SEQ ID NO: 3344012 - RNA, 16 nt, Human
ugacuuacuguacaug

SEQ ID NO: 3344013 - RNA, 13 nt, Human
ugacuuacuguac

SEQ ID NO: 3344014 - RNA, 14 nt, Human
ugacccaugcugcc

SEQ ID NO: 3344015 - RNA, 15 nt, Human
ugacccaugcugccc

SEQ ID NO: 3344016 - RNA, 12 nt, Human
ugacccaugcug

SEQ ID NO: 3344017 - RNA, 16 nt, Human
ugacccaugcugcccu

SEQ ID NO: 3344018 - RNA, 21 nt, Human
ugacccaugcugcccugugag

SEQ ID NO: 3344019 - RNA, 16 nt, Human
agaugccgcauuugga

SEQ ID NO: 3344020 - RNA, 19 nt, Human
aaccaccacacccagccca

SEQ ID NO: 3344021 - RNA, 15 nt, Human
aaccaagucaaguga

SEQ ID NO: 3344022 - RNA, 21 nt, Human
aaccaccacacccagcccacu

SEQ ID NO: 3344023 - RNA, 12 nt, Human
aaccaucauuga

SEQ ID NO: 3344024 - RNA, 17 nt, Human
aaccaucauugaaaucu

SEQ ID NO: 3344025 - RNA, 10 nt, Human
aacccagcuc

SEQ ID NO: 3344026 - RNA, 18 nt, Human
gucuuuggacccugaggc

SEQ ID NO: 3344027 - RNA, 14 nt, Human
gucuggcccuuccu

SEQ ID NO: 3344028 - RNA, 12 nt, Human
aacuccuggccu

SEQ ID NO: 3344029 - RNA, 15 nt, Human
aacucuccuccagag

SEQ ID NO: 3344030 - RNA, 18 nt, Human
aacucuccuccagaguca

SEQ ID NO: 3344031 - RNA, 16 nt, Human
aacucuccucugcugc

SEQ ID NO: 3344032 - RNA, 21 nt, Human
gugaaccaccacacccagccc

SEQ ID NO: 3344033 - RNA, 23 nt, Human
gugaaccaccacacccagcccac

SEQ ID NO: 3344034 - RNA, 22 nt, Human
gugaaccaccacacccagccca

SEQ ID NO: 3344035 - RNA, 22 nt, Human
gugcaaugaccuuucaauagga

SEQ ID NO: 3344036 - RNA, 19 nt, Human
gugauggggcccugccucc

SEQ ID NO: 3344037 - RNA, 21 nt, Human
gugcacacaccagagcccacc

SEQ ID NO: 3344038 - RNA, 22 nt, Human
gugcaugcugucccuuacguga

SEQ ID NO: 3344039 - RNA, 15 nt, Human
gugcauuaucuagau

SEQ ID NO: 3344040 - RNA, 19 nt, Human
gugcauuaucuagauacug

SEQ ID NO: 3344041 - RNA, 19 nt, Human
gugcauguguguucaugca

SEQ ID NO: 3344042 - RNA, 23 nt, Human
gugcauuaucuagauacuguauc

SEQ ID NO: 3344043 - RNA, 14 nt, Human
gugaugagaggaaa

SEQ ID NO: 3344044 - RNA, 16 nt, Human
gugaugagaggaaauc

SEQ ID NO: 3344045 - RNA, 14 nt, Human
gugauggggcccug

SEQ ID NO: 3344046 - RNA, 16 nt, Human
gugauggggcccugcc

SEQ ID NO: 3344047 - RNA, 17 nt, Human
gugauggggcccugccu

SEQ ID NO: 3344048 - RNA, 18 nt, Human
gugauggggcccugccuc

SEQ ID NO: 3344049 - RNA, 22 nt, Human
gugaugcgcaugucacggaggg

SEQ ID NO: 3344050 - RNA, 13 nt, Human
aacuuccaauuua

SEQ ID NO: 3344051 - RNA, 20 nt, Human
aacugcugacuguuuucucu

SEQ ID NO: 3344052 - RNA, 21 nt, Human
aacugcugacuguuuucucuu

SEQ ID NO: 3344053 - RNA, 23 nt, Human
aacugcugacuguuuucucuuga

SEQ ID NO: 3344054 - RNA, 15 nt, Human
aacugcugacuguuu

SEQ ID NO: 3344055 - RNA, 16 nt, Human
aacuggauuaaacuua

SEQ ID NO: 3344056 - RNA, 11 nt, Human
aacuggcugca

SEQ ID NO: 3344057 - RNA, 15 nt, Human
aacuggauuaaacuu

SEQ ID NO: 3344058 - RNA, 21 nt, Human
aacugggggagggugaaguga

SEQ ID NO: 3344059 - RNA, 22 nt, Human
aacugggggagggugaagugaa

SEQ ID NO: 3344060 - RNA, 21 nt, Human
aacuggguacuuguggacaca

SEQ ID NO: 3344061 - RNA, 16 nt, Human
aacuggguacuugugg

SEQ ID NO: 3344062 - RNA, 22 nt, Human
gugagucgaggacagggaggug

SEQ ID NO: 3344063 - RNA, 15 nt, Human
gugagucgaggacag

SEQ ID NO: 3344064 - RNA, 21 nt, Human
aacucuucaaucucuugcacu

SEQ ID NO: 3344065 - RNA, 23 nt, Human
aacugauuuuuuuuuccuucagu

SEQ ID NO: 3344066 - RNA, 17 nt, Human
gugaggccagagacaca

SEQ ID NO: 3344067 - RNA, 22 nt, Human
gugaggccagagacacaagccu

SEQ ID NO: 3344068 - RNA, 13 nt, Human
gugaggccagaga

SEQ ID NO: 3344069 - RNA, 17 nt, Human
gugaacuugggccacug

SEQ ID NO: 3344070 - RNA, 19 nt, Human
gugaacuugggccacugug

SEQ ID NO: 3344071 - RNA, 18 nt, Human
aacaaggcaaggcuguca

SEQ ID NO: 3344072 - RNA, 21 nt, Human
aacaaggcaaggcugucaauu

SEQ ID NO: 3344073 - RNA, 18 nt, Human
aaauuuugauguuuuaag

SEQ ID NO: 3344074 - RNA, 23 nt, Human
aaauuuugauguuuuaaggaugc

SEQ ID NO: 3344075 - RNA, 20 nt, Human
aacaagaccacguuucuaaa

SEQ ID NO: 3344076 - RNA, 15 nt, Human
aacaaggcaaggcug

SEQ ID NO: 3344077 - RNA, 16 nt, Human
aacaaggcaaggcugu

SEQ ID NO: 3344078 - RNA, 23 nt, Human
gucagaaguuucugccgcagccc

SEQ ID NO: 3344079 - RNA, 21 nt, Human
gucacacaguauuacuucugc

SEQ ID NO: 3344080 - RNA, 22 nt, Human
gucacacaguauuacuucugcu

SEQ ID NO: 3344081 - RNA, 18 nt, Human
aaauuuguuauaaugaau

SEQ ID NO: 3344082 - RNA, 15 nt, Human
gucagugugacugau

SEQ ID NO: 3344083 - RNA, 16 nt, Human
gucccaccuuggcugc

SEQ ID NO: 3344084 - RNA, 15 nt, Human
gucccaccuuggcug

SEQ ID NO: 3344085 - RNA, 14 nt, Human
gucccaccuuggcu

SEQ ID NO: 3344086 - RNA, 20 nt, Human
gucccaccccacacacgcca

SEQ ID NO: 3344087 - RNA, 21 nt, Human
gucccaccccacacacgccag

SEQ ID NO: 3344088 - RNA, 13 nt, Human
guccauagagagc

SEQ ID NO: 3344089 - RNA, 14 nt, Human
guccauagagagca

SEQ ID NO: 3344090 - RNA, 13 nt, Human
guccaagaagccc

SEQ ID NO: 3344091 - RNA, 15 nt, Human
guccaagaagcccag

SEQ ID NO: 3344092 - RNA, 16 nt, Human
guccaagaagcccagg

SEQ ID NO: 3344093 - RNA, 20 nt, Human
guccaagaagcccaggaaag

SEQ ID NO: 3344094 - RNA, 17 nt, Human
guccaagaagcccagga

SEQ ID NO: 3344095 - RNA, 18 nt, Human
guccaagaagcccaggaa

SEQ ID NO: 3344096 - RNA, 19 nt, Human
gucauuuuuuuuaagaaaa

SEQ ID NO: 3344097 - RNA, 21 nt, Human
gucauuuuuuuuaagaaaaag

SEQ ID NO: 3344098 - RNA, 20 nt, Human
aacacacgcgcgcacacaca

SEQ ID NO: 3344099 - RNA, 19 nt, Human
aacacacgcgcgcacacac

SEQ ID NO: 3344100 - RNA, 14 nt, Human
aacagaaauguaca

SEQ ID NO: 3344101 - RNA, 12 nt, Human
aacagaaaugua

SEQ ID NO: 3344102 - RNA, 13 nt, Human
aacagaaauguac

SEQ ID NO: 3344103 - RNA, 12 nt, Human
guccuacucugu

SEQ ID NO: 3344104 - RNA, 15 nt, Human
guccuacccacccuc

SEQ ID NO: 3344105 - RNA, 16 nt, Human
guccuacccacccucc

SEQ ID NO: 3344106 - RNA, 16 nt, Human
gucccccuuccaugga

SEQ ID NO: 3344107 - RNA, 18 nt, Human
gucccccuuccauggacu

SEQ ID NO: 3344108 - RNA, 14 nt, Human
gucccccuuccaug

SEQ ID NO: 3344109 - RNA, 18 nt, Human
gucccccugacaacacuc

SEQ ID NO: 3344110 - RNA, 11 nt, Human
aacagaaaugu

SEQ ID NO: 3344111 - RNA, 19 nt, Human
aaaugucuaguuguaacac

SEQ ID NO: 3344112 - RNA, 22 nt, Human
guauuuuguuuuugucuuaaaa

SEQ ID NO: 3344113 - RNA, 22 nt, Human
guaacaggaaaauuuuaaaaau

SEQ ID NO: 3344114 - RNA, 12 nt, Human
guaacaggcaga

SEQ ID NO: 3344115 - RNA, 19 nt, Human
aaaugggggugcauuugag

SEQ ID NO: 3344116 - RNA, 20 nt, Human
guaacaggaaaauuuuaaaa

SEQ ID NO: 3344117 - RNA, 13 nt, Human
guaugguggcugg

SEQ ID NO: 3344118 - RNA, 14 nt, Human
guaugguggcuggg

SEQ ID NO: 3344119 - RNA, 16 nt, Human
guaugguggcuggguu

SEQ ID NO: 3344120 - RNA, 15 nt, Human
guaugguggcugggu

SEQ ID NO: 3344121 - RNA, 19 nt, Human
guaucccaugagccucagc

SEQ ID NO: 3344122 - RNA, 22 nt, Human
guaucaggugcugccauccagg

SEQ ID NO: 3344123 - RNA, 18 nt, Human
guaucaggugcugccauc

SEQ ID NO: 3344124 - RNA, 16 nt, Human
guaucaggugcugcca

SEQ ID NO: 3344125 - RNA, 19 nt, Human
aaguacacuguuucaaacu

SEQ ID NO: 3344126 - RNA, 20 nt, Human
aaguacacuguuucaaacuu

SEQ ID NO: 3344127 - RNA, 23 nt, Human
aaguacacuguuucaaacuuuac

SEQ ID NO: 3344128 - RNA, 22 nt, Human
guuuugccauguuggccaggcu

SEQ ID NO: 3344129 - RNA, 21 nt, Human
guuuugccauguuggccaggc

SEQ ID NO: 3344130 - RNA, 20 nt, Human
guuuugccauguuggccagg

SEQ ID NO: 3344131 - RNA, 16 nt, Human
guuuugccauguuggc

SEQ ID NO: 3344132 - RNA, 15 nt, Human
guuucugccgcagcc

SEQ ID NO: 3344133 - RNA, 14 nt, Human
guuucugccgcagc

SEQ ID NO: 3344134 - RNA, 21 nt, Human
aaguaauaugcacacauuuuu

SEQ ID NO: 3344135 - RNA, 13 nt, Human
aaguacacuguuu

SEQ ID NO: 3344136 - RNA, 18 nt, Human
aaguacacuguuucaaac

SEQ ID NO: 3344137 - RNA, 12 nt, Human
aagugagagagg

SEQ ID NO: 3344138 - RNA, 14 nt, Human
aagugagagcuggg

SEQ ID NO: 3344139 - RNA, 17 nt, Human
aagugaagacaaugacu

SEQ ID NO: 3344140 - RNA, 19 nt, Human
aagugaagacaaugacuua

SEQ ID NO: 3344141 - RNA, 21 nt, Human
aagugaaaaaggaggaagaga

SEQ ID NO: 3344142 - RNA, 19 nt, Human
uaaaaaucucaaauuucua

SEQ ID NO: 3344143 - RNA, 20 nt, Human
uaaaaaucucaaauuucuaa

SEQ ID NO: 3344144 - RNA, 21 nt, Human
uaaaaaucucaaauuucuaaa

SEQ ID NO: 3344145 - RNA, 22 nt, Human
uaaaacuugauguguuaucucu

SEQ ID NO: 3344146 - RNA, 20 nt, Human
uaaaacuugauguguuaucu

SEQ ID NO: 3344147 - RNA, 15 nt, Human
uaaaaaguggaaaaa

SEQ ID NO: 3344148 - RNA, 15 nt, Human
guuuuucuucucccu

SEQ ID NO: 3344149 - RNA, 16 nt, Human
uaaaaaucucaaauuu

SEQ ID NO: 3344150 - RNA, 17 nt, Human
uaaaaaucucaaauuuc

SEQ ID NO: 3344151 - RNA, 15 nt, Human
uaaaaaucucaaauu

SEQ ID NO: 3344152 - RNA, 18 nt, Human
aagugauucuccugccuc

SEQ ID NO: 3344153 - RNA, 17 nt, Human
aagugauucuccugccu

SEQ ID NO: 3344154 - RNA, 16 nt, Human
aagugauucuccugcc

SEQ ID NO: 3344155 - RNA, 15 nt, Human
aagugauucuccugc

SEQ ID NO: 3344156 - RNA, 19 nt, Human
aagugauucuccugccuca

SEQ ID NO: 3344157 - RNA, 16 nt, Human
aagugaggaugaaaaa

SEQ ID NO: 3344158 - RNA, 15 nt, Human
aagugagagcugggu

SEQ ID NO: 3344159 - RNA, 22 nt, Human
uaaaauaccagccaguaaaugg

SEQ ID NO: 3344160 - RNA, 21 nt, Human
uaaaauaccagccaguaaaug

SEQ ID NO: 3344161 - RNA, 15 nt, Human
aaggaaagagggagg

SEQ ID NO: 3344162 - RNA, 15 nt, Human
aaggaagacuucauc

SEQ ID NO: 3344163 - RNA, 13 nt, Human
aaggaagcacaug

SEQ ID NO: 3344164 - RNA, 14 nt, Human
aaggaagacuucau

SEQ ID NO: 3344165 - RNA, 17 nt, Human
aaggaauaccugucccc

SEQ ID NO: 3344166 - RNA, 16 nt, Human
aaggaagcacaugccu

SEQ ID NO: 3344167 - RNA, 20 nt, Human
aaggaggggauagagagaga

SEQ ID NO: 3344168 - RNA, 14 nt, Human
aaggagauuuacaa

SEQ ID NO: 3344169 - RNA, 11 nt, Human
aaggagagcua

SEQ ID NO: 3344170 - RNA, 18 nt, Human
aaggaauaccuguccccc

SEQ ID NO: 3344171 - RNA, 19 nt, Human
guugcccaggcaggucuug

SEQ ID NO: 3344172 - RNA, 17 nt, Human
guugccuaaguauuaaa

SEQ ID NO: 3344173 - RNA, 22 nt, Human
guugccuaaguauuaaaacauu

SEQ ID NO: 3344174 - RNA, 21 nt, Human
guugccuaaguauuaaaacau

SEQ ID NO: 3344175 - RNA, 18 nt, Human
guugccuaaguauuaaaa

SEQ ID NO: 3344176 - RNA, 13 nt, Human
guugcccaggcug

SEQ ID NO: 3344177 - RNA, 12 nt, Human
guugcccaggcu

SEQ ID NO: 3344178 - RNA, 23 nt, Human
guugcccaggcaggucuugaacu

SEQ ID NO: 3344179 - RNA, 13 nt, Human
aaggauacaaaag

SEQ ID NO: 3344180 - RNA, 21 nt, Human
aaggauacaaaagcaugugag

SEQ ID NO: 3344181 - RNA, 13 nt, Human
guuuauugucaaa

SEQ ID NO: 3344182 - RNA, 15 nt, Human
guugggccaggagcc

SEQ ID NO: 3344183 - RNA, 17 nt, Human
guugggccaggagccuc

SEQ ID NO: 3344184 - RNA, 13 nt, Human
guugggcuggugu

SEQ ID NO: 3344185 - RNA, 19 nt, Human
aaggcuccaggagcagcca

SEQ ID NO: 3344186 - RNA, 22 nt, Human
aaggcuccaggagcagccacau

SEQ ID NO: 3344187 - RNA, 16 nt, Human
aaggcucgagcaugcc

SEQ ID NO: 3344188 - RNA, 18 nt, Human
aaggcucgagcaugccug

SEQ ID NO: 3344189 - RNA, 19 nt, Human
aaggcucgagcaugccugg

SEQ ID NO: 3344190 - RNA, 20 nt, Human
aaggcucgagcaugccugga

SEQ ID NO: 3344191 - RNA, 22 nt, Human
aaggcucgagcaugccuggaug

SEQ ID NO: 3344192 - RNA, 14 nt, Human
guuucaaacuuuac

SEQ ID NO: 3344193 - RNA, 16 nt, Human
guuucaaacuuuacua

SEQ ID NO: 3344194 - RNA, 13 nt, Human
guuucaaacuuua

SEQ ID NO: 3344195 - RNA, 16 nt, Human
aaggcuccaggagcag

SEQ ID NO: 3344196 - RNA, 18 nt, Human
aaggcuccaggagcagcc

SEQ ID NO: 3344197 - RNA, 15 nt, Human
aaggcuccaggagca

SEQ ID NO: 3344198 - RNA, 22 nt, Human
guuucuaugacacaugcaaggu

SEQ ID NO: 3344199 - RNA, 12 nt, Human
aaggucauuuuu

SEQ ID NO: 3344200 - RNA, 18 nt, Human
guuucugaaagggacgcu

SEQ ID NO: 3344201 - RNA, 19 nt, Human
guuucuauguguagggcgg

SEQ ID NO: 3344202 - RNA, 20 nt, Human
aagguagaaauaucugaaaa

SEQ ID NO: 3344203 - RNA, 22 nt, Human
aaggggcccaaauucuuucagu

SEQ ID NO: 3344204 - RNA, 17 nt, Human
aaggggcaguggugguu

SEQ ID NO: 3344205 - RNA, 18 nt, Human
guuaagagaaaugagcuu

SEQ ID NO: 3344206 - RNA, 11 nt, Human
guuaagagaaa

SEQ ID NO: 3344207 - RNA, 12 nt, Human
guuaagagaaau

SEQ ID NO: 3344208 - RNA, 19 nt, Human
guuaggcauugugggaagg

SEQ ID NO: 3344209 - RNA, 20 nt, Human
guuaggcauugugggaaggg

SEQ ID NO: 3344210 - RNA, 20 nt, Human
guucaaagauauuuugcuuu

SEQ ID NO: 3344211 - RNA, 21 nt, Human
guucaaagauauuuugcuuug

SEQ ID NO: 3344212 - RNA, 22 nt, Human
guucaaagauauuuugcuuugu

SEQ ID NO: 3344213 - RNA, 23 nt, Human
guuauuuuuauuuauuuaaauuu

SEQ ID NO: 3344214 - RNA, 18 nt, Human
aagcucagggccuggcuc

SEQ ID NO: 3344215 - RNA, 19 nt, Human
aagcucagggccuggcuca

SEQ ID NO: 3344216 - RNA, 20 nt, Human
aagcucagggccuggcucag

SEQ ID NO: 3344217 - RNA, 17 nt, Human
aagcuccaagcucccag

SEQ ID NO: 3344218 - RNA, 18 nt, Human
aagcuccaagcucccagg

SEQ ID NO: 3344219 - RNA, 12 nt, Human
aagcucagggcc

SEQ ID NO: 3344220 - RNA, 13 nt, Human
aagcucagggccu

SEQ ID NO: 3344221 - RNA, 16 nt, Human
aagcucagggccuggc

SEQ ID NO: 3344222 - RNA, 17 nt, Human
aagcucagggccuggcu

SEQ ID NO: 3344223 - RNA, 13 nt, Human
guucagcuccagc

SEQ ID NO: 3344224 - RNA, 12 nt, Human
aagcuaggccug

SEQ ID NO: 3344225 - RNA, 22 nt, Human
aagcuauucaguaauaacucua

SEQ ID NO: 3344226 - RNA, 20 nt, Human
aagccugaguuugcuuucaa

SEQ ID NO: 3344227 - RNA, 22 nt, Human
aagcuagacgagcaggcuucuu

SEQ ID NO: 3344228 - RNA, 19 nt, Human
aagcccaggaaaggcucca

SEQ ID NO: 3344229 - RNA, 22 nt, Human
aagcccaggaaaggcuccagga

SEQ ID NO: 3344230 - RNA, 14 nt, Human
aagcccaggaaagg

SEQ ID NO: 3344231 - RNA, 17 nt, Human
aagcccaggaaaggcuc

SEQ ID NO: 3344232 - RNA, 22 nt, Human
aagccaaagcuaggccuggcca

SEQ ID NO: 3344233 - RNA, 20 nt, Human
aagccaaagcuaggccuggc

SEQ ID NO: 3344234 - RNA, 20 nt, Human
aagccgcuggggccaguugg

SEQ ID NO: 3344235 - RNA, 19 nt, Human
aagcccugagcuuucugcu

SEQ ID NO: 3344236 - RNA, 20 nt, Human
aagcagugcaugcugucccu

SEQ ID NO: 3344237 - RNA, 14 nt, Human
aagcagugcaugcu

SEQ ID NO: 3344238 - RNA, 15 nt, Human
aagcagugcaugcug

SEQ ID NO: 3344239 - RNA, 21 nt, Human
gugugugcgccuacaggagug

SEQ ID NO: 3344240 - RNA, 12 nt, Human
aagcagugcaug

SEQ ID NO: 3344241 - RNA, 16 nt, Human
aagcauuuacuuugug

SEQ ID NO: 3344242 - RNA, 23 nt, Human
aagacugaguacguugugcauuu

SEQ ID NO: 3344243 - RNA, 22 nt, Human
aagacugaguacguugugcauu

SEQ ID NO: 3344244 - RNA, 15 nt, Human
aagaccuucuccuuc

SEQ ID NO: 3344245 - RNA, 18 nt, Human
aagaccuucuccuucacc

SEQ ID NO: 3344246 - RNA, 19 nt, Human
aagaccuucuccuucaccu

SEQ ID NO: 3344247 - RNA, 15 nt, Human
aagacgcugugcugc

SEQ ID NO: 3344248 - RNA, 17 nt, Human
aagacgcugugcugccc

SEQ ID NO: 3344249 - RNA, 18 nt, Human
aagacgcugugcugcccu

SEQ ID NO: 3344250 - RNA, 19 nt, Human
aagacgcugugcugcccug

SEQ ID NO: 3344251 - RNA, 13 nt, Human
aagacgcugugcu

SEQ ID NO: 3344252 - RNA, 13 nt, Human
gugggacacccug

SEQ ID NO: 3344253 - RNA, 15 nt, Human
gugggacacccugug

SEQ ID NO: 3344254 - RNA, 14 nt, Human
gugggagcugccug

SEQ ID NO: 3344255 - RNA, 15 nt, Human
guggggucacucugg

SEQ ID NO: 3344256 - RNA, 18 nt, Human
gugggagcugccuguuca

SEQ ID NO: 3344257 - RNA, 15 nt, Human
gugggagcugccugu

SEQ ID NO: 3344258 - RNA, 21 nt, Human
guggccucccaacucacccca

SEQ ID NO: 3344259 - RNA, 22 nt, Human
guggccucccaacucaccccag

SEQ ID NO: 3344260 - RNA, 15 nt, Human
guggccucccaacuc

SEQ ID NO: 3344261 - RNA, 22 nt, Human
gugugacaaggauugcuacugu

SEQ ID NO: 3344262 - RNA, 20 nt, Human
gugucagguggggcagcuug

SEQ ID NO: 3344263 - RNA, 17 nt, Human
guguauuuuuuuacuaa

SEQ ID NO: 3344264 - RNA, 23 nt, Human
guguauuuuuuuacuaauagaca

SEQ ID NO: 3344265 - RNA, 20 nt, Human
gugucaagagggucugagga

SEQ ID NO: 3344266 - RNA, 16 nt, Human
gugucagcauagaagu

SEQ ID NO: 3344267 - RNA, 19 nt, Human
aagaugcuucucacugcca

SEQ ID NO: 3344268 - RNA, 17 nt, Human
aagaugcuucucacugc

SEQ ID NO: 3344269 - RNA, 16 nt, Human
aagaugcuucucacug

SEQ ID NO: 3344270 - RNA, 13 nt, Human
aagaguaggaaga

SEQ ID NO: 3344271 - RNA, 22 nt, Human
aagagggagggagggcuccaga

SEQ ID NO: 3344272 - RNA, 23 nt, Human
aagagggagggagggcuccagac

SEQ ID NO: 3344273 - RNA, 12 nt, Human
aagaguaggaag

SEQ ID NO: 3344274 - RNA, 17 nt, Human
guggggucacucuggca

SEQ ID NO: 3344275 - RNA, 20 nt, Human
guggggucacucuggcagcu

SEQ ID NO: 3344276 - RNA, 21 nt, Human
guggggucacucuggcagcuc

SEQ ID NO: 3344277 - RNA, 22 nt, Human
guggggucacucuggcagcuca

SEQ ID NO: 3344278 - RNA, 21 nt, Human
aauuauuuauuaaaugcccag

SEQ ID NO: 3344279 - RNA, 22 nt, Human
aauuauuuauuaaaugcccagc

SEQ ID NO: 3344280 - RNA, 17 nt, Human
aauucaguuguuagugu

SEQ ID NO: 3344281 - RNA, 22 nt, Human
aauucaguuguuagugugucuu

SEQ ID NO: 3344282 - RNA, 11 nt, Human
aauucaguugu

SEQ ID NO: 3344283 - RNA, 16 nt, Human
uaccugaggggccucu

SEQ ID NO: 3344284 - RNA, 17 nt, Human
aauuacaggaaguacug

SEQ ID NO: 3344285 - RNA, 19 nt, Human
aauuacaggaaguacugga

SEQ ID NO: 3344286 - RNA, 20 nt, Human
aauuacaggaaguacuggag

SEQ ID NO: 3344287 - RNA, 11 nt, Human
aauuacaggaa

SEQ ID NO: 3344288 - RNA, 13 nt, Human
uaccugaagucuu

SEQ ID NO: 3344289 - RNA, 14 nt, Human
uaccugaagucuuu

SEQ ID NO: 3344290 - RNA, 13 nt, Human
uaccugaggggcc

SEQ ID NO: 3344291 - RNA, 15 nt, Human
uaccugaggggccuc

SEQ ID NO: 3344292 - RNA, 16 nt, Human
uaccugaagucuuugu

SEQ ID NO: 3344293 - RNA, 23 nt, Human
uacccgggaagggggcugggaca

SEQ ID NO: 3344294 - RNA, 22 nt, Human
uaccucuugagccuugaacuuu

SEQ ID NO: 3344295 - RNA, 21 nt, Human
uaccucuugagccuugaacuu

SEQ ID NO: 3344296 - RNA, 23 nt, Human
uaccucuugagccuugaacuuug

SEQ ID NO: 3344297 - RNA, 11 nt, Human
aauuaacuuuu

SEQ ID NO: 3344298 - RNA, 18 nt, Human
uaccagccaguaaauggg

SEQ ID NO: 3344299 - RNA, 22 nt, Human
uaccagcagagcaccuuagaca

SEQ ID NO: 3344300 - RNA, 13 nt, Human
uaccagcagagca

SEQ ID NO: 3344301 - RNA, 14 nt, Human
uaccagcagagcac

SEQ ID NO: 3344302 - RNA, 12 nt, Human
uaccagcagagc

SEQ ID NO: 3344303 - RNA, 21 nt, Human
aaugugcugaaugguuuucaa

SEQ ID NO: 3344304 - RNA, 17 nt, Human
aauuaaguacuauguau

SEQ ID NO: 3344305 - RNA, 16 nt, Human
aauuaaguacuaugua

SEQ ID NO: 3344306 - RNA, 15 nt, Human
aauuaacuuuuauaa

SEQ ID NO: 3344307 - RNA, 13 nt, Human
aauuaaguacuau

SEQ ID NO: 3344308 - RNA, 12 nt, Human
aauuaacuuuua

SEQ ID NO: 3344309 - RNA, 13 nt, Human
aauuaacuuuuau

SEQ ID NO: 3344310 - RNA, 18 nt, Human
aaugaggucagagccugc

SEQ ID NO: 3344311 - RNA, 16 nt, Human
aaugaggucagagccu

SEQ ID NO: 3344312 - RNA, 12 nt, Human
aaugagccuggc

SEQ ID NO: 3344313 - RNA, 13 nt, Human
aaugagccuggca

SEQ ID NO: 3344314 - RNA, 21 nt, Human
aaugaccuuucaauaggaaaa

SEQ ID NO: 3344315 - RNA, 20 nt, Human
aaugaccuuucaauaggaaa

SEQ ID NO: 3344316 - RNA, 11 nt, Human
aaugagccugg

SEQ ID NO: 3344317 - RNA, 13 nt, Human
aaugcaccuggaa

SEQ ID NO: 3344318 - RNA, 12 nt, Human
aaugcaaaccau

SEQ ID NO: 3344319 - RNA, 20 nt, Human
aaugcacaaacagaggccgc

SEQ ID NO: 3344320 - RNA, 11 nt, Human
aaugcaaacca

SEQ ID NO: 3344321 - RNA, 13 nt, Human
uacaaugcugugc

SEQ ID NO: 3344322 - RNA, 14 nt, Human
uacaaugcugugcc

SEQ ID NO: 3344323 - RNA, 18 nt, Human
uaauuuuuuugagacaga

SEQ ID NO: 3344324 - RNA, 21 nt, Human
aaugcuggcuguuggcugggg

SEQ ID NO: 3344325 - RNA, 22 nt, Human
aaugcuggcuguuggcuggggg

SEQ ID NO: 3344326 - RNA, 14 nt, Human
aauggaaccacucu

SEQ ID NO: 3344327 - RNA, 13 nt, Human
aauggaagacagc

SEQ ID NO: 3344328 - RNA, 16 nt, Human
aauggaagacagcucu

SEQ ID NO: 3344329 - RNA, 14 nt, Human
aaugguuuucaaaa

SEQ ID NO: 3344330 - RNA, 16 nt, Human
aaugguuuucaaaaua

SEQ ID NO: 3344331 - RNA, 14 nt, Human
uacagacaaagcgu

SEQ ID NO: 3344332 - RNA, 15 nt, Human
uacagacaaagcgug

SEQ ID NO: 3344333 - RNA, 13 nt, Human
uacagacaaagcg

SEQ ID NO: 3344334 - RNA, 23 nt, Human
uacagagcagacaguuaagagaa

SEQ ID NO: 3344335 - RNA, 19 nt, Human
uacagagcccacgccccca

SEQ ID NO: 3344336 - RNA, 22 nt, Human
uacagagcccacgcccccacug

SEQ ID NO: 3344337 - RNA, 17 nt, Human
aaucccauuuaaaaaaa

SEQ ID NO: 3344338 - RNA, 21 nt, Human
uaaguauucuuauuuaaugaa

SEQ ID NO: 3344339 - RNA, 13 nt, Human
aaucagccugcuc

SEQ ID NO: 3344340 - RNA, 18 nt, Human
aaucagccugcuccagcu

SEQ ID NO: 3344341 - RNA, 19 nt, Human
aaucagccugcuccagcug

SEQ ID NO: 3344342 - RNA, 11 nt, Human
aaucagccugc

SEQ ID NO: 3344343 - RNA, 17 nt, Human
uaaggaauaccuguccc

SEQ ID NO: 3344344 - RNA, 18 nt, Human
uaaggaauaccugucccc

SEQ ID NO: 3344345 - RNA, 13 nt, Human
uaaggaagacaau

SEQ ID NO: 3344346 - RNA, 9 nt, Human
uaaggaaua

SEQ ID NO: 3344347 - RNA, 14 nt, Human
uaagcuauucagua

SEQ ID NO: 3344348 - RNA, 21 nt, Human
uaagcuauucaguaauaacuc

SEQ ID NO: 3344349 - RNA, 18 nt, Human
aaguguauuuuuuuacua

SEQ ID NO: 3344350 - RNA, 21 nt, Human
aaguguauuuuuuuacuaaua

SEQ ID NO: 3344351 - RNA, 18 nt, Human
uaaaugaaaaucgugaca

SEQ ID NO: 3344352 - RNA, 19 nt, Human
uaaauuaacuuuuauaaac

SEQ ID NO: 3344353 - RNA, 20 nt, Human
uaaauuaacuuuuauaaacu

SEQ ID NO: 3344354 - RNA, 18 nt, Human
uaaauuaacuuuuauaaa

SEQ ID NO: 3344355 - RNA, 21 nt, Human
uaaauuaacuuuuauaaacuu

SEQ ID NO: 3344356 - RNA, 21 nt, Human
aauacaccacuacauucuguu

SEQ ID NO: 3344357 - RNA, 13 nt, Human
aauacagaggcaa

SEQ ID NO: 3344358 - RNA, 12 nt, Human
aauaccaaggaa

SEQ ID NO: 3344359 - RNA, 17 nt, Human
aauaccagccaguaaau

SEQ ID NO: 3344360 - RNA, 19 nt, Human
aauaccagccaguaaaugg

SEQ ID NO: 3344361 - RNA, 15 nt, Human
aauaccugucccccu

SEQ ID NO: 3344362 - RNA, 18 nt, Human
aauaccugucccccugac

SEQ ID NO: 3344363 - RNA, 19 nt, Human
aauaccugucccccugaca

SEQ ID NO: 3344364 - RNA, 20 nt, Human
aauagccugccucuucucua

SEQ ID NO: 3344365 - RNA, 19 nt, Human
uaacauguaauuaaguacu

SEQ ID NO: 3344366 - RNA, 17 nt, Human
uaacauguaauuaagua

SEQ ID NO: 3344367 - RNA, 16 nt, Human
uaacuugucuuuggac

SEQ ID NO: 3344368 - RNA, 20 nt, Human
uaacuugucuuuggacccug

SEQ ID NO: 3344369 - RNA, 17 nt, Human
uaacuuccaauuuacau

SEQ ID NO: 3344370 - RNA, 19 nt, Human
uaucacccagaagaaaaua

SEQ ID NO: 3344371 - RNA, 22 nt, Human
uaucacccagaagaaaauagug

SEQ ID NO: 3344372 - RNA, 20 nt, Human
acagacccugcccugugggc

SEQ ID NO: 3344373 - RNA, 19 nt, Human
uauccaacaucaacaucuu

SEQ ID NO: 3344374 - RNA, 17 nt, Human
uaucagaauucucagaa

SEQ ID NO: 3344375 - RNA, 10 nt, Human
uaucagaauu

SEQ ID NO: 3344376 - RNA, 21 nt, Human
acacuuacacuuuaugcacaa

SEQ ID NO: 3344377 - RNA, 18 nt, Human
acacuuacacuuuaugca

SEQ ID NO: 3344378 - RNA, 17 nt, Human
acacuguuucaaacuuu

SEQ ID NO: 3344379 - RNA, 18 nt, Human
acacuguuucaaacuuua

SEQ ID NO: 3344380 - RNA, 16 nt, Human
acacuguuucaaacuu

SEQ ID NO: 3344381 - RNA, 17 nt, Human
acacucauugaccugag

SEQ ID NO: 3344382 - RNA, 20 nt, Human
acacuguuucaaacuuuacu

SEQ ID NO: 3344383 - RNA, 16 nt, Human
acacuuacacuuuaug

SEQ ID NO: 3344384 - RNA, 18 nt, Human
acagacauacuaaccagc

SEQ ID NO: 3344385 - RNA, 19 nt, Human
acagacauacuaaccagca

SEQ ID NO: 3344386 - RNA, 15 nt, Human
acacuaaugaggaaa

SEQ ID NO: 3344387 - RNA, 22 nt, Human
acacuaaugaggaaacugcacu

SEQ ID NO: 3344388 - RNA, 21 nt, Human
acacucaaaagcugggcaggu

SEQ ID NO: 3344389 - RNA, 17 nt, Human
uagucacugagacagcc

SEQ ID NO: 3344390 - RNA, 15 nt, Human
acacucaaaagcugg

SEQ ID NO: 3344391 - RNA, 18 nt, Human
uauaauuuaccugaaguc

SEQ ID NO: 3344392 - RNA, 22 nt, Human
uauacacuuacacuuuaugcac

SEQ ID NO: 3344393 - RNA, 21 nt, Human
uauacacuuacacuuuaugca

SEQ ID NO: 3344394 - RNA, 16 nt, Human
acacucauugaccuga

SEQ ID NO: 3344395 - RNA, 23 nt, Human
uauaggaacuuaaauaaugugaa

SEQ ID NO: 3344396 - RNA, 17 nt, Human
acaggcccggcuccagg

SEQ ID NO: 3344397 - RNA, 16 nt, Human
acaggcccggcuccag

SEQ ID NO: 3344398 - RNA, 15 nt, Human
acaggcagauacagg

SEQ ID NO: 3344399 - RNA, 20 nt, Human
acaggaaaauuuuaaaaaua

SEQ ID NO: 3344400 - RNA, 22 nt, Human
acaggcccggcuccaggcuccu

SEQ ID NO: 3344401 - RNA, 21 nt, Human
acaggcccggcuccaggcucc

SEQ ID NO: 3344402 - RNA, 20 nt, Human
acaggcccggcuccaggcuc

SEQ ID NO: 3344403 - RNA, 18 nt, Human
acaggcccggcuccaggc

SEQ ID NO: 3344404 - RNA, 21 nt, Human
acagcuucauuuccugugucu

SEQ ID NO: 3344405 - RNA, 19 nt, Human
acagcuucauuuccugugu

SEQ ID NO: 3344406 - RNA, 17 nt, Human
acagcuucauuuccugu

SEQ ID NO: 3344407 - RNA, 20 nt, Human
acagcuugaccgugaggcca

SEQ ID NO: 3344408 - RNA, 21 nt, Human
acagcuugaccgugaggccag

SEQ ID NO: 3344409 - RNA, 17 nt, Human
acagcuugaccgugagg

SEQ ID NO: 3344410 - RNA, 21 nt, Human
acaggaaaagcugcugacagu

SEQ ID NO: 3344411 - RNA, 20 nt, Human
acaggaaaagcugcugacag

SEQ ID NO: 3344412 - RNA, 19 nt, Human
acaggaaaagcugcugaca

SEQ ID NO: 3344413 - RNA, 18 nt, Human
acaggaaaagcugcugac

SEQ ID NO: 3344414 - RNA, 22 nt, Human
acagcuugaccgugaggccaga

SEQ ID NO: 3344415 - RNA, 23 nt, Human
acagcuugaccgugaggccagag

SEQ ID NO: 3344416 - RNA, 19 nt, Human
acagcuaaugggacacuaa

SEQ ID NO: 3344417 - RNA, 17 nt, Human
acagcuaaugggacacu

SEQ ID NO: 3344418 - RNA, 16 nt, Human
acagcuaaugggacac

SEQ ID NO: 3344419 - RNA, 15 nt, Human
acagcuaaugggaca

SEQ ID NO: 3344420 - RNA, 21 nt, Human
uaugaggcauuuguuugaacu

SEQ ID NO: 3344421 - RNA, 14 nt, Human
uaugaggcauuugu

SEQ ID NO: 3344422 - RNA, 15 nt, Human
uaugaggcauuuguu

SEQ ID NO: 3344423 - RNA, 13 nt, Human
uaugaggcauuug

SEQ ID NO: 3344424 - RNA, 15 nt, Human
acagcccgggcucug

SEQ ID NO: 3344425 - RNA, 22 nt, Human
uaugcaugaaguaauaugcaca

SEQ ID NO: 3344426 - RNA, 18 nt, Human
uaugcaugaaguaauaug

SEQ ID NO: 3344427 - RNA, 23 nt, Human
uauggcuuuugugcauuaucuag

SEQ ID NO: 3344428 - RNA, 21 nt, Human
uauggcccuggccuagcauac

SEQ ID NO: 3344429 - RNA, 20 nt, Human
uauggcccuggccuagcaua

SEQ ID NO: 3344430 - RNA, 23 nt, Human
uaugggacucaaugcacugacau

SEQ ID NO: 3344431 - RNA, 16 nt, Human
uaugggacucaaugca

SEQ ID NO: 3344432 - RNA, 13 nt, Human
uagccaaggccaa

SEQ ID NO: 3344433 - RNA, 12 nt, Human
uagccaaggcca

SEQ ID NO: 3344434 - RNA, 22 nt, Human
uagcacagacccugcccugugg

SEQ ID NO: 3344435 - RNA, 15 nt, Human
uagcacagacccugc

SEQ ID NO: 3344436 - RNA, 19 nt, Human
uagcacagacccugcccug

SEQ ID NO: 3344437 - RNA, 20 nt, Human
uagcacagacccugcccugu

SEQ ID NO: 3344438 - RNA, 21 nt, Human
uagcacagacccugcccugug

SEQ ID NO: 3344439 - RNA, 14 nt, Human
uagcacagacccug

SEQ ID NO: 3344440 - RNA, 22 nt, Human
uagagcggagaaaggaagggcu

SEQ ID NO: 3344441 - RNA, 14 nt, Human
uagagccagggucu

SEQ ID NO: 3344442 - RNA, 16 nt, Human
acaaaaagcauaaaaa

SEQ ID NO: 3344443 - RNA, 16 nt, Human
uagacagucccugcca

SEQ ID NO: 3344444 - RNA, 10 nt, Human
uagacagagu

SEQ ID NO: 3344445 - RNA, 18 nt, Human
uagacaauuuauuauggc

SEQ ID NO: 3344446 - RNA, 17 nt, Human
aauuugugauacaaugc

SEQ ID NO: 3344447 - RNA, 18 nt, Human
aauuugugauacaaugcu

SEQ ID NO: 3344448 - RNA, 14 nt, Human
aauuugugauacaa

SEQ ID NO: 3344449 - RNA, 17 nt, Human
uagacagucccugccaa

SEQ ID NO: 3344450 - RNA, 21 nt, Human
uagacagucccugccaaugga

SEQ ID NO: 3344451 - RNA, 14 nt, Human
uaguagagacaggg

SEQ ID NO: 3344452 - RNA, 14 nt, Human
uagucacugagaca

SEQ ID NO: 3344453 - RNA, 22 nt, Human
uaguagagacaggguuuugcca

SEQ ID NO: 3344454 - RNA, 15 nt, Human
uaguagagacagggu

SEQ ID NO: 3344455 - RNA, 16 nt, Human
acacaggcccggcucc

SEQ ID NO: 3344456 - RNA, 18 nt, Human
acacaggcccggcuccag

SEQ ID NO: 3344457 - RNA, 17 nt, Human
acacaggcccggcucca

SEQ ID NO: 3344458 - RNA, 22 nt, Human
acacacacgcgugcacacacca

SEQ ID NO: 3344459 - RNA, 22 nt, Human
acacaggcccggcuccaggcuc

SEQ ID NO: 3344460 - RNA, 21 nt, Human
acacaggcccggcuccaggcu

SEQ ID NO: 3344461 - RNA, 20 nt, Human
acacaggcccggcuccaggc

SEQ ID NO: 3344462 - RNA, 19 nt, Human
acacaggcccggcuccagg

SEQ ID NO: 3344463 - RNA, 24 nt, Human
acacaggcccggcuccaggcuccu

SEQ ID NO: 3344464 - RNA, 23 nt, Human
acacaggcccggcuccaggcucc

SEQ ID NO: 3344465 - RNA, 15 nt, Human
uaggguuauaauaau

SEQ ID NO: 3344466 - RNA, 17 nt, Human
uaggguuauaauaaugu

SEQ ID NO: 3344467 - RNA, 19 nt, Human
uaggguaagugagagaggg

SEQ ID NO: 3344468 - RNA, 11 nt, Human
acaaugcaaac

SEQ ID NO: 3344469 - RNA, 16 nt, Human
acaaugcaaaccauca

SEQ ID NO: 3344470 - RNA, 17 nt, Human
acaaugcaaaccaucau

SEQ ID NO: 3344471 - RNA, 18 nt, Human
acaaugcaaaccaucauu

SEQ ID NO: 3344472 - RNA, 22 nt, Human
acaaugacuuacuguacaugaa

SEQ ID NO: 3344473 - RNA, 20 nt, Human
acaaugacuuacuguacaug

SEQ ID NO: 3344474 - RNA, 19 nt, Human
acaaugacuuacuguacau

SEQ ID NO: 3344475 - RNA, 19 nt, Human
acaaugcaaaccaucauug

SEQ ID NO: 3344476 - RNA, 21 nt, Human
acaaugcaaaccaucauugaa

SEQ ID NO: 3344477 - RNA, 23 nt, Human
acaaugcaaaccaucauugaaau

SEQ ID NO: 3344478 - RNA, 12 nt, Human
acacacacacau

SEQ ID NO: 3344479 - RNA, 15 nt, Human
acacacacacauaca

SEQ ID NO: 3344480 - RNA, 14 nt, Human
acacacacacauac

SEQ ID NO: 3344481 - RNA, 13 nt, Human
acacacacacaua

SEQ ID NO: 3344482 - RNA, 20 nt, Human
uagccuuagaagucacacag

SEQ ID NO: 3344483 - RNA, 21 nt, Human
uagccuuagaagucacacagu

SEQ ID NO: 3344484 - RNA, 20 nt, Human
uagccugugccucugggacu

SEQ ID NO: 3344485 - RNA, 14 nt, Human
uagcgcccaguugg

SEQ ID NO: 3344486 - RNA, 17 nt, Human
uagcgcccaguugggug

SEQ ID NO: 3344487 - RNA, 13 nt, Human
uaggaaaaacuga

SEQ ID NO: 3344488 - RNA, 14 nt, Human
uaggaaaaacugau

SEQ ID NO: 3344489 - RNA, 13 nt, Human
uagggaagauaau

SEQ ID NO: 3344490 - RNA, 16 nt, Human
uaggaaaaacugauuu

SEQ ID NO: 3344491 - RNA, 17 nt, Human
uaggaaaaacugauuuu

SEQ ID NO: 3344492 - RNA, 17 nt, Human
cacaguucaauucucau

SEQ ID NO: 3344493 - RNA, 16 nt, Human
caauaggaaaaacuga

SEQ ID NO: 3344494 - RNA, 17 nt, Human
caauaggaaaaacugau

SEQ ID NO: 3344495 - RNA, 15 nt, Human
caauaggaaaaacug

SEQ ID NO: 3344496 - RNA, 14 nt, Human
caauaggaaaaacu

SEQ ID NO: 3344497 - RNA, 18 nt, Human
caaggcuuauauucaacc

SEQ ID NO: 3344498 - RNA, 17 nt, Human
caaggcuuauauucaac

SEQ ID NO: 3344499 - RNA, 17 nt, Human
caaggcugcagugagcc

SEQ ID NO: 3344500 - RNA, 22 nt, Human
caaggcugcagugagccgagau

SEQ ID NO: 3344501 - RNA, 17 nt, Human
caaggauccugagccag

SEQ ID NO: 3344502 - RNA, 15 nt, Human
caaggcugcagugag

SEQ ID NO: 3344503 - RNA, 20 nt, Human
caaggauccugagccagauu

SEQ ID NO: 3344504 - RNA, 16 nt, Human
caaggagauuuacaac

SEQ ID NO: 3344505 - RNA, 18 nt, Human
caaggauccugagccaga

SEQ ID NO: 3344506 - RNA, 19 nt, Human
caaggauccugagccagau

SEQ ID NO: 3344507 - RNA, 23 nt, Human
caagcuggucccacucaguccau

SEQ ID NO: 3344508 - RNA, 22 nt, Human
caagcuggucccacucagucca

SEQ ID NO: 3344509 - RNA, 20 nt, Human
caagcugcacccucaggcag

SEQ ID NO: 3344510 - RNA, 22 nt, Human
caagcugcacccucaggcaggu

SEQ ID NO: 3344511 - RNA, 21 nt, Human
caagcuggucccacucagucc

SEQ ID NO: 3344512 - RNA, 17 nt, Human
caagcgauucuucugcu

SEQ ID NO: 3344513 - RNA, 15 nt, Human
caagcgauucuucug

SEQ ID NO: 3344514 - RNA, 21 nt, Human
caagcugcacccucaggcagg

SEQ ID NO: 3344515 - RNA, 18 nt, Human
caagcgauucuucugcuu

SEQ ID NO: 3344516 - RNA, 21 nt, Human
cacagcucuucuccaggcugu

SEQ ID NO: 3344517 - RNA, 21 nt, Human
cacagaguuguuacauuuuua

SEQ ID NO: 3344518 - RNA, 22 nt, Human
cacagaguuguuacauuuuuaa

SEQ ID NO: 3344519 - RNA, 13 nt, Human
cacagaggcugcc

SEQ ID NO: 3344520 - RNA, 23 nt, Human
cacagaugggugcuuggaggaag

SEQ ID NO: 3344521 - RNA, 20 nt, Human
cacagagaaaguacuucucc

SEQ ID NO: 3344522 - RNA, 19 nt, Human
cacagagaaaguacuucuc

SEQ ID NO: 3344523 - RNA, 12 nt, Human
cacagagaaagu

SEQ ID NO: 3344524 - RNA, 19 nt, Human
caaugugaaaagaaaaaug

SEQ ID NO: 3344525 - RNA, 22 nt, Human
caaugugaaaagaaaaaugagc

SEQ ID NO: 3344526 - RNA, 14 nt, Human
caauguucucucuu

SEQ ID NO: 3344527 - RNA, 17 nt, Human
caauuacaggaaguacu

SEQ ID NO: 3344528 - RNA, 18 nt, Human
caauuacaggaaguacug

SEQ ID NO: 3344529 - RNA, 14 nt, Human
cacaaacagaggcc

SEQ ID NO: 3344530 - RNA, 13 nt, Human
cacaaacagaggc

SEQ ID NO: 3344531 - RNA, 18 nt, Human
cacaaaaguuucucuuuu

SEQ ID NO: 3344532 - RNA, 17 nt, Human
cacacacgcgugcacac

SEQ ID NO: 3344533 - RNA, 14 nt, Human
cacacacacauaca

SEQ ID NO: 3344534 - RNA, 13 nt, Human
cacacacacauac

SEQ ID NO: 3344535 - RNA, 12 nt, Human
cacacacacaua

SEQ ID NO: 3344536 - RNA, 15 nt, Human
cacacacacauacac

SEQ ID NO: 3344537 - RNA, 14 nt, Human
cacacacacacaua

SEQ ID NO: 3344538 - RNA, 13 nt, Human
cacaaaggagagc

SEQ ID NO: 3344539 - RNA, 13 nt, Human
caaacagaggccg

SEQ ID NO: 3344540 - RNA, 11 nt, Human
caaaaugaaac

SEQ ID NO: 3344541 - RNA, 22 nt, Human
caaaaugaaacgcaaccaccac

SEQ ID NO: 3344542 - RNA, 20 nt, Human
caaacucuugaccucaggug

SEQ ID NO: 3344543 - RNA, 19 nt, Human
caaacucuugaccucaggu

SEQ ID NO: 3344544 - RNA, 17 nt, Human
caaacucuugaccucag

SEQ ID NO: 3344545 - RNA, 21 nt, Human
caaacucuugaccucagguga

SEQ ID NO: 3344546 - RNA, 15 nt, Human
caaaacgguuuuacu

SEQ ID NO: 3344547 - RNA, 21 nt, Human
caaaacgguuuuacugcagcu

SEQ ID NO: 3344548 - RNA, 18 nt, Human
auuuuauuuuauuaugca

SEQ ID NO: 3344549 - RNA, 15 nt, Human
caaaacucuccucug

SEQ ID NO: 3344550 - RNA, 16 nt, Human
caaaacucuccucugc

SEQ ID NO: 3344551 - RNA, 23 nt, Human
caaaacucuccucugcugcuggc

SEQ ID NO: 3344552 - RNA, 14 nt, Human
caaaaguuucucuu

SEQ ID NO: 3344553 - RNA, 21 nt, Human
caaaaucgaugcagugcuucc

SEQ ID NO: 3344554 - RNA, 14 nt, Human
caaaauaaaacuuu

SEQ ID NO: 3344555 - RNA, 16 nt, Human
caaaauaaaacuuuuu

SEQ ID NO: 3344556 - RNA, 20 nt, Human
caaaauaaaacuuuuuaaaa

SEQ ID NO: 3344557 - RNA, 17 nt, Human
caacauacucccaucug

SEQ ID NO: 3344558 - RNA, 19 nt, Human
caacauacucccaucugug

SEQ ID NO: 3344559 - RNA, 12 nt, Human
caacaggcuggg

SEQ ID NO: 3344560 - RNA, 20 nt, Human
caacauacucccaucuguga

SEQ ID NO: 3344561 - RNA, 16 nt, Human
caacauacucccaucu

SEQ ID NO: 3344562 - RNA, 15 nt, Human
caaauuucuaaaucu

SEQ ID NO: 3344563 - RNA, 22 nt, Human
caaauuucuaaaucuccaaaau

SEQ ID NO: 3344564 - RNA, 14 nt, Human
caaauuucuaaauc

SEQ ID NO: 3344565 - RNA, 23 nt, Human
caaagugcugggauuacaagcgu

SEQ ID NO: 3344566 - RNA, 19 nt, Human
caaaguggugagaggcauc

SEQ ID NO: 3344567 - RNA, 19 nt, Human
caaagugcugggauuacaa

SEQ ID NO: 3344568 - RNA, 13 nt, Human
caaagugcuggga

SEQ ID NO: 3344569 - RNA, 23 nt, Human
caaauggaaaugggcagagcaga

SEQ ID NO: 3344570 - RNA, 22 nt, Human
caaauggaaaugggcagagcag

SEQ ID NO: 3344571 - RNA, 21 nt, Human
caagaccuucuccuucaccuu

SEQ ID NO: 3344572 - RNA, 23 nt, Human
caagaccuucuccuucaccuuug

SEQ ID NO: 3344573 - RNA, 13 nt, Human
caagacgcugugc

SEQ ID NO: 3344574 - RNA, 13 nt, Human
caagaagcccagg

SEQ ID NO: 3344575 - RNA, 22 nt, Human
ugaggaugaaaaaauaacacug

SEQ ID NO: 3344576 - RNA, 22 nt, Human
ugagccgagaucacgccacugc

SEQ ID NO: 3344577 - RNA, 23 nt, Human
ugagcagggcucagcggggacag

SEQ ID NO: 3344578 - RNA, 22 nt, Human
ugagcagggcucagcggggaca

SEQ ID NO: 3344579 - RNA, 20 nt, Human
ugagcagggcucagcgggga

SEQ ID NO: 3344580 - RNA, 23 nt, Human
ugagccgagaucacgccacugca

SEQ ID NO: 3344581 - RNA, 11 nt, Human
ugagcucagga

SEQ ID NO: 3344582 - RNA, 19 nt, Human
ugagcucaggaguuugaga

SEQ ID NO: 3344583 - RNA, 18 nt, Human
ugaggcucugcccuuggu

SEQ ID NO: 3344584 - RNA, 15 nt, Human
ugaggcugggcuccc

SEQ ID NO: 3344585 - RNA, 16 nt, Human
ugaggcugggcucccu

SEQ ID NO: 3344586 - RNA, 16 nt, Human
ugaggcucugcccuug

SEQ ID NO: 3344587 - RNA, 15 nt, Human
ugaggcucugcccuu

SEQ ID NO: 3344588 - RNA, 19 nt, Human
ugaggucagagccugcagu

SEQ ID NO: 3344589 - RNA, 18 nt, Human
ugaggucagagccugcag

SEQ ID NO: 3344590 - RNA, 21 nt, Human
ugaggcugggcucccuuccca

SEQ ID NO: 3344591 - RNA, 17 nt, Human
ugaggucagagccugca

SEQ ID NO: 3344592 - RNA, 21 nt, Human
ugaggugggaggaucucuuga

SEQ ID NO: 3344593 - RNA, 12 nt, Human
ugagguguacca

SEQ ID NO: 3344594 - RNA, 22 nt, Human
ugacuuuucuguccgagcuuug

SEQ ID NO: 3344595 - RNA, 15 nt, Human
ugagaaauaaaguuu

SEQ ID NO: 3344596 - RNA, 14 nt, Human
ugagaggggaacag

SEQ ID NO: 3344597 - RNA, 18 nt, Human
ugagaggggaacagacug

SEQ ID NO: 3344598 - RNA, 14 nt, Human
ugagaccaaccugg

SEQ ID NO: 3344599 - RNA, 13 nt, Human
ugaccauucucca

SEQ ID NO: 3344600 - RNA, 16 nt, Human
ugacuuuccucuuugg

SEQ ID NO: 3344601 - RNA, 21 nt, Human
ugacucuuucuauuguuucuu

SEQ ID NO: 3344602 - RNA, 23 nt, Human
ugaacuggguacuuguggacaca

SEQ ID NO: 3344603 - RNA, 20 nt, Human
ugaagacucauucuucugua

SEQ ID NO: 3344604 - RNA, 19 nt, Human
ugaagacucauucuucugu

SEQ ID NO: 3344605 - RNA, 16 nt, Human
ugaaggcuggguucug

SEQ ID NO: 3344606 - RNA, 17 nt, Human
ugaaggccccgcccagg

SEQ ID NO: 3344607 - RNA, 19 nt, Human
ugaaggccccgcccaggcu

SEQ ID NO: 3344608 - RNA, 20 nt, Human
ugaaggccccgcccaggcuu

SEQ ID NO: 3344609 - RNA, 18 nt, Human
ugaaggccccgcccaggc

SEQ ID NO: 3344610 - RNA, 20 nt, Human
ugaaggcuggguucugaucc

SEQ ID NO: 3344611 - RNA, 21 nt, Human
ugaaggcuggguucugauccu

SEQ ID NO: 3344612 - RNA, 23 nt, Human
ugaaugaugauccuaggcauuug

SEQ ID NO: 3344613 - RNA, 13 nt, Human
ugacaacacucau

SEQ ID NO: 3344614 - RNA, 23 nt, Human
ugacaacacucauugaccugagg

SEQ ID NO: 3344615 - RNA, 13 nt, Human
ugaauuguaagga

SEQ ID NO: 3344616 - RNA, 21 nt, Human
ugaauuguaaggaaugauuaa

SEQ ID NO: 3344617 - RNA, 23 nt, Human
ugacaaggauugcuacuguccua

SEQ ID NO: 3344618 - RNA, 18 nt, Human
ugacaaggauugcuacug

SEQ ID NO: 3344619 - RNA, 16 nt, Human
ugacagacacaggccc

SEQ ID NO: 3344620 - RNA, 14 nt, Human
ugacagacacaggc

SEQ ID NO: 3344621 - RNA, 13 nt, Human
ugacagacacagg

SEQ ID NO: 3344622 - RNA, 14 nt, Human
ugacacacagcucu

SEQ ID NO: 3344623 - RNA, 15 nt, Human
ugacacacagcucug

SEQ ID NO: 3344624 - RNA, 22 nt, Human
ugacagagcaagugagacccug

SEQ ID NO: 3344625 - RNA, 23 nt, Human
ugacaucaacugcaucaagaugu

SEQ ID NO: 3344626 - RNA, 18 nt, Human
ugacagacacaggcccgg

SEQ ID NO: 3344627 - RNA, 17 nt, Human
ugacagacacaggcccg

SEQ ID NO: 3344628 - RNA, 20 nt, Human
ugaccagcaccaucucuccu

SEQ ID NO: 3344629 - RNA, 22 nt, Human
ugaaaacacuguucucugcccu

SEQ ID NO: 3344630 - RNA, 23 nt, Human
ugaaaacacuguucucugcccuc

SEQ ID NO: 3344631 - RNA, 20 nt, Human
ugaaaacacauuuuucuuag

SEQ ID NO: 3344632 - RNA, 17 nt, Human
ugaaaacacuguucucu

SEQ ID NO: 3344633 - RNA, 20 nt, Human
ugaaaacacuguucucugcc

SEQ ID NO: 3344634 - RNA, 21 nt, Human
ugaaaacacuguucucugccc

SEQ ID NO: 3344635 - RNA, 21 nt, Human
ugaaaacacauuuuucuuagg

SEQ ID NO: 3344636 - RNA, 19 nt, Human
ugaaaagaaaaaugagccu

SEQ ID NO: 3344637 - RNA, 15 nt, Human
ugaaaagaaaaauga

SEQ ID NO: 3344638 - RNA, 20 nt, Human
ugaaaagaaaaaugagccug

SEQ ID NO: 3344639 - RNA, 14 nt, Human
ugaaaauucagugg

SEQ ID NO: 3344640 - RNA, 14 nt, Human
ucuuuggacccuga

SEQ ID NO: 3344641 - RNA, 15 nt, Human
ucuuuggacccugag

SEQ ID NO: 3344642 - RNA, 13 nt, Human
ucuuuggacccug

SEQ ID NO: 3344643 - RNA, 17 nt, Human
ucuuugcagacaggcaa

SEQ ID NO: 3344644 - RNA, 14 nt, Human
ucuuugcagacagg

SEQ ID NO: 3344645 - RNA, 13 nt, Human
ucuuugcagacag

SEQ ID NO: 3344646 - RNA, 23 nt, Human
ucuuuccaaaguacacuguuuca

SEQ ID NO: 3344647 - RNA, 13 nt, Human
ucuuguguguuua

SEQ ID NO: 3344648 - RNA, 13 nt, Human
ucuuucccucccu

SEQ ID NO: 3344649 - RNA, 17 nt, Human
ucuuuccaaaguacacu

SEQ ID NO: 3344650 - RNA, 12 nt, Human
ucuuucccuccc

SEQ ID NO: 3344651 - RNA, 20 nt, Human
ucuuagguuggcaaaaaggc

SEQ ID NO: 3344652 - RNA, 23 nt, Human
ucuuagguuggcaaaaaggcagg

SEQ ID NO: 3344653 - RNA, 20 nt, Human
ucugugucagguggggcagc

SEQ ID NO: 3344654 - RNA, 17 nt, Human
ucugugucagguggggc

SEQ ID NO: 3344655 - RNA, 15 nt, Human
ucuuagauguauaua

SEQ ID NO: 3344656 - RNA, 14 nt, Human
ucuuagauguauau

SEQ ID NO: 3344657 - RNA, 22 nt, Human
ucuuauccaacaucaacaucuu

SEQ ID NO: 3344658 - RNA, 14 nt, Human
ucuucagaucucua

SEQ ID NO: 3344659 - RNA, 20 nt, Human
ucuucagagacuccugcagg

SEQ ID NO: 3344660 - RNA, 21 nt, Human
ucuucagagacuccugcaggc

SEQ ID NO: 3344661 - RNA, 14 nt, Human
ucuugcucugcuga

SEQ ID NO: 3344662 - RNA, 23 nt, Human
ucuugcucugcugacagacacag

SEQ ID NO: 3344663 - RNA, 15 nt, Human
ucuugcucugcugac

SEQ ID NO: 3344664 - RNA, 13 nt, Human
ucuugcucugcug

SEQ ID NO: 3344665 - RNA, 15 nt, Human
ucuugcaugaggcua

SEQ ID NO: 3344666 - RNA, 13 nt, Human
ucuugaagacuuu

SEQ ID NO: 3344667 - RNA, 22 nt, Human
ucuugaagacuuuucuuucagc

SEQ ID NO: 3344668 - RNA, 20 nt, Human
ucuugaaauauaggaacuua

SEQ ID NO: 3344669 - RNA, 21 nt, Human
ucuugaaauauaggaacuuaa

SEQ ID NO: 3344670 - RNA, 18 nt, Human
ucugagaggacuuuucuu

SEQ ID NO: 3344671 - RNA, 19 nt, Human
ucugacccaugcugcccug

SEQ ID NO: 3344672 - RNA, 20 nt, Human
ucugacccaugcugcccugu

SEQ ID NO: 3344673 - RNA, 22 nt, Human
ucugacccaugcugcccuguga

SEQ ID NO: 3344674 - RNA, 21 nt, Human
ucugcaagaauugaagcagga

SEQ ID NO: 3344675 - RNA, 21 nt, Human
ucugaggaauccagacccggc

SEQ ID NO: 3344676 - RNA, 18 nt, Human
ucugaggaauccagaccc

SEQ ID NO: 3344677 - RNA, 22 nt, Human
ucugaggaauccagacccggcu

SEQ ID NO: 3344678 - RNA, 17 nt, Human
ucugaggaauccagacc

SEQ ID NO: 3344679 - RNA, 13 nt, Human
ucugcccacuccc

SEQ ID NO: 3344680 - RNA, 14 nt, Human
ucugcccacucccu

SEQ ID NO: 3344681 - RNA, 12 nt, Human
ucugccucccau

SEQ ID NO: 3344682 - RNA, 13 nt, Human
ucugccucccauc

SEQ ID NO: 3344683 - RNA, 15 nt, Human
ucugccucccaucac

SEQ ID NO: 3344684 - RNA, 23 nt, Human
ucugccauauucuguuggccagu

SEQ ID NO: 3344685 - RNA, 22 nt, Human
ucugccauauucuguuggccag

SEQ ID NO: 3344686 - RNA, 12 nt, Human
ucugcccacucc

SEQ ID NO: 3344687 - RNA, 18 nt, Human
ucugccauauucuguugg

SEQ ID NO: 3344688 - RNA, 20 nt, Human
ucugccugaagucacacagu

SEQ ID NO: 3344689 - RNA, 19 nt, Human
ucugccugaagucacacag

SEQ ID NO: 3344690 - RNA, 22 nt, Human
ucugccucugacacacagcucu

SEQ ID NO: 3344691 - RNA, 21 nt, Human
ucugccucugacacacagcuc

SEQ ID NO: 3344692 - RNA, 23 nt, Human
ucugccucugacacacagcucug

SEQ ID NO: 3344693 - RNA, 16 nt, Human
ucugccucccaucacc

SEQ ID NO: 3344694 - RNA, 17 nt, Human
ucugccucccaucaccc

SEQ ID NO: 3344695 - RNA, 20 nt, Human
ucugccucccaucacccgcu

SEQ ID NO: 3344696 - RNA, 21 nt, Human
ucugccucccaucacccgcua

SEQ ID NO: 3344697 - RNA, 18 nt, Human
ucugccucugacacacag

SEQ ID NO: 3344698 - RNA, 15 nt, Human
ucugccucugacaca

SEQ ID NO: 3344699 - RNA, 16 nt, Human
ucuggaaugcaguggu

SEQ ID NO: 3344700 - RNA, 14 nt, Human
ucugcugcuggcug

SEQ ID NO: 3344701 - RNA, 15 nt, Human
ucugcugcuggcugg

SEQ ID NO: 3344702 - RNA, 17 nt, Human
ucugcugcuggcugguu

SEQ ID NO: 3344703 - RNA, 20 nt, Human
ucugccugcccaggccccug

SEQ ID NO: 3344704 - RNA, 18 nt, Human
ucugccugcccaggcccc

SEQ ID NO: 3344705 - RNA, 17 nt, Human
ucugccugcccaggccc

SEQ ID NO: 3344706 - RNA, 16 nt, Human
ucugccugcccaggcc

SEQ ID NO: 3344707 - RNA, 21 nt, Human
ucugcuccucuccccagcaag

SEQ ID NO: 3344708 - RNA, 11 nt, Human
ucugcugcugg

SEQ ID NO: 3344709 - RNA, 13 nt, Human
ucugcugcuggcu

SEQ ID NO: 3344710 - RNA, 17 nt, Human
ucugucgcccagucugg

SEQ ID NO: 3344711 - RNA, 12 nt, Human
ucuguccuggga

SEQ ID NO: 3344712 - RNA, 14 nt, Human
ucuguacagagccc

SEQ ID NO: 3344713 - RNA, 15 nt, Human
ucuguacagagccca

SEQ ID NO: 3344714 - RNA, 20 nt, Human
ucuguccuacucugugucag

SEQ ID NO: 3344715 - RNA, 13 nt, Human
ucugucuaggaau

SEQ ID NO: 3344716 - RNA, 16 nt, Human
ucugucgcccagucug

SEQ ID NO: 3344717 - RNA, 22 nt, Human
uccacugugccaugugccaggu

SEQ ID NO: 3344718 - RNA, 21 nt, Human
uccacugugccaugugccagg

SEQ ID NO: 3344719 - RNA, 14 nt, Human
uccacccugcucuc

SEQ ID NO: 3344720 - RNA, 13 nt, Human
uccacccugcucu

SEQ ID NO: 3344721 - RNA, 21 nt, Human
uccacccugcucuccgaccag

SEQ ID NO: 3344722 - RNA, 14 nt, Human
uccacuuucuagcc

SEQ ID NO: 3344723 - RNA, 20 nt, Human
uccacaagagcccaggccuc

SEQ ID NO: 3344724 - RNA, 19 nt, Human
uccacaagagcccaggccu

SEQ ID NO: 3344725 - RNA, 21 nt, Human
uccacaagagcccaggccucc

SEQ ID NO: 3344726 - RNA, 15 nt, Human
uccaagaagcccagg

SEQ ID NO: 3344727 - RNA, 16 nt, Human
uccaagaagcccagga

SEQ ID NO: 3344728 - RNA, 14 nt, Human
uccaagaagcccag

SEQ ID NO: 3344729 - RNA, 12 nt, Human
uccaagaagccc

SEQ ID NO: 3344730 - RNA, 19 nt, Human
uccaagaccuucuccuuca

SEQ ID NO: 3344731 - RNA, 20 nt, Human
uccaagaccuucuccuucac

SEQ ID NO: 3344732 - RNA, 14 nt, Human
uccaagcaggacau

SEQ ID NO: 3344733 - RNA, 17 nt, Human
ucccaggcauuccccag

SEQ ID NO: 3344734 - RNA, 18 nt, Human
ucccaggcauuccccagg

SEQ ID NO: 3344735 - RNA, 16 nt, Human
ucccaugagccucagc

SEQ ID NO: 3344736 - RNA, 15 nt, Human
ucccaugagccucag

SEQ ID NO: 3344737 - RNA, 14 nt, Human
ucccacucagucca

SEQ ID NO: 3344738 - RNA, 18 nt, Human
ucccaccuuggcugcagg

SEQ ID NO: 3344739 - RNA, 21 nt, Human
ucccaccuuggcugcagggag

SEQ ID NO: 3344740 - RNA, 19 nt, Human
ucccaccuuggcugcaggg

SEQ ID NO: 3344741 - RNA, 17 nt, Human
ucccaccucucucacuc

SEQ ID NO: 3344742 - RNA, 18 nt, Human
ucccaccucucucacucc

SEQ ID NO: 3344743 - RNA, 14 nt, Human
ucccaccucucuca

SEQ ID NO: 3344744 - RNA, 16 nt, Human
ucccaccucagccucc

SEQ ID NO: 3344745 - RNA, 18 nt, Human
ucccaccucagccucccg

SEQ ID NO: 3344746 - RNA, 15 nt, Human
uccauagagagcaag

SEQ ID NO: 3344747 - RNA, 17 nt, Human
uccauagagagcaagac

SEQ ID NO: 3344748 - RNA, 20 nt, Human
uccauagagagcaagacgcu

SEQ ID NO: 3344749 - RNA, 19 nt, Human
ucccaacucaccccagccc

SEQ ID NO: 3344750 - RNA, 21 nt, Human
ucccaacucaccccagcccca

SEQ ID NO: 3344751 - RNA, 17 nt, Human
ucccaacucaccccagc

SEQ ID NO: 3344752 - RNA, 18 nt, Human
ucccaacucaccccagcc

SEQ ID NO: 3344753 - RNA, 15 nt, Human
ucauacucaccucac

SEQ ID NO: 3344754 - RNA, 17 nt, Human
ucagucugauucccaag

SEQ ID NO: 3344755 - RNA, 18 nt, Human
ucagugugacugaucucu

SEQ ID NO: 3344756 - RNA, 21 nt, Human
ucagguggggcagcuugaggg

SEQ ID NO: 3344757 - RNA, 16 nt, Human
ucagguggggcagcuu

SEQ ID NO: 3344758 - RNA, 15 nt, Human
ucagguggggcagcu

SEQ ID NO: 3344759 - RNA, 20 nt, Human
ucaggugcugccauccaggu

SEQ ID NO: 3344760 - RNA, 18 nt, Human
ucaggugcugccauccag

SEQ ID NO: 3344761 - RNA, 14 nt, Human
ucagguggggcagc

SEQ ID NO: 3344762 - RNA, 17 nt, Human
ucagguggggucacucu

SEQ ID NO: 3344763 - RNA, 20 nt, Human
ucagguggggucacucuggc

SEQ ID NO: 3344764 - RNA, 15 nt, Human
ucaggugcugccauc

SEQ ID NO: 3344765 - RNA, 15 nt, Human
ucaguccauagcaga

SEQ ID NO: 3344766 - RNA, 15 nt, Human
ucagcugcuacuacu

SEQ ID NO: 3344767 - RNA, 21 nt, Human
ucagcuccagcucaccagccc

SEQ ID NO: 3344768 - RNA, 18 nt, Human
ucagcuccagcucaccag

SEQ ID NO: 3344769 - RNA, 15 nt, Human
ucagcuccagcucac

SEQ ID NO: 3344770 - RNA, 16 nt, Human
ucagccugcuccagcu

SEQ ID NO: 3344771 - RNA, 12 nt, Human
ucagccucccga

SEQ ID NO: 3344772 - RNA, 22 nt, Human
ucagccucccaaagugcuggga

SEQ ID NO: 3344773 - RNA, 12 nt, Human
ucagccucccaa

SEQ ID NO: 3344774 - RNA, 21 nt, Human
ucagccucccaaagugcuggg

SEQ ID NO: 3344775 - RNA, 18 nt, Human
ucagcauccuggcacccg

SEQ ID NO: 3344776 - RNA, 17 nt, Human
ucagcauccuggcaccc

SEQ ID NO: 3344777 - RNA, 16 nt, Human
ucagcauccuggcacc

SEQ ID NO: 3344778 - RNA, 15 nt, Human
ucagcauccuggcac

SEQ ID NO: 3344779 - RNA, 15 nt, Human
ucagcacgauuucug

SEQ ID NO: 3344780 - RNA, 16 nt, Human
ucagcacgauuucugu

SEQ ID NO: 3344781 - RNA, 17 nt, Human
ucagcacgauuucuguu

SEQ ID NO: 3344782 - RNA, 18 nt, Human
uccuuugugaggaagccg

SEQ ID NO: 3344783 - RNA, 22 nt, Human
uccuuugugaggaagccgcugg

SEQ ID NO: 3344784 - RNA, 17 nt, Human
uccuuugugaggaagcc

SEQ ID NO: 3344785 - RNA, 18 nt, Human
uccuuggugucgggcaug

SEQ ID NO: 3344786 - RNA, 21 nt, Human
uccuuggugucgggcaugaca

SEQ ID NO: 3344787 - RNA, 22 nt, Human
uccuugaaaacacuguucucug

SEQ ID NO: 3344788 - RNA, 23 nt, Human
uccuugaaaacacuguucucugc

SEQ ID NO: 3344789 - RNA, 20 nt, Human
uccuuaccagcagagcaccu

SEQ ID NO: 3344790 - RNA, 21 nt, Human
uccuuaccagcagagcaccuu

SEQ ID NO: 3344791 - RNA, 18 nt, Human
uccuuuucgcaggauucu

SEQ ID NO: 3344792 - RNA, 22 nt, Human
uccuuuucgcaggauucuuccu

SEQ ID NO: 3344793 - RNA, 23 nt, Human
ucgcaggauucuuccucccuccc

SEQ ID NO: 3344794 - RNA, 21 nt, Human
ucgcaggauucuuccucccuc

SEQ ID NO: 3344795 - RNA, 17 nt, Human
ucgcaggauucuuccuc

SEQ ID NO: 3344796 - RNA, 15 nt, Human
ucggaaaacaugcua

SEQ ID NO: 3344797 - RNA, 18 nt, Human
ucggaaaacaugcuacac

SEQ ID NO: 3344798 - RNA, 23 nt, Human
ucgcccagucuggaaugcagugg

SEQ ID NO: 3344799 - RNA, 19 nt, Human
ucgcccagucuggaaugca

SEQ ID NO: 3344800 - RNA, 14 nt, Human
ucgcccagucugga

SEQ ID NO: 3344801 - RNA, 23 nt, Human
ucgucacugcuuaacuucacaua

SEQ ID NO: 3344802 - RNA, 14 nt, Human
ucucaaauuucuaa

SEQ ID NO: 3344803 - RNA, 16 nt, Human
ucucaaauuucuaaau

SEQ ID NO: 3344804 - RNA, 13 nt, Human
ucucaaauuucua

SEQ ID NO: 3344805 - RNA, 16 nt, Human
ucucacacaugagcau

SEQ ID NO: 3344806 - RNA, 20 nt, Human
ucucacugccaugccagcuu

SEQ ID NO: 3344807 - RNA, 22 nt, Human
ucucacucugucgcccagucug

SEQ ID NO: 3344808 - RNA, 21 nt, Human
ucucacacaugagcaucaggc

SEQ ID NO: 3344809 - RNA, 23 nt, Human
ucucacucugucgcccagucugg

SEQ ID NO: 3344810 - RNA, 15 nt, Human
ucucacuguugccca

SEQ ID NO: 3344811 - RNA, 14 nt, Human
ucucacuguugccc

SEQ ID NO: 3344812 - RNA, 18 nt, Human
ucuacucuagggaaaaac

SEQ ID NO: 3344813 - RNA, 18 nt, Human
ucuaggaggucucuaaga

SEQ ID NO: 3344814 - RNA, 20 nt, Human
ucuacucgaguuacagacaa

SEQ ID NO: 3344815 - RNA, 21 nt, Human
ucuacucgaguuacagacaaa

SEQ ID NO: 3344816 - RNA, 12 nt, Human
ucuagggaaaaa

SEQ ID NO: 3344817 - RNA, 14 nt, Human
ucuaauauguaaca

SEQ ID NO: 3344818 - RNA, 21 nt, Human
uccgcuuucuacccagcgagc

SEQ ID NO: 3344819 - RNA, 20 nt, Human
uccgcuuucuacccagcgag

SEQ ID NO: 3344820 - RNA, 22 nt, Human
uccgaaagggacuuggaagcuc

SEQ ID NO: 3344821 - RNA, 17 nt, Human
uccgaccagacaccuug

SEQ ID NO: 3344822 - RNA, 21 nt, Human
uccgaaagggacuuggaagcu

SEQ ID NO: 3344823 - RNA, 17 nt, Human
ucccuucccaccucucu

SEQ ID NO: 3344824 - RNA, 21 nt, Human
ucccuucccacuggaggcaug

SEQ ID NO: 3344825 - RNA, 14 nt, Human
ucccuucccaccuc

SEQ ID NO: 3344826 - RNA, 16 nt, Human
ucccuucccaccucuc

SEQ ID NO: 3344827 - RNA, 14 nt, Human
ucccugccaaugga

SEQ ID NO: 3344828 - RNA, 16 nt, Human
ucccugccaauggacu

SEQ ID NO: 3344829 - RNA, 13 nt, Human
ucccucuggggcu

SEQ ID NO: 3344830 - RNA, 17 nt, Human
ucccucuggggcuguuc

SEQ ID NO: 3344831 - RNA, 20 nt, Human
ucccugcacuugcagacucu

SEQ ID NO: 3344832 - RNA, 18 nt, Human
ucccucccuuccucuuuc

SEQ ID NO: 3344833 - RNA, 22 nt, Human
ucccaugagccucagcauccug

SEQ ID NO: 3344834 - RNA, 16 nt, Human
uccuaagcuauucagu

SEQ ID NO: 3344835 - RNA, 14 nt, Human
uccuaguuccacca

SEQ ID NO: 3344836 - RNA, 17 nt, Human
uccuaguuccaccauca

SEQ ID NO: 3344837 - RNA, 12 nt, Human
uccuaguuccac

SEQ ID NO: 3344838 - RNA, 21 nt, Human
uccuaguuccaccaucaagcc

SEQ ID NO: 3344839 - RNA, 14 nt, Human
uccuccaggugcac

SEQ ID NO: 3344840 - RNA, 18 nt, Human
uccuccaggugcacaagc

SEQ ID NO: 3344841 - RNA, 20 nt, Human
uccuccaggugcacaagcuc

SEQ ID NO: 3344842 - RNA, 22 nt, Human
uccuccaggugcacaagcucca

SEQ ID NO: 3344843 - RNA, 12 nt, Human
uccuccaggugc

SEQ ID NO: 3344844 - RNA, 13 nt, Human
uccuccaggugca

SEQ ID NO: 3344845 - RNA, 10 nt, Human
uccuccaggu

SEQ ID NO: 3344846 - RNA, 12 nt, Human
uccuccucagau

SEQ ID NO: 3344847 - RNA, 17 nt, Human
uccucugcugcuggcug

SEQ ID NO: 3344848 - RNA, 13 nt, Human
uccucuguacaga

SEQ ID NO: 3344849 - RNA, 15 nt, Human
uccucuggccugugu

SEQ ID NO: 3344850 - RNA, 21 nt, Human
uccuccuuuucacaguucucu

SEQ ID NO: 3344851 - RNA, 19 nt, Human
uccuccuuuucacaguucu

SEQ ID NO: 3344852 - RNA, 21 nt, Human
uccucuaggaggucucuaaga

SEQ ID NO: 3344853 - RNA, 17 nt, Human
uccucuaggaggucucu

SEQ ID NO: 3344854 - RNA, 17 nt, Human
uccugagccagauuuca

SEQ ID NO: 3344855 - RNA, 23 nt, Human
uccucuguacagagcccacgccc

SEQ ID NO: 3344856 - RNA, 19 nt, Human
uccucuguacagagcccac

SEQ ID NO: 3344857 - RNA, 18 nt, Human
uccugagccagauuucac

SEQ ID NO: 3344858 - RNA, 19 nt, Human
uccugagccagauuucacu

SEQ ID NO: 3344859 - RNA, 14 nt, Human
uccugagccagauu

SEQ ID NO: 3344860 - RNA, 15 nt, Human
uccugaggcugggcu

SEQ ID NO: 3344861 - RNA, 16 nt, Human
uccugaggcugggcuc

SEQ ID NO: 3344862 - RNA, 17 nt, Human
uccugaggcugggcucc

SEQ ID NO: 3344863 - RNA, 19 nt, Human
uccugaggcugggcucccu

SEQ ID NO: 3344864 - RNA, 12 nt, Human
uccugaggcugg

SEQ ID NO: 3344865 - RNA, 21 nt, Human
uggccagaugcaccagcccuu

SEQ ID NO: 3344866 - RNA, 20 nt, Human
uggccagaugcaccagcccu

SEQ ID NO: 3344867 - RNA, 23 nt, Human
uggcagcugcgguccacccagga

SEQ ID NO: 3344868 - RNA, 13 nt, Human
uggcagcugcuuu

SEQ ID NO: 3344869 - RNA, 21 nt, Human
uggcacccggccccugcuggu

SEQ ID NO: 3344870 - RNA, 20 nt, Human
uggauuuaacagaaauguac

SEQ ID NO: 3344871 - RNA, 24 nt, Human
uggauuuaacagaaauguacagca

SEQ ID NO: 3344872 - RNA, 17 nt, Human
uggauuuaacagaaaug

SEQ ID NO: 3344873 - RNA, 12 nt, Human
uggaggaaggaa

SEQ ID NO: 3344874 - RNA, 18 nt, Human
uggaggaaggaaacccag

SEQ ID NO: 3344875 - RNA, 17 nt, Human
uggaaaaauagccugcc

SEQ ID NO: 3344876 - RNA, 20 nt, Human
uggaaaaauagccugccucu

SEQ ID NO: 3344877 - RNA, 21 nt, Human
uggaaagacuuuuccaacccu

SEQ ID NO: 3344878 - RNA, 20 nt, Human
uggaaagaguaggaagacuu

SEQ ID NO: 3344879 - RNA, 15 nt, Human
uggaauauauaacca

SEQ ID NO: 3344880 - RNA, 16 nt, Human
uggaauauauaaccag

SEQ ID NO: 3344881 - RNA, 17 nt, Human
uggaauaaggagaauga

SEQ ID NO: 3344882 - RNA, 19 nt, Human
uggaauaacauguaauuaa

SEQ ID NO: 3344883 - RNA, 15 nt, Human
uggaauaacauguaa

SEQ ID NO: 3344884 - RNA, 14 nt, Human
uggaauaacaugua

SEQ ID NO: 3344885 - RNA, 13 nt, Human
uggacaugcacag

SEQ ID NO: 3344886 - RNA, 19 nt, Human
uggacaugcacagcuaaca

SEQ ID NO: 3344887 - RNA, 20 nt, Human
uggacuaacuugucuuugga

SEQ ID NO: 3344888 - RNA, 19 nt, Human
ugggguuuaucagaauucu

SEQ ID NO: 3344889 - RNA, 15 nt, Human
uggguucuacccagg

SEQ ID NO: 3344890 - RNA, 16 nt, Human
uggguucuacccaggu

SEQ ID NO: 3344891 - RNA, 22 nt, Human
uggguucuacccaggugcuagg

SEQ ID NO: 3344892 - RNA, 14 nt, Human
uggguguggcgcag

SEQ ID NO: 3344893 - RNA, 21 nt, Human
uggguuucuaaagcugccagc

SEQ ID NO: 3344894 - RNA, 17 nt, Human
uggguuucuaaagcugc

SEQ ID NO: 3344895 - RNA, 18 nt, Human
uggguuucuaaagcugcc

SEQ ID NO: 3344896 - RNA, 23 nt, Human
ugguauuggcuagagguucaaag

SEQ ID NO: 3344897 - RNA, 15 nt, Human
ugggcuucaguggca

SEQ ID NO: 3344898 - RNA, 21 nt, Human
ugggcuugucuguagauuuua

SEQ ID NO: 3344899 - RNA, 16 nt, Human
ugggcagaggaaagca

SEQ ID NO: 3344900 - RNA, 22 nt, Human
ugggcuaagugauccucccacc

SEQ ID NO: 3344901 - RNA, 23 nt, Human
ugggcuggguucuacccaggugc

SEQ ID NO: 3344902 - RNA, 17 nt, Human
ugggcuggugucaccug

SEQ ID NO: 3344903 - RNA, 16 nt, Human
ugggcuaguugggcuu

SEQ ID NO: 3344904 - RNA, 21 nt, Human
ugggggaucacagccucugaa

SEQ ID NO: 3344905 - RNA, 20 nt, Human
ugggggaucacagccucuga

SEQ ID NO: 3344906 - RNA, 17 nt, Human
ugggggcugggcagagg

SEQ ID NO: 3344907 - RNA, 18 nt, Human
ugggggcugggcagagga

SEQ ID NO: 3344908 - RNA, 12 nt, Human
ugggggugcauu

SEQ ID NO: 3344909 - RNA, 15 nt, Human
ugggggugcauuuga

SEQ ID NO: 3344910 - RNA, 20 nt, Human
uggcugggggccucagugcc

SEQ ID NO: 3344911 - RNA, 21 nt, Human
uggcugggggccucagugcca

SEQ ID NO: 3344912 - RNA, 16 nt, Human
uggcugcuucaaggau

SEQ ID NO: 3344913 - RNA, 21 nt, Human
uggcugcuucaaggauccuga

SEQ ID NO: 3344914 - RNA, 14 nt, Human
uggcuuuugugcau

SEQ ID NO: 3344915 - RNA, 22 nt, Human
uggcuuccuaaaauucagugga

SEQ ID NO: 3344916 - RNA, 13 nt, Human
ugggagcaaaaga

SEQ ID NO: 3344917 - RNA, 16 nt, Human
ugggagagccuuccag

SEQ ID NO: 3344918 - RNA, 14 nt, Human
ugggagcugccugu

SEQ ID NO: 3344919 - RNA, 13 nt, Human
ugggagcugccug

SEQ ID NO: 3344920 - RNA, 12 nt, Human
ugggagcugccu

SEQ ID NO: 3344921 - RNA, 12 nt, Human
ugggacacccug

SEQ ID NO: 3344922 - RNA, 16 nt, Human
ugggauuacaggugug

SEQ ID NO: 3344923 - RNA, 18 nt, Human
ugggauccuccaggugca

SEQ ID NO: 3344924 - RNA, 13 nt, Human
ugggauccuggag

SEQ ID NO: 3344925 - RNA, 15 nt, Human
ugggcagaggaaagc

SEQ ID NO: 3344926 - RNA, 21 nt, Human
ugggagcugccuguucagcuc

SEQ ID NO: 3344927 - RNA, 17 nt, Human
ugggagcugccuguuca

SEQ ID NO: 3344928 - RNA, 22 nt, Human
ugggagcugccuguucagcucc

SEQ ID NO: 3344929 - RNA, 15 nt, Human
ugggagugagcuggu

SEQ ID NO: 3344930 - RNA, 15 nt, Human
ugggauccuccaggu

SEQ ID NO: 3344931 - RNA, 14 nt, Human
ugggauccuccagg

SEQ ID NO: 3344932 - RNA, 20 nt, Human
ugccauccagguucagcuug

SEQ ID NO: 3344933 - RNA, 21 nt, Human
ugccauccagguucagcuugu

SEQ ID NO: 3344934 - RNA, 13 nt, Human
ugcccacucccug

SEQ ID NO: 3344935 - RNA, 13 nt, Human
ugcccaccuggcc

SEQ ID NO: 3344936 - RNA, 14 nt, Human
ugcccacucccugc

SEQ ID NO: 3344937 - RNA, 15 nt, Human
ugcccacucccugca

SEQ ID NO: 3344938 - RNA, 16 nt, Human
ugcccacucccugcaa

SEQ ID NO: 3344939 - RNA, 11 nt, Human
ugcccaggcug

SEQ ID NO: 3344940 - RNA, 23 nt, Human
ugccccucaacucuccuccagag

SEQ ID NO: 3344941 - RNA, 17 nt, Human
ugccccuggcagccccu

SEQ ID NO: 3344942 - RNA, 19 nt, Human
ugccccucaacucuccucc

SEQ ID NO: 3344943 - RNA, 14 nt, Human
ugcaucaagaugug

SEQ ID NO: 3344944 - RNA, 22 nt, Human
ugccagguuuuuggucugaccc

SEQ ID NO: 3344945 - RNA, 19 nt, Human
ugccagguuuuuggucuga

SEQ ID NO: 3344946 - RNA, 18 nt, Human
ugccagguuuuuggucug

SEQ ID NO: 3344947 - RNA, 22 nt, Human
ugccacuacggaauaguuggcu

SEQ ID NO: 3344948 - RNA, 19 nt, Human
ugccacccuggggagaaag

SEQ ID NO: 3344949 - RNA, 20 nt, Human
ugcagcaauaaagcagcguu

SEQ ID NO: 3344950 - RNA, 23 nt, Human
ugcagcaauaaagcagcguuucu

SEQ ID NO: 3344951 - RNA, 12 nt, Human
ugcacuuuguuc

SEQ ID NO: 3344952 - RNA, 19 nt, Human
ugaguccccuguuuguuuc

SEQ ID NO: 3344953 - RNA, 23 nt, Human
ugcaccggcuggccuggccccuc

SEQ ID NO: 3344954 - RNA, 15 nt, Human
ugcaccgggccacag

SEQ ID NO: 3344955 - RNA, 14 nt, Human
ugcaccgggccaca

SEQ ID NO: 3344956 - RNA, 22 nt, Human
ugcaccgggccacagagaaagu

SEQ ID NO: 3344957 - RNA, 17 nt, Human
ugcaccgggccacagag

SEQ ID NO: 3344958 - RNA, 21 nt, Human
ugcaccggcuggccuggcccc

SEQ ID NO: 3344959 - RNA, 22 nt, Human
ugcagugguaugaucacggcuc

SEQ ID NO: 3344960 - RNA, 13 nt, Human
ugcaguugccagu

SEQ ID NO: 3344961 - RNA, 14 nt, Human
ugcaguugccaguc

SEQ ID NO: 3344962 - RNA, 13 nt, Human
ugcaggcagccag

SEQ ID NO: 3344963 - RNA, 14 nt, Human
ugcaggcagccagg

SEQ ID NO: 3344964 - RNA, 19 nt, Human
ugcaggcagccaggccaca

SEQ ID NO: 3344965 - RNA, 16 nt, Human
ugcagugcuuccaagg

SEQ ID NO: 3344966 - RNA, 15 nt, Human
ugcugauggugcaau

SEQ ID NO: 3344967 - RNA, 17 nt, Human
ugcugauggugcaauga

SEQ ID NO: 3344968 - RNA, 13 nt, Human
ugcugauggugca

SEQ ID NO: 3344969 - RNA, 12 nt, Human
ugcugaaggcuc

SEQ ID NO: 3344970 - RNA, 13 nt, Human
ugcugaaggcucg

SEQ ID NO: 3344971 - RNA, 19 nt, Human
ugcugacagacacaggccc

SEQ ID NO: 3344972 - RNA, 23 nt, Human
ugcugacagacacaggcccggcu

SEQ ID NO: 3344973 - RNA, 22 nt, Human
ugcugacagacacaggcccggc

SEQ ID NO: 3344974 - RNA, 16 nt, Human
ugcugcaguugccagu

SEQ ID NO: 3344975 - RNA, 18 nt, Human
ugcugcaguugccaguca

SEQ ID NO: 3344976 - RNA, 23 nt, Human
ugcugcaguugccagucaccccg

SEQ ID NO: 3344977 - RNA, 13 nt, Human
ugcugcuggcugg

SEQ ID NO: 3344978 - RNA, 17 nt, Human
ugcuccucuccccagca

SEQ ID NO: 3344979 - RNA, 18 nt, Human
ugcuccuuucuuguuuua

SEQ ID NO: 3344980 - RNA, 14 nt, Human
ugcuccucucccca

SEQ ID NO: 3344981 - RNA, 16 nt, Human
ugcucacauaucuguc

SEQ ID NO: 3344982 - RNA, 15 nt, Human
ugcucacauaucugu

SEQ ID NO: 3344983 - RNA, 16 nt, Human
ugcgccuacaggagug

SEQ ID NO: 3344984 - RNA, 14 nt, Human
ugcgccuacaggag

SEQ ID NO: 3344985 - RNA, 22 nt, Human
ugcgccuacaggagugagcacu

SEQ ID NO: 3344986 - RNA, 13 nt, Human
ugcgccuacagga

SEQ ID NO: 3344987 - RNA, 15 nt, Human
ugcuaaaugugaaug

SEQ ID NO: 3344988 - RNA, 21 nt, Human
ugcgaucuggguucacugcaa

SEQ ID NO: 3344989 - RNA, 20 nt, Human
ugcgaucuggguucacugca

SEQ ID NO: 3344990 - RNA, 19 nt, Human
ugcgaucuggguucacugc

SEQ ID NO: 3344991 - RNA, 15 nt, Human
ugcgaucuggguuca

SEQ ID NO: 3344992 - RNA, 14 nt, Human
ugcgaucuggguuc

SEQ ID NO: 3344993 - RNA, 19 nt, Human
ugccucgaacuggcugcaa

SEQ ID NO: 3344994 - RNA, 18 nt, Human
ugccucgaacuggcugca

SEQ ID NO: 3344995 - RNA, 20 nt, Human
ugccucgaacuggcugcaaa

SEQ ID NO: 3344996 - RNA, 18 nt, Human
ugccccuggcagccccug

SEQ ID NO: 3344997 - RNA, 21 nt, Human
ugccugggaucccucauccuc

SEQ ID NO: 3344998 - RNA, 18 nt, Human
ugccugggcagaaggaag

SEQ ID NO: 3344999 - RNA, 15 nt, Human
ugccugguggcagcu

SEQ ID NO: 3345000 - RNA, 14 nt, Human
ugccugguggcagc

SEQ ID NO: 3345001 - RNA, 19 nt, Human
uguacugcauaugaaagga

SEQ ID NO: 3345002 - RNA, 15 nt, Human
uguacgucugacagg

SEQ ID NO: 3345003 - RNA, 16 nt, Human
uguacagagcccacgc

SEQ ID NO: 3345004 - RNA, 17 nt, Human
uguacagagcccacgcc

SEQ ID NO: 3345005 - RNA, 13 nt, Human
uguacagagccca

SEQ ID NO: 3345006 - RNA, 18 nt, Human
uguacagagcccacgccc

SEQ ID NO: 3345007 - RNA, 16 nt, Human
ugucauuugagcaggg

SEQ ID NO: 3345008 - RNA, 23 nt, Human
ugucccaaaaagaaaggagggga

SEQ ID NO: 3345009 - RNA, 13 nt, Human
ugucaccugaaga

SEQ ID NO: 3345010 - RNA, 18 nt, Human
uguccccaccgcagacag

SEQ ID NO: 3345011 - RNA, 19 nt, Human
uguccccaccgcagacagg

SEQ ID NO: 3345012 - RNA, 22 nt, Human
uguccccaccgcagacaggacc

SEQ ID NO: 3345013 - RNA, 13 nt, Human
uguccccaccgca

SEQ ID NO: 3345014 - RNA, 16 nt, Human
uguccccgacccuugc

SEQ ID NO: 3345015 - RNA, 20 nt, Human
uguccuacccacccuccuuu

SEQ ID NO: 3345016 - RNA, 17 nt, Human
uguccuacucuguguca

SEQ ID NO: 3345017 - RNA, 12 nt, Human
uguccuacucug

SEQ ID NO: 3345018 - RNA, 16 nt, Human
uguccuacccacccuc

SEQ ID NO: 3345019 - RNA, 22 nt, Human
uguauucucuccuguaccucuu

SEQ ID NO: 3345020 - RNA, 20 nt, Human
uguauucucuccuguaccuc

SEQ ID NO: 3345021 - RNA, 19 nt, Human
uguauuuuacuaauaaaau

SEQ ID NO: 3345022 - RNA, 12 nt, Human
ugucacaggcag

SEQ ID NO: 3345023 - RNA, 17 nt, Human
ugucacacacuuuggcu

SEQ ID NO: 3345024 - RNA, 13 nt, Human
ugucacacacuuu

SEQ ID NO: 3345025 - RNA, 17 nt, Human
ugugagucaccaagccc

SEQ ID NO: 3345026 - RNA, 15 nt, Human
ugugagucaccaagc

SEQ ID NO: 3345027 - RNA, 21 nt, Human
ugugagucaccaagcccaguu

SEQ ID NO: 3345028 - RNA, 19 nt, Human
ugugagucaccaagcccag

SEQ ID NO: 3345029 - RNA, 13 nt, Human
ugugaggaagccg

SEQ ID NO: 3345030 - RNA, 18 nt, Human
ugugaggaagccgcuggg

SEQ ID NO: 3345031 - RNA, 20 nt, Human
ugugaggaagccgcuggggc

SEQ ID NO: 3345032 - RNA, 12 nt, Human
ugugaggaagcc

SEQ ID NO: 3345033 - RNA, 15 nt, Human
ugugacauguuuuau

SEQ ID NO: 3345034 - RNA, 16 nt, Human
ugucuuuggacccuga

SEQ ID NO: 3345035 - RNA, 21 nt, Human
ugucuuuucuugcaugaggcu

SEQ ID NO: 3345036 - RNA, 14 nt, Human
ugucuuuggacccu

SEQ ID NO: 3345037 - RNA, 23 nt, Human
ugucuuuucuugcaugaggcuag

SEQ ID NO: 3345038 - RNA, 23 nt, Human
ugugaaaagaaaaaugagccugg

SEQ ID NO: 3345039 - RNA, 21 nt, Human
ugugaaaagaaaaaugagccu

SEQ ID NO: 3345040 - RNA, 19 nt, Human
ugugcgccuacaggaguga

SEQ ID NO: 3345041 - RNA, 14 nt, Human
ugugcgccuacagg

SEQ ID NO: 3345042 - RNA, 16 nt, Human
ugugcauuaucuagau

SEQ ID NO: 3345043 - RNA, 19 nt, Human
ugugcauuaucuagauacu

SEQ ID NO: 3345044 - RNA, 14 nt, Human
ugugcauuaucuag

SEQ ID NO: 3345045 - RNA, 14 nt, Human
ugugcacguacaca

SEQ ID NO: 3345046 - RNA, 23 nt, Human
ugugcauuaucuagauacuguau

SEQ ID NO: 3345047 - RNA, 20 nt, Human
ugugcauuaucuagauacug

SEQ ID NO: 3345048 - RNA, 21 nt, Human
ugugcauuaucuagauacugu

SEQ ID NO: 3345049 - RNA, 12 nt, Human
uguguagggcgg

SEQ ID NO: 3345050 - RNA, 19 nt, Human
uguggacacagcucuucuc

SEQ ID NO: 3345051 - RNA, 16 nt, Human
uguggacacagcucuu

SEQ ID NO: 3345052 - RNA, 18 nt, Human
uguggacacagcucuucu

SEQ ID NO: 3345053 - RNA, 23 nt, Human
uguggcgcagcauauucaggaag

SEQ ID NO: 3345054 - RNA, 16 nt, Human
uguuggccaggcuggu

SEQ ID NO: 3345055 - RNA, 15 nt, Human
uguuggccaggcugg

SEQ ID NO: 3345056 - RNA, 17 nt, Human
uguuggcugggggccuc

SEQ ID NO: 3345057 - RNA, 19 nt, Human
uguuggcugggggccucag

SEQ ID NO: 3345058 - RNA, 13 nt, Human
uguucucugcccu

SEQ ID NO: 3345059 - RNA, 14 nt, Human
uguucucugcccuc

SEQ ID NO: 3345060 - RNA, 15 nt, Human
uguucucugcccucc

SEQ ID NO: 3345061 - RNA, 13 nt, Human
uguucuggcucuu

SEQ ID NO: 3345062 - RNA, 16 nt, Human
uguucuggcucuucca

SEQ ID NO: 3345063 - RNA, 12 nt, Human
uguucuggcucu

SEQ ID NO: 3345064 - RNA, 12 nt, Human
uguucucugccc

SEQ ID NO: 3345065 - RNA, 19 nt, Human
uguucaucauccuaagcua

SEQ ID NO: 3345066 - RNA, 15 nt, Human
uguucucucuucucc

SEQ ID NO: 3345067 - RNA, 16 nt, Human
uguucucucuucucca

SEQ ID NO: 3345068 - RNA, 17 nt, Human
uguucuggcucuuccag

SEQ ID NO: 3345069 - RNA, 20 nt, Human
uguucuggcucuuccaggcu

SEQ ID NO: 3345070 - RNA, 21 nt, Human
uguucuggcucuuccaggcug

SEQ ID NO: 3345071 - RNA, 23 nt, Human
uguucuuucuggcuaugcauuug

SEQ ID NO: 3345072 - RNA, 14 nt, Human
uguuacuaaguuuu

SEQ ID NO: 3345073 - RNA, 19 nt, Human
uguuaguaugaggcauuug

SEQ ID NO: 3345074 - RNA, 20 nt, Human
uguuaguaugaggcauuugu

SEQ ID NO: 3345075 - RNA, 17 nt, Human
uguuaguaugaggcauu

SEQ ID NO: 3345076 - RNA, 21 nt, Human
uguucagcuccagcucaccag

SEQ ID NO: 3345077 - RNA, 20 nt, Human
uguucagcuccagcucacca

SEQ ID NO: 3345078 - RNA, 18 nt, Human
uguucagcuccagcucac

SEQ ID NO: 3345079 - RNA, 16 nt, Human
uguguuuauugucaaa

SEQ ID NO: 3345080 - RNA, 13 nt, Human
uguguuuauuguc

SEQ ID NO: 3345081 - RNA, 19 nt, Human
ugugugcacguacacacac

SEQ ID NO: 3345082 - RNA, 13 nt, Human
uuaaaugcccagc

SEQ ID NO: 3345083 - RNA, 12 nt, Human
uuaacuuuuaua

SEQ ID NO: 3345084 - RNA, 13 nt, Human
uuaacuuuuauaa

SEQ ID NO: 3345085 - RNA, 20 nt, Human
uuacacuuuaugcacaaaau

SEQ ID NO: 3345086 - RNA, 13 nt, Human
uuacacuuuaugc

SEQ ID NO: 3345087 - RNA, 12 nt, Human
uuacauuuuuaa

SEQ ID NO: 3345088 - RNA, 17 nt, Human
uuacauuuuuaagugcu

SEQ ID NO: 3345089 - RNA, 22 nt, Human
uuaauuaaaacacaacaucuuu

SEQ ID NO: 3345090 - RNA, 15 nt, Human
uuaaaugcccagccc

SEQ ID NO: 3345091 - RNA, 16 nt, Human
uuaaaugcccagcccc

SEQ ID NO: 3345092 - RNA, 14 nt, Human
uuaaaugcccagcc

SEQ ID NO: 3345093 - RNA, 14 nt, Human
uuaaaacccaagug

SEQ ID NO: 3345094 - RNA, 22 nt, Human
uuaaacuuaaucuaaauggaac

SEQ ID NO: 3345095 - RNA, 16 nt, Human
uguuuuaagaggcagg

SEQ ID NO: 3345096 - RNA, 22 nt, Human
uguuuuaaggaugcuuguacau

SEQ ID NO: 3345097 - RNA, 23 nt, Human
uguuuuaaggaugcuuguacaua

SEQ ID NO: 3345098 - RNA, 19 nt, Human
uguuuuaaggaugcuugua

SEQ ID NO: 3345099 - RNA, 17 nt, Human
uguuuuaagaggcaggg

SEQ ID NO: 3345100 - RNA, 15 nt, Human
uaauaugcacacauu

SEQ ID NO: 3345101 - RNA, 16 nt, Human
uaauaugcacacauuu

SEQ ID NO: 3345102 - RNA, 17 nt, Human
uaauaugcacacauuuu

SEQ ID NO: 3345103 - RNA, 18 nt, Human
uaauaugcacacauuuuu

SEQ ID NO: 3345104 - RNA, 19 nt, Human
uaauaugcacacauuuuuu

SEQ ID NO: 3345105 - RNA, 12 nt, Human
uaaucuaaaugg

SEQ ID NO: 3345106 - RNA, 13 nt, Human
uaaucuaaaugga

SEQ ID NO: 3345107 - RNA, 20 nt, Human
uaauauuaaggaagacaaug

SEQ ID NO: 3345108 - RNA, 17 nt, Human
uaauuaaguacuaugua

SEQ ID NO: 3345109 - RNA, 14 nt, Human
uaauuaaguacuau

SEQ ID NO: 3345110 - RNA, 15 nt, Human
uaauggggcggugag

SEQ ID NO: 3345111 - RNA, 19 nt, Human
uaaugcgugcauaccacuu

SEQ ID NO: 3345112 - RNA, 22 nt, Human
uaaugcgugcauaccacuuuug

SEQ ID NO: 3345113 - RNA, 23 nt, Human
uaaugcgugcauaccacuuuugu

SEQ ID NO: 3345114 - RNA, 15 nt, Human
uaaugcgugcauacc

SEQ ID NO: 3345115 - RNA, 14 nt, Human
uaaugcgugcauac

SEQ ID NO: 3345116 - RNA, 17 nt, Human
uaaggguaucuggugac

SEQ ID NO: 3345117 - RNA, 15 nt, Human
uaaggugugcucuga

SEQ ID NO: 3345118 - RNA, 20 nt, Human
uaagguggguacgggagggu

SEQ ID NO: 3345119 - RNA, 16 nt, Human
uaaggauguucuagca

SEQ ID NO: 3345120 - RNA, 15 nt, Human
uaagaggcagggucu

SEQ ID NO: 3345121 - RNA, 12 nt, Human
uaagaggcaggg

SEQ ID NO: 3345122 - RNA, 15 nt, Human
uaagugcugcauuua

SEQ ID NO: 3345123 - RNA, 16 nt, Human
uaagugcugcauuuaa

SEQ ID NO: 3345124 - RNA, 18 nt, Human
uaagugcugcauuuaaaa

SEQ ID NO: 3345125 - RNA, 22 nt, Human
uaagugcugcauuuaaaagaua

SEQ ID NO: 3345126 - RNA, 20 nt, Human
uaagugguacuaacuuuccu

SEQ ID NO: 3345127 - RNA, 12 nt, Human
uaagugagagag

SEQ ID NO: 3345128 - RNA, 23 nt, Human
uaagugaggaugaaaaaauaaca

SEQ ID NO: 3345129 - RNA, 14 nt, Human
uaagugcugcauuu

SEQ ID NO: 3345130 - RNA, 11 nt, Human
uaacagaaaug

SEQ ID NO: 3345131 - RNA, 16 nt, Human
uaaccacuucagcuga

SEQ ID NO: 3345132 - RNA, 23 nt, Human
uaaccaguguuguggauuuaaca

SEQ ID NO: 3345133 - RNA, 16 nt, Human
uaagaaaaaggaugca

SEQ ID NO: 3345134 - RNA, 18 nt, Human
uaagaaaaaggaugcaca

SEQ ID NO: 3345135 - RNA, 19 nt, Human
uaagaaaaaggaugcacag

SEQ ID NO: 3345136 - RNA, 23 nt, Human
uaagaaaaaggaugcacagaguu

SEQ ID NO: 3345137 - RNA, 19 nt, Human
uaagaaccuuuugagugcc

SEQ ID NO: 3345138 - RNA, 13 nt, Human
uaaaugcccagcc

SEQ ID NO: 3345139 - RNA, 16 nt, Human
uaaauggaaccacucu

SEQ ID NO: 3345140 - RNA, 14 nt, Human
uaaaugcccagccc

SEQ ID NO: 3345141 - RNA, 15 nt, Human
uaaaugcccagcccc

SEQ ID NO: 3345142 - RNA, 16 nt, Human
uaaaugcccagccccu

SEQ ID NO: 3345143 - RNA, 17 nt, Human
uaaaugcccagccccuu

SEQ ID NO: 3345144 - RNA, 20 nt, Human
uaaaugucuaguuguaacac

SEQ ID NO: 3345145 - RNA, 22 nt, Human
uaaaugucucuuuaaugucaca

SEQ ID NO: 3345146 - RNA, 18 nt, Human
uaaaugggggugcauuug

SEQ ID NO: 3345147 - RNA, 19 nt, Human
uaaaugggggugcauuuga

SEQ ID NO: 3345148 - RNA, 14 nt, Human
uaaaugggggugca

SEQ ID NO: 3345149 - RNA, 17 nt, Human
uaaaugggggugcauuu

SEQ ID NO: 3345150 - RNA, 16 nt, Human
uaaauucuugcaaagu

SEQ ID NO: 3345151 - RNA, 17 nt, Human
uaaauucuugcaaagua

SEQ ID NO: 3345152 - RNA, 18 nt, Human
uaaauucuugcaaaguau

SEQ ID NO: 3345153 - RNA, 22 nt, Human
uaaauucuugcaaaguaucccu

SEQ ID NO: 3345154 - RNA, 11 nt, Human
uaaauuauuuu

SEQ ID NO: 3345155 - RNA, 18 nt, Human
uaacaccaugauuaacca

SEQ ID NO: 3345156 - RNA, 20 nt, Human
guuuguuucugaaagggacg

SEQ ID NO: 3345157 - RNA, 17 nt, Human
guuuucaaaauaaaaau

SEQ ID NO: 3345158 - RNA, 12 nt, Human
guuuucacucuu

SEQ ID NO: 3345159 - RNA, 11 nt, Human
guuuucacucu

SEQ ID NO: 3345160 - RNA, 20 nt, Human
guuuuccagguuuaagcugu

SEQ ID NO: 3345161 - RNA, 19 nt, Human
guuuuccaugaguccccug

SEQ ID NO: 3345162 - RNA, 20 nt, Human
guuuuccaugaguccccugu

SEQ ID NO: 3345163 - RNA, 23 nt, Human
guuugauuaaauucuugcaaagu

SEQ ID NO: 3345164 - RNA, 17 nt, Human
guuugagaucagccugg

SEQ ID NO: 3345165 - RNA, 18 nt, Human
guuuguuucugaaaggga

SEQ ID NO: 3345166 - RNA, 16 nt, Human
guuugauucagacagc

SEQ ID NO: 3345167 - RNA, 20 nt, Human
guuugauucagacagcugcc

SEQ ID NO: 3345168 - RNA, 18 nt, Human
guuuggggaugagaaagg

SEQ ID NO: 3345169 - RNA, 20 nt, Human
guuuguaaauuaacuuuuau

SEQ ID NO: 3345170 - RNA, 12 nt, Human
guuggcuggggg

SEQ ID NO: 3345171 - RNA, 14 nt, Human
guuggccccugccc

SEQ ID NO: 3345172 - RNA, 13 nt, Human
guuggccccugcc

SEQ ID NO: 3345173 - RNA, 20 nt, Human
guuggccccugcccggcugc

SEQ ID NO: 3345174 - RNA, 19 nt, Human
guuggcugggggccucagu

SEQ ID NO: 3345175 - RNA, 12 nt, Human
guugucagcuga

SEQ ID NO: 3345176 - RNA, 22 nt, Human
guuguggauuuaacagaaaugu

SEQ ID NO: 3345177 - RNA, 14 nt, Human
guugugguuaaucu

SEQ ID NO: 3345178 - RNA, 14 nt, Human
guuguuacauuuuu

SEQ ID NO: 3345179 - RNA, 15 nt, Human
guuguuacauuuuua

SEQ ID NO: 3345180 - RNA, 14 nt, Human
guuuagauaauaca

SEQ ID NO: 3345181 - RNA, 21 nt, Human
uaaacaagaccacguuucuaa

SEQ ID NO: 3345182 - RNA, 22 nt, Human
uaaacaagaccacguuucuaaa

SEQ ID NO: 3345183 - RNA, 20 nt, Human
uaaacaagaccacguuucua

SEQ ID NO: 3345184 - RNA, 19 nt, Human
uaaacaagaccacguuucu

SEQ ID NO: 3345185 - RNA, 22 nt, Human
uaaacuugguuuuuaaaaaacu

SEQ ID NO: 3345186 - RNA, 16 nt, Human
uaaagcagcguuucua

SEQ ID NO: 3345187 - RNA, 17 nt, Human
uaaagcagcguuucuau

SEQ ID NO: 3345188 - RNA, 19 nt, Human
uaaagcagcguuucuauga

SEQ ID NO: 3345189 - RNA, 12 nt, Human
uaaagaaaacug

SEQ ID NO: 3345190 - RNA, 15 nt, Human
uaaaggcuaccuuug

SEQ ID NO: 3345191 - RNA, 20 nt, Human
uaaagccugaguuugcuuuc

SEQ ID NO: 3345192 - RNA, 17 nt, Human
uaaaggcuaccuuugua

SEQ ID NO: 3345193 - RNA, 21 nt, Human
uaaaagauacaguuacucaga

SEQ ID NO: 3345194 - RNA, 17 nt, Human
uaaaagauacaguuacu

SEQ ID NO: 3345195 - RNA, 20 nt, Human
uaaaagauacaguuacucag

SEQ ID NO: 3345196 - RNA, 14 nt, Human
uaaaagauacaguu

SEQ ID NO: 3345197 - RNA, 21 nt, Human
uaaaacauuggauuauccuga

SEQ ID NO: 3345198 - RNA, 20 nt, Human
uaaaacauuggauuauccug

SEQ ID NO: 3345199 - RNA, 19 nt, Human
uaaaacauuggauuauccu

SEQ ID NO: 3345200 - RNA, 17 nt, Human
uaaaacauuggauuauc

SEQ ID NO: 3345201 - RNA, 22 nt, Human
uaaaacauuggauuauccugag

SEQ ID NO: 3345202 - RNA, 16 nt, Human
uaaaacauuggauuau

SEQ ID NO: 3345203 - RNA, 15 nt, Human
uaaaacauuggauua

SEQ ID NO: 3345204 - RNA, 21 nt, Human
uaaaagguaugcaaucaaauc

SEQ ID NO: 3345205 - RNA, 12 nt, Human
uaaaaggagcca

SEQ ID NO: 3345206 - RNA, 12 nt, Human
uaaaaggugacc

SEQ ID NO: 3345207 - RNA, 22 nt, Human
uaaaacacaacaucuuuuucua

SEQ ID NO: 3345208 - RNA, 23 nt, Human
uaaaacacaacaucuuuuucuac

SEQ ID NO: 3345209 - RNA, 17 nt, Human
uaaaacacaacaucuuu

SEQ ID NO: 3345210 - RNA, 15 nt, Human
uaaaacaacacucac

SEQ ID NO: 3345211 - RNA, 17 nt, Human
uaucaugacaaagacug

SEQ ID NO: 3345212 - RNA, 20 nt, Human
uaucaggugcugccauccag

SEQ ID NO: 3345213 - RNA, 17 nt, Human
uaucaggugcugccauc

SEQ ID NO: 3345214 - RNA, 19 nt, Human
uaucaggugcugccaucca

SEQ ID NO: 3345215 - RNA, 21 nt, Human
uauagaaauauauacgaacaa

SEQ ID NO: 3345216 - RNA, 19 nt, Human
uauagaaauauauacgaac

SEQ ID NO: 3345217 - RNA, 22 nt, Human
uagcuggucuuauuuguaaagc

SEQ ID NO: 3345218 - RNA, 11 nt, Human
uaggugacaga

SEQ ID NO: 3345219 - RNA, 17 nt, Human
uaguaugaggcauuugu

SEQ ID NO: 3345220 - RNA, 18 nt, Human
uaguaugaggcauuuguu

SEQ ID NO: 3345221 - RNA, 19 nt, Human
uaggugugacugaauuucu

SEQ ID NO: 3345222 - RNA, 21 nt, Human
uaggugugacugaauuucuuu

SEQ ID NO: 3345223 - RNA, 23 nt, Human
uaggugugacugaauuucuuuug

SEQ ID NO: 3345224 - RNA, 13 nt, Human
uagguguggggga

SEQ ID NO: 3345225 - RNA, 17 nt, Human
uaggugugggggaagca

SEQ ID NO: 3345226 - RNA, 20 nt, Human
uaguuguuugauucagacag

SEQ ID NO: 3345227 - RNA, 21 nt, Human
uaguuguuugauucagacagc

SEQ ID NO: 3345228 - RNA, 22 nt, Human
uaguuguuugauucagacagcu

SEQ ID NO: 3345229 - RNA, 20 nt, Human
uaguggcuuaaaacaacacu

SEQ ID NO: 3345230 - RNA, 15 nt, Human
uaguaugaggcauuu

SEQ ID NO: 3345231 - RNA, 16 nt, Human
uaguaugguggcuggg

SEQ ID NO: 3345232 - RNA, 17 nt, Human
uauaaacuuuaccuuuu

SEQ ID NO: 3345233 - RNA, 15 nt, Human
uauaaacuuuaccuu

SEQ ID NO: 3345234 - RNA, 16 nt, Human
uauaaacuuuaccuuu

SEQ ID NO: 3345235 - RNA, 13 nt, Human
uauaaacuuuacc

SEQ ID NO: 3345236 - RNA, 14 nt, Human
uauaaacuuuaccu

SEQ ID NO: 3345237 - RNA, 11 nt, Human
uauaaacuuua

SEQ ID NO: 3345238 - RNA, 15 nt, Human
uaguuugauuaaauu

SEQ ID NO: 3345239 - RNA, 16 nt, Human
uaguuugauuaaauuc

SEQ ID NO: 3345240 - RNA, 16 nt, Human
uagcauacguacacau

SEQ ID NO: 3345241 - RNA, 17 nt, Human
uagcauacguacacauu

SEQ ID NO: 3345242 - RNA, 18 nt, Human
uagcauacguacacauuu

SEQ ID NO: 3345243 - RNA, 19 nt, Human
uagcauacguacacauuuu

SEQ ID NO: 3345244 - RNA, 11 nt, Human
uagcagggaaa

SEQ ID NO: 3345245 - RNA, 16 nt, Human
uagauacuguaucaug

SEQ ID NO: 3345246 - RNA, 12 nt, Human
uagcucauucuc

SEQ ID NO: 3345247 - RNA, 21 nt, Human
uagcucaggugucccugcacu

SEQ ID NO: 3345248 - RNA, 20 nt, Human
uagcucaggugucccugcac

SEQ ID NO: 3345249 - RNA, 18 nt, Human
uagccugugccucuggga

SEQ ID NO: 3345250 - RNA, 16 nt, Human
uagcucaggugucccu

SEQ ID NO: 3345251 - RNA, 17 nt, Human
uagcugggacuacaggc

SEQ ID NO: 3345252 - RNA, 15 nt, Human
uagcugggacuacag

SEQ ID NO: 3345253 - RNA, 12 nt, Human
uagcugggacua

SEQ ID NO: 3345254 - RNA, 17 nt, Human
uagccugccucuucucu

SEQ ID NO: 3345255 - RNA, 14 nt, Human
uagaguugauacua

SEQ ID NO: 3345256 - RNA, 17 nt, Human
uagaguugauacuacag

SEQ ID NO: 3345257 - RNA, 12 nt, Human
uagagugggagc

SEQ ID NO: 3345258 - RNA, 14 nt, Human
uagagguucaaaga

SEQ ID NO: 3345259 - RNA, 15 nt, Human
uagagguucaaagau

SEQ ID NO: 3345260 - RNA, 20 nt, Human
uagaagucuuagauguauau

SEQ ID NO: 3345261 - RNA, 19 nt, Human
uacuuguggacacagcucu

SEQ ID NO: 3345262 - RNA, 23 nt, Human
uagaauuaguggcacuugcuuuu

SEQ ID NO: 3345263 - RNA, 19 nt, Human
uacaguuuguuaguaugag

SEQ ID NO: 3345264 - RNA, 21 nt, Human
uacaguuuguuaguaugaggc

SEQ ID NO: 3345265 - RNA, 16 nt, Human
uacauaaacaaguccu

SEQ ID NO: 3345266 - RNA, 17 nt, Human
uacaugaaaacacauuu

SEQ ID NO: 3345267 - RNA, 18 nt, Human
uacaugaaaacacauuuu

SEQ ID NO: 3345268 - RNA, 19 nt, Human
uacaugaaaacacauuuuu

SEQ ID NO: 3345269 - RNA, 23 nt, Human
uacaugaaaacacauuuuucuua

SEQ ID NO: 3345270 - RNA, 16 nt, Human
uacaugaaaacacauu

SEQ ID NO: 3345271 - RNA, 16 nt, Human
uacauaagauaaaugu

SEQ ID NO: 3345272 - RNA, 14 nt, Human
uacauuuuuaagug

SEQ ID NO: 3345273 - RNA, 19 nt, Human
uacauuuuuaagugcugca

SEQ ID NO: 3345274 - RNA, 22 nt, Human
uacauuuuuaagugcugcauuu

SEQ ID NO: 3345275 - RNA, 22 nt, Human
uacauggaauaacauguaauua

SEQ ID NO: 3345276 - RNA, 19 nt, Human
uacauggaauaacauguaa

SEQ ID NO: 3345277 - RNA, 18 nt, Human
uacauggaauaacaugua

SEQ ID NO: 3345278 - RNA, 14 nt, Human
uacauggaauaaca

SEQ ID NO: 3345279 - RNA, 18 nt, Human
uacaggaagguagaaaua

SEQ ID NO: 3345280 - RNA, 13 nt, Human
uacaggaaguacu

SEQ ID NO: 3345281 - RNA, 20 nt, Human
uacagcuugaccgugaggcc

SEQ ID NO: 3345282 - RNA, 19 nt, Human
uacacuguuucaaacuuua

SEQ ID NO: 3345283 - RNA, 22 nt, Human
uacacuguuucaaacuuuacua

SEQ ID NO: 3345284 - RNA, 16 nt, Human
uacacuuacacuuuau

SEQ ID NO: 3345285 - RNA, 22 nt, Human
uacacugugcugagucugaagg

SEQ ID NO: 3345286 - RNA, 23 nt, Human
uacacugugcugagucugaaggc

SEQ ID NO: 3345287 - RNA, 20 nt, Human
uacacuguuucaaacuuuac

SEQ ID NO: 3345288 - RNA, 16 nt, Human
uacacugugcugaguc

SEQ ID NO: 3345289 - RNA, 17 nt, Human
uacaguugaaaaacagc

SEQ ID NO: 3345290 - RNA, 19 nt, Human
uacaguugaaaaacagcug

SEQ ID NO: 3345291 - RNA, 18 nt, Human
uacaguuuguuaguauga

SEQ ID NO: 3345292 - RNA, 20 nt, Human
uacaguugaaaaacagcuga

SEQ ID NO: 3345293 - RNA, 14 nt, Human
uacaggaaguacug

SEQ ID NO: 3345294 - RNA, 15 nt, Human
uacaggaaguacugg

SEQ ID NO: 3345295 - RNA, 22 nt, Human
uacaggaaguacuggagaaaau

SEQ ID NO: 3345296 - RNA, 15 nt, Human
uacaggagugagcac

SEQ ID NO: 3345297 - RNA, 18 nt, Human
uacaaaguagaagucuua

SEQ ID NO: 3345298 - RNA, 14 nt, Human
uacaaaguagaagu

SEQ ID NO: 3345299 - RNA, 23 nt, Human
uacacaaugguuuucuugugugu

SEQ ID NO: 3345300 - RNA, 11 nt, Human
uacacacacac

SEQ ID NO: 3345301 - RNA, 15 nt, Human
uacacacugcauguu

SEQ ID NO: 3345302 - RNA, 21 nt, Human
uacacugugcugagucugaag

SEQ ID NO: 3345303 - RNA, 17 nt, Human
uacugcauaugaaagga

SEQ ID NO: 3345304 - RNA, 22 nt, Human
uacucgaguuacagacaaagcg

SEQ ID NO: 3345305 - RNA, 18 nt, Human
uacucgaguuacagacaa

SEQ ID NO: 3345306 - RNA, 22 nt, Human
uacuacaguccucccaucucac

SEQ ID NO: 3345307 - RNA, 20 nt, Human
uacuacaguccucccaucuc

SEQ ID NO: 3345308 - RNA, 13 nt, Human
uacuacaguuugu

SEQ ID NO: 3345309 - RNA, 14 nt, Human
uacuacaguuuguu

SEQ ID NO: 3345310 - RNA, 21 nt, Human
uacugucuucaguaagccgug

SEQ ID NO: 3345311 - RNA, 16 nt, Human
uacuguccuacccacc

SEQ ID NO: 3345312 - RNA, 13 nt, Human
uacuuguggacac

SEQ ID NO: 3345313 - RNA, 13 nt, Human
uacuaacuuuccu

SEQ ID NO: 3345314 - RNA, 20 nt, Human
uacuaauagacaauuuauua

SEQ ID NO: 3345315 - RNA, 21 nt, Human
uacuaauagacaauuuauuau

SEQ ID NO: 3345316 - RNA, 14 nt, Human
uacuaaggaaucuu

SEQ ID NO: 3345317 - RNA, 18 nt, Human
uacgaaaagaggggaaga

SEQ ID NO: 3345318 - RNA, 21 nt, Human
uacgaaaagaggggaagagac

SEQ ID NO: 3345319 - RNA, 16 nt, Human
uacgaacaaaacacac

SEQ ID NO: 3345320 - RNA, 12 nt, Human
uacgaacaaaac

SEQ ID NO: 3345321 - RNA, 13 nt, Human
uaccuuuuuuaua

SEQ ID NO: 3345322 - RNA, 16 nt, Human
uaccuuuuuuauacau

SEQ ID NO: 3345323 - RNA, 17 nt, Human
uaccuuuuuuauacaua

SEQ ID NO: 3345324 - RNA, 22 nt, Human
uaccuuuuuuauacauaaacaa

SEQ ID NO: 3345325 - RNA, 18 nt, Human
uaccucggugccuuccuc

SEQ ID NO: 3345326 - RNA, 13 nt, Human
uaccuuuuuuaga

SEQ ID NO: 3345327 - RNA, 19 nt, Human
uaccuuuuuuagaguugau

SEQ ID NO: 3345328 - RNA, 22 nt, Human
uaccuuuuuuagaguugauacu

SEQ ID NO: 3345329 - RNA, 15 nt, Human
uaccuacauacaauu

SEQ ID NO: 3345330 - RNA, 23 nt, Human
uacauuuuuaagugcugcauuua

SEQ ID NO: 3345331 - RNA, 15 nt, Human
uacccacugcucugg

SEQ ID NO: 3345332 - RNA, 17 nt, Human
guggucccaccccacac

SEQ ID NO: 3345333 - RNA, 18 nt, Human
gugguccuaaucuucuga

SEQ ID NO: 3345334 - RNA, 14 nt, Human
guggucccacccca

SEQ ID NO: 3345335 - RNA, 15 nt, Human
guggucccaccccac

SEQ ID NO: 3345336 - RNA, 16 nt, Human
guggucccaccccaca

SEQ ID NO: 3345337 - RNA, 19 nt, Human
gugguaugaucacggcuca

SEQ ID NO: 3345338 - RNA, 17 nt, Human
gugguagagugugccug

SEQ ID NO: 3345339 - RNA, 21 nt, Human
guggugagaggcauccaguau

SEQ ID NO: 3345340 - RNA, 17 nt, Human
guggugaccucugccug

SEQ ID NO: 3345341 - RNA, 14 nt, Human
guggugaccucugc

SEQ ID NO: 3345342 - RNA, 19 nt, Human
guggugcgaucuggguuca

SEQ ID NO: 3345343 - RNA, 21 nt, Human
guguaaguauucuuauuuaau

SEQ ID NO: 3345344 - RNA, 20 nt, Human
gugucccaaaaagaaaggag

SEQ ID NO: 3345345 - RNA, 18 nt, Human
gugucccugcacuugcag

SEQ ID NO: 3345346 - RNA, 16 nt, Human
gugucccugcacuugc

SEQ ID NO: 3345347 - RNA, 13 nt, Human
gugucccugcacu

SEQ ID NO: 3345348 - RNA, 22 nt, Human
guguacauggaauaacauguaa

SEQ ID NO: 3345349 - RNA, 17 nt, Human
guguacauggaauaaca

SEQ ID NO: 3345350 - RNA, 17 nt, Human
gugggcccaaugcacuu

SEQ ID NO: 3345351 - RNA, 15 nt, Human
gugggcuaguugggc

SEQ ID NO: 3345352 - RNA, 23 nt, Human
guggguuucuaaagcugccagcc

SEQ ID NO: 3345353 - RNA, 17 nt, Human
guggggcagcuugaggg

SEQ ID NO: 3345354 - RNA, 13 nt, Human
guggggcagcuug

SEQ ID NO: 3345355 - RNA, 15 nt, Human
guggggaccucaggc

SEQ ID NO: 3345356 - RNA, 18 nt, Human
guggggaccucaggccug

SEQ ID NO: 3345357 - RNA, 12 nt, Human
guggcugcuuca

SEQ ID NO: 3345358 - RNA, 14 nt, Human
guggcugcuucaag

SEQ ID NO: 3345359 - RNA, 14 nt, Human
guggcucacgccug

SEQ ID NO: 3345360 - RNA, 22 nt, Human
guggcuuaaaacaacacucaca

SEQ ID NO: 3345361 - RNA, 15 nt, Human
guggcugcuucaagg

SEQ ID NO: 3345362 - RNA, 16 nt, Human
guggcugcuucaagga

SEQ ID NO: 3345363 - RNA, 19 nt, Human
guggcugcuucaaggaucc

SEQ ID NO: 3345364 - RNA, 22 nt, Human
guggcugcuucaaggauccuga

SEQ ID NO: 3345365 - RNA, 19 nt, Human
guggcuggguuggagggug

SEQ ID NO: 3345366 - RNA, 23 nt, Human
guggcugcuucaaggauccugag

SEQ ID NO: 3345367 - RNA, 14 nt, Human
guguuacuaaguuu

SEQ ID NO: 3345368 - RNA, 12 nt, Human
guguuacuaagu

SEQ ID NO: 3345369 - RNA, 18 nt, Human
guguuaugacuccagaau

SEQ ID NO: 3345370 - RNA, 13 nt, Human
guuacagacaaag

SEQ ID NO: 3345371 - RNA, 16 nt, Human
guuacacuaaaaggug

SEQ ID NO: 3345372 - RNA, 15 nt, Human
guuacacuaaaaggu

SEQ ID NO: 3345373 - RNA, 22 nt, Human
guuaaaauaccagccaguaaau

SEQ ID NO: 3345374 - RNA, 14 nt, Human
gugucucuuggucc

SEQ ID NO: 3345375 - RNA, 17 nt, Human
gugucucccuucauccu

SEQ ID NO: 3345376 - RNA, 14 nt, Human
guguccggucccug

SEQ ID NO: 3345377 - RNA, 23 nt, Human
gugucccugcacuugcagacucu

SEQ ID NO: 3345378 - RNA, 15 nt, Human
gugucgggcaugaca

SEQ ID NO: 3345379 - RNA, 20 nt, Human
gugugagucaccaagcccag

SEQ ID NO: 3345380 - RNA, 18 nt, Human
gugucucuugguccugcu

SEQ ID NO: 3345381 - RNA, 19 nt, Human
gugucucuugguccugcug

SEQ ID NO: 3345382 - RNA, 20 nt, Human
gugucucuugguccugcugc

SEQ ID NO: 3345383 - RNA, 21 nt, Human
gugucucuugguccugcugca

SEQ ID NO: 3345384 - RNA, 22 nt, Human
gugucucuugguccugcugcag

SEQ ID NO: 3345385 - RNA, 12 nt, Human
gugugcucugau

SEQ ID NO: 3345386 - RNA, 22 nt, Human
gugugcucugaucauccacugu

SEQ ID NO: 3345387 - RNA, 15 nt, Human
gugugcucugaucau

SEQ ID NO: 3345388 - RNA, 13 nt, Human
guguggagaagcg

SEQ ID NO: 3345389 - RNA, 21 nt, Human
guguggagaagcggcuggcag

SEQ ID NO: 3345390 - RNA, 13 nt, Human
guuggccaggcug

SEQ ID NO: 3345391 - RNA, 14 nt, Human
guuggccaggcugg

SEQ ID NO: 3345392 - RNA, 15 nt, Human
guuggccaggcuggu

SEQ ID NO: 3345393 - RNA, 14 nt, Human
guuggccaguguga

SEQ ID NO: 3345394 - RNA, 19 nt, Human
guuggccaggcuggucuca

SEQ ID NO: 3345395 - RNA, 17 nt, Human
guuggccaggcuggucu

SEQ ID NO: 3345396 - RNA, 23 nt, Human
guuggccaaagccaaagcuaggc

SEQ ID NO: 3345397 - RNA, 14 nt, Human
guuggcaaaaaggc

SEQ ID NO: 3345398 - RNA, 18 nt, Human
guuggcaaaaaggcagga

SEQ ID NO: 3345399 - RNA, 14 nt, Human
guugcccaggcagg

SEQ ID NO: 3345400 - RNA, 12 nt, Human
guugcccaggca

SEQ ID NO: 3345401 - RNA, 16 nt, Human
guugccagucaccccg

SEQ ID NO: 3345402 - RNA, 17 nt, Human
guugccagucaccccgg

SEQ ID NO: 3345403 - RNA, 18 nt, Human
guugccagucaccccggc

SEQ ID NO: 3345404 - RNA, 23 nt, Human
guugccagucaccccggccaccu

SEQ ID NO: 3345405 - RNA, 13 nt, Human
guugccagucacc

SEQ ID NO: 3345406 - RNA, 14 nt, Human
guugccagucaccc

SEQ ID NO: 3345407 - RNA, 15 nt, Human
guugcaggaccucag

SEQ ID NO: 3345408 - RNA, 16 nt, Human
guugaagacagagcua

SEQ ID NO: 3345409 - RNA, 18 nt, Human
guucuuucacccuuuucu

SEQ ID NO: 3345410 - RNA, 16 nt, Human
guucugggacacaguu

SEQ ID NO: 3345411 - RNA, 15 nt, Human
guucugggacacagu

SEQ ID NO: 3345412 - RNA, 14 nt, Human
guucugggacacag

SEQ ID NO: 3345413 - RNA, 12 nt, Human
guucugggacac

SEQ ID NO: 3345414 - RNA, 11 nt, Human
guucugggaca

SEQ ID NO: 3345415 - RNA, 23 nt, Human
guucuggcagaguugaagacaga

SEQ ID NO: 3345416 - RNA, 16 nt, Human
guucuggcucuuccag

SEQ ID NO: 3345417 - RNA, 20 nt, Human
guucuggcucuuccaggcug

SEQ ID NO: 3345418 - RNA, 12 nt, Human
guucuggcucuu

SEQ ID NO: 3345419 - RNA, 13 nt, Human
guucuuuccaaag

SEQ ID NO: 3345420 - RNA, 14 nt, Human
guucuuuccaaagu

SEQ ID NO: 3345421 - RNA, 18 nt, Human
guucuuuccaaaguacac

SEQ ID NO: 3345422 - RNA, 20 nt, Human
guucuuuccaaaguacacug

SEQ ID NO: 3345423 - RNA, 17 nt, Human
guugaaaaacagcugag

SEQ ID NO: 3345424 - RNA, 19 nt, Human
guucugauccuaguuccac

SEQ ID NO: 3345425 - RNA, 22 nt, Human
guuacuaaguuuuuauggcuuu

SEQ ID NO: 3345426 - RNA, 15 nt, Human
guuacucagaauucu

SEQ ID NO: 3345427 - RNA, 16 nt, Human
guuaguuucuccaagc

SEQ ID NO: 3345428 - RNA, 19 nt, Human
guuaguuucuccaagcagg

SEQ ID NO: 3345429 - RNA, 22 nt, Human
guuaguuucuccaagcaggaca

SEQ ID NO: 3345430 - RNA, 15 nt, Human
guuacagacaaagcg

SEQ ID NO: 3345431 - RNA, 17 nt, Human
guuacagacaaagcgug

SEQ ID NO: 3345432 - RNA, 19 nt, Human
guuacauaagauaaaugug

SEQ ID NO: 3345433 - RNA, 18 nt, Human
guuacauaagauaaaugu

SEQ ID NO: 3345434 - RNA, 21 nt, Human
guuacauuuuuaagugcugca

SEQ ID NO: 3345435 - RNA, 23 nt, Human
guuaccauuuugggguacccacu

SEQ ID NO: 3345436 - RNA, 21 nt, Human
guuaugacuccagaauuuccc

SEQ ID NO: 3345437 - RNA, 19 nt, Human
guuauuaaaaaucucaaau

SEQ ID NO: 3345438 - RNA, 19 nt, Human
guucaagcgauucuucugc

SEQ ID NO: 3345439 - RNA, 18 nt, Human
guucaagcgauucuucug

SEQ ID NO: 3345440 - RNA, 23 nt, Human
guucaauucucauuugucacaca

SEQ ID NO: 3345441 - RNA, 16 nt, Human
guucaauucucauuug

SEQ ID NO: 3345442 - RNA, 20 nt, Human
guucaagcgauucuucugcu

SEQ ID NO: 3345443 - RNA, 17 nt, Human
guuccaccaucaagcca

SEQ ID NO: 3345444 - RNA, 20 nt, Human
guuccaccaucaagccacca

SEQ ID NO: 3345445 - RNA, 14 nt, Human
guuccuaauccucu

SEQ ID NO: 3345446 - RNA, 22 nt, Human
guuccucauuagcauuuugcua

SEQ ID NO: 3345447 - RNA, 19 nt, Human
guucacugcaaccuccgcc

SEQ ID NO: 3345448 - RNA, 12 nt, Human
guucaucuugaa

SEQ ID NO: 3345449 - RNA, 13 nt, Human
guucaucuugaau

SEQ ID NO: 3345450 - RNA, 18 nt, Human
guucaucuugaauuguaa

SEQ ID NO: 3345451 - RNA, 17 nt, Human
guucaucauccuaagcu

SEQ ID NO: 3345452 - RNA, 22 nt, Human
gucucacucugucgcccagucu

SEQ ID NO: 3345453 - RNA, 19 nt, Human
gucucacucugucgcccag

SEQ ID NO: 3345454 - RNA, 18 nt, Human
gucucacucugucgccca

SEQ ID NO: 3345455 - RNA, 16 nt, Human
gucucacucugucgcc

SEQ ID NO: 3345456 - RNA, 15 nt, Human
gucucacucugucgc

SEQ ID NO: 3345457 - RNA, 11 nt, Human
gucucacucug

SEQ ID NO: 3345458 - RNA, 18 nt, Human
gucucacuauguugccca

SEQ ID NO: 3345459 - RNA, 21 nt, Human
gucggaaaacaugcuacacac

SEQ ID NO: 3345460 - RNA, 16 nt, Human
gucgggcaugacacga

SEQ ID NO: 3345461 - RNA, 21 nt, Human
guccuuaccagcagagcaccu

SEQ ID NO: 3345462 - RNA, 18 nt, Human
guccuuaccagcagagca

SEQ ID NO: 3345463 - RNA, 19 nt, Human
guccuuaccagcagagcac

SEQ ID NO: 3345464 - RNA, 11 nt, Human
gucccugccaa

SEQ ID NO: 3345465 - RNA, 14 nt, Human
gucccugccaaugg

SEQ ID NO: 3345466 - RNA, 15 nt, Human
gucccugccaaugga

SEQ ID NO: 3345467 - RNA, 16 nt, Human
gucuuuuuucacuaca

SEQ ID NO: 3345468 - RNA, 23 nt, Human
gucuugcaauggcagccuuggca

SEQ ID NO: 3345469 - RNA, 21 nt, Human
gucuugcaauggcagccuugg

SEQ ID NO: 3345470 - RNA, 20 nt, Human
gucuugcaauggcagccuug

SEQ ID NO: 3345471 - RNA, 19 nt, Human
gucuugcaauggcagccuu

SEQ ID NO: 3345472 - RNA, 18 nt, Human
gucuugcaauggcagccu

SEQ ID NO: 3345473 - RNA, 17 nt, Human
gucuugcaauggcagcc

SEQ ID NO: 3345474 - RNA, 16 nt, Human
gucuugcaauggcagc

SEQ ID NO: 3345475 - RNA, 20 nt, Human
gucuugaacuccuggccuca

SEQ ID NO: 3345476 - RNA, 18 nt, Human
gucuugaacuccuggccu

SEQ ID NO: 3345477 - RNA, 21 nt, Human
gucuugaacuccuggccucaa

SEQ ID NO: 3345478 - RNA, 17 nt, Human
gucuugaacuccuggcc

SEQ ID NO: 3345479 - RNA, 16 nt, Human
gucuugaacuccuggc

SEQ ID NO: 3345480 - RNA, 18 nt, Human
gucugugccauuuuguau

SEQ ID NO: 3345481 - RNA, 14 nt, Human
gucuguucuuucca

SEQ ID NO: 3345482 - RNA, 17 nt, Human
gucuguucuuuccaaag

SEQ ID NO: 3345483 - RNA, 22 nt, Human
gugauccacccaccucagccuc

SEQ ID NO: 3345484 - RNA, 17 nt, Human
gugaguugauagcacag

SEQ ID NO: 3345485 - RNA, 15 nt, Human
gugauacaaugcugu

SEQ ID NO: 3345486 - RNA, 17 nt, Human
gugauacaaugcugugc

SEQ ID NO: 3345487 - RNA, 17 nt, Human
gugaggaugaaaaaaua

SEQ ID NO: 3345488 - RNA, 19 nt, Human
gugagccgagaucacgcca

SEQ ID NO: 3345489 - RNA, 20 nt, Human
gugagccacugcaccgggcc

SEQ ID NO: 3345490 - RNA, 15 nt, Human
gugagccacugcacc

SEQ ID NO: 3345491 - RNA, 14 nt, Human
gugagccacugcac

SEQ ID NO: 3345492 - RNA, 14 nt, Human
gugaccucugccug

SEQ ID NO: 3345493 - RNA, 13 nt, Human
gugaccucugccu

SEQ ID NO: 3345494 - RNA, 12 nt, Human
gugaccucugcc

SEQ ID NO: 3345495 - RNA, 14 nt, Human
gugacagaggcagc

SEQ ID NO: 3345496 - RNA, 13 nt, Human
gugacagaggcag

SEQ ID NO: 3345497 - RNA, 12 nt, Human
gugacagaggca

SEQ ID NO: 3345498 - RNA, 20 nt, Human
gugacaaggauugcuacugu

SEQ ID NO: 3345499 - RNA, 21 nt, Human
gugaaugaugauccuaggcau

SEQ ID NO: 3345500 - RNA, 23 nt, Human
gugcaguggugcgaucuggguuc

SEQ ID NO: 3345501 - RNA, 20 nt, Human
gugcaguggugcgaucuggg

SEQ ID NO: 3345502 - RNA, 22 nt, Human
gugcauaccacuuuuguucuug

SEQ ID NO: 3345503 - RNA, 21 nt, Human
gugcauaccacuuuuguucuu

SEQ ID NO: 3345504 - RNA, 13 nt, Human
gugauuuuuguaa

SEQ ID NO: 3345505 - RNA, 18 nt, Human
gugauuuuuguaauuuuu

SEQ ID NO: 3345506 - RNA, 24 nt, Human
gugauccacccaccucagccuccc

SEQ ID NO: 3345507 - RNA, 23 nt, Human
gugauccacccaccucagccucc

SEQ ID NO: 3345508 - RNA, 14 nt, Human
gugcggccuuuggc

SEQ ID NO: 3345509 - RNA, 14 nt, Human
gugcgccuacagga

SEQ ID NO: 3345510 - RNA, 16 nt, Human
gugccaugugccaggu

SEQ ID NO: 3345511 - RNA, 14 nt, Human
gugccaugugccag

SEQ ID NO: 3345512 - RNA, 21 nt, Human
gugcgaucuggguucacugca

SEQ ID NO: 3345513 - RNA, 22 nt, Human
guauaugucaagccauaauugu

SEQ ID NO: 3345514 - RNA, 17 nt, Human
guaugaggcauuuguuu

SEQ ID NO: 3345515 - RNA, 20 nt, Human
guaugaggcauuuguuugaa

SEQ ID NO: 3345516 - RNA, 20 nt, Human
guaugaucacggcucacugc

SEQ ID NO: 3345517 - RNA, 21 nt, Human
guaugaucacggcucacugca

SEQ ID NO: 3345518 - RNA, 23 nt, Human
guauuaaaacauuggauuauccu

SEQ ID NO: 3345519 - RNA, 20 nt, Human
guauuaaaacauuggauuau

SEQ ID NO: 3345520 - RNA, 17 nt, Human
guauuaaaacauuggau

SEQ ID NO: 3345521 - RNA, 15 nt, Human
guauuaaaacauugg

SEQ ID NO: 3345522 - RNA, 14 nt, Human
guauuaaaacauug

SEQ ID NO: 3345523 - RNA, 13 nt, Human
guauuaaaacauu

SEQ ID NO: 3345524 - RNA, 12 nt, Human
guauuaaaacau

SEQ ID NO: 3345525 - RNA, 12 nt, Human
guaucugagcag

SEQ ID NO: 3345526 - RNA, 12 nt, Human
guaucuggugac

SEQ ID NO: 3345527 - RNA, 19 nt, Human
guaucuggugacuuuccuc

SEQ ID NO: 3345528 - RNA, 13 nt, Human
guaugaggcauuu

SEQ ID NO: 3345529 - RNA, 15 nt, Human
guaugaggcauuugu

SEQ ID NO: 3345530 - RNA, 22 nt, Human
guagggcgggaggauguucugg

SEQ ID NO: 3345531 - RNA, 21 nt, Human
guagggcgggaggauguucug

SEQ ID NO: 3345532 - RNA, 23 nt, Human
guagggcgggaggauguucuggg

SEQ ID NO: 3345533 - RNA, 16 nt, Human
guagggcgggaggaug

SEQ ID NO: 3345534 - RNA, 15 nt, Human
guagagugugccuga

SEQ ID NO: 3345535 - RNA, 16 nt, Human
guaggguuauaauaau

SEQ ID NO: 3345536 - RNA, 14 nt, Human
guagucaggugccu

SEQ ID NO: 3345537 - RNA, 21 nt, Human
gucccaccuuggcugcaggga

SEQ ID NO: 3345538 - RNA, 12 nt, Human
guccacccagga

SEQ ID NO: 3345539 - RNA, 23 nt, Human
guccacccaggagccccgaggcc

SEQ ID NO: 3345540 - RNA, 23 nt, Human
gucccaccuuggcugcagggagu

SEQ ID NO: 3345541 - RNA, 20 nt, Human
gucccaccuuggcugcaggg

SEQ ID NO: 3345542 - RNA, 16 nt, Human
gucccugcacuugcag

SEQ ID NO: 3345543 - RNA, 21 nt, Human
gucccugcacuugcagacucu

SEQ ID NO: 3345544 - RNA, 19 nt, Human
gucccugcacuugcagacu

SEQ ID NO: 3345545 - RNA, 12 nt, Human
gucacucuggca

SEQ ID NO: 3345546 - RNA, 13 nt, Human
gucacucuggcag

SEQ ID NO: 3345547 - RNA, 14 nt, Human
gucacucuggcagc

SEQ ID NO: 3345548 - RNA, 16 nt, Human
gucacucuggcagcuc

SEQ ID NO: 3345549 - RNA, 17 nt, Human
gucacucuggcagcuca

SEQ ID NO: 3345550 - RNA, 19 nt, Human
gucacucuggcagcucaga

SEQ ID NO: 3345551 - RNA, 17 nt, Human
gucaccccggccaccug

SEQ ID NO: 3345552 - RNA, 18 nt, Human
gucaccccggccaccugc

SEQ ID NO: 3345553 - RNA, 22 nt, Human
gucaccccggccaccugcggug

SEQ ID NO: 3345554 - RNA, 16 nt, Human
gucagagccugcaguu

SEQ ID NO: 3345555 - RNA, 15 nt, Human
gucagagccugcagu

SEQ ID NO: 3345556 - RNA, 14 nt, Human
gucagagccugcag

SEQ ID NO: 3345557 - RNA, 19 nt, Human
guauuuuguuuuugucuua

SEQ ID NO: 3345558 - RNA, 15 nt, Human
gucaagugaaaaagg

SEQ ID NO: 3345559 - RNA, 15 nt, Human
gucaccccggccacc

SEQ ID NO: 3345560 - RNA, 14 nt, Human
guauuuuacuaaua

SEQ ID NO: 3345561 - RNA, 11 nt, Human
uuuuuccuuca

SEQ ID NO: 3345562 - RNA, 23 nt, Human
uuuuuaagaaaaaggaugcacag

SEQ ID NO: 3345563 - RNA, 19 nt, Human
uuuuuccuucagugccuua

SEQ ID NO: 3345564 - RNA, 16 nt, Human
uuuugucauauaagau

SEQ ID NO: 3345565 - RNA, 19 nt, Human
uuuuguagagccagggucu

SEQ ID NO: 3345566 - RNA, 16 nt, Human
uuuucuuucagccaag

SEQ ID NO: 3345567 - RNA, 14 nt, Human
uuuuggcugcugaa

SEQ ID NO: 3345568 - RNA, 15 nt, Human
uuuuggucuguguga

SEQ ID NO: 3345569 - RNA, 20 nt, Human
uuuugacaaggggcaguggu

SEQ ID NO: 3345570 - RNA, 21 nt, Human
uuuuaaaugcaccuggaauau

SEQ ID NO: 3345571 - RNA, 11 nt, Human
uuuuaaaugca

SEQ ID NO: 3345572 - RNA, 12 nt, Human
uuuuaaaugcac

SEQ ID NO: 3345573 - RNA, 21 nt, Human
uuuguucuggcucuuccaggc

SEQ ID NO: 3345574 - RNA, 17 nt, Human
uuuuaaagaaugcucuu

SEQ ID NO: 3345575 - RNA, 15 nt, Human
uuugcuuugugauuu

SEQ ID NO: 3345576 - RNA, 16 nt, Human
uuugcuuugugauuuu

SEQ ID NO: 3345577 - RNA, 14 nt, Human
uuuggaauuuugug

SEQ ID NO: 3345578 - RNA, 21 nt, Human
uuuggaauuuugugcccccau

SEQ ID NO: 3345579 - RNA, 17 nt, Human
uuuggucuacacugugc

SEQ ID NO: 3345580 - RNA, 12 nt, Human
uuucuucucccu

SEQ ID NO: 3345581 - RNA, 13 nt, Human
uuucuucucccuc

SEQ ID NO: 3345582 - RNA, 18 nt, Human
uuucuuagggaaggauac

SEQ ID NO: 3345583 - RNA, 23 nt, Human
uuucuuagggaaggauacaaaag

SEQ ID NO: 3345584 - RNA, 15 nt, Human
uuugaacugauaaag

SEQ ID NO: 3345585 - RNA, 14 nt, Human
uuugaacucuucaa

SEQ ID NO: 3345586 - RNA, 17 nt, Human
uuugaacugauaaagau

SEQ ID NO: 3345587 - RNA, 19 nt, Human
uuugaacugauaaagauga

SEQ ID NO: 3345588 - RNA, 22 nt, Human
uuugaagaugccgcauuuggau

SEQ ID NO: 3345589 - RNA, 20 nt, Human
uuucuaaaggcuaccuuugu

SEQ ID NO: 3345590 - RNA, 21 nt, Human
uuucuaaaggcuaccuuugua

SEQ ID NO: 3345591 - RNA, 18 nt, Human
uuucuaaaggcuaccuuu

SEQ ID NO: 3345592 - RNA, 23 nt, Human
uuucuacucgaguuacagacaaa

SEQ ID NO: 3345593 - RNA, 20 nt, Human
uuucuguucuuucuggcuau

SEQ ID NO: 3345594 - RNA, 23 nt, Human
uuacauuuuuaagugcugcauuu

SEQ ID NO: 3345595 - RNA, 14 nt, Human
uuaccacagacaua

SEQ ID NO: 3345596 - RNA, 17 nt, Human
uuaccacagacauacua

SEQ ID NO: 3345597 - RNA, 16 nt, Human
uuuccugaggcugggc

SEQ ID NO: 3345598 - RNA, 21 nt, Human
cuaauaaaauuuaaaagucuu

SEQ ID NO: 3345599 - RNA, 16 nt, Human
cuaaggugugcucuga

SEQ ID NO: 3345600 - RNA, 20 nt, Human
cuaauaaaauuuaaaagucu

SEQ ID NO: 3345601 - RNA, 18 nt, Human
cuaauauguaacaagcca

SEQ ID NO: 3345602 - RNA, 16 nt, Human
cuaauguacugcauau

SEQ ID NO: 3345603 - RNA, 14 nt, Human
cuaauguacugcau

SEQ ID NO: 3345604 - RNA, 22 nt, Human
cuacccacccuccuuucaccac

SEQ ID NO: 3345605 - RNA, 13 nt, Human
cuacccacccucc

SEQ ID NO: 3345606 - RNA, 17 nt, Human
cuacccacccuccuuuc

SEQ ID NO: 3345607 - RNA, 19 nt, Human
cuacccagcgagcccuggu

SEQ ID NO: 3345608 - RNA, 20 nt, Human
cuacccagcgagcccuggug

SEQ ID NO: 3345609 - RNA, 15 nt, Human
cuacagaggccaugg

SEQ ID NO: 3345610 - RNA, 13 nt, Human
cuacacacugcau

SEQ ID NO: 3345611 - RNA, 15 nt, Human
cuacacacugcaugu

SEQ ID NO: 3345612 - RNA, 18 nt, Human
cuacacugugcugagucu

SEQ ID NO: 3345613 - RNA, 15 nt, Human
cuaaggugugcucug

SEQ ID NO: 3345614 - RNA, 21 nt, Human
cuaagcuauucaguaauaacu

SEQ ID NO: 3345615 - RNA, 19 nt, Human
cuaagcuauucaguaauaa

SEQ ID NO: 3345616 - RNA, 17 nt, Human
cuaaccacgcuggaccu

SEQ ID NO: 3345617 - RNA, 16 nt, Human
cuaaccagcagaaaug

SEQ ID NO: 3345618 - RNA, 14 nt, Human
cuaaccacgcugga

SEQ ID NO: 3345619 - RNA, 17 nt, Human
cuaaccagcagaaaugc

SEQ ID NO: 3345620 - RNA, 17 nt, Human
cuagcacuuugggaggc

SEQ ID NO: 3345621 - RNA, 17 nt, Human
cuagagugaacuugggc

SEQ ID NO: 3345622 - RNA, 20 nt, Human
cuagacgagcaggcuucuuc

SEQ ID NO: 3345623 - RNA, 21 nt, Human
cuagacgagcaggcuucuucc

SEQ ID NO: 3345624 - RNA, 16 nt, Human
cuacuguaauuuguga

SEQ ID NO: 3345625 - RNA, 17 nt, Human
cuacuguaauuugugau

SEQ ID NO: 3345626 - RNA, 14 nt, Human
cuacccgggaaggg

SEQ ID NO: 3345627 - RNA, 15 nt, Human
cuacccgggaagggg

SEQ ID NO: 3345628 - RNA, 20 nt, Human
cuacccgggaagggggcugg

SEQ ID NO: 3345629 - RNA, 21 nt, Human
cuacccgggaagggggcuggg

SEQ ID NO: 3345630 - RNA, 21 nt, Human
cuacucugugucagguggggc

SEQ ID NO: 3345631 - RNA, 16 nt, Human
cuacucugugucaggu

SEQ ID NO: 3345632 - RNA, 13 nt, Human
cuacucuguguca

SEQ ID NO: 3345633 - RNA, 14 nt, Human
cuaugcauuugaaa

SEQ ID NO: 3345634 - RNA, 19 nt, Human
cucaacucuccuccagagu

SEQ ID NO: 3345635 - RNA, 20 nt, Human
cucaacucuccuccagaguc

SEQ ID NO: 3345636 - RNA, 21 nt, Human
cucaacucuccuccagaguca

SEQ ID NO: 3345637 - RNA, 17 nt, Human
cucaaccuccugggcua

SEQ ID NO: 3345638 - RNA, 17 nt, Human
cucacuauguugcccag

SEQ ID NO: 3345639 - RNA, 16 nt, Human
cucacuauguugccca

SEQ ID NO: 3345640 - RNA, 12 nt, Human
cucaccccagcc

SEQ ID NO: 3345641 - RNA, 13 nt, Human
cucaccccagccc

SEQ ID NO: 3345642 - RNA, 19 nt, Human
cucaccagccccagugccc

SEQ ID NO: 3345643 - RNA, 21 nt, Human
cucaccagccccagugcccac

SEQ ID NO: 3345644 - RNA, 20 nt, Human
cucaccagccccagugccca

SEQ ID NO: 3345645 - RNA, 20 nt, Human
cucaagugauucuccugccu

SEQ ID NO: 3345646 - RNA, 19 nt, Human
cucaagugauucuccugcc

SEQ ID NO: 3345647 - RNA, 18 nt, Human
cucaagugauucuccugc

SEQ ID NO: 3345648 - RNA, 23 nt, Human
cucacaguccuuaccagcagagc

SEQ ID NO: 3345649 - RNA, 17 nt, Human
cucaagugauucuccug

SEQ ID NO: 3345650 - RNA, 11 nt, Human
cuaugcauuug

SEQ ID NO: 3345651 - RNA, 12 nt, Human
cuaugcauuuga

SEQ ID NO: 3345652 - RNA, 14 nt, Human
cuaugacacaugca

SEQ ID NO: 3345653 - RNA, 20 nt, Human
cuaucaaguauuauaccuuu

SEQ ID NO: 3345654 - RNA, 22 nt, Human
cuauauuguuuucaguguacau

SEQ ID NO: 3345655 - RNA, 23 nt, Human
cuauauuguuuucaguguacaug

SEQ ID NO: 3345656 - RNA, 22 nt, Human
cuaggaccccuccaugugggcu

SEQ ID NO: 3345657 - RNA, 17 nt, Human
cuaggaggucucuaaga

SEQ ID NO: 3345658 - RNA, 21 nt, Human
cuaggaagacuuuggaaagag

SEQ ID NO: 3345659 - RNA, 13 nt, Human
cuaggaacacucc

SEQ ID NO: 3345660 - RNA, 15 nt, Human
cuaggaacacuccuu

SEQ ID NO: 3345661 - RNA, 17 nt, Human
cuaggaagacuuuggaa

SEQ ID NO: 3345662 - RNA, 21 nt, Human
cuagugugguguuuccuggca

SEQ ID NO: 3345663 - RNA, 22 nt, Human
cuagugugguguuuccuggcac

SEQ ID NO: 3345664 - RNA, 23 nt, Human
cuagugugguguuuccuggcacu

SEQ ID NO: 3345665 - RNA, 19 nt, Human
cuagugugguguuuccugg

SEQ ID NO: 3345666 - RNA, 21 nt, Human
cuaggcauuugcugaauacag

SEQ ID NO: 3345667 - RNA, 14 nt, Human
cgugcacacaccag

SEQ ID NO: 3345668 - RNA, 19 nt, Human
cgugcacacaccagagccc

SEQ ID NO: 3345669 - RNA, 18 nt, Human
cgugcacacaccagagcc

SEQ ID NO: 3345670 - RNA, 23 nt, Human
cgugcauaccacuuuuguucuug

SEQ ID NO: 3345671 - RNA, 21 nt, Human
cgugcaguggugcgaucuggg

SEQ ID NO: 3345672 - RNA, 22 nt, Human
cgucugacaggcaaugcuggcu

SEQ ID NO: 3345673 - RNA, 21 nt, Human
cgucugacaggcaaugcuggc

SEQ ID NO: 3345674 - RNA, 20 nt, Human
cgucugacaggcaaugcugg

SEQ ID NO: 3345675 - RNA, 16 nt, Human
cgugcacacaccagag

SEQ ID NO: 3345676 - RNA, 18 nt, Human
cggugcuaucucccccag

SEQ ID NO: 3345677 - RNA, 20 nt, Human
cggugcuaucucccccagcc

SEQ ID NO: 3345678 - RNA, 21 nt, Human
cggugcuaucucccccagccc

SEQ ID NO: 3345679 - RNA, 16 nt, Human
cgucucauacucaccu

SEQ ID NO: 3345680 - RNA, 16 nt, Human
cgucuaccugaggggc

SEQ ID NO: 3345681 - RNA, 14 nt, Human
cgucugacaggcaa

SEQ ID NO: 3345682 - RNA, 17 nt, Human
cguggcugcuucaagga

SEQ ID NO: 3345683 - RNA, 15 nt, Human
cuaaauggaaccacu

SEQ ID NO: 3345684 - RNA, 16 nt, Human
cuaaauggaaccacuc

SEQ ID NO: 3345685 - RNA, 17 nt, Human
cuaaauggaaccacucu

SEQ ID NO: 3345686 - RNA, 18 nt, Human
cuaaauggaaccacucua

SEQ ID NO: 3345687 - RNA, 15 nt, Human
cuaacauggaaguac

SEQ ID NO: 3345688 - RNA, 17 nt, Human
cuaacauggaaguacua

SEQ ID NO: 3345689 - RNA, 16 nt, Human
cuaaauguugaaagau

SEQ ID NO: 3345690 - RNA, 18 nt, Human
cgggaggucgaggcagga

SEQ ID NO: 3345691 - RNA, 20 nt, Human
cgggaggucgaggcaggagg

SEQ ID NO: 3345692 - RNA, 22 nt, Human
cgggcacucagaagacacugau

SEQ ID NO: 3345693 - RNA, 14 nt, Human
cgggcacucagaag

SEQ ID NO: 3345694 - RNA, 22 nt, Human
cggggacagcuccuucuguccu

SEQ ID NO: 3345695 - RNA, 22 nt, Human
cggcuggccuggccccucaggg

SEQ ID NO: 3345696 - RNA, 19 nt, Human
cggcuggccuggccccuca

SEQ ID NO: 3345697 - RNA, 23 nt, Human
cggcuggccuggccccucagggu

SEQ ID NO: 3345698 - RNA, 15 nt, Human
cgggggcagagaggg

SEQ ID NO: 3345699 - RNA, 23 nt, Human
cggggacagcuccuucuguccua

SEQ ID NO: 3345700 - RNA, 21 nt, Human
cggugagaggggaacagacug

SEQ ID NO: 3345701 - RNA, 20 nt, Human
cggugagaggggaacagacu

SEQ ID NO: 3345702 - RNA, 20 nt, Human
cgguccacccaggagccccg

SEQ ID NO: 3345703 - RNA, 16 nt, Human
cgguccacccaggagc

SEQ ID NO: 3345704 - RNA, 15 nt, Human
cgguccacccaggag

SEQ ID NO: 3345705 - RNA, 14 nt, Human
cgguccacccagga

SEQ ID NO: 3345706 - RNA, 13 nt, Human
cggaagagccuug

SEQ ID NO: 3345707 - RNA, 11 nt, Human
cggccaccugc

SEQ ID NO: 3345708 - RNA, 15 nt, Human
cggccaccugcggug

SEQ ID NO: 3345709 - RNA, 16 nt, Human
cggccaccugcggugc

SEQ ID NO: 3345710 - RNA, 17 nt, Human
cggccaccugcggugcu

SEQ ID NO: 3345711 - RNA, 24 nt, Human
cggccaggccagagggagugacag

SEQ ID NO: 3345712 - RNA, 19 nt, Human
cggccccugcugguucagg

SEQ ID NO: 3345713 - RNA, 18 nt, Human
cggccccugcugguucag

SEQ ID NO: 3345714 - RNA, 13 nt, Human
cggccccugcugg

SEQ ID NO: 3345715 - RNA, 22 nt, Human
cgcccaggcuuagucacugaga

SEQ ID NO: 3345716 - RNA, 12 nt, Human
cgcgcacacaca

SEQ ID NO: 3345717 - RNA, 18 nt, Human
cgcgcacacacacacaua

SEQ ID NO: 3345718 - RNA, 23 nt, Human
cgccaggggaaaaucagccugcu

SEQ ID NO: 3345719 - RNA, 14 nt, Human
cgccaucccagccc

SEQ ID NO: 3345720 - RNA, 16 nt, Human
cgccaucccagcccca

SEQ ID NO: 3345721 - RNA, 22 nt, Human
cgccaggggaaaaucagccugc

SEQ ID NO: 3345722 - RNA, 17 nt, Human
ccucugcccacucccug

SEQ ID NO: 3345723 - RNA, 19 nt, Human
ccucugcccacucccugca

SEQ ID NO: 3345724 - RNA, 20 nt, Human
ccucugcccacucccugcaa

SEQ ID NO: 3345725 - RNA, 22 nt, Human
cgccagauucuuuccugaggcu

SEQ ID NO: 3345726 - RNA, 14 nt, Human
cgcugugcugcccu

SEQ ID NO: 3345727 - RNA, 15 nt, Human
cggaaaacaugcuac

SEQ ID NO: 3345728 - RNA, 20 nt, Human
cggaaaacaugcuacacacu

SEQ ID NO: 3345729 - RNA, 22 nt, Human
cgcugucagccauuccuguucc

SEQ ID NO: 3345730 - RNA, 20 nt, Human
cgcuggggccaguugguccc

SEQ ID NO: 3345731 - RNA, 16 nt, Human
cgcugugcugcccugc

SEQ ID NO: 3345732 - RNA, 17 nt, Human
cgcugugcugcccugcc

SEQ ID NO: 3345733 - RNA, 15 nt, Human
cgcugugcugcccug

SEQ ID NO: 3345734 - RNA, 22 nt, Human
cgcuaagagggagggagggcuc

SEQ ID NO: 3345735 - RNA, 21 nt, Human
cgcuaagagggagggagggcu

SEQ ID NO: 3345736 - RNA, 14 nt, Human
cgcgcgcacacaca

SEQ ID NO: 3345737 - RNA, 13 nt, Human
cgcgcgcacacac

SEQ ID NO: 3345738 - RNA, 11 nt, Human
cgcgcgcacac

SEQ ID NO: 3345739 - RNA, 19 nt, Human
cgcgcgcacacacacacau

SEQ ID NO: 3345740 - RNA, 16 nt, Human
cgcuacccgggaaggg

SEQ ID NO: 3345741 - RNA, 15 nt, Human
cugaaagcccugagc

SEQ ID NO: 3345742 - RNA, 16 nt, Human
cugaaagcccugagcu

SEQ ID NO: 3345743 - RNA, 17 nt, Human
cugaaagcccugagcuu

SEQ ID NO: 3345744 - RNA, 18 nt, Human
cugaaagcccugagcuuu

SEQ ID NO: 3345745 - RNA, 19 nt, Human
cugaaagcccugagcuuuc

SEQ ID NO: 3345746 - RNA, 23 nt, Human
cugaaagcccugagcuuucugcu

SEQ ID NO: 3345747 - RNA, 19 nt, Human
cugaagaauugaaaaacca

SEQ ID NO: 3345748 - RNA, 17 nt, Human
cucuuucccucccuucc

SEQ ID NO: 3345749 - RNA, 13 nt, Human
cucuuucccuccc

SEQ ID NO: 3345750 - RNA, 23 nt, Human
cucuuuaaugucacaggcagguc

SEQ ID NO: 3345751 - RNA, 22 nt, Human
cucuuuaaugucacaggcaggu

SEQ ID NO: 3345752 - RNA, 21 nt, Human
cucuuuaaugucacaggcagg

SEQ ID NO: 3345753 - RNA, 20 nt, Human
cucuuuaaugucacaggcag

SEQ ID NO: 3345754 - RNA, 13 nt, Human
cucuugguccugc

SEQ ID NO: 3345755 - RNA, 15 nt, Human
cucuugguccugcug

SEQ ID NO: 3345756 - RNA, 16 nt, Human
cucuugguccugcugc

SEQ ID NO: 3345757 - RNA, 18 nt, Human
cucuuuaaugucacaggc

SEQ ID NO: 3345758 - RNA, 22 nt, Human
cucuugaaauauaggaacuuaa

SEQ ID NO: 3345759 - RNA, 19 nt, Human
cucuuggguucaagcgauu

SEQ ID NO: 3345760 - RNA, 21 nt, Human
cucuuggguucaagcgauucu

SEQ ID NO: 3345761 - RNA, 15 nt, Human
cucugugucaggugg

SEQ ID NO: 3345762 - RNA, 13 nt, Human
cucuuagaaaaac

SEQ ID NO: 3345763 - RNA, 14 nt, Human
cucuuccaggcugg

SEQ ID NO: 3345764 - RNA, 15 nt, Human
cucuuccaggcuggg

SEQ ID NO: 3345765 - RNA, 13 nt, Human
cucuuccaggcug

SEQ ID NO: 3345766 - RNA, 15 nt, Human
cucuggacaggcaug

SEQ ID NO: 3345767 - RNA, 21 nt, Human
cucugccugaagucacacagu

SEQ ID NO: 3345768 - RNA, 10 nt, Human
cucugccuga

SEQ ID NO: 3345769 - RNA, 22 nt, Human
cucugccugaagucacacagug

SEQ ID NO: 3345770 - RNA, 13 nt, Human
cucucuccucccu

SEQ ID NO: 3345771 - RNA, 14 nt, Human
cucuggacaggcau

SEQ ID NO: 3345772 - RNA, 16 nt, Human
cucuggacaggcaugu

SEQ ID NO: 3345773 - RNA, 12 nt, Human
cucuggcagcuc

SEQ ID NO: 3345774 - RNA, 14 nt, Human
cucuggcagcucag

SEQ ID NO: 3345775 - RNA, 15 nt, Human
cucuggcagcucaga

SEQ ID NO: 3345776 - RNA, 14 nt, Human
cugagacagcccgg

SEQ ID NO: 3345777 - RNA, 15 nt, Human
cugagacagcccggg

SEQ ID NO: 3345778 - RNA, 18 nt, Human
cugacuguuuucucuuga

SEQ ID NO: 3345779 - RNA, 16 nt, Human
cugacuguuuucucuu

SEQ ID NO: 3345780 - RNA, 13 nt, Human
cugacccaugcug

SEQ ID NO: 3345781 - RNA, 14 nt, Human
cugacccacugcuu

SEQ ID NO: 3345782 - RNA, 13 nt, Human
cugacccacugcu

SEQ ID NO: 3345783 - RNA, 14 nt, Human
cugacccaugcugc

SEQ ID NO: 3345784 - RNA, 15 nt, Human
cugacccaugcugcc

SEQ ID NO: 3345785 - RNA, 16 nt, Human
cugacccaugcugccc

SEQ ID NO: 3345786 - RNA, 12 nt, Human
cugacccacugc

SEQ ID NO: 3345787 - RNA, 22 nt, Human
cugacauuguuggccaaagcca

SEQ ID NO: 3345788 - RNA, 21 nt, Human
cugacauuguuggccaaagcc

SEQ ID NO: 3345789 - RNA, 21 nt, Human
cugacaggcaaugcuggcugu

SEQ ID NO: 3345790 - RNA, 12 nt, Human
cugaggcccaga

SEQ ID NO: 3345791 - RNA, 13 nt, Human
cugaggcccagag

SEQ ID NO: 3345792 - RNA, 14 nt, Human
cugaggcccagagg

SEQ ID NO: 3345793 - RNA, 15 nt, Human
cugaggcccagaggg

SEQ ID NO: 3345794 - RNA, 16 nt, Human
cugaggcccagagggc

SEQ ID NO: 3345795 - RNA, 17 nt, Human
cugaggcccagagggcc

SEQ ID NO: 3345796 - RNA, 18 nt, Human
cugaggcccagagggccu

SEQ ID NO: 3345797 - RNA, 19 nt, Human
cugaggcccagagggccug

SEQ ID NO: 3345798 - RNA, 21 nt, Human
cugaggcccagagggccugca

SEQ ID NO: 3345799 - RNA, 23 nt, Human
cugaggcccagagggccugcaag

SEQ ID NO: 3345800 - RNA, 14 nt, Human
cugaggcccuucuc

SEQ ID NO: 3345801 - RNA, 15 nt, Human
cugaggcccuucucu

SEQ ID NO: 3345802 - RNA, 18 nt, Human
cugaggcccuucucucca

SEQ ID NO: 3345803 - RNA, 19 nt, Human
cugaggcccuucucuccag

SEQ ID NO: 3345804 - RNA, 20 nt, Human
cugaggcccuucucuccagc

SEQ ID NO: 3345805 - RNA, 16 nt, Human
cugagacagcccgggc

SEQ ID NO: 3345806 - RNA, 17 nt, Human
cugagacagcccgggcu

SEQ ID NO: 3345807 - RNA, 18 nt, Human
cugagacagcccgggcuc

SEQ ID NO: 3345808 - RNA, 17 nt, Human
cugagccagauuucacu

SEQ ID NO: 3345809 - RNA, 18 nt, Human
cugagccagauuucacuc

SEQ ID NO: 3345810 - RNA, 19 nt, Human
cugagccagauuucacucu

SEQ ID NO: 3345811 - RNA, 20 nt, Human
cugagccagauuucacucuc

SEQ ID NO: 3345812 - RNA, 21 nt, Human
cugagccagauuucacucucc

SEQ ID NO: 3345813 - RNA, 15 nt, Human
cugagccagauuuca

SEQ ID NO: 3345814 - RNA, 13 nt, Human
cucuacaaaaagc

SEQ ID NO: 3345815 - RNA, 16 nt, Human
cucuacagaggccaug

SEQ ID NO: 3345816 - RNA, 14 nt, Human
cucuacagaggcca

SEQ ID NO: 3345817 - RNA, 19 nt, Human
cucuacagaggccaugggc

SEQ ID NO: 3345818 - RNA, 13 nt, Human
cucuacagaggcc

SEQ ID NO: 3345819 - RNA, 16 nt, Human
cuccuucacagauggg

SEQ ID NO: 3345820 - RNA, 17 nt, Human
cuccuucacagaugggu

SEQ ID NO: 3345821 - RNA, 14 nt, Human
cuccugugugugcg

SEQ ID NO: 3345822 - RNA, 19 nt, Human
cuccuucacagaugggugc

SEQ ID NO: 3345823 - RNA, 13 nt, Human
cucuacccuggca

SEQ ID NO: 3345824 - RNA, 20 nt, Human
cucuaccauccccuguagag

SEQ ID NO: 3345825 - RNA, 23 nt, Human
cucuagggaaaaaccagcgugug

SEQ ID NO: 3345826 - RNA, 22 nt, Human
cucucaggccaaacucaccugc

SEQ ID NO: 3345827 - RNA, 23 nt, Human
cucucaggccaaacucaccugcc

SEQ ID NO: 3345828 - RNA, 13 nt, Human
cucucaggccagc

SEQ ID NO: 3345829 - RNA, 15 nt, Human
cucucaggccagcug

SEQ ID NO: 3345830 - RNA, 20 nt, Human
cucucaggccaaacucaccu

SEQ ID NO: 3345831 - RNA, 21 nt, Human
cucucaggccaaacucaccug

SEQ ID NO: 3345832 - RNA, 12 nt, Human
cucucaggccaa

SEQ ID NO: 3345833 - RNA, 19 nt, Human
cucuaguuugauuaaauuc

SEQ ID NO: 3345834 - RNA, 20 nt, Human
cucuaguuugauuaaauucu

SEQ ID NO: 3345835 - RNA, 21 nt, Human
cucuaguuugauuaaauucuu

SEQ ID NO: 3345836 - RNA, 15 nt, Human
cucuaguuugauuaa

SEQ ID NO: 3345837 - RNA, 17 nt, Human
cucucaggccagcugcu

SEQ ID NO: 3345838 - RNA, 18 nt, Human
cucucaggccagcugcuu

SEQ ID NO: 3345839 - RNA, 19 nt, Human
cucucaggccagcugcuug

SEQ ID NO: 3345840 - RNA, 21 nt, Human
cucucaggccagcugcuuggg

SEQ ID NO: 3345841 - RNA, 15 nt, Human
cucuccagccccugg

SEQ ID NO: 3345842 - RNA, 16 nt, Human
cucuccagccccugga

SEQ ID NO: 3345843 - RNA, 17 nt, Human
cucuccagccccuggau

SEQ ID NO: 3345844 - RNA, 18 nt, Human
cucuccagccccuggaug

SEQ ID NO: 3345845 - RNA, 14 nt, Human
cucuccagccccug

SEQ ID NO: 3345846 - RNA, 13 nt, Human
cucuccccagcaa

SEQ ID NO: 3345847 - RNA, 19 nt, Human
cucuccagccccuggaugc

SEQ ID NO: 3345848 - RNA, 12 nt, Human
cucuccucugcu

SEQ ID NO: 3345849 - RNA, 22 nt, Human
cucuccccagcaagugagagcu

SEQ ID NO: 3345850 - RNA, 14 nt, Human
cucuccccagcaag

SEQ ID NO: 3345851 - RNA, 13 nt, Human
cucuccucugcug

SEQ ID NO: 3345852 - RNA, 14 nt, Human
cucuccucugcugc

SEQ ID NO: 3345853 - RNA, 15 nt, Human
cucuccucugcugcu

SEQ ID NO: 3345854 - RNA, 18 nt, Human
cucuccucugcugcuggc

SEQ ID NO: 3345855 - RNA, 12 nt, Human
cucucucacucc

SEQ ID NO: 3345856 - RNA, 13 nt, Human
cucucucaggcca

SEQ ID NO: 3345857 - RNA, 15 nt, Human
cuccugccucagccu

SEQ ID NO: 3345858 - RNA, 22 nt, Human
cuccugccucgaacuggcugca

SEQ ID NO: 3345859 - RNA, 19 nt, Human
cuccugugugugcgccuac

SEQ ID NO: 3345860 - RNA, 16 nt, Human
cuccugugugugcgcc

SEQ ID NO: 3345861 - RNA, 11 nt, Human
cuccugcaggc

SEQ ID NO: 3345862 - RNA, 16 nt, Human
cuccugcaggcagcca

SEQ ID NO: 3345863 - RNA, 17 nt, Human
cuccugcaggcagccag

SEQ ID NO: 3345864 - RNA, 14 nt, Human
cuccugccucagcc

SEQ ID NO: 3345865 - RNA, 13 nt, Human
cuccugccucagc

SEQ ID NO: 3345866 - RNA, 11 nt, Human
cuccugcccuu

SEQ ID NO: 3345867 - RNA, 18 nt, Human
cuccugcaggcagccagg

SEQ ID NO: 3345868 - RNA, 20 nt, Human
cuccugcaggcagccaggcc

SEQ ID NO: 3345869 - RNA, 17 nt, Human
cucccuuucuucccuac

SEQ ID NO: 3345870 - RNA, 18 nt, Human
cucccucagucuggcccu

SEQ ID NO: 3345871 - RNA, 22 nt, Human
cuccuccagccgccaugcuccu

SEQ ID NO: 3345872 - RNA, 22 nt, Human
cuccucuccccagcaagugaga

SEQ ID NO: 3345873 - RNA, 12 nt, Human
cuccccugcugg

SEQ ID NO: 3345874 - RNA, 20 nt, Human
cuccccagccccaucccaaa

SEQ ID NO: 3345875 - RNA, 20 nt, Human
cuccccagcaagugagagcu

SEQ ID NO: 3345876 - RNA, 12 nt, Human
cuccccagcaag

SEQ ID NO: 3345877 - RNA, 17 nt, Human
cucccgaguagcuggga

SEQ ID NO: 3345878 - RNA, 16 nt, Human
cucccgaguagcuggg

SEQ ID NO: 3345879 - RNA, 18 nt, Human
cucccgaauagcugggac

SEQ ID NO: 3345880 - RNA, 15 nt, Human
cucccgaguagcugg

SEQ ID NO: 3345881 - RNA, 13 nt, Human
cuccccugcuggg

SEQ ID NO: 3345882 - RNA, 16 nt, Human
cucccgaauagcuggg

SEQ ID NO: 3345883 - RNA, 17 nt, Human
cucccgaauagcuggga

SEQ ID NO: 3345884 - RNA, 21 nt, Human
cucccaucucacacaugagca

SEQ ID NO: 3345885 - RNA, 11 nt, Human
cucccaucugu

SEQ ID NO: 3345886 - RNA, 14 nt, Human
cucccaucugugaa

SEQ ID NO: 3345887 - RNA, 15 nt, Human
cucccaucugugaaa

SEQ ID NO: 3345888 - RNA, 18 nt, Human
cucccaucugugaaagga

SEQ ID NO: 3345889 - RNA, 23 nt, Human
cucccaucugugaaaggaaagag

SEQ ID NO: 3345890 - RNA, 16 nt, Human
cucccaacucacccca

SEQ ID NO: 3345891 - RNA, 17 nt, Human
cucccaacucaccccag

SEQ ID NO: 3345892 - RNA, 18 nt, Human
cucccaaagugcugggau

SEQ ID NO: 3345893 - RNA, 22 nt, Human
cucccaacucaccccagcccca

SEQ ID NO: 3345894 - RNA, 13 nt, Human
cuccaugugggcu

SEQ ID NO: 3345895 - RNA, 17 nt, Human
cucccaaagugcuggga

SEQ ID NO: 3345896 - RNA, 18 nt, Human
cucacuauguugcccagg

SEQ ID NO: 3345897 - RNA, 18 nt, Human
cugcggugcuaucucccc

SEQ ID NO: 3345898 - RNA, 19 nt, Human
cugcggugcuaucuccccc

SEQ ID NO: 3345899 - RNA, 23 nt, Human
cugcgguccacccaggagccccg

SEQ ID NO: 3345900 - RNA, 20 nt, Human
cugcccugcccaccuggccu

SEQ ID NO: 3345901 - RNA, 17 nt, Human
cugcccugcccaccugg

SEQ ID NO: 3345902 - RNA, 21 nt, Human
cugcccugcccaccuggccuc

SEQ ID NO: 3345903 - RNA, 19 nt, Human
cugccauccagguucagcu

SEQ ID NO: 3345904 - RNA, 16 nt, Human
cugccugaagucacac

SEQ ID NO: 3345905 - RNA, 18 nt, Human
cugccugaagucacacag

SEQ ID NO: 3345906 - RNA, 19 nt, Human
cugccugaagucacacagu

SEQ ID NO: 3345907 - RNA, 14 nt, Human
cugcugcaguugcc

SEQ ID NO: 3345908 - RNA, 10 nt, Human
cugcugcagu

SEQ ID NO: 3345909 - RNA, 13 nt, Human
cugcugcaguugc

SEQ ID NO: 3345910 - RNA, 12 nt, Human
cugcucugguua

SEQ ID NO: 3345911 - RNA, 15 nt, Human
cugcucuccgaccag

SEQ ID NO: 3345912 - RNA, 20 nt, Human
cugcuccucuccccagcaag

SEQ ID NO: 3345913 - RNA, 19 nt, Human
cugcuccucuccccagcaa

SEQ ID NO: 3345914 - RNA, 23 nt, Human
cugcuccucuccccagcaaguga

SEQ ID NO: 3345915 - RNA, 20 nt, Human
cugcgguccacccaggagcc

SEQ ID NO: 3345916 - RNA, 20 nt, Human
cugcggugcuaucuccccca

SEQ ID NO: 3345917 - RNA, 21 nt, Human
cugcggugcuaucucccccag

SEQ ID NO: 3345918 - RNA, 22 nt, Human
cugcggugcuaucucccccagc

SEQ ID NO: 3345919 - RNA, 23 nt, Human
cugcggugcuaucucccccagcc

SEQ ID NO: 3345920 - RNA, 22 nt, Human
cugcuugaggcaacucaucuua

SEQ ID NO: 3345921 - RNA, 20 nt, Human
cugcuugcuugcuuuuuaau

SEQ ID NO: 3345922 - RNA, 13 nt, Human
cugcuugggcuuc

SEQ ID NO: 3345923 - RNA, 15 nt, Human
cugcuugggcuucau

SEQ ID NO: 3345924 - RNA, 17 nt, Human
cugcuugggcuucaucc

SEQ ID NO: 3345925 - RNA, 18 nt, Human
cugcuugggcuucauccu

SEQ ID NO: 3345926 - RNA, 19 nt, Human
cugcuugggcuucauccuc

SEQ ID NO: 3345927 - RNA, 19 nt, Human
cugcuugugaaaggaaaga

SEQ ID NO: 3345928 - RNA, 15 nt, Human
cugcuuuuggucugu

SEQ ID NO: 3345929 - RNA, 17 nt, Human
cugcuuuuggucugugu

SEQ ID NO: 3345930 - RNA, 13 nt, Human
cugcuugaggcaa

SEQ ID NO: 3345931 - RNA, 20 nt, Human
cugcuugaggcaacucaucu

SEQ ID NO: 3345932 - RNA, 21 nt, Human
cugcuugaggcaacucaucuu

SEQ ID NO: 3345933 - RNA, 17 nt, Human
cugcuggguguggcgca

SEQ ID NO: 3345934 - RNA, 14 nt, Human
cugcuggguguggc

SEQ ID NO: 3345935 - RNA, 15 nt, Human
cugcuggguguggcg

SEQ ID NO: 3345936 - RNA, 12 nt, Human
cugcugcuggcu

SEQ ID NO: 3345937 - RNA, 13 nt, Human
cugcugcuggcug

SEQ ID NO: 3345938 - RNA, 17 nt, Human
cugcagcaauaaagcag

SEQ ID NO: 3345939 - RNA, 13 nt, Human
cugcaguugccag

SEQ ID NO: 3345940 - RNA, 16 nt, Human
cugcaguugccaguca

SEQ ID NO: 3345941 - RNA, 20 nt, Human
cugcacuccagccuggguga

SEQ ID NO: 3345942 - RNA, 19 nt, Human
cugcacuccagccugggug

SEQ ID NO: 3345943 - RNA, 18 nt, Human
cugcaccgggccacagag

SEQ ID NO: 3345944 - RNA, 13 nt, Human
cugcacuccccug

SEQ ID NO: 3345945 - RNA, 19 nt, Human
cugcacuccccugcugggu

SEQ ID NO: 3345946 - RNA, 20 nt, Human
cugcacuccccugcugggug

SEQ ID NO: 3345947 - RNA, 22 nt, Human
cugaggcccuucucuccagccc

SEQ ID NO: 3345948 - RNA, 23 nt, Human
cugaggcccuucucuccagcccc

SEQ ID NO: 3345949 - RNA, 14 nt, Human
cugcaccggcuggc

SEQ ID NO: 3345950 - RNA, 15 nt, Human
cugcaccggcuggcc

SEQ ID NO: 3345951 - RNA, 15 nt, Human
cugcaccgggccaca

SEQ ID NO: 3345952 - RNA, 14 nt, Human
cugcaccgggccac

SEQ ID NO: 3345953 - RNA, 10 nt, Human
cugcagaggg

SEQ ID NO: 3345954 - RNA, 15 nt, Human
cugcagcaauaaagc

SEQ ID NO: 3345955 - RNA, 16 nt, Human
cugcagcaauaaagca

SEQ ID NO: 3345956 - RNA, 13 nt, Human
cugcagagggcac

SEQ ID NO: 3345957 - RNA, 18 nt, Human
cugcacuccccugcuggg

SEQ ID NO: 3345958 - RNA, 21 nt, Human
cugcacuccccugcugggugu

SEQ ID NO: 3345959 - RNA, 12 nt, Human
cugccacccugg

SEQ ID NO: 3345960 - RNA, 20 nt, Human
cugccacccuggggagaaag

SEQ ID NO: 3345961 - RNA, 21 nt, Human
cugccacccuggggagaaagu

SEQ ID NO: 3345962 - RNA, 20 nt, Human
cugcaucaagaugugacaug

SEQ ID NO: 3345963 - RNA, 15 nt, Human
cugcauaugaaagga

SEQ ID NO: 3345964 - RNA, 13 nt, Human
cugccaggaagcc

SEQ ID NO: 3345965 - RNA, 14 nt, Human
cugccaggaagcca

SEQ ID NO: 3345966 - RNA, 20 nt, Human
cugccaggaagccagcaggc

SEQ ID NO: 3345967 - RNA, 21 nt, Human
cugccaggaagccagcaggcu

SEQ ID NO: 3345968 - RNA, 19 nt, Human
cugccaggaagccagcagg

SEQ ID NO: 3345969 - RNA, 15 nt, Human
cugccauccucccaa

SEQ ID NO: 3345970 - RNA, 21 nt, Human
cugccauccagguucagcuug

SEQ ID NO: 3345971 - RNA, 22 nt, Human
cugccaggaagccagcaggcuc

SEQ ID NO: 3345972 - RNA, 20 nt, Human
cugcccaggccccugccacc

SEQ ID NO: 3345973 - RNA, 19 nt, Human
cugcccaggccccugccac

SEQ ID NO: 3345974 - RNA, 18 nt, Human
cugcccaggccccugcca

SEQ ID NO: 3345975 - RNA, 16 nt, Human
cugcccaggccccugc

SEQ ID NO: 3345976 - RNA, 15 nt, Human
cugccauuucugaga

SEQ ID NO: 3345977 - RNA, 15 nt, Human
cugcccaggccccug

SEQ ID NO: 3345978 - RNA, 14 nt, Human
cugcccaggccccu

SEQ ID NO: 3345979 - RNA, 12 nt, Human
cugcccaccugg

SEQ ID NO: 3345980 - RNA, 13 nt, Human
cugcccaggcccc

SEQ ID NO: 3345981 - RNA, 18 nt, Human
cugccccuggcagccccu

SEQ ID NO: 3345982 - RNA, 17 nt, Human
cugccccuggcagcccc

SEQ ID NO: 3345983 - RNA, 19 nt, Human
cugccccuggcagccccug

SEQ ID NO: 3345984 - RNA, 13 nt, Human
cugcccggcaggg

SEQ ID NO: 3345985 - RNA, 21 nt, Human
cugguccauagagagcaagac

SEQ ID NO: 3345986 - RNA, 23 nt, Human
cuggucucaaacucuugaccuca

SEQ ID NO: 3345987 - RNA, 13 nt, Human
cuggucccacuca

SEQ ID NO: 3345988 - RNA, 18 nt, Human
cuggguacuuguggacac

SEQ ID NO: 3345989 - RNA, 14 nt, Human
cuggguacuugugg

SEQ ID NO: 3345990 - RNA, 16 nt, Human
cuggguacuuguggac

SEQ ID NO: 3345991 - RNA, 19 nt, Human
cugggcucccuucccaccu

SEQ ID NO: 3345992 - RNA, 20 nt, Human
cugggcucccuucccaccuc

SEQ ID NO: 3345993 - RNA, 21 nt, Human
cugggcucccuucccaccucu

SEQ ID NO: 3345994 - RNA, 22 nt, Human
cugggcucccuucccaccucuc

SEQ ID NO: 3345995 - RNA, 15 nt, Human
cuggguuggagggug

SEQ ID NO: 3345996 - RNA, 20 nt, Human
cugguucaggguuggccccu

SEQ ID NO: 3345997 - RNA, 13 nt, Human
cugguggcagcuc

SEQ ID NO: 3345998 - RNA, 14 nt, Human
cugguggcagcuca

SEQ ID NO: 3345999 - RNA, 12 nt, Human
cugguggcagcu

SEQ ID NO: 3346000 - RNA, 22 nt, Human
cuguacaugaaaacacauuuuu

SEQ ID NO: 3346001 - RNA, 23 nt, Human
cuguacaugaaaacacauuuuuc

SEQ ID NO: 3346002 - RNA, 21 nt, Human
cuguaccucuugagccuugaa

SEQ ID NO: 3346003 - RNA, 22 nt, Human
cuguacagagcccacgccccca

SEQ ID NO: 3346004 - RNA, 21 nt, Human
cuguaauuugugauacaaugc

SEQ ID NO: 3346005 - RNA, 23 nt, Human
cuguacagagcccacgcccccac

SEQ ID NO: 3346006 - RNA, 18 nt, Human
cuguaauuugugauacaa

SEQ ID NO: 3346007 - RNA, 17 nt, Human
cuguaauuugugauaca

SEQ ID NO: 3346008 - RNA, 22 nt, Human
cugucccagugccgagaaggaa

SEQ ID NO: 3346009 - RNA, 23 nt, Human
cugucauuugagcagggcucagc

SEQ ID NO: 3346010 - RNA, 18 nt, Human
cuguaucccaugagccuc

SEQ ID NO: 3346011 - RNA, 15 nt, Human
cuguaucccaugagc

SEQ ID NO: 3346012 - RNA, 14 nt, Human
cuguaucccaugag

SEQ ID NO: 3346013 - RNA, 22 nt, Human
cuguaccucuugagccuugaac

SEQ ID NO: 3346014 - RNA, 13 nt, Human
cugucccccugac

SEQ ID NO: 3346015 - RNA, 14 nt, Human
cugucccccugaca

SEQ ID NO: 3346016 - RNA, 20 nt, Human
cuguccuacucugugucagg

SEQ ID NO: 3346017 - RNA, 18 nt, Human
cuguccuacucuguguca

SEQ ID NO: 3346018 - RNA, 17 nt, Human
cuguccuacucuguguc

SEQ ID NO: 3346019 - RNA, 16 nt, Human
cuguccuacucugugu

SEQ ID NO: 3346020 - RNA, 22 nt, Human
cugucccuuacgugaguccugg

SEQ ID NO: 3346021 - RNA, 21 nt, Human
cuguccuacucugugucaggu

SEQ ID NO: 3346022 - RNA, 22 nt, Human
cugucucaaaaaaagaaaaaga

SEQ ID NO: 3346023 - RNA, 18 nt, Human
cugggaugauuggagggg

SEQ ID NO: 3346024 - RNA, 20 nt, Human
cugggaucccucauccucau

SEQ ID NO: 3346025 - RNA, 20 nt, Human
cugggauuacaggugugaac

SEQ ID NO: 3346026 - RNA, 17 nt, Human
cugggauuacaggugug

SEQ ID NO: 3346027 - RNA, 19 nt, Human
cugggaggucaaggcugca

SEQ ID NO: 3346028 - RNA, 21 nt, Human
cugggaggucaaggcugcagu

SEQ ID NO: 3346029 - RNA, 22 nt, Human
cugggagaaccaaaaagaggcu

SEQ ID NO: 3346030 - RNA, 17 nt, Human
cugggagagccuuccag

SEQ ID NO: 3346031 - RNA, 18 nt, Human
cugggagagccuuccagg

SEQ ID NO: 3346032 - RNA, 19 nt, Human
cugggagagccuuccaggg

SEQ ID NO: 3346033 - RNA, 20 nt, Human
cugggagagccuuccagggg

SEQ ID NO: 3346034 - RNA, 21 nt, Human
cugggagagccuuccaggggu

SEQ ID NO: 3346035 - RNA, 22 nt, Human
cuggcuggguggcaccagcagc

SEQ ID NO: 3346036 - RNA, 20 nt, Human
cuggcugguuagagguuccc

SEQ ID NO: 3346037 - RNA, 17 nt, Human
cuggcuguuggcugggg

SEQ ID NO: 3346038 - RNA, 16 nt, Human
cuggcuguuggcuggg

SEQ ID NO: 3346039 - RNA, 22 nt, Human
cuggccagaugcaccagcccuu

SEQ ID NO: 3346040 - RNA, 24 nt, Human
cuggcaugggaaugaaugucagug

SEQ ID NO: 3346041 - RNA, 16 nt, Human
cuggcaugggaaugaa

SEQ ID NO: 3346042 - RNA, 18 nt, Human
cuggcaugggaaugaaug

SEQ ID NO: 3346043 - RNA, 19 nt, Human
cuggcaugggaaugaaugu

SEQ ID NO: 3346044 - RNA, 22 nt, Human
cuggcaugggaaugaaugucag

SEQ ID NO: 3346045 - RNA, 16 nt, Human
cuggcacuauaaugua

SEQ ID NO: 3346046 - RNA, 15 nt, Human
cuggcacuauaaugu

SEQ ID NO: 3346047 - RNA, 18 nt, Human
cuggaauauauaaccagu

SEQ ID NO: 3346048 - RNA, 14 nt, Human
cuggcaagaaugug

SEQ ID NO: 3346049 - RNA, 22 nt, Human
cuggcacccggccccugcuggu

SEQ ID NO: 3346050 - RNA, 18 nt, Human
cuggcacccggccccugc

SEQ ID NO: 3346051 - RNA, 17 nt, Human
cuggcacccggccccug

SEQ ID NO: 3346052 - RNA, 16 nt, Human
cuggcacccggccccu

SEQ ID NO: 3346053 - RNA, 22 nt, Human
cuggccucaagugauucuccug

SEQ ID NO: 3346054 - RNA, 12 nt, Human
cuggccucugca

SEQ ID NO: 3346055 - RNA, 23 nt, Human
cuggccucaagugauucuccugc

SEQ ID NO: 3346056 - RNA, 15 nt, Human
cuggccugagcuggg

SEQ ID NO: 3346057 - RNA, 18 nt, Human
cuggccugagcugggaug

SEQ ID NO: 3346058 - RNA, 14 nt, Human
cuggccuggccccu

SEQ ID NO: 3346059 - RNA, 13 nt, Human
cuggccuggcccc

SEQ ID NO: 3346060 - RNA, 13 nt, Human
cuggccucugcac

SEQ ID NO: 3346061 - RNA, 14 nt, Human
cuggccucugcacu

SEQ ID NO: 3346062 - RNA, 16 nt, Human
cuggccugagcuggga

SEQ ID NO: 3346063 - RNA, 16 nt, Human
cuggccuggccccuca

SEQ ID NO: 3346064 - RNA, 17 nt, Human
cuggccuggccccucag

SEQ ID NO: 3346065 - RNA, 14 nt, Human
cuggccugugucua

SEQ ID NO: 3346066 - RNA, 19 nt, Human
gaaggaagacuucaucccu

SEQ ID NO: 3346067 - RNA, 15 nt, Human
gaaggaacguccccu

SEQ ID NO: 3346068 - RNA, 21 nt, Human
gaaggaaacccagcucugguc

SEQ ID NO: 3346069 - RNA, 22 nt, Human
gaaggaaacccagcucuggucc

SEQ ID NO: 3346070 - RNA, 21 nt, Human
gaaggacauugcggacagcca

SEQ ID NO: 3346071 - RNA, 20 nt, Human
gaaggacauugcggacagcc

SEQ ID NO: 3346072 - RNA, 19 nt, Human
gaaggacauugcggacagc

SEQ ID NO: 3346073 - RNA, 18 nt, Human
gaagccgcuggggccagu

SEQ ID NO: 3346074 - RNA, 20 nt, Human
gaagccgcuggggccaguug

SEQ ID NO: 3346075 - RNA, 14 nt, Human
gaagccgcuggggc

SEQ ID NO: 3346076 - RNA, 19 nt, Human
gaaggaaacccagcucugg

SEQ ID NO: 3346077 - RNA, 20 nt, Human
gaaggaaacccagcucuggu

SEQ ID NO: 3346078 - RNA, 19 nt, Human
gaaguaauaugcacacauu

SEQ ID NO: 3346079 - RNA, 20 nt, Human
gaaguaauaugcacacauuu

SEQ ID NO: 3346080 - RNA, 13 nt, Human
gaagucacacagu

SEQ ID NO: 3346081 - RNA, 18 nt, Human
gaagucuuagauguauau

SEQ ID NO: 3346082 - RNA, 13 nt, Human
gaagggggcuggg

SEQ ID NO: 3346083 - RNA, 18 nt, Human
gaagcauuuacuuugugu

SEQ ID NO: 3346084 - RNA, 12 nt, Human
gaagagccuugc

SEQ ID NO: 3346085 - RNA, 17 nt, Human
gaagacuucaucccucu

SEQ ID NO: 3346086 - RNA, 15 nt, Human
gaagacuucaucccu

SEQ ID NO: 3346087 - RNA, 16 nt, Human
gaagacuucaucccuc

SEQ ID NO: 3346088 - RNA, 16 nt, Human
gaacuuugaccucugc

SEQ ID NO: 3346089 - RNA, 22 nt, Human
gaacuuugaccucugcagcaau

SEQ ID NO: 3346090 - RNA, 14 nt, Human
gaagaagcucucuc

SEQ ID NO: 3346091 - RNA, 17 nt, Human
gaacuuuccaggaaggc

SEQ ID NO: 3346092 - RNA, 17 nt, Human
gaacuugggccacugug

SEQ ID NO: 3346093 - RNA, 18 nt, Human
gaacuuggcgcugccccu

SEQ ID NO: 3346094 - RNA, 17 nt, Human
gaacuuggcgcugcccc

SEQ ID NO: 3346095 - RNA, 14 nt, Human
gaacuuaaauaaug

SEQ ID NO: 3346096 - RNA, 18 nt, Human
gaaccacaucuugcucug

SEQ ID NO: 3346097 - RNA, 16 nt, Human
gaaaugggcagagcag

SEQ ID NO: 3346098 - RNA, 15 nt, Human
gaaaugggcagagca

SEQ ID NO: 3346099 - RNA, 11 nt, Human
gaaaugagcug

SEQ ID NO: 3346100 - RNA, 18 nt, Human
gaaaugaggucagagccu

SEQ ID NO: 3346101 - RNA, 17 nt, Human
gaaaugggcagagcaga

SEQ ID NO: 3346102 - RNA, 17 nt, Human
gaaauguacagcaagga

SEQ ID NO: 3346103 - RNA, 17 nt, Human
gaaauauaggaacuuaa

SEQ ID NO: 3346104 - RNA, 22 nt, Human
gaaauauauacgaacaaaacac

SEQ ID NO: 3346105 - RNA, 20 nt, Human
gaaauauauacgaacaaaac

SEQ ID NO: 3346106 - RNA, 19 nt, Human
gaaauauauacgaacaaaa

SEQ ID NO: 3346107 - RNA, 18 nt, Human
gaaauauauacgaacaaa

SEQ ID NO: 3346108 - RNA, 16 nt, Human
gaaauauauacgaaca

SEQ ID NO: 3346109 - RNA, 19 nt, Human
gaaauaucugaaaauguau

SEQ ID NO: 3346110 - RNA, 18 nt, Human
gaaauaucugaaaaugua

SEQ ID NO: 3346111 - RNA, 22 nt, Human
gaacagacuggaagcacagcuu

SEQ ID NO: 3346112 - RNA, 15 nt, Human
gaacacuccuucaca

SEQ ID NO: 3346113 - RNA, 16 nt, Human
gaacacuccuucacag

SEQ ID NO: 3346114 - RNA, 19 nt, Human
gaacagacuggaagcacag

SEQ ID NO: 3346115 - RNA, 20 nt, Human
gaacagacuggaagcacagc

SEQ ID NO: 3346116 - RNA, 17 nt, Human
gaacacuccuucacaga

SEQ ID NO: 3346117 - RNA, 16 nt, Human
gaaaaaugagccuggc

SEQ ID NO: 3346118 - RNA, 16 nt, Human
gaaagaucaaaagguu

SEQ ID NO: 3346119 - RNA, 16 nt, Human
gaaagaguaggaagac

SEQ ID NO: 3346120 - RNA, 21 nt, Human
gaaagagagagaaacaaacuu

SEQ ID NO: 3346121 - RNA, 17 nt, Human
gaaagagagagaaacaa

SEQ ID NO: 3346122 - RNA, 11 nt, Human
gaaagagagag

SEQ ID NO: 3346123 - RNA, 22 nt, Human
gaaaguacuucuccacccugcu

SEQ ID NO: 3346124 - RNA, 11 nt, Human
gaaaggaaaga

SEQ ID NO: 3346125 - RNA, 16 nt, Human
gaaaggaaagaggcuc

SEQ ID NO: 3346126 - RNA, 17 nt, Human
cuuuucuuucagccaag

SEQ ID NO: 3346127 - RNA, 16 nt, Human
cuuuucuuucagccaa

SEQ ID NO: 3346128 - RNA, 13 nt, Human
cuuuucuuuucuu

SEQ ID NO: 3346129 - RNA, 22 nt, Human
cuuuuuaauauugauaugcuua

SEQ ID NO: 3346130 - RNA, 18 nt, Human
cuuuuuuauacauaaaca

SEQ ID NO: 3346131 - RNA, 11 nt, Human
gaaaaagaaaa

SEQ ID NO: 3346132 - RNA, 16 nt, Human
gaaaaagaaaaaauau

SEQ ID NO: 3346133 - RNA, 15 nt, Human
cuuuuuuauacauaa

SEQ ID NO: 3346134 - RNA, 16 nt, Human
cuuuuuuauacauaaa

SEQ ID NO: 3346135 - RNA, 17 nt, Human
cuuuuuuauacauaaac

SEQ ID NO: 3346136 - RNA, 21 nt, Human
cuuuucgcaggauucuuccuc

SEQ ID NO: 3346137 - RNA, 20 nt, Human
cuuuucgcaggauucuuccu

SEQ ID NO: 3346138 - RNA, 13 nt, Human
cuuuuccaacccu

SEQ ID NO: 3346139 - RNA, 23 nt, Human
cuuuuccaacccucaucaccaac

SEQ ID NO: 3346140 - RNA, 22 nt, Human
cuuuucauuuaggugaggaagc

SEQ ID NO: 3346141 - RNA, 22 nt, Human
cuuuccaaaguacacuguuuca

SEQ ID NO: 3346142 - RNA, 16 nt, Human
cuuuccaaaguacacu

SEQ ID NO: 3346143 - RNA, 14 nt, Human
cuuuccaggaaggc

SEQ ID NO: 3346144 - RNA, 19 nt, Human
cuuuggaaagaguaggaag

SEQ ID NO: 3346145 - RNA, 23 nt, Human
cuuuggaaagaguaggaagacuu

SEQ ID NO: 3346146 - RNA, 15 nt, Human
cuuugcagacaggca

SEQ ID NO: 3346147 - RNA, 14 nt, Human
cuuugcagacaggc

SEQ ID NO: 3346148 - RNA, 17 nt, Human
cuuuccugaggcugggc

SEQ ID NO: 3346149 - RNA, 16 nt, Human
cuuuccugaggcuggg

SEQ ID NO: 3346150 - RNA, 20 nt, Human
cuuuccugaggcugggcucc

SEQ ID NO: 3346151 - RNA, 13 nt, Human
cuuggauuguccc

SEQ ID NO: 3346152 - RNA, 23 nt, Human
cuuggcucaaguccucuuuucug

SEQ ID NO: 3346153 - RNA, 13 nt, Human
cuuggcugcaggg

SEQ ID NO: 3346154 - RNA, 12 nt, Human
cuuggcugcagg

SEQ ID NO: 3346155 - RNA, 13 nt, Human
cuugcuugcuuuu

SEQ ID NO: 3346156 - RNA, 18 nt, Human
cuuggggaccagagcugc

SEQ ID NO: 3346157 - RNA, 19 nt, Human
cuuggggaccagagcugcc

SEQ ID NO: 3346158 - RNA, 17 nt, Human
cuuggggaccagagcug

SEQ ID NO: 3346159 - RNA, 16 nt, Human
cuuggggaccagagcu

SEQ ID NO: 3346160 - RNA, 21 nt, Human
cuuguaaauagcucagguguc

SEQ ID NO: 3346161 - RNA, 20 nt, Human
cuugguuuguaaauuaacuu

SEQ ID NO: 3346162 - RNA, 18 nt, Human
cuuguggacacagcucuu

SEQ ID NO: 3346163 - RNA, 17 nt, Human
cuuguggacacagcucu

SEQ ID NO: 3346164 - RNA, 16 nt, Human
cuuguggacacagcuc

SEQ ID NO: 3346165 - RNA, 19 nt, Human
cuugaaauauaggaacuua

SEQ ID NO: 3346166 - RNA, 22 nt, Human
cuucuuuauaauucuacuuuga

SEQ ID NO: 3346167 - RNA, 16 nt, Human
cuugaacuggguacuu

SEQ ID NO: 3346168 - RNA, 19 nt, Human
cuugaacuccuggccucaa

SEQ ID NO: 3346169 - RNA, 20 nt, Human
cuugaacuggguacuugugg

SEQ ID NO: 3346170 - RNA, 18 nt, Human
cuugaacuggguacuugu

SEQ ID NO: 3346171 - RNA, 18 nt, Human
cuugaacuccuggccuca

SEQ ID NO: 3346172 - RNA, 17 nt, Human
cuugaacuccuggccuc

SEQ ID NO: 3346173 - RNA, 15 nt, Human
cuugaacuccuggcc

SEQ ID NO: 3346174 - RNA, 14 nt, Human
cuugaacuccuggc

SEQ ID NO: 3346175 - RNA, 20 nt, Human
cuugagccuugaacuuugac

SEQ ID NO: 3346176 - RNA, 22 nt, Human
cuugagccuugaacuuugaccu

SEQ ID NO: 3346177 - RNA, 18 nt, Human
cuugagccuugaacuuug

SEQ ID NO: 3346178 - RNA, 19 nt, Human
cuugagccuugaacuuuga

SEQ ID NO: 3346179 - RNA, 14 nt, Human
cuugagagggugga

SEQ ID NO: 3346180 - RNA, 17 nt, Human
cuugaccauucuccacc

SEQ ID NO: 3346181 - RNA, 20 nt, Human
cuugaccauucuccaccugc

SEQ ID NO: 3346182 - RNA, 22 nt, Human
cuugcaaaguaucccuacugua

SEQ ID NO: 3346183 - RNA, 12 nt, Human
cuugcaaaguau

SEQ ID NO: 3346184 - RNA, 14 nt, Human
cuugcaauggcagc

SEQ ID NO: 3346185 - RNA, 18 nt, Human
cuugcagacucuacagag

SEQ ID NO: 3346186 - RNA, 21 nt, Human
cuugcaugaggcuaguguggu

SEQ ID NO: 3346187 - RNA, 17 nt, Human
cuugcaugaggcuagug

SEQ ID NO: 3346188 - RNA, 12 nt, Human
gacagcugccug

SEQ ID NO: 3346189 - RNA, 13 nt, Human
gacagcugccugg

SEQ ID NO: 3346190 - RNA, 16 nt, Human
gacagacacaggcccg

SEQ ID NO: 3346191 - RNA, 15 nt, Human
gacagacacaggccc

SEQ ID NO: 3346192 - RNA, 20 nt, Human
gacacuaaccacgcuggacc

SEQ ID NO: 3346193 - RNA, 14 nt, Human
gacagacacaggcc

SEQ ID NO: 3346194 - RNA, 12 nt, Human
gacagacacagg

SEQ ID NO: 3346195 - RNA, 21 nt, Human
gacagcugccugggaucccuc

SEQ ID NO: 3346196 - RNA, 14 nt, Human
gacagcugccuggg

SEQ ID NO: 3346197 - RNA, 15 nt, Human
gacagcugccuggga

SEQ ID NO: 3346198 - RNA, 19 nt, Human
gacaggcauguucucugag

SEQ ID NO: 3346199 - RNA, 18 nt, Human
gacaggcauguucucuga

SEQ ID NO: 3346200 - RNA, 17 nt, Human
gacaggcaaugcuggcu

SEQ ID NO: 3346201 - RNA, 24 nt, Human
gacaggcaaugcuggcuguuggcu

SEQ ID NO: 3346202 - RNA, 16 nt, Human
gacaggcaaugcuggc

SEQ ID NO: 3346203 - RNA, 14 nt, Human
gacaggcaaugcug

SEQ ID NO: 3346204 - RNA, 21 nt, Human
gacaggcaagcaccuccugcc

SEQ ID NO: 3346205 - RNA, 15 nt, Human
gacauacuaaccagc

SEQ ID NO: 3346206 - RNA, 16 nt, Human
gacauacuaaccagca

SEQ ID NO: 3346207 - RNA, 17 nt, Human
gacaugucuuuucuugc

SEQ ID NO: 3346208 - RNA, 21 nt, Human
gacaugucuuuucuugcauga

SEQ ID NO: 3346209 - RNA, 17 nt, Human
gacaaugacuuacugua

SEQ ID NO: 3346210 - RNA, 20 nt, Human
gacaaugacuuacuguacau

SEQ ID NO: 3346211 - RNA, 21 nt, Human
gacaaugacuuacuguacaug

SEQ ID NO: 3346212 - RNA, 12 nt, Human
gacaaugcaaac

SEQ ID NO: 3346213 - RNA, 16 nt, Human
gacaaugcaaaccauc

SEQ ID NO: 3346214 - RNA, 12 nt, Human
gacaauuuauua

SEQ ID NO: 3346215 - RNA, 13 nt, Human
gacaauuuauuau

SEQ ID NO: 3346216 - RNA, 19 nt, Human
gacaauuuauuauggcaca

SEQ ID NO: 3346217 - RNA, 22 nt, Human
gacacaagccuucggcgccuua

SEQ ID NO: 3346218 - RNA, 17 nt, Human
gacacaggcccggcucc

SEQ ID NO: 3346219 - RNA, 15 nt, Human
gacacaggcccggcu

SEQ ID NO: 3346220 - RNA, 12 nt, Human
gacacaggcccg

SEQ ID NO: 3346221 - RNA, 16 nt, Human
gacaaugacccagugg

SEQ ID NO: 3346222 - RNA, 22 nt, Human
gacaaggauugcuacuguccua

SEQ ID NO: 3346223 - RNA, 21 nt, Human
gacaaggauugcuacuguccu

SEQ ID NO: 3346224 - RNA, 14 nt, Human
gaagucuuuguaca

SEQ ID NO: 3346225 - RNA, 18 nt, Human
gacacuaaccacgcugga

SEQ ID NO: 3346226 - RNA, 17 nt, Human
gacacuaaccacgcugg

SEQ ID NO: 3346227 - RNA, 16 nt, Human
gacacuaaccacgcug

SEQ ID NO: 3346228 - RNA, 15 nt, Human
gacacuaaccacgcu

SEQ ID NO: 3346229 - RNA, 17 nt, Human
gacacgaauauugcuga

SEQ ID NO: 3346230 - RNA, 18 nt, Human
gacacgaauauugcugau

SEQ ID NO: 3346231 - RNA, 19 nt, Human
gacacgaauauugcugaug

SEQ ID NO: 3346232 - RNA, 17 nt, Human
gacaccuugacagggca

SEQ ID NO: 3346233 - RNA, 15 nt, Human
gacaccuugacaggg

SEQ ID NO: 3346234 - RNA, 20 nt, Human
gacaccuugacagggcacac

SEQ ID NO: 3346235 - RNA, 18 nt, Human
gacaccuugacagggcac

SEQ ID NO: 3346236 - RNA, 15 nt, Human
gacacgaauauugcu

SEQ ID NO: 3346237 - RNA, 18 nt, Human
gacacaggcccggcucca

SEQ ID NO: 3346238 - RNA, 12 nt, Human
gacacccuguga

SEQ ID NO: 3346239 - RNA, 13 nt, Human
gacacccugugau

SEQ ID NO: 3346240 - RNA, 22 nt, Human
gacacccugugauggggcccug

SEQ ID NO: 3346241 - RNA, 23 nt, Human
gacacccugugauggggcccugc

SEQ ID NO: 3346242 - RNA, 17 nt, Human
gacuacucccccaggug

SEQ ID NO: 3346243 - RNA, 22 nt, Human
gacguguuaugacuccagaauu

SEQ ID NO: 3346244 - RNA, 15 nt, Human
gacuccugcaggcag

SEQ ID NO: 3346245 - RNA, 16 nt, Human
gacuccugcaggcagc

SEQ ID NO: 3346246 - RNA, 14 nt, Human
gacuccugcaggca

SEQ ID NO: 3346247 - RNA, 15 nt, Human
gacguguuaugacuc

SEQ ID NO: 3346248 - RNA, 17 nt, Human
gacguguuaugacucca

SEQ ID NO: 3346249 - RNA, 20 nt, Human
gacguguuaugacuccagaa

SEQ ID NO: 3346250 - RNA, 21 nt, Human
gacggagucccaccuuggcug

SEQ ID NO: 3346251 - RNA, 18 nt, Human
gacggagucccaccuugg

SEQ ID NO: 3346252 - RNA, 14 nt, Human
gacggagucccacc

SEQ ID NO: 3346253 - RNA, 23 nt, Human
gaccuugaacuggguacuugugg

SEQ ID NO: 3346254 - RNA, 20 nt, Human
gaccuuucaauaggaaaaac

SEQ ID NO: 3346255 - RNA, 21 nt, Human
gaccuuucaauaggaaaaacu

SEQ ID NO: 3346256 - RNA, 14 nt, Human
gaccgugaggccag

SEQ ID NO: 3346257 - RNA, 19 nt, Human
gaccgugaggccagagaca

SEQ ID NO: 3346258 - RNA, 11 nt, Human
gaccucaggcc

SEQ ID NO: 3346259 - RNA, 12 nt, Human
gaccucaggccu

SEQ ID NO: 3346260 - RNA, 14 nt, Human
gaccugaggcccuu

SEQ ID NO: 3346261 - RNA, 15 nt, Human
gaccugaggcccuuc

SEQ ID NO: 3346262 - RNA, 18 nt, Human
gaccugaggcccuucucu

SEQ ID NO: 3346263 - RNA, 21 nt, Human
gaccugaggcccuucucucca

SEQ ID NO: 3346264 - RNA, 23 nt, Human
gacccugucucaaaaaaagaaaa

SEQ ID NO: 3346265 - RNA, 16 nt, Human
gacccugcccuguggg

SEQ ID NO: 3346266 - RNA, 13 nt, Human
gacccugcccugu

SEQ ID NO: 3346267 - RNA, 15 nt, Human
gacccugcccugugg

SEQ ID NO: 3346268 - RNA, 19 nt, Human
gacccugaggcccagaggg

SEQ ID NO: 3346269 - RNA, 20 nt, Human
gacccugaggcccagagggc

SEQ ID NO: 3346270 - RNA, 12 nt, Human
gacccugcccug

SEQ ID NO: 3346271 - RNA, 21 nt, Human
gacccugaggcccagagggcc

SEQ ID NO: 3346272 - RNA, 18 nt, Human
gacccugaggcccagagg

SEQ ID NO: 3346273 - RNA, 16 nt, Human
gacccaugcugcccug

SEQ ID NO: 3346274 - RNA, 14 nt, Human
gacccaugcugccc

SEQ ID NO: 3346275 - RNA, 15 nt, Human
gacccaugcugcccu

SEQ ID NO: 3346276 - RNA, 13 nt, Human
gacccaugcugcc

SEQ ID NO: 3346277 - RNA, 11 nt, Human
gacccacugcu

SEQ ID NO: 3346278 - RNA, 18 nt, Human
gagccagauuucacucuc

SEQ ID NO: 3346279 - RNA, 19 nt, Human
gagccagauuucacucucc

SEQ ID NO: 3346280 - RNA, 15 nt, Human
gagccagauuucacu

SEQ ID NO: 3346281 - RNA, 13 nt, Human
gagccacugcacc

SEQ ID NO: 3346282 - RNA, 19 nt, Human
gagccacugcaccgggcca

SEQ ID NO: 3346283 - RNA, 18 nt, Human
gagccacugcaccgggcc

SEQ ID NO: 3346284 - RNA, 17 nt, Human
gagcccaccuuggcuca

SEQ ID NO: 3346285 - RNA, 15 nt, Human
gagcccaccuuggcu

SEQ ID NO: 3346286 - RNA, 13 nt, Human
gagcccaccuugg

SEQ ID NO: 3346287 - RNA, 13 nt, Human
gagccagauuuca

SEQ ID NO: 3346288 - RNA, 22 nt, Human
gagcagccacauuccugaugcu

SEQ ID NO: 3346289 - RNA, 21 nt, Human
gagcagccacauuccugaugc

SEQ ID NO: 3346290 - RNA, 19 nt, Human
gagcagagaccaucccuga

SEQ ID NO: 3346291 - RNA, 21 nt, Human
gagcagagaccaucccugaag

SEQ ID NO: 3346292 - RNA, 23 nt, Human
gagcagagaccaucccugaaggc

SEQ ID NO: 3346293 - RNA, 17 nt, Human
gagcagagaccaucccu

SEQ ID NO: 3346294 - RNA, 18 nt, Human
gagcagagaccaucccug

SEQ ID NO: 3346295 - RNA, 16 nt, Human
gagcagagaccauccc

SEQ ID NO: 3346296 - RNA, 19 nt, Human
gagauagccaaggccaaag

SEQ ID NO: 3346297 - RNA, 20 nt, Human
gagauagccaaggccaaagg

SEQ ID NO: 3346298 - RNA, 21 nt, Human
gagauagccaaggccaaagga

SEQ ID NO: 3346299 - RNA, 18 nt, Human
gagcccacgcccccacug

SEQ ID NO: 3346300 - RNA, 20 nt, Human
gagccgagaucacgccacug

SEQ ID NO: 3346301 - RNA, 19 nt, Human
gagccgagaucacgccacu

SEQ ID NO: 3346302 - RNA, 22 nt, Human
gagccgagaucacgccacugca

SEQ ID NO: 3346303 - RNA, 21 nt, Human
gagccgagaucacgccacugc

SEQ ID NO: 3346304 - RNA, 13 nt, Human
gagccucagcauc

SEQ ID NO: 3346305 - RNA, 15 nt, Human
gagccucagcauccu

SEQ ID NO: 3346306 - RNA, 14 nt, Human
gagccucagcaucc

SEQ ID NO: 3346307 - RNA, 17 nt, Human
gagccucagcauccugg

SEQ ID NO: 3346308 - RNA, 12 nt, Human
gagccugcaguu

SEQ ID NO: 3346309 - RNA, 20 nt, Human
gagcuuugaaaauucagugg

SEQ ID NO: 3346310 - RNA, 22 nt, Human
gagcuuucugcuaucaaagagg

SEQ ID NO: 3346311 - RNA, 16 nt, Human
gaggaaagcaaaggag

SEQ ID NO: 3346312 - RNA, 17 nt, Human
gaggaaagcaaaggaga

SEQ ID NO: 3346313 - RNA, 18 nt, Human
gaggaagccgcuggggcc

SEQ ID NO: 3346314 - RNA, 14 nt, Human
gaggaagccgcugg

SEQ ID NO: 3346315 - RNA, 17 nt, Human
gaggaagccgcuggggc

SEQ ID NO: 3346316 - RNA, 13 nt, Human
gaggaagccgcug

SEQ ID NO: 3346317 - RNA, 17 nt, Human
gaggaagagaaaaaaua

SEQ ID NO: 3346318 - RNA, 16 nt, Human
gaggaacaaggcaagg

SEQ ID NO: 3346319 - RNA, 14 nt, Human
gaggaacaaggcaa

SEQ ID NO: 3346320 - RNA, 15 nt, Human
gagcuagcagcaggg

SEQ ID NO: 3346321 - RNA, 17 nt, Human
gagcuagcagcagggag

SEQ ID NO: 3346322 - RNA, 15 nt, Human
gagccugcaguuauu

SEQ ID NO: 3346323 - RNA, 15 nt, Human
gagcugaguggggga

SEQ ID NO: 3346324 - RNA, 17 nt, Human
gagagaagagaaugcac

SEQ ID NO: 3346325 - RNA, 20 nt, Human
gagagggugggagugggccc

SEQ ID NO: 3346326 - RNA, 21 nt, Human
gagagggugggagugggccca

SEQ ID NO: 3346327 - RNA, 13 nt, Human
gagaggggaacag

SEQ ID NO: 3346328 - RNA, 13 nt, Human
gagagccuuccag

SEQ ID NO: 3346329 - RNA, 22 nt, Human
gagacuccugcaggcagccagg

SEQ ID NO: 3346330 - RNA, 16 nt, Human
gagacucgcgacaaug

SEQ ID NO: 3346331 - RNA, 13 nt, Human
gagacucugucuc

SEQ ID NO: 3346332 - RNA, 14 nt, Human
gagacucugucuca

SEQ ID NO: 3346333 - RNA, 14 nt, Human
gagacagcccgggc

SEQ ID NO: 3346334 - RNA, 17 nt, Human
gagacagcccgggcucu

SEQ ID NO: 3346335 - RNA, 18 nt, Human
gagacagcccgggcucug

SEQ ID NO: 3346336 - RNA, 19 nt, Human
gagacagcccgggcucugc

SEQ ID NO: 3346337 - RNA, 20 nt, Human
gagacagcccgggcucugcc

SEQ ID NO: 3346338 - RNA, 21 nt, Human
gagacagcccgggcucugccu

SEQ ID NO: 3346339 - RNA, 22 nt, Human
gagacagcccgggcucugccuc

SEQ ID NO: 3346340 - RNA, 23 nt, Human
gagacagcccgggcucugccucc

SEQ ID NO: 3346341 - RNA, 24 nt, Human
gagacagcccgggcucugccuccc

SEQ ID NO: 3346342 - RNA, 22 nt, Human
gagaaaguacuucuccacccug

SEQ ID NO: 3346343 - RNA, 23 nt, Human
gagaaaguacuucuccacccugc

SEQ ID NO: 3346344 - RNA, 17 nt, Human
gacuccugcaggcagcc

SEQ ID NO: 3346345 - RNA, 18 nt, Human
gacucgcgacaaugcaaa

SEQ ID NO: 3346346 - RNA, 19 nt, Human
gacucgcgacaaugcaaac

SEQ ID NO: 3346347 - RNA, 16 nt, Human
gacuuggaagcuccgc

SEQ ID NO: 3346348 - RNA, 15 nt, Human
gacuuggaagcuccg

SEQ ID NO: 3346349 - RNA, 14 nt, Human
gacuuggaagcucc

SEQ ID NO: 3346350 - RNA, 21 nt, Human
gagaaaauggacguguuauga

SEQ ID NO: 3346351 - RNA, 13 nt, Human
gagaaacaaacuu

SEQ ID NO: 3346352 - RNA, 15 nt, Human
gagaaacaaacuuuu

SEQ ID NO: 3346353 - RNA, 13 nt, Human
gacuuggaagcuc

SEQ ID NO: 3346354 - RNA, 12 nt, Human
gagacagcccgg

SEQ ID NO: 3346355 - RNA, 19 nt, Human
gagacagaguuuucacucu

SEQ ID NO: 3346356 - RNA, 15 nt, Human
gagacacaagccuuc

SEQ ID NO: 3346357 - RNA, 17 nt, Human
gagacacaagccuucgg

SEQ ID NO: 3346358 - RNA, 20 nt, Human
gagaaugcacaaacagaggc

SEQ ID NO: 3346359 - RNA, 21 nt, Human
gagaaugcacaaacagaggcc

SEQ ID NO: 3346360 - RNA, 12 nt, Human
gaucagccuggg

SEQ ID NO: 3346361 - RNA, 15 nt, Human
gaucagccugggcaa

SEQ ID NO: 3346362 - RNA, 22 nt, Human
gaucagucugauucccaagcuc

SEQ ID NO: 3346363 - RNA, 18 nt, Human
gaucacgccacugcacua

SEQ ID NO: 3346364 - RNA, 16 nt, Human
gaucacgccacugcac

SEQ ID NO: 3346365 - RNA, 21 nt, Human
gaucauccacugugccaugug

SEQ ID NO: 3346366 - RNA, 16 nt, Human
gaucauccacugugcc

SEQ ID NO: 3346367 - RNA, 19 nt, Human
gaucauccacugugccaug

SEQ ID NO: 3346368 - RNA, 17 nt, Human
gaucauccacugugcca

SEQ ID NO: 3346369 - RNA, 14 nt, Human
gauaauacaccacu

SEQ ID NO: 3346370 - RNA, 18 nt, Human
gauaauacaccacuacau

SEQ ID NO: 3346371 - RNA, 21 nt, Human
gauaauacaccacuacauucu

SEQ ID NO: 3346372 - RNA, 22 nt, Human
gauaauacaccacuacauucug

SEQ ID NO: 3346373 - RNA, 21 nt, Human
gauagcacagacccugcccug

SEQ ID NO: 3346374 - RNA, 22 nt, Human
gauagcacagacccugcccugu

SEQ ID NO: 3346375 - RNA, 20 nt, Human
gauagcacagacccugcccu

SEQ ID NO: 3346376 - RNA, 18 nt, Human
gauacaggaaaagcugcu

SEQ ID NO: 3346377 - RNA, 13 nt, Human
gaggaaggaaacc

SEQ ID NO: 3346378 - RNA, 19 nt, Human
gaggaaggaaacccagcuc

SEQ ID NO: 3346379 - RNA, 20 nt, Human
gaggaaggaaacccagcucu

SEQ ID NO: 3346380 - RNA, 21 nt, Human
gauccugagccagauuucacu

SEQ ID NO: 3346381 - RNA, 22 nt, Human
gauccugagccagauuucacuc

SEQ ID NO: 3346382 - RNA, 15 nt, Human
gaucccucauccuca

SEQ ID NO: 3346383 - RNA, 16 nt, Human
gaucccucauccucau

SEQ ID NO: 3346384 - RNA, 17 nt, Human
gaucuuugcagacaggc

SEQ ID NO: 3346385 - RNA, 18 nt, Human
gaucuuugcagacaggca

SEQ ID NO: 3346386 - RNA, 14 nt, Human
gaugcagccucaca

SEQ ID NO: 3346387 - RNA, 12 nt, Human
gaugcagccuca

SEQ ID NO: 3346388 - RNA, 17 nt, Human
gaugccugguggcagcu

SEQ ID NO: 3346389 - RNA, 21 nt, Human
gaugcacagaguuguuacauu

SEQ ID NO: 3346390 - RNA, 22 nt, Human
gaugcacagaguuguuacauuu

SEQ ID NO: 3346391 - RNA, 13 nt, Human
gaugcaccagccc

SEQ ID NO: 3346392 - RNA, 22 nt, Human
gauggccgggcgcgguggcuca

SEQ ID NO: 3346393 - RNA, 22 nt, Human
gauggauuuccagccaaagccu

SEQ ID NO: 3346394 - RNA, 19 nt, Human
gaugccugguggcagcugc

SEQ ID NO: 3346395 - RNA, 18 nt, Human
gaugccugguggcagcug

SEQ ID NO: 3346396 - RNA, 14 nt, Human
gauggggcccugcc

SEQ ID NO: 3346397 - RNA, 22 nt, Human
gauggggcccugccuccuuugu

SEQ ID NO: 3346398 - RNA, 13 nt, Human
gauggggcccugc

SEQ ID NO: 3346399 - RNA, 15 nt, Human
gcaaucaaaucugcu

SEQ ID NO: 3346400 - RNA, 17 nt, Human
gcaaucaaaucugcuuu

SEQ ID NO: 3346401 - RNA, 15 nt, Human
gcaaugaccuuucaa

SEQ ID NO: 3346402 - RNA, 17 nt, Human
gcaaugaccuuucaaua

SEQ ID NO: 3346403 - RNA, 20 nt, Human
gcaaugaccuuucaauagga

SEQ ID NO: 3346404 - RNA, 22 nt, Human
gcaaugaccuuucaauaggaaa

SEQ ID NO: 3346405 - RNA, 23 nt, Human
gcaaugcuggcuguuggcugggg

SEQ ID NO: 3346406 - RNA, 22 nt, Human
gcaaugcuggcuguuggcuggg

SEQ ID NO: 3346407 - RNA, 14 nt, Human
gcaaugcuggcugu

SEQ ID NO: 3346408 - RNA, 13 nt, Human
gcaaugcuggcug

SEQ ID NO: 3346409 - RNA, 23 nt, Human
gcaaugaccuuucaauaggaaaa

SEQ ID NO: 3346410 - RNA, 11 nt, Human
gcaaggcuguc

SEQ ID NO: 3346411 - RNA, 18 nt, Human
gcaaggagauuuacaacu

SEQ ID NO: 3346412 - RNA, 17 nt, Human
gcaagaauugaagcagg

SEQ ID NO: 3346413 - RNA, 14 nt, Human
gcaagacgcugugc

SEQ ID NO: 3346414 - RNA, 20 nt, Human
gcaagacgcugugcugcccu

SEQ ID NO: 3346415 - RNA, 21 nt, Human
gcaagacgcugugcugcccug

SEQ ID NO: 3346416 - RNA, 22 nt, Human
gcaagacgcugugcugcccugc

SEQ ID NO: 3346417 - RNA, 23 nt, Human
gcaagacgcugugcugcccugcc

SEQ ID NO: 3346418 - RNA, 16 nt, Human
gcaaaguaucccuacu

SEQ ID NO: 3346419 - RNA, 18 nt, Human
gauucccaagcucugcuc

SEQ ID NO: 3346420 - RNA, 19 nt, Human
gauucauauuuacuucuua

SEQ ID NO: 3346421 - RNA, 18 nt, Human
gauucauauuuacuucuu

SEQ ID NO: 3346422 - RNA, 17 nt, Human
gauucauauuuacuucu

SEQ ID NO: 3346423 - RNA, 23 nt, Human
gauggggcugcaccggcuggccu

SEQ ID NO: 3346424 - RNA, 19 nt, Human
gauggggcugcaccggcug

SEQ ID NO: 3346425 - RNA, 13 nt, Human
gauucagcucugc

SEQ ID NO: 3346426 - RNA, 19 nt, Human
gauucagacagcugccugg

SEQ ID NO: 3346427 - RNA, 18 nt, Human
gauucagacagcugccug

SEQ ID NO: 3346428 - RNA, 20 nt, Human
gauucccaagcucugcuccu

SEQ ID NO: 3346429 - RNA, 19 nt, Human
gauucccaagcucugcucc

SEQ ID NO: 3346430 - RNA, 12 nt, Human
gauucuuuccug

SEQ ID NO: 3346431 - RNA, 16 nt, Human
gauucuuuccugaggc

SEQ ID NO: 3346432 - RNA, 17 nt, Human
gauucuuuccugaggcu

SEQ ID NO: 3346433 - RNA, 18 nt, Human
gauucuuuccugaggcug

SEQ ID NO: 3346434 - RNA, 20 nt, Human
gauugcaacaggcugggcuu

SEQ ID NO: 3346435 - RNA, 16 nt, Human
gauugcaccacugcac

SEQ ID NO: 3346436 - RNA, 23 nt, Human
gauugcaccacugcacuccagcc

SEQ ID NO: 3346437 - RNA, 21 nt, Human
gauugcaacaggcugggcuuc

SEQ ID NO: 3346438 - RNA, 18 nt, Human
gauugcaacaggcugggc

SEQ ID NO: 3346439 - RNA, 15 nt, Human
gauuuccguuaaaau

SEQ ID NO: 3346440 - RNA, 11 nt, Human
gauuucuguuu

SEQ ID NO: 3346441 - RNA, 19 nt, Human
gauuucuguuuagauaaua

SEQ ID NO: 3346442 - RNA, 14 nt, Human
gcagugggagcugc

SEQ ID NO: 3346443 - RNA, 12 nt, Human
gcagugggagcu

SEQ ID NO: 3346444 - RNA, 13 nt, Human
gcagugggagcug

SEQ ID NO: 3346445 - RNA, 22 nt, Human
gcaguggugguuuucuguucuu

SEQ ID NO: 3346446 - RNA, 23 nt, Human
gcaguggugguuuucuguucuuu

SEQ ID NO: 3346447 - RNA, 17 nt, Human
gcaguuauuaacacuaa

SEQ ID NO: 3346448 - RNA, 20 nt, Human
gcaggucuugaacuccuggc

SEQ ID NO: 3346449 - RNA, 19 nt, Human
gcaggucuugaacuccugg

SEQ ID NO: 3346450 - RNA, 22 nt, Human
gcagguccaggguuugaguuca

SEQ ID NO: 3346451 - RNA, 16 nt, Human
gcagugcaugcugucc

SEQ ID NO: 3346452 - RNA, 15 nt, Human
gcagugcaugcuguc

SEQ ID NO: 3346453 - RNA, 15 nt, Human
gcaggcagccaggcc

SEQ ID NO: 3346454 - RNA, 16 nt, Human
gcaggcagccaggcca

SEQ ID NO: 3346455 - RNA, 21 nt, Human
gcagggcucagcggggacagc

SEQ ID NO: 3346456 - RNA, 19 nt, Human
gcagggcucagcggggaca

SEQ ID NO: 3346457 - RNA, 18 nt, Human
gcagggucucacucuguc

SEQ ID NO: 3346458 - RNA, 17 nt, Human
gcagggucucacucugu

SEQ ID NO: 3346459 - RNA, 14 nt, Human
gcagggcucagcgg

SEQ ID NO: 3346460 - RNA, 22 nt, Human
gcaggggaggguagagcggaga

SEQ ID NO: 3346461 - RNA, 18 nt, Human
gcaugcgggcuuccuccu

SEQ ID NO: 3346462 - RNA, 14 nt, Human
gcauguucucugag

SEQ ID NO: 3346463 - RNA, 21 nt, Human
gcauguucucugaggacacua

SEQ ID NO: 3346464 - RNA, 15 nt, Human
gcauguucucugagg

SEQ ID NO: 3346465 - RNA, 14 nt, Human
gccaaacucaccug

SEQ ID NO: 3346466 - RNA, 16 nt, Human
gccaaacucaccugcc

SEQ ID NO: 3346467 - RNA, 22 nt, Human
gccaaagcuaggccuggccaga

SEQ ID NO: 3346468 - RNA, 16 nt, Human
gccaaagcuaggccug

SEQ ID NO: 3346469 - RNA, 16 nt, Human
gccaaagccuccucca

SEQ ID NO: 3346470 - RNA, 19 nt, Human
gccaaagccuccuccagcc

SEQ ID NO: 3346471 - RNA, 20 nt, Human
gccaaagccaaagcuaggcc

SEQ ID NO: 3346472 - RNA, 13 nt, Human
gccaaagccaaag

SEQ ID NO: 3346473 - RNA, 16 nt, Human
gcauuuguuugaacug

SEQ ID NO: 3346474 - RNA, 14 nt, Human
gcauuugcugaaua

SEQ ID NO: 3346475 - RNA, 21 nt, Human
gcauuugaggucuguucuuuc

SEQ ID NO: 3346476 - RNA, 13 nt, Human
gcauuugcugaau

SEQ ID NO: 3346477 - RNA, 17 nt, Human
gcauuaucuagauacug

SEQ ID NO: 3346478 - RNA, 12 nt, Human
gcacgauuucug

SEQ ID NO: 3346479 - RNA, 18 nt, Human
gcaccuuagacagucccu

SEQ ID NO: 3346480 - RNA, 18 nt, Human
gcaccuggaauauauaac

SEQ ID NO: 3346481 - RNA, 21 nt, Human
gcaccuggaauauauaaccag

SEQ ID NO: 3346482 - RNA, 15 nt, Human
gcacccucaggcagg

SEQ ID NO: 3346483 - RNA, 22 nt, Human
gcaccuggaauauauaaccagu

SEQ ID NO: 3346484 - RNA, 14 nt, Human
gcaccuuagacagu

SEQ ID NO: 3346485 - RNA, 17 nt, Human
gcaccuuagacaguccc

SEQ ID NO: 3346486 - RNA, 19 nt, Human
gcacccggccccugcuggu

SEQ ID NO: 3346487 - RNA, 18 nt, Human
gcacccggccccugcugg

SEQ ID NO: 3346488 - RNA, 22 nt, Human
gcacccaccaucaugucuggcu

SEQ ID NO: 3346489 - RNA, 16 nt, Human
gcaccagcagccugga

SEQ ID NO: 3346490 - RNA, 21 nt, Human
gcaccacugcacuccagccug

SEQ ID NO: 3346491 - RNA, 22 nt, Human
gcaccacugcacuccagccugg

SEQ ID NO: 3346492 - RNA, 15 nt, Human
gcaccagcagccugg

SEQ ID NO: 3346493 - RNA, 14 nt, Human
gcaccagcagccug

SEQ ID NO: 3346494 - RNA, 13 nt, Human
gcaauggcagccu

SEQ ID NO: 3346495 - RNA, 12 nt, Human
gcaauggcagcc

SEQ ID NO: 3346496 - RNA, 20 nt, Human
gcaccacugcacuccagccu

SEQ ID NO: 3346497 - RNA, 16 nt, Human
gcacugcuuccaguga

SEQ ID NO: 3346498 - RNA, 18 nt, Human
gcacugcuuccagugagg

SEQ ID NO: 3346499 - RNA, 20 nt, Human
gcacugcuuccagugaggcu

SEQ ID NO: 3346500 - RNA, 15 nt, Human
gcacugcuuccagug

SEQ ID NO: 3346501 - RNA, 12 nt, Human
gcagacaggacc

SEQ ID NO: 3346502 - RNA, 13 nt, Human
gcagacaggacca

SEQ ID NO: 3346503 - RNA, 15 nt, Human
gcagacaggaccagg

SEQ ID NO: 3346504 - RNA, 14 nt, Human
gcagacaggcaagc

SEQ ID NO: 3346505 - RNA, 19 nt, Human
gcagacaggcaagcaccuc

SEQ ID NO: 3346506 - RNA, 23 nt, Human
gcagacaggcaagcaccuccugc

SEQ ID NO: 3346507 - RNA, 14 nt, Human
gcagcccugcagag

SEQ ID NO: 3346508 - RNA, 15 nt, Human
gcagcccugcagagg

SEQ ID NO: 3346509 - RNA, 16 nt, Human
gcagcccugcagaggg

SEQ ID NO: 3346510 - RNA, 17 nt, Human
gcagcccugcagagggc

SEQ ID NO: 3346511 - RNA, 15 nt, Human
gcagcucaccucucc

SEQ ID NO: 3346512 - RNA, 15 nt, Human
gcagccuuggcaaac

SEQ ID NO: 3346513 - RNA, 14 nt, Human
gcagcucaccucuc

SEQ ID NO: 3346514 - RNA, 23 nt, Human
gcaggaggaucacuugaguccag

SEQ ID NO: 3346515 - RNA, 20 nt, Human
gcaggaggaucacuugaguc

SEQ ID NO: 3346516 - RNA, 13 nt, Human
gcaggcagccagg

SEQ ID NO: 3346517 - RNA, 14 nt, Human
gcaggcagccaggc

SEQ ID NO: 3346518 - RNA, 12 nt, Human
gcaggcagccag

SEQ ID NO: 3346519 - RNA, 12 nt, Human
gcagcaauaaag

SEQ ID NO: 3346520 - RNA, 22 nt, Human
gcagauacaggaaaagcugcug

SEQ ID NO: 3346521 - RNA, 17 nt, Human
gcagacaguuaagagaa

SEQ ID NO: 3346522 - RNA, 21 nt, Human
gcagaguugaagacagagcua

SEQ ID NO: 3346523 - RNA, 20 nt, Human
gcagaguugaagacagagcu

SEQ ID NO: 3346524 - RNA, 24 nt, Human
gcagccccauucugccugcccagg

SEQ ID NO: 3346525 - RNA, 21 nt, Human
gcagccccauucugccugccc

SEQ ID NO: 3346526 - RNA, 19 nt, Human
gcagccccauucugccugc

SEQ ID NO: 3346527 - RNA, 18 nt, Human
gcagccccauucugccug

SEQ ID NO: 3346528 - RNA, 16 nt, Human
gcagcaauaaagcagc

SEQ ID NO: 3346529 - RNA, 23 nt, Human
gcagcaauaaagcagcguuucua

SEQ ID NO: 3346530 - RNA, 17 nt, Human
gcagccccauucugccu

SEQ ID NO: 3346531 - RNA, 13 nt, Human
gcagcccugcaga

SEQ ID NO: 3346532 - RNA, 20 nt, Human
gcagccccuguucuggcaga

SEQ ID NO: 3346533 - RNA, 21 nt, Human
gcagccccuguucuggcagag

SEQ ID NO: 3346534 - RNA, 13 nt, Human
gccugguggcagc

SEQ ID NO: 3346535 - RNA, 21 nt, Human
gccugguggcagcugcggucc

SEQ ID NO: 3346536 - RNA, 19 nt, Human
gccugguggcagcugcggu

SEQ ID NO: 3346537 - RNA, 18 nt, Human
gccugguggcagcugcgg

SEQ ID NO: 3346538 - RNA, 21 nt, Human
gccugggggcugggcagagga

SEQ ID NO: 3346539 - RNA, 22 nt, Human
gccugggggcugggcagaggaa

SEQ ID NO: 3346540 - RNA, 21 nt, Human
gccuguugggccaggagccuc

SEQ ID NO: 3346541 - RNA, 16 nt, Human
gccuuacacaaugguu

SEQ ID NO: 3346542 - RNA, 20 nt, Human
gccuuacacaaugguuuucu

SEQ ID NO: 3346543 - RNA, 18 nt, Human
gccuuacccucauguucu

SEQ ID NO: 3346544 - RNA, 21 nt, Human
gccuuacacaaugguuuucuu

SEQ ID NO: 3346545 - RNA, 18 nt, Human
gccuuagaagucacacag

SEQ ID NO: 3346546 - RNA, 17 nt, Human
gccuuagaagucacaca

SEQ ID NO: 3346547 - RNA, 19 nt, Human
gccuuagaagucacacagu

SEQ ID NO: 3346548 - RNA, 10 nt, Human
gccuuaugga

SEQ ID NO: 3346549 - RNA, 14 nt, Human
gccuuauggaacac

SEQ ID NO: 3346550 - RNA, 16 nt, Human
gccuuauggaacacuc

SEQ ID NO: 3346551 - RNA, 18 nt, Human
gccuuauggaacacucug

SEQ ID NO: 3346552 - RNA, 19 nt, Human
gccuuauggaacacucuga

SEQ ID NO: 3346553 - RNA, 12 nt, Human
gccuuccagggg

SEQ ID NO: 3346554 - RNA, 15 nt, Human
gccuuccaggggugg

SEQ ID NO: 3346555 - RNA, 16 nt, Human
gccuuccagggguggg

SEQ ID NO: 3346556 - RNA, 23 nt, Human
gcgacaaugcaaaccaucauuga

SEQ ID NO: 3346557 - RNA, 19 nt, Human
gcgucucauacucaccuca

SEQ ID NO: 3346558 - RNA, 15 nt, Human
gcggacagccacggc

SEQ ID NO: 3346559 - RNA, 19 nt, Human
gcggaaugaaccacaucuu

SEQ ID NO: 3346560 - RNA, 13 nt, Human
gcggacagccacg

SEQ ID NO: 3346561 - RNA, 11 nt, Human
gcggacagcca

SEQ ID NO: 3346562 - RNA, 19 nt, Human
gcgcgcacacacacacaua

SEQ ID NO: 3346563 - RNA, 15 nt, Human
gcgccuacaggagug

SEQ ID NO: 3346564 - RNA, 13 nt, Human
gcgcgcacacaca

SEQ ID NO: 3346565 - RNA, 18 nt, Human
gcgcgcacacacacacau

SEQ ID NO: 3346566 - RNA, 13 nt, Human
gcuaagagggagg

SEQ ID NO: 3346567 - RNA, 14 nt, Human
gcuacacaggggaa

SEQ ID NO: 3346568 - RNA, 13 nt, Human
gcuacacacugca

SEQ ID NO: 3346569 - RNA, 20 nt, Human
gcuacacacugcauguuugu

SEQ ID NO: 3346570 - RNA, 20 nt, Human
gcuaagagggagggagggcu

SEQ ID NO: 3346571 - RNA, 15 nt, Human
gcuaggaacacuccu

SEQ ID NO: 3346572 - RNA, 16 nt, Human
gcuaccuuuguauucu

SEQ ID NO: 3346573 - RNA, 16 nt, Human
gccucccaacucaccc

SEQ ID NO: 3346574 - RNA, 17 nt, Human
gccucccaacucacccc

SEQ ID NO: 3346575 - RNA, 18 nt, Human
gccucccaacucacccca

SEQ ID NO: 3346576 - RNA, 19 nt, Human
gccucccaacucaccccag

SEQ ID NO: 3346577 - RNA, 14 nt, Human
gccucccaucaccc

SEQ ID NO: 3346578 - RNA, 16 nt, Human
gccucccaucacccgc

SEQ ID NO: 3346579 - RNA, 13 nt, Human
gccucccaacuca

SEQ ID NO: 3346580 - RNA, 19 nt, Human
gccucccaaagugcuggga

SEQ ID NO: 3346581 - RNA, 18 nt, Human
gccucccaaagugcuggg

SEQ ID NO: 3346582 - RNA, 16 nt, Human
gccucagcauccuggc

SEQ ID NO: 3346583 - RNA, 15 nt, Human
gccucagcauccugg

SEQ ID NO: 3346584 - RNA, 18 nt, Human
gccucacaguccuuacca

SEQ ID NO: 3346585 - RNA, 17 nt, Human
gccucccgaguagcugg

SEQ ID NO: 3346586 - RNA, 19 nt, Human
gccucccgaguagcuggga

SEQ ID NO: 3346587 - RNA, 18 nt, Human
gccucccgaguagcuggg

SEQ ID NO: 3346588 - RNA, 13 nt, Human
gccugcaagggag

SEQ ID NO: 3346589 - RNA, 15 nt, Human
gccugcaagggagug

SEQ ID NO: 3346590 - RNA, 13 nt, Human
gccucugccucug

SEQ ID NO: 3346591 - RNA, 12 nt, Human
gccucugccucu

SEQ ID NO: 3346592 - RNA, 14 nt, Human
gccucugcacuccc

SEQ ID NO: 3346593 - RNA, 21 nt, Human
gccucugacacacagcucugu

SEQ ID NO: 3346594 - RNA, 20 nt, Human
gccucugacacacagcucug

SEQ ID NO: 3346595 - RNA, 19 nt, Human
gccucugacacacagcucu

SEQ ID NO: 3346596 - RNA, 16 nt, Human
gccucucucaggccaa

SEQ ID NO: 3346597 - RNA, 16 nt, Human
gccucugacacacagc

SEQ ID NO: 3346598 - RNA, 18 nt, Human
gccucugacacacagcuc

SEQ ID NO: 3346599 - RNA, 17 nt, Human
gccucugacacacagcu

SEQ ID NO: 3346600 - RNA, 13 nt, Human
gccucucucaggc

SEQ ID NO: 3346601 - RNA, 14 nt, Human
gccucucucaggcc

SEQ ID NO: 3346602 - RNA, 17 nt, Human
gccucaaccuccugggc

SEQ ID NO: 3346603 - RNA, 13 nt, Human
gccucacaguccu

SEQ ID NO: 3346604 - RNA, 17 nt, Human
gccucacaguccuuacc

SEQ ID NO: 3346605 - RNA, 19 nt, Human
gccucaaccuccugggcua

SEQ ID NO: 3346606 - RNA, 18 nt, Human
gccucaaccuccugggcu

SEQ ID NO: 3346607 - RNA, 20 nt, Human
gccguguaaccauggaccca

SEQ ID NO: 3346608 - RNA, 15 nt, Human
gccgucuaccugagg

SEQ ID NO: 3346609 - RNA, 16 nt, Human
gccgucuaccugaggg

SEQ ID NO: 3346610 - RNA, 17 nt, Human
gccgucuaccugagggg

SEQ ID NO: 3346611 - RNA, 14 nt, Human
gcccuucucuccag

SEQ ID NO: 3346612 - RNA, 16 nt, Human
gcccuucucuccagcc

SEQ ID NO: 3346613 - RNA, 17 nt, Human
gcccuucucuccagccc

SEQ ID NO: 3346614 - RNA, 13 nt, Human
gcccuucucucca

SEQ ID NO: 3346615 - RNA, 19 nt, Human
gccgagaucacgccacugc

SEQ ID NO: 3346616 - RNA, 22 nt, Human
gccgagaucacgccacugcacu

SEQ ID NO: 3346617 - RNA, 21 nt, Human
gccgagaucacgccacugcac

SEQ ID NO: 3346618 - RNA, 20 nt, Human
gccgagaucacgccacugca

SEQ ID NO: 3346619 - RNA, 11 nt, Human
gccgcagcccu

SEQ ID NO: 3346620 - RNA, 12 nt, Human
gccgcagcccug

SEQ ID NO: 3346621 - RNA, 21 nt, Human
gccgggcgcgguggcucacgc

SEQ ID NO: 3346622 - RNA, 12 nt, Human
gcccaggcuggc

SEQ ID NO: 3346623 - RNA, 22 nt, Human
gcccaggccccugccacccugg

SEQ ID NO: 3346624 - RNA, 23 nt, Human
gcccaggccccugccacccuggg

SEQ ID NO: 3346625 - RNA, 21 nt, Human
gcccagagaggguggugaccu

SEQ ID NO: 3346626 - RNA, 15 nt, Human
gcccagagagggugg

SEQ ID NO: 3346627 - RNA, 22 nt, Human
gcccaguuggguggaugccugg

SEQ ID NO: 3346628 - RNA, 12 nt, Human
gccccagugccc

SEQ ID NO: 3346629 - RNA, 18 nt, Human
gccccaucccaaacccuu

SEQ ID NO: 3346630 - RNA, 14 nt, Human
gccccagugcccac

SEQ ID NO: 3346631 - RNA, 13 nt, Human
gccccagugccca

SEQ ID NO: 3346632 - RNA, 21 nt, Human
gccccagugcccacaggauca

SEQ ID NO: 3346633 - RNA, 13 nt, Human
gccccauccucug

SEQ ID NO: 3346634 - RNA, 14 nt, Human
gccccauccucugu

SEQ ID NO: 3346635 - RNA, 22 nt, Human
gccccauccucuguacagagcc

SEQ ID NO: 3346636 - RNA, 14 nt, Human
gccccauucugccu

SEQ ID NO: 3346637 - RNA, 20 nt, Human
gccccuucugacccaugcug

SEQ ID NO: 3346638 - RNA, 15 nt, Human
gccccgaggccuucu

SEQ ID NO: 3346639 - RNA, 14 nt, Human
gccccucagggucc

SEQ ID NO: 3346640 - RNA, 18 nt, Human
gccccgaggccuucucug

SEQ ID NO: 3346641 - RNA, 23 nt, Human
gccccucaacucuccuccagagu

SEQ ID NO: 3346642 - RNA, 16 nt, Human
gccccucagggucccu

SEQ ID NO: 3346643 - RNA, 15 nt, Human
gcccugcagagggca

SEQ ID NO: 3346644 - RNA, 14 nt, Human
gcccugcagagggc

SEQ ID NO: 3346645 - RNA, 13 nt, Human
gcccugcagaggg

SEQ ID NO: 3346646 - RNA, 12 nt, Human
gcccucugccca

SEQ ID NO: 3346647 - RNA, 13 nt, Human
gcccucugcccac

SEQ ID NO: 3346648 - RNA, 16 nt, Human
gcccucugcccacucc

SEQ ID NO: 3346649 - RNA, 18 nt, Human
gcccucugcccacucccu

SEQ ID NO: 3346650 - RNA, 22 nt, Human
gcccuccaagaccuucuccuuc

SEQ ID NO: 3346651 - RNA, 23 nt, Human
gcccuccaagaccuucuccuuca

SEQ ID NO: 3346652 - RNA, 19 nt, Human
gcccuccaagaccuucucc

SEQ ID NO: 3346653 - RNA, 21 nt, Human
gcccuccaagaccuucuccuu

SEQ ID NO: 3346654 - RNA, 14 nt, Human
gccaggagccuccu

SEQ ID NO: 3346655 - RNA, 16 nt, Human
gccaggagccuccugc

SEQ ID NO: 3346656 - RNA, 19 nt, Human
gccaggagccuccugcccu

SEQ ID NO: 3346657 - RNA, 20 nt, Human
gccaggagccuccugcccuu

SEQ ID NO: 3346658 - RNA, 20 nt, Human
gccaggaagccagcaggcuc

SEQ ID NO: 3346659 - RNA, 11 nt, Human
gccaggaagcc

SEQ ID NO: 3346660 - RNA, 20 nt, Human
gccagcugcuugggcuucau

SEQ ID NO: 3346661 - RNA, 12 nt, Human
gccaggaagcca

SEQ ID NO: 3346662 - RNA, 13 nt, Human
gccaggaagccag

SEQ ID NO: 3346663 - RNA, 14 nt, Human
gccaggaagccagc

SEQ ID NO: 3346664 - RNA, 17 nt, Human
gccagcugcuugggcuu

SEQ ID NO: 3346665 - RNA, 18 nt, Human
gccagcugcuugggcuuc

SEQ ID NO: 3346666 - RNA, 16 nt, Human
gccagcugcuugggcu

SEQ ID NO: 3346667 - RNA, 24 nt, Human
gccaaggccaaaggaagcacaugc

SEQ ID NO: 3346668 - RNA, 19 nt, Human
gccaaggccaaaggaagca

SEQ ID NO: 3346669 - RNA, 20 nt, Human
gccaaggccaaaggaagcac

SEQ ID NO: 3346670 - RNA, 21 nt, Human
gccagagacacaagccuucgg

SEQ ID NO: 3346671 - RNA, 20 nt, Human
gccagagacacaagccuucg

SEQ ID NO: 3346672 - RNA, 22 nt, Human
gccagagacacaagccuucggc

SEQ ID NO: 3346673 - RNA, 19 nt, Human
gccacugcaccgggccaca

SEQ ID NO: 3346674 - RNA, 21 nt, Human
gccacugcaccgggccacaga

SEQ ID NO: 3346675 - RNA, 20 nt, Human
gccacugcaccgggccacag

SEQ ID NO: 3346676 - RNA, 22 nt, Human
gccagaggagagaggacccccu

SEQ ID NO: 3346677 - RNA, 14 nt, Human
gccagaugcaccag

SEQ ID NO: 3346678 - RNA, 24 nt, Human
gccagauucuuuccugaggcuggg

SEQ ID NO: 3346679 - RNA, 13 nt, Human
gccagauuucacu

SEQ ID NO: 3346680 - RNA, 20 nt, Human
gccagauucuuuccugaggc

SEQ ID NO: 3346681 - RNA, 22 nt, Human
gccagccgagauagccaaggcc

SEQ ID NO: 3346682 - RNA, 21 nt, Human
gccagccgagauagccaaggc

SEQ ID NO: 3346683 - RNA, 19 nt, Human
gccagauucuuuccugagg

SEQ ID NO: 3346684 - RNA, 14 nt, Human
gcccacuucugcca

SEQ ID NO: 3346685 - RNA, 16 nt, Human
gcccaccuuggcucaa

SEQ ID NO: 3346686 - RNA, 15 nt, Human
gcccaccuuggcuca

SEQ ID NO: 3346687 - RNA, 13 nt, Human
gcccaccuuggcu

SEQ ID NO: 3346688 - RNA, 17 nt, Human
gcccaccuggccucugc

SEQ ID NO: 3346689 - RNA, 20 nt, Human
gcccaccuggccucugcacu

SEQ ID NO: 3346690 - RNA, 21 nt, Human
gcccaccuggccucugcacuc

SEQ ID NO: 3346691 - RNA, 24 nt, Human
gcccaccuggccucugcacucccc

SEQ ID NO: 3346692 - RNA, 15 nt, Human
gcccaccuggccucu

SEQ ID NO: 3346693 - RNA, 16 nt, Human
gcccaccuggccucug

SEQ ID NO: 3346694 - RNA, 16 nt, Human
gccaugggccuccugu

SEQ ID NO: 3346695 - RNA, 15 nt, Human
gccaugggccuccug

SEQ ID NO: 3346696 - RNA, 13 nt, Human
gccaggcuggucu

SEQ ID NO: 3346697 - RNA, 23 nt, Human
gccaguaaaugggggugcauuug

SEQ ID NO: 3346698 - RNA, 12 nt, Human
gccaguaaaugg

SEQ ID NO: 3346699 - RNA, 21 nt, Human
gccagucaccccggccaccug

SEQ ID NO: 3346700 - RNA, 14 nt, Human
gccaugcuccuggc

SEQ ID NO: 3346701 - RNA, 20 nt, Human
gccaugaggaacaaggcaag

SEQ ID NO: 3346702 - RNA, 17 nt, Human
caucccugaaggccccg

SEQ ID NO: 3346703 - RNA, 18 nt, Human
caucccugaaggccccgc

SEQ ID NO: 3346704 - RNA, 19 nt, Human
caucccugaaggccccgcc

SEQ ID NO: 3346705 - RNA, 21 nt, Human
caucccugaaggccccgccca

SEQ ID NO: 3346706 - RNA, 14 nt, Human
caucauugaaaucu

SEQ ID NO: 3346707 - RNA, 15 nt, Human
caucauugaaaucuu

SEQ ID NO: 3346708 - RNA, 20 nt, Human
caucauugaaaucuuuuugc

SEQ ID NO: 3346709 - RNA, 21 nt, Human
caucauugaaaucuuuuugcu

SEQ ID NO: 3346710 - RNA, 13 nt, Human
caucauugaaauc

SEQ ID NO: 3346711 - RNA, 15 nt, Human
caucaccaacgucug

SEQ ID NO: 3346712 - RNA, 15 nt, Human
cauccagguucagcu

SEQ ID NO: 3346713 - RNA, 15 nt, Human
caucccucuggggcu

SEQ ID NO: 3346714 - RNA, 19 nt, Human
caucccucuggggcuguuc

SEQ ID NO: 3346715 - RNA, 11 nt, Human
caucccugaag

SEQ ID NO: 3346716 - RNA, 13 nt, Human
caucccugaaggc

SEQ ID NO: 3346717 - RNA, 20 nt, Human
caucuugcucugcugacaga

SEQ ID NO: 3346718 - RNA, 19 nt, Human
caucuugcucugcugacag

SEQ ID NO: 3346719 - RNA, 14 nt, Human
caucuugcucugcu

SEQ ID NO: 3346720 - RNA, 13 nt, Human
caucuugcucugc

SEQ ID NO: 3346721 - RNA, 22 nt, Human
caucuuccaaggguacuaagga

SEQ ID NO: 3346722 - RNA, 20 nt, Human
caucucacacaugagcauca

SEQ ID NO: 3346723 - RNA, 16 nt, Human
caucucacacaugagc

SEQ ID NO: 3346724 - RNA, 17 nt, Human
caucucacacaugagca

SEQ ID NO: 3346725 - RNA, 15 nt, Human
cauccucuguacaga

SEQ ID NO: 3346726 - RNA, 18 nt, Human
cauccucuguacagagcc

SEQ ID NO: 3346727 - RNA, 19 nt, Human
cauccucuguacagagccc

SEQ ID NO: 3346728 - RNA, 15 nt, Human
caucuacccuccgau

SEQ ID NO: 3346729 - RNA, 13 nt, Human
cauccucccaagg

SEQ ID NO: 3346730 - RNA, 17 nt, Human
cauccucauacccaccc

SEQ ID NO: 3346731 - RNA, 18 nt, Human
cauccucauacccacccc

SEQ ID NO: 3346732 - RNA, 21 nt, Human
cauccucauacccacccccac

SEQ ID NO: 3346733 - RNA, 22 nt, Human
cauccucauacccacccccacc

SEQ ID NO: 3346734 - RNA, 15 nt, Human
cauccuccucagauc

SEQ ID NO: 3346735 - RNA, 16 nt, Human
cauccuccucagaucu

SEQ ID NO: 3346736 - RNA, 18 nt, Human
cauccuccucagaucuuc

SEQ ID NO: 3346737 - RNA, 19 nt, Human
cauccuccucagaucuucu

SEQ ID NO: 3346738 - RNA, 11 nt, Human
cauccuccuca

SEQ ID NO: 3346739 - RNA, 12 nt, Human
cauccuccucag

SEQ ID NO: 3346740 - RNA, 15 nt, Human
cauccucauacccac

SEQ ID NO: 3346741 - RNA, 16 nt, Human
cauccucauacccacc

SEQ ID NO: 3346742 - RNA, 23 nt, Human
cauagagagcaagacgcugugcu

SEQ ID NO: 3346743 - RNA, 19 nt, Human
cauagagagcaagacgcug

SEQ ID NO: 3346744 - RNA, 21 nt, Human
cauagagagcaagacgcugug

SEQ ID NO: 3346745 - RNA, 16 nt, Human
cauacucccaucugug

SEQ ID NO: 3346746 - RNA, 15 nt, Human
cauacucccaucugu

SEQ ID NO: 3346747 - RNA, 18 nt, Human
cauacucccaucugugaa

SEQ ID NO: 3346748 - RNA, 20 nt, Human
cauacucccaucugugaaag

SEQ ID NO: 3346749 - RNA, 11 nt, Human
cauacucugcu

SEQ ID NO: 3346750 - RNA, 17 nt, Human
cauaguaugguggcugg

SEQ ID NO: 3346751 - RNA, 19 nt, Human
cauaguaugguggcugggu

SEQ ID NO: 3346752 - RNA, 18 nt, Human
cauaguaugguggcuggg

SEQ ID NO: 3346753 - RNA, 22 nt, Human
cauaguggcuuaaaacaacacu

SEQ ID NO: 3346754 - RNA, 22 nt, Human
cauauauauguuuuaagaggca

SEQ ID NO: 3346755 - RNA, 20 nt, Human
cauauuuacuucuuauacau

SEQ ID NO: 3346756 - RNA, 17 nt, Human
cauauuuacuucuuaua

SEQ ID NO: 3346757 - RNA, 16 nt, Human
cauauuuacuucuuau

SEQ ID NO: 3346758 - RNA, 14 nt, Human
cauauuuacuucuu

SEQ ID NO: 3346759 - RNA, 14 nt, Human
caucaagaugugac

SEQ ID NO: 3346760 - RNA, 12 nt, Human
caguugaaaaac

SEQ ID NO: 3346761 - RNA, 18 nt, Human
caguugaaaaacagcuga

SEQ ID NO: 3346762 - RNA, 19 nt, Human
caguugaaaaacagcugag

SEQ ID NO: 3346763 - RNA, 22 nt, Human
caguucucuccuucuucccccc

SEQ ID NO: 3346764 - RNA, 14 nt, Human
caguucucuccuuc

SEQ ID NO: 3346765 - RNA, 15 nt, Human
caguucucuccuucu

SEQ ID NO: 3346766 - RNA, 13 nt, Human
caguucucuccuu

SEQ ID NO: 3346767 - RNA, 19 nt, Human
caguguuguggauuuaaca

SEQ ID NO: 3346768 - RNA, 13 nt, Human
caguguugccuaa

SEQ ID NO: 3346769 - RNA, 20 nt, Human
caguguuguggauuuaacag

SEQ ID NO: 3346770 - RNA, 22 nt, Human
caguguuguggauuuaacagaa

SEQ ID NO: 3346771 - RNA, 14 nt, Human
caguguugccuaag

SEQ ID NO: 3346772 - RNA, 13 nt, Human
caguuaagagaaa

SEQ ID NO: 3346773 - RNA, 14 nt, Human
caguuaagagaaau

SEQ ID NO: 3346774 - RNA, 16 nt, Human
caguggcagcugcuuu

SEQ ID NO: 3346775 - RNA, 15 nt, Human
caguggcagcugcuu

SEQ ID NO: 3346776 - RNA, 14 nt, Human
caguggcagcugcu

SEQ ID NO: 3346777 - RNA, 13 nt, Human
caguggcagcugc

SEQ ID NO: 3346778 - RNA, 12 nt, Human
caguggcagcug

SEQ ID NO: 3346779 - RNA, 22 nt, Human
caguggugguuuucuguucuuu

SEQ ID NO: 3346780 - RNA, 22 nt, Human
cagugguuccuaauccucuagg

SEQ ID NO: 3346781 - RNA, 12 nt, Human
cagugugacuga

SEQ ID NO: 3346782 - RNA, 14 nt, Human
cagugugacaagga

SEQ ID NO: 3346783 - RNA, 23 nt, Human
caguguacauggaauaacaugua

SEQ ID NO: 3346784 - RNA, 20 nt, Human
caguguacauggaauaacau

SEQ ID NO: 3346785 - RNA, 16 nt, Human
caguguacauggaaua

SEQ ID NO: 3346786 - RNA, 23 nt, Human
caguugccagucaccccggccac

SEQ ID NO: 3346787 - RNA, 16 nt, Human
caguuggguggaugcc

SEQ ID NO: 3346788 - RNA, 19 nt, Human
caguuggucccccuuccau

SEQ ID NO: 3346789 - RNA, 20 nt, Human
caguuggucccccuuccaug

SEQ ID NO: 3346790 - RNA, 21 nt, Human
caguuggucccccuuccaugg

SEQ ID NO: 3346791 - RNA, 22 nt, Human
caguuggucccccuuccaugga

SEQ ID NO: 3346792 - RNA, 19 nt, Human
caguuggguggaugccugg

SEQ ID NO: 3346793 - RNA, 18 nt, Human
caguuggguggaugccug

SEQ ID NO: 3346794 - RNA, 18 nt, Human
caguuggucccccuucca

SEQ ID NO: 3346795 - RNA, 17 nt, Human
caguuguuagugugucu

SEQ ID NO: 3346796 - RNA, 16 nt, Human
cauaaccuagccuuag

SEQ ID NO: 3346797 - RNA, 20 nt, Human
cauaaacaagaccacguuuc

SEQ ID NO: 3346798 - RNA, 21 nt, Human
cauaaacaagaccacguuucu

SEQ ID NO: 3346799 - RNA, 22 nt, Human
cauaaacaagaccacguuucua

SEQ ID NO: 3346800 - RNA, 21 nt, Human
cauaaaaauuagccaagugug

SEQ ID NO: 3346801 - RNA, 14 nt, Human
cauaagauaaaugu

SEQ ID NO: 3346802 - RNA, 13 nt, Human
cauaccacuuuug

SEQ ID NO: 3346803 - RNA, 14 nt, Human
cauaccacuuuugu

SEQ ID NO: 3346804 - RNA, 15 nt, Human
cauaccacuuuuguu

SEQ ID NO: 3346805 - RNA, 18 nt, Human
cauaccacuuuuguucuu

SEQ ID NO: 3346806 - RNA, 11 nt, Human
cauacccaccc

SEQ ID NO: 3346807 - RNA, 12 nt, Human
cauacccacccc

SEQ ID NO: 3346808 - RNA, 19 nt, Human
cauaccacuuuuguucuug

SEQ ID NO: 3346809 - RNA, 17 nt, Human
cauacguacacauuuua

SEQ ID NO: 3346810 - RNA, 18 nt, Human
cauacguacacauuuuau

SEQ ID NO: 3346811 - RNA, 14 nt, Human
cauacuaaccagca

SEQ ID NO: 3346812 - RNA, 21 nt, Human
cauacuaaccagcagaaaugc

SEQ ID NO: 3346813 - RNA, 15 nt, Human
cauacguacacauuu

SEQ ID NO: 3346814 - RNA, 16 nt, Human
cauacguacacauuuu

SEQ ID NO: 3346815 - RNA, 13 nt, Human
cauacguacacau

SEQ ID NO: 3346816 - RNA, 14 nt, Human
cauacccaccccca

SEQ ID NO: 3346817 - RNA, 17 nt, Human
cauacccacccccaccc

SEQ ID NO: 3346818 - RNA, 18 nt, Human
cauacccacccccaccca

SEQ ID NO: 3346819 - RNA, 21 nt, Human
cauacccacccccacccaagg

SEQ ID NO: 3346820 - RNA, 19 nt, Human
caugccagcuuaucucagg

SEQ ID NO: 3346821 - RNA, 20 nt, Human
caugccagcuuaucucaggg

SEQ ID NO: 3346822 - RNA, 13 nt, Human
caugccccugaac

SEQ ID NO: 3346823 - RNA, 14 nt, Human
caugccucucucag

SEQ ID NO: 3346824 - RNA, 15 nt, Human
caugccucucucagg

SEQ ID NO: 3346825 - RNA, 16 nt, Human
caugccucucucaggc

SEQ ID NO: 3346826 - RNA, 17 nt, Human
caugccucucucaggcc

SEQ ID NO: 3346827 - RNA, 18 nt, Human
caugccucucucaggcca

SEQ ID NO: 3346828 - RNA, 19 nt, Human
caugccucucucaggccaa

SEQ ID NO: 3346829 - RNA, 13 nt, Human
caugccuggaugg

SEQ ID NO: 3346830 - RNA, 16 nt, Human
cauggaauaacaugua

SEQ ID NO: 3346831 - RNA, 13 nt, Human
cauggacuuuaua

SEQ ID NO: 3346832 - RNA, 20 nt, Human
cauggaaguacuauaauuua

SEQ ID NO: 3346833 - RNA, 22 nt, Human
cauggaaguacuauaauuuacc

SEQ ID NO: 3346834 - RNA, 18 nt, Human
caugccuggauggggcug

SEQ ID NO: 3346835 - RNA, 21 nt, Human
caugccuggauggggcugcac

SEQ ID NO: 3346836 - RNA, 23 nt, Human
caugccuggauggggcugcaccg

SEQ ID NO: 3346837 - RNA, 17 nt, Human
caugcgggcuuccuccu

SEQ ID NO: 3346838 - RNA, 17 nt, Human
caugcugucccuuacgu

SEQ ID NO: 3346839 - RNA, 22 nt, Human
caugcugucccuuacgugaguc

SEQ ID NO: 3346840 - RNA, 17 nt, Human
cauggagguuugaagau

SEQ ID NO: 3346841 - RNA, 11 nt, Human
cauggacuuug

SEQ ID NO: 3346842 - RNA, 13 nt, Human
cauggacuuuguu

SEQ ID NO: 3346843 - RNA, 17 nt, Human
cauggacuuuauaagcc

SEQ ID NO: 3346844 - RNA, 16 nt, Human
cauggaguauauguca

SEQ ID NO: 3346845 - RNA, 18 nt, Human
caugggaaugaaugucag

SEQ ID NO: 3346846 - RNA, 17 nt, Human
caugggccuccugugug

SEQ ID NO: 3346847 - RNA, 16 nt, Human
caugggccuccugugu

SEQ ID NO: 3346848 - RNA, 17 nt, Human
caugggaaugaauguca

SEQ ID NO: 3346849 - RNA, 15 nt, Human
caugggccuccugug

SEQ ID NO: 3346850 - RNA, 22 nt, Human
caugggaaugaaugucagugug

SEQ ID NO: 3346851 - RNA, 14 nt, Human
caugucuuuucuug

SEQ ID NO: 3346852 - RNA, 19 nt, Human
caugucuuuucuugcauga

SEQ ID NO: 3346853 - RNA, 21 nt, Human
caugucuuuucuugcaugagg

SEQ ID NO: 3346854 - RNA, 23 nt, Human
caugucuuuucuugcaugaggcu

SEQ ID NO: 3346855 - RNA, 21 nt, Human
cauguaauuaaguacuaugua

SEQ ID NO: 3346856 - RNA, 18 nt, Human
cauguaauuaaguacuau

SEQ ID NO: 3346857 - RNA, 16 nt, Human
cauggucggaaaacau

SEQ ID NO: 3346858 - RNA, 15 nt, Human
cauguuugugauuga

SEQ ID NO: 3346859 - RNA, 15 nt, Human
caugugcacaugcac

SEQ ID NO: 3346860 - RNA, 21 nt, Human
caugugccagguuuuuggucu

SEQ ID NO: 3346861 - RNA, 21 nt, Human
cauuaaagccugaguuugcuu

SEQ ID NO: 3346862 - RNA, 15 nt, Human
cauguuuuguuuacg

SEQ ID NO: 3346863 - RNA, 13 nt, Human
cauugaccugagg

SEQ ID NO: 3346864 - RNA, 22 nt, Human
cauugaccugaggcccuucucu

SEQ ID NO: 3346865 - RNA, 19 nt, Human
cauugaaaucuuuuugcuu

SEQ ID NO: 3346866 - RNA, 21 nt, Human
cauuuaaaagauacaguuacu

SEQ ID NO: 3346867 - RNA, 21 nt, Human
cauuuacuuuguguucaccuu

SEQ ID NO: 3346868 - RNA, 17 nt, Human
cauuuacuuuguguuca

SEQ ID NO: 3346869 - RNA, 21 nt, Human
cauuucuuccacaagagccca

SEQ ID NO: 3346870 - RNA, 23 nt, Human
cauuucuuccacaagagcccagg

SEQ ID NO: 3346871 - RNA, 17 nt, Human
cauuugaggucuguucu

SEQ ID NO: 3346872 - RNA, 18 nt, Human
cauuugaggucuguucuu

SEQ ID NO: 3346873 - RNA, 19 nt, Human
cauuugaggucuguucuuu

SEQ ID NO: 3346874 - RNA, 14 nt, Human
cauuugagcagggc

SEQ ID NO: 3346875 - RNA, 23 nt, Human
cauuuugggguacccacugcucu

SEQ ID NO: 3346876 - RNA, 15 nt, Human
cauuuuuaagugcug

SEQ ID NO: 3346877 - RNA, 20 nt, Human
cauuuuuaagugcugcauuu

SEQ ID NO: 3346878 - RNA, 18 nt, Human
cauuuuuaguagagacag

SEQ ID NO: 3346879 - RNA, 19 nt, Human
cauuuuuaguagagacagg

SEQ ID NO: 3346880 - RNA, 18 nt, Human
cauuuugcuaaaugugaa

SEQ ID NO: 3346881 - RNA, 21 nt, Human
cauuuugcuaaaugugaauga

SEQ ID NO: 3346882 - RNA, 24 nt, Human
cauuuugcuaaaugugaaugauga

SEQ ID NO: 3346883 - RNA, 22 nt, Human
cauuuugggguacccacugcuc

SEQ ID NO: 3346884 - RNA, 21 nt, Human
cauuuugggguacccacugcu

SEQ ID NO: 3346885 - RNA, 20 nt, Human
cauuuugggguacccacugc

SEQ ID NO: 3346886 - RNA, 21 nt, Human
cauuuuauuuuauuaugcaug

SEQ ID NO: 3346887 - RNA, 19 nt, Human
cauuuuauuuuauuaugca

SEQ ID NO: 3346888 - RNA, 16 nt, Human
ccaaacccuucagugc

SEQ ID NO: 3346889 - RNA, 18 nt, Human
ccaaaauaaaacuuuuua

SEQ ID NO: 3346890 - RNA, 21 nt, Human
ccaaaauaaaacuuuuuaaaa

SEQ ID NO: 3346891 - RNA, 20 nt, Human
cauuuuuaguagagacaggg

SEQ ID NO: 3346892 - RNA, 14 nt, Human
ccaaagaugcagcc

SEQ ID NO: 3346893 - RNA, 13 nt, Human
ccaaagaugcagc

SEQ ID NO: 3346894 - RNA, 13 nt, Human
ccaacccucauca

SEQ ID NO: 3346895 - RNA, 15 nt, Human
ccaacccucaucacc

SEQ ID NO: 3346896 - RNA, 15 nt, Human
ccaagaccuucuccu

SEQ ID NO: 3346897 - RNA, 22 nt, Human
ccaaauucuuucaguggcuacc

SEQ ID NO: 3346898 - RNA, 15 nt, Human
ccaaauucuuucagu

SEQ ID NO: 3346899 - RNA, 16 nt, Human
ccaacaucaacaucuu

SEQ ID NO: 3346900 - RNA, 14 nt, Human
ccaacauacuccca

SEQ ID NO: 3346901 - RNA, 13 nt, Human
ccaacaucaacau

SEQ ID NO: 3346902 - RNA, 20 nt, Human
ccacaaguuaaauaaaucau

SEQ ID NO: 3346903 - RNA, 15 nt, Human
ccacaaguuaaauaa

SEQ ID NO: 3346904 - RNA, 16 nt, Human
ccacaagagcccaggc

SEQ ID NO: 3346905 - RNA, 17 nt, Human
ccacaagagcccaggcc

SEQ ID NO: 3346906 - RNA, 18 nt, Human
ccacaagagcccaggccu

SEQ ID NO: 3346907 - RNA, 19 nt, Human
ccacaagagcccaggccuc

SEQ ID NO: 3346908 - RNA, 20 nt, Human
ccacaagagcccaggccucc

SEQ ID NO: 3346909 - RNA, 21 nt, Human
ccacaagagcccaggccuccu

SEQ ID NO: 3346910 - RNA, 14 nt, Human
ccaaggcuggggga

SEQ ID NO: 3346911 - RNA, 18 nt, Human
ccaaggugggaggauugc

SEQ ID NO: 3346912 - RNA, 18 nt, Human
ccacaaaggagagcuagc

SEQ ID NO: 3346913 - RNA, 16 nt, Human
ccacaagacccuugug

SEQ ID NO: 3346914 - RNA, 13 nt, Human
ccacaagagccca

SEQ ID NO: 3346915 - RNA, 23 nt, Human
ccaagcagagguugggaggccau

SEQ ID NO: 3346916 - RNA, 14 nt, Human
ccaagcaggacaug

SEQ ID NO: 3346917 - RNA, 12 nt, Human
ccaagcucccag

SEQ ID NO: 3346918 - RNA, 13 nt, Human
ccaagcucccagg

SEQ ID NO: 3346919 - RNA, 16 nt, Human
ccagcugcuugggcuu

SEQ ID NO: 3346920 - RNA, 18 nt, Human
ccagcugcuugggcuuca

SEQ ID NO: 3346921 - RNA, 13 nt, Human
ccagcugcuuggg

SEQ ID NO: 3346922 - RNA, 15 nt, Human
ccagcugcuugggcu

SEQ ID NO: 3346923 - RNA, 21 nt, Human
ccagcugugcucuggacaggc

SEQ ID NO: 3346924 - RNA, 20 nt, Human
ccagcugugcucuggacagg

SEQ ID NO: 3346925 - RNA, 18 nt, Human
ccagcugugcucuggaca

SEQ ID NO: 3346926 - RNA, 12 nt, Human
ccaggagcagcc

SEQ ID NO: 3346927 - RNA, 13 nt, Human
ccaggagcagcca

SEQ ID NO: 3346928 - RNA, 14 nt, Human
ccaggaagccagca

SEQ ID NO: 3346929 - RNA, 15 nt, Human
ccaggaagccagcag

SEQ ID NO: 3346930 - RNA, 17 nt, Human
ccaggaagccagcaggc

SEQ ID NO: 3346931 - RNA, 19 nt, Human
ccaggaagccagcaggcuc

SEQ ID NO: 3346932 - RNA, 23 nt, Human
ccagcugugcucuggacaggcau

SEQ ID NO: 3346933 - RNA, 22 nt, Human
ccagcugugcucuggacaggca

SEQ ID NO: 3346934 - RNA, 16 nt, Human
ccaggcccucugccca

SEQ ID NO: 3346935 - RNA, 17 nt, Human
ccaggcccucugcccac

SEQ ID NO: 3346936 - RNA, 18 nt, Human
ccaggcccucugcccacu

SEQ ID NO: 3346937 - RNA, 19 nt, Human
ccaggcccucugcccacuc

SEQ ID NO: 3346938 - RNA, 13 nt, Human
ccaggccuccuac

SEQ ID NO: 3346939 - RNA, 18 nt, Human
ccaggccuccuacagcuu

SEQ ID NO: 3346940 - RNA, 19 nt, Human
ccaggccuccuacagcuug

SEQ ID NO: 3346941 - RNA, 12 nt, Human
ccaggccagagg

SEQ ID NO: 3346942 - RNA, 14 nt, Human
ccaggagcagccac

SEQ ID NO: 3346943 - RNA, 21 nt, Human
ccaggccagagggagugacag

SEQ ID NO: 3346944 - RNA, 14 nt, Human
ccaggccagaggga

SEQ ID NO: 3346945 - RNA, 23 nt, Human
ccaggccccugccacccugggga

SEQ ID NO: 3346946 - RNA, 21 nt, Human
ccaggccccugccacccuggg

SEQ ID NO: 3346947 - RNA, 19 nt, Human
ccaggccccugccacccug

SEQ ID NO: 3346948 - RNA, 22 nt, Human
ccagggacagaggggguggccu

SEQ ID NO: 3346949 - RNA, 23 nt, Human
ccagggacagaggggguggccuc

SEQ ID NO: 3346950 - RNA, 13 nt, Human
ccaucaccagaca

SEQ ID NO: 3346951 - RNA, 12 nt, Human
ccaucacccgcu

SEQ ID NO: 3346952 - RNA, 18 nt, Human
ccauauucuguuggccag

SEQ ID NO: 3346953 - RNA, 19 nt, Human
ccauauuaccacagacaua

SEQ ID NO: 3346954 - RNA, 15 nt, Human
ccauauucuguuggc

SEQ ID NO: 3346955 - RNA, 23 nt, Human
ccauagagagcaagacgcugugc

SEQ ID NO: 3346956 - RNA, 16 nt, Human
ccaucaugucuggcua

SEQ ID NO: 3346957 - RNA, 14 nt, Human
ccaucaugucuggc

SEQ ID NO: 3346958 - RNA, 21 nt, Human
ccauccucuguacagagccca

SEQ ID NO: 3346959 - RNA, 20 nt, Human
ccauccucuguacagagccc

SEQ ID NO: 3346960 - RNA, 14 nt, Human
cccaguuagcucuc

SEQ ID NO: 3346961 - RNA, 20 nt, Human
cccagugguuccuaauccuc

SEQ ID NO: 3346962 - RNA, 19 nt, Human
cccagucuggaaugcagug

SEQ ID NO: 3346963 - RNA, 18 nt, Human
cccagucuggaaugcagu

SEQ ID NO: 3346964 - RNA, 10 nt, Human
cccagucugg

SEQ ID NO: 3346965 - RNA, 21 nt, Human
cccagugcccacaggaucagu

SEQ ID NO: 3346966 - RNA, 15 nt, Human
cccagugccgagaag

SEQ ID NO: 3346967 - RNA, 13 nt, Human
cccagguuucuau

SEQ ID NO: 3346968 - RNA, 15 nt, Human
cccaggaggccagcc

SEQ ID NO: 3346969 - RNA, 16 nt, Human
cccaggaggccagccu

SEQ ID NO: 3346970 - RNA, 15 nt, Human
cccaggcauucccca

SEQ ID NO: 3346971 - RNA, 23 nt, Human
cccaggcaggucuugaacuccug

SEQ ID NO: 3346972 - RNA, 17 nt, Human
cccaggcauuccccagg

SEQ ID NO: 3346973 - RNA, 17 nt, Human
cccaggcaggucuugaa

SEQ ID NO: 3346974 - RNA, 16 nt, Human
cccaugagccucagca

SEQ ID NO: 3346975 - RNA, 15 nt, Human
cccaugagccucagc

SEQ ID NO: 3346976 - RNA, 20 nt, Human
cccaugagccucagcauccu

SEQ ID NO: 3346977 - RNA, 12 nt, Human
cccaugcugccc

SEQ ID NO: 3346978 - RNA, 13 nt, Human
cccaugcugcccu

SEQ ID NO: 3346979 - RNA, 12 nt, Human
cccaucugugaa

SEQ ID NO: 3346980 - RNA, 18 nt, Human
cccaucucacacaugagc

SEQ ID NO: 3346981 - RNA, 13 nt, Human
cccaucucacaca

SEQ ID NO: 3346982 - RNA, 20 nt, Human
cccaucugugaaaggaaaga

SEQ ID NO: 3346983 - RNA, 15 nt, Human
ccauguuggccaggc

SEQ ID NO: 3346984 - RNA, 18 nt, Human
ccauguuggccaggcugg

SEQ ID NO: 3346985 - RNA, 21 nt, Human
ccauguuggccaggcuggucu

SEQ ID NO: 3346986 - RNA, 19 nt, Human
ccauguuggccaggcuggu

SEQ ID NO: 3346987 - RNA, 19 nt, Human
cccaccuuggcugcaggga

SEQ ID NO: 3346988 - RNA, 17 nt, Human
cccaccuuggcugcagg

SEQ ID NO: 3346989 - RNA, 16 nt, Human
cccaccuuggcugcag

SEQ ID NO: 3346990 - RNA, 12 nt, Human
cccaccuggccu

SEQ ID NO: 3346991 - RNA, 15 nt, Human
cccaccuggccucug

SEQ ID NO: 3346992 - RNA, 13 nt, Human
cccacgcccccac

SEQ ID NO: 3346993 - RNA, 14 nt, Human
cccacgcccccacu

SEQ ID NO: 3346994 - RNA, 13 nt, Human
ccaugcuccuggc

SEQ ID NO: 3346995 - RNA, 16 nt, Human
ccaugcugcccuguga

SEQ ID NO: 3346996 - RNA, 17 nt, Human
ccaugcugcccugugag

SEQ ID NO: 3346997 - RNA, 15 nt, Human
ccaugcuccuggccc

SEQ ID NO: 3346998 - RNA, 18 nt, Human
ccaugcuccuggcccacu

SEQ ID NO: 3346999 - RNA, 15 nt, Human
ccaugcugcccugug

SEQ ID NO: 3347000 - RNA, 14 nt, Human
ccauguuggccagg

SEQ ID NO: 3347001 - RNA, 13 nt, Human
ccauguuggccag

SEQ ID NO: 3347002 - RNA, 13 nt, Human
ccaugugccaggu

SEQ ID NO: 3347003 - RNA, 23 nt, Human
cccagauugcaacaggcugggcu

SEQ ID NO: 3347004 - RNA, 17 nt, Human
cccagccccaaugaaca

SEQ ID NO: 3347005 - RNA, 11 nt, Human
cccagccccau

SEQ ID NO: 3347006 - RNA, 12 nt, Human
cccagccccauc

SEQ ID NO: 3347007 - RNA, 13 nt, Human
cccagccccaaug

SEQ ID NO: 3347008 - RNA, 18 nt, Human
cccagccccauccucugu

SEQ ID NO: 3347009 - RNA, 19 nt, Human
cccagccccauccucugua

SEQ ID NO: 3347010 - RNA, 18 nt, Human
cccagccccuucugaccc

SEQ ID NO: 3347011 - RNA, 13 nt, Human
cccagccccaucc

SEQ ID NO: 3347012 - RNA, 14 nt, Human
cccagccccauccc

SEQ ID NO: 3347013 - RNA, 14 nt, Human
cccagccccauccu

SEQ ID NO: 3347014 - RNA, 15 nt, Human
cccagccccauccuc

SEQ ID NO: 3347015 - RNA, 14 nt, Human
cccaggaggccagc

SEQ ID NO: 3347016 - RNA, 13 nt, Human
cccaggaggccag

SEQ ID NO: 3347017 - RNA, 14 nt, Human
cccaggagccccga

SEQ ID NO: 3347018 - RNA, 13 nt, Human
cccaggagccccg

SEQ ID NO: 3347019 - RNA, 13 nt, Human
cccagcucugguc

SEQ ID NO: 3347020 - RNA, 14 nt, Human
cccagcucuggucc

SEQ ID NO: 3347021 - RNA, 12 nt, Human
cccagcucuggu

SEQ ID NO: 3347022 - RNA, 15 nt, Human
cccagcucuggucca

SEQ ID NO: 3347023 - RNA, 16 nt, Human
cccagcucugguccau

SEQ ID NO: 3347024 - RNA, 18 nt, Human
cccagcucugguccauag

SEQ ID NO: 3347025 - RNA, 14 nt, Human
cccagcgagcccug

SEQ ID NO: 3347026 - RNA, 22 nt, Human
ccccuguccccgcacugggcuu

SEQ ID NO: 3347027 - RNA, 20 nt, Human
ccccuguucuggcagaguug

SEQ ID NO: 3347028 - RNA, 15 nt, Human
cccgaggccuucucu

SEQ ID NO: 3347029 - RNA, 20 nt, Human
cccgaggccuucucugaagg

SEQ ID NO: 3347030 - RNA, 16 nt, Human
ccccagccccauccca

SEQ ID NO: 3347031 - RNA, 15 nt, Human
ccccagccccauccu

SEQ ID NO: 3347032 - RNA, 13 nt, Human
ccccagccugcua

SEQ ID NO: 3347033 - RNA, 12 nt, Human
ccccaggaggcc

SEQ ID NO: 3347034 - RNA, 12 nt, Human
ccccuggcagcc

SEQ ID NO: 3347035 - RNA, 14 nt, Human
ccccuggcagcccc

SEQ ID NO: 3347036 - RNA, 15 nt, Human
ccccuggcagccccu

SEQ ID NO: 3347037 - RNA, 16 nt, Human
cccucagggucccugg

SEQ ID NO: 3347038 - RNA, 17 nt, Human
cccucagggucccuggu

SEQ ID NO: 3347039 - RNA, 18 nt, Human
cccucagggucccuggug

SEQ ID NO: 3347040 - RNA, 19 nt, Human
cccucagggucccuggugg

SEQ ID NO: 3347041 - RNA, 15 nt, Human
cccucagggucccug

SEQ ID NO: 3347042 - RNA, 17 nt, Human
cccuaaaguguauuuuu

SEQ ID NO: 3347043 - RNA, 22 nt, Human
cccuaaaguguauuuuuuuacu

SEQ ID NO: 3347044 - RNA, 13 nt, Human
cccucccucuuuc

SEQ ID NO: 3347045 - RNA, 17 nt, Human
cccuccaugugggcuag

SEQ ID NO: 3347046 - RNA, 17 nt, Human
cccucauccucauaccc

SEQ ID NO: 3347047 - RNA, 20 nt, Human
cccucauccucauacccacc

SEQ ID NO: 3347048 - RNA, 22 nt, Human
cccucaucaccaacgucugugc

SEQ ID NO: 3347049 - RNA, 20 nt, Human
cccucagucuggcccuuccu

SEQ ID NO: 3347050 - RNA, 21 nt, Human
cccucagggucccugguggca

SEQ ID NO: 3347051 - RNA, 21 nt, Human
cccuccaagaccuucuccuuc

SEQ ID NO: 3347052 - RNA, 22 nt, Human
cccucauccucauacccacccc

SEQ ID NO: 3347053 - RNA, 14 nt, Human
cccugguggcagcu

SEQ ID NO: 3347054 - RNA, 21 nt, Human
cccugguggcagugggagcug

SEQ ID NO: 3347055 - RNA, 22 nt, Human
cccugguggcagugggagcugc

SEQ ID NO: 3347056 - RNA, 20 nt, Human
cccugcugguucaggguugg

SEQ ID NO: 3347057 - RNA, 19 nt, Human
cccugcugguucaggguug

SEQ ID NO: 3347058 - RNA, 22 nt, Human
cccugcuggguguggcgcagca

SEQ ID NO: 3347059 - RNA, 13 nt, Human
cccugcugguuca

SEQ ID NO: 3347060 - RNA, 22 nt, Human
cccugcaaccugauugugucuc

SEQ ID NO: 3347061 - RNA, 16 nt, Human
cccugcaaccugauug

SEQ ID NO: 3347062 - RNA, 18 nt, Human
cccugcagagggcacaga

SEQ ID NO: 3347063 - RNA, 12 nt, Human
cccugcagaggg

SEQ ID NO: 3347064 - RNA, 22 nt, Human
cccugcacuugcagacucuaca

SEQ ID NO: 3347065 - RNA, 18 nt, Human
cccugccacccuggggag

SEQ ID NO: 3347066 - RNA, 17 nt, Human
cccugccacccugggga

SEQ ID NO: 3347067 - RNA, 15 nt, Human
cccugccacccuggg

SEQ ID NO: 3347068 - RNA, 14 nt, Human
cccugccacccugg

SEQ ID NO: 3347069 - RNA, 12 nt, Human
cccugccacccu

SEQ ID NO: 3347070 - RNA, 16 nt, Human
cccugccuccuuugug

SEQ ID NO: 3347071 - RNA, 23 nt, Human
cccugccuccuuugugaggaagc

SEQ ID NO: 3347072 - RNA, 14 nt, Human
cccugccuccuuug

SEQ ID NO: 3347073 - RNA, 24 nt, Human
ccucacaguccuuaccagcagagc

SEQ ID NO: 3347074 - RNA, 23 nt, Human
ccucacaguccuuaccagcagag

SEQ ID NO: 3347075 - RNA, 16 nt, Human
ccuauuagagaagaga

SEQ ID NO: 3347076 - RNA, 17 nt, Human
ccuauuagagaagagau

SEQ ID NO: 3347077 - RNA, 15 nt, Human
ccuaggugacagagu

SEQ ID NO: 3347078 - RNA, 16 nt, Human
ccucagggucccuggu

SEQ ID NO: 3347079 - RNA, 17 nt, Human
ccucagggucccuggug

SEQ ID NO: 3347080 - RNA, 20 nt, Human
ccucagggucccugguggca

SEQ ID NO: 3347081 - RNA, 23 nt, Human
ccucaggccugggggcugggcag

SEQ ID NO: 3347082 - RNA, 16 nt, Human
ccucagaucuucugug

SEQ ID NO: 3347083 - RNA, 13 nt, Human
ccuaggugacaga

SEQ ID NO: 3347084 - RNA, 21 nt, Human
ccuagaaauuccccacccuga

SEQ ID NO: 3347085 - RNA, 19 nt, Human
ccuacuguaauuugugaua

SEQ ID NO: 3347086 - RNA, 18 nt, Human
ccuacccacccuccuuuc

SEQ ID NO: 3347087 - RNA, 13 nt, Human
ccuacccacccuc

SEQ ID NO: 3347088 - RNA, 21 nt, Human
ccuacaguugaaaaacagcug

SEQ ID NO: 3347089 - RNA, 19 nt, Human
ccuacagcuugaccgugag

SEQ ID NO: 3347090 - RNA, 22 nt, Human
ccuacaguugaaaaacagcuga

SEQ ID NO: 3347091 - RNA, 16 nt, Human
ccuaaaauucagugga

SEQ ID NO: 3347092 - RNA, 15 nt, Human
ccuaaaauucagugg

SEQ ID NO: 3347093 - RNA, 13 nt, Human
cccuucccaccuc

SEQ ID NO: 3347094 - RNA, 12 nt, Human
cccuucccaccu

SEQ ID NO: 3347095 - RNA, 22 nt, Human
cccuugguuaggcauuguggga

SEQ ID NO: 3347096 - RNA, 23 nt, Human
cccuugguuaggcauugugggaa

SEQ ID NO: 3347097 - RNA, 22 nt, Human
cccuuguggucccaccccacac

SEQ ID NO: 3347098 - RNA, 20 nt, Human
cccuuguggucccaccccac

SEQ ID NO: 3347099 - RNA, 17 nt, Human
cccuuggauuguccccg

SEQ ID NO: 3347100 - RNA, 17 nt, Human
ccgggaagggggcuggg

SEQ ID NO: 3347101 - RNA, 15 nt, Human
ccucuccccagcaag

SEQ ID NO: 3347102 - RNA, 20 nt, Human
ccucuccccagcaagugaga

SEQ ID NO: 3347103 - RNA, 13 nt, Human
ccucucccuugga

SEQ ID NO: 3347104 - RNA, 22 nt, Human
ccucucccuuggauuguccccg

SEQ ID NO: 3347105 - RNA, 21 nt, Human
ccuccuccagccgccaugcuc

SEQ ID NO: 3347106 - RNA, 18 nt, Human
ccucgguguggagaagcg

SEQ ID NO: 3347107 - RNA, 13 nt, Human
ccucugacacaca

SEQ ID NO: 3347108 - RNA, 20 nt, Human
ccucugacacacagcucugu

SEQ ID NO: 3347109 - RNA, 19 nt, Human
ccucugacacacagcucug

SEQ ID NO: 3347110 - RNA, 14 nt, Human
ccucugacacacag

SEQ ID NO: 3347111 - RNA, 18 nt, Human
ccucugacacacagcucu

SEQ ID NO: 3347112 - RNA, 21 nt, Human
ccucugacacacagcucuguc

SEQ ID NO: 3347113 - RNA, 13 nt, Human
ccucugcccacuc

SEQ ID NO: 3347114 - RNA, 16 nt, Human
ccucugcccacucccu

SEQ ID NO: 3347115 - RNA, 14 nt, Human
ccucugcagcaaua

SEQ ID NO: 3347116 - RNA, 18 nt, Human
ccucugcagcaauaaagc

SEQ ID NO: 3347117 - RNA, 23 nt, Human
ccucugcacuccccugcugggug

SEQ ID NO: 3347118 - RNA, 18 nt, Human
ccucugcacuccccugcu

SEQ ID NO: 3347119 - RNA, 16 nt, Human
ccucugcacuccccug

SEQ ID NO: 3347120 - RNA, 17 nt, Human
ccucugcacuccccugc

SEQ ID NO: 3347121 - RNA, 15 nt, Human
ccucugcacuccccu

SEQ ID NO: 3347122 - RNA, 18 nt, Human
ccucccgaauagcuggga

SEQ ID NO: 3347123 - RNA, 16 nt, Human
ccucccaaagugcugg

SEQ ID NO: 3347124 - RNA, 20 nt, Human
ccucccgaauagcugggacu

SEQ ID NO: 3347125 - RNA, 19 nt, Human
ccucccgaauagcugggac

SEQ ID NO: 3347126 - RNA, 21 nt, Human
ccucccgaauagcugggacua

SEQ ID NO: 3347127 - RNA, 18 nt, Human
ccucccgaguagcuggga

SEQ ID NO: 3347128 - RNA, 17 nt, Human
ccucccgaguagcuggg

SEQ ID NO: 3347129 - RNA, 12 nt, Human
ccuccuccagcc

SEQ ID NO: 3347130 - RNA, 11 nt, Human
ccuccucagau

SEQ ID NO: 3347131 - RNA, 17 nt, Human
ccucaggugagaagcag

SEQ ID NO: 3347132 - RNA, 18 nt, Human
ccucaggugagaagcaga

SEQ ID NO: 3347133 - RNA, 20 nt, Human
ccucaggugagaagcagagg

SEQ ID NO: 3347134 - RNA, 15 nt, Human
ccucagggucccugg

SEQ ID NO: 3347135 - RNA, 11 nt, Human
ccuccaggugc

SEQ ID NO: 3347136 - RNA, 12 nt, Human
ccuccaggugca

SEQ ID NO: 3347137 - RNA, 14 nt, Human
ccucccaacucacc

SEQ ID NO: 3347138 - RNA, 17 nt, Human
ccucccaaagugcuggg

SEQ ID NO: 3347139 - RNA, 15 nt, Human
ccuccaugugggcua

SEQ ID NO: 3347140 - RNA, 12 nt, Human
ccuccauguggg

SEQ ID NO: 3347141 - RNA, 19 nt, Human
gccuguucagcuccagcuc

SEQ ID NO: 3347142 - RNA, 17 nt, Human
gccuguucagcuccagc

SEQ ID NO: 3347143 - RNA, 20 nt, Human
gccuguucagcuccagcuca

SEQ ID NO: 3347144 - RNA, 15 nt, Human
gcuaggccuggccag

SEQ ID NO: 3347145 - RNA, 14 nt, Human
gcuaggccuggcca

SEQ ID NO: 3347146 - RNA, 22 nt, Human
gcuaggaccccuccaugugggc

SEQ ID NO: 3347147 - RNA, 19 nt, Human
gcuaggaacacuccuucac

SEQ ID NO: 3347148 - RNA, 21 nt, Human
gcuaggaacacuccuucacag

SEQ ID NO: 3347149 - RNA, 18 nt, Human
gcuaggaacacuccuuca

SEQ ID NO: 3347150 - RNA, 16 nt, Human
gcuaggaacacuccuu

SEQ ID NO: 3347151 - RNA, 18 nt, Human
gcucagagagggugggag

SEQ ID NO: 3347152 - RNA, 20 nt, Human
gcucagagagggugggagug

SEQ ID NO: 3347153 - RNA, 15 nt, Human
gcucagagagggugg

SEQ ID NO: 3347154 - RNA, 12 nt, Human
gcucagggccug

SEQ ID NO: 3347155 - RNA, 13 nt, Human
gcucagggccugg

SEQ ID NO: 3347156 - RNA, 16 nt, Human
gcucagggccuggcuc

SEQ ID NO: 3347157 - RNA, 21 nt, Human
gcucagguggggucacucugg

SEQ ID NO: 3347158 - RNA, 22 nt, Human
gcucagguggggucacucuggc

SEQ ID NO: 3347159 - RNA, 20 nt, Human
gcucccaggcauuccccagg

SEQ ID NO: 3347160 - RNA, 21 nt, Human
gcucccaggcauuccccagga

SEQ ID NO: 3347161 - RNA, 14 nt, Human
gcuccccagcccca

SEQ ID NO: 3347162 - RNA, 17 nt, Human
gcucccaggcauucccc

SEQ ID NO: 3347163 - RNA, 22 nt, Human
gcucccaggcauuccccaggag

SEQ ID NO: 3347164 - RNA, 13 nt, Human
gcucucaggccag

SEQ ID NO: 3347165 - RNA, 14 nt, Human
gcucucaggccagc

SEQ ID NO: 3347166 - RNA, 15 nt, Human
gcucucaggccagcu

SEQ ID NO: 3347167 - RNA, 16 nt, Human
gcucuguccugggagu

SEQ ID NO: 3347168 - RNA, 14 nt, Human
gcucuguccuggga

SEQ ID NO: 3347169 - RNA, 15 nt, Human
gcucuguccugggag

SEQ ID NO: 3347170 - RNA, 15 nt, Human
gcucuuccaggcugg

SEQ ID NO: 3347171 - RNA, 16 nt, Human
gcucuuccaggcuggg

SEQ ID NO: 3347172 - RNA, 12 nt, Human
gcucuuccaggc

SEQ ID NO: 3347173 - RNA, 22 nt, Human
gcugaauacagaggcaacugca

SEQ ID NO: 3347174 - RNA, 17 nt, Human
gcugaaugguuuucaaa

SEQ ID NO: 3347175 - RNA, 12 nt, Human
gcugaaggcucg

SEQ ID NO: 3347176 - RNA, 20 nt, Human
gcugaaggcucgagcaugcc

SEQ ID NO: 3347177 - RNA, 16 nt, Human
gcugacagacacaggc

SEQ ID NO: 3347178 - RNA, 13 nt, Human
gcugacagacaca

SEQ ID NO: 3347179 - RNA, 15 nt, Human
gcugacagacacagg

SEQ ID NO: 3347180 - RNA, 14 nt, Human
gcugacagacacag

SEQ ID NO: 3347181 - RNA, 13 nt, Human
gcugccugggauc

SEQ ID NO: 3347182 - RNA, 17 nt, Human
gcugccauccagguuca

SEQ ID NO: 3347183 - RNA, 19 nt, Human
gcugccugggaucccucau

SEQ ID NO: 3347184 - RNA, 16 nt, Human
gcugccugggaucccu

SEQ ID NO: 3347185 - RNA, 18 nt, Human
gcugccugggaucccuca

SEQ ID NO: 3347186 - RNA, 13 nt, Human
gcugccaccugcc

SEQ ID NO: 3347187 - RNA, 19 nt, Human
gcugccagccgagauagcc

SEQ ID NO: 3347188 - RNA, 21 nt, Human
gcugccagccgagauagccaa

SEQ ID NO: 3347189 - RNA, 23 nt, Human
gcugccauccagguucagcuugu

SEQ ID NO: 3347190 - RNA, 21 nt, Human
gcugccauccagguucagcuu

SEQ ID NO: 3347191 - RNA, 18 nt, Human
gcugcaccggcuggccug

SEQ ID NO: 3347192 - RNA, 19 nt, Human
gcugcaccggcuggccugg

SEQ ID NO: 3347193 - RNA, 22 nt, Human
gcugcaccggcuggccuggccc

SEQ ID NO: 3347194 - RNA, 16 nt, Human
gcugcaccggcuggcc

SEQ ID NO: 3347195 - RNA, 17 nt, Human
gcugcaccggcuggccu

SEQ ID NO: 3347196 - RNA, 14 nt, Human
gcugcaccggcugg

SEQ ID NO: 3347197 - RNA, 15 nt, Human
gcuggguguggcgca

SEQ ID NO: 3347198 - RNA, 19 nt, Human
gcugggcagaggaaagcaa

SEQ ID NO: 3347199 - RNA, 16 nt, Human
gcugggcagaggaaag

SEQ ID NO: 3347200 - RNA, 17 nt, Human
gcugggcagaggaaagc

SEQ ID NO: 3347201 - RNA, 12 nt, Human
gcugggcucccu

SEQ ID NO: 3347202 - RNA, 16 nt, Human
gcugggcucccuuccc

SEQ ID NO: 3347203 - RNA, 17 nt, Human
gcugggcucccuuccca

SEQ ID NO: 3347204 - RNA, 20 nt, Human
gcugggcucccuucccaccu

SEQ ID NO: 3347205 - RNA, 18 nt, Human
gcuggccuggccccucag

SEQ ID NO: 3347206 - RNA, 16 nt, Human
gcugggauuacaggug

SEQ ID NO: 3347207 - RNA, 16 nt, Human
gcuggccuggccccuc

SEQ ID NO: 3347208 - RNA, 17 nt, Human
gcuggccuggccccuca

SEQ ID NO: 3347209 - RNA, 15 nt, Human
gcuggagugcaguga

SEQ ID NO: 3347210 - RNA, 14 nt, Human
gcuggagugcagug

SEQ ID NO: 3347211 - RNA, 14 nt, Human
gcugggcagaggaa

SEQ ID NO: 3347212 - RNA, 15 nt, Human
gcugggcagaggaaa

SEQ ID NO: 3347213 - RNA, 13 nt, Human
gcugggcagagga

SEQ ID NO: 3347214 - RNA, 18 nt, Human
gcugggauuacaggugug

SEQ ID NO: 3347215 - RNA, 19 nt, Human
gcugggauuacagguguga

SEQ ID NO: 3347216 - RNA, 12 nt, Human
gcuggagugcag

SEQ ID NO: 3347217 - RNA, 22 nt, Human
gcuggaccuugaacuggguacu

SEQ ID NO: 3347218 - RNA, 14 nt, Human
gcuuguacauaaug

SEQ ID NO: 3347219 - RNA, 16 nt, Human
gcuuguacauaaugcg

SEQ ID NO: 3347220 - RNA, 22 nt, Human
gcuuggggaccagagcugccac

SEQ ID NO: 3347221 - RNA, 19 nt, Human
gcugugcugcccugcccac

SEQ ID NO: 3347222 - RNA, 22 nt, Human
gcugugcugcccugcccaccug

SEQ ID NO: 3347223 - RNA, 22 nt, Human
gcuguuggcugggggccucagu

SEQ ID NO: 3347224 - RNA, 21 nt, Human
gcuguuggcugggggccucag

SEQ ID NO: 3347225 - RNA, 12 nt, Human
gcugugcugccc

SEQ ID NO: 3347226 - RNA, 21 nt, Human
gcugugcucuggacaggcaug

SEQ ID NO: 3347227 - RNA, 13 nt, Human
gcugugcugcccu

SEQ ID NO: 3347228 - RNA, 18 nt, Human
gcugugcucuggacaggc

SEQ ID NO: 3347229 - RNA, 17 nt, Human
gcugugcugcccugccc

SEQ ID NO: 3347230 - RNA, 22 nt, Human
gcuucaaggauccugagccaga

SEQ ID NO: 3347231 - RNA, 19 nt, Human
gcuucacggaagagccuug

SEQ ID NO: 3347232 - RNA, 20 nt, Human
gcuucacggaagagccuugc

SEQ ID NO: 3347233 - RNA, 19 nt, Human
gcuguaucccaugagccuc

SEQ ID NO: 3347234 - RNA, 23 nt, Human
gcuguaucccaugagccucagca

SEQ ID NO: 3347235 - RNA, 20 nt, Human
gcuguaucccaugagccuca

SEQ ID NO: 3347236 - RNA, 15 nt, Human
gcuggguucuaccca

SEQ ID NO: 3347237 - RNA, 15 nt, Human
gcuggguucugaucc

SEQ ID NO: 3347238 - RNA, 21 nt, Human
gcuggguuggaggguguccca

SEQ ID NO: 3347239 - RNA, 14 nt, Human
gcuggguuggaggg

SEQ ID NO: 3347240 - RNA, 21 nt, Human
gcuggguucuacccaggugcu

SEQ ID NO: 3347241 - RNA, 24 nt, Human
gccauguuggccaggcuggucuca

SEQ ID NO: 3347242 - RNA, 22 nt, Human
gccauguuggccaggcuggucu

SEQ ID NO: 3347243 - RNA, 20 nt, Human
gccauguuggccaggcuggu

SEQ ID NO: 3347244 - RNA, 19 nt, Human
gccauguuggccaggcugg

SEQ ID NO: 3347245 - RNA, 13 nt, Human
gcccacgccccca

SEQ ID NO: 3347246 - RNA, 14 nt, Human
gcccacgcccccac

SEQ ID NO: 3347247 - RNA, 18 nt, Human
gcccaccuuggcucaagu

SEQ ID NO: 3347248 - RNA, 17 nt, Human
gcccaccuuggcucaag

SEQ ID NO: 3347249 - RNA, 17 nt, Human
gcccacgcuggagugca

SEQ ID NO: 3347250 - RNA, 16 nt, Human
gcccacgcuggagugc

SEQ ID NO: 3347251 - RNA, 15 nt, Human
gcccacgcuggagug

SEQ ID NO: 3347252 - RNA, 14 nt, Human
gccauguuggccag

SEQ ID NO: 3347253 - RNA, 18 nt, Human
gccauguuggccaggcug

SEQ ID NO: 3347254 - RNA, 17 nt, Human
gccauguuggccaggcu

SEQ ID NO: 3347255 - RNA, 16 nt, Human
gccauguuggccaggc

SEQ ID NO: 3347256 - RNA, 15 nt, Human
gccauguuggccagg

SEQ ID NO: 3347257 - RNA, 20 nt, Human
gccauauucuguuggccagu

SEQ ID NO: 3347258 - RNA, 19 nt, Human
gccauauucuguuggccag

SEQ ID NO: 3347259 - RNA, 13 nt, Human
gccagcaggcucu

SEQ ID NO: 3347260 - RNA, 16 nt, Human
gccagcaggcucucag

SEQ ID NO: 3347261 - RNA, 21 nt, Human
gccagcaggcucucaggccag

SEQ ID NO: 3347262 - RNA, 17 nt, Human
gccagcaggcucucagg

SEQ ID NO: 3347263 - RNA, 18 nt, Human
gccagcaggcucucaggc

SEQ ID NO: 3347264 - RNA, 19 nt, Human
gccagcaggcucucaggcc

SEQ ID NO: 3347265 - RNA, 20 nt, Human
gccagcaggcucucaggcca

SEQ ID NO: 3347266 - RNA, 15 nt, Human
gccaggcccucugcc

SEQ ID NO: 3347267 - RNA, 16 nt, Human
gccaggcccucugccc

SEQ ID NO: 3347268 - RNA, 17 nt, Human
gccaggcccucugccca

SEQ ID NO: 3347269 - RNA, 19 nt, Human
gccaggcccucugcccacu

SEQ ID NO: 3347270 - RNA, 20 nt, Human
gccaggcccucugcccacuc

SEQ ID NO: 3347271 - RNA, 21 nt, Human
gccaggcccucugcccacucc

SEQ ID NO: 3347272 - RNA, 12 nt, Human
gccaggccagag

SEQ ID NO: 3347273 - RNA, 23 nt, Human
gccaggccacaagacccuugugg

SEQ ID NO: 3347274 - RNA, 23 nt, Human
gccacugcaccgggccacagaga

SEQ ID NO: 3347275 - RNA, 19 nt, Human
gccacccuggggagaaagu

SEQ ID NO: 3347276 - RNA, 13 nt, Human
gccacccugggga

SEQ ID NO: 3347277 - RNA, 21 nt, Human
gccacugcacuauagccuagg

SEQ ID NO: 3347278 - RNA, 22 nt, Human
gccacugcaccgggccacagag

SEQ ID NO: 3347279 - RNA, 18 nt, Human
gccacugugaagagaacc

SEQ ID NO: 3347280 - RNA, 19 nt, Human
gccacugugaagagaacca

SEQ ID NO: 3347281 - RNA, 20 nt, Human
gccaccaacauacucccauc

SEQ ID NO: 3347282 - RNA, 21 nt, Human
gccaccaacauacucccaucu

SEQ ID NO: 3347283 - RNA, 19 nt, Human
gccaccaacauacucccau

SEQ ID NO: 3347284 - RNA, 22 nt, Human
gccaccaacauacucccaucug

SEQ ID NO: 3347285 - RNA, 16 nt, Human
gccacauuccugaugc

SEQ ID NO: 3347286 - RNA, 20 nt, Human
gccacauuccugaugcuucu

SEQ ID NO: 3347287 - RNA, 12 nt, Human
gccucuucucua

SEQ ID NO: 3347288 - RNA, 23 nt, Human
gccucuucucuacucuagggaaa

SEQ ID NO: 3347289 - RNA, 19 nt, Human
gccugcccaggccccugcc

SEQ ID NO: 3347290 - RNA, 18 nt, Human
gccugcccaggccccugc

SEQ ID NO: 3347291 - RNA, 17 nt, Human
gccugcccaggccccug

SEQ ID NO: 3347292 - RNA, 12 nt, Human
gccucugggacu

SEQ ID NO: 3347293 - RNA, 18 nt, Human
gccuccugcccuuaccug

SEQ ID NO: 3347294 - RNA, 13 nt, Human
gccuccuccagcc

SEQ ID NO: 3347295 - RNA, 18 nt, Human
gccugggaucccucaucc

SEQ ID NO: 3347296 - RNA, 22 nt, Human
gccugggaggucaaggcugcag

SEQ ID NO: 3347297 - RNA, 14 nt, Human
gccugggaucccuc

SEQ ID NO: 3347298 - RNA, 21 nt, Human
gccugggaggucaaggcugca

SEQ ID NO: 3347299 - RNA, 10 nt, Human
gccuggccug

SEQ ID NO: 3347300 - RNA, 14 nt, Human
gccuggccccucag

SEQ ID NO: 3347301 - RNA, 20 nt, Human
gccuggccccucaggguccc

SEQ ID NO: 3347302 - RNA, 22 nt, Human
gccuggccccucagggucccug

SEQ ID NO: 3347303 - RNA, 16 nt, Human
gccuggccccucaggg

SEQ ID NO: 3347304 - RNA, 17 nt, Human
gccuggccccucagggu

SEQ ID NO: 3347305 - RNA, 15 nt, Human
gccuggccccucagg

SEQ ID NO: 3347306 - RNA, 16 nt, Human
gccugccucuucucua

SEQ ID NO: 3347307 - RNA, 14 nt, Human
gcccacucccugca

SEQ ID NO: 3347308 - RNA, 15 nt, Human
gcccacucccugcaa

SEQ ID NO: 3347309 - RNA, 19 nt, Human
gcccacucccugcaaccug

SEQ ID NO: 3347310 - RNA, 13 nt, Human
gcccacucccugc

SEQ ID NO: 3347311 - RNA, 14 nt, Human
gccccugcccggcu

SEQ ID NO: 3347312 - RNA, 13 nt, Human
gccccugcccggc

SEQ ID NO: 3347313 - RNA, 18 nt, Human
gccccaaaacucuccucu

SEQ ID NO: 3347314 - RNA, 15 nt, Human
gccccuggaugcagc

SEQ ID NO: 3347315 - RNA, 16 nt, Human
gccccuggaugcagcc

SEQ ID NO: 3347316 - RNA, 18 nt, Human
gccccuggaugcagccuc

SEQ ID NO: 3347317 - RNA, 22 nt, Human
gccccuggaugcagccucacag

SEQ ID NO: 3347318 - RNA, 22 nt, Human
gcccuaaaguguauuuuuuuac

SEQ ID NO: 3347319 - RNA, 15 nt, Human
gccgccaugcuccug

SEQ ID NO: 3347320 - RNA, 16 nt, Human
gcccuuaccugccagg

SEQ ID NO: 3347321 - RNA, 20 nt, Human
gcccuuaccugccaggaagc

SEQ ID NO: 3347322 - RNA, 16 nt, Human
gccgccaugcuccugg

SEQ ID NO: 3347323 - RNA, 21 nt, Human
gcccugugggcccccaaaugg

SEQ ID NO: 3347324 - RNA, 16 nt, Human
gcccugccuccuuugu

SEQ ID NO: 3347325 - RNA, 22 nt, Human
gcccugccuccuuugugaggaa

SEQ ID NO: 3347326 - RNA, 14 nt, Human
gcccugccuccuuu

SEQ ID NO: 3347327 - RNA, 13 nt, Human
ggccucccaacuc

SEQ ID NO: 3347328 - RNA, 14 nt, Human
ggccucccaacuca

SEQ ID NO: 3347329 - RNA, 23 nt, Human
ggccagagggagugacagaggca

SEQ ID NO: 3347330 - RNA, 22 nt, Human
ggccagagggagugacagaggc

SEQ ID NO: 3347331 - RNA, 13 nt, Human
ggccaagguggga

SEQ ID NO: 3347332 - RNA, 20 nt, Human
ggccagaugcaccagcccuu

SEQ ID NO: 3347333 - RNA, 19 nt, Human
ggccagaugcaccagcccu

SEQ ID NO: 3347334 - RNA, 17 nt, Human
ggccagaugcaccagcc

SEQ ID NO: 3347335 - RNA, 12 nt, Human
ggcauuguggga

SEQ ID NO: 3347336 - RNA, 21 nt, Human
ggccaaacucaccugccccuc

SEQ ID NO: 3347337 - RNA, 12 nt, Human
ggccaaaggaag

SEQ ID NO: 3347338 - RNA, 15 nt, Human
ggccaaagccaaagc

SEQ ID NO: 3347339 - RNA, 21 nt, Human
ggccaaaggaagcacaugccu

SEQ ID NO: 3347340 - RNA, 23 nt, Human
ggauuaaacuuaaucuaaaugga

SEQ ID NO: 3347341 - RNA, 21 nt, Human
ggauuuugauccaagcugguc

SEQ ID NO: 3347342 - RNA, 22 nt, Human
ggaugagaaagguugaagcacc

SEQ ID NO: 3347343 - RNA, 12 nt, Human
ggaugagaaagg

SEQ ID NO: 3347344 - RNA, 21 nt, Human
ggaugaauuccaaauucugcu

SEQ ID NO: 3347345 - RNA, 14 nt, Human
ggcagccaggccac

SEQ ID NO: 3347346 - RNA, 10 nt, Human
ggcagagcag

SEQ ID NO: 3347347 - RNA, 15 nt, Human
ggcagccaggccaca

SEQ ID NO: 3347348 - RNA, 17 nt, Human
ggcagccaggccacaag

SEQ ID NO: 3347349 - RNA, 12 nt, Human
ggcagaaggaag

SEQ ID NO: 3347350 - RNA, 13 nt, Human
ggagcagccacau

SEQ ID NO: 3347351 - RNA, 21 nt, Human
ggagcagccacauuccugaug

SEQ ID NO: 3347352 - RNA, 18 nt, Human
ggaggucgaggcaggagg

SEQ ID NO: 3347353 - RNA, 15 nt, Human
ggaggucgaggcagg

SEQ ID NO: 3347354 - RNA, 16 nt, Human
ggaggucgaggcagga

SEQ ID NO: 3347355 - RNA, 14 nt, Human
ggaggucgaggcag

SEQ ID NO: 3347356 - RNA, 22 nt, Human
ggagcugccuguucagcuccag

SEQ ID NO: 3347357 - RNA, 12 nt, Human
ggaggccagccu

SEQ ID NO: 3347358 - RNA, 18 nt, Human
ggaggccaaggugggagg

SEQ ID NO: 3347359 - RNA, 13 nt, Human
ggaggccagccuu

SEQ ID NO: 3347360 - RNA, 21 nt, Human
ggaggcaugugaugagaggaa

SEQ ID NO: 3347361 - RNA, 12 nt, Human
ggaggaagagaa

SEQ ID NO: 3347362 - RNA, 15 nt, Human
ggagagcuagcagca

SEQ ID NO: 3347363 - RNA, 22 nt, Human
ggagagccuuccagggguggga

SEQ ID NO: 3347364 - RNA, 17 nt, Human
ggagagccuuccagggg

SEQ ID NO: 3347365 - RNA, 18 nt, Human
ggagagccuuccaggggu

SEQ ID NO: 3347366 - RNA, 13 nt, Human
ggagagccuucca

SEQ ID NO: 3347367 - RNA, 16 nt, Human
ggagagccuuccaggg

SEQ ID NO: 3347368 - RNA, 17 nt, Human
ggacuuggaagcuccgc

SEQ ID NO: 3347369 - RNA, 15 nt, Human
ggacuuggaagcucc

SEQ ID NO: 3347370 - RNA, 19 nt, Human
ggagaaaauggacguguua

SEQ ID NO: 3347371 - RNA, 9 nt, Human
ggacuuugu

SEQ ID NO: 3347372 - RNA, 22 nt, Human
ggagaaccaaaaagaggcuaug

SEQ ID NO: 3347373 - RNA, 20 nt, Human
ggacuacaggugugagucac

SEQ ID NO: 3347374 - RNA, 22 nt, Human
ggacucaaugcacugacauugu

SEQ ID NO: 3347375 - RNA, 18 nt, Human
ggacucaaugcacugaca

SEQ ID NO: 3347376 - RNA, 15 nt, Human
ggacccugaggccca

SEQ ID NO: 3347377 - RNA, 18 nt, Human
ggacccugaggcccagag

SEQ ID NO: 3347378 - RNA, 14 nt, Human
ggacccugaggccc

SEQ ID NO: 3347379 - RNA, 13 nt, Human
ggacccugaggcc

SEQ ID NO: 3347380 - RNA, 12 nt, Human
gcuuguacauaa

SEQ ID NO: 3347381 - RNA, 19 nt, Human
gcuuguacauaaugcgugc

SEQ ID NO: 3347382 - RNA, 16 nt, Human
aaacuggauuaaacuu

SEQ ID NO: 3347383 - RNA, 16 nt, Human
aaacguggcugcuuca

SEQ ID NO: 3347384 - RNA, 17 nt, Human
aaacguggcugcuucaa

SEQ ID NO: 3347385 - RNA, 23 nt, Human
gggucucacuauguugcccaggc

SEQ ID NO: 3347386 - RNA, 22 nt, Human
gggucucacuauguugcccagg

SEQ ID NO: 3347387 - RNA, 15 nt, Human
aaacauuggauuauc

SEQ ID NO: 3347388 - RNA, 22 nt, Human
gggucacucuggcagcucagag

SEQ ID NO: 3347389 - RNA, 20 nt, Human
ggguaucaggugcugccauc

SEQ ID NO: 3347390 - RNA, 17 nt, Human
ggggccaguuggucccc

SEQ ID NO: 3347391 - RNA, 16 nt, Human
ggggcccugccuccuu

SEQ ID NO: 3347392 - RNA, 15 nt, Human
ggggcccugccuccu

SEQ ID NO: 3347393 - RNA, 19 nt, Human
ggggcccugccuccuuugu

SEQ ID NO: 3347394 - RNA, 23 nt, Human
ggggcccugccuccuuugugagg

SEQ ID NO: 3347395 - RNA, 13 nt, Human
ggggaccucaggc

SEQ ID NO: 3347396 - RNA, 15 nt, Human
ggggaccucaggccu

SEQ ID NO: 3347397 - RNA, 16 nt, Human
ggggaccucaggccug

SEQ ID NO: 3347398 - RNA, 17 nt, Human
ggggaccucaggccugg

SEQ ID NO: 3347399 - RNA, 24 nt, Human
ggggaaaaucagccugcuccagcu

SEQ ID NO: 3347400 - RNA, 22 nt, Human
aaacaugcuacacacugcaugu

SEQ ID NO: 3347401 - RNA, 16 nt, Human
aaacaugcuacacacu

SEQ ID NO: 3347402 - RNA, 19 nt, Human
aaacacaaacgggcucagc

SEQ ID NO: 3347403 - RNA, 21 nt, Human
aaacacacgcgcgcacacaca

SEQ ID NO: 3347404 - RNA, 21 nt, Human
aaaauguaggguuauaauaau

SEQ ID NO: 3347405 - RNA, 21 nt, Human
aaaauggacguguuaugacuc

SEQ ID NO: 3347406 - RNA, 20 nt, Human
aaaauggaagacagcucuua

SEQ ID NO: 3347407 - RNA, 23 nt, Human
aaacaaacuuuucaaggcuuaua

SEQ ID NO: 3347408 - RNA, 19 nt, Human
aaagacuuuuccaacccuc

SEQ ID NO: 3347409 - RNA, 15 nt, Human
aaagacuguacaaag

SEQ ID NO: 3347410 - RNA, 14 nt, Human
aaagacuguacaaa

SEQ ID NO: 3347411 - RNA, 13 nt, Human
aaagaggcuaugu

SEQ ID NO: 3347412 - RNA, 18 nt, Human
aaagaggcuaugugagca

SEQ ID NO: 3347413 - RNA, 15 nt, Human
aaagaugagugagca

SEQ ID NO: 3347414 - RNA, 12 nt, Human
ggucccacccca

SEQ ID NO: 3347415 - RNA, 22 nt, Human
gguccacccaggagccccgagg

SEQ ID NO: 3347416 - RNA, 20 nt, Human
gguccacccaggagccccga

SEQ ID NO: 3347417 - RNA, 14 nt, Human
aaacuuuaccuuuu

SEQ ID NO: 3347418 - RNA, 19 nt, Human
gguccacccaggagccccg

SEQ ID NO: 3347419 - RNA, 23 nt, Human
gguauuggcuagagguucaaaga

SEQ ID NO: 3347420 - RNA, 16 nt, Human
aaagcagugcaugcug

SEQ ID NO: 3347421 - RNA, 21 nt, Human
aaagcagugcaugcugucccu

SEQ ID NO: 3347422 - RNA, 22 nt, Human
aaagcagugcaugcugucccuu

SEQ ID NO: 3347423 - RNA, 18 nt, Human
aaagcuaggccuggccag

SEQ ID NO: 3347424 - RNA, 17 nt, Human
aaagcuaggccuggcca

SEQ ID NO: 3347425 - RNA, 17 nt, Human
aaagcagugcaugcugu

SEQ ID NO: 3347426 - RNA, 11 nt, Human
aaaggaaagag

SEQ ID NO: 3347427 - RNA, 16 nt, Human
ggugcacaagcuccaa

SEQ ID NO: 3347428 - RNA, 22 nt, Human
ggugcacaagcuccaagcuccc

SEQ ID NO: 3347429 - RNA, 17 nt, Human
ggucuguucuuuccaaa

SEQ ID NO: 3347430 - RNA, 19 nt, Human
ggucuguucuuuccaaagu

SEQ ID NO: 3347431 - RNA, 22 nt, Human
ggucuugaacuccuggccucaa

SEQ ID NO: 3347432 - RNA, 21 nt, Human
ggucuugaacuccuggccuca

SEQ ID NO: 3347433 - RNA, 12 nt, Human
ggucuguucuuu

SEQ ID NO: 3347434 - RNA, 15 nt, Human
aaaauaccagccagu

SEQ ID NO: 3347435 - RNA, 14 nt, Human
aaaauaccaaggaa

SEQ ID NO: 3347436 - RNA, 14 nt, Human
aaaauaccagccag

SEQ ID NO: 3347437 - RNA, 12 nt, Human
aaaauaaauuau

SEQ ID NO: 3347438 - RNA, 12 nt, Human
aaaauagccugc

SEQ ID NO: 3347439 - RNA, 18 nt, Human
aaaauaguggugugauuu

SEQ ID NO: 3347440 - RNA, 23 nt, Human
aaaauauauauagaaauauauac

SEQ ID NO: 3347441 - RNA, 10 nt, Human
aaaauauaua

SEQ ID NO: 3347442 - RNA, 23 nt, Human
gggcagagcagagaccaucccug

SEQ ID NO: 3347443 - RNA, 15 nt, Human
gggauuuccaugaug

SEQ ID NO: 3347444 - RNA, 18 nt, Human
gggagggcuccagacaca

SEQ ID NO: 3347445 - RNA, 18 nt, Human
aaaacugauuuuuuuuuc

SEQ ID NO: 3347446 - RNA, 22 nt, Human
aaaacugauuuuuuuuuccuuc

SEQ ID NO: 3347447 - RNA, 21 nt, Human
aaaacguggcugcuucaagga

SEQ ID NO: 3347448 - RNA, 14 nt, Human
aaaacguggcugcu

SEQ ID NO: 3347449 - RNA, 16 nt, Human
aaaacguggcugcuuc

SEQ ID NO: 3347450 - RNA, 17 nt, Human
aaaacguggcugcuuca

SEQ ID NO: 3347451 - RNA, 18 nt, Human
aaaacguggcugcuucaa

SEQ ID NO: 3347452 - RNA, 15 nt, Human
aaaaccaauguucuc

SEQ ID NO: 3347453 - RNA, 19 nt, Human
aaaaaucucaaauuucuaa

SEQ ID NO: 3347454 - RNA, 20 nt, Human
aaaaaucucaaauuucuaaa

SEQ ID NO: 3347455 - RNA, 17 nt, Human
aaaaaucucaaauuucu

SEQ ID NO: 3347456 - RNA, 22 nt, Human
gggaacagacuggaagcacagc

SEQ ID NO: 3347457 - RNA, 14 nt, Human
gggaacagacugga

SEQ ID NO: 3347458 - RNA, 14 nt, Human
aaaagcugggcagg

SEQ ID NO: 3347459 - RNA, 22 nt, Human
aaaacuugauguguuaucucuu

SEQ ID NO: 3347460 - RNA, 11 nt, Human
gggagggcucc

SEQ ID NO: 3347461 - RNA, 20 nt, Human
ggcucuuccaggcugggaga

SEQ ID NO: 3347462 - RNA, 23 nt, Human
ggcucuuccaggcugggagagcc

SEQ ID NO: 3347463 - RNA, 24 nt, Human
ggcucuuccaggcugggagagccu

SEQ ID NO: 3347464 - RNA, 18 nt, Human
ggcucgagcaugccugga

SEQ ID NO: 3347465 - RNA, 17 nt, Human
ggcugcagggaguccga

SEQ ID NO: 3347466 - RNA, 20 nt, Human
ggcugcaugcgggcuuccuc

SEQ ID NO: 3347467 - RNA, 21 nt, Human
ggcugccaaugggagcucaug

SEQ ID NO: 3347468 - RNA, 20 nt, Human
ggcucccuucccaccucucu

SEQ ID NO: 3347469 - RNA, 22 nt, Human
ggcucccuucccaccucucuca

SEQ ID NO: 3347470 - RNA, 17 nt, Human
ggcucccuucccaccuc

SEQ ID NO: 3347471 - RNA, 18 nt, Human
ggcucccuucccaccucu

SEQ ID NO: 3347472 - RNA, 16 nt, Human
ggcucccuucccaccu

SEQ ID NO: 3347473 - RNA, 13 nt, Human
ggcucccuuccca

SEQ ID NO: 3347474 - RNA, 17 nt, Human
ggcuggccuggccccuc

SEQ ID NO: 3347475 - RNA, 22 nt, Human
ggcuggccuggccccucagggu

SEQ ID NO: 3347476 - RNA, 20 nt, Human
ggcuggcgugcaguggugcg

SEQ ID NO: 3347477 - RNA, 16 nt, Human
ggcuggcgugcagugg

SEQ ID NO: 3347478 - RNA, 14 nt, Human
ggcuggcgugcagu

SEQ ID NO: 3347479 - RNA, 15 nt, Human
ggcuggccuggcccc

SEQ ID NO: 3347480 - RNA, 23 nt, Human
gggaaaaucagccugcuccagcu

SEQ ID NO: 3347481 - RNA, 13 nt, Human
gggaaaaucagcc

SEQ ID NO: 3347482 - RNA, 14 nt, Human
ggcuuuugugcauu

SEQ ID NO: 3347483 - RNA, 16 nt, Human
ggcuucaguggcagcu

SEQ ID NO: 3347484 - RNA, 16 nt, Human
ggcuggugucaccuga

SEQ ID NO: 3347485 - RNA, 19 nt, Human
ggcuguaucccaugagccu

SEQ ID NO: 3347486 - RNA, 15 nt, Human
ggcugucaauuacag

SEQ ID NO: 3347487 - RNA, 23 nt, Human
ggcuguaucccaugagccucagc

SEQ ID NO: 3347488 - RNA, 22 nt, Human
ggcuguaucccaugagccucag

SEQ ID NO: 3347489 - RNA, 20 nt, Human
ggcuguaucccaugagccuc

SEQ ID NO: 3347490 - RNA, 15 nt, Human
ggcuucaguggcagc

SEQ ID NO: 3347491 - RNA, 12 nt, Human
gaacuggcugca

SEQ ID NO: 3347492 - RNA, 11 nt, Human
gaacuggcugc

SEQ ID NO: 3347493 - RNA, 15 nt, Human
gaacuccuggccuca

SEQ ID NO: 3347494 - RNA, 16 nt, Human
gaagacaaugacuuac

SEQ ID NO: 3347495 - RNA, 22 nt, Human
gaagacaaugacuuacuguaca

SEQ ID NO: 3347496 - RNA, 23 nt, Human
gaagacaaugugaaaagaaaaau

SEQ ID NO: 3347497 - RNA, 23 nt, Human
gaagauuuugaaauuuuuauuaa

SEQ ID NO: 3347498 - RNA, 17 nt, Human
gaagcacaugccucucu

SEQ ID NO: 3347499 - RNA, 20 nt, Human
gaagcacaugccucucucag

SEQ ID NO: 3347500 - RNA, 15 nt, Human
gaagcacaugccucu

SEQ ID NO: 3347501 - RNA, 14 nt, Human
gaagcacaugccuc

SEQ ID NO: 3347502 - RNA, 15 nt, Human
gaagcagaggaagga

SEQ ID NO: 3347503 - RNA, 19 nt, Human
gaagcuccgcuuucuaccc

SEQ ID NO: 3347504 - RNA, 17 nt, Human
gaaggccccgcccaggc

SEQ ID NO: 3347505 - RNA, 22 nt, Human
gaagcuccgcuuucuacccagc

SEQ ID NO: 3347506 - RNA, 15 nt, Human
gaaggcuggguucug

SEQ ID NO: 3347507 - RNA, 19 nt, Human
gaaggcuggguucugaucc

SEQ ID NO: 3347508 - RNA, 19 nt, Human
gaaggcucgagcaugccug

SEQ ID NO: 3347509 - RNA, 18 nt, Human
gaaggccccgcccaggcu

SEQ ID NO: 3347510 - RNA, 19 nt, Human
gaaggccccgcccaggcuu

SEQ ID NO: 3347511 - RNA, 21 nt, Human
gaaggcucgagcaugccugga

SEQ ID NO: 3347512 - RNA, 20 nt, Human
gaaggcuggguucugauccu

SEQ ID NO: 3347513 - RNA, 22 nt, Human
gaaggcuggguucugauccuag

SEQ ID NO: 3347514 - RNA, 22 nt, Human
gaaggggagauaaggguaucug

SEQ ID NO: 3347515 - RNA, 14 nt, Human
gaauauugcugaug

SEQ ID NO: 3347516 - RNA, 15 nt, Human
gaauauugcugaugg

SEQ ID NO: 3347517 - RNA, 19 nt, Human
gaauauugcugauggugca

SEQ ID NO: 3347518 - RNA, 13 nt, Human
gaauauugcugau

SEQ ID NO: 3347519 - RNA, 17 nt, Human
gacagcccgggcucugc

SEQ ID NO: 3347520 - RNA, 22 nt, Human
gacacagcucuucuccaggcug

SEQ ID NO: 3347521 - RNA, 21 nt, Human
gacacagcucuucuccaggcu

SEQ ID NO: 3347522 - RNA, 23 nt, Human
gacacagcucuucuccaggcugu

SEQ ID NO: 3347523 - RNA, 16 nt, Human
gacacagcucuucucc

SEQ ID NO: 3347524 - RNA, 14 nt, Human
gacacagcucuucu

SEQ ID NO: 3347525 - RNA, 13 nt, Human
gacacagcucuuc

SEQ ID NO: 3347526 - RNA, 15 nt, Human
gacauugcggacagc

SEQ ID NO: 3347527 - RNA, 14 nt, Human
gacauugcggacag

SEQ ID NO: 3347528 - RNA, 18 nt, Human
gacagcccgggcucugcc

SEQ ID NO: 3347529 - RNA, 19 nt, Human
gacagcccgggcucugccu

SEQ ID NO: 3347530 - RNA, 16 nt, Human
gacagcccgggcucug

SEQ ID NO: 3347531 - RNA, 19 nt, Human
gacauuguuggccaaagcc

SEQ ID NO: 3347532 - RNA, 12 nt, Human
gaccaucccuga

SEQ ID NO: 3347533 - RNA, 13 nt, Human
gaccaucccugaa

SEQ ID NO: 3347534 - RNA, 18 nt, Human
gaccaucccugaaggccc

SEQ ID NO: 3347535 - RNA, 19 nt, Human
gaccaucccugaaggcccc

SEQ ID NO: 3347536 - RNA, 20 nt, Human
gaccagggauuuccaugaug

SEQ ID NO: 3347537 - RNA, 18 nt, Human
gaccagggauuuccauga

SEQ ID NO: 3347538 - RNA, 11 nt, Human
gaccugaggcc

SEQ ID NO: 3347539 - RNA, 13 nt, Human
gaccugaggcccu

SEQ ID NO: 3347540 - RNA, 16 nt, Human
gacgccaucccagccc

SEQ ID NO: 3347541 - RNA, 13 nt, Human
gaccucugccuga

SEQ ID NO: 3347542 - RNA, 20 nt, Human
gaccaucccugaaggccccg

SEQ ID NO: 3347543 - RNA, 17 nt, Human
gacgccaucccagcccc

SEQ ID NO: 3347544 - RNA, 18 nt, Human
gacgccaucccagcccca

SEQ ID NO: 3347545 - RNA, 15 nt, Human
gacgccaucccagcc

SEQ ID NO: 3347546 - RNA, 16 nt, Human
gacgcuacccgggaag

SEQ ID NO: 3347547 - RNA, 18 nt, Human
gacgcuacccgggaaggg

SEQ ID NO: 3347548 - RNA, 14 nt, Human
gacugaauuucuuu

SEQ ID NO: 3347549 - RNA, 19 nt, Human
gacucugucucaaaaaaac

SEQ ID NO: 3347550 - RNA, 13 nt, Human
gacuuuauaagcc

SEQ ID NO: 3347551 - RNA, 17 nt, Human
gagccuuccaggggugg

SEQ ID NO: 3347552 - RNA, 13 nt, Human
gagccuugaacuu

SEQ ID NO: 3347553 - RNA, 23 nt, Human
gagccuuccaggggugggacacc

SEQ ID NO: 3347554 - RNA, 20 nt, Human
gagccuuccaggggugggac

SEQ ID NO: 3347555 - RNA, 13 nt, Human
gaggccagagaca

SEQ ID NO: 3347556 - RNA, 14 nt, Human
gaggccagagacac

SEQ ID NO: 3347557 - RNA, 22 nt, Human
gaggcuagugugguguuuccug

SEQ ID NO: 3347558 - RNA, 22 nt, Human
gaggcagggucucacucugucg

SEQ ID NO: 3347559 - RNA, 15 nt, Human
gaggcagggucucac

SEQ ID NO: 3347560 - RNA, 17 nt, Human
gaggccaaggugggagg

SEQ ID NO: 3347561 - RNA, 22 nt, Human
gaggccaaggugggaggauugc

SEQ ID NO: 3347562 - RNA, 14 nt, Human
gaggcagggucuca

SEQ ID NO: 3347563 - RNA, 23 nt, Human
gaggugaccccagguuucuaugu

SEQ ID NO: 3347564 - RNA, 15 nt, Human
gaggucgaggcagga

SEQ ID NO: 3347565 - RNA, 20 nt, Human
gagugacagaggcagcccca

SEQ ID NO: 3347566 - RNA, 15 nt, Human
gaguugauucagcuc

SEQ ID NO: 3347567 - RNA, 16 nt, Human
gaguugauucagcucu

SEQ ID NO: 3347568 - RNA, 17 nt, Human
gaguugauucagcucug

SEQ ID NO: 3347569 - RNA, 22 nt, Human
gaguugauagcacagacccugc

SEQ ID NO: 3347570 - RNA, 17 nt, Human
gagucaccaagcccagu

SEQ ID NO: 3347571 - RNA, 18 nt, Human
gagucagaaguuucugcc

SEQ ID NO: 3347572 - RNA, 16 nt, Human
gagucaccaagcccag

SEQ ID NO: 3347573 - RNA, 15 nt, Human
gagucaccaagccca

SEQ ID NO: 3347574 - RNA, 18 nt, Human
gagugacagaggcagccc

SEQ ID NO: 3347575 - RNA, 17 nt, Human
gagugacagaggcagcc

SEQ ID NO: 3347576 - RNA, 12 nt, Human
gagucccaccuu

SEQ ID NO: 3347577 - RNA, 22 nt, Human
gagucagaaguuucugccgcag

SEQ ID NO: 3347578 - RNA, 22 nt, Human
gaguuguuacauuuuuaagugc

SEQ ID NO: 3347579 - RNA, 18 nt, Human
gaguugauucagcucugc

SEQ ID NO: 3347580 - RNA, 19 nt, Human
gcaagugagagcugggugu

SEQ ID NO: 3347581 - RNA, 22 nt, Human
gcacaagcugcacccucaggca

SEQ ID NO: 3347582 - RNA, 14 nt, Human
gcacaccgggcacu

SEQ ID NO: 3347583 - RNA, 14 nt, Human
gcacacauuuuuua

SEQ ID NO: 3347584 - RNA, 21 nt, Human
gcacaucagcacgauuucugu

SEQ ID NO: 3347585 - RNA, 22 nt, Human
gcacaucagcacgauuucuguu

SEQ ID NO: 3347586 - RNA, 23 nt, Human
gcacaucagcacgauuucuguuu

SEQ ID NO: 3347587 - RNA, 14 nt, Human
gcaccgggccacag

SEQ ID NO: 3347588 - RNA, 23 nt, Human
gcaccgggccacagagaaaguac

SEQ ID NO: 3347589 - RNA, 17 nt, Human
gcacuccccugcugggu

SEQ ID NO: 3347590 - RNA, 16 nt, Human
gcacucagaagacacu

SEQ ID NO: 3347591 - RNA, 13 nt, Human
gcacucagaagac

SEQ ID NO: 3347592 - RNA, 22 nt, Human
gcacuccccugcuggguguggc

SEQ ID NO: 3347593 - RNA, 16 nt, Human
gcacuccccugcuggg

SEQ ID NO: 3347594 - RNA, 16 nt, Human
gcacuugcagacucua

SEQ ID NO: 3347595 - RNA, 12 nt, Human
gauuauuggaaa

SEQ ID NO: 3347596 - RNA, 12 nt, Human
gauuauccugag

SEQ ID NO: 3347597 - RNA, 14 nt, Human
gauucuccugccuc

SEQ ID NO: 3347598 - RNA, 18 nt, Human
gauucuccugccucagcc

SEQ ID NO: 3347599 - RNA, 17 nt, Human
gauucuccugccucagc

SEQ ID NO: 3347600 - RNA, 15 nt, Human
gauucuccugccuca

SEQ ID NO: 3347601 - RNA, 18 nt, Human
gauucuuccucccucccu

SEQ ID NO: 3347602 - RNA, 17 nt, Human
gauucuuccucccuccc

SEQ ID NO: 3347603 - RNA, 14 nt, Human
gaugauccuaggca

SEQ ID NO: 3347604 - RNA, 15 nt, Human
gaugaucuaggaaga

SEQ ID NO: 3347605 - RNA, 21 nt, Human
gaugaucuaggaagacuuugg

SEQ ID NO: 3347606 - RNA, 16 nt, Human
gaugagugagcaugcc

SEQ ID NO: 3347607 - RNA, 22 nt, Human
cuggaugcagccucacaguccu

SEQ ID NO: 3347608 - RNA, 15 nt, Human
cuggaguucugguuc

SEQ ID NO: 3347609 - RNA, 16 nt, Human
cuggaguucugguucc

SEQ ID NO: 3347610 - RNA, 17 nt, Human
cuggaguucugguuccu

SEQ ID NO: 3347611 - RNA, 20 nt, Human
cugcuuaacuucacauauug

SEQ ID NO: 3347612 - RNA, 13 nt, Human
cugcugaaggcuc

SEQ ID NO: 3347613 - RNA, 14 nt, Human
cugcugaaggcucg

SEQ ID NO: 3347614 - RNA, 15 nt, Human
cugcugaaggcucga

SEQ ID NO: 3347615 - RNA, 12 nt, Human
cugcugacagug

SEQ ID NO: 3347616 - RNA, 11 nt, Human
cugcugacagu

SEQ ID NO: 3347617 - RNA, 15 nt, Human
cugcugacaguguug

SEQ ID NO: 3347618 - RNA, 13 nt, Human
cugcugacagugu

SEQ ID NO: 3347619 - RNA, 14 nt, Human
cugcucacauaucu

SEQ ID NO: 3347620 - RNA, 19 nt, Human
cugcucacauaucugucau

SEQ ID NO: 3347621 - RNA, 16 nt, Human
cugcucacauaucugu

SEQ ID NO: 3347622 - RNA, 12 nt, Human
cugcugaaggcu

SEQ ID NO: 3347623 - RNA, 15 nt, Human
cugggacuacaggca

SEQ ID NO: 3347624 - RNA, 13 nt, Human
cugggacuacagg

SEQ ID NO: 3347625 - RNA, 18 nt, Human
cugggacaugggaaaggg

SEQ ID NO: 3347626 - RNA, 22 nt, Human
cugggacaugggaaaggggaag

SEQ ID NO: 3347627 - RNA, 14 nt, Human
cugggacaugggaa

SEQ ID NO: 3347628 - RNA, 13 nt, Human
cuggcuaugcauu

SEQ ID NO: 3347629 - RNA, 14 nt, Human
cuggcuaugcauuu

SEQ ID NO: 3347630 - RNA, 15 nt, Human
cuggcuaugcauuug

SEQ ID NO: 3347631 - RNA, 16 nt, Human
cuggcuaugcauuuga

SEQ ID NO: 3347632 - RNA, 22 nt, Human
cuggcuaugcauuugaaaauuu

SEQ ID NO: 3347633 - RNA, 12 nt, Human
cuggcccuuccu

SEQ ID NO: 3347634 - RNA, 13 nt, Human
cuggggagaaagu

SEQ ID NO: 3347635 - RNA, 18 nt, Human
cuggguggcaccagcagc

SEQ ID NO: 3347636 - RNA, 20 nt, Human
cuggguggcaccagcagccu

SEQ ID NO: 3347637 - RNA, 20 nt, Human
cugggcagguuggugggggc

SEQ ID NO: 3347638 - RNA, 13 nt, Human
cugggcagaggaa

SEQ ID NO: 3347639 - RNA, 16 nt, Human
cugggcagaggaaagc

SEQ ID NO: 3347640 - RNA, 12 nt, Human
cugggcagagga

SEQ ID NO: 3347641 - RNA, 20 nt, Human
cugggcagaggaaagcaaag

SEQ ID NO: 3347642 - RNA, 15 nt, Human
cuggguguggcgcag

SEQ ID NO: 3347643 - RNA, 14 nt, Human
cuggguguggcgca

SEQ ID NO: 3347644 - RNA, 21 nt, Human
cuggguggcaccagcagccug

SEQ ID NO: 3347645 - RNA, 16 nt, Human
cugcccuuaccugcca

SEQ ID NO: 3347646 - RNA, 12 nt, Human
cugcccuuaccu

SEQ ID NO: 3347647 - RNA, 19 nt, Human
cugcccugugggcccccaa

SEQ ID NO: 3347648 - RNA, 17 nt, Human
cugcauuuaaaagauac

SEQ ID NO: 3347649 - RNA, 20 nt, Human
cugccagggacagagggggu

SEQ ID NO: 3347650 - RNA, 22 nt, Human
cugccagggacagagggggugg

SEQ ID NO: 3347651 - RNA, 23 nt, Human
cugccagggacagaggggguggc

SEQ ID NO: 3347652 - RNA, 18 nt, Human
cugccauccagguucagc

SEQ ID NO: 3347653 - RNA, 16 nt, Human
cugccauccagguuca

SEQ ID NO: 3347654 - RNA, 16 nt, Human
cugccauauucuguug

SEQ ID NO: 3347655 - RNA, 12 nt, Human
cugccauccagg

SEQ ID NO: 3347656 - RNA, 14 nt, Human
cugcauuuaaaaga

SEQ ID NO: 3347657 - RNA, 13 nt, Human
cugcauuggcuuu

SEQ ID NO: 3347658 - RNA, 16 nt, Human
cugaugcuucuucaga

SEQ ID NO: 3347659 - RNA, 17 nt, Human
cugaugcuucuucagag

SEQ ID NO: 3347660 - RNA, 14 nt, Human
cucuuaugggcugg

SEQ ID NO: 3347661 - RNA, 15 nt, Human
cucuuaugggcuggg

SEQ ID NO: 3347662 - RNA, 21 nt, Human
cugaugggcaacccccagccu

SEQ ID NO: 3347663 - RNA, 18 nt, Human
cugaugggcaacccccag

SEQ ID NO: 3347664 - RNA, 18 nt, Human
cugaugcuucuucagaga

SEQ ID NO: 3347665 - RNA, 19 nt, Human
cugaugcuucuucagagac

SEQ ID NO: 3347666 - RNA, 20 nt, Human
cugaugcuucuucagagacu

SEQ ID NO: 3347667 - RNA, 22 nt, Human
cugcaaaggguaucaggugcug

SEQ ID NO: 3347668 - RNA, 21 nt, Human
cugcaaaggguaucaggugcu

SEQ ID NO: 3347669 - RNA, 23 nt, Human
cugaugggcaacccccagccugc

SEQ ID NO: 3347670 - RNA, 22 nt, Human
cugaugggcaacccccagccug

SEQ ID NO: 3347671 - RNA, 24 nt, Human
cugaugggcaacccccagccugcu

SEQ ID NO: 3347672 - RNA, 20 nt, Human
cugcaaccuccgccucuugg

SEQ ID NO: 3347673 - RNA, 19 nt, Human
cugcaaccugauugugucu

SEQ ID NO: 3347674 - RNA, 21 nt, Human
cugcaaccugauugugucucu

SEQ ID NO: 3347675 - RNA, 14 nt, Human
cugcaaccugauug

SEQ ID NO: 3347676 - RNA, 22 nt, Human
cugcaaccuccgccucuugggu

SEQ ID NO: 3347677 - RNA, 18 nt, Human
cugcaagaauugaagcag

SEQ ID NO: 3347678 - RNA, 22 nt, Human
cugcaaccugauugugucucuu

SEQ ID NO: 3347679 - RNA, 12 nt, Human
cugcaagggagu

SEQ ID NO: 3347680 - RNA, 20 nt, Human
cugcaagaauugaagcagga

SEQ ID NO: 3347681 - RNA, 20 nt, Human
cugcaccgggccacagagaa

SEQ ID NO: 3347682 - RNA, 23 nt, Human
cugcaccgggccacagagaaagu

SEQ ID NO: 3347683 - RNA, 12 nt, Human
cugcagcuuugu

SEQ ID NO: 3347684 - RNA, 13 nt, Human
cugcaggcagcca

SEQ ID NO: 3347685 - RNA, 14 nt, Human
cugcaggcagccag

SEQ ID NO: 3347686 - RNA, 15 nt, Human
cugcaggcagccagg

SEQ ID NO: 3347687 - RNA, 16 nt, Human
cugcaggcagccaggc

SEQ ID NO: 3347688 - RNA, 17 nt, Human
cugcaggcagccaggcc

SEQ ID NO: 3347689 - RNA, 18 nt, Human
cugcaggcagccaggcca

SEQ ID NO: 3347690 - RNA, 19 nt, Human
cugcaggcagccaggccac

SEQ ID NO: 3347691 - RNA, 20 nt, Human
cugcaggcagccaggccaca

SEQ ID NO: 3347692 - RNA, 17 nt, Human
cugcacuccagccuggg

SEQ ID NO: 3347693 - RNA, 16 nt, Human
cugcacuccagccugg

SEQ ID NO: 3347694 - RNA, 18 nt, Human
cugcacuccagccugggu

SEQ ID NO: 3347695 - RNA, 24 nt, Human
cugcagccucaaccuccugggcua

SEQ ID NO: 3347696 - RNA, 23 nt, Human
cugcagccucaaccuccugggcu

SEQ ID NO: 3347697 - RNA, 20 nt, Human
cugcacuauagccuagguga

SEQ ID NO: 3347698 - RNA, 18 nt, Human
cugcacuauagccuaggu

SEQ ID NO: 3347699 - RNA, 17 nt, Human
cugcacuauagccuagg

SEQ ID NO: 3347700 - RNA, 16 nt, Human
cugcacuauagccuag

SEQ ID NO: 3347701 - RNA, 13 nt, Human
cugcacuccagcc

SEQ ID NO: 3347702 - RNA, 23 nt, Human
cugcacuauagccuaggugacag

SEQ ID NO: 3347703 - RNA, 22 nt, Human
cugcacuauagccuaggugaca

SEQ ID NO: 3347704 - RNA, 15 nt, Human
cugcacuccagccug

SEQ ID NO: 3347705 - RNA, 18 nt, Human
cuuccagugaggcucugc

SEQ ID NO: 3347706 - RNA, 17 nt, Human
cuuccagugaggcucug

SEQ ID NO: 3347707 - RNA, 19 nt, Human
cuuccagugaggcucugcc

SEQ ID NO: 3347708 - RNA, 16 nt, Human
cuuccauggacuuugu

SEQ ID NO: 3347709 - RNA, 17 nt, Human
cuuccauggacuuuguu

SEQ ID NO: 3347710 - RNA, 23 nt, Human
cuucagagacuccugcaggcagc

SEQ ID NO: 3347711 - RNA, 17 nt, Human
cuucaguggcagcugcu

SEQ ID NO: 3347712 - RNA, 18 nt, Human
cuucaguggcagcugcuu

SEQ ID NO: 3347713 - RNA, 13 nt, Human
cuucaucccucug

SEQ ID NO: 3347714 - RNA, 15 nt, Human
cuucauccuccucag

SEQ ID NO: 3347715 - RNA, 16 nt, Human
cuucauccuccucaga

SEQ ID NO: 3347716 - RNA, 17 nt, Human
cuucaccuuugucccca

SEQ ID NO: 3347717 - RNA, 18 nt, Human
cuuauugcccacgcugga

SEQ ID NO: 3347718 - RNA, 14 nt, Human
cuucaccuuugucc

SEQ ID NO: 3347719 - RNA, 20 nt, Human
cuucagagacuccugcaggc

SEQ ID NO: 3347720 - RNA, 16 nt, Human
cuucagagacuccugc

SEQ ID NO: 3347721 - RNA, 21 nt, Human
cuucagagacuccugcaggca

SEQ ID NO: 3347722 - RNA, 22 nt, Human
cuucagagacuccugcaggcag

SEQ ID NO: 3347723 - RNA, 18 nt, Human
cuuagcagggaaacagcu

SEQ ID NO: 3347724 - RNA, 13 nt, Human
cuuauugcccacg

SEQ ID NO: 3347725 - RNA, 12 nt, Human
cuuauugcccac

SEQ ID NO: 3347726 - RNA, 22 nt, Human
cuuaugggcuggguucuaccca

SEQ ID NO: 3347727 - RNA, 23 nt, Human
cuuaugggcuggguucuacccag

SEQ ID NO: 3347728 - RNA, 14 nt, Human
cuuaugggcugggu

SEQ ID NO: 3347729 - RNA, 21 nt, Human
cuuaugggcuggguucuaccc

SEQ ID NO: 3347730 - RNA, 21 nt, Human
cuuauggaacacucugagacu

SEQ ID NO: 3347731 - RNA, 19 nt, Human
cugugcugagucugaaggc

SEQ ID NO: 3347732 - RNA, 11 nt, Human
cugugcugccc

SEQ ID NO: 3347733 - RNA, 20 nt, Human
cugugcugagucugaaggcu

SEQ ID NO: 3347734 - RNA, 22 nt, Human
cugugcugagucugaaggcugg

SEQ ID NO: 3347735 - RNA, 14 nt, Human
cugugucucccuuc

SEQ ID NO: 3347736 - RNA, 19 nt, Human
cugugucucccuucauccu

SEQ ID NO: 3347737 - RNA, 14 nt, Human
cugugucuugcaau

SEQ ID NO: 3347738 - RNA, 21 nt, Human
cugugucagguggggcagcuu

SEQ ID NO: 3347739 - RNA, 19 nt, Human
cugugucagcauagaagua

SEQ ID NO: 3347740 - RNA, 20 nt, Human
cugugucagcauagaaguaa

SEQ ID NO: 3347741 - RNA, 19 nt, Human
cugugucagguggggcagc

SEQ ID NO: 3347742 - RNA, 19 nt, Human
cugugucuugcaauggcag

SEQ ID NO: 3347743 - RNA, 16 nt, Human
cugugucuugcaaugg

SEQ ID NO: 3347744 - RNA, 13 nt, Human
cuguucagcucca

SEQ ID NO: 3347745 - RNA, 13 nt, Human
cuuacacaauggu

SEQ ID NO: 3347746 - RNA, 17 nt, Human
cuguugggccaggagcc

SEQ ID NO: 3347747 - RNA, 20 nt, Human
cuguugggccaggagccucc

SEQ ID NO: 3347748 - RNA, 16 nt, Human
cuguugggccaggagc

SEQ ID NO: 3347749 - RNA, 17 nt, Human
cuuacccucauguucuu

SEQ ID NO: 3347750 - RNA, 18 nt, Human
cuuacccucauguucuua

SEQ ID NO: 3347751 - RNA, 19 nt, Human
cuuacccucauguucuuaa

SEQ ID NO: 3347752 - RNA, 13 nt, Human
cuuaccucggugc

SEQ ID NO: 3347753 - RNA, 19 nt, Human
cuuaccucggugccuuccu

SEQ ID NO: 3347754 - RNA, 21 nt, Human
cuuaccucggugccuuccucu

SEQ ID NO: 3347755 - RNA, 19 nt, Human
cuuagauguauauauuucc

SEQ ID NO: 3347756 - RNA, 20 nt, Human
cuugccgucuaccugagggg

SEQ ID NO: 3347757 - RNA, 12 nt, Human
cuugacagggca

SEQ ID NO: 3347758 - RNA, 19 nt, Human
cuugccgucuaccugaggg

SEQ ID NO: 3347759 - RNA, 23 nt, Human
cuugccgucuaccugaggggccu

SEQ ID NO: 3347760 - RNA, 12 nt, Human
cuugcucugcug

SEQ ID NO: 3347761 - RNA, 20 nt, Human
cuugaaugaugccaugagga

SEQ ID NO: 3347762 - RNA, 20 nt, Human
cuucuucagagacuccugca

SEQ ID NO: 3347763 - RNA, 21 nt, Human
cuucuucagagacuccugcag

SEQ ID NO: 3347764 - RNA, 23 nt, Human
cuucugacccaugcugcccugug

SEQ ID NO: 3347765 - RNA, 22 nt, Human
cuucuucagagacuccugcagg

SEQ ID NO: 3347766 - RNA, 18 nt, Human
cuucuucagagacuccug

SEQ ID NO: 3347767 - RNA, 20 nt, Human
cuuuggucuacacugugcug

SEQ ID NO: 3347768 - RNA, 16 nt, Human
cuuuggucuacacugu

SEQ ID NO: 3347769 - RNA, 15 nt, Human
cuuuuauaaacuuua

SEQ ID NO: 3347770 - RNA, 16 nt, Human
cuuuuauaaacuuuac

SEQ ID NO: 3347771 - RNA, 18 nt, Human
cuuuuauaaacuuuaccu

SEQ ID NO: 3347772 - RNA, 14 nt, Human
cuuuuauaaacuuu

SEQ ID NO: 3347773 - RNA, 15 nt, Human
cuuuucaaaacauuu

SEQ ID NO: 3347774 - RNA, 16 nt, Human
cuuuucaaggcuuaua

SEQ ID NO: 3347775 - RNA, 13 nt, Human
cuuuucaaggcuu

SEQ ID NO: 3347776 - RNA, 18 nt, Human
cuuugacgccaucccagc

SEQ ID NO: 3347777 - RNA, 19 nt, Human
cuuugacgccaucccagcc

SEQ ID NO: 3347778 - RNA, 21 nt, Human
cuuugacgccaucccagcccc

SEQ ID NO: 3347779 - RNA, 22 nt, Human
cuuugacgccaucccagcccca

SEQ ID NO: 3347780 - RNA, 18 nt, Human
cuuucaauaggaaaaacu

SEQ ID NO: 3347781 - RNA, 20 nt, Human
cuuucaauaggaaaaacuga

SEQ ID NO: 3347782 - RNA, 21 nt, Human
cuuucaauaggaaaaacugau

SEQ ID NO: 3347783 - RNA, 22 nt, Human
cuuucaauaggaaaaacugauu

SEQ ID NO: 3347784 - RNA, 15 nt, Human
cuuguggacacagcu

SEQ ID NO: 3347785 - RNA, 14 nt, Human
cuuguggacacagc

SEQ ID NO: 3347786 - RNA, 13 nt, Human
cuuguggacacag

SEQ ID NO: 3347787 - RNA, 13 nt, Human
caaguauuauacc

SEQ ID NO: 3347788 - RNA, 17 nt, Human
caaguauuauaccuuuu

SEQ ID NO: 3347789 - RNA, 22 nt, Human
caaguauuauaccuuuuuuaga

SEQ ID NO: 3347790 - RNA, 20 nt, Human
caaggauugcuacuguccua

SEQ ID NO: 3347791 - RNA, 19 nt, Human
caaggauugcuacuguccu

SEQ ID NO: 3347792 - RNA, 14 nt, Human
caaggcaaggcugu

SEQ ID NO: 3347793 - RNA, 17 nt, Human
caagcuccaagcuccca

SEQ ID NO: 3347794 - RNA, 18 nt, Human
caagcuccaagcucccag

SEQ ID NO: 3347795 - RNA, 19 nt, Human
caagcuccaagcucccagg

SEQ ID NO: 3347796 - RNA, 21 nt, Human
caagcuccaagcucccaggca

SEQ ID NO: 3347797 - RNA, 12 nt, Human
caagcucccagg

SEQ ID NO: 3347798 - RNA, 14 nt, Human
caagcucccaggca

SEQ ID NO: 3347799 - RNA, 15 nt, Human
caagcucccaggcau

SEQ ID NO: 3347800 - RNA, 17 nt, Human
caagcucccaggcauuc

SEQ ID NO: 3347801 - RNA, 16 nt, Human
caagcucugcuccucu

SEQ ID NO: 3347802 - RNA, 15 nt, Human
caagcucugcuccuc

SEQ ID NO: 3347803 - RNA, 20 nt, Human
caauuuauuauggcacauca

SEQ ID NO: 3347804 - RNA, 13 nt, Human
caauuuauuaugg

SEQ ID NO: 3347805 - RNA, 15 nt, Human
caauggcagccuugg

SEQ ID NO: 3347806 - RNA, 14 nt, Human
caauggcagccuug

SEQ ID NO: 3347807 - RNA, 13 nt, Human
caauggcagccuu

SEQ ID NO: 3347808 - RNA, 12 nt, Human
caauggcagccu

SEQ ID NO: 3347809 - RNA, 14 nt, Human
caaucaaaucugcu

SEQ ID NO: 3347810 - RNA, 13 nt, Human
caagcaccuccug

SEQ ID NO: 3347811 - RNA, 14 nt, Human
caagaccacguuuc

SEQ ID NO: 3347812 - RNA, 16 nt, Human
caaccccuucgcuccu

SEQ ID NO: 3347813 - RNA, 14 nt, Human
caaccccuucgcuc

SEQ ID NO: 3347814 - RNA, 18 nt, Human
caagaagcccaggaaagg

SEQ ID NO: 3347815 - RNA, 17 nt, Human
caagaaggaugauucaa

SEQ ID NO: 3347816 - RNA, 14 nt, Human
caagaagcccagga

SEQ ID NO: 3347817 - RNA, 15 nt, Human
caagaagcccaggaa

SEQ ID NO: 3347818 - RNA, 19 nt, Human
caccagcccuuagcaggga

SEQ ID NO: 3347819 - RNA, 16 nt, Human
caccagccccagugcc

SEQ ID NO: 3347820 - RNA, 22 nt, Human
caccagccccagugcccacagg

SEQ ID NO: 3347821 - RNA, 21 nt, Human
caccagccccagugcccacag

SEQ ID NO: 3347822 - RNA, 18 nt, Human
caccagccccagugccca

SEQ ID NO: 3347823 - RNA, 17 nt, Human
caccagccccagugccc

SEQ ID NO: 3347824 - RNA, 18 nt, Human
cacauuuauucugcucac

SEQ ID NO: 3347825 - RNA, 17 nt, Human
cacauuuauucugcuca

SEQ ID NO: 3347826 - RNA, 19 nt, Human
cacaucuugcucugcugac

SEQ ID NO: 3347827 - RNA, 23 nt, Human
cacaucuugcucugcugacagac

SEQ ID NO: 3347828 - RNA, 12 nt, Human
cacccagcccac

SEQ ID NO: 3347829 - RNA, 22 nt, Human
cacaucuugcucugcugacaga

SEQ ID NO: 3347830 - RNA, 21 nt, Human
cacaucuugcucugcugacag

SEQ ID NO: 3347831 - RNA, 20 nt, Human
cacaucuugcucugcugaca

SEQ ID NO: 3347832 - RNA, 15 nt, Human
cacaucuugcucugc

SEQ ID NO: 3347833 - RNA, 14 nt, Human
cacaucuugcucug

SEQ ID NO: 3347834 - RNA, 13 nt, Human
cacaucuugcucu

SEQ ID NO: 3347835 - RNA, 17 nt, Human
caccugcggugcuaucu

SEQ ID NO: 3347836 - RNA, 19 nt, Human
caccugcggugcuaucucc

SEQ ID NO: 3347837 - RNA, 16 nt, Human
caccugcggugcuauc

SEQ ID NO: 3347838 - RNA, 24 nt, Human
caccugccuguugggccaggagcc

SEQ ID NO: 3347839 - RNA, 12 nt, Human
cacccuccuuuc

SEQ ID NO: 3347840 - RNA, 12 nt, Human
cacccugcucuc

SEQ ID NO: 3347841 - RNA, 16 nt, Human
caccugccccucaacu

SEQ ID NO: 3347842 - RNA, 18 nt, Human
caccugccccucaacucu

SEQ ID NO: 3347843 - RNA, 21 nt, Human
caccugccccucaacucuccu

SEQ ID NO: 3347844 - RNA, 11 nt, Human
caccugccagg

SEQ ID NO: 3347845 - RNA, 12 nt, Human
caccugccaggg

SEQ ID NO: 3347846 - RNA, 17 nt, Human
cacccuggggagaaagu

SEQ ID NO: 3347847 - RNA, 15 nt, Human
cacgcuggagugcag

SEQ ID NO: 3347848 - RNA, 20 nt, Human
cacgcuggagugcagugagc

SEQ ID NO: 3347849 - RNA, 18 nt, Human
cacgcuggagugcaguga

SEQ ID NO: 3347850 - RNA, 17 nt, Human
cacgcuggagugcagug

SEQ ID NO: 3347851 - RNA, 16 nt, Human
cacgcuggagugcagu

SEQ ID NO: 3347852 - RNA, 21 nt, Human
cacgcuggagugcagugagcc

SEQ ID NO: 3347853 - RNA, 13 nt, Human
cacuacauucugu

SEQ ID NO: 3347854 - RNA, 14 nt, Human
cacuacauucuguu

SEQ ID NO: 3347855 - RNA, 21 nt, Human
cacuacauuauaaaugucucu

SEQ ID NO: 3347856 - RNA, 16 nt, Human
cacggaagagccuugc

SEQ ID NO: 3347857 - RNA, 22 nt, Human
cacggaagagccuugcggaagg

SEQ ID NO: 3347858 - RNA, 15 nt, Human
cacuacauucuguua

SEQ ID NO: 3347859 - RNA, 21 nt, Human
auuucuguuuagauaauacac

SEQ ID NO: 3347860 - RNA, 20 nt, Human
auuucuguuuagauaauaca

SEQ ID NO: 3347861 - RNA, 19 nt, Human
auuucuguuuagauaauac

SEQ ID NO: 3347862 - RNA, 12 nt, Human
auuucacucucc

SEQ ID NO: 3347863 - RNA, 14 nt, Human
auuuguuauaauga

SEQ ID NO: 3347864 - RNA, 17 nt, Human
caaaccaucauugaaau

SEQ ID NO: 3347865 - RNA, 14 nt, Human
caaaccaucauuga

SEQ ID NO: 3347866 - RNA, 16 nt, Human
caaaccaucauugaaa

SEQ ID NO: 3347867 - RNA, 16 nt, Human
auuuuuauuaaauuau

SEQ ID NO: 3347868 - RNA, 22 nt, Human
auuuuguuuuugucuuaaaaag

SEQ ID NO: 3347869 - RNA, 21 nt, Human
auuuuguuuuugucuuaaaaa

SEQ ID NO: 3347870 - RNA, 20 nt, Human
caaaagguuaauaaaguaau

SEQ ID NO: 3347871 - RNA, 13 nt, Human
caaaagcauguga

SEQ ID NO: 3347872 - RNA, 19 nt, Human
caaaagcaucuaugugaga

SEQ ID NO: 3347873 - RNA, 22 nt, Human
auuacaagcgugagccacugca

SEQ ID NO: 3347874 - RNA, 15 nt, Human
auucucuuauccaac

SEQ ID NO: 3347875 - RNA, 14 nt, Human
auucucuuauccaa

SEQ ID NO: 3347876 - RNA, 12 nt, Human
auucucuuaucc

SEQ ID NO: 3347877 - RNA, 23 nt, Human
auucucuaguuugauuaaauucu

SEQ ID NO: 3347878 - RNA, 20 nt, Human
auucucuaguuugauuaaau

SEQ ID NO: 3347879 - RNA, 19 nt, Human
auucucuaguuugauuaaa

SEQ ID NO: 3347880 - RNA, 11 nt, Human
caucccagccc

SEQ ID NO: 3347881 - RNA, 20 nt, Human
caucccaaacccuucagugc

SEQ ID NO: 3347882 - RNA, 21 nt, Human
cauccucuguacagagcccac

SEQ ID NO: 3347883 - RNA, 22 nt, Human
cauccucuguacagagcccacg

SEQ ID NO: 3347884 - RNA, 19 nt, Human
caucccaaacccuucagug

SEQ ID NO: 3347885 - RNA, 19 nt, Human
caucagcacgauuucuguu

SEQ ID NO: 3347886 - RNA, 21 nt, Human
caucagcacgauuucuguuua

SEQ ID NO: 3347887 - RNA, 23 nt, Human
caguuuguuaguaugaggcauuu

SEQ ID NO: 3347888 - RNA, 21 nt, Human
caguuuguuaguaugaggcau

SEQ ID NO: 3347889 - RNA, 18 nt, Human
caguuguuagugugucuu

SEQ ID NO: 3347890 - RNA, 22 nt, Human
caguuguuagugugucuuagug

SEQ ID NO: 3347891 - RNA, 23 nt, Human
cauacaggaagguagaaauaucu

SEQ ID NO: 3347892 - RNA, 16 nt, Human
cauacaguuugcacuu

SEQ ID NO: 3347893 - RNA, 23 nt, Human
cauaaugcgugcauaccacuuuu

SEQ ID NO: 3347894 - RNA, 22 nt, Human
cauauuaccacagacauacuaa

SEQ ID NO: 3347895 - RNA, 23 nt, Human
cauagcagagaaugaaagggccc

SEQ ID NO: 3347896 - RNA, 22 nt, Human
cagucugauucccaagcucugc

SEQ ID NO: 3347897 - RNA, 21 nt, Human
cagucugauucccaagcucug

SEQ ID NO: 3347898 - RNA, 14 nt, Human
caguuacucagaau

SEQ ID NO: 3347899 - RNA, 19 nt, Human
caguggugcgaucuggguu

SEQ ID NO: 3347900 - RNA, 21 nt, Human
cagugguaugaucacggcuca

SEQ ID NO: 3347901 - RNA, 20 nt, Human
caguuacucagaauucucua

SEQ ID NO: 3347902 - RNA, 20 nt, Human
cagugguaugaucacggcuc

SEQ ID NO: 3347903 - RNA, 17 nt, Human
cagugggagcugccugu

SEQ ID NO: 3347904 - RNA, 15 nt, Human
cagugggagcugccu

SEQ ID NO: 3347905 - RNA, 16 nt, Human
cagugggagcugccug

SEQ ID NO: 3347906 - RNA, 22 nt, Human
cagugcccacaggaucagucug

SEQ ID NO: 3347907 - RNA, 18 nt, Human
cagugcccacaggaucag

SEQ ID NO: 3347908 - RNA, 21 nt, Human
cagugcccacaggaucagucu

SEQ ID NO: 3347909 - RNA, 23 nt, Human
cagucugauucccaagcucugcu

SEQ ID NO: 3347910 - RNA, 20 nt, Human
cagucugauucccaagcucu

SEQ ID NO: 3347911 - RNA, 13 nt, Human
caugacaaagacu

SEQ ID NO: 3347912 - RNA, 12 nt, Human
caugcaagguca

SEQ ID NO: 3347913 - RNA, 21 nt, Human
cauggccucuucagaucucua

SEQ ID NO: 3347914 - RNA, 18 nt, Human
caugggaaaggggaaguu

SEQ ID NO: 3347915 - RNA, 14 nt, Human
caugcuccuggccc

SEQ ID NO: 3347916 - RNA, 16 nt, Human
caugcuccuggcccac

SEQ ID NO: 3347917 - RNA, 17 nt, Human
caugcuccuggcccacu

SEQ ID NO: 3347918 - RNA, 17 nt, Human
cauucuccaccugccag

SEQ ID NO: 3347919 - RNA, 18 nt, Human
cauucuccaccugccagg

SEQ ID NO: 3347920 - RNA, 19 nt, Human
cauucuccaccugccaggg

SEQ ID NO: 3347921 - RNA, 20 nt, Human
cauucuccuuguguuacuaa

SEQ ID NO: 3347922 - RNA, 17 nt, Human
cauguuacauaagauaa

SEQ ID NO: 3347923 - RNA, 16 nt, Human
cauguuacauaagaua

SEQ ID NO: 3347924 - RNA, 15 nt, Human
cauguccaagaagcc

SEQ ID NO: 3347925 - RNA, 13 nt, Human
cauguucuuaauu

SEQ ID NO: 3347926 - RNA, 16 nt, Human
cauguucuuaauucuu

SEQ ID NO: 3347927 - RNA, 21 nt, Human
cauguuacauaagauaaaugu

SEQ ID NO: 3347928 - RNA, 18 nt, Human
cauguucuuaauucuuag

SEQ ID NO: 3347929 - RNA, 17 nt, Human
cauguuggccaggcugg

SEQ ID NO: 3347930 - RNA, 18 nt, Human
cauguuggccaggcuggu

SEQ ID NO: 3347931 - RNA, 22 nt, Human
ccaaaguacacuguuucaaacu

SEQ ID NO: 3347932 - RNA, 20 nt, Human
ccaaaguacacuguuucaaa

SEQ ID NO: 3347933 - RNA, 13 nt, Human
ccaacucacccca

SEQ ID NO: 3347934 - RNA, 23 nt, Human
ccaaaucagcugcuacuacuccu

SEQ ID NO: 3347935 - RNA, 15 nt, Human
ccaaaucagcugcua

SEQ ID NO: 3347936 - RNA, 15 nt, Human
ccaagcucugcuccu

SEQ ID NO: 3347937 - RNA, 14 nt, Human
ccaagcucugcucc

SEQ ID NO: 3347938 - RNA, 16 nt, Human
ccaagcucugcuccuc

SEQ ID NO: 3347939 - RNA, 13 nt, Human
ccaagcucugcuc

SEQ ID NO: 3347940 - RNA, 21 nt, Human
ccaacucaccccagccccaaa

SEQ ID NO: 3347941 - RNA, 23 nt, Human
ccaauggacuaacuugucuuugg

SEQ ID NO: 3347942 - RNA, 16 nt, Human
cauuuaggugaggaag

SEQ ID NO: 3347943 - RNA, 18 nt, Human
cauuuaggugaggaagca

SEQ ID NO: 3347944 - RNA, 16 nt, Human
cauuggauuauccuga

SEQ ID NO: 3347945 - RNA, 17 nt, Human
cauuggauuauccugag

SEQ ID NO: 3347946 - RNA, 23 nt, Human
cauuuuuuuuaagaaaaaggaug

SEQ ID NO: 3347947 - RNA, 22 nt, Human
cauuuuuuuuaagaaaaaggau

SEQ ID NO: 3347948 - RNA, 13 nt, Human
cagacagcugccu

SEQ ID NO: 3347949 - RNA, 14 nt, Human
cagacagcugccug

SEQ ID NO: 3347950 - RNA, 13 nt, Human
cagacaggaccag

SEQ ID NO: 3347951 - RNA, 15 nt, Human
cagacaggaccaggg

SEQ ID NO: 3347952 - RNA, 16 nt, Human
cagacaggaccaggga

SEQ ID NO: 3347953 - RNA, 15 nt, Human
cagacagcugccugg

SEQ ID NO: 3347954 - RNA, 16 nt, Human
cagacagcugccuggg

SEQ ID NO: 3347955 - RNA, 17 nt, Human
cagacagcugccuggga

SEQ ID NO: 3347956 - RNA, 18 nt, Human
cagacagcugccugggau

SEQ ID NO: 3347957 - RNA, 21 nt, Human
cagacaggcaagcaccuccug

SEQ ID NO: 3347958 - RNA, 20 nt, Human
cagacaggcaagcaccuccu

SEQ ID NO: 3347959 - RNA, 18 nt, Human
cagacaggcaagcaccuc

SEQ ID NO: 3347960 - RNA, 13 nt, Human
cagacaggcaagc

SEQ ID NO: 3347961 - RNA, 17 nt, Human
cagacaggaccagggau

SEQ ID NO: 3347962 - RNA, 24 nt, Human
cagacaggaccagggauuuccaug

SEQ ID NO: 3347963 - RNA, 11 nt, Human
cagacaggcaa

SEQ ID NO: 3347964 - RNA, 23 nt, Human
cagacaggcaagcaccuccugcc

SEQ ID NO: 3347965 - RNA, 22 nt, Human
cagacaggcaagcaccuccugc

SEQ ID NO: 3347966 - RNA, 17 nt, Human
cagacucuacagaggcc

SEQ ID NO: 3347967 - RNA, 21 nt, Human
cagacucuacagaggccaugg

SEQ ID NO: 3347968 - RNA, 20 nt, Human
cagacucuacagaggccaug

SEQ ID NO: 3347969 - RNA, 19 nt, Human
cagacucuacagaggccau

SEQ ID NO: 3347970 - RNA, 18 nt, Human
cagacucuacagaggcca

SEQ ID NO: 3347971 - RNA, 23 nt, Human
cagacucuacagaggccaugggc

SEQ ID NO: 3347972 - RNA, 18 nt, Human
cagacuggaagcacagcu

SEQ ID NO: 3347973 - RNA, 17 nt, Human
cagacuggaagcacagc

SEQ ID NO: 3347974 - RNA, 16 nt, Human
cagacuggaagcacag

SEQ ID NO: 3347975 - RNA, 14 nt, Human
cagacuggaagcac

SEQ ID NO: 3347976 - RNA, 13 nt, Human
cagacuggaagca

SEQ ID NO: 3347977 - RNA, 21 nt, Human
cagacuggaagcacagcuuca

SEQ ID NO: 3347978 - RNA, 20 nt, Human
cagacuggaagcacagcuuc

SEQ ID NO: 3347979 - RNA, 13 nt, Human
cagagcugccacc

SEQ ID NO: 3347980 - RNA, 20 nt, Human
cagagagguuaaggugggua

SEQ ID NO: 3347981 - RNA, 23 nt, Human
cagagaggguggugaccucugcc

SEQ ID NO: 3347982 - RNA, 23 nt, Human
cagagagggugggagugggccca

SEQ ID NO: 3347983 - RNA, 17 nt, Human
cagaggaaagcaaagga

SEQ ID NO: 3347984 - RNA, 19 nt, Human
cagaggaaagcaaaggaga

SEQ ID NO: 3347985 - RNA, 13 nt, Human
cagaggggguggc

SEQ ID NO: 3347986 - RNA, 12 nt, Human
cagagagggugg

SEQ ID NO: 3347987 - RNA, 17 nt, Human
cagagaggguggugacc

SEQ ID NO: 3347988 - RNA, 22 nt, Human
cagagaggguggugaccucugc

SEQ ID NO: 3347989 - RNA, 20 nt, Human
cagagaggguggugaccucu

SEQ ID NO: 3347990 - RNA, 23 nt, Human
cagagacuccugcaggcagccag

SEQ ID NO: 3347991 - RNA, 19 nt, Human
cagauagauauaugcucug

SEQ ID NO: 3347992 - RNA, 19 nt, Human
cagauacuuggggggcuga

SEQ ID NO: 3347993 - RNA, 14 nt, Human
cagaggggguggcc

SEQ ID NO: 3347994 - RNA, 16 nt, Human
cagaggggguggccuc

SEQ ID NO: 3347995 - RNA, 20 nt, Human
cagauuucacucuccuuggu

SEQ ID NO: 3347996 - RNA, 20 nt, Human
cagauugcaacaggcugggc

SEQ ID NO: 3347997 - RNA, 19 nt, Human
cagauugcaacaggcuggg

SEQ ID NO: 3347998 - RNA, 17 nt, Human
cagauugcaacaggcug

SEQ ID NO: 3347999 - RNA, 19 nt, Human
cagcaccaucucuccuccu

SEQ ID NO: 3348000 - RNA, 17 nt, Human
cagcaccaucucuccuc

SEQ ID NO: 3348001 - RNA, 19 nt, Human
cagauuucacucuccuugg

SEQ ID NO: 3348002 - RNA, 18 nt, Human
cagauugcaacaggcugg

SEQ ID NO: 3348003 - RNA, 22 nt, Human
cagccaggccacaagacccuug

SEQ ID NO: 3348004 - RNA, 14 nt, Human
cagcacgauuucug

SEQ ID NO: 3348005 - RNA, 20 nt, Human
cagcacgauuucuguuuaga

SEQ ID NO: 3348006 - RNA, 22 nt, Human
caggcugggagagccuuccagg

SEQ ID NO: 3348007 - RNA, 23 nt, Human
caggcugggagagccuuccaggg

SEQ ID NO: 3348008 - RNA, 14 nt, Human
caggggaaaagagg

SEQ ID NO: 3348009 - RNA, 16 nt, Human
caggggaaaagaggag

SEQ ID NO: 3348010 - RNA, 21 nt, Human
caggcugggagagccuuccag

SEQ ID NO: 3348011 - RNA, 20 nt, Human
caggcugggagagccuucca

SEQ ID NO: 3348012 - RNA, 12 nt, Human
caggccuccuac

SEQ ID NO: 3348013 - RNA, 14 nt, Human
caggccuccuacag

SEQ ID NO: 3348014 - RNA, 21 nt, Human
caggaccagggauuuccauga

SEQ ID NO: 3348015 - RNA, 16 nt, Human
caggaccucaggugag

SEQ ID NO: 3348016 - RNA, 23 nt, Human
caggaccucaggugagaagcaga

SEQ ID NO: 3348017 - RNA, 13 nt, Human
caggaccucaggu

SEQ ID NO: 3348018 - RNA, 16 nt, Human
caggcaaugcuggcug

SEQ ID NO: 3348019 - RNA, 15 nt, Human
caggcaaugcuggcu

SEQ ID NO: 3348020 - RNA, 14 nt, Human
caggcaaugcuggc

SEQ ID NO: 3348021 - RNA, 18 nt, Human
caggaggccagccuugac

SEQ ID NO: 3348022 - RNA, 19 nt, Human
caggaggccagccuugacc

SEQ ID NO: 3348023 - RNA, 22 nt, Human
caggaggccagccuugaccauu

SEQ ID NO: 3348024 - RNA, 19 nt, Human
caggaggaucacuugaguc

SEQ ID NO: 3348025 - RNA, 11 nt, Human
caggccaggcc

SEQ ID NO: 3348026 - RNA, 12 nt, Human
caggccaggccc

SEQ ID NO: 3348027 - RNA, 23 nt, Human
caggccagcugcuugggcuucau

SEQ ID NO: 3348028 - RNA, 15 nt, Human
cagcuaacauggaag

SEQ ID NO: 3348029 - RNA, 19 nt, Human
cagcguuucuaugacacau

SEQ ID NO: 3348030 - RNA, 16 nt, Human
cagccugcuccagcug

SEQ ID NO: 3348031 - RNA, 17 nt, Human
cagccugcuccagcugu

SEQ ID NO: 3348032 - RNA, 15 nt, Human
cagccugcuccagcu

SEQ ID NO: 3348033 - RNA, 21 nt, Human
cagcugacuuuucuguccgag

SEQ ID NO: 3348034 - RNA, 19 nt, Human
caggaaaggcuccaggagc

SEQ ID NO: 3348035 - RNA, 16 nt, Human
caggaaaggcuccagg

SEQ ID NO: 3348036 - RNA, 17 nt, Human
caggaaaggcuccagga

SEQ ID NO: 3348037 - RNA, 16 nt, Human
ccagcagaaaugccuu

SEQ ID NO: 3348038 - RNA, 17 nt, Human
ccagcagaaaugccuua

SEQ ID NO: 3348039 - RNA, 22 nt, Human
ccagcagaaaugccuuacccuc

SEQ ID NO: 3348040 - RNA, 12 nt, Human
ccagcagaaaug

SEQ ID NO: 3348041 - RNA, 11 nt, Human
ccagcagccug

SEQ ID NO: 3348042 - RNA, 12 nt, Human
ccagcagccugg

SEQ ID NO: 3348043 - RNA, 13 nt, Human
ccagccccuggau

SEQ ID NO: 3348044 - RNA, 14 nt, Human
ccagccccuggaug

SEQ ID NO: 3348045 - RNA, 15 nt, Human
ccagccccuggaugc

SEQ ID NO: 3348046 - RNA, 13 nt, Human
ccagcagccugga

SEQ ID NO: 3348047 - RNA, 23 nt, Human
ccagccccauccucuguacagag

SEQ ID NO: 3348048 - RNA, 18 nt, Human
ccagccccauccucugua

SEQ ID NO: 3348049 - RNA, 15 nt, Human
ccagccccuucugac

SEQ ID NO: 3348050 - RNA, 16 nt, Human
ccagccccuucugacc

SEQ ID NO: 3348051 - RNA, 17 nt, Human
ccagccccuucugaccc

SEQ ID NO: 3348052 - RNA, 21 nt, Human
ccagcgagcccugguggcagu

SEQ ID NO: 3348053 - RNA, 12 nt, Human
ccagccccugga

SEQ ID NO: 3348054 - RNA, 18 nt, Human
ccaggaaaggcuccagga

SEQ ID NO: 3348055 - RNA, 19 nt, Human
ccaggaaaggcuccaggag

SEQ ID NO: 3348056 - RNA, 17 nt, Human
ccaggaaaggcuccagg

SEQ ID NO: 3348057 - RNA, 17 nt, Human
ccagucaccccggccac

SEQ ID NO: 3348058 - RNA, 18 nt, Human
ccagucaccccggccacc

SEQ ID NO: 3348059 - RNA, 13 nt, Human
ccagucaccccgg

SEQ ID NO: 3348060 - RNA, 16 nt, Human
ccagucaccccggcca

SEQ ID NO: 3348061 - RNA, 19 nt, Human
ccaguaucuugaagacuuu

SEQ ID NO: 3348062 - RNA, 22 nt, Human
ccaguaucuugaagacuuuucu

SEQ ID NO: 3348063 - RNA, 20 nt, Human
ccaggggugggacacccugu

SEQ ID NO: 3348064 - RNA, 21 nt, Human
ccaggggugggacacccugug

SEQ ID NO: 3348065 - RNA, 22 nt, Human
ccaggggugggacacccuguga

SEQ ID NO: 3348066 - RNA, 13 nt, Human
ccaguaucuugaa

SEQ ID NO: 3348067 - RNA, 19 nt, Human
ccaggggugggacacccug

SEQ ID NO: 3348068 - RNA, 14 nt, Human
ccagaugcaccagc

SEQ ID NO: 3348069 - RNA, 13 nt, Human
ccagaugcaccag

SEQ ID NO: 3348070 - RNA, 20 nt, Human
ccagagggccugcaagggag

SEQ ID NO: 3348071 - RNA, 16 nt, Human
ccagagacacaagccu

SEQ ID NO: 3348072 - RNA, 18 nt, Human
ccagagacacaagccuuc

SEQ ID NO: 3348073 - RNA, 14 nt, Human
ccacuuuuguucuu

SEQ ID NO: 3348074 - RNA, 15 nt, Human
ccacuuuuguucuug

SEQ ID NO: 3348075 - RNA, 21 nt, Human
ccacuuuuguucuugguuugu

SEQ ID NO: 3348076 - RNA, 16 nt, Human
ccagacccggcugcgu

SEQ ID NO: 3348077 - RNA, 17 nt, Human
ccagacccggcugcgug

SEQ ID NO: 3348078 - RNA, 20 nt, Human
ccacuuucuagccagaggag

SEQ ID NO: 3348079 - RNA, 18 nt, Human
ccacuuucuagccagagg

SEQ ID NO: 3348080 - RNA, 19 nt, Human
ccacuuucuagccagagga

SEQ ID NO: 3348081 - RNA, 13 nt, Human
ccacuuucuagcc

SEQ ID NO: 3348082 - RNA, 19 nt, Human
ccacugcaccgggccacag

SEQ ID NO: 3348083 - RNA, 17 nt, Human
ccacugcaccgggccac

SEQ ID NO: 3348084 - RNA, 14 nt, Human
ccacugcaccgggc

SEQ ID NO: 3348085 - RNA, 13 nt, Human
ccacugcaccggg

SEQ ID NO: 3348086 - RNA, 20 nt, Human
ccacugcacuauagccuagg

SEQ ID NO: 3348087 - RNA, 19 nt, Human
ccacugcacuauagccuag

SEQ ID NO: 3348088 - RNA, 18 nt, Human
cccaggcuggcgugcagu

SEQ ID NO: 3348089 - RNA, 20 nt, Human
cccaggcuggcgugcagugg

SEQ ID NO: 3348090 - RNA, 19 nt, Human
cccaggcuggcgugcagug

SEQ ID NO: 3348091 - RNA, 14 nt, Human
cccauccucuguac

SEQ ID NO: 3348092 - RNA, 13 nt, Human
cccauccucugua

SEQ ID NO: 3348093 - RNA, 15 nt, Human
cccauccucuguaca

SEQ ID NO: 3348094 - RNA, 19 nt, Human
cccauccucuguacagagc

SEQ ID NO: 3348095 - RNA, 23 nt, Human
cccagccccaaaacucuccucug

SEQ ID NO: 3348096 - RNA, 21 nt, Human
cccagccccaaaacucuccuc

SEQ ID NO: 3348097 - RNA, 19 nt, Human
cccagcccacuucugccau

SEQ ID NO: 3348098 - RNA, 17 nt, Human
cccagcccacuucugcc

SEQ ID NO: 3348099 - RNA, 23 nt, Human
cccauucugccugcccaggcccc

SEQ ID NO: 3348100 - RNA, 18 nt, Human
ccccaaaacucuccucug

SEQ ID NO: 3348101 - RNA, 20 nt, Human
ccccaaaacucuccucugcu

SEQ ID NO: 3348102 - RNA, 14 nt, Human
ccccagccccaucc

SEQ ID NO: 3348103 - RNA, 14 nt, Human
ccccagccccaaaa

SEQ ID NO: 3348104 - RNA, 21 nt, Human
ccccauucugccugcccaggc

SEQ ID NO: 3348105 - RNA, 10 nt, Human
ccccagcccc

SEQ ID NO: 3348106 - RNA, 12 nt, Human
ccccagccccaa

SEQ ID NO: 3348107 - RNA, 14 nt, Human
ccccgcccaggcuu

SEQ ID NO: 3348108 - RNA, 14 nt, Human
ccccggccaccugc

SEQ ID NO: 3348109 - RNA, 18 nt, Human
ccccggccaccugcggug

SEQ ID NO: 3348110 - RNA, 13 nt, Human
ccccggccaccug

SEQ ID NO: 3348111 - RNA, 12 nt, Human
ccccgcccaggc

SEQ ID NO: 3348112 - RNA, 14 nt, Human
cccccuuccaugga

SEQ ID NO: 3348113 - RNA, 17 nt, Human
ccaugggccuccugugu

SEQ ID NO: 3348114 - RNA, 17 nt, Human
ccaugaggaacaaggca

SEQ ID NO: 3348115 - RNA, 16 nt, Human
ccaugaggaacaaggc

SEQ ID NO: 3348116 - RNA, 15 nt, Human
cccaccgcagacagg

SEQ ID NO: 3348117 - RNA, 18 nt, Human
cccaccgcagacaggacc

SEQ ID NO: 3348118 - RNA, 17 nt, Human
cccaagcucugcuccuc

SEQ ID NO: 3348119 - RNA, 15 nt, Human
cccaagcucugcucc

SEQ ID NO: 3348120 - RNA, 15 nt, Human
cccacccaagggccu

SEQ ID NO: 3348121 - RNA, 18 nt, Human
cccaccaucaugucuggc

SEQ ID NO: 3348122 - RNA, 11 nt, Human
ccucaggcagg

SEQ ID NO: 3348123 - RNA, 17 nt, Human
ccucccaacucacccca

SEQ ID NO: 3348124 - RNA, 20 nt, Human
ccucccaacucaccccagcc

SEQ ID NO: 3348125 - RNA, 21 nt, Human
ccucccaacucaccccagccc

SEQ ID NO: 3348126 - RNA, 17 nt, Human
ccucccaccucagccuc

SEQ ID NO: 3348127 - RNA, 15 nt, Human
ccucccaacucaccc

SEQ ID NO: 3348128 - RNA, 19 nt, Human
ccuccuuugugaggaagcc

SEQ ID NO: 3348129 - RNA, 18 nt, Human
ccuccuuugugaggaagc

SEQ ID NO: 3348130 - RNA, 15 nt, Human
ccucgaacuggcugc

SEQ ID NO: 3348131 - RNA, 16 nt, Human
ccucgaacuggcugca

SEQ ID NO: 3348132 - RNA, 20 nt, Human
ccucugccugaagucacaca

SEQ ID NO: 3348133 - RNA, 11 nt, Human
ccucugccuga

SEQ ID NO: 3348134 - RNA, 23 nt, Human
ccucugccucugacacacagcuc

SEQ ID NO: 3348135 - RNA, 21 nt, Human
ccucugccucugacacacagc

SEQ ID NO: 3348136 - RNA, 20 nt, Human
ccucugccucugacacacag

SEQ ID NO: 3348137 - RNA, 23 nt, Human
ccugccuccuuugugaggaagcc

SEQ ID NO: 3348138 - RNA, 21 nt, Human
ccugccuccuuugugaggaag

SEQ ID NO: 3348139 - RNA, 22 nt, Human
ccugccuccuuugugaggaagc

SEQ ID NO: 3348140 - RNA, 13 nt, Human
ccugccuccuuug

SEQ ID NO: 3348141 - RNA, 15 nt, Human
ccugccuccuuugug

SEQ ID NO: 3348142 - RNA, 19 nt, Human
ccugccuccuuugugagga

SEQ ID NO: 3348143 - RNA, 20 nt, Human
ccugccuccuuugugaggaa

SEQ ID NO: 3348144 - RNA, 12 nt, Human
ccugcugcaguu

SEQ ID NO: 3348145 - RNA, 11 nt, Human
ccugcugcagu

SEQ ID NO: 3348146 - RNA, 22 nt, Human
ccugcugcaguugccagucacc

SEQ ID NO: 3348147 - RNA, 21 nt, Human
ccugcugcaguugccagucac

SEQ ID NO: 3348148 - RNA, 15 nt, Human
ccugccucuucucua

SEQ ID NO: 3348149 - RNA, 15 nt, Human
ccugcaggcagccag

SEQ ID NO: 3348150 - RNA, 12 nt, Human
ccugcagagggc

SEQ ID NO: 3348151 - RNA, 16 nt, Human
ccugcaggcagccagg

SEQ ID NO: 3348152 - RNA, 17 nt, Human
ccugcaggcagccaggc

SEQ ID NO: 3348153 - RNA, 18 nt, Human
ccugcaggcagccaggcc

SEQ ID NO: 3348154 - RNA, 19 nt, Human
ccugcaggcagccaggcca

SEQ ID NO: 3348155 - RNA, 20 nt, Human
ccugcaggcagccaggccac

SEQ ID NO: 3348156 - RNA, 21 nt, Human
ccugcaggcagccaggccaca

SEQ ID NO: 3348157 - RNA, 16 nt, Human
ccugaggcugggcucc

SEQ ID NO: 3348158 - RNA, 17 nt, Human
ccugaggcugggcuccc

SEQ ID NO: 3348159 - RNA, 19 nt, Human
ccugaggcugggcucccuu

SEQ ID NO: 3348160 - RNA, 21 nt, Human
ccugaggcugggcucccuucc

SEQ ID NO: 3348161 - RNA, 12 nt, Human
ccugaggggccu

SEQ ID NO: 3348162 - RNA, 16 nt, Human
ccucuuugagugaagc

SEQ ID NO: 3348163 - RNA, 12 nt, Human
cccugaaggccc

SEQ ID NO: 3348164 - RNA, 16 nt, Human
cccugaaagcccugag

SEQ ID NO: 3348165 - RNA, 13 nt, Human
cccugaaggcccc

SEQ ID NO: 3348166 - RNA, 14 nt, Human
cccugaaggccccg

SEQ ID NO: 3348167 - RNA, 16 nt, Human
cccugaaggccccgcc

SEQ ID NO: 3348168 - RNA, 19 nt, Human
cccugaaggccccgcccag

SEQ ID NO: 3348169 - RNA, 16 nt, Human
cccugacaacacucau

SEQ ID NO: 3348170 - RNA, 22 nt, Human
cccugacaacacucauugaccu

SEQ ID NO: 3348171 - RNA, 20 nt, Human
cccugaaggccccgcccagg

SEQ ID NO: 3348172 - RNA, 22 nt, Human
cccugaaggccccgcccaggcu

SEQ ID NO: 3348173 - RNA, 14 nt, Human
cccugacaacacuc

SEQ ID NO: 3348174 - RNA, 18 nt, Human
cccugaaagcccugagcu

SEQ ID NO: 3348175 - RNA, 17 nt, Human
cccuggaugcagccuca

SEQ ID NO: 3348176 - RNA, 21 nt, Human
cccuggaugcagccucacagu

SEQ ID NO: 3348177 - RNA, 13 nt, Human
cccuggaugcagc

SEQ ID NO: 3348178 - RNA, 22 nt, Human
cccugcccaccuggccucugca

SEQ ID NO: 3348179 - RNA, 17 nt, Human
cccugcccggcugcgga

SEQ ID NO: 3348180 - RNA, 14 nt, Human
cccugcccggcugc

SEQ ID NO: 3348181 - RNA, 16 nt, Human
cccugagcuuucugcu

SEQ ID NO: 3348182 - RNA, 20 nt, Human
cccugcccaccuggccucug

SEQ ID NO: 3348183 - RNA, 16 nt, Human
ccgaauagcugggacu

SEQ ID NO: 3348184 - RNA, 17 nt, Human
ccgaccagacaccuuga

SEQ ID NO: 3348185 - RNA, 13 nt, Human
ccgaccagacacc

SEQ ID NO: 3348186 - RNA, 15 nt, Human
ccgcagacaggacca

SEQ ID NO: 3348187 - RNA, 16 nt, Human
ccgaaaacguggcugc

SEQ ID NO: 3348188 - RNA, 17 nt, Human
ccgaaaacguggcugcu

SEQ ID NO: 3348189 - RNA, 19 nt, Human
ccgaaagggacuuggaagc

SEQ ID NO: 3348190 - RNA, 15 nt, Human
cccuuccucuuucca

SEQ ID NO: 3348191 - RNA, 16 nt, Human
ccgcagacaggaccag

SEQ ID NO: 3348192 - RNA, 17 nt, Human
ccgcagacaggaccagg

SEQ ID NO: 3348193 - RNA, 21 nt, Human
cccugugauggggcccugccu

SEQ ID NO: 3348194 - RNA, 22 nt, Human
cccugugauggggcccugccuc

SEQ ID NO: 3348195 - RNA, 23 nt, Human
cccugugauggggcccugccucc

SEQ ID NO: 3348196 - RNA, 20 nt, Human
cccugugauggggcccugcc

SEQ ID NO: 3348197 - RNA, 16 nt, Human
ccggccaccugcggug

SEQ ID NO: 3348198 - RNA, 15 nt, Human
ccggccccugcuggu

SEQ ID NO: 3348199 - RNA, 18 nt, Human
ccggcaggguccuagaaa

SEQ ID NO: 3348200 - RNA, 19 nt, Human
ccuagcauacguacacauu

SEQ ID NO: 3348201 - RNA, 17 nt, Human
ccuagcacuuugggagg

SEQ ID NO: 3348202 - RNA, 14 nt, Human
ccuaaucuucugaa

SEQ ID NO: 3348203 - RNA, 14 nt, Human
ccgucuaccugagg

SEQ ID NO: 3348204 - RNA, 15 nt, Human
ccgucuaccugaggg

SEQ ID NO: 3348205 - RNA, 14 nt, Human
ccggcuccaggcuc

SEQ ID NO: 3348206 - RNA, 13 nt, Human
ccggcuccaggcu

SEQ ID NO: 3348207 - RNA, 12 nt, Human
ccggcuccaggc

SEQ ID NO: 3348208 - RNA, 17 nt, Human
ccgucuaccugaggggc

SEQ ID NO: 3348209 - RNA, 12 nt, Human
ccgugaggccag

SEQ ID NO: 3348210 - RNA, 13 nt, Human
ccgugaggccaga

SEQ ID NO: 3348211 - RNA, 14 nt, Human
ccgugaggccagag

SEQ ID NO: 3348212 - RNA, 14 nt, Human
cuaaguuuuuaugg

SEQ ID NO: 3348213 - RNA, 18 nt, Human
cuaaguauuaaaacauug

SEQ ID NO: 3348214 - RNA, 13 nt, Human
cuaaguauuaaaa

SEQ ID NO: 3348215 - RNA, 20 nt, Human
cuaaguauuaaaacauugga

SEQ ID NO: 3348216 - RNA, 19 nt, Human
cuacaaaaagcauaaaaau

SEQ ID NO: 3348217 - RNA, 12 nt, Human
cuaaguauuaaa

SEQ ID NO: 3348218 - RNA, 11 nt, Human
cuaaguauuaa

SEQ ID NO: 3348219 - RNA, 12 nt, Human
cgugacaacacu

SEQ ID NO: 3348220 - RNA, 15 nt, Human
cgugacaacacuugu

SEQ ID NO: 3348221 - RNA, 14 nt, Human
cgugacaacacuug

SEQ ID NO: 3348222 - RNA, 20 nt, Human
cgugagccacugcaccgggc

SEQ ID NO: 3348223 - RNA, 15 nt, Human
cgugagccacugcac

SEQ ID NO: 3348224 - RNA, 14 nt, Human
cgugagccacugca

SEQ ID NO: 3348225 - RNA, 14 nt, Human
cgugaggccagaga

SEQ ID NO: 3348226 - RNA, 22 nt, Human
cgugagccacugcaccgggcca

SEQ ID NO: 3348227 - RNA, 19 nt, Human
cguguuaugacuccagaau

SEQ ID NO: 3348228 - RNA, 15 nt, Human
cguguuaugacucca

SEQ ID NO: 3348229 - RNA, 19 nt, Human
cgugaguccuggcauggga

SEQ ID NO: 3348230 - RNA, 18 nt, Human
cgugaguccuggcauggg

SEQ ID NO: 3348231 - RNA, 14 nt, Human
cuaacuugucuuug

SEQ ID NO: 3348232 - RNA, 22 nt, Human
cuaacuugucuuuggacccuga

SEQ ID NO: 3348233 - RNA, 17 nt, Human
cgggccacagagaaagu

SEQ ID NO: 3348234 - RNA, 12 nt, Human
cgggcucugccu

SEQ ID NO: 3348235 - RNA, 19 nt, Human
cgggcucagcaaaagaugc

SEQ ID NO: 3348236 - RNA, 20 nt, Human
cgguggcucacgccuguaau

SEQ ID NO: 3348237 - RNA, 22 nt, Human
cguacacauuuuauuuuauuau

SEQ ID NO: 3348238 - RNA, 16 nt, Human
cguacacauuuuauuu

SEQ ID NO: 3348239 - RNA, 17 nt, Human
cggagacggagucccac

SEQ ID NO: 3348240 - RNA, 20 nt, Human
cggagacggagucccaccuu

SEQ ID NO: 3348241 - RNA, 15 nt, Human
cggagacggaguccc

SEQ ID NO: 3348242 - RNA, 22 nt, Human
cggagucccaccuuggcugcag

SEQ ID NO: 3348243 - RNA, 21 nt, Human
cggagucccaccuuggcugca

SEQ ID NO: 3348244 - RNA, 23 nt, Human
cggagucccaccuuggcugcagg

SEQ ID NO: 3348245 - RNA, 23 nt, Human
cgccaaggcugggggaagaagcu

SEQ ID NO: 3348246 - RNA, 18 nt, Human
cgcuggagugcagugagc

SEQ ID NO: 3348247 - RNA, 17 nt, Human
cgcuggagugcagugag

SEQ ID NO: 3348248 - RNA, 19 nt, Human
cgcugccccuggcagcccc

SEQ ID NO: 3348249 - RNA, 20 nt, Human
cgcugccccuggcagccccu

SEQ ID NO: 3348250 - RNA, 12 nt, Human
ccuuauggaaca

SEQ ID NO: 3348251 - RNA, 22 nt, Human
ccuuauggaacacucugagacu

SEQ ID NO: 3348252 - RNA, 19 nt, Human
ccuuauggaacacucugag

SEQ ID NO: 3348253 - RNA, 20 nt, Human
ccuuauggaacacucugaga

SEQ ID NO: 3348254 - RNA, 14 nt, Human
ccuuauggaacacu

SEQ ID NO: 3348255 - RNA, 16 nt, Human
ccuuauggaacacucu

SEQ ID NO: 3348256 - RNA, 17 nt, Human
ccuuauggaacacucug

SEQ ID NO: 3348257 - RNA, 18 nt, Human
ccuuauggaacacucuga

SEQ ID NO: 3348258 - RNA, 14 nt, Human
ccuucccaccucuc

SEQ ID NO: 3348259 - RNA, 19 nt, Human
ccuucccaccucucucacu

SEQ ID NO: 3348260 - RNA, 12 nt, Human
ccuucccaccuc

SEQ ID NO: 3348261 - RNA, 20 nt, Human
ccuuagcagggaaacagcua

SEQ ID NO: 3348262 - RNA, 19 nt, Human
ccuuagcagggaaacagcu

SEQ ID NO: 3348263 - RNA, 16 nt, Human
ccuuagcaaauucugu

SEQ ID NO: 3348264 - RNA, 17 nt, Human
ccuguugggccaggagc

SEQ ID NO: 3348265 - RNA, 18 nt, Human
ccuguugggccaggagcc

SEQ ID NO: 3348266 - RNA, 19 nt, Human
ccuguugggccaggagccu

SEQ ID NO: 3348267 - RNA, 20 nt, Human
ccuguugggccaggagccuc

SEQ ID NO: 3348268 - RNA, 16 nt, Human
ccuguugggccaggag

SEQ ID NO: 3348269 - RNA, 18 nt, Human
ccuguucccaugagauga

SEQ ID NO: 3348270 - RNA, 12 nt, Human
ccuguucuggca

SEQ ID NO: 3348271 - RNA, 17 nt, Human
ccuguucuggcagaguu

SEQ ID NO: 3348272 - RNA, 19 nt, Human
ccuguucagcuccagcuca

SEQ ID NO: 3348273 - RNA, 16 nt, Human
ccuguucagcuccagc

SEQ ID NO: 3348274 - RNA, 15 nt, Human
ccuguucagcuccag

SEQ ID NO: 3348275 - RNA, 14 nt, Human
ccuguucagcucca

SEQ ID NO: 3348276 - RNA, 21 nt, Human
ccuguucagcuccagcucacc

SEQ ID NO: 3348277 - RNA, 20 nt, Human
ccuguucagcuccagcucac

SEQ ID NO: 3348278 - RNA, 23 nt, Human
ccuguucagcuccagcucaccag

SEQ ID NO: 3348279 - RNA, 13 nt, Human
ccuguucagcucc

SEQ ID NO: 3348280 - RNA, 15 nt, Human
ccuuucaauaggaaa

SEQ ID NO: 3348281 - RNA, 17 nt, Human
ccuuucaauaggaaaaa

SEQ ID NO: 3348282 - RNA, 20 nt, Human
ccuucucuccagccccugga

SEQ ID NO: 3348283 - RNA, 16 nt, Human
ccuucucugaaggaca

SEQ ID NO: 3348284 - RNA, 14 nt, Human
ccuucucugaagga

SEQ ID NO: 3348285 - RNA, 21 nt, Human
ccuucucuccagccccuggau

SEQ ID NO: 3348286 - RNA, 23 nt, Human
ccuucucuccagccccuggaugc

SEQ ID NO: 3348287 - RNA, 19 nt, Human
ccuucucuccagccccugg

SEQ ID NO: 3348288 - RNA, 22 nt, Human
ccuucuguccuacucuguguca

SEQ ID NO: 3348289 - RNA, 21 nt, Human
ccuucuguccuacucuguguc

SEQ ID NO: 3348290 - RNA, 20 nt, Human
ccuucuguccuacucugugu

SEQ ID NO: 3348291 - RNA, 23 nt, Human
cucaggugucccugcacuugcag

SEQ ID NO: 3348292 - RNA, 19 nt, Human
cucaggugucccugcacuu

SEQ ID NO: 3348293 - RNA, 22 nt, Human
cucagucuggcccuuccuuuuc

SEQ ID NO: 3348294 - RNA, 17 nt, Human
cucaguccauagcagag

SEQ ID NO: 3348295 - RNA, 15 nt, Human
cucaguccauagcag

SEQ ID NO: 3348296 - RNA, 20 nt, Human
cucagucuggcccuuccuuu

SEQ ID NO: 3348297 - RNA, 13 nt, Human
cucagccucccga

SEQ ID NO: 3348298 - RNA, 22 nt, Human
cucagccucccgaauagcuggg

SEQ ID NO: 3348299 - RNA, 21 nt, Human
cucagccucccgaauagcugg

SEQ ID NO: 3348300 - RNA, 19 nt, Human
cucagccucccgaauagcu

SEQ ID NO: 3348301 - RNA, 23 nt, Human
cucagaagacacugaugggcaac

SEQ ID NO: 3348302 - RNA, 17 nt, Human
cucaccuuucccaucuu

SEQ ID NO: 3348303 - RNA, 22 nt, Human
cucagaagacacugaugggcaa

SEQ ID NO: 3348304 - RNA, 20 nt, Human
cucagaagacacugaugggc

SEQ ID NO: 3348305 - RNA, 17 nt, Human
cucagaagacacugaug

SEQ ID NO: 3348306 - RNA, 15 nt, Human
cucagaagacacuga

SEQ ID NO: 3348307 - RNA, 13 nt, Human
cucagaagacacu

SEQ ID NO: 3348308 - RNA, 19 nt, Human
cucaggccaaacucaccug

SEQ ID NO: 3348309 - RNA, 20 nt, Human
cucaggccaaacucaccugc

SEQ ID NO: 3348310 - RNA, 21 nt, Human
cucaggccaaacucaccugcc

SEQ ID NO: 3348311 - RNA, 15 nt, Human
cucaggccagcugcu

SEQ ID NO: 3348312 - RNA, 16 nt, Human
cucaggccagcugcuu

SEQ ID NO: 3348313 - RNA, 17 nt, Human
cucaggccagcugcuug

SEQ ID NO: 3348314 - RNA, 18 nt, Human
cucaggccagcugcuugg

SEQ ID NO: 3348315 - RNA, 22 nt, Human
cucaggccugggggcugggcag

SEQ ID NO: 3348316 - RNA, 11 nt, Human
cucaggccugg

SEQ ID NO: 3348317 - RNA, 23 nt, Human
cucaauuauuuugcauuuuuucu

SEQ ID NO: 3348318 - RNA, 21 nt, Human
cucaagugauucuccugccuc

SEQ ID NO: 3348319 - RNA, 22 nt, Human
cuauguugcccaggcaggucuu

SEQ ID NO: 3348320 - RNA, 21 nt, Human
cuauguugcccaggcaggucu

SEQ ID NO: 3348321 - RNA, 19 nt, Human
cuauguugcccaggcaggu

SEQ ID NO: 3348322 - RNA, 18 nt, Human
cuauguugcccaggcagg

SEQ ID NO: 3348323 - RNA, 17 nt, Human
cuauguugcccaggcag

SEQ ID NO: 3348324 - RNA, 13 nt, Human
cuaucucccccag

SEQ ID NO: 3348325 - RNA, 14 nt, Human
cuaugugagaccau

SEQ ID NO: 3348326 - RNA, 13 nt, Human
cucuccuccagag

SEQ ID NO: 3348327 - RNA, 15 nt, Human
cucuccuccagaguc

SEQ ID NO: 3348328 - RNA, 12 nt, Human
cucuccuccaga

SEQ ID NO: 3348329 - RNA, 16 nt, Human
cucuccuccagaguca

SEQ ID NO: 3348330 - RNA, 17 nt, Human
cuccuuugugaggaagc

SEQ ID NO: 3348331 - RNA, 18 nt, Human
cuccuuugugaggaagcc

SEQ ID NO: 3348332 - RNA, 17 nt, Human
cucgguguggagaagcg

SEQ ID NO: 3348333 - RNA, 16 nt, Human
cucgguguggagaagc

SEQ ID NO: 3348334 - RNA, 17 nt, Human
cucugcacuccccugcu

SEQ ID NO: 3348335 - RNA, 21 nt, Human
cucugcuccucuccccagcaa

SEQ ID NO: 3348336 - RNA, 20 nt, Human
cucugcuccucuccccagca

SEQ ID NO: 3348337 - RNA, 23 nt, Human
cucugcugacagacacaggcccg

SEQ ID NO: 3348338 - RNA, 13 nt, Human
cucugcugcuggc

SEQ ID NO: 3348339 - RNA, 20 nt, Human
cucugcugacagacacaggc

SEQ ID NO: 3348340 - RNA, 22 nt, Human
cucugcugacagacacaggccc

SEQ ID NO: 3348341 - RNA, 21 nt, Human
cucugcugacagacacaggcc

SEQ ID NO: 3348342 - RNA, 16 nt, Human
cucuguacagagccca

SEQ ID NO: 3348343 - RNA, 14 nt, Human
cucugcugcuggcu

SEQ ID NO: 3348344 - RNA, 15 nt, Human
cucugcugcuggcug

SEQ ID NO: 3348345 - RNA, 16 nt, Human
cucugcugcuggcugg

SEQ ID NO: 3348346 - RNA, 14 nt, Human
cucuguacagagcc

SEQ ID NO: 3348347 - RNA, 15 nt, Human
cucuguacagagccc

SEQ ID NO: 3348348 - RNA, 13 nt, Human
cucuguacagagc

SEQ ID NO: 3348349 - RNA, 15 nt, Human
cucugcacuccccug

SEQ ID NO: 3348350 - RNA, 16 nt, Human
cucugcacuccccugc

SEQ ID NO: 3348351 - RNA, 14 nt, Human
cucugcacuccccu

SEQ ID NO: 3348352 - RNA, 20 nt, Human
cucugcacaagcugcacccu

SEQ ID NO: 3348353 - RNA, 21 nt, Human
cucugcacaagcugcacccuc

SEQ ID NO: 3348354 - RNA, 19 nt, Human
cucugcacaagcugcaccc

SEQ ID NO: 3348355 - RNA, 20 nt, Human
cucccucuuucccucccuuc

SEQ ID NO: 3348356 - RNA, 22 nt, Human
cuccaggugcacaagcuccaag

SEQ ID NO: 3348357 - RNA, 20 nt, Human
cuccaggcuguaucccauga

SEQ ID NO: 3348358 - RNA, 23 nt, Human
cuccaggcuccuuuagcgcccag

SEQ ID NO: 3348359 - RNA, 15 nt, Human
cuccaggcuccuuua

SEQ ID NO: 3348360 - RNA, 23 nt, Human
cuccaggugcacaagcuccaagc

SEQ ID NO: 3348361 - RNA, 13 nt, Human
cuccucugcugcu

SEQ ID NO: 3348362 - RNA, 14 nt, Human
cuccucugcugcug

SEQ ID NO: 3348363 - RNA, 18 nt, Human
cuccuggcccacugcauc

SEQ ID NO: 3348364 - RNA, 19 nt, Human
cuccuggcccacugcaucg

SEQ ID NO: 3348365 - RNA, 18 nt, Human
cuccugggcuaagugauc

SEQ ID NO: 3348366 - RNA, 19 nt, Human
cuccuggccucaagugauu

SEQ ID NO: 3348367 - RNA, 16 nt, Human
cuccuguaccucuuga

SEQ ID NO: 3348368 - RNA, 15 nt, Human
cuccuuucaccacau

SEQ ID NO: 3348369 - RNA, 14 nt, Human
cuccuuguguuacu

SEQ ID NO: 3348370 - RNA, 23 nt, Human
cuccgcuuucuacccagcgagcc

SEQ ID NO: 3348371 - RNA, 18 nt, Human
augcuggcuguuggcugg

SEQ ID NO: 3348372 - RNA, 14 nt, Human
augcuccuggccca

SEQ ID NO: 3348373 - RNA, 14 nt, Human
uuuaucagaauucu

SEQ ID NO: 3348374 - RNA, 16 nt, Human
augcuucucacugcca

SEQ ID NO: 3348375 - RNA, 20 nt, Human
augcuucucacugccaugcc

SEQ ID NO: 3348376 - RNA, 17 nt, Human
auggaagacagcucuua

SEQ ID NO: 3348377 - RNA, 18 nt, Human
auggaagacagcucuuau

SEQ ID NO: 3348378 - RNA, 20 nt, Human
augcuggcuguuggcugggg

SEQ ID NO: 3348379 - RNA, 19 nt, Human
augcuggcuguuggcuggg

SEQ ID NO: 3348380 - RNA, 11 nt, Human
uuucagaaaug

SEQ ID NO: 3348381 - RNA, 12 nt, Human
uuucagaaaugu

SEQ ID NO: 3348382 - RNA, 16 nt, Human
uuucccuauuagagaa

SEQ ID NO: 3348383 - RNA, 12 nt, Human
uuucaaacuuua

SEQ ID NO: 3348384 - RNA, 18 nt, Human
uuuaccugaagucuuugu

SEQ ID NO: 3348385 - RNA, 16 nt, Human
uuuacugcagcuuugu

SEQ ID NO: 3348386 - RNA, 11 nt, Human
uuuacuuaaac

SEQ ID NO: 3348387 - RNA, 13 nt, Human
uuuacuucuuaua

SEQ ID NO: 3348388 - RNA, 14 nt, Human
uuuacuucuuauac

SEQ ID NO: 3348389 - RNA, 21 nt, Human
uuuaaugaaagacuguacaaa

SEQ ID NO: 3348390 - RNA, 21 nt, Human
augccaugaggaacaaggcaa

SEQ ID NO: 3348391 - RNA, 16 nt, Human
augcccagccccuucu

SEQ ID NO: 3348392 - RNA, 15 nt, Human
augcccagccccuuc

SEQ ID NO: 3348393 - RNA, 17 nt, Human
augcccagccccuucug

SEQ ID NO: 3348394 - RNA, 13 nt, Human
augccucucucag

SEQ ID NO: 3348395 - RNA, 14 nt, Human
augccucucucagg

SEQ ID NO: 3348396 - RNA, 15 nt, Human
augccucucucaggc

SEQ ID NO: 3348397 - RNA, 22 nt, Human
augcgugcauaccacuuuuguu

SEQ ID NO: 3348398 - RNA, 20 nt, Human
augcgugcauaccacuuuug

SEQ ID NO: 3348399 - RNA, 13 nt, Human
uugugaggaagcc

SEQ ID NO: 3348400 - RNA, 19 nt, Human
uugugauacaaugcugugc

SEQ ID NO: 3348401 - RNA, 20 nt, Human
uugugauacaaugcugugcc

SEQ ID NO: 3348402 - RNA, 17 nt, Human
uugugaggaagccgcug

SEQ ID NO: 3348403 - RNA, 18 nt, Human
uugugaggaagccgcugg

SEQ ID NO: 3348404 - RNA, 18 nt, Human
uuguccccaccgcagaca

SEQ ID NO: 3348405 - RNA, 20 nt, Human
uuguccccaccgcagacagg

SEQ ID NO: 3348406 - RNA, 15 nt, Human
uuguccccgacccuu

SEQ ID NO: 3348407 - RNA, 17 nt, Human
uugucacacacuuuggc

SEQ ID NO: 3348408 - RNA, 21 nt, Human
uugucauauaagauucauauu

SEQ ID NO: 3348409 - RNA, 13 nt, Human
augaguccccugu

SEQ ID NO: 3348410 - RNA, 15 nt, Human
augaggucagagccu

SEQ ID NO: 3348411 - RNA, 18 nt, Human
augaggucagagccugca

SEQ ID NO: 3348412 - RNA, 16 nt, Human
augaggucagagccug

SEQ ID NO: 3348413 - RNA, 20 nt, Human
augaggucagagccugcagu

SEQ ID NO: 3348414 - RNA, 19 nt, Human
augaggucagagccugcag

SEQ ID NO: 3348415 - RNA, 12 nt, Human
uuuaagagaaau

SEQ ID NO: 3348416 - RNA, 21 nt, Human
uuuaagcuguuacugucuuca

SEQ ID NO: 3348417 - RNA, 19 nt, Human
uuuaaggaugcuuguacau

SEQ ID NO: 3348418 - RNA, 20 nt, Human
uuuaaggaugcuuguacaua

SEQ ID NO: 3348419 - RNA, 21 nt, Human
uuuaaggaugcuuguacauaa

SEQ ID NO: 3348420 - RNA, 22 nt, Human
uuuaaggaugcuuguacauaau

SEQ ID NO: 3348421 - RNA, 16 nt, Human
uuuaaugaaagacugu

SEQ ID NO: 3348422 - RNA, 11 nt, Human
uuuaaaugcac

SEQ ID NO: 3348423 - RNA, 21 nt, Human
augcacuuuguucuggcucuu

SEQ ID NO: 3348424 - RNA, 23 nt, Human
augcacuuuguucuggcucuucc

SEQ ID NO: 3348425 - RNA, 17 nt, Human
uuguucuugguuuguaa

SEQ ID NO: 3348426 - RNA, 19 nt, Human
uuguucuugguuuguaaau

SEQ ID NO: 3348427 - RNA, 18 nt, Human
aucuagauacuguaucau

SEQ ID NO: 3348428 - RNA, 23 nt, Human
aucuaauauguaacaagccaccc

SEQ ID NO: 3348429 - RNA, 20 nt, Human
aucuaauauguaacaagcca

SEQ ID NO: 3348430 - RNA, 15 nt, Human
uugauacuacaguuu

SEQ ID NO: 3348431 - RNA, 17 nt, Human
uugauacuacaguuugu

SEQ ID NO: 3348432 - RNA, 21 nt, Human
uugagugcugucuccauguuu

SEQ ID NO: 3348433 - RNA, 11 nt, Human
uugagugccuu

SEQ ID NO: 3348434 - RNA, 17 nt, Human
aucuaggaagacuuugg

SEQ ID NO: 3348435 - RNA, 18 nt, Human
aucuaggaagacuuugga

SEQ ID NO: 3348436 - RNA, 19 nt, Human
aucuaggaagacuuuggaa

SEQ ID NO: 3348437 - RNA, 19 nt, Human
aucuagauacuguaucaug

SEQ ID NO: 3348438 - RNA, 21 nt, Human
aucucaaauaacuaaaaggua

SEQ ID NO: 3348439 - RNA, 14 nt, Human
aucucaaauaacua

SEQ ID NO: 3348440 - RNA, 14 nt, Human
aucucaaauuucua

SEQ ID NO: 3348441 - RNA, 23 nt, Human
aucucaaauaacuaaaagguaug

SEQ ID NO: 3348442 - RNA, 16 nt, Human
uugagcagggcucagc

SEQ ID NO: 3348443 - RNA, 12 nt, Human
uugagcagggcu

SEQ ID NO: 3348444 - RNA, 11 nt, Human
uugagacagag

SEQ ID NO: 3348445 - RNA, 12 nt, Human
uugacagggcac

SEQ ID NO: 3348446 - RNA, 10 nt, Human
uugacagggc

SEQ ID NO: 3348447 - RNA, 19 nt, Human
uugacaggauuauuggaaa

SEQ ID NO: 3348448 - RNA, 13 nt, Human
uugacaucaacug

SEQ ID NO: 3348449 - RNA, 16 nt, Human
uugacaucaacugcau

SEQ ID NO: 3348450 - RNA, 11 nt, Human
uugcccaggca

SEQ ID NO: 3348451 - RNA, 23 nt, Human
uugcccaggcuggcgugcagugg

SEQ ID NO: 3348452 - RNA, 14 nt, Human
uugcccaggcuggc

SEQ ID NO: 3348453 - RNA, 12 nt, Human
uugcccaggcug

SEQ ID NO: 3348454 - RNA, 11 nt, Human
uugcccaggcu

SEQ ID NO: 3348455 - RNA, 18 nt, Human
uugcccaggcaggucuug

SEQ ID NO: 3348456 - RNA, 16 nt, Human
uugcccaggcaggucu

SEQ ID NO: 3348457 - RNA, 14 nt, Human
uugcccaggcaggu

SEQ ID NO: 3348458 - RNA, 13 nt, Human
uugcccaggcagg

SEQ ID NO: 3348459 - RNA, 14 nt, Human
uugcaugaggcuag

SEQ ID NO: 3348460 - RNA, 12 nt, Human
uugcaugaggcu

SEQ ID NO: 3348461 - RNA, 18 nt, Human
uugcaccacugcacucca

SEQ ID NO: 3348462 - RNA, 21 nt, Human
uugcaccacugcacuccagcc

SEQ ID NO: 3348463 - RNA, 16 nt, Human
aucucaaauuucuaaa

SEQ ID NO: 3348464 - RNA, 17 nt, Human
aucucaaauuucuaaau

SEQ ID NO: 3348465 - RNA, 23 nt, Human
aucucacacaugagcaucaggcc

SEQ ID NO: 3348466 - RNA, 18 nt, Human
aucucuugagccugggag

SEQ ID NO: 3348467 - RNA, 16 nt, Human
aucucacacaugagca

SEQ ID NO: 3348468 - RNA, 15 nt, Human
uugauuaaauucuug

SEQ ID NO: 3348469 - RNA, 16 nt, Human
uugauuaaauucuugc

SEQ ID NO: 3348470 - RNA, 20 nt, Human
uugauuaaauucuugcaaag

SEQ ID NO: 3348471 - RNA, 23 nt, Human
uugauguucuuucacccuuuucu

SEQ ID NO: 3348472 - RNA, 15 nt, Human
uugcuuugugauuuu

SEQ ID NO: 3348473 - RNA, 17 nt, Human
uuggaaaauaaauuauu

SEQ ID NO: 3348474 - RNA, 20 nt, Human
uugcuuugugauuuuuguaa

SEQ ID NO: 3348475 - RNA, 14 nt, Human
aucuugcucugcug

SEQ ID NO: 3348476 - RNA, 13 nt, Human
aucuugcucugcu

SEQ ID NO: 3348477 - RNA, 16 nt, Human
aucuugcucugcugac

SEQ ID NO: 3348478 - RNA, 15 nt, Human
aucuugcucugcuga

SEQ ID NO: 3348479 - RNA, 17 nt, Human
aucugucauuugagcag

SEQ ID NO: 3348480 - RNA, 12 nt, Human
aucugucauuug

SEQ ID NO: 3348481 - RNA, 22 nt, Human
augaaccacaucuugcucugcu

SEQ ID NO: 3348482 - RNA, 23 nt, Human
augaaccacaucuugcucugcug

SEQ ID NO: 3348483 - RNA, 17 nt, Human
augaaugaaacauuuug

SEQ ID NO: 3348484 - RNA, 16 nt, Human
augaaugucaguguga

SEQ ID NO: 3348485 - RNA, 18 nt, Human
augaaugucagugugacu

SEQ ID NO: 3348486 - RNA, 18 nt, Human
uuggugguuucagaaaug

SEQ ID NO: 3348487 - RNA, 19 nt, Human
uuggugguuucagaaaugu

SEQ ID NO: 3348488 - RNA, 14 nt, Human
uugguuuguaaauu

SEQ ID NO: 3348489 - RNA, 18 nt, Human
uuggugucgggcaugaca

SEQ ID NO: 3348490 - RNA, 19 nt, Human
uuggugucgggcaugacac

SEQ ID NO: 3348491 - RNA, 17 nt, Human
uuggugucgggcaugac

SEQ ID NO: 3348492 - RNA, 15 nt, Human
uucugaaagggacgc

SEQ ID NO: 3348493 - RNA, 19 nt, Human
aucauugaaaucuuuuugc

SEQ ID NO: 3348494 - RNA, 23 nt, Human
uucugaacuuggcgcugccccug

SEQ ID NO: 3348495 - RNA, 22 nt, Human
uucugggacacaguucaauucu

SEQ ID NO: 3348496 - RNA, 11 nt, Human
uucugggacac

SEQ ID NO: 3348497 - RNA, 10 nt, Human
uucugggaca

SEQ ID NO: 3348498 - RNA, 16 nt, Human
uucugccgcagcccug

SEQ ID NO: 3348499 - RNA, 23 nt, Human
uucugccgcagcccugcagaggg

SEQ ID NO: 3348500 - RNA, 16 nt, Human
aucccauaugccuggg

SEQ ID NO: 3348501 - RNA, 16 nt, Human
auccagguucagcuug

SEQ ID NO: 3348502 - RNA, 15 nt, Human
auccagguucagcuu

SEQ ID NO: 3348503 - RNA, 22 nt, Human
uucucagaaucucaaauaacua

SEQ ID NO: 3348504 - RNA, 19 nt, Human
uucucagaaucucaaauaa

SEQ ID NO: 3348505 - RNA, 13 nt, Human
uucucagaaucuc

SEQ ID NO: 3348506 - RNA, 23 nt, Human
uucucagaaucucaaauaacuaa

SEQ ID NO: 3348507 - RNA, 13 nt, Human
uucuaggccuggg

SEQ ID NO: 3348508 - RNA, 17 nt, Human
aucagcacgauuucugu

SEQ ID NO: 3348509 - RNA, 15 nt, Human
aucagcacgauuucu

SEQ ID NO: 3348510 - RNA, 16 nt, Human
aucagcacgauuucug

SEQ ID NO: 3348511 - RNA, 14 nt, Human
aucauugaaaucuu

SEQ ID NO: 3348512 - RNA, 15 nt, Human
aucauugaaaucuuu

SEQ ID NO: 3348513 - RNA, 13 nt, Human
aucauugaaaucu

SEQ ID NO: 3348514 - RNA, 13 nt, Human
uuccuaauccucu

SEQ ID NO: 3348515 - RNA, 15 nt, Human
uuccuaauccucuag

SEQ ID NO: 3348516 - RNA, 11 nt, Human
uuccugugucu

SEQ ID NO: 3348517 - RNA, 17 nt, Human
uuccuguucccaugaga

SEQ ID NO: 3348518 - RNA, 11 nt, Human
uuccuucagug

SEQ ID NO: 3348519 - RNA, 14 nt, Human
uuccuucagugccu

SEQ ID NO: 3348520 - RNA, 13 nt, Human
aucaaguauuaua

SEQ ID NO: 3348521 - RNA, 14 nt, Human
aucaaguauuauac

SEQ ID NO: 3348522 - RNA, 18 nt, Human
aucaaguauuauaccuuu

SEQ ID NO: 3348523 - RNA, 19 nt, Human
aucacggcucacugcagcc

SEQ ID NO: 3348524 - RNA, 22 nt, Human
aucacggcucacugcagccuca

SEQ ID NO: 3348525 - RNA, 19 nt, Human
auauugauuuccguuaaaa

SEQ ID NO: 3348526 - RNA, 21 nt, Human
auauugauuuccguuaaaaua

SEQ ID NO: 3348527 - RNA, 22 nt, Human
auauugauuuccguuaaaauac

SEQ ID NO: 3348528 - RNA, 16 nt, Human
auauucuguuggccag

SEQ ID NO: 3348529 - RNA, 22 nt, Human
auauuaaggaagacaaugugaa

SEQ ID NO: 3348530 - RNA, 24 nt, Human
auauuaagaaagacuaucuaaaug

SEQ ID NO: 3348531 - RNA, 22 nt, Human
auauuaagaaagacuaucuaaa

SEQ ID NO: 3348532 - RNA, 20 nt, Human
auauguuuuaagaggcaggg

SEQ ID NO: 3348533 - RNA, 18 nt, Human
auauguuuuaagaggcag

SEQ ID NO: 3348534 - RNA, 20 nt, Human
auauuguuuucaguguacau

SEQ ID NO: 3348535 - RNA, 17 nt, Human
auauuguuuucagugua

SEQ ID NO: 3348536 - RNA, 17 nt, Human
auauugcugauggugca

SEQ ID NO: 3348537 - RNA, 16 nt, Human
auauaggaacuuaaau

SEQ ID NO: 3348538 - RNA, 14 nt, Human
uucagccaagaauu

SEQ ID NO: 3348539 - RNA, 19 nt, Human
uucagccaagaauucuuaa

SEQ ID NO: 3348540 - RNA, 17 nt, Human
uucagaucucuaacuuc

SEQ ID NO: 3348541 - RNA, 18 nt, Human
auauauagaaauauauac

SEQ ID NO: 3348542 - RNA, 22 nt, Human
auauauacgaacaaaacacacg

SEQ ID NO: 3348543 - RNA, 21 nt, Human
uucaucauccuaagcuauuca

SEQ ID NO: 3348544 - RNA, 18 nt, Human
uucaucauccuaagcuau

SEQ ID NO: 3348545 - RNA, 14 nt, Human
uucaguaauaacuc

SEQ ID NO: 3348546 - RNA, 21 nt, Human
uucauauuuacuucuuauaca

SEQ ID NO: 3348547 - RNA, 16 nt, Human
uucauauuuacuucuu

SEQ ID NO: 3348548 - RNA, 22 nt, Human
auaucugaaaauguauguguaa

SEQ ID NO: 3348549 - RNA, 14 nt, Human
auaugucaagccau

SEQ ID NO: 3348550 - RNA, 16 nt, Human
uuauuuaguuccuuga

SEQ ID NO: 3348551 - RNA, 22 nt, Human
uuauuuaaugaaagacuguaca

SEQ ID NO: 3348552 - RNA, 18 nt, Human
uuauuuaaugaaagacug

SEQ ID NO: 3348553 - RNA, 14 nt, Human
uuauuuaaauuuua

SEQ ID NO: 3348554 - RNA, 23 nt, Human
auagcuggucuuauuuguaaagc

SEQ ID NO: 3348555 - RNA, 22 nt, Human
auagcuggucuuauuuguaaag

SEQ ID NO: 3348556 - RNA, 17 nt, Human
auagcugggacuacagg

SEQ ID NO: 3348557 - RNA, 18 nt, Human
auagccugccucuucucu

SEQ ID NO: 3348558 - RNA, 17 nt, Human
auaagauaaaugugcug

SEQ ID NO: 3348559 - RNA, 13 nt, Human
auaagauaaaugu

SEQ ID NO: 3348560 - RNA, 12 nt, Human
auagcugggacu

SEQ ID NO: 3348561 - RNA, 21 nt, Human
auagcucaggugucccugcac

SEQ ID NO: 3348562 - RNA, 20 nt, Human
auagcucaggugucccugca

SEQ ID NO: 3348563 - RNA, 22 nt, Human
auagcucaggugucccugcacu

SEQ ID NO: 3348564 - RNA, 19 nt, Human
auagcucaggugucccugc

SEQ ID NO: 3348565 - RNA, 17 nt, Human
uucaaaauaaaaaugag

SEQ ID NO: 3348566 - RNA, 16 nt, Human
uucaaggauccugagc

SEQ ID NO: 3348567 - RNA, 18 nt, Human
uucaaggauccugagcca

SEQ ID NO: 3348568 - RNA, 19 nt, Human
uucaaggauccugagccag

SEQ ID NO: 3348569 - RNA, 21 nt, Human
uucaaggauccugagccagau

SEQ ID NO: 3348570 - RNA, 15 nt, Human
uucaaggauccugag

SEQ ID NO: 3348571 - RNA, 22 nt, Human
uucaccacaugugcacaugcac

SEQ ID NO: 3348572 - RNA, 17 nt, Human
uucacauauugauuucc

SEQ ID NO: 3348573 - RNA, 19 nt, Human
auaggaacuuaaauaaugu

SEQ ID NO: 3348574 - RNA, 13 nt, Human
auuacuucugcua

SEQ ID NO: 3348575 - RNA, 12 nt, Human
auuacuucugcu

SEQ ID NO: 3348576 - RNA, 14 nt, Human
auuacuucugcuac

SEQ ID NO: 3348577 - RNA, 23 nt, Human
uuuugugcauuaucuagauacug

SEQ ID NO: 3348578 - RNA, 23 nt, Human
uuuuuauacauaaacaagaccac

SEQ ID NO: 3348579 - RNA, 21 nt, Human
uuuuguuccacaaguuaaaua

SEQ ID NO: 3348580 - RNA, 16 nt, Human
uuuuguuuuugucuua

SEQ ID NO: 3348581 - RNA, 13 nt, Human
auuaaggaagaca

SEQ ID NO: 3348582 - RNA, 19 nt, Human
auuaaguacuauguaucaa

SEQ ID NO: 3348583 - RNA, 16 nt, Human
auuaaguacuauguau

SEQ ID NO: 3348584 - RNA, 18 nt, Human
auuaaguacuauguauca

SEQ ID NO: 3348585 - RNA, 19 nt, Human
auucccaagcucugcuccu

SEQ ID NO: 3348586 - RNA, 18 nt, Human
auucccaagcucugcucc

SEQ ID NO: 3348587 - RNA, 19 nt, Human
auuccccaggaggccagcc

SEQ ID NO: 3348588 - RNA, 20 nt, Human
auuccccaggaggccagccu

SEQ ID NO: 3348589 - RNA, 22 nt, Human
auuccccaggaggccagccuug

SEQ ID NO: 3348590 - RNA, 17 nt, Human
auucccaagcucugcuc

SEQ ID NO: 3348591 - RNA, 16 nt, Human
uuugugauacaaugcu

SEQ ID NO: 3348592 - RNA, 23 nt, Human
uuugucuuaaaaaguggaaaaau

SEQ ID NO: 3348593 - RNA, 13 nt, Human
uuugucuuaaaaa

SEQ ID NO: 3348594 - RNA, 14 nt, Human
uuugucuuaaaaag

SEQ ID NO: 3348595 - RNA, 15 nt, Human
uuugugauacaaugc

SEQ ID NO: 3348596 - RNA, 22 nt, Human
uuugugauacaaugcugugccc

SEQ ID NO: 3348597 - RNA, 19 nt, Human
uuugugcauuaucuagaua

SEQ ID NO: 3348598 - RNA, 22 nt, Human
uuugugcauuaucuagauacug

SEQ ID NO: 3348599 - RNA, 14 nt, Human
uuuguuucugaaag

SEQ ID NO: 3348600 - RNA, 16 nt, Human
uuuguuucugaaaggg

SEQ ID NO: 3348601 - RNA, 14 nt, Human
uuuguacagacaac

SEQ ID NO: 3348602 - RNA, 16 nt, Human
uuuguaauuuuuuuau

SEQ ID NO: 3348603 - RNA, 13 nt, Human
augugagaccauu

SEQ ID NO: 3348604 - RNA, 14 nt, Human
augugagacugguu

SEQ ID NO: 3348605 - RNA, 16 nt, Human
auguccaagaagccca

SEQ ID NO: 3348606 - RNA, 17 nt, Human
auguccaagaagcccag

SEQ ID NO: 3348607 - RNA, 12 nt, Human
auguaucaauga

SEQ ID NO: 3348608 - RNA, 14 nt, Human
uuugacaaggggca

SEQ ID NO: 3348609 - RNA, 19 nt, Human
uuugaccucugcagcaaua

SEQ ID NO: 3348610 - RNA, 21 nt, Human
uuugaccucugcagcaauaaa

SEQ ID NO: 3348611 - RNA, 23 nt, Human
uuucccucccuuccucuuuccau

SEQ ID NO: 3348612 - RNA, 23 nt, Human
uuugauuaaauucuugcaaagua

SEQ ID NO: 3348613 - RNA, 15 nt, Human
uuugauucagacagc

SEQ ID NO: 3348614 - RNA, 15 nt, Human
uuugauccaagcugg

SEQ ID NO: 3348615 - RNA, 14 nt, Human
uuugauccaagcug

SEQ ID NO: 3348616 - RNA, 13 nt, Human
uuugagacagagu

SEQ ID NO: 3348617 - RNA, 18 nt, Human
uuugaccucugcagcaau

SEQ ID NO: 3348618 - RNA, 12 nt, Human
uuuggcugcuga

SEQ ID NO: 3348619 - RNA, 13 nt, Human
uuuggcugcugaa

SEQ ID NO: 3348620 - RNA, 21 nt, Human
uuugggguacccacugcucug

SEQ ID NO: 3348621 - RNA, 22 nt, Human
uuugggguacccacugcucugg

SEQ ID NO: 3348622 - RNA, 22 nt, Human
uuuggauuggaugaauuccaaa

SEQ ID NO: 3348623 - RNA, 22 nt, Human
uuugcuggggccgaaagaacag

SEQ ID NO: 3348624 - RNA, 19 nt, Human
uuugcuggggccgaaagaa

SEQ ID NO: 3348625 - RNA, 22 nt, Human
auuaaaaaucucaaauuucuaa

SEQ ID NO: 3348626 - RNA, 23 nt, Human
auuaaaaaucucaaauuucuaaa

SEQ ID NO: 3348627 - RNA, 19 nt, Human
auuaaaacacaacaucuuu

SEQ ID NO: 3348628 - RNA, 17 nt, Human
auguuggccaggcuggu

SEQ ID NO: 3348629 - RNA, 13 nt, Human
uuuucuguucuuu

SEQ ID NO: 3348630 - RNA, 16 nt, Human
auguuggccaggcugg

SEQ ID NO: 3348631 - RNA, 23 nt, Human
uuuucuacucgaguuacagacaa

SEQ ID NO: 3348632 - RNA, 12 nt, Human
uuuuauuaaauu

SEQ ID NO: 3348633 - RNA, 15 nt, Human
uuuuaguagagacag

SEQ ID NO: 3348634 - RNA, 18 nt, Human
uuuuauggcuuuugugca

SEQ ID NO: 3348635 - RNA, 19 nt, Human
uuuuauggcuuuugugcau

SEQ ID NO: 3348636 - RNA, 15 nt, Human
auguugcccaggcag

SEQ ID NO: 3348637 - RNA, 14 nt, Human
auguugcccaggca

SEQ ID NO: 3348638 - RNA, 18 nt, Human
auguugaaagaucaaaag

SEQ ID NO: 3348639 - RNA, 13 nt, Human
auguugcccaggc

SEQ ID NO: 3348640 - RNA, 20 nt, Human
auguucuuucacccuuuucu

SEQ ID NO: 3348641 - RNA, 12 nt, Human
auguugaaagau

SEQ ID NO: 3348642 - RNA, 17 nt, Human
uuuuagaguugauacua

SEQ ID NO: 3348643 - RNA, 21 nt, Human
uuuuagacccuauugcugcuu

SEQ ID NO: 3348644 - RNA, 20 nt, Human
auguuacauaagauaaaugu

SEQ ID NO: 3348645 - RNA, 19 nt, Human
auguuacauaagauaaaug

SEQ ID NO: 3348646 - RNA, 18 nt, Human
uuuuaaaaaacugcugac

SEQ ID NO: 3348647 - RNA, 18 nt, Human
auugcaacaggcugggcu

SEQ ID NO: 3348648 - RNA, 17 nt, Human
auugcaacaggcugggc

SEQ ID NO: 3348649 - RNA, 12 nt, Human
auugcaccacug

SEQ ID NO: 3348650 - RNA, 16 nt, Human
auugcaacaggcuggg

SEQ ID NO: 3348651 - RNA, 23 nt, Human
auuggcuagagguucaaagauau

SEQ ID NO: 3348652 - RNA, 19 nt, Human
auuggcuagagguucaaag

SEQ ID NO: 3348653 - RNA, 20 nt, Human
auuggcuagagguucaaaga

SEQ ID NO: 3348654 - RNA, 22 nt, Human
auuggcuagagguucaaagaua

SEQ ID NO: 3348655 - RNA, 17 nt, Human
auuugaggucuguucuu

SEQ ID NO: 3348656 - RNA, 18 nt, Human
auuugaggucuguucuuu

SEQ ID NO: 3348657 - RNA, 15 nt, Human
auuugaggucuguuc

SEQ ID NO: 3348658 - RNA, 15 nt, Human
auuugagcagggcuc

SEQ ID NO: 3348659 - RNA, 21 nt, Human
auuuggugguuucagaaaugu

SEQ ID NO: 3348660 - RNA, 21 nt, Human
auuugaggucuguucuuucca

SEQ ID NO: 3348661 - RNA, 17 nt, Human
auuuccguuaaaauacc

SEQ ID NO: 3348662 - RNA, 14 nt, Human
auuucccaaagcag

SEQ ID NO: 3348663 - RNA, 20 nt, Human
auuuacuucuuauacauuug

SEQ ID NO: 3348664 - RNA, 19 nt, Human
auuuacuucuuauacauuu

SEQ ID NO: 3348665 - RNA, 17 nt, Human
auuuacuucuuauacau

SEQ ID NO: 3348666 - RNA, 22 nt, Human
auuuacaacugggggaggguga

SEQ ID NO: 3348667 - RNA, 17 nt, Human
auuguuuucaguguaca

SEQ ID NO: 3348668 - RNA, 19 nt, Human
auuguuuucaguguacaug

SEQ ID NO: 3348669 - RNA, 18 nt, Human
auuguuuucaguguacau

SEQ ID NO: 3348670 - RNA, 16 nt, Human
ugaguacguugugcau

SEQ ID NO: 3348671 - RNA, 17 nt, Human
ugaguacguugugcauu

SEQ ID NO: 3348672 - RNA, 18 nt, Human
ugaguacguugugcauuu

SEQ ID NO: 3348673 - RNA, 19 nt, Human
ugaguacguugugcauuug

SEQ ID NO: 3348674 - RNA, 23 nt, Human
agcauaaaaauuagccaagugug

SEQ ID NO: 3348675 - RNA, 19 nt, Human
agcauaaaaauuagccaag

SEQ ID NO: 3348676 - RNA, 17 nt, Human
ugagugcagcucuggag

SEQ ID NO: 3348677 - RNA, 13 nt, Human
ugagugccuuaca

SEQ ID NO: 3348678 - RNA, 14 nt, Human
ugagugccuuacac

SEQ ID NO: 3348679 - RNA, 14 nt, Human
ugagugagcaugcc

SEQ ID NO: 3348680 - RNA, 20 nt, Human
ugaguacguugugcauuugg

SEQ ID NO: 3348681 - RNA, 18 nt, Human
ugagucaccaagcccagu

SEQ ID NO: 3348682 - RNA, 18 nt, Human
ugaguucauacccuguua

SEQ ID NO: 3348683 - RNA, 21 nt, Human
ugagugggggaucacagccuc

SEQ ID NO: 3348684 - RNA, 14 nt, Human
ugauacaaugcugu

SEQ ID NO: 3348685 - RNA, 15 nt, Human
ugauacaaugcugug

SEQ ID NO: 3348686 - RNA, 13 nt, Human
agcaggacaugga

SEQ ID NO: 3348687 - RNA, 11 nt, Human
agcagccacau

SEQ ID NO: 3348688 - RNA, 16 nt, Human
agcagcagggagggcu

SEQ ID NO: 3348689 - RNA, 20 nt, Human
ugacccaugcugcccuguga

SEQ ID NO: 3348690 - RNA, 18 nt, Human
ugacccaugcugcccugu

SEQ ID NO: 3348691 - RNA, 19 nt, Human
ugacccaugcugcccugug

SEQ ID NO: 3348692 - RNA, 17 nt, Human
ugacccaugcugcccug

SEQ ID NO: 3348693 - RNA, 17 nt, Human
agcaggcucgggcuccc

SEQ ID NO: 3348694 - RNA, 13 nt, Human
agcaggcucucag

SEQ ID NO: 3348695 - RNA, 14 nt, Human
agcaggcucucagg

SEQ ID NO: 3348696 - RNA, 15 nt, Human
agcaggcucucaggc

SEQ ID NO: 3348697 - RNA, 16 nt, Human
agcaggcucucaggcc

SEQ ID NO: 3348698 - RNA, 17 nt, Human
agcaggcucucaggcca

SEQ ID NO: 3348699 - RNA, 18 nt, Human
agcaggcucucaggccag

SEQ ID NO: 3348700 - RNA, 19 nt, Human
agcaggcucucaggccagc

SEQ ID NO: 3348701 - RNA, 21 nt, Human
agcaggcucucaggccagcug

SEQ ID NO: 3348702 - RNA, 22 nt, Human
agcaggcucucaggccagcugc

SEQ ID NO: 3348703 - RNA, 23 nt, Human
agcaggcucucaggccagcugcu

SEQ ID NO: 3348704 - RNA, 15 nt, Human
agcagggaaacagcu

SEQ ID NO: 3348705 - RNA, 14 nt, Human
agcagggaaacagc

SEQ ID NO: 3348706 - RNA, 13 nt, Human
agcagggaaacag

SEQ ID NO: 3348707 - RNA, 22 nt, Human
agcagggcucagcggggacagc

SEQ ID NO: 3348708 - RNA, 15 nt, Human
agcagggcucagcgg

SEQ ID NO: 3348709 - RNA, 14 nt, Human
agcagggcucagcg

SEQ ID NO: 3348710 - RNA, 13 nt, Human
agcagggcucagc

SEQ ID NO: 3348711 - RNA, 20 nt, Human
agcagggagggcuucugcca

SEQ ID NO: 3348712 - RNA, 15 nt, Human
agcauuuugcuaaau

SEQ ID NO: 3348713 - RNA, 22 nt, Human
agcauuuugcuaaaugugaaug

SEQ ID NO: 3348714 - RNA, 19 nt, Human
agcauggcugccaauggga

SEQ ID NO: 3348715 - RNA, 13 nt, Human
agcauggcugcca

SEQ ID NO: 3348716 - RNA, 16 nt, Human
agcauauucaggaagc

SEQ ID NO: 3348717 - RNA, 22 nt, Human
agcaucaggccaggcccucugc

SEQ ID NO: 3348718 - RNA, 21 nt, Human
agcaucaggccaggcccucug

SEQ ID NO: 3348719 - RNA, 23 nt, Human
agcaucaggccaggcccucugcc

SEQ ID NO: 3348720 - RNA, 14 nt, Human
ugaucacggcucac

SEQ ID NO: 3348721 - RNA, 13 nt, Human
ugaucacggcuca

SEQ ID NO: 3348722 - RNA, 15 nt, Human
ugaucacggcucacu

SEQ ID NO: 3348723 - RNA, 17 nt, Human
agcauauucaggaagcu

SEQ ID NO: 3348724 - RNA, 19 nt, Human
agcauauucaggaagcuca

SEQ ID NO: 3348725 - RNA, 21 nt, Human
agcauauucaggaagcucagg

SEQ ID NO: 3348726 - RNA, 18 nt, Human
ugauccucccaccucagc

SEQ ID NO: 3348727 - RNA, 20 nt, Human
ugauccucccaccucagccu

SEQ ID NO: 3348728 - RNA, 19 nt, Human
ugauccucccaccucagcc

SEQ ID NO: 3348729 - RNA, 13 nt, Human
ugaucuaggaaga

SEQ ID NO: 3348730 - RNA, 16 nt, Human
ugauccucccaccuca

SEQ ID NO: 3348731 - RNA, 21 nt, Human
ugaugaucuuugcagacaggc

SEQ ID NO: 3348732 - RNA, 13 nt, Human
ugauggggcccug

SEQ ID NO: 3348733 - RNA, 22 nt, Human
ugaugggcaacccccagccugc

SEQ ID NO: 3348734 - RNA, 21 nt, Human
ugaugggcaacccccagccug

SEQ ID NO: 3348735 - RNA, 22 nt, Human
ugaugaaaugaggucagagccu

SEQ ID NO: 3348736 - RNA, 14 nt, Human
ugaucuaggaagac

SEQ ID NO: 3348737 - RNA, 20 nt, Human
ugaugaucuuugcagacagg

SEQ ID NO: 3348738 - RNA, 19 nt, Human
ugaugaucuuugcagacag

SEQ ID NO: 3348739 - RNA, 23 nt, Human
ugaugaaaugaggucagagccug

SEQ ID NO: 3348740 - RNA, 13 nt, Human
ugauuaaauucuu

SEQ ID NO: 3348741 - RNA, 16 nt, Human
ugauuaaauucuugca

SEQ ID NO: 3348742 - RNA, 20 nt, Human
ugauuaaccacuucagcuga

SEQ ID NO: 3348743 - RNA, 16 nt, Human
agccacggccaggcca

SEQ ID NO: 3348744 - RNA, 21 nt, Human
ugauguuuuaaggaugcuugu

SEQ ID NO: 3348745 - RNA, 17 nt, Human
ugauguuuuccaugagu

SEQ ID NO: 3348746 - RNA, 18 nt, Human
ugauguuuuaaggaugcu

SEQ ID NO: 3348747 - RNA, 19 nt, Human
ugauguuuuccaugagucc

SEQ ID NO: 3348748 - RNA, 22 nt, Human
ugauggggcccugccuccuuug

SEQ ID NO: 3348749 - RNA, 17 nt, Human
ugcagccucacaguccu

SEQ ID NO: 3348750 - RNA, 21 nt, Human
ugcagccucacaguccuuacc

SEQ ID NO: 3348751 - RNA, 18 nt, Human
ugcagccucacaguccuu

SEQ ID NO: 3348752 - RNA, 21 nt, Human
ugcagacaggcaagcaccucc

SEQ ID NO: 3348753 - RNA, 13 nt, Human
ugcagacaggcaa

SEQ ID NO: 3348754 - RNA, 12 nt, Human
ugcagacaggca

SEQ ID NO: 3348755 - RNA, 14 nt, Human
agccuccugcccuu

SEQ ID NO: 3348756 - RNA, 18 nt, Human
agccuccugcccuuaccu

SEQ ID NO: 3348757 - RNA, 13 nt, Human
agccuccugcccu

SEQ ID NO: 3348758 - RNA, 19 nt, Human
ugcaugcugucccuuacgu

SEQ ID NO: 3348759 - RNA, 21 nt, Human
ugcaugcugucccuuacguga

SEQ ID NO: 3348760 - RNA, 16 nt, Human
ugcaugcugucccuua

SEQ ID NO: 3348761 - RNA, 18 nt, Human
ugcaugcugucccuuacg

SEQ ID NO: 3348762 - RNA, 17 nt, Human
ugcaucguuucaucuuc

SEQ ID NO: 3348763 - RNA, 18 nt, Human
ugcauaccacuuuuguuc

SEQ ID NO: 3348764 - RNA, 20 nt, Human
ugcauaccacuuuuguucuu

SEQ ID NO: 3348765 - RNA, 16 nt, Human
ugcauaccacuuuugu

SEQ ID NO: 3348766 - RNA, 14 nt, Human
ugcauaccacuuuu

SEQ ID NO: 3348767 - RNA, 20 nt, Human
agccuuagaagucacacagu

SEQ ID NO: 3348768 - RNA, 23 nt, Human
agccuugaacuuugaccucugca

SEQ ID NO: 3348769 - RNA, 19 nt, Human
agccuugcggaagguucua

SEQ ID NO: 3348770 - RNA, 21 nt, Human
agccuugaccauucuccaccu

SEQ ID NO: 3348771 - RNA, 18 nt, Human
agccuugaccauucucca

SEQ ID NO: 3348772 - RNA, 19 nt, Human
agccuugaccauucuccac

SEQ ID NO: 3348773 - RNA, 22 nt, Human
agcgcccaguuggguggaugcc

SEQ ID NO: 3348774 - RNA, 18 nt, Human
agccugugccucugggac

SEQ ID NO: 3348775 - RNA, 17 nt, Human
agccugugccucuggga

SEQ ID NO: 3348776 - RNA, 16 nt, Human
ugcauuuaaaagauac

SEQ ID NO: 3348777 - RNA, 13 nt, Human
ugccaauggacua

SEQ ID NO: 3348778 - RNA, 14 nt, Human
ugccaaugggagcu

SEQ ID NO: 3348779 - RNA, 17 nt, Human
ugccagccgagauagcc

SEQ ID NO: 3348780 - RNA, 22 nt, Human
ugccagccgagauagccaaggc

SEQ ID NO: 3348781 - RNA, 16 nt, Human
agcccgggcucugccu

SEQ ID NO: 3348782 - RNA, 14 nt, Human
agcccugcagaggg

SEQ ID NO: 3348783 - RNA, 15 nt, Human
agcccugcagagggc

SEQ ID NO: 3348784 - RNA, 16 nt, Human
agcccugcagagggca

SEQ ID NO: 3348785 - RNA, 19 nt, Human
agcccugcagagggcacag

SEQ ID NO: 3348786 - RNA, 13 nt, Human
agcccgggcucug

SEQ ID NO: 3348787 - RNA, 14 nt, Human
agcccgggcucugc

SEQ ID NO: 3348788 - RNA, 15 nt, Human
agcccgggcucugcc

SEQ ID NO: 3348789 - RNA, 15 nt, Human
agccccuucugaccc

SEQ ID NO: 3348790 - RNA, 16 nt, Human
agccccuucugaccca

SEQ ID NO: 3348791 - RNA, 14 nt, Human
agccccuucugacc

SEQ ID NO: 3348792 - RNA, 22 nt, Human
agccccuggaugcagccucaca

SEQ ID NO: 3348793 - RNA, 14 nt, Human
agcccaggccuccu

SEQ ID NO: 3348794 - RNA, 19 nt, Human
agcccaggccuccuacagc

SEQ ID NO: 3348795 - RNA, 14 nt, Human
agccccgaggccuu

SEQ ID NO: 3348796 - RNA, 21 nt, Human
ugcaccacugcacuccagccu

SEQ ID NO: 3348797 - RNA, 13 nt, Human
ugcaccagcccuu

SEQ ID NO: 3348798 - RNA, 15 nt, Human
ugcaccacugcacuc

SEQ ID NO: 3348799 - RNA, 14 nt, Human
ugcaccggcuggcc

SEQ ID NO: 3348800 - RNA, 15 nt, Human
ugcaccggcuggccu

SEQ ID NO: 3348801 - RNA, 16 nt, Human
ugcaccggcuggccug

SEQ ID NO: 3348802 - RNA, 14 nt, Human
ugcacuccagccug

SEQ ID NO: 3348803 - RNA, 16 nt, Human
ugcacuccagccuggg

SEQ ID NO: 3348804 - RNA, 15 nt, Human
ugcacuccagccugg

SEQ ID NO: 3348805 - RNA, 12 nt, Human
agcccaggccuc

SEQ ID NO: 3348806 - RNA, 15 nt, Human
ugcaaggucauuuuu

SEQ ID NO: 3348807 - RNA, 20 nt, Human
ugcaaaguaucccuacugua

SEQ ID NO: 3348808 - RNA, 21 nt, Human
ugcaaaggguaucaggugcug

SEQ ID NO: 3348809 - RNA, 18 nt, Human
ugcaaaccaucauugaaa

SEQ ID NO: 3348810 - RNA, 12 nt, Human
ugcaaaccauca

SEQ ID NO: 3348811 - RNA, 13 nt, Human
ugcaaaccaucau

SEQ ID NO: 3348812 - RNA, 18 nt, Human
agccacggccaggccaga

SEQ ID NO: 3348813 - RNA, 17 nt, Human
agccacggccaggccag

SEQ ID NO: 3348814 - RNA, 23 nt, Human
ugccugcccaggccccugccacc

SEQ ID NO: 3348815 - RNA, 22 nt, Human
ugccugcccaggccccugccac

SEQ ID NO: 3348816 - RNA, 20 nt, Human
ugccugcccaggccccugcc

SEQ ID NO: 3348817 - RNA, 17 nt, Human
ugccucugccucugaca

SEQ ID NO: 3348818 - RNA, 20 nt, Human
ugccucugccucugacacac

SEQ ID NO: 3348819 - RNA, 18 nt, Human
ugccucugccucugacac

SEQ ID NO: 3348820 - RNA, 14 nt, Human
ugccucagccuccc

SEQ ID NO: 3348821 - RNA, 16 nt, Human
ugccuggauggggcug

SEQ ID NO: 3348822 - RNA, 17 nt, Human
ugccuggauggggcugc

SEQ ID NO: 3348823 - RNA, 20 nt, Human
ugccuggauggggcugcacc

SEQ ID NO: 3348824 - RNA, 16 nt, Human
agcugccuguucagcu

SEQ ID NO: 3348825 - RNA, 14 nt, Human
agcugccuguucag

SEQ ID NO: 3348826 - RNA, 18 nt, Human
agcugccuguucagcucc

SEQ ID NO: 3348827 - RNA, 16 nt, Human
agcugcuugggcuuca

SEQ ID NO: 3348828 - RNA, 23 nt, Human
agcugugcucuggacaggcaugu

SEQ ID NO: 3348829 - RNA, 18 nt, Human
agcugugcucuggacagg

SEQ ID NO: 3348830 - RNA, 17 nt, Human
agcugugcucuggacag

SEQ ID NO: 3348831 - RNA, 18 nt, Human
agcuguuacugucuucag

SEQ ID NO: 3348832 - RNA, 14 nt, Human
agcuguuacugucu

SEQ ID NO: 3348833 - RNA, 19 nt, Human
agcugggacuacaggcacc

SEQ ID NO: 3348834 - RNA, 22 nt, Human
agcugggguggggaccucaggc

SEQ ID NO: 3348835 - RNA, 23 nt, Human
agcugggguggggaccucaggcc

SEQ ID NO: 3348836 - RNA, 20 nt, Human
agcugggguggggaccucag

SEQ ID NO: 3348837 - RNA, 16 nt, Human
agcugggacuacaggu

SEQ ID NO: 3348838 - RNA, 23 nt, Human
agcugggacuacaggcacccacc

SEQ ID NO: 3348839 - RNA, 20 nt, Human
agcugggacuacaggcaccc

SEQ ID NO: 3348840 - RNA, 19 nt, Human
agcuguuacugucuucagu

SEQ ID NO: 3348841 - RNA, 21 nt, Human
ugccuguucagcuccagcuca

SEQ ID NO: 3348842 - RNA, 16 nt, Human
ugccuguugggccagg

SEQ ID NO: 3348843 - RNA, 17 nt, Human
ugccuguugggccagga

SEQ ID NO: 3348844 - RNA, 20 nt, Human
ugccuuacccucauguucuu

SEQ ID NO: 3348845 - RNA, 16 nt, Human
ugccuuggggacaaga

SEQ ID NO: 3348846 - RNA, 21 nt, Human
ugccuuacccucauguucuua

SEQ ID NO: 3348847 - RNA, 16 nt, Human
agcucucuccucccuu

SEQ ID NO: 3348848 - RNA, 21 nt, Human
agcuccuucuguccuacucug

SEQ ID NO: 3348849 - RNA, 16 nt, Human
agcuccuucuguccua

SEQ ID NO: 3348850 - RNA, 12 nt, Human
agcucuggucca

SEQ ID NO: 3348851 - RNA, 17 nt, Human
agcucugguccauagag

SEQ ID NO: 3348852 - RNA, 14 nt, Human
agcucuguccuggg

SEQ ID NO: 3348853 - RNA, 23 nt, Human
agcucccaggcauuccccaggag

SEQ ID NO: 3348854 - RNA, 15 nt, Human
agcuccuucuguccu

SEQ ID NO: 3348855 - RNA, 13 nt, Human
agcuccuucuguc

SEQ ID NO: 3348856 - RNA, 13 nt, Human
agcucccaggcau

SEQ ID NO: 3348857 - RNA, 21 nt, Human
agcucuguccugggagugagc

SEQ ID NO: 3348858 - RNA, 16 nt, Human
agcucuguccugggag

SEQ ID NO: 3348859 - RNA, 20 nt, Human
agcugccagccgagauagcc

SEQ ID NO: 3348860 - RNA, 14 nt, Human
agcugccagccgag

SEQ ID NO: 3348861 - RNA, 18 nt, Human
ugcccuuaccugccagga

SEQ ID NO: 3348862 - RNA, 12 nt, Human
ugccgcagcccu

SEQ ID NO: 3348863 - RNA, 13 nt, Human
ugccucagccucc

SEQ ID NO: 3348864 - RNA, 12 nt, Human
ugccucagccuc

SEQ ID NO: 3348865 - RNA, 13 nt, Human
aggaagcucaggg

SEQ ID NO: 3348866 - RNA, 14 nt, Human
aggaagcucagggc

SEQ ID NO: 3348867 - RNA, 12 nt, Human
aggaagcucagg

SEQ ID NO: 3348868 - RNA, 15 nt, Human
aggaagcucagggcc

SEQ ID NO: 3348869 - RNA, 23 nt, Human
aggaaaggcuccaggagcagcca

SEQ ID NO: 3348870 - RNA, 21 nt, Human
ugcuccagcuguucagcuggu

SEQ ID NO: 3348871 - RNA, 20 nt, Human
ugcuccagcuguucagcugg

SEQ ID NO: 3348872 - RNA, 15 nt, Human
ugcucugcugacaga

SEQ ID NO: 3348873 - RNA, 14 nt, Human
ugcucugcugacag

SEQ ID NO: 3348874 - RNA, 14 nt, Human
ugcuaucuccccca

SEQ ID NO: 3348875 - RNA, 17 nt, Human
ugcuaucucccccagcc

SEQ ID NO: 3348876 - RNA, 13 nt, Human
ugcuaucuccccc

SEQ ID NO: 3348877 - RNA, 20 nt, Human
agcuuaaaggggcuagagug

SEQ ID NO: 3348878 - RNA, 11 nt, Human
ugcuacacacu

SEQ ID NO: 3348879 - RNA, 15 nt, Human
ugcgguccacccagg

SEQ ID NO: 3348880 - RNA, 14 nt, Human
ugcgguccacccag

SEQ ID NO: 3348881 - RNA, 14 nt, Human
aggaaaagcugcug

SEQ ID NO: 3348882 - RNA, 21 nt, Human
agcuuguaaauagcucaggug

SEQ ID NO: 3348883 - RNA, 20 nt, Human
agcuugaccgugaggccaga

SEQ ID NO: 3348884 - RNA, 22 nt, Human
agcuugaccgugaggccagaga

SEQ ID NO: 3348885 - RNA, 19 nt, Human
agcuugaccgugaggccag

SEQ ID NO: 3348886 - RNA, 23 nt, Human
agcuugaccgugaggccagagac

SEQ ID NO: 3348887 - RNA, 22 nt, Human
agcuugaggguugggcuggugu

SEQ ID NO: 3348888 - RNA, 16 nt, Human
uggaagacagcucuua

SEQ ID NO: 3348889 - RNA, 15 nt, Human
uggaagacagcucuu

SEQ ID NO: 3348890 - RNA, 23 nt, Human
uggaaauuuguuauaaugaauga

SEQ ID NO: 3348891 - RNA, 21 nt, Human
uggaaauuuguuauaaugaau

SEQ ID NO: 3348892 - RNA, 18 nt, Human
ugcuuuuggucuguguga

SEQ ID NO: 3348893 - RNA, 17 nt, Human
ugcuuuuggucugugug

SEQ ID NO: 3348894 - RNA, 23 nt, Human
ugcuuuuuaauauugauaugcuu

SEQ ID NO: 3348895 - RNA, 20 nt, Human
ugcuuuugucuaugggacuc

SEQ ID NO: 3348896 - RNA, 22 nt, Human
ugcuuugugauuuuuguaauuu

SEQ ID NO: 3348897 - RNA, 17 nt, Human
ugcuuugugauuuuugu

SEQ ID NO: 3348898 - RNA, 15 nt, Human
ugcuugagcucagga

SEQ ID NO: 3348899 - RNA, 12 nt, Human
aggaucagucug

SEQ ID NO: 3348900 - RNA, 13 nt, Human
aggaucagucuga

SEQ ID NO: 3348901 - RNA, 19 nt, Human
aggauucuuccucccuccc

SEQ ID NO: 3348902 - RNA, 17 nt, Human
aggauucuuccucccuc

SEQ ID NO: 3348903 - RNA, 22 nt, Human
aggaugaucuaggaagacuuug

SEQ ID NO: 3348904 - RNA, 23 nt, Human
aggaugaucuaggaagacuuugg

SEQ ID NO: 3348905 - RNA, 22 nt, Human
aggaugcacagaguuguuacau

SEQ ID NO: 3348906 - RNA, 16 nt, Human
aggauucuuccucccu

SEQ ID NO: 3348907 - RNA, 20 nt, Human
aggaugaucuaggaagacuu

SEQ ID NO: 3348908 - RNA, 16 nt, Human
uggaagcacagcuuca

SEQ ID NO: 3348909 - RNA, 16 nt, Human
aggagccuccugcccu

SEQ ID NO: 3348910 - RNA, 12 nt, Human
aggagcagccac

SEQ ID NO: 3348911 - RNA, 13 nt, Human
aggagcagccaca

SEQ ID NO: 3348912 - RNA, 19 nt, Human
aggacuuuucuuuguggcu

SEQ ID NO: 3348913 - RNA, 17 nt, Human
aggacuuuucuuugugg

SEQ ID NO: 3348914 - RNA, 22 nt, Human
aggacuuuucuuuguggcuucc

SEQ ID NO: 3348915 - RNA, 13 nt, Human
aggccagccuuga

SEQ ID NO: 3348916 - RNA, 15 nt, Human
aggccagccuugacc

SEQ ID NO: 3348917 - RNA, 23 nt, Human
uggcagcucaccucucccuugga

SEQ ID NO: 3348918 - RNA, 21 nt, Human
uggcagcucaccucucccuug

SEQ ID NO: 3348919 - RNA, 22 nt, Human
uggcagcucaccucucccuugg

SEQ ID NO: 3348920 - RNA, 20 nt, Human
uggcacccggccccugcugg

SEQ ID NO: 3348921 - RNA, 19 nt, Human
uggcacccggccccugcug

SEQ ID NO: 3348922 - RNA, 18 nt, Human
uggcacccggccccugcu

SEQ ID NO: 3348923 - RNA, 16 nt, Human
uggcacccggccccug

SEQ ID NO: 3348924 - RNA, 13 nt, Human
aggcccagagggc

SEQ ID NO: 3348925 - RNA, 17 nt, Human
aggcccggcuccaggcu

SEQ ID NO: 3348926 - RNA, 13 nt, Human
aggcccggcucca

SEQ ID NO: 3348927 - RNA, 14 nt, Human
aggccccgcccagg

SEQ ID NO: 3348928 - RNA, 23 nt, Human
uggcacaucagcacgauuucugu

SEQ ID NO: 3348929 - RNA, 21 nt, Human
uggcacaucagcacgauuucu

SEQ ID NO: 3348930 - RNA, 23 nt, Human
uggaugccugguggcagcugcgg

SEQ ID NO: 3348931 - RNA, 21 nt, Human
uggaugccugguggcagcugc

SEQ ID NO: 3348932 - RNA, 20 nt, Human
uggaugccugguggcagcug

SEQ ID NO: 3348933 - RNA, 14 nt, Human
uggagugcagugag

SEQ ID NO: 3348934 - RNA, 16 nt, Human
aggcauuugcugaaua

SEQ ID NO: 3348935 - RNA, 20 nt, Human
uggagguacgaaaagagggg

SEQ ID NO: 3348936 - RNA, 16 nt, Human
aggcaaggcugucaau

SEQ ID NO: 3348937 - RNA, 19 nt, Human
aggcaagcaccuccugccu

SEQ ID NO: 3348938 - RNA, 18 nt, Human
aggcaagcaccuccugcc

SEQ ID NO: 3348939 - RNA, 20 nt, Human
aggcaagcaccuccugccuc

SEQ ID NO: 3348940 - RNA, 17 nt, Human
aggcaagcaccuccugc

SEQ ID NO: 3348941 - RNA, 18 nt, Human
aggauugcuacuguccua

SEQ ID NO: 3348942 - RNA, 17 nt, Human
aggauugcuacuguccu

SEQ ID NO: 3348943 - RNA, 15 nt, Human
aggauugcuacuguc

SEQ ID NO: 3348944 - RNA, 14 nt, Human
uggagaaaauggac

SEQ ID NO: 3348945 - RNA, 12 nt, Human
aggcaggauggc

SEQ ID NO: 3348946 - RNA, 22 nt, Human
aggcaggucuugaacuccuggc

SEQ ID NO: 3348947 - RNA, 12 nt, Human
aggcagggucuc

SEQ ID NO: 3348948 - RNA, 15 nt, Human
aggcauaaagucagg

SEQ ID NO: 3348949 - RNA, 17 nt, Human
aggcaggugggauggau

SEQ ID NO: 3348950 - RNA, 22 nt, Human
aggcauaaagucagggguuccc

SEQ ID NO: 3348951 - RNA, 18 nt, Human
aggcauugugggaagggg

SEQ ID NO: 3348952 - RNA, 17 nt, Human
uggugcgaucuggguuc

SEQ ID NO: 3348953 - RNA, 16 nt, Human
uggugcgaucuggguu

SEQ ID NO: 3348954 - RNA, 19 nt, Human
uggugucgggcaugacacg

SEQ ID NO: 3348955 - RNA, 15 nt, Human
ugguggcagcugcgg

SEQ ID NO: 3348956 - RNA, 13 nt, Human
ugguggcagcugc

SEQ ID NO: 3348957 - RNA, 14 nt, Human
ugguggcagcugcg

SEQ ID NO: 3348958 - RNA, 18 nt, Human
ugguuaggcauuguggga

SEQ ID NO: 3348959 - RNA, 20 nt, Human
ugguuaggcauugugggaag

SEQ ID NO: 3348960 - RNA, 15 nt, Human
uggucagauuugaac

SEQ ID NO: 3348961 - RNA, 16 nt, Human
uggucagauuugaacu

SEQ ID NO: 3348962 - RNA, 13 nt, Human
aggucagagccug

SEQ ID NO: 3348963 - RNA, 18 nt, Human
aggucagagccugcaguu

SEQ ID NO: 3348964 - RNA, 17 nt, Human
aggucagagccugcagu

SEQ ID NO: 3348965 - RNA, 15 nt, Human
aggucagagccugca

SEQ ID NO: 3348966 - RNA, 14 nt, Human
aggucagagccugc

SEQ ID NO: 3348967 - RNA, 16 nt, Human
aggucuugaacuccug

SEQ ID NO: 3348968 - RNA, 16 nt, Human
aggugagaagcagagg

SEQ ID NO: 3348969 - RNA, 21 nt, Human
aggugagaagcagaggaagga

SEQ ID NO: 3348970 - RNA, 23 nt, Human
aggugagaagcagaggaaggaga

SEQ ID NO: 3348971 - RNA, 15 nt, Human
aggugacagagugag

SEQ ID NO: 3348972 - RNA, 13 nt, Human
aggugacagagug

SEQ ID NO: 3348973 - RNA, 17 nt, Human
aggucuugaacuccugg

SEQ ID NO: 3348974 - RNA, 13 nt, Human
aggugaccccagg

SEQ ID NO: 3348975 - RNA, 22 nt, Human
aggugacagagugagacucugu

SEQ ID NO: 3348976 - RNA, 20 nt, Human
aggugauccacccaccucag

SEQ ID NO: 3348977 - RNA, 14 nt, Human
aggugauccaccca

SEQ ID NO: 3348978 - RNA, 16 nt, Human
aggugggauccuccag

SEQ ID NO: 3348979 - RNA, 17 nt, Human
aggugggauccuccagg

SEQ ID NO: 3348980 - RNA, 23 nt, Human
agguggggcagcuugaggguugg

SEQ ID NO: 3348981 - RNA, 16 nt, Human
agguggggcagcuuga

SEQ ID NO: 3348982 - RNA, 18 nt, Human
aggugccucaagagaagg

SEQ ID NO: 3348983 - RNA, 15 nt, Human
aggugggauccucca

SEQ ID NO: 3348984 - RNA, 20 nt, Human
aggugugcucugaucaucca

SEQ ID NO: 3348985 - RNA, 15 nt, Human
aggugugcucugauc

SEQ ID NO: 3348986 - RNA, 19 nt, Human
agguggggucacucuggca

SEQ ID NO: 3348987 - RNA, 20 nt, Human
aggugucccugcacuugcag

SEQ ID NO: 3348988 - RNA, 14 nt, Human
agguuuaagcuguu

SEQ ID NO: 3348989 - RNA, 12 nt, Human
aggugugcucug

SEQ ID NO: 3348990 - RNA, 17 nt, Human
ugguuuucaaaauaaaa

SEQ ID NO: 3348991 - RNA, 15 nt, Human
ugguuuucaaaauaa

SEQ ID NO: 3348992 - RNA, 15 nt, Human
ugguuuguaaauuaa

SEQ ID NO: 3348993 - RNA, 14 nt, Human
ugguuuucaaaaua

SEQ ID NO: 3348994 - RNA, 16 nt, Human
uguaaauagcucaggu

SEQ ID NO: 3348995 - RNA, 15 nt, Human
uguaaauagcucagg

SEQ ID NO: 3348996 - RNA, 20 nt, Human
aguagaagucuuagauguau

SEQ ID NO: 3348997 - RNA, 19 nt, Human
aguagaagucuuagaugua

SEQ ID NO: 3348998 - RNA, 21 nt, Human
aguagaagucuuagauguaua

SEQ ID NO: 3348999 - RNA, 17 nt, Human
aguagaagucuuagaug

SEQ ID NO: 3349000 - RNA, 11 nt, Human
aguagagacag

SEQ ID NO: 3349001 - RNA, 17 nt, Human
uguaggcauaaagucag

SEQ ID NO: 3349002 - RNA, 20 nt, Human
uguaggcauaaagucagggg

SEQ ID NO: 3349003 - RNA, 14 nt, Human
aguaauaugcacac

SEQ ID NO: 3349004 - RNA, 15 nt, Human
aguaauaugcacaca

SEQ ID NO: 3349005 - RNA, 18 nt, Human
uguagagccagggucuca

SEQ ID NO: 3349006 - RNA, 16 nt, Human
uguagagccagggucu

SEQ ID NO: 3349007 - RNA, 15 nt, Human
uguagagccaggguc

SEQ ID NO: 3349008 - RNA, 23 nt, Human
agucacacagugagucgaggaca

SEQ ID NO: 3349009 - RNA, 15 nt, Human
agucacacagugagu

SEQ ID NO: 3349010 - RNA, 19 nt, Human
agucaccccggccaccugc

SEQ ID NO: 3349011 - RNA, 17 nt, Human
agucaccccggccaccu

SEQ ID NO: 3349012 - RNA, 14 nt, Human
aguaugguggcugg

SEQ ID NO: 3349013 - RNA, 23 nt, Human
agucacacaguauuacuucugcu

SEQ ID NO: 3349014 - RNA, 16 nt, Human
aguaugguggcugggu

SEQ ID NO: 3349015 - RNA, 15 nt, Human
aguaugguggcuggg

SEQ ID NO: 3349016 - RNA, 15 nt, Human
aguauuacuucugcu

SEQ ID NO: 3349017 - RNA, 18 nt, Human
aguauuacuucugcuaca

SEQ ID NO: 3349018 - RNA, 14 nt, Human
ugucaauuacagga

SEQ ID NO: 3349019 - RNA, 15 nt, Human
ugucaauuacaggaa

SEQ ID NO: 3349020 - RNA, 17 nt, Human
ugucaauuacaggaagu

SEQ ID NO: 3349021 - RNA, 19 nt, Human
uguauucucuccuguaccu

SEQ ID NO: 3349022 - RNA, 16 nt, Human
uguauuuuuuuacuaa

SEQ ID NO: 3349023 - RNA, 17 nt, Human
uguaucaaugaguaaca

SEQ ID NO: 3349024 - RNA, 17 nt, Human
uggguggcaccagcagc

SEQ ID NO: 3349025 - RNA, 20 nt, Human
uggguggcaccagcagccug

SEQ ID NO: 3349026 - RNA, 21 nt, Human
uggguggcaccagcagccugg

SEQ ID NO: 3349027 - RNA, 23 nt, Human
uggguggaugccugguggcagcu

SEQ ID NO: 3349028 - RNA, 20 nt, Human
ugguagagugugccugaagu

SEQ ID NO: 3349029 - RNA, 16 nt, Human
aggguggugaccucug

SEQ ID NO: 3349030 - RNA, 15 nt, Human
agggugggagugggc

SEQ ID NO: 3349031 - RNA, 20 nt, Human
aggggguggccucccaacuc

SEQ ID NO: 3349032 - RNA, 18 nt, Human
aggggguggccucccaac

SEQ ID NO: 3349033 - RNA, 23 nt, Human
agggucucacuauguugcccagg

SEQ ID NO: 3349034 - RNA, 16 nt, Human
agggucucacucuguc

SEQ ID NO: 3349035 - RNA, 15 nt, Human
agggucucacucugu

SEQ ID NO: 3349036 - RNA, 14 nt, Human
agggucucacucug

SEQ ID NO: 3349037 - RNA, 15 nt, Human
aggguaaggcugugg

SEQ ID NO: 3349038 - RNA, 20 nt, Human
aggggaauguuugccucugc

SEQ ID NO: 3349039 - RNA, 19 nt, Human
aggggaauguuugccucug

SEQ ID NO: 3349040 - RNA, 23 nt, Human
aggggagcaaaaucgaugcagug

SEQ ID NO: 3349041 - RNA, 21 nt, Human
aggggaauguuugccucugcc

SEQ ID NO: 3349042 - RNA, 22 nt, Human
uggggucacucuggcagcucag

SEQ ID NO: 3349043 - RNA, 20 nt, Human
uggggucacucuggcagcuc

SEQ ID NO: 3349044 - RNA, 13 nt, Human
uggggucacucug

SEQ ID NO: 3349045 - RNA, 14 nt, Human
uggggucacucugg

SEQ ID NO: 3349046 - RNA, 15 nt, Human
ugggguaugggagag

SEQ ID NO: 3349047 - RNA, 19 nt, Human
ugggguacccacugcucug

SEQ ID NO: 3349048 - RNA, 18 nt, Human
ugggguacccacugcucu

SEQ ID NO: 3349049 - RNA, 17 nt, Human
ugggguacccacugcuc

SEQ ID NO: 3349050 - RNA, 13 nt, Human
aggggaauguuug

SEQ ID NO: 3349051 - RNA, 18 nt, Human
aggggaaaaucagccugc

SEQ ID NO: 3349052 - RNA, 22 nt, Human
aggggaaaaucagccugcucca

SEQ ID NO: 3349053 - RNA, 14 nt, Human
aggggaacagacug

SEQ ID NO: 3349054 - RNA, 13 nt, Human
aggggaaaagagg

SEQ ID NO: 3349055 - RNA, 12 nt, Human
agggcuccagac

SEQ ID NO: 3349056 - RNA, 14 nt, Human
uggggaccucaggc

SEQ ID NO: 3349057 - RNA, 15 nt, Human
uggggaccucaggcc

SEQ ID NO: 3349058 - RNA, 16 nt, Human
uggggaccucaggccu

SEQ ID NO: 3349059 - RNA, 12 nt, Human
uggggcccugcc

SEQ ID NO: 3349060 - RNA, 21 nt, Human
uggggccaguuggucccccuu

SEQ ID NO: 3349061 - RNA, 22 nt, Human
uggggcugcaccggcuggccug

SEQ ID NO: 3349062 - RNA, 23 nt, Human
uggggcugcaccggcuggccugg

SEQ ID NO: 3349063 - RNA, 15 nt, Human
agggagggagggcuc

SEQ ID NO: 3349064 - RNA, 13 nt, Human
agggagggcucca

SEQ ID NO: 3349065 - RNA, 21 nt, Human
ugggcccccaaauggaaaugg

SEQ ID NO: 3349066 - RNA, 16 nt, Human
ugggcccccaaaugga

SEQ ID NO: 3349067 - RNA, 11 nt, Human
ugggcagagca

SEQ ID NO: 3349068 - RNA, 12 nt, Human
ugggcagagcag

SEQ ID NO: 3349069 - RNA, 18 nt, Human
ugggccaggagccuccug

SEQ ID NO: 3349070 - RNA, 23 nt, Human
ugggcagaaggaagacuucaucc

SEQ ID NO: 3349071 - RNA, 20 nt, Human
ugggaggaucucuugagccu

SEQ ID NO: 3349072 - RNA, 21 nt, Human
ugggaggaucucuugagccug

SEQ ID NO: 3349073 - RNA, 19 nt, Human
ugggaggccaaggugggag

SEQ ID NO: 3349074 - RNA, 22 nt, Human
ugggaggauugcuugagcucag

SEQ ID NO: 3349075 - RNA, 20 nt, Human
ugggaggccaaggugggagg

SEQ ID NO: 3349076 - RNA, 23 nt, Human
agggcucagcggggacagcuccu

SEQ ID NO: 3349077 - RNA, 22 nt, Human
agggcucagcggggacagcucc

SEQ ID NO: 3349078 - RNA, 20 nt, Human
agggcucagcggggacagcu

SEQ ID NO: 3349079 - RNA, 19 nt, Human
agggcucagcggggacagc

SEQ ID NO: 3349080 - RNA, 14 nt, Human
agggagggcuccag

SEQ ID NO: 3349081 - RNA, 15 nt, Human
agggagggcuccaga

SEQ ID NO: 3349082 - RNA, 16 nt, Human
agggagggcuccagac

SEQ ID NO: 3349083 - RNA, 20 nt, Human
aggcccggcuccaggcuccu

SEQ ID NO: 3349084 - RNA, 18 nt, Human
aggcccggcuccaggcuc

SEQ ID NO: 3349085 - RNA, 21 nt, Human
aggcccggcuccaggcuccuu

SEQ ID NO: 3349086 - RNA, 22 nt, Human
agggaaggauacaaaagcaugu

SEQ ID NO: 3349087 - RNA, 19 nt, Human
ugggagagaagagaaugca

SEQ ID NO: 3349088 - RNA, 21 nt, Human
ugggagagaagagaaugcaca

SEQ ID NO: 3349089 - RNA, 18 nt, Human
ugggaggaucucuugagc

SEQ ID NO: 3349090 - RNA, 18 nt, Human
ugggacucaaugcacuga

SEQ ID NO: 3349091 - RNA, 20 nt, Human
ugggacucaaugcacugaca

SEQ ID NO: 3349092 - RNA, 22 nt, Human
ugggagaaccaaaaagaggcua

SEQ ID NO: 3349093 - RNA, 15 nt, Human
ugggacuacaggcac

SEQ ID NO: 3349094 - RNA, 14 nt, Human
ugggacuacaggca

SEQ ID NO: 3349095 - RNA, 17 nt, Human
uguuuucaguguacaug

SEQ ID NO: 3349096 - RNA, 20 nt, Human
uguuuuccaugaguccccug

SEQ ID NO: 3349097 - RNA, 15 nt, Human
uguuuucucuugaga

SEQ ID NO: 3349098 - RNA, 14 nt, Human
aguucugguuccua

SEQ ID NO: 3349099 - RNA, 17 nt, Human
uguuugauucagacagc

SEQ ID NO: 3349100 - RNA, 22 nt, Human
uguuugauucagacagcugccu

SEQ ID NO: 3349101 - RNA, 17 nt, Human
uguuuauugucaaagug

SEQ ID NO: 3349102 - RNA, 19 nt, Human
uguuuauugucaaaguggu

SEQ ID NO: 3349103 - RNA, 21 nt, Human
aguuggguggaugccuggugg

SEQ ID NO: 3349104 - RNA, 17 nt, Human
aguuggguggaugccug

SEQ ID NO: 3349105 - RNA, 16 nt, Human
aguuggcuaggacccc

SEQ ID NO: 3349106 - RNA, 18 nt, Human
aguuggucccccuuccau

SEQ ID NO: 3349107 - RNA, 21 nt, Human
aguuguuugauucagacagcu

SEQ ID NO: 3349108 - RNA, 23 nt, Human
aguuguuugauucagacagcugc

SEQ ID NO: 3349109 - RNA, 20 nt, Human
uuaaauucuugcaaaguauc

SEQ ID NO: 3349110 - RNA, 22 nt, Human
uuaagugcugcauuuaaaagau

SEQ ID NO: 3349111 - RNA, 17 nt, Human
uuaaguacuauguauca

SEQ ID NO: 3349112 - RNA, 16 nt, Human
uuaagaggcagggucu

SEQ ID NO: 3349113 - RNA, 15 nt, Human
uuaagaggcaggguc

SEQ ID NO: 3349114 - RNA, 13 nt, Human
uuaagaggcaggg

SEQ ID NO: 3349115 - RNA, 15 nt, Human
auaaacaagaccacg

SEQ ID NO: 3349116 - RNA, 22 nt, Human
auaaacaagaccacguuucuaa

SEQ ID NO: 3349117 - RNA, 23 nt, Human
auaaacaagaccacguuucuaaa

SEQ ID NO: 3349118 - RNA, 19 nt, Human
uuaauuuuuuugagacaga

SEQ ID NO: 3349119 - RNA, 20 nt, Human
uuaaugaaagacuguacaaa

SEQ ID NO: 3349120 - RNA, 23 nt, Human
uuaaugaaagacuguacaaagua

SEQ ID NO: 3349121 - RNA, 15 nt, Human
uuaauucuuagcuca

SEQ ID NO: 3349122 - RNA, 16 nt, Human
auaacuaaaagguaug

SEQ ID NO: 3349123 - RNA, 14 nt, Human
uuacaggaaguacu

SEQ ID NO: 3349124 - RNA, 18 nt, Human
uuacucagaauucucuag

SEQ ID NO: 3349125 - RNA, 23 nt, Human
uuacucagaauucucuaguuuga

SEQ ID NO: 3349126 - RNA, 19 nt, Human
uuacuauggcccuggccua

SEQ ID NO: 3349127 - RNA, 20 nt, Human
uuacauaagauaaaugugcu

SEQ ID NO: 3349128 - RNA, 14 nt, Human
uuagaaauauaauu

SEQ ID NO: 3349129 - RNA, 12 nt, Human
uuagaaauauaa

SEQ ID NO: 3349130 - RNA, 11 nt, Human
uuagaaauaua

SEQ ID NO: 3349131 - RNA, 11 nt, Human
uuagacagagu

SEQ ID NO: 3349132 - RNA, 18 nt, Human
ugugaaaggaaagaggcu

SEQ ID NO: 3349133 - RNA, 21 nt, Human
ugugaaaggaaagagggaggu

SEQ ID NO: 3349134 - RNA, 15 nt, Human
ugugaaaggaaagag

SEQ ID NO: 3349135 - RNA, 19 nt, Human
ugugaaccaccacacccag

SEQ ID NO: 3349136 - RNA, 20 nt, Human
ugugaaccaccacacccagc

SEQ ID NO: 3349137 - RNA, 17 nt, Human
ugugaaccaccacaccc

SEQ ID NO: 3349138 - RNA, 23 nt, Human
agucuuagauguauauauuuccu

SEQ ID NO: 3349139 - RNA, 14 nt, Human
agucuuuguacaga

SEQ ID NO: 3349140 - RNA, 16 nt, Human
ugugacugaauuucuu

SEQ ID NO: 3349141 - RNA, 15 nt, Human
ugugacugaauuucu

SEQ ID NO: 3349142 - RNA, 19 nt, Human
agugaggcucugcccuugg

SEQ ID NO: 3349143 - RNA, 20 nt, Human
agugaggcucugcccuuggu

SEQ ID NO: 3349144 - RNA, 21 nt, Human
agugaggcucugcccuugguu

SEQ ID NO: 3349145 - RNA, 21 nt, Human
agugaguugauagcacagacc

SEQ ID NO: 3349146 - RNA, 15 nt, Human
agugagucgaggaca

SEQ ID NO: 3349147 - RNA, 15 nt, Human
agugaggcucugccc

SEQ ID NO: 3349148 - RNA, 14 nt, Human
agugaggcucugcc

SEQ ID NO: 3349149 - RNA, 16 nt, Human
agugaggcucugcccu

SEQ ID NO: 3349150 - RNA, 17 nt, Human
agugaggcucugcccuu

SEQ ID NO: 3349151 - RNA, 21 nt, Human
ugugcccccauguaagcaccc

SEQ ID NO: 3349152 - RNA, 21 nt, Human
ugugcugcccugcccaccugg

SEQ ID NO: 3349153 - RNA, 17 nt, Human
uguggaguucaucuuga

SEQ ID NO: 3349154 - RNA, 21 nt, Human
uguggaguucaucuugaauug

SEQ ID NO: 3349155 - RNA, 16 nt, Human
ugugccaugugccagg

SEQ ID NO: 3349156 - RNA, 12 nt, Human
ugugccaugugc

SEQ ID NO: 3349157 - RNA, 20 nt, Human
ugugccagguuuuuggucug

SEQ ID NO: 3349158 - RNA, 23 nt, Human
ugugcauuuggugguuucagaaa

SEQ ID NO: 3349159 - RNA, 19 nt, Human
ugugauggggcccugccuc

SEQ ID NO: 3349160 - RNA, 20 nt, Human
ugugauggggcccugccucc

SEQ ID NO: 3349161 - RNA, 18 nt, Human
ugugauggggcccugccu

SEQ ID NO: 3349162 - RNA, 18 nt, Human
uguugcccaggcaggucu

SEQ ID NO: 3349163 - RNA, 17 nt, Human
uguugcccaggcagguc

SEQ ID NO: 3349164 - RNA, 16 nt, Human
uguugcccaggcaggu

SEQ ID NO: 3349165 - RNA, 15 nt, Human
uguugcccaggcagg

SEQ ID NO: 3349166 - RNA, 12 nt, Human
uguugcccaggc

SEQ ID NO: 3349167 - RNA, 13 nt, Human
uguugcccaggca

SEQ ID NO: 3349168 - RNA, 16 nt, Human
uguucugggacacagu

SEQ ID NO: 3349169 - RNA, 15 nt, Human
uguucugggacacag

SEQ ID NO: 3349170 - RNA, 20 nt, Human
uguuccacaaguuaaauaaa

SEQ ID NO: 3349171 - RNA, 19 nt, Human
uguuccacaaguuaaauaa

SEQ ID NO: 3349172 - RNA, 20 nt, Human
agugugucuuagugugugca

SEQ ID NO: 3349173 - RNA, 17 nt, Human
aguggugcgaucugggu

SEQ ID NO: 3349174 - RNA, 16 nt, Human
aguggugcgaucuggg

SEQ ID NO: 3349175 - RNA, 19 nt, Human
aguggugguuuucuguucu

SEQ ID NO: 3349176 - RNA, 20 nt, Human
aguggugguuuucuguucuu

SEQ ID NO: 3349177 - RNA, 21 nt, Human
aguggugguuuucuguucuuu

SEQ ID NO: 3349178 - RNA, 23 nt, Human
aguggugguuuucuguucuuucu

SEQ ID NO: 3349179 - RNA, 17 nt, Human
aguggugguuuucuguu

SEQ ID NO: 3349180 - RNA, 18 nt, Human
aguggugguuuucuguuc

SEQ ID NO: 3349181 - RNA, 21 nt, Human
agugguggugaacagaacaaa

SEQ ID NO: 3349182 - RNA, 16 nt, Human
agugugguguuuccug

SEQ ID NO: 3349183 - RNA, 19 nt, Human
agugugguguuuccuggca

SEQ ID NO: 3349184 - RNA, 17 nt, Human
agugugguguuuccugg

SEQ ID NO: 3349185 - RNA, 21 nt, Human
ugugucucuugguccugcugc

SEQ ID NO: 3349186 - RNA, 20 nt, Human
ugugucuugcaauggcagcc

SEQ ID NO: 3349187 - RNA, 21 nt, Human
ugugucuugcaauggcagccu

SEQ ID NO: 3349188 - RNA, 16 nt, Human
ugugucucuugguccu

SEQ ID NO: 3349189 - RNA, 17 nt, Human
ugugucucuugguccug

SEQ ID NO: 3349190 - RNA, 20 nt, Human
ugugucucuugguccugcug

SEQ ID NO: 3349191 - RNA, 19 nt, Human
uguguguuuauugucaaag

SEQ ID NO: 3349192 - RNA, 23 nt, Human
uguguguuuauugucaaaguggu

SEQ ID NO: 3349193 - RNA, 11 nt, Human
uguguguuuau

SEQ ID NO: 3349194 - RNA, 22 nt, Human
agugaguugauagcacagaccc

SEQ ID NO: 3349195 - RNA, 23 nt, Human
agugaguugauagcacagacccu

SEQ ID NO: 3349196 - RNA, 12 nt, Human
agugcugcauuu

SEQ ID NO: 3349197 - RNA, 13 nt, Human
agugcugcauuua

SEQ ID NO: 3349198 - RNA, 21 nt, Human
agugcugggauuacaggugug

SEQ ID NO: 3349199 - RNA, 16 nt, Human
agugcugcauuuaaaa

SEQ ID NO: 3349200 - RNA, 17 nt, Human
agugcugcauuuaaaag

SEQ ID NO: 3349201 - RNA, 19 nt, Human
agugcugcauuuaaaagau

SEQ ID NO: 3349202 - RNA, 20 nt, Human
agugcugggauuacaggugu

SEQ ID NO: 3349203 - RNA, 14 nt, Human
ugugguguuuccug

SEQ ID NO: 3349204 - RNA, 16 nt, Human
ugugguguuuccuggc

SEQ ID NO: 3349205 - RNA, 13 nt, Human
uguggucccaccc

SEQ ID NO: 3349206 - RNA, 15 nt, Human
uguggucccacccca

SEQ ID NO: 3349207 - RNA, 21 nt, Human
uguggguuucuaaagcugcca

SEQ ID NO: 3349208 - RNA, 23 nt, Human
uguggguuucuaaagcugccagc

SEQ ID NO: 3349209 - RNA, 22 nt, Human
accacuuuuguucuugguuugu

SEQ ID NO: 3349210 - RNA, 16 nt, Human
accagagcccaccuug

SEQ ID NO: 3349211 - RNA, 14 nt, Human
accagagcccaccu

SEQ ID NO: 3349212 - RNA, 12 nt, Human
accagagcccac

SEQ ID NO: 3349213 - RNA, 11 nt, Human
accagacaggu

SEQ ID NO: 3349214 - RNA, 14 nt, Human
accagacaccuuga

SEQ ID NO: 3349215 - RNA, 15 nt, Human
accacuuuuguucuu

SEQ ID NO: 3349216 - RNA, 16 nt, Human
accacuuuuguucuug

SEQ ID NO: 3349217 - RNA, 21 nt, Human
accacuuuuguucuugguuug

SEQ ID NO: 3349218 - RNA, 15 nt, Human
accacuucagcugac

SEQ ID NO: 3349219 - RNA, 17 nt, Human
accacugcacuccagcc

SEQ ID NO: 3349220 - RNA, 20 nt, Human
accacugcacuccagccugg

SEQ ID NO: 3349221 - RNA, 17 nt, Human
ucaccccggccaccugc

SEQ ID NO: 3349222 - RNA, 18 nt, Human
ucaccccggccaccugcg

SEQ ID NO: 3349223 - RNA, 21 nt, Human
accacugcacuccagccuggg

SEQ ID NO: 3349224 - RNA, 15 nt, Human
ucaccucucccuugg

SEQ ID NO: 3349225 - RNA, 13 nt, Human
ucaccugccccuc

SEQ ID NO: 3349226 - RNA, 15 nt, Human
ucaccugccccucaa

SEQ ID NO: 3349227 - RNA, 19 nt, Human
ucacuauguugcccaggca

SEQ ID NO: 3349228 - RNA, 17 nt, Human
ucacuauguugcccagg

SEQ ID NO: 3349229 - RNA, 18 nt, Human
ucacuauguugcccaggc

SEQ ID NO: 3349230 - RNA, 17 nt, Human
accaacauacucccauc

SEQ ID NO: 3349231 - RNA, 19 nt, Human
accaacauacucccaucug

SEQ ID NO: 3349232 - RNA, 21 nt, Human
accaacauacucccaucugug

SEQ ID NO: 3349233 - RNA, 22 nt, Human
accaacauacucccaucuguga

SEQ ID NO: 3349234 - RNA, 23 nt, Human
ucaagugaaaaaggaggaagaga

SEQ ID NO: 3349235 - RNA, 15 nt, Human
ucaagugaaaaagga

SEQ ID NO: 3349236 - RNA, 15 nt, Human
accaauguucucucu

SEQ ID NO: 3349237 - RNA, 15 nt, Human
ucaccccggccaccu

SEQ ID NO: 3349238 - RNA, 14 nt, Human
ucaccccagcccca

SEQ ID NO: 3349239 - RNA, 20 nt, Human
ucaccccagccccaaaacuc

SEQ ID NO: 3349240 - RNA, 13 nt, Human
ucaccccagcccc

SEQ ID NO: 3349241 - RNA, 15 nt, Human
ucacauaucugucau

SEQ ID NO: 3349242 - RNA, 12 nt, Human
ucacauaucugu

SEQ ID NO: 3349243 - RNA, 15 nt, Human
ucacaguucucuccu

SEQ ID NO: 3349244 - RNA, 24 nt, Human
acccagcgagcccugguggcagug

SEQ ID NO: 3349245 - RNA, 23 nt, Human
ucagccguguaaccauggaccca

SEQ ID NO: 3349246 - RNA, 23 nt, Human
acccagcgagcccugguggcagu

SEQ ID NO: 3349247 - RNA, 19 nt, Human
acccagcgagcccuggugg

SEQ ID NO: 3349248 - RNA, 17 nt, Human
acccagcgagcccuggu

SEQ ID NO: 3349249 - RNA, 22 nt, Human
ucagccaagaauucuuaaauau

SEQ ID NO: 3349250 - RNA, 12 nt, Human
acccccacccaa

SEQ ID NO: 3349251 - RNA, 15 nt, Human
accccuucgcuccug

SEQ ID NO: 3349252 - RNA, 14 nt, Human
accccuucgcuccu

SEQ ID NO: 3349253 - RNA, 14 nt, Human
ucagcggggacagc

SEQ ID NO: 3349254 - RNA, 19 nt, Human
ucagaaguuucugccgcag

SEQ ID NO: 3349255 - RNA, 22 nt, Human
ucagaaguuucugccgcagccc

SEQ ID NO: 3349256 - RNA, 14 nt, Human
ucagaagacacuga

SEQ ID NO: 3349257 - RNA, 18 nt, Human
ucagagccugcaguuauu

SEQ ID NO: 3349258 - RNA, 15 nt, Human
ucagagccugcaguu

SEQ ID NO: 3349259 - RNA, 14 nt, Human
ucagagccugcagu

SEQ ID NO: 3349260 - RNA, 13 nt, Human
ucagagccugcag

SEQ ID NO: 3349261 - RNA, 16 nt, Human
ucagagagggugggag

SEQ ID NO: 3349262 - RNA, 21 nt, Human
ucagagagggugggagugggc

SEQ ID NO: 3349263 - RNA, 12 nt, Human
ucagagccugca

SEQ ID NO: 3349264 - RNA, 17 nt, Human
ucagagacuccugcagg

SEQ ID NO: 3349265 - RNA, 20 nt, Human
ucagagacuccugcaggcag

SEQ ID NO: 3349266 - RNA, 21 nt, Human
ucagagacuccugcaggcagc

SEQ ID NO: 3349267 - RNA, 16 nt, Human
ucagagacuccugcag

SEQ ID NO: 3349268 - RNA, 19 nt, Human
ucagaaucucaaauaacua

SEQ ID NO: 3349269 - RNA, 18 nt, Human
ucagaaucucaaauaacu

SEQ ID NO: 3349270 - RNA, 22 nt, Human
accauggucggaaaacaugcua

SEQ ID NO: 3349271 - RNA, 23 nt, Human
ucacucuuauugcccacgcugga

SEQ ID NO: 3349272 - RNA, 21 nt, Human
ucacucuuauugcccacgcug

SEQ ID NO: 3349273 - RNA, 15 nt, Human
acccacugcucuggu

SEQ ID NO: 3349274 - RNA, 14 nt, Human
acccacugcucugg

SEQ ID NO: 3349275 - RNA, 13 nt, Human
acccacugcucug

SEQ ID NO: 3349276 - RNA, 11 nt, Human
acccacugcuc

SEQ ID NO: 3349277 - RNA, 10 nt, Human
acccacugcu

SEQ ID NO: 3349278 - RNA, 21 nt, Human
acauguccaagaagcccagga

SEQ ID NO: 3349279 - RNA, 19 nt, Human
acauguccaagaagcccag

SEQ ID NO: 3349280 - RNA, 15 nt, Human
ucaaauuucuaaauc

SEQ ID NO: 3349281 - RNA, 16 nt, Human
ucaaauuucuaaaucu

SEQ ID NO: 3349282 - RNA, 15 nt, Human
acauucuguuaauca

SEQ ID NO: 3349283 - RNA, 14 nt, Human
ucaaauuucuaaau

SEQ ID NO: 3349284 - RNA, 12 nt, Human
acauucuguuaa

SEQ ID NO: 3349285 - RNA, 17 nt, Human
ucaaauuucuaaaucuc

SEQ ID NO: 3349286 - RNA, 16 nt, Human
ucaacagguuuuccug

SEQ ID NO: 3349287 - RNA, 16 nt, Human
ucaaguauuauaccuu

SEQ ID NO: 3349288 - RNA, 21 nt, Human
ucaaguauuauaccuuuuuua

SEQ ID NO: 3349289 - RNA, 23 nt, Human
ucaaguauuauaccuuuuuuaga

SEQ ID NO: 3349290 - RNA, 15 nt, Human
ucaaguauuauaccu

SEQ ID NO: 3349291 - RNA, 11 nt, Human
ucaaguauuau

SEQ ID NO: 3349292 - RNA, 20 nt, Human
ucaaggcuuauauucaacca

SEQ ID NO: 3349293 - RNA, 18 nt, Human
ucaaggcuuauauucaac

SEQ ID NO: 3349294 - RNA, 17 nt, Human
ucaaggcuuauauucaa

SEQ ID NO: 3349295 - RNA, 18 nt, Human
ucaaauaacuaaaaggua

SEQ ID NO: 3349296 - RNA, 13 nt, Human
acaugagcaucag

SEQ ID NO: 3349297 - RNA, 22 nt, Human
acaugcuacacacugcauguuu

SEQ ID NO: 3349298 - RNA, 17 nt, Human
acaugaucuucuuuaua

SEQ ID NO: 3349299 - RNA, 15 nt, Human
acaugaucuucuuua

SEQ ID NO: 3349300 - RNA, 17 nt, Human
acaugagcaucaggcca

SEQ ID NO: 3349301 - RNA, 18 nt, Human
acaugagcaucaggccag

SEQ ID NO: 3349302 - RNA, 19 nt, Human
acaugagcaucaggccagg

SEQ ID NO: 3349303 - RNA, 13 nt, Human
acauacuaaccag

SEQ ID NO: 3349304 - RNA, 21 nt, Human
acauacuaaccagcagaaaug

SEQ ID NO: 3349305 - RNA, 22 nt, Human
acauacuaaccagcagaaaugc

SEQ ID NO: 3349306 - RNA, 13 nt, Human
acauacucccauc

SEQ ID NO: 3349307 - RNA, 14 nt, Human
acauacucugcuua

SEQ ID NO: 3349308 - RNA, 17 nt, Human
acauacucccaucugug

SEQ ID NO: 3349309 - RNA, 16 nt, Human
acaguuuguuaguaug

SEQ ID NO: 3349310 - RNA, 20 nt, Human
acaguuuguuaguaugaggc

SEQ ID NO: 3349311 - RNA, 15 nt, Human
acaguugaaaaacag

SEQ ID NO: 3349312 - RNA, 16 nt, Human
acaguugaaaaacagc

SEQ ID NO: 3349313 - RNA, 20 nt, Human
acaguugaaaaacagcugag

SEQ ID NO: 3349314 - RNA, 22 nt, Human
uauuucccucaccuuucccauc

SEQ ID NO: 3349315 - RNA, 23 nt, Human
uauuuccuauauuguuuucagug

SEQ ID NO: 3349316 - RNA, 18 nt, Human
acauauugauuuccguua

SEQ ID NO: 3349317 - RNA, 22 nt, Human
acauauugauuuccguuaaaau

SEQ ID NO: 3349318 - RNA, 23 nt, Human
acauauugauuuccguuaaaaua

SEQ ID NO: 3349319 - RNA, 14 nt, Human
acauauugauuucc

SEQ ID NO: 3349320 - RNA, 16 nt, Human
acauauugauuuccgu

SEQ ID NO: 3349321 - RNA, 16 nt, Human
acaugaaaacacauuu

SEQ ID NO: 3349322 - RNA, 18 nt, Human
acaugaaaacacauuuuu

SEQ ID NO: 3349323 - RNA, 19 nt, Human
acaugaaaacacauuuuuc

SEQ ID NO: 3349324 - RNA, 19 nt, Human
acaucuugcucugcugaca

SEQ ID NO: 3349325 - RNA, 18 nt, Human
acaucuugcucugcugac

SEQ ID NO: 3349326 - RNA, 17 nt, Human
acaugaaaacacauuuu

SEQ ID NO: 3349327 - RNA, 21 nt, Human
acaucuugcucugcugacaga

SEQ ID NO: 3349328 - RNA, 17 nt, Human
acaucuugcucugcuga

SEQ ID NO: 3349329 - RNA, 13 nt, Human
acaucuugcucug

SEQ ID NO: 3349330 - RNA, 18 nt, Human
acaucaacaucuugguca

SEQ ID NO: 3349331 - RNA, 16 nt, Human
acaucaacaucuuggu

SEQ ID NO: 3349332 - RNA, 14 nt, Human
accugaggcccuuc

SEQ ID NO: 3349333 - RNA, 21 nt, Human
accucuugagccuugaacuuu

SEQ ID NO: 3349334 - RNA, 15 nt, Human
accugaggcccuucu

SEQ ID NO: 3349335 - RNA, 16 nt, Human
accugaggcccuucuc

SEQ ID NO: 3349336 - RNA, 20 nt, Human
accugaggcccuucucucca

SEQ ID NO: 3349337 - RNA, 21 nt, Human
accugaggcccuucucuccag

SEQ ID NO: 3349338 - RNA, 16 nt, Human
accugaggggccucuu

SEQ ID NO: 3349339 - RNA, 15 nt, Human
accugauugugucuc

SEQ ID NO: 3349340 - RNA, 17 nt, Human
accugauugugucucuu

SEQ ID NO: 3349341 - RNA, 18 nt, Human
accugauugugucucuug

SEQ ID NO: 3349342 - RNA, 14 nt, Human
accugauugugucu

SEQ ID NO: 3349343 - RNA, 19 nt, Human
accucggugccuuccucuu

SEQ ID NO: 3349344 - RNA, 17 nt, Human
accucggugccuuccuc

SEQ ID NO: 3349345 - RNA, 13 nt, Human
accuccugggcua

SEQ ID NO: 3349346 - RNA, 22 nt, Human
ucauugaaaucuuuuugcuuug

SEQ ID NO: 3349347 - RNA, 12 nt, Human
ucauugaccuga

SEQ ID NO: 3349348 - RNA, 14 nt, Human
ucauugaccugagg

SEQ ID NO: 3349349 - RNA, 15 nt, Human
ucauugaccugaggc

SEQ ID NO: 3349350 - RNA, 12 nt, Human
ucauugaaaucu

SEQ ID NO: 3349351 - RNA, 13 nt, Human
ucauugaaaucuu

SEQ ID NO: 3349352 - RNA, 12 nt, Human
ucauucuucugu

SEQ ID NO: 3349353 - RNA, 15 nt, Human
ucauccuaagcuauu

SEQ ID NO: 3349354 - RNA, 23 nt, Human
accuccugccucgaacuggcugc

SEQ ID NO: 3349355 - RNA, 12 nt, Human
accuccugccuc

SEQ ID NO: 3349356 - RNA, 13 nt, Human
accuccugccucg

SEQ ID NO: 3349357 - RNA, 14 nt, Human
ucauccuucuggaa

SEQ ID NO: 3349358 - RNA, 18 nt, Human
ucauccucauacccaccc

SEQ ID NO: 3349359 - RNA, 13 nt, Human
ucauccuccucag

SEQ ID NO: 3349360 - RNA, 19 nt, Human
ucauccuccucagaucuuc

SEQ ID NO: 3349361 - RNA, 22 nt, Human
ucauccuucuggaauaaggaga

SEQ ID NO: 3349362 - RNA, 13 nt, Human
ucaggaagcucag

SEQ ID NO: 3349363 - RNA, 14 nt, Human
ucaggaagcucagg

SEQ ID NO: 3349364 - RNA, 15 nt, Human
ucaggaagcucaggg

SEQ ID NO: 3349365 - RNA, 12 nt, Human
ucaggaagcuca

SEQ ID NO: 3349366 - RNA, 16 nt, Human
accuggccucugcacu

SEQ ID NO: 3349367 - RNA, 17 nt, Human
accuggccucugcacuc

SEQ ID NO: 3349368 - RNA, 14 nt, Human
accuggccucugca

SEQ ID NO: 3349369 - RNA, 15 nt, Human
uccacccaggagccc

SEQ ID NO: 3349370 - RNA, 14 nt, Human
uccacccaggagcc

SEQ ID NO: 3349371 - RNA, 12 nt, Human
uccacccaggag

SEQ ID NO: 3349372 - RNA, 19 nt, Human
uccacccaccucagccucc

SEQ ID NO: 3349373 - RNA, 18 nt, Human
uccacccaccucagccuc

SEQ ID NO: 3349374 - RNA, 17 nt, Human
uccacccaccucagccu

SEQ ID NO: 3349375 - RNA, 19 nt, Human
accuuagacagucccugcc

SEQ ID NO: 3349376 - RNA, 20 nt, Human
accuuagacagucccugcca

SEQ ID NO: 3349377 - RNA, 18 nt, Human
accuuagacagucccugc

SEQ ID NO: 3349378 - RNA, 19 nt, Human
accuguuucugcagccacu

SEQ ID NO: 3349379 - RNA, 23 nt, Human
accuggccucugcacuccccugc

SEQ ID NO: 3349380 - RNA, 18 nt, Human
accuggccucugcacucc

SEQ ID NO: 3349381 - RNA, 20 nt, Human
accuggccucugcacucccc

SEQ ID NO: 3349382 - RNA, 21 nt, Human
accuggguaacuagggaagau

SEQ ID NO: 3349383 - RNA, 18 nt, Human
uccaaggguacuaaggaa

SEQ ID NO: 3349384 - RNA, 21 nt, Human
uccaagcuggucccacucagu

SEQ ID NO: 3349385 - RNA, 20 nt, Human
uccaagcuggucccacucag

SEQ ID NO: 3349386 - RNA, 16 nt, Human
uccaagcuggucccac

SEQ ID NO: 3349387 - RNA, 12 nt, Human
accugccaggaa

SEQ ID NO: 3349388 - RNA, 14 nt, Human
accugccaggaagc

SEQ ID NO: 3349389 - RNA, 14 nt, Human
uccaacccucauca

SEQ ID NO: 3349390 - RNA, 16 nt, Human
uccaacccucaucacc

SEQ ID NO: 3349391 - RNA, 17 nt, Human
uccaacccucaucacca

SEQ ID NO: 3349392 - RNA, 23 nt, Human
uccaacccucaucaccaacgucu

SEQ ID NO: 3349393 - RNA, 14 nt, Human
uccaggcuguaucc

SEQ ID NO: 3349394 - RNA, 12 nt, Human
uccagccccugg

SEQ ID NO: 3349395 - RNA, 13 nt, Human
uccagccccugga

SEQ ID NO: 3349396 - RNA, 19 nt, Human
acgccagauucuuuccuga

SEQ ID NO: 3349397 - RNA, 17 nt, Human
acgccagauucuuuccu

SEQ ID NO: 3349398 - RNA, 16 nt, Human
acgagcaggcuucuuc

SEQ ID NO: 3349399 - RNA, 19 nt, Human
accuuuuuuauacauaaac

SEQ ID NO: 3349400 - RNA, 20 nt, Human
accuuuuuuauacauaaaca

SEQ ID NO: 3349401 - RNA, 21 nt, Human
uccaggcuguaucccaugagc

SEQ ID NO: 3349402 - RNA, 21 nt, Human
accuuuuuuauacauaaacaa

SEQ ID NO: 3349403 - RNA, 14 nt, Human
uccagacccggcug

SEQ ID NO: 3349404 - RNA, 20 nt, Human
uccagaauuucccaaagcag

SEQ ID NO: 3349405 - RNA, 22 nt, Human
uccagaauuucccaaagcagug

SEQ ID NO: 3349406 - RNA, 16 nt, Human
uccagaauuucccaaa

SEQ ID NO: 3349407 - RNA, 18 nt, Human
uccagacccggcugcgug

SEQ ID NO: 3349408 - RNA, 15 nt, Human
uccagacccggcugc

SEQ ID NO: 3349409 - RNA, 19 nt, Human
uccagacccggcugcgugg

SEQ ID NO: 3349410 - RNA, 17 nt, Human
accuuuugagugccuua

SEQ ID NO: 3349411 - RNA, 20 nt, Human
accuuuugagugccuuacac

SEQ ID NO: 3349412 - RNA, 14 nt, Human
accuuuugagugcc

SEQ ID NO: 3349413 - RNA, 17 nt, Human
accuuagacagucccug

SEQ ID NO: 3349414 - RNA, 17 nt, Human
acuacucccccaggugg

SEQ ID NO: 3349415 - RNA, 21 nt, Human
acucacauuuauucugcucac

SEQ ID NO: 3349416 - RNA, 12 nt, Human
acucaccccagc

SEQ ID NO: 3349417 - RNA, 17 nt, Human
ucccgaguagcugggac

SEQ ID NO: 3349418 - RNA, 16 nt, Human
ucccgaguagcuggga

SEQ ID NO: 3349419 - RNA, 18 nt, Human
ucccgaguagcugggacu

SEQ ID NO: 3349420 - RNA, 15 nt, Human
ucccgaguagcuggg

SEQ ID NO: 3349421 - RNA, 18 nt, Human
ucccgaauagcugggacu

SEQ ID NO: 3349422 - RNA, 20 nt, Human
ucccgaauagcugggacuac

SEQ ID NO: 3349423 - RNA, 11 nt, Human
ucccugaaggc

SEQ ID NO: 3349424 - RNA, 15 nt, Human
ucccugaaggccccg

SEQ ID NO: 3349425 - RNA, 14 nt, Human
ucccucuuucccuc

SEQ ID NO: 3349426 - RNA, 20 nt, Human
ucccucuuucccucccuucc

SEQ ID NO: 3349427 - RNA, 18 nt, Human
ucccucuuucccucccuu

SEQ ID NO: 3349428 - RNA, 16 nt, Human
ucccugaaggccccgc

SEQ ID NO: 3349429 - RNA, 12 nt, Human
ucccugucccag

SEQ ID NO: 3349430 - RNA, 15 nt, Human
ucccugguggcagcu

SEQ ID NO: 3349431 - RNA, 17 nt, Human
uccggucccugucccag

SEQ ID NO: 3349432 - RNA, 16 nt, Human
uccuagaaauucccca

SEQ ID NO: 3349433 - RNA, 12 nt, Human
ucccuuuuccuu

SEQ ID NO: 3349434 - RNA, 12 nt, Human
acuccagccugg

SEQ ID NO: 3349435 - RNA, 23 nt, Human
acuccagaauuucccaaagcagu

SEQ ID NO: 3349436 - RNA, 13 nt, Human
acuccagccuggg

SEQ ID NO: 3349437 - RNA, 18 nt, Human
acuccugcaggcagccag

SEQ ID NO: 3349438 - RNA, 19 nt, Human
acuccugcaggcagccagg

SEQ ID NO: 3349439 - RNA, 17 nt, Human
acuccugcaggcagcca

SEQ ID NO: 3349440 - RNA, 15 nt, Human
acuccagaauuuccc

SEQ ID NO: 3349441 - RNA, 17 nt, Human
acuccagaauuucccaa

SEQ ID NO: 3349442 - RNA, 14 nt, Human
acucauugaccuga

SEQ ID NO: 3349443 - RNA, 15 nt, Human
acucauucuucugua

SEQ ID NO: 3349444 - RNA, 13 nt, Human
acuacaguuuguu

SEQ ID NO: 3349445 - RNA, 14 nt, Human
acuacaguuuguua

SEQ ID NO: 3349446 - RNA, 17 nt, Human
acuacaguccucccauc

SEQ ID NO: 3349447 - RNA, 15 nt, Human
acuacaggcacccac

SEQ ID NO: 3349448 - RNA, 11 nt, Human
acuacaggcac

SEQ ID NO: 3349449 - RNA, 14 nt, Human
acuacauucuguua

SEQ ID NO: 3349450 - RNA, 11 nt, Human
acuacauucug

SEQ ID NO: 3349451 - RNA, 12 nt, Human
acuacauucugu

SEQ ID NO: 3349452 - RNA, 13 nt, Human
acuacauucuguu

SEQ ID NO: 3349453 - RNA, 17 nt, Human
ucccagcugugcucugg

SEQ ID NO: 3349454 - RNA, 18 nt, Human
uccccaccgcagacagga

SEQ ID NO: 3349455 - RNA, 21 nt, Human
uccccaccgcagacaggacca

SEQ ID NO: 3349456 - RNA, 17 nt, Human
uccccaccgcagacagg

SEQ ID NO: 3349457 - RNA, 16 nt, Human
uccccaccgcagacag

SEQ ID NO: 3349458 - RNA, 15 nt, Human
acuacauucuguuaa

SEQ ID NO: 3349459 - RNA, 15 nt, Human
ucccaucacccgcua

SEQ ID NO: 3349460 - RNA, 16 nt, Human
ucccauaugccugggc

SEQ ID NO: 3349461 - RNA, 22 nt, Human
ucccauaugccugggcagaagg

SEQ ID NO: 3349462 - RNA, 14 nt, Human
acguacacauuuua

SEQ ID NO: 3349463 - RNA, 15 nt, Human
acgguuuuacugcag

SEQ ID NO: 3349464 - RNA, 23 nt, Human
acguggcugcuucaaggauccug

SEQ ID NO: 3349465 - RNA, 15 nt, Human
ucccaccccacacac

SEQ ID NO: 3349466 - RNA, 20 nt, Human
ucccaccccacacacgccag

SEQ ID NO: 3349467 - RNA, 16 nt, Human
ucccacaaaggagagc

SEQ ID NO: 3349468 - RNA, 20 nt, Human
acgggaggguaaggcugugg

SEQ ID NO: 3349469 - RNA, 14 nt, Human
ucccaccccacaca

SEQ ID NO: 3349470 - RNA, 21 nt, Human
ucccaaagcagugcaugcugu

SEQ ID NO: 3349471 - RNA, 17 nt, Human
ucccaaagcagugcaug

SEQ ID NO: 3349472 - RNA, 18 nt, Human
ucccaaagcagugcaugc

SEQ ID NO: 3349473 - RNA, 13 nt, Human
ucccaaagugcug

SEQ ID NO: 3349474 - RNA, 18 nt, Human
ucccaaacccuucagugc

SEQ ID NO: 3349475 - RNA, 16 nt, Human
ucccaaagcagugcau

SEQ ID NO: 3349476 - RNA, 22 nt, Human
acgccagauucuuuccugaggc

SEQ ID NO: 3349477 - RNA, 23 nt, Human
acgccagauucuuuccugaggcu

SEQ ID NO: 3349478 - RNA, 21 nt, Human
ucugaacuuggcgcugccccu

SEQ ID NO: 3349479 - RNA, 19 nt, Human
agaaauaucugaaaaugua

SEQ ID NO: 3349480 - RNA, 14 nt, Human
agaaauauaauuga

SEQ ID NO: 3349481 - RNA, 20 nt, Human
agaaauaucugaaaauguau

SEQ ID NO: 3349482 - RNA, 18 nt, Human
ucugcagcaauaaagcag

SEQ ID NO: 3349483 - RNA, 20 nt, Human
ucugcacuccccugcugggu

SEQ ID NO: 3349484 - RNA, 18 nt, Human
ucugcacuccccugcugg

SEQ ID NO: 3349485 - RNA, 19 nt, Human
ucugcacuccccugcuggg

SEQ ID NO: 3349486 - RNA, 17 nt, Human
ucugcacuccccugcug

SEQ ID NO: 3349487 - RNA, 23 nt, Human
ucugagacucgcgacaaugcaaa

SEQ ID NO: 3349488 - RNA, 22 nt, Human
ucugagacucgcgacaaugcaa

SEQ ID NO: 3349489 - RNA, 17 nt, Human
agaaaaaggaugcacag

SEQ ID NO: 3349490 - RNA, 20 nt, Human
ucucuuuaaugucacaggca

SEQ ID NO: 3349491 - RNA, 13 nt, Human
agaaaaagaaaaa

SEQ ID NO: 3349492 - RNA, 14 nt, Human
ucucuugauucaua

SEQ ID NO: 3349493 - RNA, 16 nt, Human
ucucuugauucauaau

SEQ ID NO: 3349494 - RNA, 18 nt, Human
ucucuugagccugggagg

SEQ ID NO: 3349495 - RNA, 17 nt, Human
ucucuugagccugggag

SEQ ID NO: 3349496 - RNA, 18 nt, Human
acuuugaccucugcagca

SEQ ID NO: 3349497 - RNA, 15 nt, Human
acuuugaccucugca

SEQ ID NO: 3349498 - RNA, 16 nt, Human
acuuugaccucugcag

SEQ ID NO: 3349499 - RNA, 13 nt, Human
ucucucacuccuu

SEQ ID NO: 3349500 - RNA, 15 nt, Human
ucucucacuccuuga

SEQ ID NO: 3349501 - RNA, 21 nt, Human
ucucucaggccaaacucaccu

SEQ ID NO: 3349502 - RNA, 17 nt, Human
ucucuccagccccugga

SEQ ID NO: 3349503 - RNA, 16 nt, Human
ucucuccagccccugg

SEQ ID NO: 3349504 - RNA, 18 nt, Human
ucucuccagccccuggau

SEQ ID NO: 3349505 - RNA, 19 nt, Human
ucucuccagccccuggaug

SEQ ID NO: 3349506 - RNA, 16 nt, Human
ucucuccuguaccucu

SEQ ID NO: 3349507 - RNA, 14 nt, Human
ucucuccuguaccu

SEQ ID NO: 3349508 - RNA, 11 nt, Human
ucucugcccuc

SEQ ID NO: 3349509 - RNA, 15 nt, Human
ucucugcccuccaag

SEQ ID NO: 3349510 - RNA, 16 nt, Human
ucucugcccuccaaga

SEQ ID NO: 3349511 - RNA, 17 nt, Human
ucucugcccuccaagac

SEQ ID NO: 3349512 - RNA, 16 nt, Human
ucuccauguuugaugu

SEQ ID NO: 3349513 - RNA, 14 nt, Human
acuuugaccucugc

SEQ ID NO: 3349514 - RNA, 16 nt, Human
acuuucuagccagagg

SEQ ID NO: 3349515 - RNA, 17 nt, Human
acuuucuagccagagga

SEQ ID NO: 3349516 - RNA, 16 nt, Human
acuuuaaaaggagcca

SEQ ID NO: 3349517 - RNA, 21 nt, Human
ucuccuccuuuucacaguucu

SEQ ID NO: 3349518 - RNA, 16 nt, Human
ucuccaggcuguaucc

SEQ ID NO: 3349519 - RNA, 17 nt, Human
ucuccaaaauaaaacuu

SEQ ID NO: 3349520 - RNA, 19 nt, Human
ucuccaaaauaaaacuuuu

SEQ ID NO: 3349521 - RNA, 22 nt, Human
ucuccaaaauaaaacuuuuuaa

SEQ ID NO: 3349522 - RNA, 13 nt, Human
ucuccaaaauaaa

SEQ ID NO: 3349523 - RNA, 11 nt, Human
ucuccaggcug

SEQ ID NO: 3349524 - RNA, 15 nt, Human
acuuguggacacagc

SEQ ID NO: 3349525 - RNA, 12 nt, Human
ucucagggccug

SEQ ID NO: 3349526 - RNA, 13 nt, Human
ucucagggccugg

SEQ ID NO: 3349527 - RNA, 14 nt, Human
ucucagggccuggu

SEQ ID NO: 3349528 - RNA, 15 nt, Human
ucucagggccugguc

SEQ ID NO: 3349529 - RNA, 19 nt, Human
ucucagggccuggucguuu

SEQ ID NO: 3349530 - RNA, 11 nt, Human
ucucacuccuu

SEQ ID NO: 3349531 - RNA, 11 nt, Human
acuucagcuga

SEQ ID NO: 3349532 - RNA, 16 nt, Human
acuucagcugacuuuu

SEQ ID NO: 3349533 - RNA, 23 nt, Human
ucucacacaugagcaucaggcca

SEQ ID NO: 3349534 - RNA, 12 nt, Human
ucucacucuguc

SEQ ID NO: 3349535 - RNA, 13 nt, Human
ucucacuccuuga

SEQ ID NO: 3349536 - RNA, 22 nt, Human
acuucgggaggucgaggcagga

SEQ ID NO: 3349537 - RNA, 14 nt, Human
acuucuccacccug

SEQ ID NO: 3349538 - RNA, 16 nt, Human
acuuguggacacagcu

SEQ ID NO: 3349539 - RNA, 17 nt, Human
acuuguggacacagcuc

SEQ ID NO: 3349540 - RNA, 19 nt, Human
acuugagcccagagugaac

SEQ ID NO: 3349541 - RNA, 19 nt, Human
acuugagaauuacccuuuu

SEQ ID NO: 3349542 - RNA, 16 nt, Human
acuucuccacccugcu

SEQ ID NO: 3349543 - RNA, 15 nt, Human
acuucuccacccugc

SEQ ID NO: 3349544 - RNA, 17 nt, Human
acuuaaauaaugugaaa

SEQ ID NO: 3349545 - RNA, 18 nt, Human
acuuaaauaaugugaaac

SEQ ID NO: 3349546 - RNA, 16 nt, Human
acuuaaauaaugugaa

SEQ ID NO: 3349547 - RNA, 15 nt, Human
acuuaaauaauguga

SEQ ID NO: 3349548 - RNA, 14 nt, Human
acuguugcccaggc

SEQ ID NO: 3349549 - RNA, 13 nt, Human
acuguugcccagg

SEQ ID NO: 3349550 - RNA, 12 nt, Human
acuguugcccag

SEQ ID NO: 3349551 - RNA, 18 nt, Human
acuguugcccaggcuggc

SEQ ID NO: 3349552 - RNA, 17 nt, Human
acuguugcccaggcugg

SEQ ID NO: 3349553 - RNA, 15 nt, Human
acuuaaucuaaaugg

SEQ ID NO: 3349554 - RNA, 16 nt, Human
acuuaaucuaaaugga

SEQ ID NO: 3349555 - RNA, 13 nt, Human
acuuaaucuaaau

SEQ ID NO: 3349556 - RNA, 17 nt, Human
acuuacuaaaauauaua

SEQ ID NO: 3349557 - RNA, 22 nt, Human
acuuacuaaaauauauauagaa

SEQ ID NO: 3349558 - RNA, 14 nt, Human
acuguucucugccc

SEQ ID NO: 3349559 - RNA, 20 nt, Human
acuguucucugcccuccaag

SEQ ID NO: 3349560 - RNA, 21 nt, Human
acuguucucugcccuccaaga

SEQ ID NO: 3349561 - RNA, 19 nt, Human
acuguucucugcccuccaa

SEQ ID NO: 3349562 - RNA, 15 nt, Human
ucuaaagcugccagc

SEQ ID NO: 3349563 - RNA, 13 nt, Human
ucuaaagcugcca

SEQ ID NO: 3349564 - RNA, 14 nt, Human
ucuaaagcugccag

SEQ ID NO: 3349565 - RNA, 17 nt, Human
acuguccuacccacccu

SEQ ID NO: 3349566 - RNA, 18 nt, Human
acuguccuacccacccuc

SEQ ID NO: 3349567 - RNA, 22 nt, Human
acugugcugagucugaaggcug

SEQ ID NO: 3349568 - RNA, 19 nt, Human
ucgggaggucgaggcagga

SEQ ID NO: 3349569 - RNA, 21 nt, Human
ucgggaggucgaggcaggagg

SEQ ID NO: 3349570 - RNA, 17 nt, Human
ucgggaggucgaggcag

SEQ ID NO: 3349571 - RNA, 11 nt, Human
ucgggcaugac

SEQ ID NO: 3349572 - RNA, 12 nt, Human
ucgggcaugaca

SEQ ID NO: 3349573 - RNA, 21 nt, Human
acugcuugugaaaggaaagag

SEQ ID NO: 3349574 - RNA, 20 nt, Human
acugcuuaacuucacauauu

SEQ ID NO: 3349575 - RNA, 15 nt, Human
acuggauuaaacuua

SEQ ID NO: 3349576 - RNA, 18 nt, Human
acugcuuaacuucacaua

SEQ ID NO: 3349577 - RNA, 16 nt, Human
acugcauaugaaagga

SEQ ID NO: 3349578 - RNA, 21 nt, Human
uccuagaaauuccccacccug

SEQ ID NO: 3349579 - RNA, 22 nt, Human
uccuagaaauuccccacccuga

SEQ ID NO: 3349580 - RNA, 15 nt, Human
acugcauguuuguga

SEQ ID NO: 3349581 - RNA, 16 nt, Human
acugcauguuugugau

SEQ ID NO: 3349582 - RNA, 20 nt, Human
acugcaucaagaugugacau

SEQ ID NO: 3349583 - RNA, 22 nt, Human
acugcaucaagaugugacaugu

SEQ ID NO: 3349584 - RNA, 16 nt, Human
ucgcgacaaugcaaac

SEQ ID NO: 3349585 - RNA, 14 nt, Human
ucgcgacaaugcaa

SEQ ID NO: 3349586 - RNA, 19 nt, Human
ucgcgacaaugcaaaccau

SEQ ID NO: 3349587 - RNA, 18 nt, Human
ucgagcaugccuggaugg

SEQ ID NO: 3349588 - RNA, 15 nt, Human
ucgagcaugccugga

SEQ ID NO: 3349589 - RNA, 16 nt, Human
ucgagcaugccuggau

SEQ ID NO: 3349590 - RNA, 22 nt, Human
uccuuuagcgcccaguugggug

SEQ ID NO: 3349591 - RNA, 22 nt, Human
uccuuggugucgggcaugacac

SEQ ID NO: 3349592 - RNA, 14 nt, Human
uccuuguguuacua

SEQ ID NO: 3349593 - RNA, 23 nt, Human
uccuuguguuacuaaguuuuuau

SEQ ID NO: 3349594 - RNA, 19 nt, Human
uccuuuagcgcccaguugg

SEQ ID NO: 3349595 - RNA, 15 nt, Human
uccuuuagcgcccag

SEQ ID NO: 3349596 - RNA, 16 nt, Human
uccuucagugccuuau

SEQ ID NO: 3349597 - RNA, 17 nt, Human
uccuucagugccuuaug

SEQ ID NO: 3349598 - RNA, 14 nt, Human
uccuucagugccuu

SEQ ID NO: 3349599 - RNA, 15 nt, Human
uccuucagugccuua

SEQ ID NO: 3349600 - RNA, 19 nt, Human
agaggcagccccauucugc

SEQ ID NO: 3349601 - RNA, 13 nt, Human
agaggcagcccca

SEQ ID NO: 3349602 - RNA, 24 nt, Human
agaggcagccccauucugccugcc

SEQ ID NO: 3349603 - RNA, 13 nt, Human
agaggcagggucu

SEQ ID NO: 3349604 - RNA, 10 nt, Human
agaggcaggg

SEQ ID NO: 3349605 - RNA, 17 nt, Human
agaggcuaugugagcac

SEQ ID NO: 3349606 - RNA, 19 nt, Human
agaggccaugggccuccug

SEQ ID NO: 3349607 - RNA, 20 nt, Human
agagguucaaagauauuuug

SEQ ID NO: 3349608 - RNA, 19 nt, Human
ugaacuuugaccucugcag

SEQ ID NO: 3349609 - RNA, 20 nt, Human
ugaacuuugaccucugcagc

SEQ ID NO: 3349610 - RNA, 17 nt, Human
ugaacuuugaccucugc

SEQ ID NO: 3349611 - RNA, 22 nt, Human
ugaacuuugaccucugcagcaa

SEQ ID NO: 3349612 - RNA, 12 nt, Human
ugaacuccuggc

SEQ ID NO: 3349613 - RNA, 11 nt, Human
ugaacuccugg

SEQ ID NO: 3349614 - RNA, 15 nt, Human
ugaacuccuggccuc

SEQ ID NO: 3349615 - RNA, 14 nt, Human
ugaacuccuggccu

SEQ ID NO: 3349616 - RNA, 22 nt, Human
ugaaccgaugagaaauaaaguu

SEQ ID NO: 3349617 - RNA, 15 nt, Human
ugaaauuuuuauuaa

SEQ ID NO: 3349618 - RNA, 21 nt, Human
agagccuugcggaagguucua

SEQ ID NO: 3349619 - RNA, 22 nt, Human
agagccuuccaggggugggaca

SEQ ID NO: 3349620 - RNA, 11 nt, Human
agagccuugcg

SEQ ID NO: 3349621 - RNA, 17 nt, Human
agagcagagaccauccc

SEQ ID NO: 3349622 - RNA, 18 nt, Human
agagcagagaccaucccu

SEQ ID NO: 3349623 - RNA, 20 nt, Human
agagcagagaccaucccuga

SEQ ID NO: 3349624 - RNA, 16 nt, Human
agagauugugguuuca

SEQ ID NO: 3349625 - RNA, 17 nt, Human
ucuuuggacccugaggc

SEQ ID NO: 3349626 - RNA, 21 nt, Human
ucuuuggacccugaggcccag

SEQ ID NO: 3349627 - RNA, 16 nt, Human
ucuuuggacccugagg

SEQ ID NO: 3349628 - RNA, 12 nt, Human
agagcagagacc

SEQ ID NO: 3349629 - RNA, 18 nt, Human
agagcugccaccugccug

SEQ ID NO: 3349630 - RNA, 14 nt, Human
agagcugccaccug

SEQ ID NO: 3349631 - RNA, 12 nt, Human
agauaaaugugc

SEQ ID NO: 3349632 - RNA, 16 nt, Human
agaucacgccacugca

SEQ ID NO: 3349633 - RNA, 15 nt, Human
agaucacgccacugc

SEQ ID NO: 3349634 - RNA, 14 nt, Human
agaucacgccacug

SEQ ID NO: 3349635 - RNA, 18 nt, Human
agaucacgccacugcacu

SEQ ID NO: 3349636 - RNA, 17 nt, Human
agaucacgccacugcac

SEQ ID NO: 3349637 - RNA, 20 nt, Human
ugacacacagcucuguccug

SEQ ID NO: 3349638 - RNA, 17 nt, Human
agaguugauacuacagu

SEQ ID NO: 3349639 - RNA, 20 nt, Human
agaguugauacuacaguuug

SEQ ID NO: 3349640 - RNA, 22 nt, Human
agaguugauacuacaguuuguu

SEQ ID NO: 3349641 - RNA, 22 nt, Human
agagucucacuguugcccaggc

SEQ ID NO: 3349642 - RNA, 12 nt, Human
agaguuguuaca

SEQ ID NO: 3349643 - RNA, 21 nt, Human
agaguuguuacauuuuuaagu

SEQ ID NO: 3349644 - RNA, 20 nt, Human
ugaaugguuuucaaaauaaa

SEQ ID NO: 3349645 - RNA, 18 nt, Human
ugaaugucagugugacug

SEQ ID NO: 3349646 - RNA, 19 nt, Human
ugaaugucagugugacuga

SEQ ID NO: 3349647 - RNA, 22 nt, Human
agagucagaaguuucugccgca

SEQ ID NO: 3349648 - RNA, 21 nt, Human
ugacacacagcucuguccugg

SEQ ID NO: 3349649 - RNA, 20 nt, Human
ugacaggcaaugcuggcugu

SEQ ID NO: 3349650 - RNA, 16 nt, Human
ugacagggcacaccgg

SEQ ID NO: 3349651 - RNA, 11 nt, Human
ugacagggcac

SEQ ID NO: 3349652 - RNA, 20 nt, Human
ugacagggcacaccgggcac

SEQ ID NO: 3349653 - RNA, 13 nt, Human
agaucagccuggg

SEQ ID NO: 3349654 - RNA, 15 nt, Human
agaucagccugggca

SEQ ID NO: 3349655 - RNA, 18 nt, Human
ugaccaaugauggucacc

SEQ ID NO: 3349656 - RNA, 21 nt, Human
ugacauuguuggccaaagcca

SEQ ID NO: 3349657 - RNA, 20 nt, Human
ugacauuguuggccaaagcc

SEQ ID NO: 3349658 - RNA, 15 nt, Human
agaugcaccagcccu

SEQ ID NO: 3349659 - RNA, 14 nt, Human
agaugcaccagccc

SEQ ID NO: 3349660 - RNA, 15 nt, Human
agaugcuucucacug

SEQ ID NO: 3349661 - RNA, 13 nt, Human
ugacccacugcuu

SEQ ID NO: 3349662 - RNA, 12 nt, Human
ugacccacugcu

SEQ ID NO: 3349663 - RNA, 23 nt, Human
ugaccauucuccaccugccaggg

SEQ ID NO: 3349664 - RNA, 12 nt, Human
agacagucccug

SEQ ID NO: 3349665 - RNA, 12 nt, Human
agacagcugccu

SEQ ID NO: 3349666 - RNA, 15 nt, Human
agacagcugccuggg

SEQ ID NO: 3349667 - RNA, 13 nt, Human
agacagucccugc

SEQ ID NO: 3349668 - RNA, 19 nt, Human
agacagucccugccaaugg

SEQ ID NO: 3349669 - RNA, 18 nt, Human
ucuuaugggcuggguucu

SEQ ID NO: 3349670 - RNA, 12 nt, Human
ucuuagauguau

SEQ ID NO: 3349671 - RNA, 23 nt, Human
ucuuacuuacuaaaauauauaua

SEQ ID NO: 3349672 - RNA, 13 nt, Human
agacagcugccug

SEQ ID NO: 3349673 - RNA, 14 nt, Human
agacagcugccugg

SEQ ID NO: 3349674 - RNA, 21 nt, Human
agacacauguccaagaagccc

SEQ ID NO: 3349675 - RNA, 22 nt, Human
agacacauguccaagaagccca

SEQ ID NO: 3349676 - RNA, 16 nt, Human
agacacaggcccggcu

SEQ ID NO: 3349677 - RNA, 23 nt, Human
agacacaggcccggcuccaggcu

SEQ ID NO: 3349678 - RNA, 24 nt, Human
agacacauguccaagaagcccagg

SEQ ID NO: 3349679 - RNA, 19 nt, Human
agacaccuugacagggcac

SEQ ID NO: 3349680 - RNA, 22 nt, Human
agacaccuugacagggcacacc

SEQ ID NO: 3349681 - RNA, 20 nt, Human
agacacauguccaagaagcc

SEQ ID NO: 3349682 - RNA, 22 nt, Human
agacacaggcccggcuccaggc

SEQ ID NO: 3349683 - RNA, 21 nt, Human
agacacaggcccggcuccagg

SEQ ID NO: 3349684 - RNA, 20 nt, Human
agacacaggcccggcuccag

SEQ ID NO: 3349685 - RNA, 19 nt, Human
agacacaggcccggcucca

SEQ ID NO: 3349686 - RNA, 17 nt, Human
agacacaggcccggcuc

SEQ ID NO: 3349687 - RNA, 18 nt, Human
agaauucucuaguuugau

SEQ ID NO: 3349688 - RNA, 19 nt, Human
agaauucucuaguuugauu

SEQ ID NO: 3349689 - RNA, 17 nt, Human
agaauucucuuauccaa

SEQ ID NO: 3349690 - RNA, 14 nt, Human
agacacaagccuuc

SEQ ID NO: 3349691 - RNA, 13 nt, Human
agacacaagccuu

SEQ ID NO: 3349692 - RNA, 18 nt, Human
ucuguacgucugacaggc

SEQ ID NO: 3349693 - RNA, 13 nt, Human
ucuguuuagauaa

SEQ ID NO: 3349694 - RNA, 23 nt, Human
ucuguuuagauaauacaccacua

SEQ ID NO: 3349695 - RNA, 16 nt, Human
ucuguuuagauaauac

SEQ ID NO: 3349696 - RNA, 19 nt, Human
ucuguuuagauaauacacc

SEQ ID NO: 3349697 - RNA, 14 nt, Human
agaauucucuaguu

SEQ ID NO: 3349698 - RNA, 20 nt, Human
agaauuauaauuaguuccuc

SEQ ID NO: 3349699 - RNA, 20 nt, Human
agaauucucagaaucucaaa

SEQ ID NO: 3349700 - RNA, 21 nt, Human
agaauguguuuaaacuugguu

SEQ ID NO: 3349701 - RNA, 19 nt, Human
agaauuaguggcacuugcu

SEQ ID NO: 3349702 - RNA, 23 nt, Human
agaaccccaggguccuguagccc

SEQ ID NO: 3349703 - RNA, 14 nt, Human
agacccggcugcgu

SEQ ID NO: 3349704 - RNA, 18 nt, Human
ucuugagccuugaacuuu

SEQ ID NO: 3349705 - RNA, 19 nt, Human
ucuugagccuugaacuuug

SEQ ID NO: 3349706 - RNA, 17 nt, Human
ucuugagccuugaacuu

SEQ ID NO: 3349707 - RNA, 16 nt, Human
ucuugagccuugaacu

SEQ ID NO: 3349708 - RNA, 22 nt, Human
ucuucuguacgucugacaggca

SEQ ID NO: 3349709 - RNA, 21 nt, Human
ucuucuguacgucugacaggc

SEQ ID NO: 3349710 - RNA, 19 nt, Human
ucuucugcuucagccuccc

SEQ ID NO: 3349711 - RNA, 22 nt, Human
ucuucugcuucagccucccgag

SEQ ID NO: 3349712 - RNA, 17 nt, Human
ucuuauuuaaugaaaga

SEQ ID NO: 3349713 - RNA, 23 nt, Human
agacauacuaaccagcagaaaug

SEQ ID NO: 3349714 - RNA, 20 nt, Human
ucuucuguacgucugacagg

SEQ ID NO: 3349715 - RNA, 22 nt, Human
ucuuuaaugucacaggcagguc

SEQ ID NO: 3349716 - RNA, 19 nt, Human
ucuuuaaugucacaggcag

SEQ ID NO: 3349717 - RNA, 16 nt, Human
ucuugguuuguaaauu

SEQ ID NO: 3349718 - RNA, 20 nt, Human
ucuuuaaugucacaggcagg

SEQ ID NO: 3349719 - RNA, 19 nt, Human
ucuugguccugcugcaguu

SEQ ID NO: 3349720 - RNA, 14 nt, Human
ucuugguuuguaaa

SEQ ID NO: 3349721 - RNA, 15 nt, Human
agacucgcgacaaug

SEQ ID NO: 3349722 - RNA, 17 nt, Human
agacucgcgacaaugca

SEQ ID NO: 3349723 - RNA, 18 nt, Human
agacucgcgacaaugcaa

SEQ ID NO: 3349724 - RNA, 19 nt, Human
agacucgcgacaaugcaaa

SEQ ID NO: 3349725 - RNA, 23 nt, Human
agacuccugcaggcagccaggcc

SEQ ID NO: 3349726 - RNA, 20 nt, Human
ucuuuauaauucuacuuuga

SEQ ID NO: 3349727 - RNA, 13 nt, Human
ucuuucugcuuug

SEQ ID NO: 3349728 - RNA, 18 nt, Human
ucuuucuggcuaugcauu

SEQ ID NO: 3349729 - RNA, 20 nt, Human
agacucgcgacaaugcaaac

SEQ ID NO: 3349730 - RNA, 14 nt, Human
agacuguacaaagu

SEQ ID NO: 3349731 - RNA, 16 nt, Human
agacuguacaaaguag

SEQ ID NO: 3349732 - RNA, 15 nt, Human
agacuguacaaagua

SEQ ID NO: 3349733 - RNA, 19 nt, Human
agacuuuucuuucagccaa

SEQ ID NO: 3349734 - RNA, 22 nt, Human
agagaaaaaauauuuuccugcc

SEQ ID NO: 3349735 - RNA, 15 nt, Human
gucacaggcaggucc

SEQ ID NO: 3349736 - RNA, 13 nt, Human
gucacaggcaggu

SEQ ID NO: 3349737 - RNA, 16 nt, Human
gucacaggcaggucca

SEQ ID NO: 3349738 - RNA, 12 nt, Human
gucacaggcagg

SEQ ID NO: 3349739 - RNA, 19 nt, Human
aacaagaccacguuucuaa

SEQ ID NO: 3349740 - RNA, 16 nt, Human
aacaagaccacguuuc

SEQ ID NO: 3349741 - RNA, 17 nt, Human
aacaagaccacguuucu

SEQ ID NO: 3349742 - RNA, 23 nt, Human
aacaaggcaaggcugucaauuac

SEQ ID NO: 3349743 - RNA, 21 nt, Human
gucauuugagcagggcucagc

SEQ ID NO: 3349744 - RNA, 21 nt, Human
aacacuguucucugcccucca

SEQ ID NO: 3349745 - RNA, 19 nt, Human
aacacuguucucugcccuc

SEQ ID NO: 3349746 - RNA, 19 nt, Human
gucauuugagcagggcuca

SEQ ID NO: 3349747 - RNA, 22 nt, Human
gucauuugagcagggcucagcg

SEQ ID NO: 3349748 - RNA, 17 nt, Human
aacacucauugaccuga

SEQ ID NO: 3349749 - RNA, 21 nt, Human
aacacucauugaccugaggcc

SEQ ID NO: 3349750 - RNA, 12 nt, Human
aacacuccuuca

SEQ ID NO: 3349751 - RNA, 11 nt, Human
aacacucugag

SEQ ID NO: 3349752 - RNA, 12 nt, Human
aacacucugaga

SEQ ID NO: 3349753 - RNA, 13 nt, Human
aacacucugagac

SEQ ID NO: 3349754 - RNA, 14 nt, Human
aacacucugagacu

SEQ ID NO: 3349755 - RNA, 15 nt, Human
aacacuguucucugc

SEQ ID NO: 3349756 - RNA, 20 nt, Human
aacacuguucucugcccucc

SEQ ID NO: 3349757 - RNA, 14 nt, Human
aacauacucccauc

SEQ ID NO: 3349758 - RNA, 15 nt, Human
aacauacucccaucu

SEQ ID NO: 3349759 - RNA, 10 nt, Human
aacagaaaug

SEQ ID NO: 3349760 - RNA, 15 nt, Human
aacagaaauguacag

SEQ ID NO: 3349761 - RNA, 21 nt, Human
aacagaaauguacagcaagga

SEQ ID NO: 3349762 - RNA, 13 nt, Human
guccgagcuuuga

SEQ ID NO: 3349763 - RNA, 13 nt, Human
aacaggcugggcu

SEQ ID NO: 3349764 - RNA, 22 nt, Human
aacaggcugggcuucaguggca

SEQ ID NO: 3349765 - RNA, 19 nt, Human
aacagacuggaagcacagc

SEQ ID NO: 3349766 - RNA, 23 nt, Human
aacaggcugggcuucaguggcag

SEQ ID NO: 3349767 - RNA, 19 nt, Human
aacagguuuuccugaagaa

SEQ ID NO: 3349768 - RNA, 18 nt, Human
aaccacaucuugcucugc

SEQ ID NO: 3349769 - RNA, 21 nt, Human
aaccaucauugaaaucuuuuu

SEQ ID NO: 3349770 - RNA, 16 nt, Human
aaccauggacuuuaua

SEQ ID NO: 3349771 - RNA, 18 nt, Human
aaccaucauugaaaucuu

SEQ ID NO: 3349772 - RNA, 19 nt, Human
aaccaucauugaaaucuuu

SEQ ID NO: 3349773 - RNA, 20 nt, Human
aaccaucauugaaaucuuuu

SEQ ID NO: 3349774 - RNA, 22 nt, Human
aaccacaucuugcucugcugac

SEQ ID NO: 3349775 - RNA, 20 nt, Human
aaccacaucuugcucugcug

SEQ ID NO: 3349776 - RNA, 16 nt, Human
aacauuuugucauaua

SEQ ID NO: 3349777 - RNA, 13 nt, Human
gucuccauguuug

SEQ ID NO: 3349778 - RNA, 14 nt, Human
aaccuccugggcua

SEQ ID NO: 3349779 - RNA, 17 nt, Human
aaccuccgccucuuggg

SEQ ID NO: 3349780 - RNA, 15 nt, Human
aacccccagccugcu

SEQ ID NO: 3349781 - RNA, 14 nt, Human
aacccccagccugc

SEQ ID NO: 3349782 - RNA, 13 nt, Human
aacccccagccug

SEQ ID NO: 3349783 - RNA, 17 nt, Human
aacccagcucuggucca

SEQ ID NO: 3349784 - RNA, 13 nt, Human
aacccagcucugg

SEQ ID NO: 3349785 - RNA, 14 nt, Human
aacccagcucuggu

SEQ ID NO: 3349786 - RNA, 11 nt, Human
aacccagcucu

SEQ ID NO: 3349787 - RNA, 23 nt, Human
aaccauuuugcugucccuuuucc

SEQ ID NO: 3349788 - RNA, 15 nt, Human
gucuuagauguauau

SEQ ID NO: 3349789 - RNA, 14 nt, Human
gucuuuggacccug

SEQ ID NO: 3349790 - RNA, 15 nt, Human
gucuuuggacccuga

SEQ ID NO: 3349791 - RNA, 17 nt, Human
gucuuuggacccugagg

SEQ ID NO: 3349792 - RNA, 14 nt, Human
gucuuuucuugcau

SEQ ID NO: 3349793 - RNA, 19 nt, Human
gucuuuucuugcaugaggc

SEQ ID NO: 3349794 - RNA, 24 nt, Human
gucuuuucuugcaugaggcuagug

SEQ ID NO: 3349795 - RNA, 16 nt, Human
aacguggcugcuucaa

SEQ ID NO: 3349796 - RNA, 19 nt, Human
aacguggcugcuucaagga

SEQ ID NO: 3349797 - RNA, 15 nt, Human
aacguggcugcuuca

SEQ ID NO: 3349798 - RNA, 19 nt, Human
gugaaccaccacacccagc

SEQ ID NO: 3349799 - RNA, 19 nt, Human
gucaaaguggugagaggca

SEQ ID NO: 3349800 - RNA, 18 nt, Human
gucaaaguggugagaggc

SEQ ID NO: 3349801 - RNA, 17 nt, Human
guauuuuuuuacuaaua

SEQ ID NO: 3349802 - RNA, 21 nt, Human
guauuuuuuuacuaauagaca

SEQ ID NO: 3349803 - RNA, 20 nt, Human
gucacacaguauuacuucug

SEQ ID NO: 3349804 - RNA, 16 nt, Human
gucacacacuuuggcu

SEQ ID NO: 3349805 - RNA, 14 nt, Human
guauuuuuuuacua

SEQ ID NO: 3349806 - RNA, 15 nt, Human
guauuuuuuuacuaa

SEQ ID NO: 3349807 - RNA, 22 nt, Human
guauuggcuagagguucaaaga

SEQ ID NO: 3349808 - RNA, 22 nt, Human
aaauuaacuuuuauaaacuuua

SEQ ID NO: 3349809 - RNA, 23 nt, Human
aaauuaacuuuuauaaacuuuac

SEQ ID NO: 3349810 - RNA, 19 nt, Human
aaauuaacuuuuauaaacu

SEQ ID NO: 3349811 - RNA, 21 nt, Human
aaauuaacuuuuauaaacuuu

SEQ ID NO: 3349812 - RNA, 16 nt, Human
aaauuccccacccuga

SEQ ID NO: 3349813 - RNA, 14 nt, Human
aaauucaugcugcu

SEQ ID NO: 3349814 - RNA, 15 nt, Human
aaaugggggugcauu

SEQ ID NO: 3349815 - RNA, 16 nt, Human
aaaugggggugcauuu

SEQ ID NO: 3349816 - RNA, 17 nt, Human
aaaugggggugcauuug

SEQ ID NO: 3349817 - RNA, 18 nt, Human
aaaugggggugcauuuga

SEQ ID NO: 3349818 - RNA, 21 nt, Human
guaucccaugagccucagcau

SEQ ID NO: 3349819 - RNA, 15 nt, Human
guaucccuacuguaa

SEQ ID NO: 3349820 - RNA, 22 nt, Human
guaugaucacggcucacugcag

SEQ ID NO: 3349821 - RNA, 14 nt, Human
guaugggagagaag

SEQ ID NO: 3349822 - RNA, 21 nt, Human
guauucucuccuguaccucuu

SEQ ID NO: 3349823 - RNA, 15 nt, Human
guauucuuauuuaau

SEQ ID NO: 3349824 - RNA, 15 nt, Human
guaugggagagaaga

SEQ ID NO: 3349825 - RNA, 21 nt, Human
guagcugggacuacaggcacc

SEQ ID NO: 3349826 - RNA, 19 nt, Human
guagcugggacuacaggca

SEQ ID NO: 3349827 - RNA, 18 nt, Human
guagcugggacuacaggc

SEQ ID NO: 3349828 - RNA, 12 nt, Human
guagcugggacu

SEQ ID NO: 3349829 - RNA, 22 nt, Human
guagcucuaggagggcuggcaa

SEQ ID NO: 3349830 - RNA, 18 nt, Human
guaggaagguuaauguuc

SEQ ID NO: 3349831 - RNA, 15 nt, Human
guaggaagacuuugg

SEQ ID NO: 3349832 - RNA, 15 nt, Human
aaaucccauuuaaaa

SEQ ID NO: 3349833 - RNA, 18 nt, Human
aaaucccuuaccucggug

SEQ ID NO: 3349834 - RNA, 13 nt, Human
aaaucgaugcagu

SEQ ID NO: 3349835 - RNA, 15 nt, Human
aaaucucaaauuucu

SEQ ID NO: 3349836 - RNA, 16 nt, Human
aaaucucaaauuucua

SEQ ID NO: 3349837 - RNA, 17 nt, Human
aaaucucaaauuucuaa

SEQ ID NO: 3349838 - RNA, 17 nt, Human
aaaugaaaaucgugaca

SEQ ID NO: 3349839 - RNA, 18 nt, Human
aaaugcaccuggaauaua

SEQ ID NO: 3349840 - RNA, 22 nt, Human
aaaugcaccuggaauauauaac

SEQ ID NO: 3349841 - RNA, 14 nt, Human
aaaugcaccuggaa

SEQ ID NO: 3349842 - RNA, 18 nt, Human
aaaugggcagagcagaga

SEQ ID NO: 3349843 - RNA, 20 nt, Human
aaaugggcagagcagagacc

SEQ ID NO: 3349844 - RNA, 15 nt, Human
aaaugggcagagcag

SEQ ID NO: 3349845 - RNA, 13 nt, Human
aaaugcccagcuu

SEQ ID NO: 3349846 - RNA, 18 nt, Human
aaaugcccagccccuucu

SEQ ID NO: 3349847 - RNA, 14 nt, Human
aaaugcccagcccc

SEQ ID NO: 3349848 - RNA, 15 nt, Human
aaaugcccagccccu

SEQ ID NO: 3349849 - RNA, 13 nt, Human
aaaugcccagccc

SEQ ID NO: 3349850 - RNA, 13 nt, Human
aaaugagccuggc

SEQ ID NO: 3349851 - RNA, 19 nt, Human
aaaugagccuggcaagaau

SEQ ID NO: 3349852 - RNA, 23 nt, Human
aaaugagguacucuccuggaaau

SEQ ID NO: 3349853 - RNA, 16 nt, Human
aaaugagguacucucc

SEQ ID NO: 3349854 - RNA, 19 nt, Human
aaaugaggucagagccugc

SEQ ID NO: 3349855 - RNA, 17 nt, Human
aaaugaggucagagccu

SEQ ID NO: 3349856 - RNA, 17 nt, Human
gugguuuucuguucuuu

SEQ ID NO: 3349857 - RNA, 18 nt, Human
aagagguuuuaaaaaaau

SEQ ID NO: 3349858 - RNA, 12 nt, Human
aagaugcagccg

SEQ ID NO: 3349859 - RNA, 12 nt, Human
aagcaaaggaga

SEQ ID NO: 3349860 - RNA, 13 nt, Human
aagcaaaggagau

SEQ ID NO: 3349861 - RNA, 14 nt, Human
aagaugugacaugu

SEQ ID NO: 3349862 - RNA, 18 nt, Human
aagaugugacauguuuua

SEQ ID NO: 3349863 - RNA, 23 nt, Human
guguuuccuggcacugcuuccag

SEQ ID NO: 3349864 - RNA, 18 nt, Human
gugucuugcaauggcagc

SEQ ID NO: 3349865 - RNA, 17 nt, Human
gugucuugcaauggcag

SEQ ID NO: 3349866 - RNA, 18 nt, Human
gugucuuuuuucacuaca

SEQ ID NO: 3349867 - RNA, 17 nt, Human
gugugacuacuccccca

SEQ ID NO: 3349868 - RNA, 17 nt, Human
aagacuguacaaaguag

SEQ ID NO: 3349869 - RNA, 21 nt, Human
aagacugaguacguugugcau

SEQ ID NO: 3349870 - RNA, 16 nt, Human
aagacuguacaaagua

SEQ ID NO: 3349871 - RNA, 17 nt, Human
aagacugaguacguugu

SEQ ID NO: 3349872 - RNA, 18 nt, Human
aagacuaucuaaauguug

SEQ ID NO: 3349873 - RNA, 17 nt, Human
aagacuaucuaaauguu

SEQ ID NO: 3349874 - RNA, 16 nt, Human
aagacuaucuaaaugu

SEQ ID NO: 3349875 - RNA, 18 nt, Human
aagacccuugugguccca

SEQ ID NO: 3349876 - RNA, 21 nt, Human
aagacccuuguggucccaccc

SEQ ID NO: 3349877 - RNA, 22 nt, Human
aagacccuuguggucccacccc

SEQ ID NO: 3349878 - RNA, 19 nt, Human
aagagauugugguuucauu

SEQ ID NO: 3349879 - RNA, 22 nt, Human
guggcgcagcauauucaggaag

SEQ ID NO: 3349880 - RNA, 23 nt, Human
guggcgcagcauauucaggaagc

SEQ ID NO: 3349881 - RNA, 22 nt, Human
gugggacacccugugauggggc

SEQ ID NO: 3349882 - RNA, 23 nt, Human
gugggaggaucucuugagccugg

SEQ ID NO: 3349883 - RNA, 13 nt, Human
gugggagugggcc

SEQ ID NO: 3349884 - RNA, 14 nt, Human
gugggagugggccc

SEQ ID NO: 3349885 - RNA, 14 nt, Human
guggguacgggagg

SEQ ID NO: 3349886 - RNA, 20 nt, Human
gugggggaucacagccucug

SEQ ID NO: 3349887 - RNA, 16 nt, Human
gugguuucagaaaugu

SEQ ID NO: 3349888 - RNA, 14 nt, Human
guggugguuuucug

SEQ ID NO: 3349889 - RNA, 16 nt, Human
aagaauugaagcagga

SEQ ID NO: 3349890 - RNA, 14 nt, Human
guggcagcucaccu

SEQ ID NO: 3349891 - RNA, 16 nt, Human
guggcagcucaccucu

SEQ ID NO: 3349892 - RNA, 18 nt, Human
guggauuuaacagaaaug

SEQ ID NO: 3349893 - RNA, 19 nt, Human
guggauuuaacagaaaugu

SEQ ID NO: 3349894 - RNA, 19 nt, Human
guggcaccagcagccugga

SEQ ID NO: 3349895 - RNA, 18 nt, Human
guggcaccagcagccugg

SEQ ID NO: 3349896 - RNA, 20 nt, Human
guggaugccugguggcagcu

SEQ ID NO: 3349897 - RNA, 21 nt, Human
guggaugccugguggcagcug

SEQ ID NO: 3349898 - RNA, 17 nt, Human
guggacacagcucuucu

SEQ ID NO: 3349899 - RNA, 22 nt, Human
guggacacagcucuucuccagg

SEQ ID NO: 3349900 - RNA, 18 nt, Human
guggacacagcucuucuc

SEQ ID NO: 3349901 - RNA, 22 nt, Human
gugcugggauuacaagcgugag

SEQ ID NO: 3349902 - RNA, 21 nt, Human
gugcugggauuacaagcguga

SEQ ID NO: 3349903 - RNA, 20 nt, Human
gugcugggauuacaggugug

SEQ ID NO: 3349904 - RNA, 19 nt, Human
gugcuaucucccccagccc

SEQ ID NO: 3349905 - RNA, 22 nt, Human
gugcuaucucccccagccccau

SEQ ID NO: 3349906 - RNA, 12 nt, Human
gugcuauguucu

SEQ ID NO: 3349907 - RNA, 18 nt, Human
aacuugucuuuggacccu

SEQ ID NO: 3349908 - RNA, 11 nt, Human
gugccuuaugg

SEQ ID NO: 3349909 - RNA, 17 nt, Human
aacuuggcgcugccccu

SEQ ID NO: 3349910 - RNA, 13 nt, Human
aacuuuaccuuuu

SEQ ID NO: 3349911 - RNA, 21 nt, Human
gugccuuauggaacacucuga

SEQ ID NO: 3349912 - RNA, 23 nt, Human
gugccuuauggaacacucugaga

SEQ ID NO: 3349913 - RNA, 14 nt, Human
gugccuuauggaac

SEQ ID NO: 3349914 - RNA, 13 nt, Human
gugccucugggac

SEQ ID NO: 3349915 - RNA, 12 nt, Human
gugccucuggga

SEQ ID NO: 3349916 - RNA, 22 nt, Human
gugccgagaaggaagccuccca

SEQ ID NO: 3349917 - RNA, 15 nt, Human
gugccucaagagaag

SEQ ID NO: 3349918 - RNA, 22 nt, Human
aagaaagacuaucuaaauguug

SEQ ID NO: 3349919 - RNA, 20 nt, Human
aagaaagacuaucuaaaugu

SEQ ID NO: 3349920 - RNA, 18 nt, Human
aagaaaaaggaugcacag

SEQ ID NO: 3349921 - RNA, 15 nt, Human
aagaaaaaggaugca

SEQ ID NO: 3349922 - RNA, 17 nt, Human
aagaaaaaggaugcaca

SEQ ID NO: 3349923 - RNA, 18 nt, Human
aagaaaaagaaaaagaaa

SEQ ID NO: 3349924 - RNA, 21 nt, Human
gugcuaucucccccagcccca

SEQ ID NO: 3349925 - RNA, 22 nt, Human
gugcuaggaacacuccuucaca

SEQ ID NO: 3349926 - RNA, 17 nt, Human
gugcuaggaacacuccu

SEQ ID NO: 3349927 - RNA, 18 nt, Human
gugcuaggaacacuccuu

SEQ ID NO: 3349928 - RNA, 20 nt, Human
guucccauuugcuccuuucu

SEQ ID NO: 3349929 - RNA, 16 nt, Human
guucccauuugcuccu

SEQ ID NO: 3349930 - RNA, 20 nt, Human
guuccauggccucuucagau

SEQ ID NO: 3349931 - RNA, 22 nt, Human
guugaugaucuuugcagacagg

SEQ ID NO: 3349932 - RNA, 17 nt, Human
guucuuaguuugcaguu

SEQ ID NO: 3349933 - RNA, 21 nt, Human
guucuugguuuguaaauuaac

SEQ ID NO: 3349934 - RNA, 18 nt, Human
guucuugguuuguaaauu

SEQ ID NO: 3349935 - RNA, 23 nt, Human
guucugggacacaguucaauucu

SEQ ID NO: 3349936 - RNA, 20 nt, Human
guucccuuugacgccauccc

SEQ ID NO: 3349937 - RNA, 21 nt, Human
guucccuuugacgccauccca

SEQ ID NO: 3349938 - RNA, 16 nt, Human
guucuacccaggugcu

SEQ ID NO: 3349939 - RNA, 17 nt, Human
guucagcuccagcucac

SEQ ID NO: 3349940 - RNA, 16 nt, Human
guucagcuccagcuca

SEQ ID NO: 3349941 - RNA, 15 nt, Human
guucagcuccagcuc

SEQ ID NO: 3349942 - RNA, 19 nt, Human
guucaggguuggccccugc

SEQ ID NO: 3349943 - RNA, 18 nt, Human
guucaggguuggccccug

SEQ ID NO: 3349944 - RNA, 17 nt, Human
guucaggguuggccccu

SEQ ID NO: 3349945 - RNA, 16 nt, Human
aagcuaggccuggcca

SEQ ID NO: 3349946 - RNA, 18 nt, Human
aagcuaggccuggccaga

SEQ ID NO: 3349947 - RNA, 17 nt, Human
aagcuaggccuggccag

SEQ ID NO: 3349948 - RNA, 19 nt, Human
aagccuccuccagccgcca

SEQ ID NO: 3349949 - RNA, 20 nt, Human
guuaguaugaggcauuuguu

SEQ ID NO: 3349950 - RNA, 17 nt, Human
guuaguaugaggcauuu

SEQ ID NO: 3349951 - RNA, 18 nt, Human
guuaaucauuagguguga

SEQ ID NO: 3349952 - RNA, 18 nt, Human
guuaaugauagcuacugu

SEQ ID NO: 3349953 - RNA, 18 nt, Human
guuggucccccuuccaug

SEQ ID NO: 3349954 - RNA, 13 nt, Human
guuggguggaugc

SEQ ID NO: 3349955 - RNA, 15 nt, Human
aaggauccugagcca

SEQ ID NO: 3349956 - RNA, 17 nt, Human
aaggauccugagccaga

SEQ ID NO: 3349957 - RNA, 18 nt, Human
aaggaugaucuaggaaga

SEQ ID NO: 3349958 - RNA, 23 nt, Human
aaggaugaucuaggaagacuuug

SEQ ID NO: 3349959 - RNA, 14 nt, Human
aaggauccugagcc

SEQ ID NO: 3349960 - RNA, 13 nt, Human
aaggauccugagc

SEQ ID NO: 3349961 - RNA, 23 nt, Human
guugaugaucuuugcagacaggc

SEQ ID NO: 3349962 - RNA, 15 nt, Human
aaggaugcuuguaca

SEQ ID NO: 3349963 - RNA, 16 nt, Human
aaggaugcuuguacau

SEQ ID NO: 3349964 - RNA, 18 nt, Human
aaggaugcacagaguugu

SEQ ID NO: 3349965 - RNA, 19 nt, Human
aaggaugcccaaagaugca

SEQ ID NO: 3349966 - RNA, 17 nt, Human
aaggaugcuuguacaua

SEQ ID NO: 3349967 - RNA, 19 nt, Human
aaggaugcuuguacauaau

SEQ ID NO: 3349968 - RNA, 17 nt, Human
guugcccaggcuggcgu

SEQ ID NO: 3349969 - RNA, 15 nt, Human
guugcccaggcaggu

SEQ ID NO: 3349970 - RNA, 21 nt, Human
guugcccaggcuggcgugcag

SEQ ID NO: 3349971 - RNA, 18 nt, Human
guugcccaggcaggucuu

SEQ ID NO: 3349972 - RNA, 14 nt, Human
aaggcuccaggagc

SEQ ID NO: 3349973 - RNA, 17 nt, Human
guugcccaggcaggucu

SEQ ID NO: 3349974 - RNA, 16 nt, Human
aaggccaaaggaagca

SEQ ID NO: 3349975 - RNA, 18 nt, Human
aaggccaaaggaagcaca

SEQ ID NO: 3349976 - RNA, 19 nt, Human
aaggcuaccuuuguauucu

SEQ ID NO: 3349977 - RNA, 15 nt, Human
aaggcuaccuuugua

SEQ ID NO: 3349978 - RNA, 12 nt, Human
aaguaauaugca

SEQ ID NO: 3349979 - RNA, 15 nt, Human
aaguaauaugcacac

SEQ ID NO: 3349980 - RNA, 16 nt, Human
aaguaauaugcacaca

SEQ ID NO: 3349981 - RNA, 19 nt, Human
guuucuaaaggcuaccuuu

SEQ ID NO: 3349982 - RNA, 20 nt, Human
guuucuaaagcugccagccg

SEQ ID NO: 3349983 - RNA, 16 nt, Human
aaggguaucaggugcu

SEQ ID NO: 3349984 - RNA, 23 nt, Human
aaggggaauguuugccucugccu

SEQ ID NO: 3349985 - RNA, 22 nt, Human
aaggggaauguuugccucugcc

SEQ ID NO: 3349986 - RNA, 19 nt, Human
aagggccuggccugagcug

SEQ ID NO: 3349987 - RNA, 14 nt, Human
aagggccuggccug

SEQ ID NO: 3349988 - RNA, 17 nt, Human
aagggccuggccugagc

SEQ ID NO: 3349989 - RNA, 13 nt, Human
aagggccuggccu

SEQ ID NO: 3349990 - RNA, 18 nt, Human
aaggcuuauauucaacca

SEQ ID NO: 3349991 - RNA, 23 nt, Human
aaggcuuauauucaaccauggac

SEQ ID NO: 3349992 - RNA, 21 nt, Human
aaggcuuauauucaaccaugg

SEQ ID NO: 3349993 - RNA, 13 nt, Human
guuugccucugcc

SEQ ID NO: 3349994 - RNA, 22 nt, Human
guuucuaaaggcuaccuuugua

SEQ ID NO: 3349995 - RNA, 23 nt, Human
guuucuaaaggcuaccuuuguau

SEQ ID NO: 3349996 - RNA, 21 nt, Human
guuugauucagacagcugccu

SEQ ID NO: 3349997 - RNA, 22 nt, Human
guuugauucagacagcugccug

SEQ ID NO: 3349998 - RNA, 11 nt, Human
guuuucuguuc

SEQ ID NO: 3349999 - RNA, 19 nt, Human
guuuucuguucuuucuggc

SEQ ID NO: 3350000 - RNA, 19 nt, Human
acacacagcucuguccugg

SEQ ID NO: 3350001 - RNA, 13 nt, Human
acacacacauaca

SEQ ID NO: 3350002 - RNA, 12 nt, Human
acacacauacac

SEQ ID NO: 3350003 - RNA, 12 nt, Human
acacacagcucu

SEQ ID NO: 3350004 - RNA, 11 nt, Human
acacacagcuc

SEQ ID NO: 3350005 - RNA, 11 nt, Human
acacacacaua

SEQ ID NO: 3350006 - RNA, 15 nt, Human
acaaugguuuucuug

SEQ ID NO: 3350007 - RNA, 21 nt, Human
acaaugguuuucuuguguguu

SEQ ID NO: 3350008 - RNA, 22 nt, Human
acacaguauuacuucugcuaca

SEQ ID NO: 3350009 - RNA, 11 nt, Human
acacagugagu

SEQ ID NO: 3350010 - RNA, 22 nt, Human
acacagcucuucuccaggcugu

SEQ ID NO: 3350011 - RNA, 21 nt, Human
uagguuggcaaaaaggcagga

SEQ ID NO: 3350012 - RNA, 13 nt, Human
uaguagagacagg

SEQ ID NO: 3350013 - RNA, 18 nt, Human
acacauguccaagaagcc

SEQ ID NO: 3350014 - RNA, 19 nt, Human
acacauguccaagaagccc

SEQ ID NO: 3350015 - RNA, 13 nt, Human
acacauguccaag

SEQ ID NO: 3350016 - RNA, 21 nt, Human
acacauguccaagaagcccag

SEQ ID NO: 3350017 - RNA, 22 nt, Human
acacauguccaagaagcccagg

SEQ ID NO: 3350018 - RNA, 13 nt, Human
acacccagcccac

SEQ ID NO: 3350019 - RNA, 12 nt, Human
acacccagccca

SEQ ID NO: 3350020 - RNA, 22 nt, Human
uauaaccaguguuguggauuua

SEQ ID NO: 3350021 - RNA, 20 nt, Human
uauaaccaguguuguggauu

SEQ ID NO: 3350022 - RNA, 17 nt, Human
acacuaaccacgcugga

SEQ ID NO: 3350023 - RNA, 16 nt, Human
acacuaaccacgcugg

SEQ ID NO: 3350024 - RNA, 19 nt, Human
acacuaaccacgcuggacc

SEQ ID NO: 3350025 - RNA, 15 nt, Human
acacuaaccacgcug

SEQ ID NO: 3350026 - RNA, 16 nt, Human
acaccuugacagggca

SEQ ID NO: 3350027 - RNA, 15 nt, Human
acaccuugacagggc

SEQ ID NO: 3350028 - RNA, 14 nt, Human
acaccuugacaggg

SEQ ID NO: 3350029 - RNA, 18 nt, Human
acaccucugcacaagcug

SEQ ID NO: 3350030 - RNA, 16 nt, Human
acagaguuguuacauu

SEQ ID NO: 3350031 - RNA, 17 nt, Human
acagaguuguuacauuu

SEQ ID NO: 3350032 - RNA, 18 nt, Human
acagaguuguuacauuuu

SEQ ID NO: 3350033 - RNA, 19 nt, Human
acagaguuguuacauuuuu

SEQ ID NO: 3350034 - RNA, 20 nt, Human
acagaguuguuacauuuuua

SEQ ID NO: 3350035 - RNA, 21 nt, Human
acagagcaagugagacccugu

SEQ ID NO: 3350036 - RNA, 18 nt, Human
acagagcuacacagggga

SEQ ID NO: 3350037 - RNA, 19 nt, Human
uaucccuacuguaauuugu

SEQ ID NO: 3350038 - RNA, 20 nt, Human
uaucccuacuguaauuugug

SEQ ID NO: 3350039 - RNA, 13 nt, Human
uaucucagggccu

SEQ ID NO: 3350040 - RNA, 21 nt, Human
acagcccgggcucugccuccc

SEQ ID NO: 3350041 - RNA, 22 nt, Human
acagcccgggcucugccuccca

SEQ ID NO: 3350042 - RNA, 20 nt, Human
acagcccgggcucugccucc

SEQ ID NO: 3350043 - RNA, 23 nt, Human
acagcccgggcucugccucccau

SEQ ID NO: 3350044 - RNA, 23 nt, Human
acagaugggugcuuggaggaagg

SEQ ID NO: 3350045 - RNA, 20 nt, Human
acagauacuccuccaagguu

SEQ ID NO: 3350046 - RNA, 20 nt, Human
acagauagauauaugcucug

SEQ ID NO: 3350047 - RNA, 21 nt, Human
acagaguuguuacauuuuuaa

SEQ ID NO: 3350048 - RNA, 15 nt, Human
acagaguuguuacau

SEQ ID NO: 3350049 - RNA, 15 nt, Human
acagacacaggcccg

SEQ ID NO: 3350050 - RNA, 17 nt, Human
acagacacaggcccggc

SEQ ID NO: 3350051 - RNA, 18 nt, Human
acagacacaggcccggcu

SEQ ID NO: 3350052 - RNA, 19 nt, Human
acagacuggaagcacagcu

SEQ ID NO: 3350053 - RNA, 17 nt, Human
acagacuggaagcacag

SEQ ID NO: 3350054 - RNA, 21 nt, Human
acagacuggaagcacagcuuc

SEQ ID NO: 3350055 - RNA, 21 nt, Human
uauauucaaccauggacuuua

SEQ ID NO: 3350056 - RNA, 14 nt, Human
uauauucaaccaug

SEQ ID NO: 3350057 - RNA, 13 nt, Human
uauauucaaccau

SEQ ID NO: 3350058 - RNA, 12 nt, Human
uauauucaacca

SEQ ID NO: 3350059 - RNA, 18 nt, Human
acagaaaauucuucucca

SEQ ID NO: 3350060 - RNA, 23 nt, Human
acacuguuucaaacuuuacuaug

SEQ ID NO: 3350061 - RNA, 15 nt, Human
acacuguuucaaacu

SEQ ID NO: 3350062 - RNA, 22 nt, Human
acacuguucucugcccuccaag

SEQ ID NO: 3350063 - RNA, 23 nt, Human
acacuguucucugcccuccaaga

SEQ ID NO: 3350064 - RNA, 16 nt, Human
acacuguucucugccc

SEQ ID NO: 3350065 - RNA, 17 nt, Human
acacuguucucugcccu

SEQ ID NO: 3350066 - RNA, 18 nt, Human
acacuguucucugcccuc

SEQ ID NO: 3350067 - RNA, 20 nt, Human
acacuguucucugcccucca

SEQ ID NO: 3350068 - RNA, 14 nt, Human
acacuguucucugc

SEQ ID NO: 3350069 - RNA, 15 nt, Human
acacuguucucugcc

SEQ ID NO: 3350070 - RNA, 22 nt, Human
acacucacauuuauucugcuca

SEQ ID NO: 3350071 - RNA, 11 nt, Human
acacucugaga

SEQ ID NO: 3350072 - RNA, 13 nt, Human
acacucugagacu

SEQ ID NO: 3350073 - RNA, 13 nt, Human
acacuccuucaca

SEQ ID NO: 3350074 - RNA, 18 nt, Human
uacuucuccacccugcuc

SEQ ID NO: 3350075 - RNA, 13 nt, Human
uacuucuccaccc

SEQ ID NO: 3350076 - RNA, 16 nt, Human
uacuucuuauacauuu

SEQ ID NO: 3350077 - RNA, 15 nt, Human
uacuucuuauacauu

SEQ ID NO: 3350078 - RNA, 14 nt, Human
uacuucuuauacau

SEQ ID NO: 3350079 - RNA, 20 nt, Human
uacuucuccacccugcucuc

SEQ ID NO: 3350080 - RNA, 15 nt, Human
uacuucugcuacaua

SEQ ID NO: 3350081 - RNA, 13 nt, Human
aauuuauuauggc

SEQ ID NO: 3350082 - RNA, 14 nt, Human
aauuuauuauggca

SEQ ID NO: 3350083 - RNA, 15 nt, Human
aauuuaccugaaguc

SEQ ID NO: 3350084 - RNA, 17 nt, Human
aauuuaccugaagucuu

SEQ ID NO: 3350085 - RNA, 23 nt, Human
uacuguaauuugugauacaaugc

SEQ ID NO: 3350086 - RNA, 15 nt, Human
uacuguaauuuguga

SEQ ID NO: 3350087 - RNA, 16 nt, Human
uacuguaauuugugau

SEQ ID NO: 3350088 - RNA, 15 nt, Human
uacgucugacaggca

SEQ ID NO: 3350089 - RNA, 16 nt, Human
uacucuacccucuuag

SEQ ID NO: 3350090 - RNA, 22 nt, Human
uacucuacccucuuagaaaaac

SEQ ID NO: 3350091 - RNA, 16 nt, Human
uacgucugacaggcaa

SEQ ID NO: 3350092 - RNA, 14 nt, Human
uacgucugacaggc

SEQ ID NO: 3350093 - RNA, 13 nt, Human
uacuaaaauauau

SEQ ID NO: 3350094 - RNA, 12 nt, Human
uacuaaaauaua

SEQ ID NO: 3350095 - RNA, 20 nt, Human
aauuugugauacaaugcugu

SEQ ID NO: 3350096 - RNA, 16 nt, Human
aauuuguuauaaugaa

SEQ ID NO: 3350097 - RNA, 18 nt, Human
aauuugggggaaaauuua

SEQ ID NO: 3350098 - RNA, 14 nt, Human
acaaaacuuuucua

SEQ ID NO: 3350099 - RNA, 21 nt, Human
acaaagcgugguggacaugca

SEQ ID NO: 3350100 - RNA, 15 nt, Human
acaagcuccaagcuc

SEQ ID NO: 3350101 - RNA, 16 nt, Human
acaagcuccaagcucc

SEQ ID NO: 3350102 - RNA, 17 nt, Human
acaagcuccaagcuccc

SEQ ID NO: 3350103 - RNA, 19 nt, Human
acaagcuccaagcucccag

SEQ ID NO: 3350104 - RNA, 22 nt, Human
acaagcuccaagcucccaggca

SEQ ID NO: 3350105 - RNA, 17 nt, Human
acaagcgugagccacug

SEQ ID NO: 3350106 - RNA, 13 nt, Human
acaagcuccaagc

SEQ ID NO: 3350107 - RNA, 17 nt, Human
acaagaccacguuucua

SEQ ID NO: 3350108 - RNA, 18 nt, Human
acaagagcccaggccucc

SEQ ID NO: 3350109 - RNA, 16 nt, Human
acaagaccacguuucu

SEQ ID NO: 3350110 - RNA, 22 nt, Human
acaagagcccaggccuccuaca

SEQ ID NO: 3350111 - RNA, 17 nt, Human
acaacaucuuuuucuac

SEQ ID NO: 3350112 - RNA, 19 nt, Human
uaaguacuauguaucaaug

SEQ ID NO: 3350113 - RNA, 20 nt, Human
uaaguuuuuauggcuuuugu

SEQ ID NO: 3350114 - RNA, 16 nt, Human
uaaguauuaaaacauu

SEQ ID NO: 3350115 - RNA, 15 nt, Human
uaaguauuaaaacau

SEQ ID NO: 3350116 - RNA, 14 nt, Human
uaaguauuaaaaca

SEQ ID NO: 3350117 - RNA, 13 nt, Human
aaucuaaauggaa

SEQ ID NO: 3350118 - RNA, 15 nt, Human
aaucuaaauggaacc

SEQ ID NO: 3350119 - RNA, 18 nt, Human
aaucuaaauggaaccacu

SEQ ID NO: 3350120 - RNA, 12 nt, Human
aaucuaaaugga

SEQ ID NO: 3350121 - RNA, 12 nt, Human
aaucucaaauuu

SEQ ID NO: 3350122 - RNA, 15 nt, Human
aaucucaaauaacua

SEQ ID NO: 3350123 - RNA, 14 nt, Human
aaucucaaauuucu

SEQ ID NO: 3350124 - RNA, 13 nt, Human
aaucucaaauaac

SEQ ID NO: 3350125 - RNA, 15 nt, Human
aaugagccuggcaag

SEQ ID NO: 3350126 - RNA, 14 nt, Human
aaugacuuacugua

SEQ ID NO: 3350127 - RNA, 17 nt, Human
aaugacuuacuguacau

SEQ ID NO: 3350128 - RNA, 18 nt, Human
aaugacuuacuguacaug

SEQ ID NO: 3350129 - RNA, 13 nt, Human
uaaugaggaaacu

SEQ ID NO: 3350130 - RNA, 19 nt, Human
uaaugaaagacuguacaaa

SEQ ID NO: 3350131 - RNA, 18 nt, Human
uaaugaaagacuguacaa

SEQ ID NO: 3350132 - RNA, 17 nt, Human
uaaugaaagacuguaca

SEQ ID NO: 3350133 - RNA, 14 nt, Human
uaaugaaagacugu

SEQ ID NO: 3350134 - RNA, 23 nt, Human
uaaugaaagacuguacaaaguag

SEQ ID NO: 3350135 - RNA, 22 nt, Human
uaaugaaagacuguacaaagua

SEQ ID NO: 3350136 - RNA, 15 nt, Human
uaaugacuuaagcac

SEQ ID NO: 3350137 - RNA, 21 nt, Human
uaaugacuuaagcacacuuga

SEQ ID NO: 3350138 - RNA, 13 nt, Human
aaucuucugaacu

SEQ ID NO: 3350139 - RNA, 20 nt, Human
aaucuucugaacuuggcgcu

SEQ ID NO: 3350140 - RNA, 13 nt, Human
aaugcugugcccu

SEQ ID NO: 3350141 - RNA, 20 nt, Human
aaugcugugcccuaaagugu

SEQ ID NO: 3350142 - RNA, 21 nt, Human
aaugcugugcccuaaagugua

SEQ ID NO: 3350143 - RNA, 20 nt, Human
aaugcccagccccuucugac

SEQ ID NO: 3350144 - RNA, 22 nt, Human
aaugcccagccccuucugaccc

SEQ ID NO: 3350145 - RNA, 23 nt, Human
aaugcccagccccuucugaccca

SEQ ID NO: 3350146 - RNA, 24 nt, Human
aaugcccagccccuucugacccau

SEQ ID NO: 3350147 - RNA, 16 nt, Human
aauggacguguuauga

SEQ ID NO: 3350148 - RNA, 18 nt, Human
aauggaagacagcucuua

SEQ ID NO: 3350149 - RNA, 14 nt, Human
aaugcccagccccu

SEQ ID NO: 3350150 - RNA, 15 nt, Human
aaugcccagccccuu

SEQ ID NO: 3350151 - RNA, 13 nt, Human
aaugcccagcccc

SEQ ID NO: 3350152 - RNA, 21 nt, Human
uacaagcgugagccacugcac

SEQ ID NO: 3350153 - RNA, 14 nt, Human
aaugagccuggcaa

SEQ ID NO: 3350154 - RNA, 15 nt, Human
uacaaaagcauguga

SEQ ID NO: 3350155 - RNA, 20 nt, Human
uacaaaaagcauaaaaauua

SEQ ID NO: 3350156 - RNA, 15 nt, Human
uacaaaaagcauaaa

SEQ ID NO: 3350157 - RNA, 19 nt, Human
uacaccacuacauucuguu

SEQ ID NO: 3350158 - RNA, 20 nt, Human
uacaccacuacauucuguua

SEQ ID NO: 3350159 - RNA, 15 nt, Human
uacaccacuacauuc

SEQ ID NO: 3350160 - RNA, 16 nt, Human
uacaccacuacauucu

SEQ ID NO: 3350161 - RNA, 17 nt, Human
uacaccacuacauucug

SEQ ID NO: 3350162 - RNA, 18 nt, Human
uacaccacuacauucugu

SEQ ID NO: 3350163 - RNA, 23 nt, Human
uacacauuuuauuuuauuaugca

SEQ ID NO: 3350164 - RNA, 23 nt, Human
uacagagcccacgcccccacugg

SEQ ID NO: 3350165 - RNA, 17 nt, Human
uacauaaugcgugcaua

SEQ ID NO: 3350166 - RNA, 19 nt, Human
uacauaaugcgugcauacc

SEQ ID NO: 3350167 - RNA, 20 nt, Human
uacauaaugcgugcauacca

SEQ ID NO: 3350168 - RNA, 15 nt, Human
uacauaaugcgugca

SEQ ID NO: 3350169 - RNA, 12 nt, Human
aauguacugcau

SEQ ID NO: 3350170 - RNA, 14 nt, Human
aauguacugcauau

SEQ ID NO: 3350171 - RNA, 14 nt, Human
aauguauguguaag

SEQ ID NO: 3350172 - RNA, 12 nt, Human
aauguaugugua

SEQ ID NO: 3350173 - RNA, 20 nt, Human
aaguuuuuauggcuuuugug

SEQ ID NO: 3350174 - RNA, 16 nt, Human
aauaaaucauaaaacu

SEQ ID NO: 3350175 - RNA, 12 nt, Human
aauaaaacuuuu

SEQ ID NO: 3350176 - RNA, 14 nt, Human
aauaaaacuuuuua

SEQ ID NO: 3350177 - RNA, 15 nt, Human
aauaaaacuuuuuaa

SEQ ID NO: 3350178 - RNA, 18 nt, Human
aauaaaacuuuuuaaaau

SEQ ID NO: 3350179 - RNA, 22 nt, Human
aauaacauguaauuaaguacua

SEQ ID NO: 3350180 - RNA, 19 nt, Human
uaaauaaugugaaacugga

SEQ ID NO: 3350181 - RNA, 14 nt, Human
uaaaucuccaaaau

SEQ ID NO: 3350182 - RNA, 15 nt, Human
uaaaucuccaaaaua

SEQ ID NO: 3350183 - RNA, 22 nt, Human
uaaaucuccaaaauaaaacuuu

SEQ ID NO: 3350184 - RNA, 20 nt, Human
uaaauguugaaagaucaaaa

SEQ ID NO: 3350185 - RNA, 15 nt, Human
uaaauguugaaagau

SEQ ID NO: 3350186 - RNA, 23 nt, Human
uaaaugcaccuggaauauauaac

SEQ ID NO: 3350187 - RNA, 12 nt, Human
uaaauuaacuuu

SEQ ID NO: 3350188 - RNA, 14 nt, Human
uaaauuaacuuuua

SEQ ID NO: 3350189 - RNA, 15 nt, Human
uaaauuaacuuuuau

SEQ ID NO: 3350190 - RNA, 16 nt, Human
uaaauuaacuuuuaua

SEQ ID NO: 3350191 - RNA, 17 nt, Human
uaaauuaacuuuuauaa

SEQ ID NO: 3350192 - RNA, 15 nt, Human
aauaggaaaaacuga

SEQ ID NO: 3350193 - RNA, 16 nt, Human
aauaggaaaaacugau

SEQ ID NO: 3350194 - RNA, 17 nt, Human
aauaggaaaaacugauu

SEQ ID NO: 3350195 - RNA, 18 nt, Human
aauaggaaaaacugauuu

SEQ ID NO: 3350196 - RNA, 19 nt, Human
aauaggaaaaacugauuuu

SEQ ID NO: 3350197 - RNA, 14 nt, Human
aauagcugggacua

SEQ ID NO: 3350198 - RNA, 13 nt, Human
aauagcugggacu

SEQ ID NO: 3350199 - RNA, 23 nt, Human
aauagacaauuuauuauggcaca

SEQ ID NO: 3350200 - RNA, 18 nt, Human
aauagacaauuuauuaug

SEQ ID NO: 3350201 - RNA, 14 nt, Human
uaacauggaaguac

SEQ ID NO: 3350202 - RNA, 15 nt, Human
uaacuaaaagguaug

SEQ ID NO: 3350203 - RNA, 14 nt, Human
uaacuaaaagguau

SEQ ID NO: 3350204 - RNA, 15 nt, Human
uaacauggaaguacu

SEQ ID NO: 3350205 - RNA, 11 nt, Human
aauauugcuga

SEQ ID NO: 3350206 - RNA, 12 nt, Human
aauauugcugau

SEQ ID NO: 3350207 - RNA, 13 nt, Human
aauauugcugaug

SEQ ID NO: 3350208 - RNA, 15 nt, Human
aauauugcugauggu

SEQ ID NO: 3350209 - RNA, 18 nt, Human
aauauugcugauggugca

SEQ ID NO: 3350210 - RNA, 21 nt, Human
aauauugcugauggugcaaug

SEQ ID NO: 3350211 - RNA, 22 nt, Human
aauauugcugauggugcaauga

SEQ ID NO: 3350212 - RNA, 18 nt, Human
aauauugauaugcuuaua

SEQ ID NO: 3350213 - RNA, 17 nt, Human
aauauugauaugcuuau

SEQ ID NO: 3350214 - RNA, 15 nt, Human
uaacuuuuauaaacu

SEQ ID NO: 3350215 - RNA, 17 nt, Human
uaacuuuuauaaacuuu

SEQ ID NO: 3350216 - RNA, 18 nt, Human
uaacuuuuauaaacuuua

SEQ ID NO: 3350217 - RNA, 19 nt, Human
aauaucugaaaauguaugu

SEQ ID NO: 3350218 - RNA, 18 nt, Human
aauaucugaaaauguaug

SEQ ID NO: 3350219 - RNA, 17 nt, Human
aauaucugaaaauguau

SEQ ID NO: 3350220 - RNA, 16 nt, Human
aauaucugaaaaugua

SEQ ID NO: 3350221 - RNA, 20 nt, Human
aauaucugaaaauguaugug

SEQ ID NO: 3350222 - RNA, 17 nt, Human
aaaacacauuuuucuua

SEQ ID NO: 3350223 - RNA, 15 nt, Human
aaaacacauuuuucu

SEQ ID NO: 3350224 - RNA, 19 nt, Human
aaaacacuguucucugccc

SEQ ID NO: 3350225 - RNA, 11 nt, Human
aaaagaaaaag

SEQ ID NO: 3350226 - RNA, 14 nt, Human
aaaauaaaacuuuu

SEQ ID NO: 3350227 - RNA, 13 nt, Human
aaaaucagccugc

SEQ ID NO: 3350228 - RNA, 17 nt, Human
aaaaucagccugcucca

SEQ ID NO: 3350229 - RNA, 21 nt, Human
aaaaucagccugcuccagcug

SEQ ID NO: 3350230 - RNA, 18 nt, Human
aaaaucucaaauuucuaa

SEQ ID NO: 3350231 - RNA, 15 nt, Human
aaaaucucaaauuuc

SEQ ID NO: 3350232 - RNA, 16 nt, Human
aaaaucucaaauuucu

SEQ ID NO: 3350233 - RNA, 15 nt, Human
aaaccgccaaggcug

SEQ ID NO: 3350234 - RNA, 16 nt, Human
aaaccgccaaggcugg

SEQ ID NO: 3350235 - RNA, 12 nt, Human
aaacccagcucu

SEQ ID NO: 3350236 - RNA, 16 nt, Human
aaacccagcucugguc

SEQ ID NO: 3350237 - RNA, 12 nt, Human
aaacucuuaaaa

SEQ ID NO: 3350238 - RNA, 23 nt, Human
aaacucuuaaaacccaagugccu

SEQ ID NO: 3350239 - RNA, 22 nt, Human
aaacugauuuuuuuuuccuuca

SEQ ID NO: 3350240 - RNA, 23 nt, Human
aaacugauuuuuuuuuccuucag

SEQ ID NO: 3350241 - RNA, 20 nt, Human
aaagauauuuugcuuuguga

SEQ ID NO: 3350242 - RNA, 16 nt, Human
aaagccuccuccagcc

SEQ ID NO: 3350243 - RNA, 16 nt, Human
aaccuuuugagugccu

SEQ ID NO: 3350244 - RNA, 23 nt, Human
aaccuuuugagugccuuacacaa

SEQ ID NO: 3350245 - RNA, 23 nt, Human
aacauggccuuugcuugaaagaa

SEQ ID NO: 3350246 - RNA, 15 nt, Human
aaauucuugcaaagu

SEQ ID NO: 3350247 - RNA, 23 nt, Human
aaauucuucuccacuuucuagcc

SEQ ID NO: 3350248 - RNA, 11 nt, Human
aacaggcagau

SEQ ID NO: 3350249 - RNA, 22 nt, Human
aacauggccuuugcuugaaaga

SEQ ID NO: 3350250 - RNA, 14 nt, Human
aaaggaugcacaga

SEQ ID NO: 3350251 - RNA, 20 nt, Human
aaaggaugcccaaagaugca

SEQ ID NO: 3350252 - RNA, 19 nt, Human
aaaugcuguaacuuucuga

SEQ ID NO: 3350253 - RNA, 13 nt, Human
aaaucuuuuugcu

SEQ ID NO: 3350254 - RNA, 14 nt, Human
aaaucuuuuugcuu

SEQ ID NO: 3350255 - RNA, 19 nt, Human
aaaucucaaauuucuaaau

SEQ ID NO: 3350256 - RNA, 13 nt, Human
aaggcaaggcugu

SEQ ID NO: 3350257 - RNA, 15 nt, Human
aaggcaaggcuguca

SEQ ID NO: 3350258 - RNA, 13 nt, Human
aagcugcacccuc

SEQ ID NO: 3350259 - RNA, 19 nt, Human
aagcugcacccucaggcag

SEQ ID NO: 3350260 - RNA, 17 nt, Human
aagauacaguuacucag

SEQ ID NO: 3350261 - RNA, 19 nt, Human
aagauaauauuaaggaaga

SEQ ID NO: 3350262 - RNA, 21 nt, Human
aagauaauauuaaggaagaca

SEQ ID NO: 3350263 - RNA, 14 nt, Human
aagauaaaugugcu

SEQ ID NO: 3350264 - RNA, 23 nt, Human
aagccaguguugccuaaguauua

SEQ ID NO: 3350265 - RNA, 18 nt, Human
aagccaguguugccuaag

SEQ ID NO: 3350266 - RNA, 15 nt, Human
aagcgugagccacug

SEQ ID NO: 3350267 - RNA, 14 nt, Human
aagcggcuggcagc

SEQ ID NO: 3350268 - RNA, 20 nt, Human
aagacaaugugaaaagaaaa

SEQ ID NO: 3350269 - RNA, 22 nt, Human
aagacaaugacuuacuguacau

SEQ ID NO: 3350270 - RNA, 19 nt, Human
aagacaaugugaaaagaaa

SEQ ID NO: 3350271 - RNA, 23 nt, Human
aagacagauacuccuccaagguu

SEQ ID NO: 3350272 - RNA, 15 nt, Human
aagaccacguuucua

SEQ ID NO: 3350273 - RNA, 17 nt, Human
aagaccacguuucuaaa

SEQ ID NO: 3350274 - RNA, 13 nt, Human
aagagaaaaaaua

SEQ ID NO: 3350275 - RNA, 19 nt, Human
aagacuuuucuuucagcca

SEQ ID NO: 3350276 - RNA, 21 nt, Human
aagacuuuuccaacccucauc

SEQ ID NO: 3350277 - RNA, 12 nt, Human
aagacuuuucuu

SEQ ID NO: 3350278 - RNA, 17 nt, Human
aagacuuuuccaacccu

SEQ ID NO: 3350279 - RNA, 20 nt, Human
aagaguaggaagacuuugga

SEQ ID NO: 3350280 - RNA, 14 nt, Human
aagugcugcauuua

SEQ ID NO: 3350281 - RNA, 22 nt, Human
aagugcugcauuuaaaagauac

SEQ ID NO: 3350282 - RNA, 12 nt, Human
aagugcugggau

SEQ ID NO: 3350283 - RNA, 16 nt, Human
aauaaugugaaacugg

SEQ ID NO: 3350284 - RNA, 17 nt, Human
aauaaugugaaacugga

SEQ ID NO: 3350285 - RNA, 22 nt, Human
aauaaugugaaacuggauuaaa

SEQ ID NO: 3350286 - RNA, 14 nt, Human
aauaaagcagcguu

SEQ ID NO: 3350287 - RNA, 13 nt, Human
aauauuaagaaag

SEQ ID NO: 3350288 - RNA, 23 nt, Human
aauauguggaguucaucuugaau

SEQ ID NO: 3350289 - RNA, 19 nt, Human
aauauauacgaacaaaaca

SEQ ID NO: 3350290 - RNA, 18 nt, Human
aauauauacgaacaaaac

SEQ ID NO: 3350291 - RNA, 15 nt, Human
aaucaccgaaaacgu

SEQ ID NO: 3350292 - RNA, 23 nt, Human
aaucaccgaaaacguggcugcuu

SEQ ID NO: 3350293 - RNA, 21 nt, Human
aaucaccgaaaacguggcugc

SEQ ID NO: 3350294 - RNA, 20 nt, Human
aaugaaagacuguacaaagu

SEQ ID NO: 3350295 - RNA, 18 nt, Human
aaugaaagacuguacaaa

SEQ ID NO: 3350296 - RNA, 21 nt, Human
aaugaaagacuguacaaagua

SEQ ID NO: 3350297 - RNA, 20 nt, Human
aaugaugccaugaggaacaa

SEQ ID NO: 3350298 - RNA, 19 nt, Human
aaugaugccaugaggaaca

SEQ ID NO: 3350299 - RNA, 20 nt, Human
acgauuucuguuuagauaau

SEQ ID NO: 3350300 - RNA, 23 nt, Human
acgauuucuguuuagauaauaca

SEQ ID NO: 3350301 - RNA, 19 nt, Human
acgauuucuguuuagauaa

SEQ ID NO: 3350302 - RNA, 22 nt, Human
acgcugugcugcccugcccacc

SEQ ID NO: 3350303 - RNA, 19 nt, Human
acgcugugcugcccugccc

SEQ ID NO: 3350304 - RNA, 12 nt, Human
acgucugugcca

SEQ ID NO: 3350305 - RNA, 13 nt, Human
acgucugugccau

SEQ ID NO: 3350306 - RNA, 15 nt, Human
acggaauaguuggcu

SEQ ID NO: 3350307 - RNA, 19 nt, Human
acggaauaguuggcuagga

SEQ ID NO: 3350308 - RNA, 17 nt, Human
acggacacucaaaagcu

SEQ ID NO: 3350309 - RNA, 18 nt, Human
acuaauggggcggugaga

SEQ ID NO: 3350310 - RNA, 23 nt, Human
accugccaggaagccagcaggcu

SEQ ID NO: 3350311 - RNA, 21 nt, Human
accugccaggaagccagcagg

SEQ ID NO: 3350312 - RNA, 22 nt, Human
accugccaggaagccagcaggc

SEQ ID NO: 3350313 - RNA, 12 nt, Human
accugccccuca

SEQ ID NO: 3350314 - RNA, 15 nt, Human
accugccccucaacu

SEQ ID NO: 3350315 - RNA, 19 nt, Human
accugccaggaagccagca

SEQ ID NO: 3350316 - RNA, 20 nt, Human
accucugccugaagucacac

SEQ ID NO: 3350317 - RNA, 12 nt, Human
accucugccuga

SEQ ID NO: 3350318 - RNA, 21 nt, Human
accucaggugauccacccacc

SEQ ID NO: 3350319 - RNA, 20 nt, Human
accucaggugauccacccac

SEQ ID NO: 3350320 - RNA, 17 nt, Human
acccugugauggggccc

SEQ ID NO: 3350321 - RNA, 19 nt, Human
acccugugauggggcccug

SEQ ID NO: 3350322 - RNA, 20 nt, Human
acccugugauggggcccugc

SEQ ID NO: 3350323 - RNA, 16 nt, Human
accgggcacucagaag

SEQ ID NO: 3350324 - RNA, 20 nt, Human
accgggccacagagaaagua

SEQ ID NO: 3350325 - RNA, 14 nt, Human
accgggcacucaga

SEQ ID NO: 3350326 - RNA, 12 nt, Human
accgggcacuca

SEQ ID NO: 3350327 - RNA, 11 nt, Human
accucagccuc

SEQ ID NO: 3350328 - RNA, 12 nt, Human
accucagccucc

SEQ ID NO: 3350329 - RNA, 23 nt, Human
accgugaggccagagacacaagc

SEQ ID NO: 3350330 - RNA, 17 nt, Human
accgugaggccagagac

SEQ ID NO: 3350331 - RNA, 19 nt, Human
accggcuggccuggccccu

SEQ ID NO: 3350332 - RNA, 18 nt, Human
accgugaggccagagaca

SEQ ID NO: 3350333 - RNA, 14 nt, Human
acccuauugcugcu

SEQ ID NO: 3350334 - RNA, 19 nt, Human
acccuauugcugcuugagg

SEQ ID NO: 3350335 - RNA, 13 nt, Human
acccuauugcugc

SEQ ID NO: 3350336 - RNA, 13 nt, Human
acccucaggcagg

SEQ ID NO: 3350337 - RNA, 14 nt, Human
acccucaggcaggu

SEQ ID NO: 3350338 - RNA, 15 nt, Human
acccucaggcaggug

SEQ ID NO: 3350339 - RNA, 16 nt, Human
acccucaggcaggugg

SEQ ID NO: 3350340 - RNA, 13 nt, Human
acccucaucacca

SEQ ID NO: 3350341 - RNA, 23 nt, Human
acccuggcacuauaauguaagcu

SEQ ID NO: 3350342 - RNA, 23 nt, Human
acccucaucaccaacgucugugc

SEQ ID NO: 3350343 - RNA, 16 nt, Human
acccuggggagaaagu

SEQ ID NO: 3350344 - RNA, 16 nt, Human
acccugugauggggcc

SEQ ID NO: 3350345 - RNA, 16 nt, Human
acugugccaugugcca

SEQ ID NO: 3350346 - RNA, 18 nt, Human
acugugccaugugccagg

SEQ ID NO: 3350347 - RNA, 17 nt, Human
acugugccaugugccag

SEQ ID NO: 3350348 - RNA, 14 nt, Human
acugccaugccagc

SEQ ID NO: 3350349 - RNA, 20 nt, Human
acugcuuuuggucuguguga

SEQ ID NO: 3350350 - RNA, 23 nt, Human
acuuggggggcugaggugggagg

SEQ ID NO: 3350351 - RNA, 13 nt, Human
acuguuucaaacu

SEQ ID NO: 3350352 - RNA, 15 nt, Human
acuguuucaaacuuu

SEQ ID NO: 3350353 - RNA, 18 nt, Human
acuguuucaaacuuuacu

SEQ ID NO: 3350354 - RNA, 19 nt, Human
acuguuucaaacuuuacua

SEQ ID NO: 3350355 - RNA, 12 nt, Human
acugaauuucuu

SEQ ID NO: 3350356 - RNA, 23 nt, Human
acugaauuucuuuugccguuauu

SEQ ID NO: 3350357 - RNA, 18 nt, Human
acugacauuguuggccaa

SEQ ID NO: 3350358 - RNA, 17 nt, Human
acugacauuguuggcca

SEQ ID NO: 3350359 - RNA, 16 nt, Human
acugauuuuuuuuucc

SEQ ID NO: 3350360 - RNA, 17 nt, Human
acugauuuuuuuuuccu

SEQ ID NO: 3350361 - RNA, 18 nt, Human
acugauuuuuuuuuccuu

SEQ ID NO: 3350362 - RNA, 19 nt, Human
acugauuuuuuuuuccuuc

SEQ ID NO: 3350363 - RNA, 23 nt, Human
acugaugggcaacccccagccug

SEQ ID NO: 3350364 - RNA, 15 nt, Human
acucuacagaggcca

SEQ ID NO: 3350365 - RNA, 22 nt, Human
acucccaucugugaaaggaaag

SEQ ID NO: 3350366 - RNA, 15 nt, Human
aauuucccaaagcag

SEQ ID NO: 3350367 - RNA, 17 nt, Human
aauuucccaaagcagug

SEQ ID NO: 3350368 - RNA, 19 nt, Human
aauucucagaaucucaaau

SEQ ID NO: 3350369 - RNA, 14 nt, Human
aauucuacuuugag

SEQ ID NO: 3350370 - RNA, 15 nt, Human
aauucucuaguuuga

SEQ ID NO: 3350371 - RNA, 17 nt, Human
aauucucuaguuugauu

SEQ ID NO: 3350372 - RNA, 15 nt, Human
aauucucuuauccaa

SEQ ID NO: 3350373 - RNA, 21 nt, Human
aauucucauuugucacacacu

SEQ ID NO: 3350374 - RNA, 16 nt, Human
aauuguaaggaaugau

SEQ ID NO: 3350375 - RNA, 22 nt, Human
aauuguaaggaaugauuaauua

SEQ ID NO: 3350376 - RNA, 14 nt, Human
aauucuguuuuucu

SEQ ID NO: 3350377 - RNA, 18 nt, Human
aauucuguuuuucuaggc

SEQ ID NO: 3350378 - RNA, 19 nt, Human
aauuaugaguuauuuuuau

SEQ ID NO: 3350379 - RNA, 15 nt, Human
acaaguuaaauaaau

SEQ ID NO: 3350380 - RNA, 16 nt, Human
acaaggcaaggcuguc

SEQ ID NO: 3350381 - RNA, 17 nt, Human
acaaggcaaggcuguca

SEQ ID NO: 3350382 - RNA, 19 nt, Human
acaaggcaaggcugucaau

SEQ ID NO: 3350383 - RNA, 15 nt, Human
acaaggcaaggcugu

SEQ ID NO: 3350384 - RNA, 16 nt, Human
acacagcucuucucca

SEQ ID NO: 3350385 - RNA, 14 nt, Human
acacagcucuucuc

SEQ ID NO: 3350386 - RNA, 18 nt, Human
acacagcucuucuccagg

SEQ ID NO: 3350387 - RNA, 13 nt, Human
acacagcucuucu

SEQ ID NO: 3350388 - RNA, 23 nt, Human
acaccagagcccaccuuggcuca

SEQ ID NO: 3350389 - RNA, 18 nt, Human
acaccagagcccaccuug

SEQ ID NO: 3350390 - RNA, 13 nt, Human
acaccagagccca

SEQ ID NO: 3350391 - RNA, 13 nt, Human
acacgcgcgcaca

SEQ ID NO: 3350392 - RNA, 14 nt, Human
accagagcugccac

SEQ ID NO: 3350393 - RNA, 16 nt, Human
accagagcugccaccu

SEQ ID NO: 3350394 - RNA, 13 nt, Human
accagagcugcca

SEQ ID NO: 3350395 - RNA, 12 nt, Human
accagagcugcc

SEQ ID NO: 3350396 - RNA, 12 nt, Human
accaagcccagu

SEQ ID NO: 3350397 - RNA, 13 nt, Human
accacguuucuaa

SEQ ID NO: 3350398 - RNA, 14 nt, Human
accacguuucuaaa

SEQ ID NO: 3350399 - RNA, 16 nt, Human
accacgcuggaccuug

SEQ ID NO: 3350400 - RNA, 14 nt, Human
accacgcuggaccu

SEQ ID NO: 3350401 - RNA, 18 nt, Human
accacgcuggaccuugaa

SEQ ID NO: 3350402 - RNA, 14 nt, Human
accaacgucugugc

SEQ ID NO: 3350403 - RNA, 17 nt, Human
accaacgucugugccau

SEQ ID NO: 3350404 - RNA, 20 nt, Human
acaugccucucucaggccaa

SEQ ID NO: 3350405 - RNA, 18 nt, Human
acaugugcacaugcacgu

SEQ ID NO: 3350406 - RNA, 13 nt, Human
acaugcacgugug

SEQ ID NO: 3350407 - RNA, 23 nt, Human
acaugcacagcuaacauggaagu

SEQ ID NO: 3350408 - RNA, 16 nt, Human
acauacaauuccaaac

SEQ ID NO: 3350409 - RNA, 20 nt, Human
acauacaggaagguagaaau

SEQ ID NO: 3350410 - RNA, 18 nt, Human
acauacacgaaagagaga

SEQ ID NO: 3350411 - RNA, 18 nt, Human
acagcucuucuccaggcu

SEQ ID NO: 3350412 - RNA, 20 nt, Human
acagcucuucuccaggcugu

SEQ ID NO: 3350413 - RNA, 19 nt, Human
acagcucuucuccaggcug

SEQ ID NO: 3350414 - RNA, 17 nt, Human
acaggcaaugcuggcug

SEQ ID NO: 3350415 - RNA, 14 nt, Human
acaggcacccacca

SEQ ID NO: 3350416 - RNA, 16 nt, Human
acaggcaaugcuggcu

SEQ ID NO: 3350417 - RNA, 15 nt, Human
acaggcaaugcuggc

SEQ ID NO: 3350418 - RNA, 14 nt, Human
acaggcaaugcugg

SEQ ID NO: 3350419 - RNA, 23 nt, Human
acagugagucgaggacagggagg

SEQ ID NO: 3350420 - RNA, 23 nt, Human
acaggcacccaccaucaugucug

SEQ ID NO: 3350421 - RNA, 14 nt, Human
agaccacguuucua

SEQ ID NO: 3350422 - RNA, 23 nt, Human
agaccaucccugaaggccccgcc

SEQ ID NO: 3350423 - RNA, 21 nt, Human
agaccaucccugaaggccccg

SEQ ID NO: 3350424 - RNA, 21 nt, Human
agacagcccgggcucugccuc

SEQ ID NO: 3350425 - RNA, 22 nt, Human
agacagcccgggcucugccucc

SEQ ID NO: 3350426 - RNA, 23 nt, Human
agacagcccgggcucugccuccc

SEQ ID NO: 3350427 - RNA, 18 nt, Human
agacgcugugcugcccug

SEQ ID NO: 3350428 - RNA, 19 nt, Human
agacgcugugcugcccugc

SEQ ID NO: 3350429 - RNA, 17 nt, Human
agacgcugugcugcccu

SEQ ID NO: 3350430 - RNA, 16 nt, Human
agacgcugugcugccc

SEQ ID NO: 3350431 - RNA, 23 nt, Human
agacaaugacuuacuguacauga

SEQ ID NO: 3350432 - RNA, 20 nt, Human
agacaaugugaaaagaaaaa

SEQ ID NO: 3350433 - RNA, 16 nt, Human
agacucuuuggacacu

SEQ ID NO: 3350434 - RNA, 18 nt, Human
agagaaaguacuucucca

SEQ ID NO: 3350435 - RNA, 15 nt, Human
agagaaacaaacuuu

SEQ ID NO: 3350436 - RNA, 14 nt, Human
agagaaacaaacuu

SEQ ID NO: 3350437 - RNA, 13 nt, Human
agagaaacaaacu

SEQ ID NO: 3350438 - RNA, 17 nt, Human
agagcccacgcccccac

SEQ ID NO: 3350439 - RNA, 11 nt, Human
agagagcaaga

SEQ ID NO: 3350440 - RNA, 19 nt, Human
agagagcaagacgcugugc

SEQ ID NO: 3350441 - RNA, 18 nt, Human
agagcccacgcccccacu

SEQ ID NO: 3350442 - RNA, 23 nt, Human
agaaugcacaaacagaggccgcc

SEQ ID NO: 3350443 - RNA, 22 nt, Human
agaaugcacaaacagaggccgc

SEQ ID NO: 3350444 - RNA, 18 nt, Human
agaaugcucuuuacuuca

SEQ ID NO: 3350445 - RNA, 17 nt, Human
agaaucucaaauaacua

SEQ ID NO: 3350446 - RNA, 14 nt, Human
agaagucacacagu

SEQ ID NO: 3350447 - RNA, 19 nt, Human
agaagucuuagauguauau

SEQ ID NO: 3350448 - RNA, 17 nt, Human
agaagucuuagauguau

SEQ ID NO: 3350449 - RNA, 21 nt, Human
agaaccaaaaagaggcuaugu

SEQ ID NO: 3350450 - RNA, 15 nt, Human
agaagagaaugcaca

SEQ ID NO: 3350451 - RNA, 21 nt, Human
agaagagauugugguuucauu

SEQ ID NO: 3350452 - RNA, 17 nt, Human
agaaccaaaaagaggcu

SEQ ID NO: 3350453 - RNA, 18 nt, Human
agaaccaaaaagaggcua

SEQ ID NO: 3350454 - RNA, 20 nt, Human
agcacuaaggugugcucuga

SEQ ID NO: 3350455 - RNA, 21 nt, Human
agcacagacccugcccugugg

SEQ ID NO: 3350456 - RNA, 20 nt, Human
agcacagacccugcccugug

SEQ ID NO: 3350457 - RNA, 17 nt, Human
agcagugcaugcugucc

SEQ ID NO: 3350458 - RNA, 13 nt, Human
agcagugcaugcu

SEQ ID NO: 3350459 - RNA, 16 nt, Human
agcagugcaugcuguc

SEQ ID NO: 3350460 - RNA, 18 nt, Human
agcagcguuucuaugaca

SEQ ID NO: 3350461 - RNA, 19 nt, Human
agcagcguuucuaugacac

SEQ ID NO: 3350462 - RNA, 20 nt, Human
agcagccuggacccugugga

SEQ ID NO: 3350463 - RNA, 16 nt, Human
agcagccuggacccug

SEQ ID NO: 3350464 - RNA, 16 nt, Human
agcaucuaugugagac

SEQ ID NO: 3350465 - RNA, 23 nt, Human
agccagcaggcucucaggccagc

SEQ ID NO: 3350466 - RNA, 22 nt, Human
agccagcaggcucucaggccag

SEQ ID NO: 3350467 - RNA, 21 nt, Human
agccagcaggcucucaggcca

SEQ ID NO: 3350468 - RNA, 17 nt, Human
agcccacgcccccacug

SEQ ID NO: 3350469 - RNA, 18 nt, Human
agcccacgcccccacugg

SEQ ID NO: 3350470 - RNA, 15 nt, Human
agcccacgcccccac

SEQ ID NO: 3350471 - RNA, 19 nt, Human
agcccacgcccccacuggu

SEQ ID NO: 3350472 - RNA, 23 nt, Human
agcccaccccucaacaccucugc

SEQ ID NO: 3350473 - RNA, 15 nt, Human
agcccaccccucaac

SEQ ID NO: 3350474 - RNA, 13 nt, Human
agcccaccuuggc

SEQ ID NO: 3350475 - RNA, 14 nt, Human
agccagauuucacu

SEQ ID NO: 3350476 - RNA, 17 nt, Human
agccagauuucacucuc

SEQ ID NO: 3350477 - RNA, 20 nt, Human
agccagauuucacucuccuu

SEQ ID NO: 3350478 - RNA, 14 nt, Human
agauucuuuccuga

SEQ ID NO: 3350479 - RNA, 20 nt, Human
agaugggugcuuggaggaag

SEQ ID NO: 3350480 - RNA, 22 nt, Human
agaugggugcuuggaggaagga

SEQ ID NO: 3350481 - RNA, 18 nt, Human
agaugacaucugucuagg

SEQ ID NO: 3350482 - RNA, 18 nt, Human
agaucucuaacuucacca

SEQ ID NO: 3350483 - RNA, 16 nt, Human
agauugcaacaggcug

SEQ ID NO: 3350484 - RNA, 15 nt, Human
agauucuuuccugag

SEQ ID NO: 3350485 - RNA, 16 nt, Human
agauucuuuccugagg

SEQ ID NO: 3350486 - RNA, 16 nt, Human
agauugcaccacugca

SEQ ID NO: 3350487 - RNA, 17 nt, Human
agauugcaacaggcugg

SEQ ID NO: 3350488 - RNA, 23 nt, Human
agauugcaacaggcugggcuuca

SEQ ID NO: 3350489 - RNA, 19 nt, Human
agcaaauucuguuuuucua

SEQ ID NO: 3350490 - RNA, 13 nt, Human
agaguugaagaca

SEQ ID NO: 3350491 - RNA, 14 nt, Human
agaguugaagacag

SEQ ID NO: 3350492 - RNA, 15 nt, Human
agaguugaagacaga

SEQ ID NO: 3350493 - RNA, 20 nt, Human
agauagccaaggccaaagga

SEQ ID NO: 3350494 - RNA, 23 nt, Human
agaggggguggccucccaacuca

SEQ ID NO: 3350495 - RNA, 20 nt, Human
agagggucugaggaauccag

SEQ ID NO: 3350496 - RNA, 19 nt, Human
agaguggggauaugauuua

SEQ ID NO: 3350497 - RNA, 19 nt, Human
aggcccucugcccacuccc

SEQ ID NO: 3350498 - RNA, 20 nt, Human
aggcccucugcccacucccu

SEQ ID NO: 3350499 - RNA, 24 nt, Human
aggcuguaucccaugagccucagc

SEQ ID NO: 3350500 - RNA, 12 nt, Human
aggcugucaauu

SEQ ID NO: 3350501 - RNA, 17 nt, Human
aggcugcagugagccga

SEQ ID NO: 3350502 - RNA, 19 nt, Human
aggcugcagugagccgaga

SEQ ID NO: 3350503 - RNA, 23 nt, Human
aggcuguaucccaugagccucag

SEQ ID NO: 3350504 - RNA, 18 nt, Human
agggccuggcucaggugg

SEQ ID NO: 3350505 - RNA, 13 nt, Human
agggccuggcuca

SEQ ID NO: 3350506 - RNA, 14 nt, Human
agggccuggcucag

SEQ ID NO: 3350507 - RNA, 18 nt, Human
agggccuggccugagcug

SEQ ID NO: 3350508 - RNA, 13 nt, Human
aggccagcugcuu

SEQ ID NO: 3350509 - RNA, 14 nt, Human
aggccagcugcuug

SEQ ID NO: 3350510 - RNA, 16 nt, Human
aggccagcugcuuggg

SEQ ID NO: 3350511 - RNA, 16 nt, Human
aggccaggcccucugc

SEQ ID NO: 3350512 - RNA, 17 nt, Human
aggccaggcccucugcc

SEQ ID NO: 3350513 - RNA, 18 nt, Human
aggccaggcccucugccc

SEQ ID NO: 3350514 - RNA, 19 nt, Human
aggccaggcccucugccca

SEQ ID NO: 3350515 - RNA, 23 nt, Human
aggccaggcccucugcccacucc

SEQ ID NO: 3350516 - RNA, 17 nt, Human
aggcccucugcccacuc

SEQ ID NO: 3350517 - RNA, 15 nt, Human
aggcccucugcccac

SEQ ID NO: 3350518 - RNA, 16 nt, Human
aggccaugggccuccu

SEQ ID NO: 3350519 - RNA, 14 nt, Human
aggccaugggccuc

SEQ ID NO: 3350520 - RNA, 22 nt, Human
aggcauguucucugaggacacu

SEQ ID NO: 3350521 - RNA, 20 nt, Human
aggcauguucucugaggaca

SEQ ID NO: 3350522 - RNA, 21 nt, Human
aggcauuccccaggaggccag

SEQ ID NO: 3350523 - RNA, 21 nt, Human
aggcaugugaugagaggaaau

SEQ ID NO: 3350524 - RNA, 22 nt, Human
aggcauuccccaggaggccagc

SEQ ID NO: 3350525 - RNA, 23 nt, Human
aggcauuccccaggaggccagcc

SEQ ID NO: 3350526 - RNA, 12 nt, Human
aggccagcugcu

SEQ ID NO: 3350527 - RNA, 23 nt, Human
aggcaugugaugagaggaaauca

SEQ ID NO: 3350528 - RNA, 24 nt, Human
aggcaugugaugagaggaaaucac

SEQ ID NO: 3350529 - RNA, 15 nt, Human
aggcagccaggccac

SEQ ID NO: 3350530 - RNA, 16 nt, Human
aggcagccaggccaca

SEQ ID NO: 3350531 - RNA, 14 nt, Human
aggcagccaggcca

SEQ ID NO: 3350532 - RNA, 13 nt, Human
aggcagauacagg

SEQ ID NO: 3350533 - RNA, 14 nt, Human
aggagugagcacua

SEQ ID NO: 3350534 - RNA, 12 nt, Human
aggagugagcac

SEQ ID NO: 3350535 - RNA, 15 nt, Human
aggaggucucuaaga

SEQ ID NO: 3350536 - RNA, 19 nt, Human
aggaaguacuggagaaaau

SEQ ID NO: 3350537 - RNA, 14 nt, Human
aggaggucucuaag

SEQ ID NO: 3350538 - RNA, 23 nt, Human
agcucaccagccccagugcccac

SEQ ID NO: 3350539 - RNA, 22 nt, Human
agcucaccagccccagugccca

SEQ ID NO: 3350540 - RNA, 15 nt, Human
agcugacuuuucugu

SEQ ID NO: 3350541 - RNA, 15 nt, Human
agcuggucccacuca

SEQ ID NO: 3350542 - RNA, 22 nt, Human
agcugccuguucagcuccagcu

SEQ ID NO: 3350543 - RNA, 15 nt, Human
aggaacacuccuuca

SEQ ID NO: 3350544 - RNA, 23 nt, Human
aggaacuuaaauaaugugaaacu

SEQ ID NO: 3350545 - RNA, 12 nt, Human
aggaacacuccu

SEQ ID NO: 3350546 - RNA, 23 nt, Human
aggaacaaggcaaggcugucaau

SEQ ID NO: 3350547 - RNA, 14 nt, Human
aggaagguagaaau

SEQ ID NO: 3350548 - RNA, 11 nt, Human
aggaaguacug

SEQ ID NO: 3350549 - RNA, 15 nt, Human
aggaaguacuggaga

SEQ ID NO: 3350550 - RNA, 21 nt, Human
agcuuuguuuguugucagcug

SEQ ID NO: 3350551 - RNA, 14 nt, Human
agccuggacccugu

SEQ ID NO: 3350552 - RNA, 18 nt, Human
agccugggcaaugugaua

SEQ ID NO: 3350553 - RNA, 20 nt, Human
agccugggaggucaaggcug

SEQ ID NO: 3350554 - RNA, 21 nt, Human
agcucaccagccccagugccc

SEQ ID NO: 3350555 - RNA, 20 nt, Human
agcucaccagccccagugcc

SEQ ID NO: 3350556 - RNA, 14 nt, Human
agcucaccagcccc

SEQ ID NO: 3350557 - RNA, 13 nt, Human
agcucaccagccc

SEQ ID NO: 3350558 - RNA, 14 nt, Human
agcuaaugggacac

SEQ ID NO: 3350559 - RNA, 13 nt, Human
agcuaaugggaca

SEQ ID NO: 3350560 - RNA, 19 nt, Human
agcuaacauggaaguacua

SEQ ID NO: 3350561 - RNA, 20 nt, Human
agcuaacauggaaguacuau

SEQ ID NO: 3350562 - RNA, 15 nt, Human
agcgauucuucugcu

SEQ ID NO: 3350563 - RNA, 17 nt, Human
agcgauucuucugcuuc

SEQ ID NO: 3350564 - RNA, 14 nt, Human
aguucauacccugu

SEQ ID NO: 3350565 - RNA, 18 nt, Human
aguuccaccaucaagcca

SEQ ID NO: 3350566 - RNA, 21 nt, Human
aguuccaccaucaagccacca

SEQ ID NO: 3350567 - RNA, 18 nt, Human
aguugaaaaacagcugag

SEQ ID NO: 3350568 - RNA, 16 nt, Human
aguugaagacagagcu

SEQ ID NO: 3350569 - RNA, 17 nt, Human
aguugaagacagagcua

SEQ ID NO: 3350570 - RNA, 17 nt, Human
aguugaaaaacagcuga

SEQ ID NO: 3350571 - RNA, 17 nt, Human
aguuguuagugugucuu

SEQ ID NO: 3350572 - RNA, 22 nt, Human
aguuguuagugugucuuagugu

SEQ ID NO: 3350573 - RNA, 14 nt, Human
aguuugauuaaauu

SEQ ID NO: 3350574 - RNA, 11 nt, Human
aguuugcaguu

SEQ ID NO: 3350575 - RNA, 17 nt, Human
auacaccacuacauucu

SEQ ID NO: 3350576 - RNA, 21 nt, Human
auacaccacuacauucuguua

SEQ ID NO: 3350577 - RNA, 15 nt, Human
auacacgaaagagag

SEQ ID NO: 3350578 - RNA, 21 nt, Human
auaaagaugagugagcaugcc

SEQ ID NO: 3350579 - RNA, 23 nt, Human
auacaaugcugugcccuaaagug

SEQ ID NO: 3350580 - RNA, 17 nt, Human
auacaaugcugugcccu

SEQ ID NO: 3350581 - RNA, 12 nt, Human
auaauguuaaca

SEQ ID NO: 3350582 - RNA, 15 nt, Human
auacaccacuacauu

SEQ ID NO: 3350583 - RNA, 18 nt, Human
agucuggcccuuccuuuu

SEQ ID NO: 3350584 - RNA, 16 nt, Human
agucgaggacagggag

SEQ ID NO: 3350585 - RNA, 18 nt, Human
agucuggaaugcaguggu

SEQ ID NO: 3350586 - RNA, 20 nt, Human
agucugauucccaagcucug

SEQ ID NO: 3350587 - RNA, 22 nt, Human
agucugauucccaagcucugcu

SEQ ID NO: 3350588 - RNA, 21 nt, Human
agucugauucccaagcucugc

SEQ ID NO: 3350589 - RNA, 16 nt, Human
aguccuuaccagcaga

SEQ ID NO: 3350590 - RNA, 18 nt, Human
aguccuuaccagcagagc

SEQ ID NO: 3350591 - RNA, 19 nt, Human
agugacagaggcagcccca

SEQ ID NO: 3350592 - RNA, 16 nt, Human
agugacagaggcagcc

SEQ ID NO: 3350593 - RNA, 14 nt, Human
agugacagaggcag

SEQ ID NO: 3350594 - RNA, 19 nt, Human
agugccuuauggaacacuc

SEQ ID NO: 3350595 - RNA, 20 nt, Human
agugccuuauggaacacucu

SEQ ID NO: 3350596 - RNA, 21 nt, Human
agugccuuauggaacacucug

SEQ ID NO: 3350597 - RNA, 22 nt, Human
agugccuuauggaacacucuga

SEQ ID NO: 3350598 - RNA, 18 nt, Human
agugccuuauggaacacu

SEQ ID NO: 3350599 - RNA, 17 nt, Human
agugauucuccugccuc

SEQ ID NO: 3350600 - RNA, 20 nt, Human
agugauucuccugccucagc

SEQ ID NO: 3350601 - RNA, 18 nt, Human
agugauucuccugccuca

SEQ ID NO: 3350602 - RNA, 19 nt, Human
agugauucuccugccucag

SEQ ID NO: 3350603 - RNA, 22 nt, Human
agugauccucccaccucagccu

SEQ ID NO: 3350604 - RNA, 20 nt, Human
agugauccucccaccucagc

SEQ ID NO: 3350605 - RNA, 19 nt, Human
agugauccucccaccucag

SEQ ID NO: 3350606 - RNA, 18 nt, Human
aguaaaugggggugcauu

SEQ ID NO: 3350607 - RNA, 19 nt, Human
aguaaaugggggugcauuu

SEQ ID NO: 3350608 - RNA, 20 nt, Human
aguaaaugggggugcauuug

SEQ ID NO: 3350609 - RNA, 21 nt, Human
aguaaaugggggugcauuuga

SEQ ID NO: 3350610 - RNA, 17 nt, Human
aguaacuuacuuaggug

SEQ ID NO: 3350611 - RNA, 21 nt, Human
aguacuucuccacccugcucu

SEQ ID NO: 3350612 - RNA, 19 nt, Human
aguacuucuccacccugcu

SEQ ID NO: 3350613 - RNA, 20 nt, Human
aguacuucuccacccugcuc

SEQ ID NO: 3350614 - RNA, 15 nt, Human
aguacuggagaaaau

SEQ ID NO: 3350615 - RNA, 22 nt, Human
augaggcauuuguuugaacuga

SEQ ID NO: 3350616 - RNA, 15 nt, Human
augaccuuucaauag

SEQ ID NO: 3350617 - RNA, 13 nt, Human
augaccuuucaau

SEQ ID NO: 3350618 - RNA, 11 nt, Human
augagccuggc

SEQ ID NO: 3350619 - RNA, 19 nt, Human
augagccucagcauccugg

SEQ ID NO: 3350620 - RNA, 21 nt, Human
augagccucagcauccuggca

SEQ ID NO: 3350621 - RNA, 23 nt, Human
augaaguaauaugcacacauuuu

SEQ ID NO: 3350622 - RNA, 14 nt, Human
augaaguaauaugc

SEQ ID NO: 3350623 - RNA, 21 nt, Human
augaaguaauaugcacacauu

SEQ ID NO: 3350624 - RNA, 12 nt, Human
augaaagacugu

SEQ ID NO: 3350625 - RNA, 23 nt, Human
augaagcauuuacuuuguguuca

SEQ ID NO: 3350626 - RNA, 23 nt, Human
aucuaggaagacuuuggaaagag

SEQ ID NO: 3350627 - RNA, 18 nt, Human
augccugguggcagcugc

SEQ ID NO: 3350628 - RNA, 19 nt, Human
augccugguggcagcugcg

SEQ ID NO: 3350629 - RNA, 13 nt, Human
augccugguggca

SEQ ID NO: 3350630 - RNA, 12 nt, Human
augccugguggc

SEQ ID NO: 3350631 - RNA, 11 nt, Human
augccuggugg

SEQ ID NO: 3350632 - RNA, 21 nt, Human
augccugguggcagcugcggu

SEQ ID NO: 3350633 - RNA, 16 nt, Human
augcuuugaucccuuc

SEQ ID NO: 3350634 - RNA, 19 nt, Human
augcucugcauguuacaua

SEQ ID NO: 3350635 - RNA, 18 nt, Human
augcucugcauguuacau

SEQ ID NO: 3350636 - RNA, 15 nt, Human
augcucugcauguua

SEQ ID NO: 3350637 - RNA, 14 nt, Human
augcuucuucagag

SEQ ID NO: 3350638 - RNA, 17 nt, Human
augcuucuucagagacu

SEQ ID NO: 3350639 - RNA, 20 nt, Human
augcuucuucagagacuccu

SEQ ID NO: 3350640 - RNA, 18 nt, Human
auggcuuuugugcauuau

SEQ ID NO: 3350641 - RNA, 21 nt, Human
augggaaugaaugucagugug

SEQ ID NO: 3350642 - RNA, 22 nt, Human
aucuaggaagacuuuggaaaga

SEQ ID NO: 3350643 - RNA, 21 nt, Human
auccacugugccaugugccag

SEQ ID NO: 3350644 - RNA, 15 nt, Human
aucauccuaagcuau

SEQ ID NO: 3350645 - RNA, 23 nt, Human
aucauccacugugccaugugcca

SEQ ID NO: 3350646 - RNA, 20 nt, Human
aucaugacaaagacugagua

SEQ ID NO: 3350647 - RNA, 14 nt, Human
auagcacagacccu

SEQ ID NO: 3350648 - RNA, 20 nt, Human
aucaaaagguuaauaaagua

SEQ ID NO: 3350649 - RNA, 19 nt, Human
aucaaagagguuuuaaaaa

SEQ ID NO: 3350650 - RNA, 18 nt, Human
auauuuuuuucuuuucuu

SEQ ID NO: 3350651 - RNA, 20 nt, Human
caacaggcugggcuucagug

SEQ ID NO: 3350652 - RNA, 14 nt, Human
caaaggagauugga

SEQ ID NO: 3350653 - RNA, 20 nt, Human
caaaggagauuggaaggaac

SEQ ID NO: 3350654 - RNA, 16 nt, Human
caaaguggugagaggc

SEQ ID NO: 3350655 - RNA, 17 nt, Human
caaaguggugagaggca

SEQ ID NO: 3350656 - RNA, 23 nt, Human
caaaggguaucaggugcugccau

SEQ ID NO: 3350657 - RNA, 19 nt, Human
caaaggguaucaggugcug

SEQ ID NO: 3350658 - RNA, 21 nt, Human
caaaggguaucaggugcugcc

SEQ ID NO: 3350659 - RNA, 20 nt, Human
caaaggguaucaggugcugc

SEQ ID NO: 3350660 - RNA, 14 nt, Human
caaagagguuuuaa

SEQ ID NO: 3350661 - RNA, 21 nt, Human
caaagagguuuuaaaaaaauc

SEQ ID NO: 3350662 - RNA, 23 nt, Human
caaggggaauguuugccucugcc

SEQ ID NO: 3350663 - RNA, 13 nt, Human
caagggccuggcc

SEQ ID NO: 3350664 - RNA, 14 nt, Human
caagggccuggccu

SEQ ID NO: 3350665 - RNA, 15 nt, Human
caagggccuggccug

SEQ ID NO: 3350666 - RNA, 21 nt, Human
caaggggaauguuugccucug

SEQ ID NO: 3350667 - RNA, 20 nt, Human
caagugauucuccugccuca

SEQ ID NO: 3350668 - RNA, 15 nt, Human
caagugagacccugu

SEQ ID NO: 3350669 - RNA, 18 nt, Human
caagugauucuccugccu

SEQ ID NO: 3350670 - RNA, 19 nt, Human
caagugauucuccugccuc

SEQ ID NO: 3350671 - RNA, 19 nt, Human
caagugaaaaaggaggaag

SEQ ID NO: 3350672 - RNA, 22 nt, Human
caagugaaaaaggaggaagaga

SEQ ID NO: 3350673 - RNA, 23 nt, Human
caagugaaaaaggaggaagagaa

SEQ ID NO: 3350674 - RNA, 14 nt, Human
caagugagacccug

SEQ ID NO: 3350675 - RNA, 14 nt, Human
caaggauccugagc

SEQ ID NO: 3350676 - RNA, 15 nt, Human
caaggauccugagcc

SEQ ID NO: 3350677 - RNA, 16 nt, Human
caaggauccugagcca

SEQ ID NO: 3350678 - RNA, 13 nt, Human
caaggauccugag

SEQ ID NO: 3350679 - RNA, 18 nt, Human
caaggcugggggaagaag

SEQ ID NO: 3350680 - RNA, 21 nt, Human
caaggcugggggaagaagcuc

SEQ ID NO: 3350681 - RNA, 13 nt, Human
caaggcugucaau

SEQ ID NO: 3350682 - RNA, 14 nt, Human
caaggcugucaauu

SEQ ID NO: 3350683 - RNA, 17 nt, Human
caagagcccaggccucc

SEQ ID NO: 3350684 - RNA, 17 nt, Human
caagagggucugaggaa

SEQ ID NO: 3350685 - RNA, 16 nt, Human
caagagggucugagga

SEQ ID NO: 3350686 - RNA, 12 nt, Human
caagagggucug

SEQ ID NO: 3350687 - RNA, 13 nt, Human
caagaccuucucc

SEQ ID NO: 3350688 - RNA, 19 nt, Human
caagacgcugugcugcccu

SEQ ID NO: 3350689 - RNA, 20 nt, Human
caagacgcugugcugcccug

SEQ ID NO: 3350690 - RNA, 21 nt, Human
caagacgcugugcugcccugc

SEQ ID NO: 3350691 - RNA, 22 nt, Human
caagacgcugugcugcccugcc

SEQ ID NO: 3350692 - RNA, 23 nt, Human
caagacccuuguggucccacccc

SEQ ID NO: 3350693 - RNA, 20 nt, Human
caacugcaucaagaugugac

SEQ ID NO: 3350694 - RNA, 23 nt, Human
caacugcaucaagaugugacaug

SEQ ID NO: 3350695 - RNA, 17 nt, Human
caacugcaucaagaugu

SEQ ID NO: 3350696 - RNA, 19 nt, Human
caaccugauugugucucuu

SEQ ID NO: 3350697 - RNA, 21 nt, Human
caaccugauugugucucuugg

SEQ ID NO: 3350698 - RNA, 16 nt, Human
caaccugauugugucu

SEQ ID NO: 3350699 - RNA, 17 nt, Human
caaccugauugugucuc

SEQ ID NO: 3350700 - RNA, 14 nt, Human
caacauacucccau

SEQ ID NO: 3350701 - RNA, 15 nt, Human
caacauacucccauc

SEQ ID NO: 3350702 - RNA, 17 nt, Human
caacaggcugggcuuca

SEQ ID NO: 3350703 - RNA, 13 nt, Human
caacaggcugggc

SEQ ID NO: 3350704 - RNA, 14 nt, Human
caacaggcugggcu

SEQ ID NO: 3350705 - RNA, 15 nt, Human
caaugaccuuucaau

SEQ ID NO: 3350706 - RNA, 16 nt, Human
caaugaccuuucaaua

SEQ ID NO: 3350707 - RNA, 13 nt, Human
caaugauggucac

SEQ ID NO: 3350708 - RNA, 14 nt, Human
caaugaccuuucaa

SEQ ID NO: 3350709 - RNA, 13 nt, Human
caaugaccuuuca

SEQ ID NO: 3350710 - RNA, 21 nt, Human
caaugcaaaccaucauugaaa

SEQ ID NO: 3350711 - RNA, 22 nt, Human
caaugcaaaccaucauugaaau

SEQ ID NO: 3350712 - RNA, 14 nt, Human
caaugauggucacc

SEQ ID NO: 3350713 - RNA, 13 nt, Human
caaugcacuuugu

SEQ ID NO: 3350714 - RNA, 14 nt, Human
caaugcacugacau

SEQ ID NO: 3350715 - RNA, 23 nt, Human
caaugcaaaccaucauugaaauc

SEQ ID NO: 3350716 - RNA, 20 nt, Human
caaugcaaaccaucauugaa

SEQ ID NO: 3350717 - RNA, 13 nt, Human
cacacccagccca

SEQ ID NO: 3350718 - RNA, 22 nt, Human
cacaccagagcccaccuuggcu

SEQ ID NO: 3350719 - RNA, 21 nt, Human
cacaccagagcccaccuuggc

SEQ ID NO: 3350720 - RNA, 15 nt, Human
cacacagcucugucc

SEQ ID NO: 3350721 - RNA, 14 nt, Human
cacacagcucuguc

SEQ ID NO: 3350722 - RNA, 13 nt, Human
cacacagcucugu

SEQ ID NO: 3350723 - RNA, 12 nt, Human
cacacagcucug

SEQ ID NO: 3350724 - RNA, 20 nt, Human
cacacccagcccacuucugc

SEQ ID NO: 3350725 - RNA, 14 nt, Human
cacacccagcccac

SEQ ID NO: 3350726 - RNA, 17 nt, Human
cacaccgggcacucaga

SEQ ID NO: 3350727 - RNA, 20 nt, Human
cacacaccagagcccaccuu

SEQ ID NO: 3350728 - RNA, 16 nt, Human
cacacaccagagccca

SEQ ID NO: 3350729 - RNA, 15 nt, Human
cacacaccagagccc

SEQ ID NO: 3350730 - RNA, 14 nt, Human
cacacacuuuggcu

SEQ ID NO: 3350731 - RNA, 21 nt, Human
cacacagaggcugccucuccc

SEQ ID NO: 3350732 - RNA, 15 nt, Human
cacaaacagaggccg

SEQ ID NO: 3350733 - RNA, 17 nt, Human
cacaaacgggcucagca

SEQ ID NO: 3350734 - RNA, 18 nt, Human
caaugguuuucuugugug

SEQ ID NO: 3350735 - RNA, 17 nt, Human
cacaaagguagcuuuuc

SEQ ID NO: 3350736 - RNA, 14 nt, Human
caccaccucuuugg

SEQ ID NO: 3350737 - RNA, 17 nt, Human
caccacacccagcccac

SEQ ID NO: 3350738 - RNA, 19 nt, Human
caccacacccagcccacuu

SEQ ID NO: 3350739 - RNA, 15 nt, Human
caccagagcccaccu

SEQ ID NO: 3350740 - RNA, 22 nt, Human
caccagagcccaccuuggcuca

SEQ ID NO: 3350741 - RNA, 20 nt, Human
caccagagcccaccuuggcu

SEQ ID NO: 3350742 - RNA, 18 nt, Human
caccagagcccaccuugg

SEQ ID NO: 3350743 - RNA, 17 nt, Human
caccagagcccaccuug

SEQ ID NO: 3350744 - RNA, 18 nt, Human
cacauguccaagaagccc

SEQ ID NO: 3350745 - RNA, 19 nt, Human
cacauguccaagaagccca

SEQ ID NO: 3350746 - RNA, 21 nt, Human
cacauguccaagaagcccagg

SEQ ID NO: 3350747 - RNA, 22 nt, Human
cacauguccaagaagcccagga

SEQ ID NO: 3350748 - RNA, 16 nt, Human
caccaacgucugugcc

SEQ ID NO: 3350749 - RNA, 17 nt, Human
caccaacgucugugcca

SEQ ID NO: 3350750 - RNA, 13 nt, Human
caccaagcccagu

SEQ ID NO: 3350751 - RNA, 12 nt, Human
caccaagcccag

SEQ ID NO: 3350752 - RNA, 21 nt, Human
caccauauuaccacagacaua

SEQ ID NO: 3350753 - RNA, 14 nt, Human
caccaucaagccac

SEQ ID NO: 3350754 - RNA, 15 nt, Human
caccaucaagccacc

SEQ ID NO: 3350755 - RNA, 13 nt, Human
caccaucaagcca

SEQ ID NO: 3350756 - RNA, 16 nt, Human
caccaucaagccacca

SEQ ID NO: 3350757 - RNA, 17 nt, Human
caccaucaagccaccaa

SEQ ID NO: 3350758 - RNA, 19 nt, Human
caccaucaagccaccaaca

SEQ ID NO: 3350759 - RNA, 24 nt, Human
caccaucaagccaccaacauacuc

SEQ ID NO: 3350760 - RNA, 17 nt, Human
caccaucaugucuggcu

SEQ ID NO: 3350761 - RNA, 15 nt, Human
caccaucaugucugg

SEQ ID NO: 3350762 - RNA, 18 nt, Human
caccaucaugucuggcua

SEQ ID NO: 3350763 - RNA, 17 nt, Human
cacaugcaaggucauuu

SEQ ID NO: 3350764 - RNA, 19 nt, Human
cacaugcaaggucauuuuu

SEQ ID NO: 3350765 - RNA, 20 nt, Human
cacaugcaaggucauuuuuu

SEQ ID NO: 3350766 - RNA, 18 nt, Human
cacaugcacgugugugca

SEQ ID NO: 3350767 - RNA, 16 nt, Human
cacauguccaagaagc

SEQ ID NO: 3350768 - RNA, 17 nt, Human
cacauguccaagaagcc

SEQ ID NO: 3350769 - RNA, 20 nt, Human
cacaugccucucucaggcca

SEQ ID NO: 3350770 - RNA, 21 nt, Human
cacaugccucucucaggccaa

SEQ ID NO: 3350771 - RNA, 19 nt, Human
cacaugccucucucaggcc

SEQ ID NO: 3350772 - RNA, 13 nt, Human
cacaugagcauca

SEQ ID NO: 3350773 - RNA, 17 nt, Human
cacaugagcaucaggcc

SEQ ID NO: 3350774 - RNA, 18 nt, Human
cacaugagcaucaggcca

SEQ ID NO: 3350775 - RNA, 19 nt, Human
cacaugagcaucaggccag

SEQ ID NO: 3350776 - RNA, 20 nt, Human
cacaugagcaucaggccagg

SEQ ID NO: 3350777 - RNA, 21 nt, Human
cacaugagcaucaggccaggc

SEQ ID NO: 3350778 - RNA, 22 nt, Human
cacacggacacucaaaagcugg

SEQ ID NO: 3350779 - RNA, 18 nt, Human
cacacgcgcgcacacaca

SEQ ID NO: 3350780 - RNA, 14 nt, Human
cacacgcgcgcaca

SEQ ID NO: 3350781 - RNA, 18 nt, Human
cacagcucuucuccaggc

SEQ ID NO: 3350782 - RNA, 19 nt, Human
cacaggcagguccaggguu

SEQ ID NO: 3350783 - RNA, 23 nt, Human
cacaguccuuaccagcagagcac

SEQ ID NO: 3350784 - RNA, 22 nt, Human
cacaguccuuaccagcagagca

SEQ ID NO: 3350785 - RNA, 17 nt, Human
cacaggaucagucugau

SEQ ID NO: 3350786 - RNA, 20 nt, Human
cacagcucuucuccaggcug

SEQ ID NO: 3350787 - RNA, 19 nt, Human
cacagcucuucuccaggcu

SEQ ID NO: 3350788 - RNA, 12 nt, Human
ucacucuccuug

SEQ ID NO: 3350789 - RNA, 14 nt, Human
ucacucuccuuggu

SEQ ID NO: 3350790 - RNA, 12 nt, Human
ucacucuggcag

SEQ ID NO: 3350791 - RNA, 13 nt, Human
ucacucuggcagc

SEQ ID NO: 3350792 - RNA, 23 nt, Human
ucacucuccuuggugucgggcau

SEQ ID NO: 3350793 - RNA, 14 nt, Human
ucacucuggcagcu

SEQ ID NO: 3350794 - RNA, 15 nt, Human
ucacucuggcagcuc

SEQ ID NO: 3350795 - RNA, 16 nt, Human
ucacucuggcagcuca

SEQ ID NO: 3350796 - RNA, 17 nt, Human
ucacucuggcagcucag

SEQ ID NO: 3350797 - RNA, 18 nt, Human
ucacucuggcagcucaga

SEQ ID NO: 3350798 - RNA, 19 nt, Human
ucacucuggcagcucagag

SEQ ID NO: 3350799 - RNA, 20 nt, Human
ucacucuggcagcucagaga

SEQ ID NO: 3350800 - RNA, 22 nt, Human
ucacucuggcagcucagagagg

SEQ ID NO: 3350801 - RNA, 13 nt, Human
ucacuccuugaaa

SEQ ID NO: 3350802 - RNA, 20 nt, Human
ucacggcucacugcagccuc

SEQ ID NO: 3350803 - RNA, 15 nt, Human
ucacggcucacugca

SEQ ID NO: 3350804 - RNA, 13 nt, Human
ucacggcucacug

SEQ ID NO: 3350805 - RNA, 16 nt, Human
ucacggaagagccuug

SEQ ID NO: 3350806 - RNA, 17 nt, Human
ucacggaagagccuugc

SEQ ID NO: 3350807 - RNA, 14 nt, Human
ucacggaagagccu

SEQ ID NO: 3350808 - RNA, 15 nt, Human
ucacaggcaggucca

SEQ ID NO: 3350809 - RNA, 12 nt, Human
ucacaggcaggu

SEQ ID NO: 3350810 - RNA, 19 nt, Human
ucacaggcagguccagggu

SEQ ID NO: 3350811 - RNA, 14 nt, Human
ucaccuuucccauc

SEQ ID NO: 3350812 - RNA, 12 nt, Human
ucaccuuugucc

SEQ ID NO: 3350813 - RNA, 14 nt, Human
ucaccuuugucccc

SEQ ID NO: 3350814 - RNA, 15 nt, Human
ucaccuuugucccca

SEQ ID NO: 3350815 - RNA, 17 nt, Human
ucaccuuuguccccacc

SEQ ID NO: 3350816 - RNA, 18 nt, Human
ucaccuuuguccccaccg

SEQ ID NO: 3350817 - RNA, 22 nt, Human
ucaccuuuguccccaccgcaga

SEQ ID NO: 3350818 - RNA, 20 nt, Human
ucacgccuguaauccuagca

SEQ ID NO: 3350819 - RNA, 19 nt, Human
ucacgccuguaauccuagc

SEQ ID NO: 3350820 - RNA, 14 nt, Human
ucacgccacugcac

SEQ ID NO: 3350821 - RNA, 13 nt, Human
ucacgccacugca

SEQ ID NO: 3350822 - RNA, 16 nt, Human
ucacgccacugcacua

SEQ ID NO: 3350823 - RNA, 15 nt, Human
ucacugcuuaacuuc

SEQ ID NO: 3350824 - RNA, 17 nt, Human
ucacugcuuaacuucac

SEQ ID NO: 3350825 - RNA, 18 nt, Human
ucacugcuuaacuucaca

SEQ ID NO: 3350826 - RNA, 16 nt, Human
ucacucugucgcccag

SEQ ID NO: 3350827 - RNA, 12 nt, Human
ucacucugucgc

SEQ ID NO: 3350828 - RNA, 19 nt, Human
ucacucugucgcccagucu

SEQ ID NO: 3350829 - RNA, 19 nt, Human
ucagcacgauuucuguuua

SEQ ID NO: 3350830 - RNA, 18 nt, Human
ucagcacgauuucuguuu

SEQ ID NO: 3350831 - RNA, 15 nt, Human
ucagacagcugccug

SEQ ID NO: 3350832 - RNA, 16 nt, Human
ucagacagcugccugg

SEQ ID NO: 3350833 - RNA, 17 nt, Human
ucagacagcugccuggg

SEQ ID NO: 3350834 - RNA, 18 nt, Human
ucagacagcugccuggga

SEQ ID NO: 3350835 - RNA, 19 nt, Human
ucagacagcugccugggau

SEQ ID NO: 3350836 - RNA, 20 nt, Human
ucagacagcugccugggauc

SEQ ID NO: 3350837 - RNA, 14 nt, Human
ucagacagcugccu

SEQ ID NO: 3350838 - RNA, 23 nt, Human
uauuuauuaaaugcccagccccu

SEQ ID NO: 3350839 - RNA, 22 nt, Human
uauuuauuaaaugcccagcccc

SEQ ID NO: 3350840 - RNA, 15 nt, Human
uaucugaaaauguau

SEQ ID NO: 3350841 - RNA, 14 nt, Human
uaucugaaaaugua

SEQ ID NO: 3350842 - RNA, 20 nt, Human
uaucugaaaauguaugugua

SEQ ID NO: 3350843 - RNA, 15 nt, Human
uauuuuuuuacuaau

SEQ ID NO: 3350844 - RNA, 22 nt, Human
ucaaaacgguuuuacugcagcu

SEQ ID NO: 3350845 - RNA, 14 nt, Human
ucaaacucuuaaaa

SEQ ID NO: 3350846 - RNA, 16 nt, Human
ucaaacuuuacuaugg

SEQ ID NO: 3350847 - RNA, 15 nt, Human
ucaaacuuuacuaug

SEQ ID NO: 3350848 - RNA, 13 nt, Human
ucaaacuuuacua

SEQ ID NO: 3350849 - RNA, 22 nt, Human
ucaaacucuugaccucagguga

SEQ ID NO: 3350850 - RNA, 13 nt, Human
ucaaccuccuggg

SEQ ID NO: 3350851 - RNA, 21 nt, Human
ucaagcgauucuucugcuuca

SEQ ID NO: 3350852 - RNA, 16 nt, Human
ucaagcgauucuucug

SEQ ID NO: 3350853 - RNA, 20 nt, Human
ucaaggauccugagccagau

SEQ ID NO: 3350854 - RNA, 21 nt, Human
ucaagugauucuccugccuca

SEQ ID NO: 3350855 - RNA, 17 nt, Human
ucaaggauccugagcca

SEQ ID NO: 3350856 - RNA, 22 nt, Human
ucaagugauucuccugccucag

SEQ ID NO: 3350857 - RNA, 18 nt, Human
ucaaggauccugagccag

SEQ ID NO: 3350858 - RNA, 19 nt, Human
ucaaggauccugagccaga

SEQ ID NO: 3350859 - RNA, 13 nt, Human
ucaauuacaggaa

SEQ ID NO: 3350860 - RNA, 18 nt, Human
ucaauuacaggaaguacu

SEQ ID NO: 3350861 - RNA, 18 nt, Human
ucaaugcacugacauugu

SEQ ID NO: 3350862 - RNA, 14 nt, Human
ucaauaggaaaaac

SEQ ID NO: 3350863 - RNA, 14 nt, Human
ucaaugcacugaca

SEQ ID NO: 3350864 - RNA, 13 nt, Human
ucaauaggaaaaa

SEQ ID NO: 3350865 - RNA, 13 nt, Human
ucacacagugagu

SEQ ID NO: 3350866 - RNA, 22 nt, Human
ucacacaguauuacuucugcua

SEQ ID NO: 3350867 - RNA, 21 nt, Human
ucacacaguauuacuucugcu

SEQ ID NO: 3350868 - RNA, 19 nt, Human
ucaauuacaggaaguacug

SEQ ID NO: 3350869 - RNA, 23 nt, Human
ucacacagugagucgaggacagg

SEQ ID NO: 3350870 - RNA, 22 nt, Human
ucacacagugagucgaggacag

SEQ ID NO: 3350871 - RNA, 21 nt, Human
ucacacaugagcaucaggcca

SEQ ID NO: 3350872 - RNA, 11 nt, Human
ucacaggcagg

SEQ ID NO: 3350873 - RNA, 22 nt, Human
ucccccagccccauccucugua

SEQ ID NO: 3350874 - RNA, 20 nt, Human
uccccgcacugggcuugggg

SEQ ID NO: 3350875 - RNA, 21 nt, Human
ucccccuuccauggacuuugu

SEQ ID NO: 3350876 - RNA, 15 nt, Human
ucccuacuguaauuu

SEQ ID NO: 3350877 - RNA, 17 nt, Human
ucccucccucuuucccu

SEQ ID NO: 3350878 - RNA, 15 nt, Human
ucccucccucuuucc

SEQ ID NO: 3350879 - RNA, 14 nt, Human
uccccugcugggug

SEQ ID NO: 3350880 - RNA, 15 nt, Human
uccccugcugggugu

SEQ ID NO: 3350881 - RNA, 20 nt, Human
uccccugcuggguguggcgc

SEQ ID NO: 3350882 - RNA, 21 nt, Human
uccccugcuggguguggcgca

SEQ ID NO: 3350883 - RNA, 22 nt, Human
uccccuguagagugggagcuga

SEQ ID NO: 3350884 - RNA, 23 nt, Human
uccccuguccccgcacugggcuu

SEQ ID NO: 3350885 - RNA, 24 nt, Human
uccccugcuggguguggcgcagca

SEQ ID NO: 3350886 - RNA, 19 nt, Human
uccccuguagagugggagc

SEQ ID NO: 3350887 - RNA, 22 nt, Human
uccccacuugagaauuacccuu

SEQ ID NO: 3350888 - RNA, 20 nt, Human
ucccaucucacacaugagca

SEQ ID NO: 3350889 - RNA, 23 nt, Human
ucccaucucacacaugagcauca

SEQ ID NO: 3350890 - RNA, 22 nt, Human
ucccaggcauuccccaggaggc

SEQ ID NO: 3350891 - RNA, 19 nt, Human
ucccaggcauuccccagga

SEQ ID NO: 3350892 - RNA, 20 nt, Human
ucccaggcauuccccaggag

SEQ ID NO: 3350893 - RNA, 21 nt, Human
ucccaggcauuccccaggagg

SEQ ID NO: 3350894 - RNA, 15 nt, Human
ucccaccucagccuc

SEQ ID NO: 3350895 - RNA, 14 nt, Human
ucccaccucagccu

SEQ ID NO: 3350896 - RNA, 13 nt, Human
ucccaccucagcc

SEQ ID NO: 3350897 - RNA, 15 nt, Human
ucccaagcucugcuc

SEQ ID NO: 3350898 - RNA, 14 nt, Human
ucccaagcucugcu

SEQ ID NO: 3350899 - RNA, 13 nt, Human
ucccaagcucugc

SEQ ID NO: 3350900 - RNA, 12 nt, Human
ucccaagcucug

SEQ ID NO: 3350901 - RNA, 17 nt, Human
ucccaagcucugcuccu

SEQ ID NO: 3350902 - RNA, 14 nt, Human
ucccaacucacccc

SEQ ID NO: 3350903 - RNA, 15 nt, Human
ucccaacucacccca

SEQ ID NO: 3350904 - RNA, 16 nt, Human
ucccaacucaccccag

SEQ ID NO: 3350905 - RNA, 13 nt, Human
ucccaacucaccc

SEQ ID NO: 3350906 - RNA, 23 nt, Human
uccagcucaccagccccagugcc

SEQ ID NO: 3350907 - RNA, 21 nt, Human
ucccaaagugcugggauuaca

SEQ ID NO: 3350908 - RNA, 14 nt, Human
uccauggacuuugu

SEQ ID NO: 3350909 - RNA, 15 nt, Human
uccauggacuuuguu

SEQ ID NO: 3350910 - RNA, 13 nt, Human
uccauggacuuug

SEQ ID NO: 3350911 - RNA, 18 nt, Human
ucauuaggugugacugaa

SEQ ID NO: 3350912 - RNA, 21 nt, Human
ucauuaggugugacugaauuu

SEQ ID NO: 3350913 - RNA, 16 nt, Human
ucauuaggugugacug

SEQ ID NO: 3350914 - RNA, 20 nt, Human
ucauacccacccccacccaa

SEQ ID NO: 3350915 - RNA, 14 nt, Human
ucauacccaccccc

SEQ ID NO: 3350916 - RNA, 15 nt, Human
ucauacccaccccca

SEQ ID NO: 3350917 - RNA, 17 nt, Human
ucagugugacugaucuc

SEQ ID NO: 3350918 - RNA, 13 nt, Human
ucagugugacuga

SEQ ID NO: 3350919 - RNA, 23 nt, Human
ucagugguuggcaauuguuucaa

SEQ ID NO: 3350920 - RNA, 23 nt, Human
ucagucugauucccaagcucugc

SEQ ID NO: 3350921 - RNA, 15 nt, Human
ucagucuggcccuuc

SEQ ID NO: 3350922 - RNA, 24 nt, Human
ucagucugauucccaagcucugcu

SEQ ID NO: 3350923 - RNA, 13 nt, Human
ucauacccacccc

SEQ ID NO: 3350924 - RNA, 13 nt, Human
ucauaaugacuua

SEQ ID NO: 3350925 - RNA, 16 nt, Human
uccaaaauaaaacuuu

SEQ ID NO: 3350926 - RNA, 17 nt, Human
uccaaaauaaaacuuuu

SEQ ID NO: 3350927 - RNA, 20 nt, Human
uccaagaagcccaggaaagg

SEQ ID NO: 3350928 - RNA, 22 nt, Human
uccaagaagcccaggaaaggcu

SEQ ID NO: 3350929 - RNA, 19 nt, Human
uccaagaagcccaggaaag

SEQ ID NO: 3350930 - RNA, 22 nt, Human
uccaagcaggacauggacaagg

SEQ ID NO: 3350931 - RNA, 14 nt, Human
uccacaagagccca

SEQ ID NO: 3350932 - RNA, 12 nt, Human
uccaccugccag

SEQ ID NO: 3350933 - RNA, 18 nt, Human
uccagcucaccagcccca

SEQ ID NO: 3350934 - RNA, 13 nt, Human
uccaccugccagg

SEQ ID NO: 3350935 - RNA, 15 nt, Human
ucgaguuacagacaa

SEQ ID NO: 3350936 - RNA, 17 nt, Human
ucgaguuacagacaaag

SEQ ID NO: 3350937 - RNA, 23 nt, Human
ucgcugugucagcauagaaguaa

SEQ ID NO: 3350938 - RNA, 10 nt, Human
ucccucccuu

SEQ ID NO: 3350939 - RNA, 22 nt, Human
uccuggcaugggaaugaauguc

SEQ ID NO: 3350940 - RNA, 17 nt, Human
uccuggcccacugcauc

SEQ ID NO: 3350941 - RNA, 15 nt, Human
uccugguguggaaga

SEQ ID NO: 3350942 - RNA, 12 nt, Human
uccuucuguccu

SEQ ID NO: 3350943 - RNA, 19 nt, Human
uccuucuguccuacucugu

SEQ ID NO: 3350944 - RNA, 17 nt, Human
ucucacucugucgccca

SEQ ID NO: 3350945 - RNA, 16 nt, Human
ucucacucugucgccc

SEQ ID NO: 3350946 - RNA, 18 nt, Human
ucucacucugucgcccag

SEQ ID NO: 3350947 - RNA, 21 nt, Human
ucucacuguugcccaggcugg

SEQ ID NO: 3350948 - RNA, 20 nt, Human
ucucacuguugcccaggcug

SEQ ID NO: 3350949 - RNA, 19 nt, Human
ucucacuguugcccaggcu

SEQ ID NO: 3350950 - RNA, 18 nt, Human
ucucacuguugcccaggc

SEQ ID NO: 3350951 - RNA, 21 nt, Human
ucucagaaucucaaauaacua

SEQ ID NO: 3350952 - RNA, 17 nt, Human
ucucagaaucucaaaua

SEQ ID NO: 3350953 - RNA, 17 nt, Human
ucucacuguugcccagg

SEQ ID NO: 3350954 - RNA, 21 nt, Human
ucucaaacucuugaccucagg

SEQ ID NO: 3350955 - RNA, 13 nt, Human
ucucaaacucuug

SEQ ID NO: 3350956 - RNA, 22 nt, Human
ucucaaacucuugaccucaggu

SEQ ID NO: 3350957 - RNA, 18 nt, Human
ucucaaauuucuaaaucu

SEQ ID NO: 3350958 - RNA, 22 nt, Human
ucuaaaucuccaaaauaaaacu

SEQ ID NO: 3350959 - RNA, 15 nt, Human
ucuaacuucaccaua

SEQ ID NO: 3350960 - RNA, 16 nt, Human
ucuaacuucaccauau

SEQ ID NO: 3350961 - RNA, 22 nt, Human
ucuacugaggugcuauguucuu

SEQ ID NO: 3350962 - RNA, 22 nt, Human
ucuagggaaaaaccagcgugug

SEQ ID NO: 3350963 - RNA, 19 nt, Human
ucuagggaaaaaccagcgu

SEQ ID NO: 3350964 - RNA, 19 nt, Human
ucuacugaggugcuauguu

SEQ ID NO: 3350965 - RNA, 18 nt, Human
ucuacugaggugcuaugu

SEQ ID NO: 3350966 - RNA, 15 nt, Human
ucuacacugugcuga

SEQ ID NO: 3350967 - RNA, 12 nt, Human
ucuacacugugc

SEQ ID NO: 3350968 - RNA, 14 nt, Human
ucuacacugugcug

SEQ ID NO: 3350969 - RNA, 13 nt, Human
ucucugaggacac

SEQ ID NO: 3350970 - RNA, 15 nt, Human
ucucuacaaaaagca

SEQ ID NO: 3350971 - RNA, 18 nt, Human
ucucuaguuugauuaaau

SEQ ID NO: 3350972 - RNA, 19 nt, Human
ucucuaguuugauuaaauu

SEQ ID NO: 3350973 - RNA, 16 nt, Human
ucucuaguuugauuaa

SEQ ID NO: 3350974 - RNA, 19 nt, Human
ucuccugccucagccuccc

SEQ ID NO: 3350975 - RNA, 22 nt, Human
ucuccugccucagccucccaaa

SEQ ID NO: 3350976 - RNA, 22 nt, Human
ucucccccagccccauccucug

SEQ ID NO: 3350977 - RNA, 13 nt, Human
ucucccccagccc

SEQ ID NO: 3350978 - RNA, 18 nt, Human
ucucccccagccccaucc

SEQ ID NO: 3350979 - RNA, 20 nt, Human
ucucccccagccccauccuc

SEQ ID NO: 3350980 - RNA, 15 nt, Human
ucucccccagcccca

SEQ ID NO: 3350981 - RNA, 17 nt, Human
ucucccccagccccauc

SEQ ID NO: 3350982 - RNA, 14 nt, Human
ucucccccagcccc

SEQ ID NO: 3350983 - RNA, 23 nt, Human
ucugaggacacuaaccacgcugg

SEQ ID NO: 3350984 - RNA, 20 nt, Human
ucugaggacacuaaccacgc

SEQ ID NO: 3350985 - RNA, 16 nt, Human
ucugaggaauccagac

SEQ ID NO: 3350986 - RNA, 23 nt, Human
ucugauucccaagcucugcuccu

SEQ ID NO: 3350987 - RNA, 21 nt, Human
ucugauucccaagcucugcuc

SEQ ID NO: 3350988 - RNA, 14 nt, Human
ucugcacaagcugc

SEQ ID NO: 3350989 - RNA, 19 nt, Human
ucugcacaagcugcacccu

SEQ ID NO: 3350990 - RNA, 15 nt, Human
ucugacccaugcugc

SEQ ID NO: 3350991 - RNA, 16 nt, Human
ucugacccaugcugcc

SEQ ID NO: 3350992 - RNA, 17 nt, Human
ucugacccaugcugccc

SEQ ID NO: 3350993 - RNA, 18 nt, Human
ucugacccaugcugcccu

SEQ ID NO: 3350994 - RNA, 24 nt, Human
ucugagaucaaaacgguuuuacug

SEQ ID NO: 3350995 - RNA, 20 nt, Human
ucugaacuuggcgcugcccc

SEQ ID NO: 3350996 - RNA, 15 nt, Human
ucugacccacugcuu

SEQ ID NO: 3350997 - RNA, 14 nt, Human
ucugacccaugcug

SEQ ID NO: 3350998 - RNA, 13 nt, Human
ucugaaagggacg

SEQ ID NO: 3350999 - RNA, 23 nt, Human
ucugaaaauguauguguaaguau

SEQ ID NO: 3351000 - RNA, 14 nt, Human
ucugaaaauguaug

SEQ ID NO: 3351001 - RNA, 16 nt, Human
ucucuuuucaaaacau

SEQ ID NO: 3351002 - RNA, 15 nt, Human
ucucuuuucaaaaca

SEQ ID NO: 3351003 - RNA, 16 nt, Human
ucugaaaauguaugug

SEQ ID NO: 3351004 - RNA, 14 nt, Human
ugaagacagagcua

SEQ ID NO: 3351005 - RNA, 16 nt, Human
ugaagacagagcuaca

SEQ ID NO: 3351006 - RNA, 13 nt, Human
ugaagacagagcu

SEQ ID NO: 3351007 - RNA, 14 nt, Human
ugaacuuggcgcug

SEQ ID NO: 3351008 - RNA, 12 nt, Human
ugaacuugguuc

SEQ ID NO: 3351009 - RNA, 19 nt, Human
ugaacuggguacuugugga

SEQ ID NO: 3351010 - RNA, 17 nt, Human
ugaagacuuuucuuuca

SEQ ID NO: 3351011 - RNA, 22 nt, Human
ugaagacuuuucuuucagccaa

SEQ ID NO: 3351012 - RNA, 14 nt, Human
ugaagacuuuucuu

SEQ ID NO: 3351013 - RNA, 20 nt, Human
ugaaggcucgagcaugccug

SEQ ID NO: 3351014 - RNA, 21 nt, Human
ugaaggcucgagcaugccugg

SEQ ID NO: 3351015 - RNA, 13 nt, Human
ugaacugauaaag

SEQ ID NO: 3351016 - RNA, 15 nt, Human
ugaacugauaaagau

SEQ ID NO: 3351017 - RNA, 15 nt, Human
ugaacucuucaaucu

SEQ ID NO: 3351018 - RNA, 21 nt, Human
ugaaccacaucuugcucugcu

SEQ ID NO: 3351019 - RNA, 20 nt, Human
ugaaccacaucuugcucugc

SEQ ID NO: 3351020 - RNA, 18 nt, Human
ugaacucuucaaucucuu

SEQ ID NO: 3351021 - RNA, 19 nt, Human
ugaaccacaucuugcucug

SEQ ID NO: 3351022 - RNA, 17 nt, Human
ucuuuugccguuauuaa

SEQ ID NO: 3351023 - RNA, 19 nt, Human
ucuuuugccguuauuaaaa

SEQ ID NO: 3351024 - RNA, 16 nt, Human
ucuuuuugcuuugcuu

SEQ ID NO: 3351025 - RNA, 22 nt, Human
ugaaaagaaaaaugagccuggc

SEQ ID NO: 3351026 - RNA, 17 nt, Human
ugaaaucuuuuugcuuu

SEQ ID NO: 3351027 - RNA, 17 nt, Human
ugaaagggcccagagag

SEQ ID NO: 3351028 - RNA, 16 nt, Human
ugaaagggcccagaga

SEQ ID NO: 3351029 - RNA, 15 nt, Human
ugaaagggcccagag

SEQ ID NO: 3351030 - RNA, 22 nt, Human
ugaaaugaggucagagccugca

SEQ ID NO: 3351031 - RNA, 21 nt, Human
ugaaaugaggucagagccugc

SEQ ID NO: 3351032 - RNA, 23 nt, Human
ugaaaugaggucagagccugcag

SEQ ID NO: 3351033 - RNA, 20 nt, Human
ugaaaugaggucagagccug

SEQ ID NO: 3351034 - RNA, 19 nt, Human
ugaaaugaggucagagccu

SEQ ID NO: 3351035 - RNA, 17 nt, Human
ugaaaggaaagaggcuc

SEQ ID NO: 3351036 - RNA, 12 nt, Human
ugaaaggaaaga

SEQ ID NO: 3351037 - RNA, 14 nt, Human
ucuuauacauuuga

SEQ ID NO: 3351038 - RNA, 15 nt, Human
ucuuauacauuugau

SEQ ID NO: 3351039 - RNA, 16 nt, Human
ucuuaguggauguucu

SEQ ID NO: 3351040 - RNA, 14 nt, Human
ucuuagugugugca

SEQ ID NO: 3351041 - RNA, 13 nt, Human
ucuuaaaaagugg

SEQ ID NO: 3351042 - RNA, 15 nt, Human
ucuucaguaagccgu

SEQ ID NO: 3351043 - RNA, 16 nt, Human
ucuucaguaagccgug

SEQ ID NO: 3351044 - RNA, 21 nt, Human
ucuuccacaagagcccaggcc

SEQ ID NO: 3351045 - RNA, 19 nt, Human
ucuucuccacuuucuagcc

SEQ ID NO: 3351046 - RNA, 21 nt, Human
ucuucuccacuuucuagccag

SEQ ID NO: 3351047 - RNA, 11 nt, Human
ucuugcucugc

SEQ ID NO: 3351048 - RNA, 12 nt, Human
ucuugcucugcu

SEQ ID NO: 3351049 - RNA, 17 nt, Human
ucuugaauuguaaggaa

SEQ ID NO: 3351050 - RNA, 21 nt, Human
ucuugaauuguaaggaaugau

SEQ ID NO: 3351051 - RNA, 12 nt, Human
ucuucuccaggc

SEQ ID NO: 3351052 - RNA, 14 nt, Human
ucuucuccaggcug

SEQ ID NO: 3351053 - RNA, 13 nt, Human
ucuucuccaggcu

SEQ ID NO: 3351054 - RNA, 18 nt, Human
ucuugaacuccuggccuc

SEQ ID NO: 3351055 - RNA, 17 nt, Human
ucuugaacuccuggccu

SEQ ID NO: 3351056 - RNA, 16 nt, Human
ucuugaacuccuggcc

SEQ ID NO: 3351057 - RNA, 15 nt, Human
ucuugaacuccuggc

SEQ ID NO: 3351058 - RNA, 18 nt, Human
ucuuaaaaaguggaaaaa

SEQ ID NO: 3351059 - RNA, 17 nt, Human
ucuguacgucugacagg

SEQ ID NO: 3351060 - RNA, 22 nt, Human
ucuguggguuucuaaagcugcc

SEQ ID NO: 3351061 - RNA, 19 nt, Human
ucuguccgagcuuugaaaa

SEQ ID NO: 3351062 - RNA, 23 nt, Human
ucuguggguuucuaaagcugcca

SEQ ID NO: 3351063 - RNA, 22 nt, Human
ucugugucagguggggcagcuu

SEQ ID NO: 3351064 - RNA, 23 nt, Human
ucuguacagagcccacgccccca

SEQ ID NO: 3351065 - RNA, 12 nt, Human
ucugggacacag

SEQ ID NO: 3351066 - RNA, 15 nt, Human
ucuggcucuuccagg

SEQ ID NO: 3351067 - RNA, 16 nt, Human
ucuggcucuuccaggc

SEQ ID NO: 3351068 - RNA, 17 nt, Human
ucuggcucuuccaggcu

SEQ ID NO: 3351069 - RNA, 14 nt, Human
ucuggcuaugcauu

SEQ ID NO: 3351070 - RNA, 21 nt, Human
uaguuugauuaaauucuugca

SEQ ID NO: 3351071 - RNA, 20 nt, Human
uauaaugaaugaaacauuuu

SEQ ID NO: 3351072 - RNA, 18 nt, Human
uauaaugaaugaaacauu

SEQ ID NO: 3351073 - RNA, 20 nt, Human
uauaauguaagcucuacuga

SEQ ID NO: 3351074 - RNA, 19 nt, Human
uauaauguaagcucuacug

SEQ ID NO: 3351075 - RNA, 14 nt, Human
uauaauguaagcuc

SEQ ID NO: 3351076 - RNA, 17 nt, Human
uauaauucuacuuugag

SEQ ID NO: 3351077 - RNA, 15 nt, Human
uaguggauguucuga

SEQ ID NO: 3351078 - RNA, 23 nt, Human
uaguuugauuaaauucuugcaaa

SEQ ID NO: 3351079 - RNA, 12 nt, Human
uaguuugcaguu

SEQ ID NO: 3351080 - RNA, 13 nt, Human
uaguuucuccaag

SEQ ID NO: 3351081 - RNA, 15 nt, Human
uaucuaaauguugaa

SEQ ID NO: 3351082 - RNA, 16 nt, Human
uaucgucacugcuuaa

SEQ ID NO: 3351083 - RNA, 19 nt, Human
uaucgucacugcuuaacuu

SEQ ID NO: 3351084 - RNA, 16 nt, Human
uaucaugacaaagacu

SEQ ID NO: 3351085 - RNA, 17 nt, Human
uauauacgaacaaaaca

SEQ ID NO: 3351086 - RNA, 17 nt, Human
uauauagaaauauauac

SEQ ID NO: 3351087 - RNA, 16 nt, Human
uagccuaggugacaga

SEQ ID NO: 3351088 - RNA, 14 nt, Human
uagcccaaaaccaa

SEQ ID NO: 3351089 - RNA, 11 nt, Human
uagcugggacu

SEQ ID NO: 3351090 - RNA, 19 nt, Human
uagcugggacuacaggcac

SEQ ID NO: 3351091 - RNA, 20 nt, Human
uagcugggacuacaggcacc

SEQ ID NO: 3351092 - RNA, 18 nt, Human
uagcugggacuacaggug

SEQ ID NO: 3351093 - RNA, 22 nt, Human
uagcucauucuccuuguguuac

SEQ ID NO: 3351094 - RNA, 21 nt, Human
uagcucuaggagggcuggcaa

SEQ ID NO: 3351095 - RNA, 16 nt, Human
uaggaagacuuuggaa

SEQ ID NO: 3351096 - RNA, 17 nt, Human
uaggaagacuuuggaaa

SEQ ID NO: 3351097 - RNA, 14 nt, Human
uaggaagacuuugg

SEQ ID NO: 3351098 - RNA, 15 nt, Human
uaggaagacuuugga

SEQ ID NO: 3351099 - RNA, 13 nt, Human
uaggaagacuuug

SEQ ID NO: 3351100 - RNA, 13 nt, Human
uaggaacacuccu

SEQ ID NO: 3351101 - RNA, 14 nt, Human
uaggaacacuccuu

SEQ ID NO: 3351102 - RNA, 17 nt, Human
uaggaacacuccuucac

SEQ ID NO: 3351103 - RNA, 21 nt, Human
uaggaacuuaaauaaugugaa

SEQ ID NO: 3351104 - RNA, 15 nt, Human
uaggaagguuaaugu

SEQ ID NO: 3351105 - RNA, 13 nt, Human
uaggccuggccag

SEQ ID NO: 3351106 - RNA, 11 nt, Human
uagagacaggg

SEQ ID NO: 3351107 - RNA, 16 nt, Human
uagagagagaccacuu

SEQ ID NO: 3351108 - RNA, 19 nt, Human
uagagguucaaagauauuu

SEQ ID NO: 3351109 - RNA, 16 nt, Human
uagagguucaaagaua

SEQ ID NO: 3351110 - RNA, 21 nt, Human
uagagguucaaagauauuuug

SEQ ID NO: 3351111 - RNA, 16 nt, Human
uagcacuuugggaggc

SEQ ID NO: 3351112 - RNA, 23 nt, Human
uagcagagaaugaaagggcccag

SEQ ID NO: 3351113 - RNA, 19 nt, Human
uagcagagaaugaaagggc

SEQ ID NO: 3351114 - RNA, 18 nt, Human
uagauaauacaccacuac

SEQ ID NO: 3351115 - RNA, 12 nt, Human
uagauguauaua

SEQ ID NO: 3351116 - RNA, 17 nt, Human
uacacacugcauguuug

SEQ ID NO: 3351117 - RNA, 15 nt, Human
uacacacacauacac

SEQ ID NO: 3351118 - RNA, 21 nt, Human
uacacacacacgcgugcacac

SEQ ID NO: 3351119 - RNA, 21 nt, Human
uacacaaugguuuucuugugu

SEQ ID NO: 3351120 - RNA, 17 nt, Human
uacacaaugguuuucuu

SEQ ID NO: 3351121 - RNA, 14 nt, Human
uacacuguuucaaa

SEQ ID NO: 3351122 - RNA, 22 nt, Human
uacacacugcauguuugugauu

SEQ ID NO: 3351123 - RNA, 24 nt, Human
uacagcaaggagauuuacaacugg

SEQ ID NO: 3351124 - RNA, 17 nt, Human
uacacuguuucaaacuu

SEQ ID NO: 3351125 - RNA, 18 nt, Human
uacacuguuucaaacuuu

SEQ ID NO: 3351126 - RNA, 13 nt, Human
uacacuuuaugca

SEQ ID NO: 3351127 - RNA, 21 nt, Human
uacagcuugaccgugaggcca

SEQ ID NO: 3351128 - RNA, 22 nt, Human
uacagcuugaccgugaggccag

SEQ ID NO: 3351129 - RNA, 18 nt, Human
uacaggaaaagcugcuga

SEQ ID NO: 3351130 - RNA, 17 nt, Human
uacaggaaaagcugcug

SEQ ID NO: 3351131 - RNA, 23 nt, Human
uacagcuugaccgugaggccaga

SEQ ID NO: 3351132 - RNA, 19 nt, Human
uacaggaaaagcugcugac

SEQ ID NO: 3351133 - RNA, 16 nt, Human
uacaggcacccaccau

SEQ ID NO: 3351134 - RNA, 22 nt, Human
uacccaggugcuaggaacacuc

SEQ ID NO: 3351135 - RNA, 18 nt, Human
uacccagcgagcccuggu

SEQ ID NO: 3351136 - RNA, 16 nt, Human
uacccagcgagcccug

SEQ ID NO: 3351137 - RNA, 14 nt, Human
uacccacugcucug

SEQ ID NO: 3351138 - RNA, 13 nt, Human
uacccacugcucu

SEQ ID NO: 3351139 - RNA, 12 nt, Human
uacccacugcuc

SEQ ID NO: 3351140 - RNA, 11 nt, Human
uacccacugcu

SEQ ID NO: 3351141 - RNA, 17 nt, Human
uacccacccccacccaa

SEQ ID NO: 3351142 - RNA, 19 nt, Human
uacccacccccacccaagg

SEQ ID NO: 3351143 - RNA, 23 nt, Human
uacccacccccacccaagggccu

SEQ ID NO: 3351144 - RNA, 12 nt, Human
uacccaccccca

SEQ ID NO: 3351145 - RNA, 15 nt, Human
uacccacccccaccc

SEQ ID NO: 3351146 - RNA, 13 nt, Human
uaccacagacaua

SEQ ID NO: 3351147 - RNA, 23 nt, Human
uaccauuuugggguacccacugc

SEQ ID NO: 3351148 - RNA, 19 nt, Human
uacaguuacucagaauucu

SEQ ID NO: 3351149 - RNA, 23 nt, Human
uacaguuacucagaauucucuag

SEQ ID NO: 3351150 - RNA, 19 nt, Human
uacauaagauaaaugugcu

SEQ ID NO: 3351151 - RNA, 18 nt, Human
uacauaagauaaaugugc

SEQ ID NO: 3351152 - RNA, 17 nt, Human
uacauaagauaaaugug

SEQ ID NO: 3351153 - RNA, 22 nt, Human
uacauaagauaaaugugcugaa

SEQ ID NO: 3351154 - RNA, 14 nt, Human
uacuuguggacaca

SEQ ID NO: 3351155 - RNA, 18 nt, Human
uacuuguggacacagcuc

SEQ ID NO: 3351156 - RNA, 15 nt, Human
uacuuguggacacag

SEQ ID NO: 3351157 - RNA, 17 nt, Human
uacuuacuaaaauauau

SEQ ID NO: 3351158 - RNA, 15 nt, Human
uacuuacuaaaauau

SEQ ID NO: 3351159 - RNA, 21 nt, Human
uacuguaucaugacaaagacu

SEQ ID NO: 3351160 - RNA, 23 nt, Human
uagaaauaucugaaaauguaugu

SEQ ID NO: 3351161 - RNA, 21 nt, Human
uagaaauaucugaaaauguau

SEQ ID NO: 3351162 - RNA, 20 nt, Human
uagaaauaucugaaaaugua

SEQ ID NO: 3351163 - RNA, 15 nt, Human
uagaaauauaauuga

SEQ ID NO: 3351164 - RNA, 20 nt, Human
uaccuuuguauucucuccug

SEQ ID NO: 3351165 - RNA, 19 nt, Human
uaccuuuuuuauacauaaa

SEQ ID NO: 3351166 - RNA, 20 nt, Human
uaccuuuuuuauacauaaac

SEQ ID NO: 3351167 - RNA, 18 nt, Human
uaccuuuuuuauacauaa

SEQ ID NO: 3351168 - RNA, 22 nt, Human
uacccaucccauaugccugggc

SEQ ID NO: 3351169 - RNA, 12 nt, Human
uacuacaguccu

SEQ ID NO: 3351170 - RNA, 17 nt, Human
uacuacaguccucccau

SEQ ID NO: 3351171 - RNA, 15 nt, Human
uacuaauagacaauu

SEQ ID NO: 3351172 - RNA, 17 nt, Human
uacuaauagacaauuua

SEQ ID NO: 3351173 - RNA, 22 nt, Human
uacuaauaaaauuuaaaagucu

SEQ ID NO: 3351174 - RNA, 18 nt, Human
uacuaaccagcagaaaug

SEQ ID NO: 3351175 - RNA, 17 nt, Human
uacuaaccagcagaaau

SEQ ID NO: 3351176 - RNA, 19 nt, Human
uacuaaccagcagaaaugc

SEQ ID NO: 3351177 - RNA, 16 nt, Human
uacucagaauucucua

SEQ ID NO: 3351178 - RNA, 22 nt, Human
uacucagaauucucuaguuuga

SEQ ID NO: 3351179 - RNA, 20 nt, Human
uacuacaguuuguuaguaug

SEQ ID NO: 3351180 - RNA, 14 nt, Human
uacucaccucaccc

SEQ ID NO: 3351181 - RNA, 12 nt, Human
uacucaccucac

SEQ ID NO: 3351182 - RNA, 12 nt, Human
uacucccaucug

SEQ ID NO: 3351183 - RNA, 14 nt, Human
uacucccaucugug

SEQ ID NO: 3351184 - RNA, 16 nt, Human
uacucccaucugugaa

SEQ ID NO: 3351185 - RNA, 17 nt, Human
uacucccaucugugaaa

SEQ ID NO: 3351186 - RNA, 15 nt, Human
uacugaggugcuaug

SEQ ID NO: 3351187 - RNA, 15 nt, Human
uaauuugugauacaa

SEQ ID NO: 3351188 - RNA, 18 nt, Human
uaauuugugauacaaugc

SEQ ID NO: 3351189 - RNA, 14 nt, Human
uaauuugugauaca

SEQ ID NO: 3351190 - RNA, 19 nt, Human
uaauuugugauacaaugcu

SEQ ID NO: 3351191 - RNA, 22 nt, Human
uaauuugugauacaaugcugug

SEQ ID NO: 3351192 - RNA, 20 nt, Human
uaauuaaguacuauguauca

SEQ ID NO: 3351193 - RNA, 17 nt, Human
uaauuaaaacacaacau

SEQ ID NO: 3351194 - RNA, 18 nt, Human
uaauucuuagcucauucu

SEQ ID NO: 3351195 - RNA, 20 nt, Human
uaauugacaggauuauugga

SEQ ID NO: 3351196 - RNA, 22 nt, Human
uaauugacaggauuauuggaaa

SEQ ID NO: 3351197 - RNA, 21 nt, Human
uaauaguucagguaacaggca

SEQ ID NO: 3351198 - RNA, 20 nt, Human
uaauccucuaggaggucucu

SEQ ID NO: 3351199 - RNA, 11 nt, Human
uaaucuaaaug

SEQ ID NO: 3351200 - RNA, 17 nt, Human
uaagauaaaugugcuga

SEQ ID NO: 3351201 - RNA, 16 nt, Human
uaagauaaaugugcug

SEQ ID NO: 3351202 - RNA, 14 nt, Human
uaagauaaaugugc

SEQ ID NO: 3351203 - RNA, 12 nt, Human
uaagagggaggg

SEQ ID NO: 3351204 - RNA, 22 nt, Human
uaagagggagggagggcuccag

SEQ ID NO: 3351205 - RNA, 23 nt, Human
uaagagggagggagggcuccaga

SEQ ID NO: 3351206 - RNA, 21 nt, Human
uaacuuuuauaaacuuuaccu

SEQ ID NO: 3351207 - RNA, 22 nt, Human
uaacuuuuauaaacuuuaccuu

SEQ ID NO: 3351208 - RNA, 19 nt, Human
uaacuuuuauaaacuuuac

SEQ ID NO: 3351209 - RNA, 24 nt, Human
uaagaaagacuaucuaaauguuga

SEQ ID NO: 3351210 - RNA, 22 nt, Human
uaagaaccuuuugagugccuua

SEQ ID NO: 3351211 - RNA, 22 nt, Human
uaagaggcagggucucacucug

SEQ ID NO: 3351212 - RNA, 20 nt, Human
uaaggaugcuuguacauaau

SEQ ID NO: 3351213 - RNA, 21 nt, Human
uaaggaugcuuguacauaaug

SEQ ID NO: 3351214 - RNA, 22 nt, Human
uaaggaugcuuguacauaaugc

SEQ ID NO: 3351215 - RNA, 23 nt, Human
uaaggaugcuuguacauaaugcg

SEQ ID NO: 3351216 - RNA, 18 nt, Human
uaaggaugcuuguacaua

SEQ ID NO: 3351217 - RNA, 19 nt, Human
uaaggaugcuuguacauaa

SEQ ID NO: 3351218 - RNA, 19 nt, Human
uaagccaguguugccuaag

SEQ ID NO: 3351219 - RNA, 18 nt, Human
uaagccaguguugccuaa

SEQ ID NO: 3351220 - RNA, 19 nt, Human
uaacaggcagauacaggaa

SEQ ID NO: 3351221 - RNA, 14 nt, Human
uaaccagcagaaau

SEQ ID NO: 3351222 - RNA, 16 nt, Human
uaaccagcagaaaugc

SEQ ID NO: 3351223 - RNA, 19 nt, Human
uaaccagcagaaaugccuu

SEQ ID NO: 3351224 - RNA, 20 nt, Human
uaacuuuuauaaacuuuacc

SEQ ID NO: 3351225 - RNA, 12 nt, Human
uaacagaaaugu

SEQ ID NO: 3351226 - RNA, 14 nt, Human
uaacagaaauguac

SEQ ID NO: 3351227 - RNA, 15 nt, Human
uaacagaaauguaca

SEQ ID NO: 3351228 - RNA, 13 nt, Human
uaacagaaaugua

SEQ ID NO: 3351229 - RNA, 23 nt, Human
uaaacaagaccacguuucuaaag

SEQ ID NO: 3351230 - RNA, 18 nt, Human
uaaacaagaccacguuuc

SEQ ID NO: 3351231 - RNA, 16 nt, Human
uaaacuuuaccuuuuu

SEQ ID NO: 3351232 - RNA, 22 nt, Human
uaaacuuuaccuuuuuuauaca

SEQ ID NO: 3351233 - RNA, 14 nt, Human
uaaacuuaaucuaa

SEQ ID NO: 3351234 - RNA, 13 nt, Human
uaaacuuaaucua

SEQ ID NO: 3351235 - RNA, 18 nt, Human
uaaacuuaaucuaaaugg

SEQ ID NO: 3351236 - RNA, 19 nt, Human
uaaacuuaaucuaaaugga

SEQ ID NO: 3351237 - RNA, 19 nt, Human
uaaaucagccguguaacca

SEQ ID NO: 3351238 - RNA, 21 nt, Human
uaaaguguauuuuuuuacuaa

SEQ ID NO: 3351239 - RNA, 22 nt, Human
uaaaguguauuuuuuuacuaau

SEQ ID NO: 3351240 - RNA, 23 nt, Human
uaaaguguauuuuuuuacuaaua

SEQ ID NO: 3351241 - RNA, 20 nt, Human
uaaaguguauuuuuuuacua

SEQ ID NO: 3351242 - RNA, 13 nt, Human
uaaaguuucuguu

SEQ ID NO: 3351243 - RNA, 19 nt, Human
guuuuuauggcuuuugugc

SEQ ID NO: 3351244 - RNA, 22 nt, Human
guuuuuauggcuuuugugcauu

SEQ ID NO: 3351245 - RNA, 23 nt, Human
guuuuuauggcuuuugugcauua

SEQ ID NO: 3351246 - RNA, 12 nt, Human
guuuucucuuga

SEQ ID NO: 3351247 - RNA, 19 nt, Human
guuuucucuugagagggug

SEQ ID NO: 3351248 - RNA, 17 nt, Human
guuuucaguguacaugg

SEQ ID NO: 3351249 - RNA, 16 nt, Human
guuuucaguguacaug

SEQ ID NO: 3351250 - RNA, 13 nt, Human
guuuuccugaaga

SEQ ID NO: 3351251 - RNA, 22 nt, Human
uaaaaaugagguacucuccugg

SEQ ID NO: 3351252 - RNA, 20 nt, Human
uaaaaaacugcugacuguuu

SEQ ID NO: 3351253 - RNA, 23 nt, Human
uaaaaaacugcugacuguuuucu

SEQ ID NO: 3351254 - RNA, 16 nt, Human
guuugaaccaagaacu

SEQ ID NO: 3351255 - RNA, 18 nt, Human
guuugagaucagccuggg

SEQ ID NO: 3351256 - RNA, 14 nt, Human
guuucuaaagcugc

SEQ ID NO: 3351257 - RNA, 15 nt, Human
guuucuaaagcugcc

SEQ ID NO: 3351258 - RNA, 16 nt, Human
guuucuaaagcugcca

SEQ ID NO: 3351259 - RNA, 19 nt, Human
guuuguaaauuaacuuuua

SEQ ID NO: 3351260 - RNA, 17 nt, Human
guuuguaaauuaacuuu

SEQ ID NO: 3351261 - RNA, 17 nt, Human
guuugauuaaauucuug

SEQ ID NO: 3351262 - RNA, 19 nt, Human
guuugauuaaauucuugca

SEQ ID NO: 3351263 - RNA, 22 nt, Human
guuugauuaaauucuugcaaag

SEQ ID NO: 3351264 - RNA, 21 nt, Human
guuuccuggcacugcuuccag

SEQ ID NO: 3351265 - RNA, 22 nt, Human
guuuccuggcacugcuuccagu

SEQ ID NO: 3351266 - RNA, 16 nt, Human
guuuccuggcacugcu

SEQ ID NO: 3351267 - RNA, 20 nt, Human
guuuccuggcacugcuucca

SEQ ID NO: 3351268 - RNA, 14 nt, Human
guuucagaaaugug

SEQ ID NO: 3351269 - RNA, 18 nt, Human
guuucagaaauguguuau

SEQ ID NO: 3351270 - RNA, 21 nt, Human
gguuggccccugcccggcugc

SEQ ID NO: 3351271 - RNA, 18 nt, Human
gguuggcaaaaaggcagg

SEQ ID NO: 3351272 - RNA, 15 nt, Human
guuuagauaauacac

SEQ ID NO: 3351273 - RNA, 16 nt, Human
ugggccuccugugugu

SEQ ID NO: 3351274 - RNA, 14 nt, Human
ugggccuccugugu

SEQ ID NO: 3351275 - RNA, 24 nt, Human
ugggagcugccuguucagcuccag

SEQ ID NO: 3351276 - RNA, 19 nt, Human
ugggcuucaguggcagcug

SEQ ID NO: 3351277 - RNA, 18 nt, Human
ugggcuucaguggcagcu

SEQ ID NO: 3351278 - RNA, 13 nt, Human
uggggcagcuuga

SEQ ID NO: 3351279 - RNA, 21 nt, Human
ugggcuuggggaccagagcug

SEQ ID NO: 3351280 - RNA, 16 nt, Human
uggggcagcuugaggg

SEQ ID NO: 3351281 - RNA, 19 nt, Human
ugggcuuggggaccagagc

SEQ ID NO: 3351282 - RNA, 20 nt, Human
ugggcuucaguggcagcugc

SEQ ID NO: 3351283 - RNA, 17 nt, Human
ugggcuucaguggcagc

SEQ ID NO: 3351284 - RNA, 23 nt, Human
ugggugucaagagggucugagga

SEQ ID NO: 3351285 - RNA, 21 nt, Human
ugggugucaagagggucugag

SEQ ID NO: 3351286 - RNA, 16 nt, Human
uggguucacugcaacc

SEQ ID NO: 3351287 - RNA, 23 nt, Human
uggguucaagcgauucuucugcu

SEQ ID NO: 3351288 - RNA, 17 nt, Human
ugggguggggaccucag

SEQ ID NO: 3351289 - RNA, 13 nt, Human
uggcucuuccagg

SEQ ID NO: 3351290 - RNA, 15 nt, Human
uggcucuuccaggcu

SEQ ID NO: 3351291 - RNA, 12 nt, Human
uggcugggggcc

SEQ ID NO: 3351292 - RNA, 16 nt, Human
uggcucuuccaggcug

SEQ ID NO: 3351293 - RNA, 20 nt, Human
uggcucagguggggucacuc

SEQ ID NO: 3351294 - RNA, 22 nt, Human
uggcucagguggggucacucug

SEQ ID NO: 3351295 - RNA, 14 nt, Human
uggcgcugccccug

SEQ ID NO: 3351296 - RNA, 22 nt, Human
uggcgugcaguggugcgaucug

SEQ ID NO: 3351297 - RNA, 22 nt, Human
uggcugguuagagguucccuuu

SEQ ID NO: 3351298 - RNA, 14 nt, Human
uggcugggggccuc

SEQ ID NO: 3351299 - RNA, 21 nt, Human
ugggaaugaaugucaguguga

SEQ ID NO: 3351300 - RNA, 22 nt, Human
ugggaaugaaugucagugugac

SEQ ID NO: 3351301 - RNA, 23 nt, Human
ugggagcugccuguucagcucca

SEQ ID NO: 3351302 - RNA, 16 nt, Human
ugggacaugggaaagg

SEQ ID NO: 3351303 - RNA, 16 nt, Human
uggacaggcauguucu

SEQ ID NO: 3351304 - RNA, 12 nt, Human
uggacaggcaug

SEQ ID NO: 3351305 - RNA, 22 nt, Human
uggaggcaugugaugagaggaa

SEQ ID NO: 3351306 - RNA, 20 nt, Human
uggcagugggagcugccugu

SEQ ID NO: 3351307 - RNA, 19 nt, Human
uggcagugggagcugccug

SEQ ID NO: 3351308 - RNA, 16 nt, Human
uggcagugggagcugc

SEQ ID NO: 3351309 - RNA, 15 nt, Human
uggcagugggagcug

SEQ ID NO: 3351310 - RNA, 14 nt, Human
uggcagugggagcu

SEQ ID NO: 3351311 - RNA, 13 nt, Human
uggcagugggagc

SEQ ID NO: 3351312 - RNA, 22 nt, Human
uggcagcugcgguccacccagg

SEQ ID NO: 3351313 - RNA, 21 nt, Human
uggcagcugcgguccacccag

SEQ ID NO: 3351314 - RNA, 19 nt, Human
uggcagcugcgguccaccc

SEQ ID NO: 3351315 - RNA, 14 nt, Human
uggaugccuggugg

SEQ ID NO: 3351316 - RNA, 14 nt, Human
uggcacugcuucca

SEQ ID NO: 3351317 - RNA, 16 nt, Human
uggcacugcuuccagu

SEQ ID NO: 3351318 - RNA, 18 nt, Human
uggcacugcuuccaguga

SEQ ID NO: 3351319 - RNA, 19 nt, Human
ugcuuccagugaggcucug

SEQ ID NO: 3351320 - RNA, 20 nt, Human
ugcuuccagugaggcucugc

SEQ ID NO: 3351321 - RNA, 16 nt, Human
ugcuuccagugaggcu

SEQ ID NO: 3351322 - RNA, 18 nt, Human
ugcuuccagugaggcucu

SEQ ID NO: 3351323 - RNA, 16 nt, Human
ugcuucuucagagacu

SEQ ID NO: 3351324 - RNA, 13 nt, Human
ugcuucuucagag

SEQ ID NO: 3351325 - RNA, 14 nt, Human
uggaagacagcucu

SEQ ID NO: 3351326 - RNA, 16 nt, Human
uggaaaauaaauuauu

SEQ ID NO: 3351327 - RNA, 15 nt, Human
uggaaaauaaauuau

SEQ ID NO: 3351328 - RNA, 11 nt, Human
uggaagacagc

SEQ ID NO: 3351329 - RNA, 12 nt, Human
uggaagacagcu

SEQ ID NO: 3351330 - RNA, 14 nt, Human
ugccagucaccccg

SEQ ID NO: 3351331 - RNA, 24 nt, Human
ugccagguuuuuggucugacccac

SEQ ID NO: 3351332 - RNA, 11 nt, Human
ugccagggaca

SEQ ID NO: 3351333 - RNA, 22 nt, Human
ugccagggacagaggggguggc

SEQ ID NO: 3351334 - RNA, 15 nt, Human
ugcccaccuggccuc

SEQ ID NO: 3351335 - RNA, 17 nt, Human
ugcccaccuggccucug

SEQ ID NO: 3351336 - RNA, 18 nt, Human
ugcccaccuggccucugc

SEQ ID NO: 3351337 - RNA, 14 nt, Human
ugcccaccuggccu

SEQ ID NO: 3351338 - RNA, 10 nt, Human
ugcccagccc

SEQ ID NO: 3351339 - RNA, 15 nt, Human
ugcaucguuucaucu

SEQ ID NO: 3351340 - RNA, 15 nt, Human
ugcaggcagccaggc

SEQ ID NO: 3351341 - RNA, 16 nt, Human
ugcaggcagccaggcc

SEQ ID NO: 3351342 - RNA, 17 nt, Human
ugcaggcagccaggcca

SEQ ID NO: 3351343 - RNA, 18 nt, Human
ugcaggcagccaggccac

SEQ ID NO: 3351344 - RNA, 21 nt, Human
ugcacagaguuguuacauuuu

SEQ ID NO: 3351345 - RNA, 22 nt, Human
ugcacagaguuguuacauuuuu

SEQ ID NO: 3351346 - RNA, 20 nt, Human
ugcacagaguuguuacauuu

SEQ ID NO: 3351347 - RNA, 23 nt, Human
ugcacagaguuguuacauuuuua

SEQ ID NO: 3351348 - RNA, 17 nt, Human
ugcacagcuaacaugga

SEQ ID NO: 3351349 - RNA, 22 nt, Human
ugaagucuuuguacagacaaca

SEQ ID NO: 3351350 - RNA, 17 nt, Human
ugaagucuuuguacaga

SEQ ID NO: 3351351 - RNA, 20 nt, Human
ugaagucuuuguacagacaa

SEQ ID NO: 3351352 - RNA, 18 nt, Human
ugcacagcuaacauggaa

SEQ ID NO: 3351353 - RNA, 20 nt, Human
ugcacagcuaacauggaagu

SEQ ID NO: 3351354 - RNA, 23 nt, Human
ugcacagcuaacauggaaguacu

SEQ ID NO: 3351355 - RNA, 14 nt, Human
ugcaggaccucagg

SEQ ID NO: 3351356 - RNA, 15 nt, Human
ugcaggaccucaggu

SEQ ID NO: 3351357 - RNA, 16 nt, Human
ugcaggaccucaggug

SEQ ID NO: 3351358 - RNA, 18 nt, Human
ugcaggaccucaggugag

SEQ ID NO: 3351359 - RNA, 14 nt, Human
ugcagcaauaaagc

SEQ ID NO: 3351360 - RNA, 15 nt, Human
ugcagcaauaaagca

SEQ ID NO: 3351361 - RNA, 16 nt, Human
ugcagcaauaaagcag

SEQ ID NO: 3351362 - RNA, 16 nt, Human
ugcacguacacacaca

SEQ ID NO: 3351363 - RNA, 16 nt, Human
ugcacuugcagacucu

SEQ ID NO: 3351364 - RNA, 21 nt, Human
ugcacuugcagacucuacaga

SEQ ID NO: 3351365 - RNA, 14 nt, Human
ugcacuuuguucug

SEQ ID NO: 3351366 - RNA, 15 nt, Human
ugcacuuuguucugg

SEQ ID NO: 3351367 - RNA, 18 nt, Human
ugcacuuuguucuggcuc

SEQ ID NO: 3351368 - RNA, 19 nt, Human
ugcacuuuguucuggcucu

SEQ ID NO: 3351369 - RNA, 16 nt, Human
ugccuccuuugugagg

SEQ ID NO: 3351370 - RNA, 17 nt, Human
ugccuccuuugugagga

SEQ ID NO: 3351371 - RNA, 18 nt, Human
ugccuccuuugugaggaa

SEQ ID NO: 3351372 - RNA, 14 nt, Human
ugccucugggacug

SEQ ID NO: 3351373 - RNA, 17 nt, Human
ugccugaagucacacag

SEQ ID NO: 3351374 - RNA, 18 nt, Human
ugccugaagucacacagu

SEQ ID NO: 3351375 - RNA, 22 nt, Human
ugccugaagucacacagugagu

SEQ ID NO: 3351376 - RNA, 11 nt, Human
ugcccagcccc

SEQ ID NO: 3351377 - RNA, 23 nt, Human
ugcccaggcuggcgugcaguggu

SEQ ID NO: 3351378 - RNA, 15 nt, Human
ugccuaaguauuaaa

SEQ ID NO: 3351379 - RNA, 13 nt, Human
ugccuaaguauua

SEQ ID NO: 3351380 - RNA, 21 nt, Human
ugccuaaguauuaaaacauug

SEQ ID NO: 3351381 - RNA, 20 nt, Human
ugccuaaguauuaaaacauu

SEQ ID NO: 3351382 - RNA, 19 nt, Human
ugccuaaguauuaaaacau

SEQ ID NO: 3351383 - RNA, 17 nt, Human
ugccuaaguauuaaaac

SEQ ID NO: 3351384 - RNA, 23 nt, Human
ugccuaaguauuaaaacauugga

SEQ ID NO: 3351385 - RNA, 22 nt, Human
ugccuaaguauuaaaacauugg

SEQ ID NO: 3351386 - RNA, 18 nt, Human
ugccuuauggaacacucu

SEQ ID NO: 3351387 - RNA, 20 nt, Human
ugccuuauggaacacucuga

SEQ ID NO: 3351388 - RNA, 21 nt, Human
ugccuuauggaacacucugag

SEQ ID NO: 3351389 - RNA, 22 nt, Human
ugccuuauggaacacucugaga

SEQ ID NO: 3351390 - RNA, 21 nt, Human
ugccuggauggggcugcaccg

SEQ ID NO: 3351391 - RNA, 23 nt, Human
ugcggugcuaucucccccagccc

SEQ ID NO: 3351392 - RNA, 21 nt, Human
ugcggugcuaucucccccagc

SEQ ID NO: 3351393 - RNA, 19 nt, Human
ugcuccuggcccacugcau

SEQ ID NO: 3351394 - RNA, 22 nt, Human
ugcugaaugguuuucaaaauaa

SEQ ID NO: 3351395 - RNA, 18 nt, Human
ugcugaaugguuuucaaa

SEQ ID NO: 3351396 - RNA, 17 nt, Human
ugcugaaugguuuucaa

SEQ ID NO: 3351397 - RNA, 18 nt, Human
ugcugaauacagaggcaa

SEQ ID NO: 3351398 - RNA, 23 nt, Human
ugcugaauacagaggcaacugca

SEQ ID NO: 3351399 - RNA, 21 nt, Human
ugcugaaggcucgagcaugcc

SEQ ID NO: 3351400 - RNA, 16 nt, Human
ugcugacagacacagg

SEQ ID NO: 3351401 - RNA, 23 nt, Human
ugcugagucugaaggcuggguuc

SEQ ID NO: 3351402 - RNA, 15 nt, Human
ugcugacagacacag

SEQ ID NO: 3351403 - RNA, 18 nt, Human
ugcugauggugcaaugac

SEQ ID NO: 3351404 - RNA, 20 nt, Human
ugcugauggugcaaugaccu

SEQ ID NO: 3351405 - RNA, 23 nt, Human
ugcugauggugcaaugaccuuuc

SEQ ID NO: 3351406 - RNA, 15 nt, Human
ugcugcaguugccag

SEQ ID NO: 3351407 - RNA, 19 nt, Human
ugcuccucuccccagcaag

SEQ ID NO: 3351408 - RNA, 18 nt, Human
ugcuccucuccccagcaa

SEQ ID NO: 3351409 - RNA, 16 nt, Human
ugcuaggaacacuccu

SEQ ID NO: 3351410 - RNA, 17 nt, Human
ugcuaggaacacuccuu

SEQ ID NO: 3351411 - RNA, 19 nt, Human
ugcuaggaacacuccuuca

SEQ ID NO: 3351412 - RNA, 15 nt, Human
ugcgugcauaccacu

SEQ ID NO: 3351413 - RNA, 23 nt, Human
uguaucccaugagccucagcauc

SEQ ID NO: 3351414 - RNA, 19 nt, Human
uguaucccaugagccucag

SEQ ID NO: 3351415 - RNA, 16 nt, Human
uguaucccaugagccu

SEQ ID NO: 3351416 - RNA, 12 nt, Human
ugucagugugac

SEQ ID NO: 3351417 - RNA, 20 nt, Human
ugucagugugacugaucucu

SEQ ID NO: 3351418 - RNA, 19 nt, Human
ugucagugugacugaucuc

SEQ ID NO: 3351419 - RNA, 16 nt, Human
uguacgucugacaggc

SEQ ID NO: 3351420 - RNA, 17 nt, Human
uguacgucugacaggca

SEQ ID NO: 3351421 - RNA, 14 nt, Human
uguagagugggagc

SEQ ID NO: 3351422 - RNA, 23 nt, Human
uguaccucuugagccuugaacuu

SEQ ID NO: 3351423 - RNA, 22 nt, Human
uguaccucuugagccuugaacu

SEQ ID NO: 3351424 - RNA, 14 nt, Human
uguaccucuugagc

SEQ ID NO: 3351425 - RNA, 13 nt, Human
uguaaauuaacuu

SEQ ID NO: 3351426 - RNA, 14 nt, Human
uguaaauuaacuuu

SEQ ID NO: 3351427 - RNA, 15 nt, Human
uguaaauuaacuuuu

SEQ ID NO: 3351428 - RNA, 16 nt, Human
uguaaauuaacuuuua

SEQ ID NO: 3351429 - RNA, 17 nt, Human
uguaaauuaacuuuuau

SEQ ID NO: 3351430 - RNA, 21 nt, Human
ugugauacaaugcugugcccu

SEQ ID NO: 3351431 - RNA, 19 nt, Human
ugugaguacuacaguccuc

SEQ ID NO: 3351432 - RNA, 20 nt, Human
ugugaguacuacaguccucc

SEQ ID NO: 3351433 - RNA, 23 nt, Human
ugugaguacuacaguccucccau

SEQ ID NO: 3351434 - RNA, 18 nt, Human
ugugaguacuacaguccu

SEQ ID NO: 3351435 - RNA, 21 nt, Human
ugugacaaggauugcuacugu

SEQ ID NO: 3351436 - RNA, 16 nt, Human
ugucuuuuuucacuac

SEQ ID NO: 3351437 - RNA, 19 nt, Human
ugucuuuggacccugaggc

SEQ ID NO: 3351438 - RNA, 22 nt, Human
ugucuuuggacccugaggccca

SEQ ID NO: 3351439 - RNA, 17 nt, Human
ugucuuuggacccugag

SEQ ID NO: 3351440 - RNA, 18 nt, Human
ugucuuuggacccugagg

SEQ ID NO: 3351441 - RNA, 13 nt, Human
ugugaaaggaaag

SEQ ID NO: 3351442 - RNA, 14 nt, Human
ugugaaaggaaaga

SEQ ID NO: 3351443 - RNA, 20 nt, Human
ugugcgugcauguguguuca

SEQ ID NO: 3351444 - RNA, 17 nt, Human
ugugccucugggacugg

SEQ ID NO: 3351445 - RNA, 16 nt, Human
ugugccucugggacug

SEQ ID NO: 3351446 - RNA, 15 nt, Human
ugugccucugggacu

SEQ ID NO: 3351447 - RNA, 13 nt, Human
ugugccucuggga

SEQ ID NO: 3351448 - RNA, 22 nt, Human
ugugcacaugcacgugugugca

SEQ ID NO: 3351449 - RNA, 16 nt, Human
ugugcacaugcacgug

SEQ ID NO: 3351450 - RNA, 13 nt, Human
uguggacacagcu

SEQ ID NO: 3351451 - RNA, 14 nt, Human
uguggacacagcuc

SEQ ID NO: 3351452 - RNA, 12 nt, Human
uguggagaagcg

SEQ ID NO: 3351453 - RNA, 15 nt, Human
uguggacacagcucu

SEQ ID NO: 3351454 - RNA, 12 nt, Human
ugugggaagggg

SEQ ID NO: 3351455 - RNA, 22 nt, Human
ugugggcuaguugggcuuccuc

SEQ ID NO: 3351456 - RNA, 13 nt, Human
uguuuuugucuua

SEQ ID NO: 3351457 - RNA, 17 nt, Human
uuaaaacaacacucaca

SEQ ID NO: 3351458 - RNA, 20 nt, Human
uguuuccuggcacugcuucc

SEQ ID NO: 3351459 - RNA, 21 nt, Human
uguuuccuggcacugcuucca

SEQ ID NO: 3351460 - RNA, 22 nt, Human
uguuuccuggcacugcuuccag

SEQ ID NO: 3351461 - RNA, 15 nt, Human
uguuuccuggcacug

SEQ ID NO: 3351462 - RNA, 17 nt, Human
uguuuguugucagcuga

SEQ ID NO: 3351463 - RNA, 16 nt, Human
uguuuguugucagcug

SEQ ID NO: 3351464 - RNA, 17 nt, Human
uuaaaugcccagccccu

SEQ ID NO: 3351465 - RNA, 18 nt, Human
uuaaaugcccagccccuu

SEQ ID NO: 3351466 - RNA, 17 nt, Human
uuaaaugcaccuggaau

SEQ ID NO: 3351467 - RNA, 18 nt, Human
uuaaaugcaccuggaaua

SEQ ID NO: 3351468 - RNA, 16 nt, Human
uuaaaugcaccuggaa

SEQ ID NO: 3351469 - RNA, 11 nt, Human
uuaaaugcacc

SEQ ID NO: 3351470 - RNA, 16 nt, Human
uuaaacuuaaucuaaa

SEQ ID NO: 3351471 - RNA, 18 nt, Human
uuaaacuuaaucuaaaug

SEQ ID NO: 3351472 - RNA, 20 nt, Human
uuaaacuuaaucuaaaugga

SEQ ID NO: 3351473 - RNA, 17 nt, Human
uuaaggaugcuuguaca

SEQ ID NO: 3351474 - RNA, 18 nt, Human
uuaaggaugcuuguacau

SEQ ID NO: 3351475 - RNA, 19 nt, Human
uuaaggaugcuuguacaua

SEQ ID NO: 3351476 - RNA, 20 nt, Human
uuaaggaugcuuguacauaa

SEQ ID NO: 3351477 - RNA, 21 nt, Human
uuaaggaagacaaugugaaaa

SEQ ID NO: 3351478 - RNA, 22 nt, Human
uuaaggaugcuuguacauaaug

SEQ ID NO: 3351479 - RNA, 18 nt, Human
uuaaugucacaggcaggu

SEQ ID NO: 3351480 - RNA, 17 nt, Human
uuaaugucacaggcagg

SEQ ID NO: 3351481 - RNA, 22 nt, Human
uuaccuuuuuuauacauaaaca

SEQ ID NO: 3351482 - RNA, 19 nt, Human
uuaccuuuuuuauacauaa

SEQ ID NO: 3351483 - RNA, 20 nt, Human
uuaccuuuuuuauacauaaa

SEQ ID NO: 3351484 - RNA, 20 nt, Human
uuacgguuuuccagguuuaa

SEQ ID NO: 3351485 - RNA, 20 nt, Human
uuacauuuuuaagugcugca

SEQ ID NO: 3351486 - RNA, 21 nt, Human
uuacauuuuuaagugcugcau

SEQ ID NO: 3351487 - RNA, 22 nt, Human
uuacauuuuuaagugcugcauu

SEQ ID NO: 3351488 - RNA, 16 nt, Human
uguucucugcccucca

SEQ ID NO: 3351489 - RNA, 18 nt, Human
uguucucugaggacacua

SEQ ID NO: 3351490 - RNA, 16 nt, Human
uguucucugaggacac

SEQ ID NO: 3351491 - RNA, 13 nt, Human
uguucucugagga

SEQ ID NO: 3351492 - RNA, 20 nt, Human
uguucuuucuggcuaugcau

SEQ ID NO: 3351493 - RNA, 22 nt, Human
uguucuuucuggcuaugcauuu

SEQ ID NO: 3351494 - RNA, 20 nt, Human
uguucuuuccaaaguacacu

SEQ ID NO: 3351495 - RNA, 11 nt, Human
uguugaaagau

SEQ ID NO: 3351496 - RNA, 15 nt, Human
uguucugacccugcu

SEQ ID NO: 3351497 - RNA, 19 nt, Human
uguucucugcccuccaaga

SEQ ID NO: 3351498 - RNA, 18 nt, Human
uguucugacccugcuuca

SEQ ID NO: 3351499 - RNA, 14 nt, Human
uguucuuucuggcu

SEQ ID NO: 3351500 - RNA, 11 nt, Human
uguuggccagg

SEQ ID NO: 3351501 - RNA, 15 nt, Human
uguuggccaaagcca

SEQ ID NO: 3351502 - RNA, 14 nt, Human
uguuggccaggcug

SEQ ID NO: 3351503 - RNA, 22 nt, Human
uguuacauuuuuaagugcugca

SEQ ID NO: 3351504 - RNA, 13 nt, Human
uguuacauuuuua

SEQ ID NO: 3351505 - RNA, 19 nt, Human
uguuacauaagauaaaugu

SEQ ID NO: 3351506 - RNA, 15 nt, Human
uguuacugucuucag

SEQ ID NO: 3351507 - RNA, 16 nt, Human
uguuacugucuucagu

SEQ ID NO: 3351508 - RNA, 11 nt, Human
uguucagcugg

SEQ ID NO: 3351509 - RNA, 22 nt, Human
uguucagcuccagcucaccagc

SEQ ID NO: 3351510 - RNA, 16 nt, Human
uguucagcuccagcuc

SEQ ID NO: 3351511 - RNA, 15 nt, Human
uguucagcuccagcu

SEQ ID NO: 3351512 - RNA, 14 nt, Human
uguucagcuccagc

SEQ ID NO: 3351513 - RNA, 16 nt, Human
uguguagggcgggagg

SEQ ID NO: 3351514 - RNA, 12 nt, Human
uuuuuuacuaau

SEQ ID NO: 3351515 - RNA, 17 nt, Human
uuuuuuccuucagugcc

SEQ ID NO: 3351516 - RNA, 20 nt, Human
uuucaauaggaaaaacugau

SEQ ID NO: 3351517 - RNA, 22 nt, Human
uuucaauaggaaaaacugauuu

SEQ ID NO: 3351518 - RNA, 19 nt, Human
uuucaauaggaaaaacuga

SEQ ID NO: 3351519 - RNA, 22 nt, Human
uuucauugcugggcuugucugu

SEQ ID NO: 3351520 - RNA, 15 nt, Human
uuucagccaagaauu

SEQ ID NO: 3351521 - RNA, 13 nt, Human
uuuccaggaaggc

SEQ ID NO: 3351522 - RNA, 12 nt, Human
uuuccaaaguac

SEQ ID NO: 3351523 - RNA, 15 nt, Human
uuuccaaaguacacu

SEQ ID NO: 3351524 - RNA, 15 nt, Human
uuucuagccagagga

SEQ ID NO: 3351525 - RNA, 21 nt, Human
uuuccucuuuggucuacacug

SEQ ID NO: 3351526 - RNA, 14 nt, Human
uuucuaaaggcuac

SEQ ID NO: 3351527 - RNA, 14 nt, Human
uuucuaaagcugcc

SEQ ID NO: 3351528 - RNA, 17 nt, Human
uuucuaaagcugccagc

SEQ ID NO: 3351529 - RNA, 14 nt, Human
uuuauugucaaagu

SEQ ID NO: 3351530 - RNA, 16 nt, Human
uuuauugucaaagugg

SEQ ID NO: 3351531 - RNA, 19 nt, Human
uuuauuuaguuccuugagu

SEQ ID NO: 3351532 - RNA, 14 nt, Human
uuuauaaacuuuac

SEQ ID NO: 3351533 - RNA, 16 nt, Human
uuuaucgucacugcuu

SEQ ID NO: 3351534 - RNA, 16 nt, Human
uuuauaaacuuuaccu

SEQ ID NO: 3351535 - RNA, 21 nt, Human
uuuaucgucacugcuuaacuu

SEQ ID NO: 3351536 - RNA, 15 nt, Human
uuuacuuuguguuca

SEQ ID NO: 3351537 - RNA, 16 nt, Human
uuuguaaauuaacuuu

SEQ ID NO: 3351538 - RNA, 17 nt, Human
uuuguaaauuaacuuuu

SEQ ID NO: 3351539 - RNA, 15 nt, Human
uuuguaaauuaacuu

SEQ ID NO: 3351540 - RNA, 19 nt, Human
uuuggugguuucagaaaug

SEQ ID NO: 3351541 - RNA, 13 nt, Human
uuuguccccaccg

SEQ ID NO: 3351542 - RNA, 21 nt, Human
uuuguccccaccgcagacagg

SEQ ID NO: 3351543 - RNA, 16 nt, Human
uuuguugucagcugaa

SEQ ID NO: 3351544 - RNA, 17 nt, Human
uuugaggucuguucuuu

SEQ ID NO: 3351545 - RNA, 22 nt, Human
uuugaggucuguucuuuccaaa

SEQ ID NO: 3351546 - RNA, 15 nt, Human
uuugagcagggcuca

SEQ ID NO: 3351547 - RNA, 14 nt, Human
uuugcagacaggca

SEQ ID NO: 3351548 - RNA, 18 nt, Human
uuugccauguuggccagg

SEQ ID NO: 3351549 - RNA, 14 nt, Human
uuuucuucucccuc

SEQ ID NO: 3351550 - RNA, 17 nt, Human
uuuucuugcaugaggcu

SEQ ID NO: 3351551 - RNA, 15 nt, Human
uuuuccuucagugcc

SEQ ID NO: 3351552 - RNA, 18 nt, Human
uuuuccaugaguccccug

SEQ ID NO: 3351553 - RNA, 19 nt, Human
uuuuccaugaguccccugu

SEQ ID NO: 3351554 - RNA, 15 nt, Human
uuuucacaguucucu

SEQ ID NO: 3351555 - RNA, 18 nt, Human
uuuucaaggcuuauauuc

SEQ ID NO: 3351556 - RNA, 18 nt, Human
uuuuaucgucacugcuua

SEQ ID NO: 3351557 - RNA, 16 nt, Human
uucucuccagccccug

SEQ ID NO: 3351558 - RNA, 18 nt, Human
uucucuccagccccugga

SEQ ID NO: 3351559 - RNA, 22 nt, Human
uucucuccuguaccucuugagc

SEQ ID NO: 3351560 - RNA, 16 nt, Human
uucuccaagcaggaca

SEQ ID NO: 3351561 - RNA, 13 nt, Human
uucuccacccugc

SEQ ID NO: 3351562 - RNA, 11 nt, Human
uucuccaggcu

SEQ ID NO: 3351563 - RNA, 16 nt, Human
uucugacccaugcugc

SEQ ID NO: 3351564 - RNA, 18 nt, Human
uucugacccaugcugccc

SEQ ID NO: 3351565 - RNA, 20 nt, Human
uucugacccaugcugcccug

SEQ ID NO: 3351566 - RNA, 21 nt, Human
uucugacccaugcugcccugu

SEQ ID NO: 3351567 - RNA, 21 nt, Human
uucugacccugcuucaaauau

SEQ ID NO: 3351568 - RNA, 20 nt, Human
uucucugaggacacuaacca

SEQ ID NO: 3351569 - RNA, 17 nt, Human
uucucugcccuccaaga

SEQ ID NO: 3351570 - RNA, 14 nt, Human
uucuauuguuucuu

SEQ ID NO: 3351571 - RNA, 16 nt, Human
uucuaugacacaugca

SEQ ID NO: 3351572 - RNA, 17 nt, Human
uucuaugacacaugcaa

SEQ ID NO: 3351573 - RNA, 22 nt, Human
uuccucccucccucuuucccuc

SEQ ID NO: 3351574 - RNA, 21 nt, Human
uuccucccucccucuuucccu

SEQ ID NO: 3351575 - RNA, 19 nt, Human
uuccucccucccucuuucc

SEQ ID NO: 3351576 - RNA, 12 nt, Human
uuccucccuccc

SEQ ID NO: 3351577 - RNA, 23 nt, Human
uuccucauaguaugguggcuggg

SEQ ID NO: 3351578 - RNA, 22 nt, Human
uuccccacuugagaauuacccu

SEQ ID NO: 3351579 - RNA, 19 nt, Human
uucccuuugacgccauccc

SEQ ID NO: 3351580 - RNA, 19 nt, Human
uuccuucauucaacccacc

SEQ ID NO: 3351581 - RNA, 23 nt, Human
uuccuucagugccuuauggaaca

SEQ ID NO: 3351582 - RNA, 16 nt, Human
uuccuucagugccuua

SEQ ID NO: 3351583 - RNA, 19 nt, Human
uuccuucagugccuuaugg

SEQ ID NO: 3351584 - RNA, 15 nt, Human
uuccuucagugccuu

SEQ ID NO: 3351585 - RNA, 16 nt, Human
uucuaaaggcuaccuu

SEQ ID NO: 3351586 - RNA, 17 nt, Human
uucuaaagcugccagcc

SEQ ID NO: 3351587 - RNA, 17 nt, Human
uucuaaaggcuaccuuu

SEQ ID NO: 3351588 - RNA, 18 nt, Human
uucuaaaggcuaccuuug

SEQ ID NO: 3351589 - RNA, 13 nt, Human
uucaaagauauuu

SEQ ID NO: 3351590 - RNA, 13 nt, Human
uuacgugaguccu

SEQ ID NO: 3351591 - RNA, 14 nt, Human
uuacgugaguccug

SEQ ID NO: 3351592 - RNA, 17 nt, Human
uuacuaaaauauauaua

SEQ ID NO: 3351593 - RNA, 14 nt, Human
uuacuaaaauauau

SEQ ID NO: 3351594 - RNA, 18 nt, Human
uucaauucucauuuguca

SEQ ID NO: 3351595 - RNA, 14 nt, Human
uucacucuccuugg

SEQ ID NO: 3351596 - RNA, 22 nt, Human
uucagcuccagcucaccagccc

SEQ ID NO: 3351597 - RNA, 15 nt, Human
uucagagacuccugc

SEQ ID NO: 3351598 - RNA, 18 nt, Human
uucagcugcauacaguuu

SEQ ID NO: 3351599 - RNA, 17 nt, Human
uucagcugacuuuucug

SEQ ID NO: 3351600 - RNA, 16 nt, Human
uucaggaagcucaggg

SEQ ID NO: 3351601 - RNA, 17 nt, Human
uucagcucugcaagaau

SEQ ID NO: 3351602 - RNA, 24 nt, Human
uucagcucugcaagaauugaagca

SEQ ID NO: 3351603 - RNA, 23 nt, Human
uucagcuccagcucaccagcccc

SEQ ID NO: 3351604 - RNA, 15 nt, Human
uucaggaagcucagg

SEQ ID NO: 3351605 - RNA, 20 nt, Human
uucaggaagcucagggccug

SEQ ID NO: 3351606 - RNA, 17 nt, Human
uucaggaagcucagggc

SEQ ID NO: 3351607 - RNA, 19 nt, Human
uucaggaagcucagggccu

SEQ ID NO: 3351608 - RNA, 13 nt, Human
uucauaaugacuu

SEQ ID NO: 3351609 - RNA, 23 nt, Human
uucauaaugacuuaagcacacuu

SEQ ID NO: 3351610 - RNA, 19 nt, Human
uucagugccuuauggaaca

SEQ ID NO: 3351611 - RNA, 21 nt, Human
uucagugccuuauggaacacu

SEQ ID NO: 3351612 - RNA, 18 nt, Human
uucagugccuuauggaac

SEQ ID NO: 3351613 - RNA, 18 nt, Human
uucauuuaggugaggaag

SEQ ID NO: 3351614 - RNA, 19 nt, Human
uucauuuaggugaggaagc

SEQ ID NO: 3351615 - RNA, 12 nt, Human
uucaucuugaau

SEQ ID NO: 3351616 - RNA, 20 nt, Human
uucaucuuccaacucaaacu

SEQ ID NO: 3351617 - RNA, 11 nt, Human
uucaucuugaa

SEQ ID NO: 3351618 - RNA, 17 nt, Human
uuccaugaguccccugu

SEQ ID NO: 3351619 - RNA, 18 nt, Human
uugauuuccguuaaaaua

SEQ ID NO: 3351620 - RNA, 17 nt, Human
uugcaacaggcugggcu

SEQ ID NO: 3351621 - RNA, 14 nt, Human
uugcaacaggcugg

SEQ ID NO: 3351622 - RNA, 18 nt, Human
uugauagcacagacccug

SEQ ID NO: 3351623 - RNA, 21 nt, Human
uugauagcacagacccugccc

SEQ ID NO: 3351624 - RNA, 16 nt, Human
uugcagacaggcaagc

SEQ ID NO: 3351625 - RNA, 20 nt, Human
uugaccgugaggccagagac

SEQ ID NO: 3351626 - RNA, 21 nt, Human
uugaccgugaggccagagaca

SEQ ID NO: 3351627 - RNA, 17 nt, Human
uugaccgugaggccaga

SEQ ID NO: 3351628 - RNA, 16 nt, Human
uugaccucugcagcaa

SEQ ID NO: 3351629 - RNA, 15 nt, Human
uugaccucaggugau

SEQ ID NO: 3351630 - RNA, 14 nt, Human
uugacgccauccca

SEQ ID NO: 3351631 - RNA, 22 nt, Human
uugacgccaucccagccccaau

SEQ ID NO: 3351632 - RNA, 12 nt, Human
uugaccugaggc

SEQ ID NO: 3351633 - RNA, 19 nt, Human
uugaccugaggcccuucuc

SEQ ID NO: 3351634 - RNA, 22 nt, Human
uugaccugaggcccuucucucc

SEQ ID NO: 3351635 - RNA, 20 nt, Human
uugacgccaucccagcccca

SEQ ID NO: 3351636 - RNA, 19 nt, Human
uugauagcacagacccugc

SEQ ID NO: 3351637 - RNA, 20 nt, Human
uugauagcacagacccugcc

SEQ ID NO: 3351638 - RNA, 23 nt, Human
uucuugguuuguaaauuaacuuu

SEQ ID NO: 3351639 - RNA, 17 nt, Human
uucuugguuuguaaauu

SEQ ID NO: 3351640 - RNA, 18 nt, Human
uucuugguuuguaaauua

SEQ ID NO: 3351641 - RNA, 13 nt, Human
uucuugguuugua

SEQ ID NO: 3351642 - RNA, 16 nt, Human
uucuugguuuguaaau

SEQ ID NO: 3351643 - RNA, 23 nt, Human
uucuuauuuaaugaaagacugua

SEQ ID NO: 3351644 - RNA, 19 nt, Human
uucuuauuuaaugaaagac

SEQ ID NO: 3351645 - RNA, 23 nt, Human
uucuguggguuucuaaagcugcc

SEQ ID NO: 3351646 - RNA, 17 nt, Human
uucuguccuacucugug

SEQ ID NO: 3351647 - RNA, 17 nt, Human
uucuguccgagcuuuga

SEQ ID NO: 3351648 - RNA, 21 nt, Human
uucuguccgagcuuugaaaau

SEQ ID NO: 3351649 - RNA, 19 nt, Human
uugaaaacacuguucucug

SEQ ID NO: 3351650 - RNA, 21 nt, Human
uugaaaacacuguucucugcc

SEQ ID NO: 3351651 - RNA, 18 nt, Human
uucuuuauaauucuacuu

SEQ ID NO: 3351652 - RNA, 16 nt, Human
uugaacugauaaagau

SEQ ID NO: 3351653 - RNA, 19 nt, Human
uugaacucuucaaucucuu

SEQ ID NO: 3351654 - RNA, 22 nt, Human
uugaacuuugaccucugcagca

SEQ ID NO: 3351655 - RNA, 20 nt, Human
uugaacuuugaccucugcag

SEQ ID NO: 3351656 - RNA, 17 nt, Human
uugaagacagagcuaca

SEQ ID NO: 3351657 - RNA, 19 nt, Human
uugaagacuuuucuuucag

SEQ ID NO: 3351658 - RNA, 17 nt, Human
uuggcaaaaaggcagga

SEQ ID NO: 3351659 - RNA, 11 nt, Human
uuggaaggaac

SEQ ID NO: 3351660 - RNA, 19 nt, Human
uuggaaggaacguccccug

SEQ ID NO: 3351661 - RNA, 23 nt, Human
uuggaaagaguaggaagacuuug

SEQ ID NO: 3351662 - RNA, 20 nt, Human
uugcuggggccgaaagaaca

SEQ ID NO: 3351663 - RNA, 22 nt, Human
uugcugauggugcaaugaccuu

SEQ ID NO: 3351664 - RNA, 20 nt, Human
uugcugauggugcaaugacc

SEQ ID NO: 3351665 - RNA, 19 nt, Human
uugcugauggugcaaugac

SEQ ID NO: 3351666 - RNA, 18 nt, Human
uugccucugccucugaca

SEQ ID NO: 3351667 - RNA, 16 nt, Human
uugccucugccucuga

SEQ ID NO: 3351668 - RNA, 14 nt, Human
uugccucugccucu

SEQ ID NO: 3351669 - RNA, 11 nt, Human
uugccucugcc

SEQ ID NO: 3351670 - RNA, 18 nt, Human
uugccagucaccccggcc

SEQ ID NO: 3351671 - RNA, 13 nt, Human
uugccagucaccc

SEQ ID NO: 3351672 - RNA, 23 nt, Human
uugcccacgcuggagugcaguga

SEQ ID NO: 3351673 - RNA, 15 nt, Human
uuguagagccagggu

SEQ ID NO: 3351674 - RNA, 14 nt, Human
uuguagagccaggg

SEQ ID NO: 3351675 - RNA, 21 nt, Human
uuguauucucuccuguaccuc

SEQ ID NO: 3351676 - RNA, 12 nt, Human
uuguacagacaa

SEQ ID NO: 3351677 - RNA, 13 nt, Human
uuguacagacaac

SEQ ID NO: 3351678 - RNA, 12 nt, Human
uugguccugcug

SEQ ID NO: 3351679 - RNA, 22 nt, Human
uuggucccccuuccauggacuu

SEQ ID NO: 3351680 - RNA, 16 nt, Human
uuggucccccuuccau

SEQ ID NO: 3351681 - RNA, 13 nt, Human
uuggcauucccca

SEQ ID NO: 3351682 - RNA, 24 nt, Human
uuggccaaagccaaagcuaggccu

SEQ ID NO: 3351683 - RNA, 14 nt, Human
uuggccaggcuggu

SEQ ID NO: 3351684 - RNA, 16 nt, Human
uuggcugcugaaggcu

SEQ ID NO: 3351685 - RNA, 18 nt, Human
uuggcugggggccucagu

SEQ ID NO: 3351686 - RNA, 22 nt, Human
uuggcugggggccucagugcca

SEQ ID NO: 3351687 - RNA, 21 nt, Human
uuggcugggggccucagugcc

SEQ ID NO: 3351688 - RNA, 16 nt, Human
uuggguggaugccugg

SEQ ID NO: 3351689 - RNA, 22 nt, Human
uuggcuuuggguugcaggaccu

SEQ ID NO: 3351690 - RNA, 16 nt, Human
uugggaggccauuugu

SEQ ID NO: 3351691 - RNA, 22 nt, Human
ccccaaauggaaaugggcagag

SEQ ID NO: 3351692 - RNA, 21 nt, Human
ccccaaauggaaaugggcaga

SEQ ID NO: 3351693 - RNA, 14 nt, Human
ccccacccaagggc

SEQ ID NO: 3351694 - RNA, 20 nt, Human
ccccacccaagggccuggcc

SEQ ID NO: 3351695 - RNA, 17 nt, Human
cccaugcugcccuguga

SEQ ID NO: 3351696 - RNA, 14 nt, Human
cccaugcugcccug

SEQ ID NO: 3351697 - RNA, 15 nt, Human
cccaugcugcccugu

SEQ ID NO: 3351698 - RNA, 16 nt, Human
cccaugcugcccugug

SEQ ID NO: 3351699 - RNA, 18 nt, Human
cccagugccgagaaggaa

SEQ ID NO: 3351700 - RNA, 17 nt, Human
cccagugccgagaagga

SEQ ID NO: 3351701 - RNA, 20 nt, Human
cccagugcccacaggaucag

SEQ ID NO: 3351702 - RNA, 15 nt, Human
cccagugcccacagg

SEQ ID NO: 3351703 - RNA, 17 nt, Human
ccccaggaggccagccu

SEQ ID NO: 3351704 - RNA, 13 nt, Human
cccaggcaggucu

SEQ ID NO: 3351705 - RNA, 11 nt, Human
cccaggcaggu

SEQ ID NO: 3351706 - RNA, 18 nt, Human
cccaggaggccagccuug

SEQ ID NO: 3351707 - RNA, 22 nt, Human
cccaggaggccagccuugacca

SEQ ID NO: 3351708 - RNA, 18 nt, Human
cccaggagccccgaggcc

SEQ ID NO: 3351709 - RNA, 21 nt, Human
cccaggagccccgaggccuuc

SEQ ID NO: 3351710 - RNA, 22 nt, Human
cccaggccccugccacccuggg

SEQ ID NO: 3351711 - RNA, 21 nt, Human
cccaggccccugccacccugg

SEQ ID NO: 3351712 - RNA, 18 nt, Human
cccaggccccugccaccc

SEQ ID NO: 3351713 - RNA, 16 nt, Human
cccaggccccugccac

SEQ ID NO: 3351714 - RNA, 11 nt, Human
cccaggccccu

SEQ ID NO: 3351715 - RNA, 22 nt, Human
cccaggcauuccccaggaggcc

SEQ ID NO: 3351716 - RNA, 23 nt, Human
cccaggcauuccccaggaggcca

SEQ ID NO: 3351717 - RNA, 20 nt, Human
cccaggcauuccccaggagg

SEQ ID NO: 3351718 - RNA, 21 nt, Human
cccaggcauuccccaggaggc

SEQ ID NO: 3351719 - RNA, 18 nt, Human
cccaggcauuccccagga

SEQ ID NO: 3351720 - RNA, 17 nt, Human
cccaggccuccuacagc

SEQ ID NO: 3351721 - RNA, 18 nt, Human
cccaggccuccuacagcu

SEQ ID NO: 3351722 - RNA, 13 nt, Human
cccagugcccaca

SEQ ID NO: 3351723 - RNA, 20 nt, Human
cccagucuggaaugcagugg

SEQ ID NO: 3351724 - RNA, 23 nt, Human
cccaggugcuaggaacacuccuu

SEQ ID NO: 3351725 - RNA, 22 nt, Human
cccaggugcuaggaacacuccu

SEQ ID NO: 3351726 - RNA, 15 nt, Human
cccagcgagcccugg

SEQ ID NO: 3351727 - RNA, 18 nt, Human
cccagcgagcccuggugg

SEQ ID NO: 3351728 - RNA, 17 nt, Human
cccagcgagcccuggug

SEQ ID NO: 3351729 - RNA, 23 nt, Human
cccagcgagcccugguggcagug

SEQ ID NO: 3351730 - RNA, 19 nt, Human
cccagcgagcccugguggc

SEQ ID NO: 3351731 - RNA, 12 nt, Human
cccagccugcua

SEQ ID NO: 3351732 - RNA, 22 nt, Human
cccagcaagugagagcugggug

SEQ ID NO: 3351733 - RNA, 21 nt, Human
cccagcaagugagagcugggu

SEQ ID NO: 3351734 - RNA, 20 nt, Human
cccagcaagugagagcuggg

SEQ ID NO: 3351735 - RNA, 19 nt, Human
cccagcaagugagagcugg

SEQ ID NO: 3351736 - RNA, 11 nt, Human
cccagccccuu

SEQ ID NO: 3351737 - RNA, 20 nt, Human
cccagagggccugcaaggga

SEQ ID NO: 3351738 - RNA, 18 nt, Human
cccagagggccugcaagg

SEQ ID NO: 3351739 - RNA, 18 nt, Human
cccagcaagugagagcug

SEQ ID NO: 3351740 - RNA, 16 nt, Human
cccagcaagugagagc

SEQ ID NO: 3351741 - RNA, 22 nt, Human
cccagauugcaacaggcugggc

SEQ ID NO: 3351742 - RNA, 21 nt, Human
cccagauugcaacaggcuggg

SEQ ID NO: 3351743 - RNA, 20 nt, Human
cccagauugcaacaggcugg

SEQ ID NO: 3351744 - RNA, 23 nt, Human
cccaaugcacuuuguucuggcuc

SEQ ID NO: 3351745 - RNA, 18 nt, Human
cccaagggccuggccuga

SEQ ID NO: 3351746 - RNA, 19 nt, Human
cccaagggccuggccugag

SEQ ID NO: 3351747 - RNA, 23 nt, Human
cccaagggccuggccugagcugg

SEQ ID NO: 3351748 - RNA, 23 nt, Human
cccaaauggaaaugggcagagca

SEQ ID NO: 3351749 - RNA, 17 nt, Human
cccaagggccuggccug

SEQ ID NO: 3351750 - RNA, 20 nt, Human
ccaggaagccagcaggcucu

SEQ ID NO: 3351751 - RNA, 22 nt, Human
ccaggaagccagcaggcucuca

SEQ ID NO: 3351752 - RNA, 14 nt, Human
ccagcucuggucca

SEQ ID NO: 3351753 - RNA, 17 nt, Human
ccagcucugguccauag

SEQ ID NO: 3351754 - RNA, 21 nt, Human
ccagcucugguccauagagag

SEQ ID NO: 3351755 - RNA, 22 nt, Human
ccagcucugguccauagagagc

SEQ ID NO: 3351756 - RNA, 20 nt, Human
ccagcugcuugggcuucauc

SEQ ID NO: 3351757 - RNA, 23 nt, Human
ccagcugcuugggcuucauccuc

SEQ ID NO: 3351758 - RNA, 19 nt, Human
ccagccuugaccauucucc

SEQ ID NO: 3351759 - RNA, 20 nt, Human
ccagccuugaccauucucca

SEQ ID NO: 3351760 - RNA, 16 nt, Human
ccagagcccaccuugg

SEQ ID NO: 3351761 - RNA, 22 nt, Human
ccagagcccaccuuggcucaag

SEQ ID NO: 3351762 - RNA, 14 nt, Human
ccagagcccaccuu

SEQ ID NO: 3351763 - RNA, 16 nt, Human
ccagcgagcccuggug

SEQ ID NO: 3351764 - RNA, 15 nt, Human
ccagcgagcccuggu

SEQ ID NO: 3351765 - RNA, 13 nt, Human
ccagcgagcccug

SEQ ID NO: 3351766 - RNA, 14 nt, Human
ccagcgagcccugg

SEQ ID NO: 3351767 - RNA, 12 nt, Human
ccagcucugguc

SEQ ID NO: 3351768 - RNA, 13 nt, Human
ccagcucuggucc

SEQ ID NO: 3351769 - RNA, 11 nt, Human
ccagcucuggu

SEQ ID NO: 3351770 - RNA, 15 nt, Human
ccaggagcagccaca

SEQ ID NO: 3351771 - RNA, 16 nt, Human
ccaggagcagccacau

SEQ ID NO: 3351772 - RNA, 15 nt, Human
ccaggagccccgagg

SEQ ID NO: 3351773 - RNA, 13 nt, Human
ccaggcauggugg

SEQ ID NO: 3351774 - RNA, 14 nt, Human
ccaggcauucccca

SEQ ID NO: 3351775 - RNA, 24 nt, Human
ccaggcauuccccaggaggccagc

SEQ ID NO: 3351776 - RNA, 23 nt, Human
ccaggcauuccccaggaggccag

SEQ ID NO: 3351777 - RNA, 22 nt, Human
ccaggcauuccccaggaggcca

SEQ ID NO: 3351778 - RNA, 13 nt, Human
ccaggagccuccu

SEQ ID NO: 3351779 - RNA, 14 nt, Human
ccaggagccuccug

SEQ ID NO: 3351780 - RNA, 18 nt, Human
ccaggagccuccugcccu

SEQ ID NO: 3351781 - RNA, 12 nt, Human
ccaggagccucc

SEQ ID NO: 3351782 - RNA, 12 nt, Human
ccaggaggccag

SEQ ID NO: 3351783 - RNA, 13 nt, Human
ccaggaggccagc

SEQ ID NO: 3351784 - RNA, 19 nt, Human
ccaggcuggucucaaacuc

SEQ ID NO: 3351785 - RNA, 14 nt, Human
ccaggcuggucuca

SEQ ID NO: 3351786 - RNA, 20 nt, Human
ccaggcuguaucccaugagc

SEQ ID NO: 3351787 - RNA, 19 nt, Human
ccaggugcuaggaacacuc

SEQ ID NO: 3351788 - RNA, 14 nt, Human
ccagguucagcuug

SEQ ID NO: 3351789 - RNA, 23 nt, Human
ccaguaaaugggggugcauuuga

SEQ ID NO: 3351790 - RNA, 18 nt, Human
ccagugaggcucugcccu

SEQ ID NO: 3351791 - RNA, 19 nt, Human
ccagugaggcucugcccuu

SEQ ID NO: 3351792 - RNA, 20 nt, Human
ccagugaggcucugcccuug

SEQ ID NO: 3351793 - RNA, 17 nt, Human
ccagugaggcucugccc

SEQ ID NO: 3351794 - RNA, 12 nt, Human
ccauccucugua

SEQ ID NO: 3351795 - RNA, 19 nt, Human
ccauccucuguacagagcc

SEQ ID NO: 3351796 - RNA, 17 nt, Human
ccaucauugaaaucuuu

SEQ ID NO: 3351797 - RNA, 22 nt, Human
ccaucauugaaaucuuuuugcu

SEQ ID NO: 3351798 - RNA, 14 nt, Human
ccaugcugcccugu

SEQ ID NO: 3351799 - RNA, 11 nt, Human
ccaugcugccc

SEQ ID NO: 3351800 - RNA, 13 nt, Human
ccaugcugcccug

SEQ ID NO: 3351801 - RNA, 19 nt, Human
ccaugauuaaccacuucag

SEQ ID NO: 3351802 - RNA, 21 nt, Human
ccaugauuaaccacuucagcu

SEQ ID NO: 3351803 - RNA, 18 nt, Human
ccaugauguuuuccauga

SEQ ID NO: 3351804 - RNA, 13 nt, Human
ccauggacuuugu

SEQ ID NO: 3351805 - RNA, 14 nt, Human
ccauggacuuuguu

SEQ ID NO: 3351806 - RNA, 15 nt, Human
ccauucuccaccugc

SEQ ID NO: 3351807 - RNA, 16 nt, Human
ccauucuccaccugcc

SEQ ID NO: 3351808 - RNA, 14 nt, Human
ccauggacuuuaua

SEQ ID NO: 3351809 - RNA, 18 nt, Human
ccauucugccugcccagg

SEQ ID NO: 3351810 - RNA, 17 nt, Human
ccauucugccugcccag

SEQ ID NO: 3351811 - RNA, 17 nt, Human
ccauucuccaccugcca

SEQ ID NO: 3351812 - RNA, 16 nt, Human
ccauucugccugccca

SEQ ID NO: 3351813 - RNA, 20 nt, Human
ccauucugccugcccaggcc

SEQ ID NO: 3351814 - RNA, 19 nt, Human
ccauucugccugcccaggc

SEQ ID NO: 3351815 - RNA, 14 nt, Human
ccauucuccaccug

SEQ ID NO: 3351816 - RNA, 21 nt, Human
ccauucugccugcccaggccc

SEQ ID NO: 3351817 - RNA, 12 nt, Human
cccaaagaugca

SEQ ID NO: 3351818 - RNA, 15 nt, Human
cccaaagaugcagcc

SEQ ID NO: 3351819 - RNA, 23 nt, Human
ccauuuuggauucuuauggacaa

SEQ ID NO: 3351820 - RNA, 20 nt, Human
ccauuuugggguacccacug

SEQ ID NO: 3351821 - RNA, 22 nt, Human
ccauuuugggguacccacugcu

SEQ ID NO: 3351822 - RNA, 20 nt, Human
cccaaaacucuccucugcug

SEQ ID NO: 3351823 - RNA, 11 nt, Human
ccacuacauuc

SEQ ID NO: 3351824 - RNA, 15 nt, Human
ccacuacauucuguu

SEQ ID NO: 3351825 - RNA, 14 nt, Human
ccacuacauucugu

SEQ ID NO: 3351826 - RNA, 16 nt, Human
ccacuacauucuguua

SEQ ID NO: 3351827 - RNA, 17 nt, Human
ccacuacauucuguuaa

SEQ ID NO: 3351828 - RNA, 23 nt, Human
ccacggccaggccagagggagug

SEQ ID NO: 3351829 - RNA, 18 nt, Human
ccacggccaggccagagg

SEQ ID NO: 3351830 - RNA, 16 nt, Human
ccacggccaggccaga

SEQ ID NO: 3351831 - RNA, 18 nt, Human
ccacgcuggagugcagug

SEQ ID NO: 3351832 - RNA, 15 nt, Human
ccacccccacccaag

SEQ ID NO: 3351833 - RNA, 13 nt, Human
ccacgcuggagug

SEQ ID NO: 3351834 - RNA, 16 nt, Human
ccacgcuggagugcag

SEQ ID NO: 3351835 - RNA, 15 nt, Human
ccaccccacacacgc

SEQ ID NO: 3351836 - RNA, 20 nt, Human
ccagacaccuugacagggca

SEQ ID NO: 3351837 - RNA, 21 nt, Human
ccagacaccuugacagggcac

SEQ ID NO: 3351838 - RNA, 21 nt, Human
ccagaauuucccaaagcagug

SEQ ID NO: 3351839 - RNA, 18 nt, Human
ccagaauuucccaaagca

SEQ ID NO: 3351840 - RNA, 12 nt, Human
ccagaauuuccc

SEQ ID NO: 3351841 - RNA, 19 nt, Human
ccagaauuucccaaagcag

SEQ ID NO: 3351842 - RNA, 23 nt, Human
ccagaaguuugagaucagccugg

SEQ ID NO: 3351843 - RNA, 22 nt, Human
ccagaaguuugagaucagccug

SEQ ID NO: 3351844 - RNA, 13 nt, Human
ccacuucagcuga

SEQ ID NO: 3351845 - RNA, 14 nt, Human
ccacuucagcugac

SEQ ID NO: 3351846 - RNA, 23 nt, Human
ccacugcacuccagccuggguga

SEQ ID NO: 3351847 - RNA, 17 nt, Human
ccacccccacccaaggg

SEQ ID NO: 3351848 - RNA, 23 nt, Human
ccacccaggagccccgaggccuu

SEQ ID NO: 3351849 - RNA, 21 nt, Human
ccacccaggagccccgaggcc

SEQ ID NO: 3351850 - RNA, 21 nt, Human
ccaccaacauacucccaucug

SEQ ID NO: 3351851 - RNA, 17 nt, Human
ccacaucuugcucugcu

SEQ ID NO: 3351852 - RNA, 18 nt, Human
ccacaucuugcucugcug

SEQ ID NO: 3351853 - RNA, 19 nt, Human
ccacaucuugcucugcuga

SEQ ID NO: 3351854 - RNA, 16 nt, Human
ccacauuccugaugcu

SEQ ID NO: 3351855 - RNA, 16 nt, Human
ccacaugugcacaugc

SEQ ID NO: 3351856 - RNA, 16 nt, Human
ccacaggaucagucug

SEQ ID NO: 3351857 - RNA, 15 nt, Human
ccacacccagcccac

SEQ ID NO: 3351858 - RNA, 20 nt, Human
ccacacccagcccacuucug

SEQ ID NO: 3351859 - RNA, 22 nt, Human
ccacacccagcccacuucugcc

SEQ ID NO: 3351860 - RNA, 21 nt, Human
ccacacccagcccacuucugc

SEQ ID NO: 3351861 - RNA, 15 nt, Human
ccaagaagcccagga

SEQ ID NO: 3351862 - RNA, 12 nt, Human
ccaacccucauc

SEQ ID NO: 3351863 - RNA, 19 nt, Human
ccaagaagcccaggaaagg

SEQ ID NO: 3351864 - RNA, 20 nt, Human
ccaagaagcccaggaaaggc

SEQ ID NO: 3351865 - RNA, 20 nt, Human
ccaaacucaccugccccuca

SEQ ID NO: 3351866 - RNA, 17 nt, Human
ccaaagccuccuccagc

SEQ ID NO: 3351867 - RNA, 22 nt, Human
ccaaagccuccuccagccgcca

SEQ ID NO: 3351868 - RNA, 23 nt, Human
ccaaagcagugcaugcugucccu

SEQ ID NO: 3351869 - RNA, 19 nt, Human
ccaaagccaaagcuaggcc

SEQ ID NO: 3351870 - RNA, 19 nt, Human
ccaaagcagugcaugcugu

SEQ ID NO: 3351871 - RNA, 15 nt, Human
ccaaagcuaggccug

SEQ ID NO: 3351872 - RNA, 17 nt, Human
ccaaagcuaggccuggc

SEQ ID NO: 3351873 - RNA, 16 nt, Human
ccaaagcuaggccugg

SEQ ID NO: 3351874 - RNA, 21 nt, Human
ccaaagcuaggccuggccaga

SEQ ID NO: 3351875 - RNA, 15 nt, Human
ccaaaggaagcacau

SEQ ID NO: 3351876 - RNA, 23 nt, Human
ccaaaggaagcacaugccucucu

SEQ ID NO: 3351877 - RNA, 17 nt, Human
ccaacauacucccaucu

SEQ ID NO: 3351878 - RNA, 18 nt, Human
ccaacauacucccaucug

SEQ ID NO: 3351879 - RNA, 19 nt, Human
ccaacauacucccaucugu

SEQ ID NO: 3351880 - RNA, 20 nt, Human
ccaacauacucccaucugug

SEQ ID NO: 3351881 - RNA, 16 nt, Human
ccaacauacucccauc

SEQ ID NO: 3351882 - RNA, 21 nt, Human
ccaacauacucccaucuguga

SEQ ID NO: 3351883 - RNA, 22 nt, Human
ccaacauacucccaucugugaa

SEQ ID NO: 3351884 - RNA, 15 nt, Human
ccaaaguacacuguu

SEQ ID NO: 3351885 - RNA, 18 nt, Human
ccaaaguacacuguuuca

SEQ ID NO: 3351886 - RNA, 22 nt, Human
ccaaggggaauguuugccucug

SEQ ID NO: 3351887 - RNA, 19 nt, Human
ccaagggccuggccugagc

SEQ ID NO: 3351888 - RNA, 16 nt, Human
ccaagggccuggccug

SEQ ID NO: 3351889 - RNA, 18 nt, Human
ccaagggccuggccugag

SEQ ID NO: 3351890 - RNA, 18 nt, Human
ccaaggccaaaggaagca

SEQ ID NO: 3351891 - RNA, 21 nt, Human
ccaaggccaaaggaagcacau

SEQ ID NO: 3351892 - RNA, 16 nt, Human
ccaaggccaaaggaag

SEQ ID NO: 3351893 - RNA, 15 nt, Human
ccaagggccuggccu

SEQ ID NO: 3351894 - RNA, 23 nt, Human
ccaagguuuggggaagaacgaag

SEQ ID NO: 3351895 - RNA, 13 nt, Human
ccaaggugggagg

SEQ ID NO: 3351896 - RNA, 20 nt, Human
ccaagucaagugaaaaagga

SEQ ID NO: 3351897 - RNA, 15 nt, Human
ccaagcucccaggca

SEQ ID NO: 3351898 - RNA, 16 nt, Human
ccaagcucccaggcau

SEQ ID NO: 3351899 - RNA, 17 nt, Human
ccaaggccaaaggaagc

SEQ ID NO: 3351900 - RNA, 14 nt, Human
ccaagcucccaggc

SEQ ID NO: 3351901 - RNA, 22 nt, Human
cauuugaaaauuuugauguuuu

SEQ ID NO: 3351902 - RNA, 20 nt, Human
cauuugaaaauuuugauguu

SEQ ID NO: 3351903 - RNA, 18 nt, Human
cauuugagcagggcucag

SEQ ID NO: 3351904 - RNA, 17 nt, Human
cauuugagcagggcuca

SEQ ID NO: 3351905 - RNA, 20 nt, Human
cauuugagcagggcucagcg

SEQ ID NO: 3351906 - RNA, 16 nt, Human
cauuugagcagggcuc

SEQ ID NO: 3351907 - RNA, 17 nt, Human
cauuuguuugaacugau

SEQ ID NO: 3351908 - RNA, 20 nt, Human
cauuuguuugaacugauaaa

SEQ ID NO: 3351909 - RNA, 22 nt, Human
cauuuguuugaacugauaaaga

SEQ ID NO: 3351910 - RNA, 13 nt, Human
cauuugcuccuuu

SEQ ID NO: 3351911 - RNA, 14 nt, Human
cauuugcuccuuuc

SEQ ID NO: 3351912 - RNA, 17 nt, Human
ccaaacucaccugcccc

SEQ ID NO: 3351913 - RNA, 13 nt, Human
cacccaagggccu

SEQ ID NO: 3351914 - RNA, 14 nt, Human
cacccaagggccug

SEQ ID NO: 3351915 - RNA, 15 nt, Human
cacccaagggccugg

SEQ ID NO: 3351916 - RNA, 18 nt, Human
cauuguuggccaaagcca

SEQ ID NO: 3351917 - RNA, 17 nt, Human
cauuguuggccaaagcc

SEQ ID NO: 3351918 - RNA, 13 nt, Human
cauuuccuguguc

SEQ ID NO: 3351919 - RNA, 12 nt, Human
cauuuccugugu

SEQ ID NO: 3351920 - RNA, 15 nt, Human
cauuuaaaagauaca

SEQ ID NO: 3351921 - RNA, 16 nt, Human
cauuuaaaagauacag

SEQ ID NO: 3351922 - RNA, 12 nt, Human
cauuuaaaagau

SEQ ID NO: 3351923 - RNA, 21 nt, Human
cccccgcugucagccauuccu

SEQ ID NO: 3351924 - RNA, 12 nt, Human
cccccagcccca

SEQ ID NO: 3351925 - RNA, 12 nt, Human
ccccacugguga

SEQ ID NO: 3351926 - RNA, 13 nt, Human
ccccacuggugac

SEQ ID NO: 3351927 - RNA, 13 nt, Human
ccccaggaggcca

SEQ ID NO: 3351928 - RNA, 14 nt, Human
ccccaggaggccag

SEQ ID NO: 3351929 - RNA, 15 nt, Human
ccccaggaggccagc

SEQ ID NO: 3351930 - RNA, 21 nt, Human
ccccaggaggccagccuugac

SEQ ID NO: 3351931 - RNA, 22 nt, Human
ccccaggaggccagccuugacc

SEQ ID NO: 3351932 - RNA, 16 nt, Human
ccccucagggucccug

SEQ ID NO: 3351933 - RNA, 19 nt, Human
cccugguggcagugggagc

SEQ ID NO: 3351934 - RNA, 16 nt, Human
cccugguggcaguggg

SEQ ID NO: 3351935 - RNA, 15 nt, Human
cccugguggcagugg

SEQ ID NO: 3351936 - RNA, 18 nt, Human
ccccucagggucccuggu

SEQ ID NO: 3351937 - RNA, 20 nt, Human
ccccucagggucccuggugg

SEQ ID NO: 3351938 - RNA, 17 nt, Human
ccccucagggucccugg

SEQ ID NO: 3351939 - RNA, 16 nt, Human
cccugugggcccccaa

SEQ ID NO: 3351940 - RNA, 15 nt, Human
cccugugggccccca

SEQ ID NO: 3351941 - RNA, 15 nt, Human
cccuguuuguuucug

SEQ ID NO: 3351942 - RNA, 18 nt, Human
cccugugggcccccaaau

SEQ ID NO: 3351943 - RNA, 18 nt, Human
cccuuggggagcaggcuc

SEQ ID NO: 3351944 - RNA, 14 nt, Human
cccuugugguccca

SEQ ID NO: 3351945 - RNA, 16 nt, Human
cccuuguggucccacc

SEQ ID NO: 3351946 - RNA, 18 nt, Human
cccuuguggucccacccc

SEQ ID NO: 3351947 - RNA, 20 nt, Human
cccuuugacgccaucccagc

SEQ ID NO: 3351948 - RNA, 17 nt, Human
cccuugccgucuaccug

SEQ ID NO: 3351949 - RNA, 18 nt, Human
cccuugccgucuaccuga

SEQ ID NO: 3351950 - RNA, 17 nt, Human
ccgaggccuucucugaa

SEQ ID NO: 3351951 - RNA, 18 nt, Human
ccgagaucacgccacugc

SEQ ID NO: 3351952 - RNA, 11 nt, Human
cccuuuuccuu

SEQ ID NO: 3351953 - RNA, 13 nt, Human
cccuuuucuguuu

SEQ ID NO: 3351954 - RNA, 17 nt, Human
cccuuuuuuggcugcug

SEQ ID NO: 3351955 - RNA, 18 nt, Human
cccuuuuuuggcugcuga

SEQ ID NO: 3351956 - RNA, 17 nt, Human
ccgagaaggaagccucc

SEQ ID NO: 3351957 - RNA, 18 nt, Human
ccgagauagccaaggcca

SEQ ID NO: 3351958 - RNA, 19 nt, Human
ccgagauagccaaggccaa

SEQ ID NO: 3351959 - RNA, 22 nt, Human
ccgagauagccaaggccaaagg

SEQ ID NO: 3351960 - RNA, 17 nt, Human
ccucacaguccuuacca

SEQ ID NO: 3351961 - RNA, 23 nt, Human
ccucaagugauucuccugccuca

SEQ ID NO: 3351962 - RNA, 12 nt, Human
ccucaccccacu

SEQ ID NO: 3351963 - RNA, 20 nt, Human
ccucacaguccuuaccagca

SEQ ID NO: 3351964 - RNA, 22 nt, Human
ccucacaguccuuaccagcaga

SEQ ID NO: 3351965 - RNA, 15 nt, Human
ccucaccccacugug

SEQ ID NO: 3351966 - RNA, 17 nt, Human
ccucaccuuucccaucu

SEQ ID NO: 3351967 - RNA, 23 nt, Human
ccgcuuucuacccagcgagcccu

SEQ ID NO: 3351968 - RNA, 14 nt, Human
ccgcuggggccagu

SEQ ID NO: 3351969 - RNA, 12 nt, Human
ccggcuggccug

SEQ ID NO: 3351970 - RNA, 15 nt, Human
ccgggcacucagaag

SEQ ID NO: 3351971 - RNA, 13 nt, Human
ccggcuggccugg

SEQ ID NO: 3351972 - RNA, 19 nt, Human
ccucugcagcaauaaagca

SEQ ID NO: 3351973 - RNA, 22 nt, Human
ccucugcacuccccugcugggu

SEQ ID NO: 3351974 - RNA, 14 nt, Human
ccucugcacucccc

SEQ ID NO: 3351975 - RNA, 19 nt, Human
ccucugcacuccccugcug

SEQ ID NO: 3351976 - RNA, 20 nt, Human
ccucugcacuccccugcugg

SEQ ID NO: 3351977 - RNA, 21 nt, Human
ccucugcacuccccugcuggg

SEQ ID NO: 3351978 - RNA, 20 nt, Human
ccucugcacaagcugcaccc

SEQ ID NO: 3351979 - RNA, 17 nt, Human
ccucugcacaagcugca

SEQ ID NO: 3351980 - RNA, 19 nt, Human
ccucugcacaagcugcacc

SEQ ID NO: 3351981 - RNA, 11 nt, Human
ccucugcacaa

SEQ ID NO: 3351982 - RNA, 15 nt, Human
ccucugcacaagcug

SEQ ID NO: 3351983 - RNA, 17 nt, Human
ccucugacacacagcuc

SEQ ID NO: 3351984 - RNA, 12 nt, Human
ccucugggacug

SEQ ID NO: 3351985 - RNA, 23 nt, Human
ccucugaaaaccaauguucucuc

SEQ ID NO: 3351986 - RNA, 15 nt, Human
ccucugacacacagc

SEQ ID NO: 3351987 - RNA, 16 nt, Human
ccucugacacacagcu

SEQ ID NO: 3351988 - RNA, 12 nt, Human
ccucucccauca

SEQ ID NO: 3351989 - RNA, 23 nt, Human
ccuccugugugugcgccuacagg

SEQ ID NO: 3351990 - RNA, 15 nt, Human
ccucagucuggcccu

SEQ ID NO: 3351991 - RNA, 19 nt, Human
ccucaggugauccacccac

SEQ ID NO: 3351992 - RNA, 17 nt, Human
ccucaggugauccaccc

SEQ ID NO: 3351993 - RNA, 22 nt, Human
ccucaggugagaagcagaggaa

SEQ ID NO: 3351994 - RNA, 22 nt, Human
ccucaggugauccacccaccuc

SEQ ID NO: 3351995 - RNA, 22 nt, Human
ccucagggucccugguggcagc

SEQ ID NO: 3351996 - RNA, 16 nt, Human
ccucaggugagaagca

SEQ ID NO: 3351997 - RNA, 14 nt, Human
ccucaggccugggg

SEQ ID NO: 3351998 - RNA, 21 nt, Human
ccucaggccugggggcugggc

SEQ ID NO: 3351999 - RNA, 10 nt, Human
ccucaggccu

SEQ ID NO: 3352000 - RNA, 11 nt, Human
ccucaggccug

SEQ ID NO: 3352001 - RNA, 14 nt, Human
ccucagggucccug

SEQ ID NO: 3352002 - RNA, 14 nt, Human
ccucagcauccugg

SEQ ID NO: 3352003 - RNA, 17 nt, Human
ccucagcauccuggcac

SEQ ID NO: 3352004 - RNA, 16 nt, Human
ccucagcauccuggca

SEQ ID NO: 3352005 - RNA, 15 nt, Human
ccucccucccucuuu

SEQ ID NO: 3352006 - RNA, 13 nt, Human
ccucccucccucu

SEQ ID NO: 3352007 - RNA, 13 nt, Human
ccucccucuuucc

SEQ ID NO: 3352008 - RNA, 16 nt, Human
ccucccucccucuuuc

SEQ ID NO: 3352009 - RNA, 13 nt, Human
ccuccugggcuaa

SEQ ID NO: 3352010 - RNA, 22 nt, Human
ccuccugugugugcgccuacag

SEQ ID NO: 3352011 - RNA, 15 nt, Human
ccuccugugugugcg

SEQ ID NO: 3352012 - RNA, 13 nt, Human
ccuccugugugug

SEQ ID NO: 3352013 - RNA, 12 nt, Human
ccugaggcccag

SEQ ID NO: 3352014 - RNA, 13 nt, Human
ccugaggcccaga

SEQ ID NO: 3352015 - RNA, 12 nt, Human
ccugacaacacu

SEQ ID NO: 3352016 - RNA, 14 nt, Human
ccugacaacacuca

SEQ ID NO: 3352017 - RNA, 15 nt, Human
ccugacaacacucau

SEQ ID NO: 3352018 - RNA, 16 nt, Human
ccugacaacacucauu

SEQ ID NO: 3352019 - RNA, 16 nt, Human
ccugaggcccuucucu

SEQ ID NO: 3352020 - RNA, 17 nt, Human
ccugaggcccuucucuc

SEQ ID NO: 3352021 - RNA, 19 nt, Human
ccugaggcccuucucucca

SEQ ID NO: 3352022 - RNA, 20 nt, Human
ccugaggcccuucucuccag

SEQ ID NO: 3352023 - RNA, 21 nt, Human
ccugaggcccuucucuccagc

SEQ ID NO: 3352024 - RNA, 22 nt, Human
ccugaggcccuucucuccagcc

SEQ ID NO: 3352025 - RNA, 23 nt, Human
ccugaggcccuucucuccagccc

SEQ ID NO: 3352026 - RNA, 19 nt, Human
ccugauugugucucuuggu

SEQ ID NO: 3352027 - RNA, 23 nt, Human
ccugauugugucucuugguccug

SEQ ID NO: 3352028 - RNA, 17 nt, Human
ccugaugcuucuucaga

SEQ ID NO: 3352029 - RNA, 18 nt, Human
ccugaugcuucuucagag

SEQ ID NO: 3352030 - RNA, 22 nt, Human
ccugaugcuucuucagagacuc

SEQ ID NO: 3352031 - RNA, 14 nt, Human
ccugaugcuucuuc

SEQ ID NO: 3352032 - RNA, 14 nt, Human
ccugaggcccuucu

SEQ ID NO: 3352033 - RNA, 14 nt, Human
ccucuguacagagc

SEQ ID NO: 3352034 - RNA, 15 nt, Human
ccucuguacagagcc

SEQ ID NO: 3352035 - RNA, 16 nt, Human
ccucuguacagagccc

SEQ ID NO: 3352036 - RNA, 17 nt, Human
ccucuguacagagccca

SEQ ID NO: 3352037 - RNA, 18 nt, Human
ccucuguacagagcccac

SEQ ID NO: 3352038 - RNA, 23 nt, Human
ccucuguacagagcccacgcccc

SEQ ID NO: 3352039 - RNA, 14 nt, Human
ccucuuagaaaaac

SEQ ID NO: 3352040 - RNA, 15 nt, Human
ccucuuaugggcugg

SEQ ID NO: 3352041 - RNA, 16 nt, Human
ccucuuaugggcuggg

SEQ ID NO: 3352042 - RNA, 14 nt, Human
ccucuuaugggcug

SEQ ID NO: 3352043 - RNA, 17 nt, Human
ccugaagucacacagug

SEQ ID NO: 3352044 - RNA, 16 nt, Human
ccugaagucacacagu

SEQ ID NO: 3352045 - RNA, 13 nt, Human
ccugaaggccccg

SEQ ID NO: 3352046 - RNA, 15 nt, Human
ccugaagucacacag

SEQ ID NO: 3352047 - RNA, 22 nt, Human
ccucuuuggucuacacugugcu

SEQ ID NO: 3352048 - RNA, 19 nt, Human
ccucuuuggucuacacugu

SEQ ID NO: 3352049 - RNA, 17 nt, Human
ccucuuaugggcugggu

SEQ ID NO: 3352050 - RNA, 20 nt, Human
cguuucuaugacacaugcaa

SEQ ID NO: 3352051 - RNA, 19 nt, Human
cguuucuaaaggcuaccuu

SEQ ID NO: 3352052 - RNA, 21 nt, Human
cguuucuaaaggcuaccuuug

SEQ ID NO: 3352053 - RNA, 12 nt, Human
cguggcugcuuc

SEQ ID NO: 3352054 - RNA, 14 nt, Human
cguggcugcuucaa

SEQ ID NO: 3352055 - RNA, 15 nt, Human
cguggcugcuucaag

SEQ ID NO: 3352056 - RNA, 13 nt, Human
cgucugacaggca

SEQ ID NO: 3352057 - RNA, 14 nt, Human
cgucuaccugaggg

SEQ ID NO: 3352058 - RNA, 11 nt, Human
cguccccuguc

SEQ ID NO: 3352059 - RNA, 14 nt, Human
cguccccugucccc

SEQ ID NO: 3352060 - RNA, 19 nt, Human
cgugcauaccacuuuuguu

SEQ ID NO: 3352061 - RNA, 14 nt, Human
cgugcauaccacuu

SEQ ID NO: 3352062 - RNA, 18 nt, Human
cgugcauaccacuuuugu

SEQ ID NO: 3352063 - RNA, 22 nt, Human
cgugcacacaccagagcccacc

SEQ ID NO: 3352064 - RNA, 22 nt, Human
cgugcaguggugcgaucugggu

SEQ ID NO: 3352065 - RNA, 21 nt, Human
cgugcacacaccagagcccac

SEQ ID NO: 3352066 - RNA, 20 nt, Human
cgugcacacaccagagccca

SEQ ID NO: 3352067 - RNA, 22 nt, Human
cggugcuaucucccccagcccc

SEQ ID NO: 3352068 - RNA, 23 nt, Human
cggugcuaucucccccagcccca

SEQ ID NO: 3352069 - RNA, 16 nt, Human
cgcgacaaugcaaacc

SEQ ID NO: 3352070 - RNA, 17 nt, Human
cgcgacaaugcaaacca

SEQ ID NO: 3352071 - RNA, 15 nt, Human
cgcgacaaugcaaac

SEQ ID NO: 3352072 - RNA, 15 nt, Human
cgcccccacugguga

SEQ ID NO: 3352073 - RNA, 13 nt, Human
cgcagacaggacc

SEQ ID NO: 3352074 - RNA, 14 nt, Human
cgcagacaggacca

SEQ ID NO: 3352075 - RNA, 14 nt, Human
cgcuaagagggagg

SEQ ID NO: 3352076 - RNA, 15 nt, Human
cgcuaagagggaggg

SEQ ID NO: 3352077 - RNA, 16 nt, Human
cgcuaagagggaggga

SEQ ID NO: 3352078 - RNA, 20 nt, Human
cgcgugcacacaccagagcc

SEQ ID NO: 3352079 - RNA, 19 nt, Human
cgcgugcacacaccagagc

SEQ ID NO: 3352080 - RNA, 16 nt, Human
cgcgugcacacaccag

SEQ ID NO: 3352081 - RNA, 23 nt, Human
ccuuugacgccaucccagcccca

SEQ ID NO: 3352082 - RNA, 16 nt, Human
ccuuugcuugaaagaa

SEQ ID NO: 3352083 - RNA, 13 nt, Human
ccuuggcugcagg

SEQ ID NO: 3352084 - RNA, 12 nt, Human
ccuuggcugcag

SEQ ID NO: 3352085 - RNA, 16 nt, Human
ccuuguggucccaccc

SEQ ID NO: 3352086 - RNA, 19 nt, Human
ccuuguggucccaccccac

SEQ ID NO: 3352087 - RNA, 20 nt, Human
ccuuguggucccaccccaca

SEQ ID NO: 3352088 - RNA, 13 nt, Human
ccuuuaagagaaa

SEQ ID NO: 3352089 - RNA, 12 nt, Human
cgaggacaggga

SEQ ID NO: 3352090 - RNA, 13 nt, Human
cgaggacagggag

SEQ ID NO: 3352091 - RNA, 19 nt, Human
cgaggccuucucugaagga

SEQ ID NO: 3352092 - RNA, 18 nt, Human
cgaggccuucucugaagg

SEQ ID NO: 3352093 - RNA, 18 nt, Human
ccuuuguauucucuccug

SEQ ID NO: 3352094 - RNA, 15 nt, Human
ccuuuguauucucuc

SEQ ID NO: 3352095 - RNA, 12 nt, Human
cgauuucuguuu

SEQ ID NO: 3352096 - RNA, 23 nt, Human
cgcacuucgggaggucgaggcag

SEQ ID NO: 3352097 - RNA, 19 nt, Human
cgaucuggguucacugcaa

SEQ ID NO: 3352098 - RNA, 19 nt, Human
cgauucuucugcuucagcc

SEQ ID NO: 3352099 - RNA, 13 nt, Human
cgauucuucugcu

SEQ ID NO: 3352100 - RNA, 21 nt, Human
cgauucuucugcuucagccuc

SEQ ID NO: 3352101 - RNA, 13 nt, Human
cgcuccugugucu

SEQ ID NO: 3352102 - RNA, 20 nt, Human
cggaaugaaccacaucuugc

SEQ ID NO: 3352103 - RNA, 18 nt, Human
cggacagccacggccagg

SEQ ID NO: 3352104 - RNA, 16 nt, Human
cggacagccacggcca

SEQ ID NO: 3352105 - RNA, 15 nt, Human
cggacagccacggcc

SEQ ID NO: 3352106 - RNA, 12 nt, Human
cgggcaugacac

SEQ ID NO: 3352107 - RNA, 15 nt, Human
cgggcaugacacgaa

SEQ ID NO: 3352108 - RNA, 17 nt, Human
cgggaggucgaggcagg

SEQ ID NO: 3352109 - RNA, 16 nt, Human
cgggaggucgaggcag

SEQ ID NO: 3352110 - RNA, 20 nt, Human
cgggaggauguucugggaca

SEQ ID NO: 3352111 - RNA, 15 nt, Human
cggcuggccuggccc

SEQ ID NO: 3352112 - RNA, 16 nt, Human
cggcuggccuggcccc

SEQ ID NO: 3352113 - RNA, 14 nt, Human
cggcuggccuggcc

SEQ ID NO: 3352114 - RNA, 18 nt, Human
cggcuggccuggccccuc

SEQ ID NO: 3352115 - RNA, 20 nt, Human
ccugugaguacuacaguccu

SEQ ID NO: 3352116 - RNA, 17 nt, Human
ccugucccccugacaac

SEQ ID NO: 3352117 - RNA, 16 nt, Human
ccugucccccugacaa

SEQ ID NO: 3352118 - RNA, 18 nt, Human
ccuguccccgcacugggc

SEQ ID NO: 3352119 - RNA, 17 nt, Human
ccugugccucugggacu

SEQ ID NO: 3352120 - RNA, 15 nt, Human
ccugugccucuggga

SEQ ID NO: 3352121 - RNA, 20 nt, Human
ccugugauggggcccugccu

SEQ ID NO: 3352122 - RNA, 21 nt, Human
ccugugauggggcccugccuc

SEQ ID NO: 3352123 - RNA, 22 nt, Human
ccugugauggggcccugccucc

SEQ ID NO: 3352124 - RNA, 18 nt, Human
ccugugauggggcccugc

SEQ ID NO: 3352125 - RNA, 19 nt, Human
ccugugauggggcccugcc

SEQ ID NO: 3352126 - RNA, 17 nt, Human
ccugugauggggcccug

SEQ ID NO: 3352127 - RNA, 13 nt, Human
ccugguggcagcu

SEQ ID NO: 3352128 - RNA, 12 nt, Human
ccugguggcagc

SEQ ID NO: 3352129 - RNA, 14 nt, Human
ccugguggcagcuc

SEQ ID NO: 3352130 - RNA, 16 nt, Human
ccugguggcagcucac

SEQ ID NO: 3352131 - RNA, 17 nt, Human
ccugguggcagcucacc

SEQ ID NO: 3352132 - RNA, 18 nt, Human
ccugguggcagcucaccu

SEQ ID NO: 3352133 - RNA, 12 nt, Human
ccuguaccucuu

SEQ ID NO: 3352134 - RNA, 20 nt, Human
ccuguaauccuagcacuuug

SEQ ID NO: 3352135 - RNA, 21 nt, Human
ccuguagagugggagcugagu

SEQ ID NO: 3352136 - RNA, 19 nt, Human
ccuguagagugggagcuga

SEQ ID NO: 3352137 - RNA, 23 nt, Human
ccuguagagugggagcugagugg

SEQ ID NO: 3352138 - RNA, 21 nt, Human
ccugcuggguguggcgcagca

SEQ ID NO: 3352139 - RNA, 13 nt, Human
ccugcugguucag

SEQ ID NO: 3352140 - RNA, 19 nt, Human
ccugcugguucaggguugg

SEQ ID NO: 3352141 - RNA, 23 nt, Human
ccugcgucucauacucaccucac

SEQ ID NO: 3352142 - RNA, 19 nt, Human
ccugcaacaccuuguuucc

SEQ ID NO: 3352143 - RNA, 16 nt, Human
ccugcaaccugauugu

SEQ ID NO: 3352144 - RNA, 18 nt, Human
ccugcaacaccuuguuuc

SEQ ID NO: 3352145 - RNA, 13 nt, Human
ccugcuccagcug

SEQ ID NO: 3352146 - RNA, 14 nt, Human
ccugcuccagcugu

SEQ ID NO: 3352147 - RNA, 22 nt, Human
ccugcuccagcuguucagcugg

SEQ ID NO: 3352148 - RNA, 12 nt, Human
ccugcuccagcu

SEQ ID NO: 3352149 - RNA, 14 nt, Human
ccuggccccucagg

SEQ ID NO: 3352150 - RNA, 18 nt, Human
ccuggcaugggaaugaau

SEQ ID NO: 3352151 - RNA, 16 nt, Human
ccugggaucccucauc

SEQ ID NO: 3352152 - RNA, 20 nt, Human
ccugggaucccucauccuca

SEQ ID NO: 3352153 - RNA, 14 nt, Human
ccugggcagaagga

SEQ ID NO: 3352154 - RNA, 12 nt, Human
ccugggcagaag

SEQ ID NO: 3352155 - RNA, 20 nt, Human
ccuggcacugcuuccaguga

SEQ ID NO: 3352156 - RNA, 17 nt, Human
ccuggcacugcuuccag

SEQ ID NO: 3352157 - RNA, 21 nt, Human
ccuggcacugcuuccagugag

SEQ ID NO: 3352158 - RNA, 14 nt, Human
ccuggcagccccug

SEQ ID NO: 3352159 - RNA, 16 nt, Human
ccuggcagccccuguu

SEQ ID NO: 3352160 - RNA, 16 nt, Human
ccuggcaugggaauga

SEQ ID NO: 3352161 - RNA, 17 nt, Human
ccuggcaugggaaugaa

SEQ ID NO: 3352162 - RNA, 14 nt, Human
ccuggcaugggaau

SEQ ID NO: 3352163 - RNA, 13 nt, Human
ccuggacccugug

SEQ ID NO: 3352164 - RNA, 14 nt, Human
ccuggacccugugg

SEQ ID NO: 3352165 - RNA, 13 nt, Human
ccuugacagggca

SEQ ID NO: 3352166 - RNA, 14 nt, Human
ccuugacagggcac

SEQ ID NO: 3352167 - RNA, 19 nt, Human
ccuugaccauucuccaccu

SEQ ID NO: 3352168 - RNA, 20 nt, Human
ccuugaccauucuccaccug

SEQ ID NO: 3352169 - RNA, 17 nt, Human
ccuugacagggcacacc

SEQ ID NO: 3352170 - RNA, 15 nt, Human
ccuugacagggcaca

SEQ ID NO: 3352171 - RNA, 19 nt, Human
ccuuggauuguccccgacc

SEQ ID NO: 3352172 - RNA, 22 nt, Human
ccuugaguugauucagcucugc

SEQ ID NO: 3352173 - RNA, 23 nt, Human
ccuugaguugauucagcucugca

SEQ ID NO: 3352174 - RNA, 21 nt, Human
ccuugaccauucuccaccugc

SEQ ID NO: 3352175 - RNA, 20 nt, Human
ccuugaguugauucagcucu

SEQ ID NO: 3352176 - RNA, 17 nt, Human
ccuugaaugaugccaug

SEQ ID NO: 3352177 - RNA, 17 nt, Human
ccuugaacuuugaccuc

SEQ ID NO: 3352178 - RNA, 16 nt, Human
ccuugaacuggguacu

SEQ ID NO: 3352179 - RNA, 19 nt, Human
ccuugaaaacacuguucuc

SEQ ID NO: 3352180 - RNA, 21 nt, Human
ccuugaaaacacuguucucug

SEQ ID NO: 3352181 - RNA, 22 nt, Human
ccuugaaaacacuguucucugc

SEQ ID NO: 3352182 - RNA, 14 nt, Human
ccuugaacugggua

SEQ ID NO: 3352183 - RNA, 15 nt, Human
ccuucgcuccugugu

SEQ ID NO: 3352184 - RNA, 14 nt, Human
ccuucgcuccugug

SEQ ID NO: 3352185 - RNA, 13 nt, Human
ccuucgcuccugu

SEQ ID NO: 3352186 - RNA, 15 nt, Human
ccuugaaaacacugu

SEQ ID NO: 3352187 - RNA, 11 nt, Human
ccuuuggcuuc

SEQ ID NO: 3352188 - RNA, 14 nt, Human
ccuuaccagcagag

SEQ ID NO: 3352189 - RNA, 15 nt, Human
ccuuaccagcagagc

SEQ ID NO: 3352190 - RNA, 16 nt, Human
ccuuaccagcagagca

SEQ ID NO: 3352191 - RNA, 19 nt, Human
ccuuacccucauguucuua

SEQ ID NO: 3352192 - RNA, 13 nt, Human
ccuuaccagcaga

SEQ ID NO: 3352193 - RNA, 20 nt, Human
ccuuaccucggugccuuccu

SEQ ID NO: 3352194 - RNA, 14 nt, Human
ccuuagacaguccc

SEQ ID NO: 3352195 - RNA, 21 nt, Human
ccuuagacagucccugccaau

SEQ ID NO: 3352196 - RNA, 18 nt, Human
ccuuagacagucccugcc

SEQ ID NO: 3352197 - RNA, 19 nt, Human
ccuuagacagucccugcca

SEQ ID NO: 3352198 - RNA, 16 nt, Human
ccuuagacagucccug

SEQ ID NO: 3352199 - RNA, 17 nt, Human
ccuuagacagucccugc

SEQ ID NO: 3352200 - RNA, 15 nt, Human
ccuuccagggguggg

SEQ ID NO: 3352201 - RNA, 16 nt, Human
ccuuccagggguggga

SEQ ID NO: 3352202 - RNA, 18 nt, Human
ccuuccaggggugggaca

SEQ ID NO: 3352203 - RNA, 14 nt, Human
ccuuccucuuucca

SEQ ID NO: 3352204 - RNA, 20 nt, Human
ccuucagugccuuauggaac

SEQ ID NO: 3352205 - RNA, 15 nt, Human
ccuucagugccuuau

SEQ ID NO: 3352206 - RNA, 19 nt, Human
ccuucagugccuuauggaa

SEQ ID NO: 3352207 - RNA, 13 nt, Human
ccuucagugccuu

SEQ ID NO: 3352208 - RNA, 14 nt, Human
ccuucagugccuua

SEQ ID NO: 3352209 - RNA, 12 nt, Human
ccuucagugccu

SEQ ID NO: 3352210 - RNA, 19 nt, Human
cugcccuccaagaccuucu

SEQ ID NO: 3352211 - RNA, 15 nt, Human
cugcccggcugcgga

SEQ ID NO: 3352212 - RNA, 11 nt, Human
cugcccggcug

SEQ ID NO: 3352213 - RNA, 13 nt, Human
cugcccugcccac

SEQ ID NO: 3352214 - RNA, 14 nt, Human
cugcccugcccacc

SEQ ID NO: 3352215 - RNA, 15 nt, Human
cugcccugcccaccu

SEQ ID NO: 3352216 - RNA, 16 nt, Human
cugcccugcccaccug

SEQ ID NO: 3352217 - RNA, 16 nt, Human
cugccauuucugagau

SEQ ID NO: 3352218 - RNA, 14 nt, Human
cugccccuggcagc

SEQ ID NO: 3352219 - RNA, 15 nt, Human
cugccccuggcagcc

SEQ ID NO: 3352220 - RNA, 16 nt, Human
cugccccuggcagccc

SEQ ID NO: 3352221 - RNA, 20 nt, Human
cugcccggcaggguccuaga

SEQ ID NO: 3352222 - RNA, 19 nt, Human
cugccagccgagauagcca

SEQ ID NO: 3352223 - RNA, 15 nt, Human
cugccaggaagccag

SEQ ID NO: 3352224 - RNA, 16 nt, Human
cugccaggaagccagc

SEQ ID NO: 3352225 - RNA, 18 nt, Human
cugccaggaagccagcag

SEQ ID NO: 3352226 - RNA, 15 nt, Human
cugccaugccagcuu

SEQ ID NO: 3352227 - RNA, 17 nt, Human
cugccaugccagcuuau

SEQ ID NO: 3352228 - RNA, 19 nt, Human
cugccaugccagcuuaucu

SEQ ID NO: 3352229 - RNA, 16 nt, Human
cugccacccuggggag

SEQ ID NO: 3352230 - RNA, 15 nt, Human
cugccacccugggga

SEQ ID NO: 3352231 - RNA, 14 nt, Human
cugccacccugggg

SEQ ID NO: 3352232 - RNA, 17 nt, Human
cugcuccucuccccagc

SEQ ID NO: 3352233 - RNA, 16 nt, Human
cugcuccucuccccag

SEQ ID NO: 3352234 - RNA, 18 nt, Human
cugcuccucuccccagca

SEQ ID NO: 3352235 - RNA, 20 nt, Human
cugcggaaugaaccacaucu

SEQ ID NO: 3352236 - RNA, 15 nt, Human
cugcgguccacccag

SEQ ID NO: 3352237 - RNA, 21 nt, Human
cugcggaaugaaccacaucuu

SEQ ID NO: 3352238 - RNA, 16 nt, Human
cugcgguccacccagg

SEQ ID NO: 3352239 - RNA, 14 nt, Human
cugcuccagcuguu

SEQ ID NO: 3352240 - RNA, 13 nt, Human
cugccucuucucu

SEQ ID NO: 3352241 - RNA, 23 nt, Human
cugccugaagucacacagugagu

SEQ ID NO: 3352242 - RNA, 23 nt, Human
cugccuguugggccaggagccuc

SEQ ID NO: 3352243 - RNA, 14 nt, Human
cugccugcccaggc

SEQ ID NO: 3352244 - RNA, 13 nt, Human
cugccugcccagg

SEQ ID NO: 3352245 - RNA, 13 nt, Human
cugccucagccuc

SEQ ID NO: 3352246 - RNA, 13 nt, Human
cugagucugaagg

SEQ ID NO: 3352247 - RNA, 14 nt, Human
cugagucugaaggc

SEQ ID NO: 3352248 - RNA, 15 nt, Human
cugagucugaaggcu

SEQ ID NO: 3352249 - RNA, 16 nt, Human
cugagucugaaggcug

SEQ ID NO: 3352250 - RNA, 13 nt, Human
cugauaaagauga

SEQ ID NO: 3352251 - RNA, 15 nt, Human
cugauucccaagcuc

SEQ ID NO: 3352252 - RNA, 18 nt, Human
cugauucccaagcucugc

SEQ ID NO: 3352253 - RNA, 17 nt, Human
cugauucccaagcucug

SEQ ID NO: 3352254 - RNA, 20 nt, Human
cugauucccaagcucugcuc

SEQ ID NO: 3352255 - RNA, 19 nt, Human
cugauucccaagcucugcu

SEQ ID NO: 3352256 - RNA, 22 nt, Human
cugauucccaagcucugcuccu

SEQ ID NO: 3352257 - RNA, 17 nt, Human
cugcacccucaggcagg

SEQ ID NO: 3352258 - RNA, 16 nt, Human
cugcacccucaggcag

SEQ ID NO: 3352259 - RNA, 18 nt, Human
cugcacccucaggcaggu

SEQ ID NO: 3352260 - RNA, 13 nt, Human
cugcacaagcugc

SEQ ID NO: 3352261 - RNA, 14 nt, Human
cugcacaagcugca

SEQ ID NO: 3352262 - RNA, 15 nt, Human
cugcacaagcugcac

SEQ ID NO: 3352263 - RNA, 16 nt, Human
cugcacaagcugcacc

SEQ ID NO: 3352264 - RNA, 11 nt, Human
cugcagccuca

SEQ ID NO: 3352265 - RNA, 20 nt, Human
cugcagccucaaccuccugg

SEQ ID NO: 3352266 - RNA, 19 nt, Human
cugcagccucaaccuccug

SEQ ID NO: 3352267 - RNA, 22 nt, Human
cugcagccucaaccuccugggc

SEQ ID NO: 3352268 - RNA, 22 nt, Human
cugcagggaguccgaaagggac

SEQ ID NO: 3352269 - RNA, 17 nt, Human
cugcaccggcuggccug

SEQ ID NO: 3352270 - RNA, 18 nt, Human
cugcaccggcuggccugg

SEQ ID NO: 3352271 - RNA, 19 nt, Human
cugcaccggcuggccuggc

SEQ ID NO: 3352272 - RNA, 16 nt, Human
cugcacuugcagacuc

SEQ ID NO: 3352273 - RNA, 14 nt, Human
cugcacuugcagac

SEQ ID NO: 3352274 - RNA, 16 nt, Human
cugcaccggcuggccu

SEQ ID NO: 3352275 - RNA, 17 nt, Human
cugggguggggaccuca

SEQ ID NO: 3352276 - RNA, 18 nt, Human
cugggguggggaccucag

SEQ ID NO: 3352277 - RNA, 19 nt, Human
cugggguggggaccucagg

SEQ ID NO: 3352278 - RNA, 17 nt, Human
cugggggccucagugcc

SEQ ID NO: 3352279 - RNA, 13 nt, Human
cugggggccucag

SEQ ID NO: 3352280 - RNA, 21 nt, Human
cugggguggggaccucaggcc

SEQ ID NO: 3352281 - RNA, 22 nt, Human
cugggguggggaccucaggccu

SEQ ID NO: 3352282 - RNA, 23 nt, Human
cugggguggggaccucaggccug

SEQ ID NO: 3352283 - RNA, 20 nt, Human
cuggguacuuguggacacag

SEQ ID NO: 3352284 - RNA, 23 nt, Human
cuggguacuuguggacacagcuc

SEQ ID NO: 3352285 - RNA, 21 nt, Human
cuggguacuuguggacacagc

SEQ ID NO: 3352286 - RNA, 19 nt, Human
cuggguacuuguggacaca

SEQ ID NO: 3352287 - RNA, 20 nt, Human
cugggcuucaguggcagcug

SEQ ID NO: 3352288 - RNA, 19 nt, Human
cugggcuucaguggcagcu

SEQ ID NO: 3352289 - RNA, 17 nt, Human
cugggcuucaguggcag

SEQ ID NO: 3352290 - RNA, 18 nt, Human
cugggcuucaguggcagc

SEQ ID NO: 3352291 - RNA, 17 nt, Human
cugggcuuggggaccag

SEQ ID NO: 3352292 - RNA, 20 nt, Human
cugggcuuggggaccagagc

SEQ ID NO: 3352293 - RNA, 13 nt, Human
cugggcuugggga

SEQ ID NO: 3352294 - RNA, 22 nt, Human
cugggcuucaguggcagcugcu

SEQ ID NO: 3352295 - RNA, 21 nt, Human
cugggcuucaguggcagcugc

SEQ ID NO: 3352296 - RNA, 18 nt, Human
cugguccauagagagcaa

SEQ ID NO: 3352297 - RNA, 14 nt, Human
cuggucccacucag

SEQ ID NO: 3352298 - RNA, 18 nt, Human
cuggucccacucagucca

SEQ ID NO: 3352299 - RNA, 15 nt, Human
cuggucccacucagu

SEQ ID NO: 3352300 - RNA, 15 nt, Human
cugguccauagagag

SEQ ID NO: 3352301 - RNA, 17 nt, Human
cugguccauagagagca

SEQ ID NO: 3352302 - RNA, 13 nt, Human
cuggguuggaggg

SEQ ID NO: 3352303 - RNA, 19 nt, Human
cuggguucuacccaggugc

SEQ ID NO: 3352304 - RNA, 23 nt, Human
cugguggcagugggagcugccug

SEQ ID NO: 3352305 - RNA, 19 nt, Human
cugguggcagugggagcug

SEQ ID NO: 3352306 - RNA, 20 nt, Human
cuggcuguuggcugggggcc

SEQ ID NO: 3352307 - RNA, 18 nt, Human
cuggcuguuggcuggggg

SEQ ID NO: 3352308 - RNA, 21 nt, Human
cuggcuggguggcaccagcag

SEQ ID NO: 3352309 - RNA, 19 nt, Human
cuggcuguuggcugggggc

SEQ ID NO: 3352310 - RNA, 18 nt, Human
cuggcucuuccaggcugg

SEQ ID NO: 3352311 - RNA, 19 nt, Human
cuggcucuuccaggcuggg

SEQ ID NO: 3352312 - RNA, 17 nt, Human
cuggcucuuccaggcug

SEQ ID NO: 3352313 - RNA, 13 nt, Human
cuggccugagcug

SEQ ID NO: 3352314 - RNA, 20 nt, Human
cugggcaaugugauaaaacc

SEQ ID NO: 3352315 - RNA, 12 nt, Human
cugggagugagc

SEQ ID NO: 3352316 - RNA, 13 nt, Human
cugggagugagcu

SEQ ID NO: 3352317 - RNA, 16 nt, Human
cugggagugagcuggu

SEQ ID NO: 3352318 - RNA, 18 nt, Human
cugggaggucaaggcugc

SEQ ID NO: 3352319 - RNA, 15 nt, Human
cuggaaugcaguggu

SEQ ID NO: 3352320 - RNA, 14 nt, Human
cuggaaugcagugg

SEQ ID NO: 3352321 - RNA, 15 nt, Human
cuggaagcacagcuu

SEQ ID NO: 3352322 - RNA, 18 nt, Human
cuggaagcacagcuucau

SEQ ID NO: 3352323 - RNA, 14 nt, Human
cuggaagcacagcu

SEQ ID NO: 3352324 - RNA, 13 nt, Human
cuggauuaaacuu

SEQ ID NO: 3352325 - RNA, 23 nt, Human
cuggauuaaacuuaaucuaaaug

SEQ ID NO: 3352326 - RNA, 16 nt, Human
cuggauggggcugcac

SEQ ID NO: 3352327 - RNA, 15 nt, Human
cuggauggggcugca

SEQ ID NO: 3352328 - RNA, 22 nt, Human
cuggcacuauaauguaagcucu

SEQ ID NO: 3352329 - RNA, 23 nt, Human
cuggcacuauaauguaagcucua

SEQ ID NO: 3352330 - RNA, 13 nt, Human
cuggcacugcuuc

SEQ ID NO: 3352331 - RNA, 14 nt, Human
cuggcacugcuucc

SEQ ID NO: 3352332 - RNA, 14 nt, Human
cuggccuagcauac

SEQ ID NO: 3352333 - RNA, 23 nt, Human
cuggccuagcauacguacacauu

SEQ ID NO: 3352334 - RNA, 17 nt, Human
cuggccuagcauacgua

SEQ ID NO: 3352335 - RNA, 12 nt, Human
cuggcccacugc

SEQ ID NO: 3352336 - RNA, 13 nt, Human
cuggcccacugca

SEQ ID NO: 3352337 - RNA, 20 nt, Human
cuggccagaugcaccagccc

SEQ ID NO: 3352338 - RNA, 19 nt, Human
cuggccagaugcaccagcc

SEQ ID NO: 3352339 - RNA, 18 nt, Human
cuggccagaugcaccagc

SEQ ID NO: 3352340 - RNA, 17 nt, Human
cuggccagaugcaccag

SEQ ID NO: 3352341 - RNA, 21 nt, Human
cuggccagaugcaccagcccu

SEQ ID NO: 3352342 - RNA, 14 nt, Human
cuggccagaugcac

SEQ ID NO: 3352343 - RNA, 15 nt, Human
cuggcacugcuucca

SEQ ID NO: 3352344 - RNA, 16 nt, Human
cuggcacugcuuccag

SEQ ID NO: 3352345 - RNA, 17 nt, Human
cuggcacugcuuccagu

SEQ ID NO: 3352346 - RNA, 16 nt, Human
cuggccagaugcacca

SEQ ID NO: 3352347 - RNA, 20 nt, Human
cuccagcucaccagccccag

SEQ ID NO: 3352348 - RNA, 19 nt, Human
cuccagcucaccagcccca

SEQ ID NO: 3352349 - RNA, 12 nt, Human
cuccacccugcu

SEQ ID NO: 3352350 - RNA, 15 nt, Human
cuccaccugccaggg

SEQ ID NO: 3352351 - RNA, 17 nt, Human
cuccaccugccagggac

SEQ ID NO: 3352352 - RNA, 18 nt, Human
cuccaccugccagggaca

SEQ ID NO: 3352353 - RNA, 21 nt, Human
cuccaccugccagggacagag

SEQ ID NO: 3352354 - RNA, 11 nt, Human
cuccacccugc

SEQ ID NO: 3352355 - RNA, 17 nt, Human
cucccaggcauucccca

SEQ ID NO: 3352356 - RNA, 19 nt, Human
cucccaggcauuccccagg

SEQ ID NO: 3352357 - RNA, 20 nt, Human
cucccaggcauuccccagga

SEQ ID NO: 3352358 - RNA, 21 nt, Human
cucccaggcauuccccaggag

SEQ ID NO: 3352359 - RNA, 22 nt, Human
cucccaggcauuccccaggagg

SEQ ID NO: 3352360 - RNA, 22 nt, Human
cucccaaggggcccaaauucuu

SEQ ID NO: 3352361 - RNA, 21 nt, Human
cucccaaggggcccaaauucu

SEQ ID NO: 3352362 - RNA, 15 nt, Human
cucccaggcauuccc

SEQ ID NO: 3352363 - RNA, 14 nt, Human
cuccaugugggcua

SEQ ID NO: 3352364 - RNA, 13 nt, Human
cuccagcuguuca

SEQ ID NO: 3352365 - RNA, 18 nt, Human
cuccagcuguucagcugg

SEQ ID NO: 3352366 - RNA, 19 nt, Human
cuccagcuguucagcuggu

SEQ ID NO: 3352367 - RNA, 11 nt, Human
cuccaggcucc

SEQ ID NO: 3352368 - RNA, 22 nt, Human
cucagguggggucacucuggca

SEQ ID NO: 3352369 - RNA, 23 nt, Human
cucagguggggucacucuggcag

SEQ ID NO: 3352370 - RNA, 16 nt, Human
cucaggugucccugca

SEQ ID NO: 3352371 - RNA, 15 nt, Human
cucaggugucccugc

SEQ ID NO: 3352372 - RNA, 12 nt, Human
cucagggucccu

SEQ ID NO: 3352373 - RNA, 23 nt, Human
cuaaaagguaugcaaucaaaucu

SEQ ID NO: 3352374 - RNA, 19 nt, Human
cucauaguaugguggcugg

SEQ ID NO: 3352375 - RNA, 18 nt, Human
cucauaguaugguggcug

SEQ ID NO: 3352376 - RNA, 18 nt, Human
cucaggugucccugcacu

SEQ ID NO: 3352377 - RNA, 17 nt, Human
cucaggugucccugcac

SEQ ID NO: 3352378 - RNA, 13 nt, Human
cucauugaccuga

SEQ ID NO: 3352379 - RNA, 15 nt, Human
cucauugaccugagg

SEQ ID NO: 3352380 - RNA, 23 nt, Human
cucauucuucuguacgucugaca

SEQ ID NO: 3352381 - RNA, 16 nt, Human
cucauugaccugaggc

SEQ ID NO: 3352382 - RNA, 12 nt, Human
cucauucuucug

SEQ ID NO: 3352383 - RNA, 14 nt, Human
cucauucuucugua

SEQ ID NO: 3352384 - RNA, 13 nt, Human
cucauucuucugu

SEQ ID NO: 3352385 - RNA, 21 nt, Human
cucauuagcauuuugcuaaau

SEQ ID NO: 3352386 - RNA, 13 nt, Human
cucgcgacaaugc

SEQ ID NO: 3352387 - RNA, 15 nt, Human
cucgcgacaaugcaa

SEQ ID NO: 3352388 - RNA, 16 nt, Human
cucgaguuacagacaa

SEQ ID NO: 3352389 - RNA, 20 nt, Human
cucgaguuacagacaaagcg

SEQ ID NO: 3352390 - RNA, 20 nt, Human
cuccuucuguccuacucugu

SEQ ID NO: 3352391 - RNA, 15 nt, Human
cuccuucuguccuac

SEQ ID NO: 3352392 - RNA, 14 nt, Human
cuccuucuguccua

SEQ ID NO: 3352393 - RNA, 13 nt, Human
cuccuucaccuuu

SEQ ID NO: 3352394 - RNA, 16 nt, Human
cucgaacuggcugcaa

SEQ ID NO: 3352395 - RNA, 11 nt, Human
cuccuucuucc

SEQ ID NO: 3352396 - RNA, 21 nt, Human
cuccuugaaaacacuguucuc

SEQ ID NO: 3352397 - RNA, 15 nt, Human
cuccugcaggcagcc

SEQ ID NO: 3352398 - RNA, 21 nt, Human
cuccugcaggcagccaggcca

SEQ ID NO: 3352399 - RNA, 22 nt, Human
cuccugcaggcagccaggccac

SEQ ID NO: 3352400 - RNA, 11 nt, Human
cuccugugugu

SEQ ID NO: 3352401 - RNA, 23 nt, Human
cuccugugucuugcaauggcagc

SEQ ID NO: 3352402 - RNA, 15 nt, Human
cuccugugucuugca

SEQ ID NO: 3352403 - RNA, 14 nt, Human
cuccuucaccuuug

SEQ ID NO: 3352404 - RNA, 16 nt, Human
cuccuucaccuuuguc

SEQ ID NO: 3352405 - RNA, 19 nt, Human
cuccuucaccuuugucccc

SEQ ID NO: 3352406 - RNA, 21 nt, Human
cuccuucaccuuuguccccac

SEQ ID NO: 3352407 - RNA, 12 nt, Human
cuccucagaucu

SEQ ID NO: 3352408 - RNA, 14 nt, Human
cuccucagaucuuc

SEQ ID NO: 3352409 - RNA, 13 nt, Human
cuccugcaggcag

SEQ ID NO: 3352410 - RNA, 14 nt, Human
cuccugcaggcagc

SEQ ID NO: 3352411 - RNA, 12 nt, Human
cuccugcaggca

SEQ ID NO: 3352412 - RNA, 14 nt, Human
cucccaucucacac

SEQ ID NO: 3352413 - RNA, 15 nt, Human
cucccaucucacaca

SEQ ID NO: 3352414 - RNA, 18 nt, Human
cucccaucucacacauga

SEQ ID NO: 3352415 - RNA, 10 nt, Human
cucccuuccu

SEQ ID NO: 3352416 - RNA, 23 nt, Human
cucccuucccaccucucucacuc

SEQ ID NO: 3352417 - RNA, 17 nt, Human
cucccuuggauuguccc

SEQ ID NO: 3352418 - RNA, 13 nt, Human
cucccuuccucuu

SEQ ID NO: 3352419 - RNA, 14 nt, Human
cucccuuccucuuu

SEQ ID NO: 3352420 - RNA, 15 nt, Human
cucuugaccucaggu

SEQ ID NO: 3352421 - RNA, 13 nt, Human
cucuugaccucag

SEQ ID NO: 3352422 - RNA, 16 nt, Human
cucuugaccucaggug

SEQ ID NO: 3352423 - RNA, 18 nt, Human
cucuugguccugcugcag

SEQ ID NO: 3352424 - RNA, 19 nt, Human
cucuugguccugcugcagu

SEQ ID NO: 3352425 - RNA, 17 nt, Human
cucuugguccugcugca

SEQ ID NO: 3352426 - RNA, 17 nt, Human
cucuuuccaucuacccu

SEQ ID NO: 3352427 - RNA, 15 nt, Human
cucuuuggacacuca

SEQ ID NO: 3352428 - RNA, 18 nt, Human
cucuuuggacacucacac

SEQ ID NO: 3352429 - RNA, 17 nt, Human
cucuuucuauuguuucu

SEQ ID NO: 3352430 - RNA, 16 nt, Human
cucuggcagcucagag

SEQ ID NO: 3352431 - RNA, 17 nt, Human
cucuggcagcucagaga

SEQ ID NO: 3352432 - RNA, 18 nt, Human
cucuggcagcucagagag

SEQ ID NO: 3352433 - RNA, 19 nt, Human
cucuggcagcucagagagg

SEQ ID NO: 3352434 - RNA, 24 nt, Human
cucuuaaaacccaagugccuuagc

SEQ ID NO: 3352435 - RNA, 13 nt, Human
cucuuaaaaccca

SEQ ID NO: 3352436 - RNA, 22 nt, Human
cucuuccaggcugggagagccu

SEQ ID NO: 3352437 - RNA, 21 nt, Human
cucuuccaggcugggagagcc

SEQ ID NO: 3352438 - RNA, 23 nt, Human
cucuuccaggcugggagagccuu

SEQ ID NO: 3352439 - RNA, 12 nt, Human
cucuucuccagg

SEQ ID NO: 3352440 - RNA, 19 nt, Human
cugacagacacaggcccgg

SEQ ID NO: 3352441 - RNA, 21 nt, Human
cugacagacacaggcccggcu

SEQ ID NO: 3352442 - RNA, 11 nt, Human
cugacaggcaa

SEQ ID NO: 3352443 - RNA, 19 nt, Human
cugacaggcaaugcuggcu

SEQ ID NO: 3352444 - RNA, 18 nt, Human
cugacaggcaaugcuggc

SEQ ID NO: 3352445 - RNA, 17 nt, Human
cugacaggcaaugcugg

SEQ ID NO: 3352446 - RNA, 16 nt, Human
cugacaggcaaugcug

SEQ ID NO: 3352447 - RNA, 20 nt, Human
cugacaggcaaugcuggcug

SEQ ID NO: 3352448 - RNA, 17 nt, Human
cugacauuguuggccaa

SEQ ID NO: 3352449 - RNA, 11 nt, Human
cugacccacug

SEQ ID NO: 3352450 - RNA, 24 nt, Human
cugaagucuuuguacagacaacaa

SEQ ID NO: 3352451 - RNA, 15 nt, Human
cugaagucacacagu

SEQ ID NO: 3352452 - RNA, 14 nt, Human
cugaagucacacag

SEQ ID NO: 3352453 - RNA, 16 nt, Human
cugaauacagaggcaa

SEQ ID NO: 3352454 - RNA, 19 nt, Human
cucuuuggucuacacugug

SEQ ID NO: 3352455 - RNA, 18 nt, Human
cucuuugggccuggcucc

SEQ ID NO: 3352456 - RNA, 21 nt, Human
cugaaccuggguaacuaggga

SEQ ID NO: 3352457 - RNA, 16 nt, Human
cugaacuuggcgcugc

SEQ ID NO: 3352458 - RNA, 21 nt, Human
cugaacuuggcgcugccccug

SEQ ID NO: 3352459 - RNA, 15 nt, Human
cugaacuuggcgcug

SEQ ID NO: 3352460 - RNA, 21 nt, Human
cugaagacucauucuucugua

SEQ ID NO: 3352461 - RNA, 19 nt, Human
cugaagacucauucuucug

SEQ ID NO: 3352462 - RNA, 15 nt, Human
cucucucacuccuug

SEQ ID NO: 3352463 - RNA, 16 nt, Human
cucucucacuccuuga

SEQ ID NO: 3352464 - RNA, 12 nt, Human
cucucucaggcc

SEQ ID NO: 3352465 - RNA, 14 nt, Human
cucucucacuccuu

SEQ ID NO: 3352466 - RNA, 14 nt, Human
cucuccuguaccuc

SEQ ID NO: 3352467 - RNA, 15 nt, Human
cucuccuguaccucu

SEQ ID NO: 3352468 - RNA, 13 nt, Human
cucuccuguaccu

SEQ ID NO: 3352469 - RNA, 22 nt, Human
cucuccuguaccucuugagccu

SEQ ID NO: 3352470 - RNA, 17 nt, Human
cucuccuguaccucuug

SEQ ID NO: 3352471 - RNA, 18 nt, Human
cucuccuguaccucuuga

SEQ ID NO: 3352472 - RNA, 13 nt, Human
cucuccagccccu

SEQ ID NO: 3352473 - RNA, 12 nt, Human
cucuccagcccc

SEQ ID NO: 3352474 - RNA, 18 nt, Human
cucucccaucacuucccu

SEQ ID NO: 3352475 - RNA, 14 nt, Human
cucucccaucacuu

SEQ ID NO: 3352476 - RNA, 20 nt, Human
cucucccaucacuucccuac

SEQ ID NO: 3352477 - RNA, 13 nt, Human
cucucccaucacu

SEQ ID NO: 3352478 - RNA, 23 nt, Human
cucucaggccagcugcuugggcu

SEQ ID NO: 3352479 - RNA, 22 nt, Human
cucucaggccagcugcuugggc

SEQ ID NO: 3352480 - RNA, 22 nt, Human
cucuggacaggcauguucucug

SEQ ID NO: 3352481 - RNA, 14 nt, Human
cucugccucugaca

SEQ ID NO: 3352482 - RNA, 14 nt, Human
cucugcccuccaag

SEQ ID NO: 3352483 - RNA, 15 nt, Human
cucugcccuccaaga

SEQ ID NO: 3352484 - RNA, 16 nt, Human
cucugcccuccaagac

SEQ ID NO: 3352485 - RNA, 23 nt, Human
cucugcccuccaagaccuucucc

SEQ ID NO: 3352486 - RNA, 20 nt, Human
cucugcccacucccugcaac

SEQ ID NO: 3352487 - RNA, 16 nt, Human
cucugaggacacuaac

SEQ ID NO: 3352488 - RNA, 22 nt, Human
cucugcaagaauugaagcagga

SEQ ID NO: 3352489 - RNA, 15 nt, Human
cuuccagugaggcuc

SEQ ID NO: 3352490 - RNA, 14 nt, Human
cuuccagugaggcu

SEQ ID NO: 3352491 - RNA, 21 nt, Human
cuuccaggggugggacacccu

SEQ ID NO: 3352492 - RNA, 22 nt, Human
cuuccaggggugggacacccug

SEQ ID NO: 3352493 - RNA, 24 nt, Human
cuuccaggggugggacacccugug

SEQ ID NO: 3352494 - RNA, 22 nt, Human
cuuccacaagagcccaggccuc

SEQ ID NO: 3352495 - RNA, 23 nt, Human
cuuccacaagagcccaggccucc

SEQ ID NO: 3352496 - RNA, 11 nt, Human
cuucagugccu

SEQ ID NO: 3352497 - RNA, 12 nt, Human
cuucagugccuu

SEQ ID NO: 3352498 - RNA, 13 nt, Human
cuucagugccuua

SEQ ID NO: 3352499 - RNA, 18 nt, Human
cuucauuuccugugucuu

SEQ ID NO: 3352500 - RNA, 11 nt, Human
cuucagcugac

SEQ ID NO: 3352501 - RNA, 17 nt, Human
cuucugccauauucugu

SEQ ID NO: 3352502 - RNA, 15 nt, Human
cuucugccauauucu

SEQ ID NO: 3352503 - RNA, 21 nt, Human
cuucugccauauucuguuggc

SEQ ID NO: 3352504 - RNA, 17 nt, Human
cuucugcuucagccucc

SEQ ID NO: 3352505 - RNA, 16 nt, Human
cuucugcuucagccuc

SEQ ID NO: 3352506 - RNA, 13 nt, Human
cuucugcuucagc

SEQ ID NO: 3352507 - RNA, 18 nt, Human
cuucugcuucagccuccc

SEQ ID NO: 3352508 - RNA, 22 nt, Human
cuucuccuucaccuuugucccc

SEQ ID NO: 3352509 - RNA, 19 nt, Human
cuucuccuucaccuuuguc

SEQ ID NO: 3352510 - RNA, 15 nt, Human
cuucuccacccugcu

SEQ ID NO: 3352511 - RNA, 14 nt, Human
cuucuccacccugc

SEQ ID NO: 3352512 - RNA, 14 nt, Human
cuucuccaggcugu

SEQ ID NO: 3352513 - RNA, 17 nt, Human
cuucuccaggcuguauc

SEQ ID NO: 3352514 - RNA, 15 nt, Human
cuucgcuccuguguc

SEQ ID NO: 3352515 - RNA, 14 nt, Human
cuucgcuccugugu

SEQ ID NO: 3352516 - RNA, 13 nt, Human
cuucgcuccugug

SEQ ID NO: 3352517 - RNA, 20 nt, Human
cuucgggaggucgaggcagg

SEQ ID NO: 3352518 - RNA, 21 nt, Human
cuucgggaggucgaggcagga

SEQ ID NO: 3352519 - RNA, 19 nt, Human
cuucgggaggucgaggcag

SEQ ID NO: 3352520 - RNA, 12 nt, Human
cuguuuagauaa

SEQ ID NO: 3352521 - RNA, 18 nt, Human
cuguuuguuucugaaagg

SEQ ID NO: 3352522 - RNA, 13 nt, Human
cuguuuucucuug

SEQ ID NO: 3352523 - RNA, 14 nt, Human
cuguuuucucuuga

SEQ ID NO: 3352524 - RNA, 21 nt, Human
cuguuuguuucugaaagggac

SEQ ID NO: 3352525 - RNA, 23 nt, Human
cuguuuguuucugaaagggacgc

SEQ ID NO: 3352526 - RNA, 17 nt, Human
cuguuuucucuugagag

SEQ ID NO: 3352527 - RNA, 15 nt, Human
cuuaacuucacauau

SEQ ID NO: 3352528 - RNA, 16 nt, Human
cuuaacuucacauauu

SEQ ID NO: 3352529 - RNA, 17 nt, Human
cuuaacuucacauauug

SEQ ID NO: 3352530 - RNA, 22 nt, Human
cuuaacuucacauauugauuuc

SEQ ID NO: 3352531 - RNA, 12 nt, Human
cuuaacuucaca

SEQ ID NO: 3352532 - RNA, 14 nt, Human
cuuaacuucacaua

SEQ ID NO: 3352533 - RNA, 14 nt, Human
cuuaaucuaaaugg

SEQ ID NO: 3352534 - RNA, 17 nt, Human
cuuagguuggcaaaaag

SEQ ID NO: 3352535 - RNA, 21 nt, Human
cuuauauucaaccauggacuu

SEQ ID NO: 3352536 - RNA, 19 nt, Human
cuuauauucaaccauggac

SEQ ID NO: 3352537 - RNA, 15 nt, Human
cuuagacagucccug

SEQ ID NO: 3352538 - RNA, 16 nt, Human
cuuagacagucccugc

SEQ ID NO: 3352539 - RNA, 14 nt, Human
cuuagacagucccu

SEQ ID NO: 3352540 - RNA, 15 nt, Human
cuuagaagucacaca

SEQ ID NO: 3352541 - RNA, 17 nt, Human
cuuagacagucccugcc

SEQ ID NO: 3352542 - RNA, 18 nt, Human
cuuagacagucccugcca

SEQ ID NO: 3352543 - RNA, 19 nt, Human
cuuagacagucccugccaa

SEQ ID NO: 3352544 - RNA, 11 nt, Human
cuuagacaguc

SEQ ID NO: 3352545 - RNA, 16 nt, Human
cuuacuguacaugaaa

SEQ ID NO: 3352546 - RNA, 13 nt, Human
cuuacuguacaug

SEQ ID NO: 3352547 - RNA, 16 nt, Human
cuuacuuacuaaaaua

SEQ ID NO: 3352548 - RNA, 19 nt, Human
cuuacuuacuaaaauauau

SEQ ID NO: 3352549 - RNA, 15 nt, Human
cuuacgugaguccug

SEQ ID NO: 3352550 - RNA, 22 nt, Human
cuuacuaaaauauauauagaaa

SEQ ID NO: 3352551 - RNA, 15 nt, Human
cuuacuaaaauauau

SEQ ID NO: 3352552 - RNA, 14 nt, Human
cuuacuaaaauaua

SEQ ID NO: 3352553 - RNA, 22 nt, Human
cuuuuguucuugguuuguaaau

SEQ ID NO: 3352554 - RNA, 20 nt, Human
cuuuuguucuugguuuguaa

SEQ ID NO: 3352555 - RNA, 15 nt, Human
cuuuucuguuugcua

SEQ ID NO: 3352556 - RNA, 23 nt, Human
cuuuucuguccgagcuuugaaaa

SEQ ID NO: 3352557 - RNA, 21 nt, Human
cuuuguuuguugucagcugaa

SEQ ID NO: 3352558 - RNA, 20 nt, Human
cuuuguuuguugucagcuga

SEQ ID NO: 3352559 - RNA, 16 nt, Human
gaaaacaugcuacaca

SEQ ID NO: 3352560 - RNA, 18 nt, Human
gaaaacaugcuacacacu

SEQ ID NO: 3352561 - RNA, 20 nt, Human
gaaaacacuguucucugccc

SEQ ID NO: 3352562 - RNA, 21 nt, Human
gaaaacacuguucucugcccu

SEQ ID NO: 3352563 - RNA, 18 nt, Human
gaaaacacuguucucugc

SEQ ID NO: 3352564 - RNA, 19 nt, Human
gaaaacacuguucucugcc

SEQ ID NO: 3352565 - RNA, 16 nt, Human
cuuuuuuagaguugau

SEQ ID NO: 3352566 - RNA, 19 nt, Human
gaaaacaugcuacacacug

SEQ ID NO: 3352567 - RNA, 14 nt, Human
cuuugcuugaaaga

SEQ ID NO: 3352568 - RNA, 23 nt, Human
cuuuggaaagacuuuuccaaccc

SEQ ID NO: 3352569 - RNA, 12 nt, Human
cuuuggaaagac

SEQ ID NO: 3352570 - RNA, 15 nt, Human
cuuuguucuggcucu

SEQ ID NO: 3352571 - RNA, 16 nt, Human
cuuuguucuggcucuu

SEQ ID NO: 3352572 - RNA, 21 nt, Human
cuuuguucuggcucuuccagg

SEQ ID NO: 3352573 - RNA, 19 nt, Human
cuuugugaggaagccgcug

SEQ ID NO: 3352574 - RNA, 13 nt, Human
cuuuguggcuucc

SEQ ID NO: 3352575 - RNA, 23 nt, Human
cuuugugaggaagccgcuggggc

SEQ ID NO: 3352576 - RNA, 23 nt, Human
cuuugggaggccaaggugggagg

SEQ ID NO: 3352577 - RNA, 13 nt, Human
cuuucugaaauaa

SEQ ID NO: 3352578 - RNA, 15 nt, Human
cuuuagcgcccaguu

SEQ ID NO: 3352579 - RNA, 19 nt, Human
cuuuaccuuuuuuauacau

SEQ ID NO: 3352580 - RNA, 20 nt, Human
cuuuaccuuuuuuauacaua

SEQ ID NO: 3352581 - RNA, 17 nt, Human
cuuuaccuuuuuuauac

SEQ ID NO: 3352582 - RNA, 16 nt, Human
cuuguuaagauaguua

SEQ ID NO: 3352583 - RNA, 16 nt, Human
cuuguggucccacccc

SEQ ID NO: 3352584 - RNA, 19 nt, Human
cuuguggucccaccccaca

SEQ ID NO: 3352585 - RNA, 15 nt, Human
cuuguggucccaccc

SEQ ID NO: 3352586 - RNA, 18 nt, Human
cuugggccacugugaaga

SEQ ID NO: 3352587 - RNA, 20 nt, Human
cuugggccacugugaagaga

SEQ ID NO: 3352588 - RNA, 14 nt, Human
cuugguuuguaaau

SEQ ID NO: 3352589 - RNA, 15 nt, Human
cuugguuuguaaauu

SEQ ID NO: 3352590 - RNA, 12 nt, Human
cuugagccuggg

SEQ ID NO: 3352591 - RNA, 15 nt, Human
cuugagccugggagg

SEQ ID NO: 3352592 - RNA, 15 nt, Human
cuugaggguugggcu

SEQ ID NO: 3352593 - RNA, 20 nt, Human
cuugaguugauucagcucug

SEQ ID NO: 3352594 - RNA, 18 nt, Human
cuugaguugauucagcuc

SEQ ID NO: 3352595 - RNA, 19 nt, Human
cuugaguugauucagcucu

SEQ ID NO: 3352596 - RNA, 18 nt, Human
cuugcaauggcagccuug

SEQ ID NO: 3352597 - RNA, 17 nt, Human
cuugcaauggcagccuu

SEQ ID NO: 3352598 - RNA, 16 nt, Human
cuugcaauggcagccu

SEQ ID NO: 3352599 - RNA, 15 nt, Human
cuugcaauggcagcc

SEQ ID NO: 3352600 - RNA, 20 nt, Human
cuugcagacucuacagaggc

SEQ ID NO: 3352601 - RNA, 21 nt, Human
cuugcagacucuacagaggcc

SEQ ID NO: 3352602 - RNA, 22 nt, Human
cuugcucugcugacagacacag

SEQ ID NO: 3352603 - RNA, 17 nt, Human
cuugcucugcugacaga

SEQ ID NO: 3352604 - RNA, 20 nt, Human
cuugcuucaaccccaugaga

SEQ ID NO: 3352605 - RNA, 14 nt, Human
cuuggaagcuccgc

SEQ ID NO: 3352606 - RNA, 20 nt, Human
cuuggaagcuccgcuuucua

SEQ ID NO: 3352607 - RNA, 13 nt, Human
cuugcaugaggcu

SEQ ID NO: 3352608 - RNA, 14 nt, Human
cuugcaugaggcua

SEQ ID NO: 3352609 - RNA, 22 nt, Human
gaaugguuuucaaaauaaaaau

SEQ ID NO: 3352610 - RNA, 13 nt, Human
gaaugucagugug

SEQ ID NO: 3352611 - RNA, 14 nt, Human
gaaugucaguguga

SEQ ID NO: 3352612 - RNA, 23 nt, Human
gaaugaaccacaucuugcucugc

SEQ ID NO: 3352613 - RNA, 18 nt, Human
gaaugaaccacaucuugc

SEQ ID NO: 3352614 - RNA, 22 nt, Human
gaaugaaccacaucuugcucug

SEQ ID NO: 3352615 - RNA, 11 nt, Human
gaaugcagugg

SEQ ID NO: 3352616 - RNA, 15 nt, Human
gaauuguaaggaaug

SEQ ID NO: 3352617 - RNA, 22 nt, Human
gaauuguaaggaaugauuaauu

SEQ ID NO: 3352618 - RNA, 15 nt, Human
gaauuucccaaagca

SEQ ID NO: 3352619 - RNA, 17 nt, Human
gaauucucuaguuugau

SEQ ID NO: 3352620 - RNA, 17 nt, Human
gaauucucagaaucuca

SEQ ID NO: 3352621 - RNA, 20 nt, Human
gaaugucagugugacugauc

SEQ ID NO: 3352622 - RNA, 21 nt, Human
gaaugucagugugacugaucu

SEQ ID NO: 3352623 - RNA, 14 nt, Human
gaauugaaaaacca

SEQ ID NO: 3352624 - RNA, 19 nt, Human
gaauucucuaguuugauua

SEQ ID NO: 3352625 - RNA, 17 nt, Human
gaauaauacaguaucuc

SEQ ID NO: 3352626 - RNA, 21 nt, Human
gaauacagaggcaacugcauu

SEQ ID NO: 3352627 - RNA, 19 nt, Human
gaauaacauguaauuaagu

SEQ ID NO: 3352628 - RNA, 18 nt, Human
gaauaacauguaauuaag

SEQ ID NO: 3352629 - RNA, 14 nt, Human
gaauaacauguaau

SEQ ID NO: 3352630 - RNA, 20 nt, Human
gaaguuugagaucagccugg

SEQ ID NO: 3352631 - RNA, 22 nt, Human
gaauagcugggacuacaggugu

SEQ ID NO: 3352632 - RNA, 15 nt, Human
gaauagcugggacua

SEQ ID NO: 3352633 - RNA, 23 nt, Human
gaauagcugggacuacaggugug

SEQ ID NO: 3352634 - RNA, 15 nt, Human
gaauaccuguccccc

SEQ ID NO: 3352635 - RNA, 13 nt, Human
gaauaccuguccc

SEQ ID NO: 3352636 - RNA, 22 nt, Human
gaaguaauaugcacacauuuuu

SEQ ID NO: 3352637 - RNA, 21 nt, Human
gaaguaauaugcacacauuuu

SEQ ID NO: 3352638 - RNA, 15 nt, Human
gaaguacuggagaaa

SEQ ID NO: 3352639 - RNA, 18 nt, Human
gaaguacuauaauuuacc

SEQ ID NO: 3352640 - RNA, 16 nt, Human
gaagggggcugggaca

SEQ ID NO: 3352641 - RNA, 19 nt, Human
gaagggggcugggacaugg

SEQ ID NO: 3352642 - RNA, 14 nt, Human
gaagcggcuggcag

SEQ ID NO: 3352643 - RNA, 15 nt, Human
gaagggggcugggac

SEQ ID NO: 3352644 - RNA, 21 nt, Human
gaaguuucugccgcagcccug

SEQ ID NO: 3352645 - RNA, 15 nt, Human
gaagucuuagaugua

SEQ ID NO: 3352646 - RNA, 20 nt, Human
gaaguuucugccgcagcccu

SEQ ID NO: 3352647 - RNA, 23 nt, Human
gaacuuugaccucugcagcaaua

SEQ ID NO: 3352648 - RNA, 11 nt, Human
gaagacuuugg

SEQ ID NO: 3352649 - RNA, 13 nt, Human
gaagacuuuggaa

SEQ ID NO: 3352650 - RNA, 19 nt, Human
gaagacuucaucccucugg

SEQ ID NO: 3352651 - RNA, 20 nt, Human
gaagacuuuucuuucagcca

SEQ ID NO: 3352652 - RNA, 14 nt, Human
gaagacuuuggaaa

SEQ ID NO: 3352653 - RNA, 17 nt, Human
gaagacuuuggaaagag

SEQ ID NO: 3352654 - RNA, 19 nt, Human
gaagagaaugcacaaacag

SEQ ID NO: 3352655 - RNA, 20 nt, Human
gaagccagcaggcucucagg

SEQ ID NO: 3352656 - RNA, 19 nt, Human
gaagccagcaggcucucag

SEQ ID NO: 3352657 - RNA, 21 nt, Human
gaagccagcaggcucucaggc

SEQ ID NO: 3352658 - RNA, 22 nt, Human
gaagccagcaggcucucaggcc

SEQ ID NO: 3352659 - RNA, 13 nt, Human
gaagcccaggaaa

SEQ ID NO: 3352660 - RNA, 15 nt, Human
gaagcccaggaaagg

SEQ ID NO: 3352661 - RNA, 16 nt, Human
gaagcccaggaaaggc

SEQ ID NO: 3352662 - RNA, 23 nt, Human
gaagcccuucuaccuuccugcaa

SEQ ID NO: 3352663 - RNA, 23 nt, Human
gaagcccaggaaaggcuccagga

SEQ ID NO: 3352664 - RNA, 17 nt, Human
gaagcauuuacuuugug

SEQ ID NO: 3352665 - RNA, 20 nt, Human
gaagauaauauuaaggaaga

SEQ ID NO: 3352666 - RNA, 22 nt, Human
gaaccuuuugagugccuuacac

SEQ ID NO: 3352667 - RNA, 19 nt, Human
gaaccuuuugagugccuua

SEQ ID NO: 3352668 - RNA, 21 nt, Human
gaaccuuuugagugccuuaca

SEQ ID NO: 3352669 - RNA, 18 nt, Human
gaaccuuuugagugccuu

SEQ ID NO: 3352670 - RNA, 13 nt, Human
gaacacucugaga

SEQ ID NO: 3352671 - RNA, 14 nt, Human
gaacacucugagac

SEQ ID NO: 3352672 - RNA, 15 nt, Human
gaacacucugagacu

SEQ ID NO: 3352673 - RNA, 20 nt, Human
gaccuucuccuucaccuuug

SEQ ID NO: 3352674 - RNA, 21 nt, Human
gaccuucuccuucaccuuugu

SEQ ID NO: 3352675 - RNA, 14 nt, Human
gaccuugaacuggg

SEQ ID NO: 3352676 - RNA, 15 nt, Human
gaccuucuccuucac

SEQ ID NO: 3352677 - RNA, 16 nt, Human
gaccuucuccuucacc

SEQ ID NO: 3352678 - RNA, 14 nt, Human
gaccuucuccuuca

SEQ ID NO: 3352679 - RNA, 20 nt, Human
gacccuugccgucuaccuga

SEQ ID NO: 3352680 - RNA, 23 nt, Human
gacccuugccgucuaccugaggg

SEQ ID NO: 3352681 - RNA, 19 nt, Human
gacccuugccgucuaccug

SEQ ID NO: 3352682 - RNA, 16 nt, Human
gacuaacuugucuuug

SEQ ID NO: 3352683 - RNA, 23 nt, Human
gacuaacuugucuuuggacccug

SEQ ID NO: 3352684 - RNA, 11 nt, Human
gacguguuaug

SEQ ID NO: 3352685 - RNA, 14 nt, Human
gacguguuaugacu

SEQ ID NO: 3352686 - RNA, 22 nt, Human
gaccuuuaagagaaaugagcug

SEQ ID NO: 3352687 - RNA, 11 nt, Human
gaccuuucaau

SEQ ID NO: 3352688 - RNA, 19 nt, Human
gaccuuucaauaggaaaaa

SEQ ID NO: 3352689 - RNA, 22 nt, Human
gacgcugugcugcccugcccac

SEQ ID NO: 3352690 - RNA, 21 nt, Human
gacgcugugcugcccugccca

SEQ ID NO: 3352691 - RNA, 13 nt, Human
gacggagucccac

SEQ ID NO: 3352692 - RNA, 23 nt, Human
gacggagucccaccuuggcugca

SEQ ID NO: 3352693 - RNA, 12 nt, Human
gacuucaucccu

SEQ ID NO: 3352694 - RNA, 20 nt, Human
gacuucaucccucuggggcu

SEQ ID NO: 3352695 - RNA, 15 nt, Human
gacuuacuguacaug

SEQ ID NO: 3352696 - RNA, 16 nt, Human
gacuuacuguacauga

SEQ ID NO: 3352697 - RNA, 12 nt, Human
gacuuacuguac

SEQ ID NO: 3352698 - RNA, 18 nt, Human
gacuuacuguacaugaaa

SEQ ID NO: 3352699 - RNA, 23 nt, Human
gacuuacuguacaugaaaacaca

SEQ ID NO: 3352700 - RNA, 23 nt, Human
gacuggccaagguuuggggaaga

SEQ ID NO: 3352701 - RNA, 16 nt, Human
gacugaauuucuuuug

SEQ ID NO: 3352702 - RNA, 21 nt, Human
gacucuacagaggccaugggc

SEQ ID NO: 3352703 - RNA, 15 nt, Human
gacucuacagaggcc

SEQ ID NO: 3352704 - RNA, 18 nt, Human
gacuccugcaggcagcca

SEQ ID NO: 3352705 - RNA, 19 nt, Human
gacuccugcaggcagccag

SEQ ID NO: 3352706 - RNA, 20 nt, Human
gacuccugcaggcagccagg

SEQ ID NO: 3352707 - RNA, 15 nt, Human
gacuacaggcaccca

SEQ ID NO: 3352708 - RNA, 13 nt, Human
gacuacaggcacc

SEQ ID NO: 3352709 - RNA, 18 nt, Human
gacuacaggcacccacca

SEQ ID NO: 3352710 - RNA, 12 nt, Human
gacuacaggcac

SEQ ID NO: 3352711 - RNA, 20 nt, Human
gacagagcuacacaggggaa

SEQ ID NO: 3352712 - RNA, 16 nt, Human
gacagagugagacucu

SEQ ID NO: 3352713 - RNA, 21 nt, Human
gacagagucucacuguugccc

SEQ ID NO: 3352714 - RNA, 23 nt, Human
gacagaggcagccccauucugcc

SEQ ID NO: 3352715 - RNA, 14 nt, Human
gacagagucucacu

SEQ ID NO: 3352716 - RNA, 22 nt, Human
gaauuucccaaagcagugcaug

SEQ ID NO: 3352717 - RNA, 16 nt, Human
gaauuucccaaagcag

SEQ ID NO: 3352718 - RNA, 18 nt, Human
gaauuucccaaagcagug

SEQ ID NO: 3352719 - RNA, 22 nt, Human
gacacgaauauugcugauggug

SEQ ID NO: 3352720 - RNA, 21 nt, Human
gacacuaaccacgcuggaccu

SEQ ID NO: 3352721 - RNA, 22 nt, Human
gacagacacaggcccggcucca

SEQ ID NO: 3352722 - RNA, 20 nt, Human
gacagacacaggcccggcuc

SEQ ID NO: 3352723 - RNA, 16 nt, Human
gacacuagaagauuuu

SEQ ID NO: 3352724 - RNA, 17 nt, Human
gacagacacaggcccgg

SEQ ID NO: 3352725 - RNA, 19 nt, Human
gacaggcaaugcuggcugu

SEQ ID NO: 3352726 - RNA, 18 nt, Human
gacaggcaaugcuggcug

SEQ ID NO: 3352727 - RNA, 20 nt, Human
gacaggcaagcaccuccugc

SEQ ID NO: 3352728 - RNA, 21 nt, Human
gacaggcauguucucugagga

SEQ ID NO: 3352729 - RNA, 20 nt, Human
gacaggcauguucucugagg

SEQ ID NO: 3352730 - RNA, 23 nt, Human
gacaggcaaugcuggcuguuggc

SEQ ID NO: 3352731 - RNA, 18 nt, Human
gacaggcaagcaccuccu

SEQ ID NO: 3352732 - RNA, 17 nt, Human
gacaggcaagcaccucc

SEQ ID NO: 3352733 - RNA, 13 nt, Human
gacaggcaagcac

SEQ ID NO: 3352734 - RNA, 22 nt, Human
gacaggcauguucucugaggac

SEQ ID NO: 3352735 - RNA, 24 nt, Human
gacagggcacaccgggcacucaga

SEQ ID NO: 3352736 - RNA, 22 nt, Human
gacaguuaagagaaaugagcuu

SEQ ID NO: 3352737 - RNA, 23 nt, Human
gacaucaacugcaucaagaugug

SEQ ID NO: 3352738 - RNA, 16 nt, Human
gacaucaacugcauca

SEQ ID NO: 3352739 - RNA, 10 nt, Human
gacccugagg

SEQ ID NO: 3352740 - RNA, 11 nt, Human
gacccugaggc

SEQ ID NO: 3352741 - RNA, 12 nt, Human
gacccugaggcc

SEQ ID NO: 3352742 - RNA, 16 nt, Human
gacccugaggcccaga

SEQ ID NO: 3352743 - RNA, 17 nt, Human
gacccugcccugugggc

SEQ ID NO: 3352744 - RNA, 20 nt, Human
gacccugcccugugggcccc

SEQ ID NO: 3352745 - RNA, 22 nt, Human
gacccugcccugugggccccca

SEQ ID NO: 3352746 - RNA, 17 nt, Human
gacccaugcugcccugu

SEQ ID NO: 3352747 - RNA, 19 nt, Human
gacccaugcugcccuguga

SEQ ID NO: 3352748 - RNA, 20 nt, Human
gacccaugcugcccugugag

SEQ ID NO: 3352749 - RNA, 18 nt, Human
gacccaugcugcccugug

SEQ ID NO: 3352750 - RNA, 12 nt, Human
gacccacugcuu

SEQ ID NO: 3352751 - RNA, 18 nt, Human
gaccacaaaacuuuucua

SEQ ID NO: 3352752 - RNA, 20 nt, Human
gaccagcaccaucucuccuc

SEQ ID NO: 3352753 - RNA, 21 nt, Human
gaccagcaccaucucuccucc

SEQ ID NO: 3352754 - RNA, 19 nt, Human
gaccagagcugccaccugc

SEQ ID NO: 3352755 - RNA, 23 nt, Human
gaccagacaccuugacagggcac

SEQ ID NO: 3352756 - RNA, 21 nt, Human
gaccagagcugccaccugccu

SEQ ID NO: 3352757 - RNA, 16 nt, Human
gaccacguuucuaaag

SEQ ID NO: 3352758 - RNA, 21 nt, Human
gaccagacaccuugacagggc

SEQ ID NO: 3352759 - RNA, 22 nt, Human
gaccagacaccuugacagggca

SEQ ID NO: 3352760 - RNA, 21 nt, Human
gaugaaaugaggucagagccu

SEQ ID NO: 3352761 - RNA, 15 nt, Human
gaugaaaugagguca

SEQ ID NO: 3352762 - RNA, 19 nt, Human
gaucuucuuuauaauucua

SEQ ID NO: 3352763 - RNA, 22 nt, Human
gaucuucuguggguuucuaaag

SEQ ID NO: 3352764 - RNA, 23 nt, Human
gaugcaccagcccuuagcaggga

SEQ ID NO: 3352765 - RNA, 15 nt, Human
gaugcaccagcccuu

SEQ ID NO: 3352766 - RNA, 14 nt, Human
gaugagaggaaauc

SEQ ID NO: 3352767 - RNA, 14 nt, Human
gaugcaccagcccu

SEQ ID NO: 3352768 - RNA, 23 nt, Human
gaugagaaauaaaguuucuguug

SEQ ID NO: 3352769 - RNA, 18 nt, Human
gaugaccuugaaugaugc

SEQ ID NO: 3352770 - RNA, 16 nt, Human
gaugccugguggcagc

SEQ ID NO: 3352771 - RNA, 15 nt, Human
gaugccugguggcag

SEQ ID NO: 3352772 - RNA, 14 nt, Human
gaugcagugcuucc

SEQ ID NO: 3352773 - RNA, 14 nt, Human
gaugccugguggca

SEQ ID NO: 3352774 - RNA, 19 nt, Human
gaugcagccucacaguccu

SEQ ID NO: 3352775 - RNA, 17 nt, Human
gauccucccaccucagc

SEQ ID NO: 3352776 - RNA, 21 nt, Human
gauccucccaccucagccucc

SEQ ID NO: 3352777 - RNA, 14 nt, Human
gauccuccaggugc

SEQ ID NO: 3352778 - RNA, 16 nt, Human
gauccucccaccucag

SEQ ID NO: 3352779 - RNA, 12 nt, Human
gauccuccaggu

SEQ ID NO: 3352780 - RNA, 13 nt, Human
gaucauccacugu

SEQ ID NO: 3352781 - RNA, 13 nt, Human
gaucuaggaagac

SEQ ID NO: 3352782 - RNA, 14 nt, Human
gaucuaggaagacu

SEQ ID NO: 3352783 - RNA, 18 nt, Human
gaucuaggaagacuuugg

SEQ ID NO: 3352784 - RNA, 20 nt, Human
gaucuggguucacugcaacc

SEQ ID NO: 3352785 - RNA, 20 nt, Human
gaucuaggaagacuuuggaa

SEQ ID NO: 3352786 - RNA, 12 nt, Human
gauccugagcca

SEQ ID NO: 3352787 - RNA, 16 nt, Human
gauacaaaagcaugug

SEQ ID NO: 3352788 - RNA, 18 nt, Human
gauauaugcucugcaugu

SEQ ID NO: 3352789 - RNA, 20 nt, Human
gauagugucccacggugccu

SEQ ID NO: 3352790 - RNA, 14 nt, Human
gaucacagccucug

SEQ ID NO: 3352791 - RNA, 20 nt, Human
gaucacggcucacugcagcc

SEQ ID NO: 3352792 - RNA, 23 nt, Human
gaucacggcucacugcagccuca

SEQ ID NO: 3352793 - RNA, 23 nt, Human
gauaauacaccacuacauucugu

SEQ ID NO: 3352794 - RNA, 24 nt, Human
gauaauacaccacuacauucuguu

SEQ ID NO: 3352795 - RNA, 12 nt, Human
gauaauacacca

SEQ ID NO: 3352796 - RNA, 15 nt, Human
gcaaaccaucauuga

SEQ ID NO: 3352797 - RNA, 17 nt, Human
gcaaaccaucauugaaa

SEQ ID NO: 3352798 - RNA, 19 nt, Human
gcaaaccaucauugaaauc

SEQ ID NO: 3352799 - RNA, 20 nt, Human
gcaaaccaucauugaaaucu

SEQ ID NO: 3352800 - RNA, 21 nt, Human
gcaaaccaucauugaaaucuu

SEQ ID NO: 3352801 - RNA, 16 nt, Human
gcaaaccaucauugaa

SEQ ID NO: 3352802 - RNA, 18 nt, Human
gcaacugcauuggcuuug

SEQ ID NO: 3352803 - RNA, 14 nt, Human
gcaaggcugucaau

SEQ ID NO: 3352804 - RNA, 18 nt, Human
gcaaggcugucaauuaca

SEQ ID NO: 3352805 - RNA, 14 nt, Human
gcaaggucauuuuu

SEQ ID NO: 3352806 - RNA, 13 nt, Human
gcaaggcugucaa

SEQ ID NO: 3352807 - RNA, 17 nt, Human
gcaauccugcaagaaca

SEQ ID NO: 3352808 - RNA, 16 nt, Human
gcaagcaccuccugcc

SEQ ID NO: 3352809 - RNA, 15 nt, Human
gcaagcaccuccugc

SEQ ID NO: 3352810 - RNA, 20 nt, Human
gcaagcaccuccugccucga

SEQ ID NO: 3352811 - RNA, 18 nt, Human
gcaagcaccuccugccuc

SEQ ID NO: 3352812 - RNA, 22 nt, Human
gauuucuguuuagauaauacac

SEQ ID NO: 3352813 - RNA, 21 nt, Human
gauuucuguuuagauaauaca

SEQ ID NO: 3352814 - RNA, 19 nt, Human
gauuuguuaaugauagcua

SEQ ID NO: 3352815 - RNA, 19 nt, Human
gauucuuuccugaggcugg

SEQ ID NO: 3352816 - RNA, 17 nt, Human
gauucccaagcucugcu

SEQ ID NO: 3352817 - RNA, 16 nt, Human
gauucccaagcucugc

SEQ ID NO: 3352818 - RNA, 20 nt, Human
gauucuuuccugaggcuggg

SEQ ID NO: 3352819 - RNA, 22 nt, Human
gauucuuuccugaggcugggcu

SEQ ID NO: 3352820 - RNA, 16 nt, Human
gauugcaacaggcugg

SEQ ID NO: 3352821 - RNA, 17 nt, Human
gauugcaacaggcuggg

SEQ ID NO: 3352822 - RNA, 15 nt, Human
gauugcaacaggcug

SEQ ID NO: 3352823 - RNA, 13 nt, Human
gauuacaagcgug

SEQ ID NO: 3352824 - RNA, 12 nt, Human
gauucagacagc

SEQ ID NO: 3352825 - RNA, 13 nt, Human
gauucagacagcu

SEQ ID NO: 3352826 - RNA, 14 nt, Human
gauucagacagcug

SEQ ID NO: 3352827 - RNA, 17 nt, Human
gauucagacagcugccu

SEQ ID NO: 3352828 - RNA, 15 nt, Human
gauucagcucugcaa

SEQ ID NO: 3352829 - RNA, 15 nt, Human
gauucccaagcucug

SEQ ID NO: 3352830 - RNA, 18 nt, Human
gauguucuagcauggcug

SEQ ID NO: 3352831 - RNA, 20 nt, Human
gaugccugguggcagcugcg

SEQ ID NO: 3352832 - RNA, 23 nt, Human
gcaugaaguaauaugcacacauu

SEQ ID NO: 3352833 - RNA, 16 nt, Human
gcaucaggccaggccc

SEQ ID NO: 3352834 - RNA, 17 nt, Human
gcaucaggccaggcccu

SEQ ID NO: 3352835 - RNA, 13 nt, Human
gcaucaggccagg

SEQ ID NO: 3352836 - RNA, 15 nt, Human
gcaucaggccaggcc

SEQ ID NO: 3352837 - RNA, 17 nt, Human
gcaugccuggauggggc

SEQ ID NO: 3352838 - RNA, 22 nt, Human
gcaugccuggauggggcugcac

SEQ ID NO: 3352839 - RNA, 15 nt, Human
gcaugcugucccuua

SEQ ID NO: 3352840 - RNA, 15 nt, Human
gcaugccuggauggg

SEQ ID NO: 3352841 - RNA, 17 nt, Human
gcauguuugugauugac

SEQ ID NO: 3352842 - RNA, 22 nt, Human
gcauguucucugaggacacuaa

SEQ ID NO: 3352843 - RNA, 18 nt, Human
gcauuuguuugaacugau

SEQ ID NO: 3352844 - RNA, 17 nt, Human
gcauuugcugaauacag

SEQ ID NO: 3352845 - RNA, 23 nt, Human
gcauuugcugaauacagaggcaa

SEQ ID NO: 3352846 - RNA, 12 nt, Human
gcauuccccacu

SEQ ID NO: 3352847 - RNA, 22 nt, Human
gcauuuugcuaaaugugaauga

SEQ ID NO: 3352848 - RNA, 16 nt, Human
gccaaaggaagcacau

SEQ ID NO: 3352849 - RNA, 20 nt, Human
gccaaaggaagcacaugccu

SEQ ID NO: 3352850 - RNA, 14 nt, Human
gccaaaggaagcac

SEQ ID NO: 3352851 - RNA, 21 nt, Human
gccaaacucaccugccccuca

SEQ ID NO: 3352852 - RNA, 19 nt, Human
gccaaacucaccugccccu

SEQ ID NO: 3352853 - RNA, 15 nt, Human
gcagugggagcugcc

SEQ ID NO: 3352854 - RNA, 16 nt, Human
gcagugggagcugccu

SEQ ID NO: 3352855 - RNA, 23 nt, Human
gcagugcuuccaaggauggacca

SEQ ID NO: 3352856 - RNA, 12 nt, Human
gcagggcucagc

SEQ ID NO: 3352857 - RNA, 16 nt, Human
gcagggagggcuucug

SEQ ID NO: 3352858 - RNA, 20 nt, Human
gcaggauucuuccucccucc

SEQ ID NO: 3352859 - RNA, 15 nt, Human
gcauauucaggaagc

SEQ ID NO: 3352860 - RNA, 17 nt, Human
gcauauucaggaagcuc

SEQ ID NO: 3352861 - RNA, 18 nt, Human
gcauauucaggaagcuca

SEQ ID NO: 3352862 - RNA, 20 nt, Human
gcauauucaggaagcucagg

SEQ ID NO: 3352863 - RNA, 21 nt, Human
gcaucaagaugugacauguuu

SEQ ID NO: 3352864 - RNA, 18 nt, Human
gcagugggagcugccugu

SEQ ID NO: 3352865 - RNA, 17 nt, Human
gcagugggagcugccug

SEQ ID NO: 3352866 - RNA, 15 nt, Human
gcagaguugaagaca

SEQ ID NO: 3352867 - RNA, 17 nt, Human
gcagagaccaucccuga

SEQ ID NO: 3352868 - RNA, 14 nt, Human
gcagagaccauccc

SEQ ID NO: 3352869 - RNA, 15 nt, Human
gcagagaccaucccu

SEQ ID NO: 3352870 - RNA, 23 nt, Human
gcagagaaugaaagggcccagag

SEQ ID NO: 3352871 - RNA, 22 nt, Human
gcagagaaugaaagggcccaga

SEQ ID NO: 3352872 - RNA, 21 nt, Human
gcagagaauucucuuauccaa

SEQ ID NO: 3352873 - RNA, 21 nt, Human
gcagagaaugaaagggcccag

SEQ ID NO: 3352874 - RNA, 20 nt, Human
gcagagaaugaaagggccca

SEQ ID NO: 3352875 - RNA, 19 nt, Human
gcagagaaugaaagggccc

SEQ ID NO: 3352876 - RNA, 19 nt, Human
gcagaguugaagacagagc

SEQ ID NO: 3352877 - RNA, 16 nt, Human
gcagaguugaagacag

SEQ ID NO: 3352878 - RNA, 17 nt, Human
gcagaguugaagacaga

SEQ ID NO: 3352879 - RNA, 14 nt, Human
gcagccuggacccu

SEQ ID NO: 3352880 - RNA, 22 nt, Human
gcagccucaaccuccugggcua

SEQ ID NO: 3352881 - RNA, 21 nt, Human
gcagccucaaccuccugggcu

SEQ ID NO: 3352882 - RNA, 20 nt, Human
gcagccucaaccuccugggc

SEQ ID NO: 3352883 - RNA, 19 nt, Human
gcagccucaaccuccuggg

SEQ ID NO: 3352884 - RNA, 20 nt, Human
gcagcagggagggcuucugc

SEQ ID NO: 3352885 - RNA, 19 nt, Human
gcaccacugcacuccagcc

SEQ ID NO: 3352886 - RNA, 15 nt, Human
gcaccuccugccucg

SEQ ID NO: 3352887 - RNA, 14 nt, Human
gcaccuccugccuc

SEQ ID NO: 3352888 - RNA, 17 nt, Human
gcacccggccccugcug

SEQ ID NO: 3352889 - RNA, 15 nt, Human
gcacccggccccugc

SEQ ID NO: 3352890 - RNA, 14 nt, Human
gcacccggccccug

SEQ ID NO: 3352891 - RNA, 22 nt, Human
gcacaugccucucucaggccaa

SEQ ID NO: 3352892 - RNA, 16 nt, Human
gcacagcuucauuucc

SEQ ID NO: 3352893 - RNA, 13 nt, Human
gcaaugaccuuuc

SEQ ID NO: 3352894 - RNA, 14 nt, Human
gcaaugaccuuuca

SEQ ID NO: 3352895 - RNA, 19 nt, Human
gcacagcuaacauggaagu

SEQ ID NO: 3352896 - RNA, 18 nt, Human
gcacuaaggugugcucug

SEQ ID NO: 3352897 - RNA, 17 nt, Human
gcacuaaggugugcucu

SEQ ID NO: 3352898 - RNA, 22 nt, Human
gcacugggcuuggggaccagag

SEQ ID NO: 3352899 - RNA, 23 nt, Human
gcacugggcuuggggaccagagc

SEQ ID NO: 3352900 - RNA, 14 nt, Human
gcacugggcuuggg

SEQ ID NO: 3352901 - RNA, 13 nt, Human
gcagaaggaagac

SEQ ID NO: 3352902 - RNA, 14 nt, Human
gcagaaggaagacu

SEQ ID NO: 3352903 - RNA, 12 nt, Human
gcagaaggaaga

SEQ ID NO: 3352904 - RNA, 14 nt, Human
gccuggacccugug

SEQ ID NO: 3352905 - RNA, 11 nt, Human
gccugcccagg

SEQ ID NO: 3352906 - RNA, 21 nt, Human
gccucugcacuccccugcugg

SEQ ID NO: 3352907 - RNA, 15 nt, Human
gccucugcacucccc

SEQ ID NO: 3352908 - RNA, 17 nt, Human
gccucugcacuccccug

SEQ ID NO: 3352909 - RNA, 18 nt, Human
gccucugcacuccccugc

SEQ ID NO: 3352910 - RNA, 19 nt, Human
gccucugcacuccccugcu

SEQ ID NO: 3352911 - RNA, 20 nt, Human
gccucugcacuccccugcug

SEQ ID NO: 3352912 - RNA, 16 nt, Human
gccucugcacuccccu

SEQ ID NO: 3352913 - RNA, 15 nt, Human
gccucugacacacag

SEQ ID NO: 3352914 - RNA, 15 nt, Human
gccucucccaucacu

SEQ ID NO: 3352915 - RNA, 19 nt, Human
gccucccgaauagcuggga

SEQ ID NO: 3352916 - RNA, 18 nt, Human
gccucccgaauagcuggg

SEQ ID NO: 3352917 - RNA, 23 nt, Human
gccucccgaguagcugggacuac

SEQ ID NO: 3352918 - RNA, 21 nt, Human
gccucccgaguagcugggacu

SEQ ID NO: 3352919 - RNA, 20 nt, Human
gccucccgaauagcugggac

SEQ ID NO: 3352920 - RNA, 20 nt, Human
gccucccgaguagcugggac

SEQ ID NO: 3352921 - RNA, 14 nt, Human
gccucagccuccca

SEQ ID NO: 3352922 - RNA, 12 nt, Human
gccucagccucc

SEQ ID NO: 3352923 - RNA, 17 nt, Human
gccucccaucacccgcu

SEQ ID NO: 3352924 - RNA, 21 nt, Human
gccucagcauccuggcacccg

SEQ ID NO: 3352925 - RNA, 17 nt, Human
gccucagcauccuggca

SEQ ID NO: 3352926 - RNA, 18 nt, Human
gccucagcauccuggcac

SEQ ID NO: 3352927 - RNA, 24 nt, Human
gccucaagugauucuccugccuca

SEQ ID NO: 3352928 - RNA, 22 nt, Human
gccucaagugauucuccugccu

SEQ ID NO: 3352929 - RNA, 18 nt, Human
gccgucuaccugaggggc

SEQ ID NO: 3352930 - RNA, 20 nt, Human
gccgucuaccugaggggccu

SEQ ID NO: 3352931 - RNA, 22 nt, Human
gccgucuaccugaggggccucu

SEQ ID NO: 3352932 - RNA, 23 nt, Human
gccgucuaccugaggggccucuu

SEQ ID NO: 3352933 - RNA, 16 nt, Human
gccgcagcccugcaga

SEQ ID NO: 3352934 - RNA, 17 nt, Human
gccgcagcccugcagag

SEQ ID NO: 3352935 - RNA, 15 nt, Human
gccgcagcccugcag

SEQ ID NO: 3352936 - RNA, 17 nt, Human
gccgagauagccaaggc

SEQ ID NO: 3352937 - RNA, 13 nt, Human
gccgcagcccugc

SEQ ID NO: 3352938 - RNA, 23 nt, Human
gcccuucucuccagccccuggau

SEQ ID NO: 3352939 - RNA, 16 nt, Human
gccgagauagccaagg

SEQ ID NO: 3352940 - RNA, 22 nt, Human
gcuacacaggggaaaagaggag

SEQ ID NO: 3352941 - RNA, 14 nt, Human
gcgugagccacugc

SEQ ID NO: 3352942 - RNA, 15 nt, Human
gcgugagccacugca

SEQ ID NO: 3352943 - RNA, 17 nt, Human
gcuaacauggaaguacu

SEQ ID NO: 3352944 - RNA, 18 nt, Human
gcuaacauggaaguacua

SEQ ID NO: 3352945 - RNA, 14 nt, Human
gcuaacauggaagu

SEQ ID NO: 3352946 - RNA, 21 nt, Human
gcuagacgagcaggcuucuuc

SEQ ID NO: 3352947 - RNA, 22 nt, Human
gcuagacgagcaggcuucuucc

SEQ ID NO: 3352948 - RNA, 23 nt, Human
gcgguccacccaggagccccgag

SEQ ID NO: 3352949 - RNA, 20 nt, Human
gcgguccacccaggagcccc

SEQ ID NO: 3352950 - RNA, 23 nt, Human
gcggggacagcuccuucuguccu

SEQ ID NO: 3352951 - RNA, 19 nt, Human
gcggacagccacggccagg

SEQ ID NO: 3352952 - RNA, 16 nt, Human
gcggacagccacggcc

SEQ ID NO: 3352953 - RNA, 23 nt, Human
gcggacagccacggccaggccag

SEQ ID NO: 3352954 - RNA, 19 nt, Human
gcggggacagcuccuucug

SEQ ID NO: 3352955 - RNA, 18 nt, Human
gcggggacagcuccuucu

SEQ ID NO: 3352956 - RNA, 18 nt, Human
gcgccuacaggagugagc

SEQ ID NO: 3352957 - RNA, 21 nt, Human
gcgccuacaggagugagcacu

SEQ ID NO: 3352958 - RNA, 20 nt, Human
gcgccuacaggagugagcac

SEQ ID NO: 3352959 - RNA, 14 nt, Human
gcgcugccccuggc

SEQ ID NO: 3352960 - RNA, 19 nt, Human
gccuuacccucauguucuu

SEQ ID NO: 3352961 - RNA, 20 nt, Human
gccuuagaagucacacagua

SEQ ID NO: 3352962 - RNA, 21 nt, Human
gccuuauggaacacucugaga

SEQ ID NO: 3352963 - RNA, 22 nt, Human
gccuuauggaacacucugagac

SEQ ID NO: 3352964 - RNA, 23 nt, Human
gccuuauggaacacucugagacu

SEQ ID NO: 3352965 - RNA, 20 nt, Human
gccuuauggaacacucugag

SEQ ID NO: 3352966 - RNA, 15 nt, Human
gccugguggcagcug

SEQ ID NO: 3352967 - RNA, 14 nt, Human
gccugguggcagcu

SEQ ID NO: 3352968 - RNA, 17 nt, Human
gccugguggcagcugcg

SEQ ID NO: 3352969 - RNA, 16 nt, Human
gccugguggcagcugc

SEQ ID NO: 3352970 - RNA, 21 nt, Human
gccuuccaggggugggacacc

SEQ ID NO: 3352971 - RNA, 13 nt, Human
gccuuuggcuuca

SEQ ID NO: 3352972 - RNA, 14 nt, Human
gccagcugcuuggg

SEQ ID NO: 3352973 - RNA, 15 nt, Human
gccagcugcuugggc

SEQ ID NO: 3352974 - RNA, 14 nt, Human
gccagccuugacca

SEQ ID NO: 3352975 - RNA, 20 nt, Human
gccagccuugaccauucucc

SEQ ID NO: 3352976 - RNA, 21 nt, Human
gccagccuugaccauucucca

SEQ ID NO: 3352977 - RNA, 22 nt, Human
gccagccuugaccauucuccac

SEQ ID NO: 3352978 - RNA, 20 nt, Human
gccagccgagauagccaagg

SEQ ID NO: 3352979 - RNA, 12 nt, Human
gccagccuugac

SEQ ID NO: 3352980 - RNA, 16 nt, Human
gccagauucuuuccug

SEQ ID NO: 3352981 - RNA, 19 nt, Human
gccagagggagugacagag

SEQ ID NO: 3352982 - RNA, 17 nt, Human
gccagauucuuuccuga

SEQ ID NO: 3352983 - RNA, 18 nt, Human
gccagagggagugacaga

SEQ ID NO: 3352984 - RNA, 17 nt, Human
gccagagggagugacag

SEQ ID NO: 3352985 - RNA, 12 nt, Human
gccagagacaca

SEQ ID NO: 3352986 - RNA, 15 nt, Human
gccagagacacaagc

SEQ ID NO: 3352987 - RNA, 18 nt, Human
gccacugcaccgggccac

SEQ ID NO: 3352988 - RNA, 17 nt, Human
gccacugcaccgggcca

SEQ ID NO: 3352989 - RNA, 15 nt, Human
gccacggccaggcca

SEQ ID NO: 3352990 - RNA, 14 nt, Human
gccacggccaggcc

SEQ ID NO: 3352991 - RNA, 12 nt, Human
gccaaaggaagc

SEQ ID NO: 3352992 - RNA, 21 nt, Human
gccacuauuguuagucucuug

SEQ ID NO: 3352993 - RNA, 20 nt, Human
gccacuauuguuagucucuu

SEQ ID NO: 3352994 - RNA, 16 nt, Human
gccacggccaggccag

SEQ ID NO: 3352995 - RNA, 17 nt, Human
gccaucccagccccaau

SEQ ID NO: 3352996 - RNA, 14 nt, Human
gccauccagguuca

SEQ ID NO: 3352997 - RNA, 13 nt, Human
gccaucccagccc

SEQ ID NO: 3352998 - RNA, 14 nt, Human
gccaucccagcccc

SEQ ID NO: 3352999 - RNA, 15 nt, Human
gccaucccagcccca

SEQ ID NO: 3353000 - RNA, 16 nt, Human
gccaucccagccccaa

SEQ ID NO: 3353001 - RNA, 20 nt, Human
gccauccagguucagcuugu

SEQ ID NO: 3353002 - RNA, 19 nt, Human
gccauccagguucagcuug

SEQ ID NO: 3353003 - RNA, 21 nt, Human
gccaggggaaaaucagccugc

SEQ ID NO: 3353004 - RNA, 22 nt, Human
gccaggggaaaaucagccugcu

SEQ ID NO: 3353005 - RNA, 17 nt, Human
gccaggggaaaaucagc

SEQ ID NO: 3353006 - RNA, 19 nt, Human
gccaggaagccagcaggcu

SEQ ID NO: 3353007 - RNA, 17 nt, Human
gccaggaagccagcagg

SEQ ID NO: 3353008 - RNA, 18 nt, Human
gccaggaagccagcaggc

SEQ ID NO: 3353009 - RNA, 15 nt, Human
gccaggaagccagca

SEQ ID NO: 3353010 - RNA, 18 nt, Human
gcccacaggaucagucug

SEQ ID NO: 3353011 - RNA, 13 nt, Human
gcccacaggauca

SEQ ID NO: 3353012 - RNA, 19 nt, Human
gcccacaggaucagucuga

SEQ ID NO: 3353013 - RNA, 15 nt, Human
gcccaccccucaaca

SEQ ID NO: 3353014 - RNA, 15 nt, Human
gcccaaagaugcagc

SEQ ID NO: 3353015 - RNA, 16 nt, Human
gcccaaagaugcagcc

SEQ ID NO: 3353016 - RNA, 20 nt, Human
gccauuucuuccacaagagc

SEQ ID NO: 3353017 - RNA, 22 nt, Human
gccauuucuuccacaagagccc

SEQ ID NO: 3353018 - RNA, 17 nt, Human
gccauuucuuccacaag

SEQ ID NO: 3353019 - RNA, 17 nt, Human
gccccagugcccacagg

SEQ ID NO: 3353020 - RNA, 16 nt, Human
gccccagugcccacag

SEQ ID NO: 3353021 - RNA, 15 nt, Human
gccccagugcccaca

SEQ ID NO: 3353022 - RNA, 21 nt, Human
gccccauucugccugcccagg

SEQ ID NO: 3353023 - RNA, 20 nt, Human
gccccauucugccugcccag

SEQ ID NO: 3353024 - RNA, 18 nt, Human
gccccauucugccugccc

SEQ ID NO: 3353025 - RNA, 17 nt, Human
gccccauucugccugcc

SEQ ID NO: 3353026 - RNA, 23 nt, Human
gccccauccucuguacagagccc

SEQ ID NO: 3353027 - RNA, 15 nt, Human
gcccaggcuggcgug

SEQ ID NO: 3353028 - RNA, 14 nt, Human
gcccaggcuggcgu

SEQ ID NO: 3353029 - RNA, 16 nt, Human
gcccaggcuggcgugc

SEQ ID NO: 3353030 - RNA, 20 nt, Human
gcccagucuggaaugcagug

SEQ ID NO: 3353031 - RNA, 22 nt, Human
gcccagucuggaaugcaguggu

SEQ ID NO: 3353032 - RNA, 12 nt, Human
gcccaggaaagg

SEQ ID NO: 3353033 - RNA, 15 nt, Human
gcccaggaaaggcuc

SEQ ID NO: 3353034 - RNA, 16 nt, Human
gcccaggaaaggcucc

SEQ ID NO: 3353035 - RNA, 18 nt, Human
gcccaggccuccuacagc

SEQ ID NO: 3353036 - RNA, 11 nt, Human
gcccaggcugg

SEQ ID NO: 3353037 - RNA, 13 nt, Human
gcccaggccuccu

SEQ ID NO: 3353038 - RNA, 19 nt, Human
gcccucugcccacucccug

SEQ ID NO: 3353039 - RNA, 22 nt, Human
gcccucugcccacucccugcaa

SEQ ID NO: 3353040 - RNA, 19 nt, Human
gcccgggcucugccuccca

SEQ ID NO: 3353041 - RNA, 20 nt, Human
gcccgggcucugccucccau

SEQ ID NO: 3353042 - RNA, 13 nt, Human
gcccgggcucugc

SEQ ID NO: 3353043 - RNA, 14 nt, Human
gcccgggcucugcc

SEQ ID NO: 3353044 - RNA, 15 nt, Human
gcccgggcucugccu

SEQ ID NO: 3353045 - RNA, 18 nt, Human
gcccgggcucugccuccc

SEQ ID NO: 3353046 - RNA, 12 nt, Human
gcccgggcucug

SEQ ID NO: 3353047 - RNA, 14 nt, Human
gcccggcuccaggc

SEQ ID NO: 3353048 - RNA, 13 nt, Human
gcccggcuccagg

SEQ ID NO: 3353049 - RNA, 12 nt, Human
gcccggcuccag

SEQ ID NO: 3353050 - RNA, 19 nt, Human
gccccuucugacccaugcu

SEQ ID NO: 3353051 - RNA, 23 nt, Human
gccccauucugccugcccaggcc

SEQ ID NO: 3353052 - RNA, 22 nt, Human
gccccauucugccugcccaggc

SEQ ID NO: 3353053 - RNA, 23 nt, Human
gccccgaggccuucucugaagga

SEQ ID NO: 3353054 - RNA, 15 nt, Human
gccccauucugccug

SEQ ID NO: 3353055 - RNA, 14 nt, Human
gccccgcccaggcu

SEQ ID NO: 3353056 - RNA, 22 nt, Human
gccccgaggccuucucugaagg

SEQ ID NO: 3353057 - RNA, 19 nt, Human
gccccucagggucccuggu

SEQ ID NO: 3353058 - RNA, 21 nt, Human
gccccucagggucccuggugg

SEQ ID NO: 3353059 - RNA, 18 nt, Human
gccccucagggucccugg

SEQ ID NO: 3353060 - RNA, 17 nt, Human
gccccuggcagccccug

SEQ ID NO: 3353061 - RNA, 23 nt, Human
gccccuggcagccccuguucugg

SEQ ID NO: 3353062 - RNA, 21 nt, Human
ggaagcacaugccucucucag

SEQ ID NO: 3353063 - RNA, 22 nt, Human
ggaagcacaugccucucucagg

SEQ ID NO: 3353064 - RNA, 23 nt, Human
ggaagcacaugccucucucaggc

SEQ ID NO: 3353065 - RNA, 15 nt, Human
ggaagccagcaggcu

SEQ ID NO: 3353066 - RNA, 16 nt, Human
ggaagccagcaggcuc

SEQ ID NO: 3353067 - RNA, 17 nt, Human
ggaagccagcaggcucu

SEQ ID NO: 3353068 - RNA, 18 nt, Human
ggaagccagcaggcucuc

SEQ ID NO: 3353069 - RNA, 13 nt, Human
ggaagccagcagg

SEQ ID NO: 3353070 - RNA, 14 nt, Human
ggaagccagcaggc

SEQ ID NO: 3353071 - RNA, 13 nt, Human
ggaagcacaugcc

SEQ ID NO: 3353072 - RNA, 14 nt, Human
ggaagcacaugccu

SEQ ID NO: 3353073 - RNA, 15 nt, Human
ggaagcacaugccuc

SEQ ID NO: 3353074 - RNA, 17 nt, Human
ggaagcacaugccucuc

SEQ ID NO: 3353075 - RNA, 17 nt, Human
ggaagcacagcuucauu

SEQ ID NO: 3353076 - RNA, 13 nt, Human
ggaagagccuugc

SEQ ID NO: 3353077 - RNA, 14 nt, Human
ggaaaauaaauuau

SEQ ID NO: 3353078 - RNA, 17 nt, Human
ggaacagacuggaagca

SEQ ID NO: 3353079 - RNA, 20 nt, Human
ggaacagacuggaagcacag

SEQ ID NO: 3353080 - RNA, 19 nt, Human
ggaacagacuggaagcaca

SEQ ID NO: 3353081 - RNA, 15 nt, Human
ggaaaaauagccugc

SEQ ID NO: 3353082 - RNA, 14 nt, Human
ggaaaaacugauuu

SEQ ID NO: 3353083 - RNA, 13 nt, Human
ggaaaaauagccu

SEQ ID NO: 3353084 - RNA, 14 nt, Human
gcuuuuacuuaaac

SEQ ID NO: 3353085 - RNA, 18 nt, Human
gcuuccagugaggcucug

SEQ ID NO: 3353086 - RNA, 19 nt, Human
gcuuccagugaggcucugc

SEQ ID NO: 3353087 - RNA, 20 nt, Human
gcuuccagugaggcucugcc

SEQ ID NO: 3353088 - RNA, 21 nt, Human
gcuuccagugaggcucugccc

SEQ ID NO: 3353089 - RNA, 22 nt, Human
gcuugaggguugggcugguguc

SEQ ID NO: 3353090 - RNA, 13 nt, Human
gcuuggaggaagg

SEQ ID NO: 3353091 - RNA, 14 nt, Human
gcuuggaggaagga

SEQ ID NO: 3353092 - RNA, 15 nt, Human
gcuuggaggaaggaa

SEQ ID NO: 3353093 - RNA, 17 nt, Human
gcugucaauuacaggaa

SEQ ID NO: 3353094 - RNA, 19 nt, Human
gcugucaauuacaggaagu

SEQ ID NO: 3353095 - RNA, 22 nt, Human
gcugucaauuacaggaaguacu

SEQ ID NO: 3353096 - RNA, 23 nt, Human
gcugucaauuacaggaaguacug

SEQ ID NO: 3353097 - RNA, 21 nt, Human
gcugucccuuacgugaguccu

SEQ ID NO: 3353098 - RNA, 19 nt, Human
gcugucccuuacgugaguc

SEQ ID NO: 3353099 - RNA, 17 nt, Human
gcugucuccauguuuga

SEQ ID NO: 3353100 - RNA, 14 nt, Human
gcuggucccacuca

SEQ ID NO: 3353101 - RNA, 18 nt, Human
gcuggugucaccugaaga

SEQ ID NO: 3353102 - RNA, 16 nt, Human
gcuggugucaccugaa

SEQ ID NO: 3353103 - RNA, 21 nt, Human
gcugguuagagguucccuuug

SEQ ID NO: 3353104 - RNA, 15 nt, Human
gcugguucaggguug

SEQ ID NO: 3353105 - RNA, 16 nt, Human
gcugucaauuacagga

SEQ ID NO: 3353106 - RNA, 22 nt, Human
gcugguucaggguuggccccug

SEQ ID NO: 3353107 - RNA, 18 nt, Human
gcugggcuucaguggcag

SEQ ID NO: 3353108 - RNA, 23 nt, Human
gcugggggaagaagcucucuccu

SEQ ID NO: 3353109 - RNA, 12 nt, Human
gcuggggccagu

SEQ ID NO: 3353110 - RNA, 19 nt, Human
gcuggucccacucagucca

SEQ ID NO: 3353111 - RNA, 15 nt, Human
gcuggucccacucag

SEQ ID NO: 3353112 - RNA, 18 nt, Human
gcugggggccucagugcc

SEQ ID NO: 3353113 - RNA, 20 nt, Human
gcugggggccucagugccac

SEQ ID NO: 3353114 - RNA, 19 nt, Human
gcugggggccucagugcca

SEQ ID NO: 3353115 - RNA, 12 nt, Human
gcugggagagcc

SEQ ID NO: 3353116 - RNA, 13 nt, Human
gcugggagagccu

SEQ ID NO: 3353117 - RNA, 17 nt, Human
gcugggagagccuucca

SEQ ID NO: 3353118 - RNA, 18 nt, Human
gcugggagagccuuccag

SEQ ID NO: 3353119 - RNA, 19 nt, Human
gcugggagagccuuccagg

SEQ ID NO: 3353120 - RNA, 22 nt, Human
gcugggagagccuuccaggggu

SEQ ID NO: 3353121 - RNA, 17 nt, Human
gcugggcuucaguggca

SEQ ID NO: 3353122 - RNA, 21 nt, Human
gcugggaugauuggagggggg

SEQ ID NO: 3353123 - RNA, 18 nt, Human
gcugcgguccacccagga

SEQ ID NO: 3353124 - RNA, 17 nt, Human
gcugcgguccacccagg

SEQ ID NO: 3353125 - RNA, 13 nt, Human
gcugcuucaagga

SEQ ID NO: 3353126 - RNA, 16 nt, Human
gcugcuugggcuucau

SEQ ID NO: 3353127 - RNA, 21 nt, Human
gcugcuucaaggauccugagc

SEQ ID NO: 3353128 - RNA, 22 nt, Human
gcugcuucaaggauccugagcc

SEQ ID NO: 3353129 - RNA, 23 nt, Human
gcugcuucaaggauccugagcca

SEQ ID NO: 3353130 - RNA, 11 nt, Human
gcugcccugug

SEQ ID NO: 3353131 - RNA, 12 nt, Human
gcugcccuguga

SEQ ID NO: 3353132 - RNA, 14 nt, Human
gcugcccugugagu

SEQ ID NO: 3353133 - RNA, 16 nt, Human
gcugcgguccacccag

SEQ ID NO: 3353134 - RNA, 20 nt, Human
gcugggacuacaggcaccca

SEQ ID NO: 3353135 - RNA, 19 nt, Human
gcugggacuacaggcaccc

SEQ ID NO: 3353136 - RNA, 18 nt, Human
gcugggacuacaggcacc

SEQ ID NO: 3353137 - RNA, 13 nt, Human
gcugggacuacag

SEQ ID NO: 3353138 - RNA, 19 nt, Human
gcugggacuacagguguga

SEQ ID NO: 3353139 - RNA, 20 nt, Human
gcugggacaugggaaagggg

SEQ ID NO: 3353140 - RNA, 17 nt, Human
gcugcuugggcuucauc

SEQ ID NO: 3353141 - RNA, 18 nt, Human
gcuggaccuugaacuggg

SEQ ID NO: 3353142 - RNA, 16 nt, Human
gcuggaccuugaacug

SEQ ID NO: 3353143 - RNA, 21 nt, Human
gcuggaccuugaacuggguac

SEQ ID NO: 3353144 - RNA, 23 nt, Human
ggcaggucuugaacuccuggccu

SEQ ID NO: 3353145 - RNA, 13 nt, Human
ggcagguccaggg

SEQ ID NO: 3353146 - RNA, 19 nt, Human
ggcagcugcgguccaccca

SEQ ID NO: 3353147 - RNA, 17 nt, Human
ggcagcuugaggguugg

SEQ ID NO: 3353148 - RNA, 21 nt, Human
ggcagcuugaggguugggcug

SEQ ID NO: 3353149 - RNA, 16 nt, Human
ggcagcucaccucucc

SEQ ID NO: 3353150 - RNA, 22 nt, Human
ggcagcucaccucucccuugga

SEQ ID NO: 3353151 - RNA, 18 nt, Human
ggcagcucaccucucccu

SEQ ID NO: 3353152 - RNA, 21 nt, Human
ggcagcucaccucucccuugg

SEQ ID NO: 3353153 - RNA, 23 nt, Human
ggcagaguugaagacagagcuac

SEQ ID NO: 3353154 - RNA, 23 nt, Human
ggcagauacaggaaaagcugcug

SEQ ID NO: 3353155 - RNA, 21 nt, Human
ggcagaguugaagacagagcu

SEQ ID NO: 3353156 - RNA, 17 nt, Human
ggcagaggaaagcaaag

SEQ ID NO: 3353157 - RNA, 20 nt, Human
ggcagagcagagaccauccc

SEQ ID NO: 3353158 - RNA, 15 nt, Human
ggcagagcagagacc

SEQ ID NO: 3353159 - RNA, 16 nt, Human
ggcagagcagagacca

SEQ ID NO: 3353160 - RNA, 12 nt, Human
ggcagagcagag

SEQ ID NO: 3353161 - RNA, 16 nt, Human
ggcacccggccccugc

SEQ ID NO: 3353162 - RNA, 15 nt, Human
ggcacccggccccug

SEQ ID NO: 3353163 - RNA, 16 nt, Human
ggcaaggcugucaauu

SEQ ID NO: 3353164 - RNA, 21 nt, Human
ggaucagucugauucccaagc

SEQ ID NO: 3353165 - RNA, 19 nt, Human
ggcaacccccagccugcua

SEQ ID NO: 3353166 - RNA, 19 nt, Human
ggcaacugcauuggcuuug

SEQ ID NO: 3353167 - RNA, 15 nt, Human
ggcaaggcugucaau

SEQ ID NO: 3353168 - RNA, 18 nt, Human
ggcaacugcauuggcuuu

SEQ ID NO: 3353169 - RNA, 11 nt, Human
ggccaggcugg

SEQ ID NO: 3353170 - RNA, 16 nt, Human
ggccaggccagaggga

SEQ ID NO: 3353171 - RNA, 14 nt, Human
ggccaggccagagg

SEQ ID NO: 3353172 - RNA, 16 nt, Human
ggccacugugaagaga

SEQ ID NO: 3353173 - RNA, 14 nt, Human
ggccaggagccucc

SEQ ID NO: 3353174 - RNA, 16 nt, Human
ggccaggagccuccug

SEQ ID NO: 3353175 - RNA, 11 nt, Human
ggccacuguga

SEQ ID NO: 3353176 - RNA, 15 nt, Human
ggcauuccccaggag

SEQ ID NO: 3353177 - RNA, 16 nt, Human
ggccacaagacccuug

SEQ ID NO: 3353178 - RNA, 17 nt, Human
ggccacaagacccuugu

SEQ ID NO: 3353179 - RNA, 16 nt, Human
ggccaccugcggugcu

SEQ ID NO: 3353180 - RNA, 22 nt, Human
ggccaccugcggugcuaucucc

SEQ ID NO: 3353181 - RNA, 23 nt, Human
ggcauguucucugaggacacuaa

SEQ ID NO: 3353182 - RNA, 15 nt, Human
ggcagguuggugggg

SEQ ID NO: 3353183 - RNA, 12 nt, Human
ggccccugccac

SEQ ID NO: 3353184 - RNA, 16 nt, Human
ggccccugccacccug

SEQ ID NO: 3353185 - RNA, 13 nt, Human
ggccccugccacc

SEQ ID NO: 3353186 - RNA, 13 nt, Human
ggccccugcccgg

SEQ ID NO: 3353187 - RNA, 18 nt, Human
ggccccugccacccuggg

SEQ ID NO: 3353188 - RNA, 17 nt, Human
ggccccugccacccugg

SEQ ID NO: 3353189 - RNA, 16 nt, Human
ggccccucaggguccc

SEQ ID NO: 3353190 - RNA, 19 nt, Human
ggccccucagggucccugg

SEQ ID NO: 3353191 - RNA, 20 nt, Human
ggccccucagggucccuggu

SEQ ID NO: 3353192 - RNA, 21 nt, Human
ggccccucagggucccuggug

SEQ ID NO: 3353193 - RNA, 13 nt, Human
ggccaugggccuc

SEQ ID NO: 3353194 - RNA, 20 nt, Human
ggagcaaaaucgaugcagug

SEQ ID NO: 3353195 - RNA, 20 nt, Human
ggagauuuacaacuggggga

SEQ ID NO: 3353196 - RNA, 15 nt, Human
ggagaggggcacagg

SEQ ID NO: 3353197 - RNA, 17 nt, Human
ggagagcuagcagcagg

SEQ ID NO: 3353198 - RNA, 21 nt, Human
ggagagcuagcagcagggagg

SEQ ID NO: 3353199 - RNA, 21 nt, Human
ggagaccccuuggggagcagg

SEQ ID NO: 3353200 - RNA, 20 nt, Human
ggaagccagcaggcucucag

SEQ ID NO: 3353201 - RNA, 23 nt, Human
ggaggaucacuugaguccagaag

SEQ ID NO: 3353202 - RNA, 17 nt, Human
ggaggaucucuugagcc

SEQ ID NO: 3353203 - RNA, 21 nt, Human
ggaggaucucuugagccuggg

SEQ ID NO: 3353204 - RNA, 12 nt, Human
ggagggcuccag

SEQ ID NO: 3353205 - RNA, 13 nt, Human
ggagggcuccaga

SEQ ID NO: 3353206 - RNA, 16 nt, Human
ggagugacagaggcag

SEQ ID NO: 3353207 - RNA, 11 nt, Human
ggagugacaga

SEQ ID NO: 3353208 - RNA, 20 nt, Human
ggagucccaccuuggcugca

SEQ ID NO: 3353209 - RNA, 17 nt, Human
ggagggcuccagacaca

SEQ ID NO: 3353210 - RNA, 14 nt, Human
ggagggcuccagac

SEQ ID NO: 3353211 - RNA, 15 nt, Human
ggagggcuccagaca

SEQ ID NO: 3353212 - RNA, 21 nt, Human
ggagugacagaggcagcccca

SEQ ID NO: 3353213 - RNA, 19 nt, Human
ggagugacagaggcagccc

SEQ ID NO: 3353214 - RNA, 18 nt, Human
ggagugacagaggcagcc

SEQ ID NO: 3353215 - RNA, 17 nt, Human
ggagugacagaggcagc

SEQ ID NO: 3353216 - RNA, 21 nt, Human
ggagugaguugauagcacaga

SEQ ID NO: 3353217 - RNA, 14 nt, Human
ggagugagcugguu

SEQ ID NO: 3353218 - RNA, 12 nt, Human
ggagugagcugg

SEQ ID NO: 3353219 - RNA, 16 nt, Human
ggaucacagccucuga

SEQ ID NO: 3353220 - RNA, 17 nt, Human
gggugaagugaagacaa

SEQ ID NO: 3353221 - RNA, 19 nt, Human
gggugacagagcaagugag

SEQ ID NO: 3353222 - RNA, 22 nt, Human
ggguucaagcgauucuucugcu

SEQ ID NO: 3353223 - RNA, 23 nt, Human
ggguucaagcgauucuucugcuu

SEQ ID NO: 3353224 - RNA, 12 nt, Human
ggguucuaccca

SEQ ID NO: 3353225 - RNA, 23 nt, Human
gguagaaauaucugaaaauguau

SEQ ID NO: 3353226 - RNA, 22 nt, Human
gguagaagcccuucuaccuucc

SEQ ID NO: 3353227 - RNA, 13 nt, Human
gguacccacugcu

SEQ ID NO: 3353228 - RNA, 11 nt, Human
gguacccacug

SEQ ID NO: 3353229 - RNA, 22 nt, Human
gguagaaauaucugaaaaugua

SEQ ID NO: 3353230 - RNA, 17 nt, Human
gguacuuguggacacag

SEQ ID NO: 3353231 - RNA, 16 nt, Human
gguacuuguggacaca

SEQ ID NO: 3353232 - RNA, 15 nt, Human
ggucccaccccacac

SEQ ID NO: 3353233 - RNA, 16 nt, Human
ggucccaccccacaca

SEQ ID NO: 3353234 - RNA, 17 nt, Human
ggguaagugagagaggg

SEQ ID NO: 3353235 - RNA, 14 nt, Human
gggucucacucugu

SEQ ID NO: 3353236 - RNA, 12 nt, Human
gggucucacucu

SEQ ID NO: 3353237 - RNA, 21 nt, Human
gggucugaggaauccagaccc

SEQ ID NO: 3353238 - RNA, 12 nt, Human
gggucugaggaa

SEQ ID NO: 3353239 - RNA, 17 nt, Human
gggguggggaccucagg

SEQ ID NO: 3353240 - RNA, 12 nt, Human
gggguggccucc

SEQ ID NO: 3353241 - RNA, 19 nt, Human
ggggcugaggugggaggau

SEQ ID NO: 3353242 - RNA, 12 nt, Human
ggggcugcaccg

SEQ ID NO: 3353243 - RNA, 21 nt, Human
ggggcugcaccggcuggccug

SEQ ID NO: 3353244 - RNA, 22 nt, Human
ggggcugcaccggcuggccugg

SEQ ID NO: 3353245 - RNA, 22 nt, Human
gggggaggugggauccuccagg

SEQ ID NO: 3353246 - RNA, 21 nt, Human
ggggaaaaucagccugcucca

SEQ ID NO: 3353247 - RNA, 17 nt, Human
ggggaaaaucagccugc

SEQ ID NO: 3353248 - RNA, 19 nt, Human
ggggaaaaucagccugcuc

SEQ ID NO: 3353249 - RNA, 16 nt, Human
ggggaaaaucagccug

SEQ ID NO: 3353250 - RNA, 22 nt, Human
gggcuuggggaccagagcugcc

SEQ ID NO: 3353251 - RNA, 17 nt, Human
ggggcugaggugggagg

SEQ ID NO: 3353252 - RNA, 16 nt, Human
ggggcaacccugguga

SEQ ID NO: 3353253 - RNA, 21 nt, Human
ggugaccucugccugaaguca

SEQ ID NO: 3353254 - RNA, 22 nt, Human
ggugaccagcaccaucucuccu

SEQ ID NO: 3353255 - RNA, 21 nt, Human
ggugacagagugagacucugu

SEQ ID NO: 3353256 - RNA, 17 nt, Human
ggucccaccccacacac

SEQ ID NO: 3353257 - RNA, 14 nt, Human
ggucccaccccaca

SEQ ID NO: 3353258 - RNA, 23 nt, Human
ggucucacucugucgcccagucu

SEQ ID NO: 3353259 - RNA, 22 nt, Human
ggucucacucugucgcccaguc

SEQ ID NO: 3353260 - RNA, 16 nt, Human
ggucucacucugucgc

SEQ ID NO: 3353261 - RNA, 23 nt, Human
gguggccucccaacucaccccag

SEQ ID NO: 3353262 - RNA, 17 nt, Human
gguggccucccaacuca

SEQ ID NO: 3353263 - RNA, 22 nt, Human
gguggccucccaacucacccca

SEQ ID NO: 3353264 - RNA, 16 nt, Human
gguggcagugggagcu

SEQ ID NO: 3353265 - RNA, 22 nt, Human
gguggcagugggagcugccugu

SEQ ID NO: 3353266 - RNA, 19 nt, Human
gguggcagugggagcugcc

SEQ ID NO: 3353267 - RNA, 15 nt, Human
ggugcugccauccag

SEQ ID NO: 3353268 - RNA, 16 nt, Human
ggugagaggggaacag

SEQ ID NO: 3353269 - RNA, 15 nt, Human
ggugagaagcagagg

SEQ ID NO: 3353270 - RNA, 16 nt, Human
ggugcuaucuccccca

SEQ ID NO: 3353271 - RNA, 17 nt, Human
ggugcuaucucccccag

SEQ ID NO: 3353272 - RNA, 19 nt, Human
ggugcuaucucccccagcc

SEQ ID NO: 3353273 - RNA, 20 nt, Human
ggugcuaucucccccagccc

SEQ ID NO: 3353274 - RNA, 17 nt, Human
ggugguuucagaaaugu

SEQ ID NO: 3353275 - RNA, 18 nt, Human
ggugguuucagaaaugug

SEQ ID NO: 3353276 - RNA, 21 nt, Human
ggugguuauggagaggguguc

SEQ ID NO: 3353277 - RNA, 15 nt, Human
ggugguuuucuguuc

SEQ ID NO: 3353278 - RNA, 18 nt, Human
ggugguuuucuguucuuu

SEQ ID NO: 3353279 - RNA, 17 nt, Human
ggugucaagagggucug

SEQ ID NO: 3353280 - RNA, 19 nt, Human
ggugucaagagggucugag

SEQ ID NO: 3353281 - RNA, 19 nt, Human
ggugucaccugaagacuca

SEQ ID NO: 3353282 - RNA, 15 nt, Human
gguggugaccucugc

SEQ ID NO: 3353283 - RNA, 14 nt, Human
gguggugaccucug

SEQ ID NO: 3353284 - RNA, 16 nt, Human
gguggugaccucugcc

SEQ ID NO: 3353285 - RNA, 13 nt, Human
gguugagguuuca

SEQ ID NO: 3353286 - RNA, 21 nt, Human
gguucaaagauauuuugcuuu

SEQ ID NO: 3353287 - RNA, 23 nt, Human
gguucaagcgauucuucugcuuc

SEQ ID NO: 3353288 - RNA, 13 nt, Human
gguucaaagauau

SEQ ID NO: 3353289 - RNA, 17 nt, Human
gguuaggcauuguggga

SEQ ID NO: 3353290 - RNA, 13 nt, Human
gguuauggagagg

SEQ ID NO: 3353291 - RNA, 21 nt, Human
gguuacccaguuagcucucaa

SEQ ID NO: 3353292 - RNA, 23 nt, Human
ggcugcuucaaggauccugagcc

SEQ ID NO: 3353293 - RNA, 21 nt, Human
ggcugcuucaaggauccugag

SEQ ID NO: 3353294 - RNA, 19 nt, Human
ggcugggagagccuuccag

SEQ ID NO: 3353295 - RNA, 18 nt, Human
ggcugggagagccuucca

SEQ ID NO: 3353296 - RNA, 15 nt, Human
ggcugggcagaggaa

SEQ ID NO: 3353297 - RNA, 19 nt, Human
ggcugggcagaggaaagca

SEQ ID NO: 3353298 - RNA, 13 nt, Human
ggcugggcagagg

SEQ ID NO: 3353299 - RNA, 14 nt, Human
ggcugggcagagga

SEQ ID NO: 3353300 - RNA, 20 nt, Human
ggcugggagagccuuccagg

SEQ ID NO: 3353301 - RNA, 23 nt, Human
ggcugggagagccuuccaggggu

SEQ ID NO: 3353302 - RNA, 13 nt, Human
ggcugcugaaggc

SEQ ID NO: 3353303 - RNA, 18 nt, Human
ggcugcugaaggcucgag

SEQ ID NO: 3353304 - RNA, 15 nt, Human
ggcugcugaaggcuc

SEQ ID NO: 3353305 - RNA, 17 nt, Human
ggcugcugaaggcucga

SEQ ID NO: 3353306 - RNA, 14 nt, Human
ggcugcugaaggcu

SEQ ID NO: 3353307 - RNA, 13 nt, Human
ggcugcagggagu

SEQ ID NO: 3353308 - RNA, 12 nt, Human
ggcugcagggag

SEQ ID NO: 3353309 - RNA, 11 nt, Human
ggcugcuucaa

SEQ ID NO: 3353310 - RNA, 12 nt, Human
ggcugcuucaag

SEQ ID NO: 3353311 - RNA, 22 nt, Human
ggcugcuucaaggauccugagc

SEQ ID NO: 3353312 - RNA, 18 nt, Human
ggcugcaccggcuggccu

SEQ ID NO: 3353313 - RNA, 19 nt, Human
ggcugcaccggcuggccug

SEQ ID NO: 3353314 - RNA, 17 nt, Human
ggcugcaccggcuggcc

SEQ ID NO: 3353315 - RNA, 24 nt, Human
ggcugcaaaggguaucaggugcug

SEQ ID NO: 3353316 - RNA, 23 nt, Human
ggcugcaaaggguaucaggugcu

SEQ ID NO: 3353317 - RNA, 22 nt, Human
ggcugcaaaggguaucaggugc

SEQ ID NO: 3353318 - RNA, 18 nt, Human
ggcugcaaaggguaucag

SEQ ID NO: 3353319 - RNA, 17 nt, Human
ggccccugcccggcugc

SEQ ID NO: 3353320 - RNA, 16 nt, Human
ggccccugcccggcug

SEQ ID NO: 3353321 - RNA, 17 nt, Human
ggcucugccucccauca

SEQ ID NO: 3353322 - RNA, 20 nt, Human
ggccccugcccggcugcgga

SEQ ID NO: 3353323 - RNA, 13 nt, Human
ggcugagguggga

SEQ ID NO: 3353324 - RNA, 15 nt, Human
ggcugaggugggagg

SEQ ID NO: 3353325 - RNA, 15 nt, Human
ggcuuagucacugag

SEQ ID NO: 3353326 - RNA, 21 nt, Human
ggcuuagucacugagacagcc

SEQ ID NO: 3353327 - RNA, 23 nt, Human
ggcuuauauucaaccauggacuu

SEQ ID NO: 3353328 - RNA, 14 nt, Human
ggcuuauauucaac

SEQ ID NO: 3353329 - RNA, 22 nt, Human
ggcuuauauucaaccauggacu

SEQ ID NO: 3353330 - RNA, 21 nt, Human
ggcuuauauucaaccauggac

SEQ ID NO: 3353331 - RNA, 20 nt, Human
ggcuuauauucaaccaugga

SEQ ID NO: 3353332 - RNA, 15 nt, Human
ggcuuauauucaacc

SEQ ID NO: 3353333 - RNA, 17 nt, Human
ggcugggcuucaguggc

SEQ ID NO: 3353334 - RNA, 13 nt, Human
ggcugggcuucag

SEQ ID NO: 3353335 - RNA, 15 nt, Human
ggcuuaaaacaacac

SEQ ID NO: 3353336 - RNA, 12 nt, Human
ggcugggcuuca

SEQ ID NO: 3353337 - RNA, 17 nt, Human
ggcugggcucccuuccc

SEQ ID NO: 3353338 - RNA, 10 nt, Human
ggcuuuugug

SEQ ID NO: 3353339 - RNA, 19 nt, Human
ggcuuggggaccagagcug

SEQ ID NO: 3353340 - RNA, 21 nt, Human
ggcuuggggaccagagcugcc

SEQ ID NO: 3353341 - RNA, 12 nt, Human
gggaccucaggc

SEQ ID NO: 3353342 - RNA, 13 nt, Human
gggaccucaggcc

SEQ ID NO: 3353343 - RNA, 15 nt, Human
gggaccucaggccug

SEQ ID NO: 3353344 - RNA, 17 nt, Human
gggacuacaggcaccca

SEQ ID NO: 3353345 - RNA, 14 nt, Human
gggaagggggcugg

SEQ ID NO: 3353346 - RNA, 16 nt, Human
gggaagggggcuggga

SEQ ID NO: 3353347 - RNA, 17 nt, Human
gggaagggggcugggac

SEQ ID NO: 3353348 - RNA, 21 nt, Human
gggaaggauacaaaagcaugu

SEQ ID NO: 3353349 - RNA, 23 nt, Human
gggaaggauacaaaagcauguga

SEQ ID NO: 3353350 - RNA, 16 nt, Human
gggaaggauacaaaag

SEQ ID NO: 3353351 - RNA, 23 nt, Human
gggccacagagaaaguacuucuc

SEQ ID NO: 3353352 - RNA, 16 nt, Human
gggccacagagaaagu

SEQ ID NO: 3353353 - RNA, 17 nt, Human
gggcccagagagggugg

SEQ ID NO: 3353354 - RNA, 12 nt, Human
gggcaugacacg

SEQ ID NO: 3353355 - RNA, 13 nt, Human
gggcccugccucc

SEQ ID NO: 3353356 - RNA, 13 nt, Human
gggccuggccuga

SEQ ID NO: 3353357 - RNA, 12 nt, Human
gggccuggccug

SEQ ID NO: 3353358 - RNA, 14 nt, Human
gggccuggccugag

SEQ ID NO: 3353359 - RNA, 18 nt, Human
gggccuggccugagcugg

SEQ ID NO: 3353360 - RNA, 17 nt, Human
gggccuggcucaggugg

SEQ ID NO: 3353361 - RNA, 13 nt, Human
gggccuggcuccc

SEQ ID NO: 3353362 - RNA, 23 nt, Human
gggcacaccgggcacucagaaga

SEQ ID NO: 3353363 - RNA, 18 nt, Human
gggcacagaaaauggaag

SEQ ID NO: 3353364 - RNA, 20 nt, Human
gggcacagaaaauggaagac

SEQ ID NO: 3353365 - RNA, 21 nt, Human
gggcacagaaaauggaagaca

SEQ ID NO: 3353366 - RNA, 19 nt, Human
gggcacucagaagacacug

SEQ ID NO: 3353367 - RNA, 16 nt, Human
gggcacucagaagaca

SEQ ID NO: 3353368 - RNA, 13 nt, Human
gggcacagggucu

SEQ ID NO: 3353369 - RNA, 16 nt, Human
gggcacagggucucua

SEQ ID NO: 3353370 - RNA, 18 nt, Human
gggcagaaggaagacuuc

SEQ ID NO: 3353371 - RNA, 14 nt, Human
gggcagaaggaaga

SEQ ID NO: 3353372 - RNA, 20 nt, Human
gggcacucagaagacacuga

SEQ ID NO: 3353373 - RNA, 11 nt, Human
gggcagagcag

SEQ ID NO: 3353374 - RNA, 17 nt, Human
gggcagguugguggggg

SEQ ID NO: 3353375 - RNA, 16 nt, Human
gggaggugaccccagg

SEQ ID NO: 3353376 - RNA, 17 nt, Human
gggaggugggauccucc

SEQ ID NO: 3353377 - RNA, 14 nt, Human
gggagugagcuggu

SEQ ID NO: 3353378 - RNA, 11 nt, Human
gggagugagcu

SEQ ID NO: 3353379 - RNA, 18 nt, Human
gggagugacagaggcagc

SEQ ID NO: 3353380 - RNA, 17 nt, Human
gggagugacagaggcag

SEQ ID NO: 3353381 - RNA, 23 nt, Human
gggauccuggaguucugguuccu

SEQ ID NO: 3353382 - RNA, 18 nt, Human
gggcaacccuggugacca

SEQ ID NO: 3353383 - RNA, 20 nt, Human
gggcaacccccagccugcua

SEQ ID NO: 3353384 - RNA, 15 nt, Human
gggauccuccaggug

SEQ ID NO: 3353385 - RNA, 16 nt, Human
gggauccuccaggugc

SEQ ID NO: 3353386 - RNA, 21 nt, Human
gggauaugauuuaaaucagcc

SEQ ID NO: 3353387 - RNA, 13 nt, Human
gggauagagagag

SEQ ID NO: 3353388 - RNA, 16 nt, Western equine encephalomyelitis virus
uucacacagcugcucu

SEQ ID NO: 3353389 - RNA, 18 nt, Western equine encephalomyelitis virus
gaaacagcaccauuugga

SEQ ID NO: 3353390 - RNA, 16 nt, Western equine encephalomyelitis virus
caugcgacaaaccacc

SEQ ID NO: 3353391 - RNA, 14 nt, Western equine encephalomyelitis virus
ugccguaggcagca

SEQ ID NO: 3353392 - RNA, 12 nt, Western equine encephalomyelitis virus
ugugcugcauuc

SEQ ID NO: 3353393 - RNA, 16 nt, Western equine encephalomyelitis virus
gcagacgcaacagcag

SEQ ID NO: 3353394 - RNA, 17 nt, Western equine encephalomyelitis virus
ugcccguauugcagaca

SEQ ID NO: 3353395 - RNA, 23 nt, Western equine encephalomyelitis virus
gcacuguuugggggagcaucauc

SEQ ID NO: 3353396 - RNA, 15 nt, Western equine encephalomyelitis virus
uccacguugaaggaa

SEQ ID NO: 3353397 - RNA, 22 nt, Western equine encephalomyelitis virus
uacgugaccugcaaauuccaca

SEQ ID NO: 3353398 - RNA, 14 nt, Western equine encephalomyelitis virus
cagaauggauuaca

SEQ ID NO: 3353399 - RNA, 14 nt, Western equine encephalomyelitis virus
ccugacugcaaugc

SEQ ID NO: 3353400 - RNA, 22 nt, Western equine encephalomyelitis virus
cauauuuuacuuaaaaacacua

SEQ ID NO: 3353401 - RNA, 16 nt, Western equine encephalomyelitis virus
acggcugcugaagccu

SEQ ID NO: 3353402 - RNA, 14 nt, Western equine encephalomyelitis virus
cgguagagaggagu

SEQ ID NO: 3353403 - RNA, 15 nt, Western equine encephalomyelitis virus
caaaggcggauuaca

SEQ ID NO: 3353404 - RNA, 22 nt, Western equine encephalomyelitis virus
cugcguugucggaggaaggcug

SEQ ID NO: 3353405 - RNA, 17 nt, Western equine encephalomyelitis virus
acacgcugcuggagaac

SEQ ID NO: 3353406 - RNA, 16 nt, Western equine encephalomyelitis virus
ugaaauguggaagaac

SEQ ID NO: 3353407 - RNA, 19 nt, Western equine encephalomyelitis virus
ccgaggaagcacagugcau

SEQ ID NO: 3353408 - RNA, 16 nt, Western equine encephalomyelitis virus
ggccgugaaauugaag

SEQ ID NO: 3353409 - RNA, 15 nt, Western equine encephalomyelitis virus
agugagaacacacaa

SEQ ID NO: 3353410 - RNA, 22 nt, Western equine encephalomyelitis virus
acacuauaucacuuuuaugaga

SEQ ID NO: 3353411 - RNA, 13 nt, Western equine encephalomyelitis virus
ccacguugaagga

SEQ ID NO: 3353412 - RNA, 17 nt, Western equine encephalomyelitis virus
guccaccgccaaagaag

SEQ ID NO: 3353413 - RNA, 21 nt, Western equine encephalomyelitis virus
cauuaccgaugacuucacacu

SEQ ID NO: 3353414 - RNA, 14 nt, Western equine encephalomyelitis virus
aggaagcgucaggc

SEQ ID NO: 3353415 - RNA, 11 nt, Western equine encephalomyelitis virus
acagcaccauu

SEQ ID NO: 3353416 - RNA, 16 nt, Western equine encephalomyelitis virus
cuuggaacuggcugcu

SEQ ID NO: 3353417 - RNA, 14 nt, Western equine encephalomyelitis virus
ugcaagaaacagca

SEQ ID NO: 3353418 - RNA, 19 nt, Western equine encephalomyelitis virus
gacagcuguuuugaaggaa

SEQ ID NO: 3353419 - RNA, 22 nt, Western equine encephalomyelitis virus
guccaguucacucccacuccac

SEQ ID NO: 3353420 - RNA, 20 nt, Western equine encephalomyelitis virus
gcaagaagagacugccugac

SEQ ID NO: 3353421 - RNA, 12 nt, Western equine encephalomyelitis virus
cggcaacaccac

SEQ ID NO: 3353422 - RNA, 15 nt, Western equine encephalomyelitis virus
cgauguacuuccgag

SEQ ID NO: 3353423 - RNA, 18 nt, Western equine encephalomyelitis virus
ccacugugccaaauguuc

SEQ ID NO: 3353424 - RNA, 15 nt, Western equine encephalomyelitis virus
uucaugcugcaugcc

SEQ ID NO: 3353425 - RNA, 16 nt, Western equine encephalomyelitis virus
caccagcgacaaacca

SEQ ID NO: 3353426 - RNA, 20 nt, Western equine encephalomyelitis virus
aguccuaucuggaggaagcg

SEQ ID NO: 3353427 - RNA, 18 nt, Western equine encephalomyelitis virus
aaaagaagaagcagcaag

SEQ ID NO: 3353428 - RNA, 17 nt, Western equine encephalomyelitis virus
caccgccaaagaagaag

SEQ ID NO: 3353429 - RNA, 13 nt, Western equine encephalomyelitis virus
ugcacuaaagcaa

SEQ ID NO: 3353430 - RNA, 23 nt, Western equine encephalomyelitis virus
cacguuuacgaucacuugaagga

SEQ ID NO: 3353431 - RNA, 20 nt, Western equine encephalomyelitis virus
gcagacgcaacagcagaaug

SEQ ID NO: 3353432 - RNA, 13 nt, Western equine encephalomyelitis virus
uggaagaacaacu

SEQ ID NO: 3353433 - RNA, 16 nt, Western equine encephalomyelitis virus
uucuggcaagaacguc

SEQ ID NO: 3353434 - RNA, 16 nt, Western equine encephalomyelitis virus
ggaagcguggugcaua

SEQ ID NO: 3353435 - RNA, 23 nt, Western equine encephalomyelitis virus
gccaagugaauggauaugccugc

SEQ ID NO: 3353436 - RNA, 19 nt, Western equine encephalomyelitis virus
cgauguauuuccgaggaag

SEQ ID NO: 3353437 - RNA, 15 nt, Western equine encephalomyelitis virus
acgacacgcugcugg

SEQ ID NO: 3353438 - RNA, 17 nt, Western equine encephalomyelitis virus
ucccaugcgacaaacca

SEQ ID NO: 3353439 - RNA, 18 nt, Western equine encephalomyelitis virus
caucccugaugcagcuuu

SEQ ID NO: 3353440 - RNA, 16 nt, Western equine encephalomyelitis virus
guccauggaaagcugg

SEQ ID NO: 3353441 - RNA, 12 nt, Western equine encephalomyelitis virus
ccgaucaugcug

SEQ ID NO: 3353442 - RNA, 13 nt, Western equine encephalomyelitis virus
guagaugacugag

SEQ ID NO: 3353443 - RNA, 15 nt, Western equine encephalomyelitis virus
gacagugagaacaca

SEQ ID NO: 3353444 - RNA, 11 nt, Western equine encephalomyelitis virus
acucagugcaa

SEQ ID NO: 3353445 - RNA, 17 nt, Western equine encephalomyelitis virus
cggcaagaaguccaccu

SEQ ID NO: 3353446 - RNA, 21 nt, Western equine encephalomyelitis virus
ucggcuacaaucaggcaggca

SEQ ID NO: 3353447 - RNA, 13 nt, Western equine encephalomyelitis virus
ugacagugagaac

SEQ ID NO: 3353448 - RNA, 20 nt, Western equine encephalomyelitis virus
cacgagcggagcaucugaga

SEQ ID NO: 3353449 - RNA, 19 nt, Western equine encephalomyelitis virus
aacggcugcacuaaagcaa

SEQ ID NO: 3353450 - RNA, 20 nt, Western equine encephalomyelitis virus
cgugaccugcaaauuccaca

SEQ ID NO: 3353451 - RNA, 23 nt, Western equine encephalomyelitis virus
auacguuugucaauggcgucacg

SEQ ID NO: 3353452 - RNA, 20 nt, Western equine encephalomyelitis virus
gcuugacaccgacagucugc

SEQ ID NO: 3353453 - RNA, 20 nt, Western equine encephalomyelitis virus
auuuuacuuaaaaacacuau

SEQ ID NO: 3353454 - RNA, 15 nt, Western equine encephalomyelitis virus
cagcgacaaaccacc

SEQ ID NO: 3353455 - RNA, 17 nt, Western equine encephalomyelitis virus
guggagaaaaagaucag

SEQ ID NO: 3353456 - RNA, 17 nt, Western equine encephalomyelitis virus
aaacauuuggagaaacu

SEQ ID NO: 3353457 - RNA, 21 nt, Western equine encephalomyelitis virus
accaugaaccagucagagucu

SEQ ID NO: 3353458 - RNA, 15 nt, Western equine encephalomyelitis virus
ugcaaggcauccuca

SEQ ID NO: 3353459 - RNA, 16 nt, Western equine encephalomyelitis virus
gcaggcgucugccugg

SEQ ID NO: 3353460 - RNA, 17 nt, Western equine encephalomyelitis virus
agucugggcccaggagu

SEQ ID NO: 3353461 - RNA, 17 nt, Western equine encephalomyelitis virus
ugcaaugcgaccaacau

SEQ ID NO: 3353462 - RNA, 23 nt, Western equine encephalomyelitis virus
ggucauagcagggccgauaucag

SEQ ID NO: 3353463 - RNA, 22 nt, Western equine encephalomyelitis virus
acucgauguacuuccgaggaag

SEQ ID NO: 3353464 - RNA, 15 nt, Western equine encephalomyelitis virus
caggcgucugccugg

SEQ ID NO: 3353465 - RNA, 15 nt, Western equine encephalomyelitis virus
ggcacacagaccacu

SEQ ID NO: 3353466 - RNA, 14 nt, Western equine encephalomyelitis virus
gcccaggagucggc

SEQ ID NO: 3353467 - RNA, 18 nt, Western equine encephalomyelitis virus
acgcaagccuaaaccagg

SEQ ID NO: 3353468 - RNA, 23 nt, Western equine encephalomyelitis virus
aaaacucgauguacuuccgagga

SEQ ID NO: 3353469 - RNA, 19 nt, Western equine encephalomyelitis virus
uucagcccaauaaaaauug

SEQ ID NO: 3353470 - RNA, 23 nt, Western equine encephalomyelitis virus
uuagcgguuuugugcugcauucg

SEQ ID NO: 3353471 - RNA, 18 nt, Western equine encephalomyelitis virus
agcuaugaaaccaggagc

SEQ ID NO: 3353472 - RNA, 13 nt, Western equine encephalomyelitis virus
cauuccuucacca

SEQ ID NO: 3353473 - RNA, 12 nt, Western equine encephalomyelitis virus
aagcacagugca

SEQ ID NO: 3353474 - RNA, 19 nt, Western equine encephalomyelitis virus
gaucuuauuaggcacacag

SEQ ID NO: 3353475 - RNA, 13 nt, Western equine encephalomyelitis virus
acgccagaacgaa

SEQ ID NO: 3353476 - RNA, 20 nt, Western equine encephalomyelitis virus
aagccuucugucaagaacau

SEQ ID NO: 3353477 - RNA, 15 nt, Western equine encephalomyelitis virus
gugagaacacacaac

SEQ ID NO: 3353478 - RNA, 18 nt, Western equine encephalomyelitis virus
acaacguauguguaugaa

SEQ ID NO: 3353479 - RNA, 16 nt, Western equine encephalomyelitis virus
ccacacaugugacugc

SEQ ID NO: 3353480 - RNA, 16 nt, Western equine encephalomyelitis virus
cagaacgaacacucga

SEQ ID NO: 3353481 - RNA, 18 nt, Western equine encephalomyelitis virus
ugguucaaaggcaucacc

SEQ ID NO: 3353482 - RNA, 14 nt, Western equine encephalomyelitis virus
ugcagacacucaac

SEQ ID NO: 3353483 - RNA, 17 nt, Western equine encephalomyelitis virus
cuccacgacagcuguuu

SEQ ID NO: 3353484 - RNA, 19 nt, Western equine encephalomyelitis virus
gauguacuuccgaggaagc

SEQ ID NO: 3353485 - RNA, 12 nt, Western equine encephalomyelitis virus
gaaacauuugga

SEQ ID NO: 3353486 - RNA, 19 nt, Western equine encephalomyelitis virus
uuuacuuaaaaacacuaua

SEQ ID NO: 3353487 - RNA, 14 nt, Western equine encephalomyelitis virus
uuaacaacacuaua

SEQ ID NO: 3353488 - RNA, 16 nt, Western equine encephalomyelitis virus
aguacgugaccugcaa

SEQ ID NO: 3353489 - RNA, 14 nt, Western equine encephalomyelitis virus
accacucagugcaa

SEQ ID NO: 3353490 - RNA, 18 nt, Western equine encephalomyelitis virus
cgauguacuuccgaggaa

SEQ ID NO: 3353491 - RNA, 16 nt, Western equine encephalomyelitis virus
augcaccguggagaaa

SEQ ID NO: 3353492 - RNA, 14 nt, Western equine encephalomyelitis virus
cuugacacuaaaac

SEQ ID NO: 3353493 - RNA, 17 nt, Western equine encephalomyelitis virus
cccuccuaggcgccgcu

SEQ ID NO: 3353494 - RNA, 19 nt, Western equine encephalomyelitis virus
auuuuacuuaaaaacacua

SEQ ID NO: 3353495 - RNA, 21 nt, Western equine encephalomyelitis virus
gcuucuacaacuggcaccacg

SEQ ID NO: 3353496 - RNA, 12 nt, Western equine encephalomyelitis virus
uaggcacacaga

SEQ ID NO: 3353497 - RNA, 21 nt, Western equine encephalomyelitis virus
ccgaggaagcguggugcauaa

SEQ ID NO: 3353498 - RNA, 18 nt, Western equine encephalomyelitis virus
cugcguugucggaggaag

SEQ ID NO: 3353499 - RNA, 20 nt, Western equine encephalomyelitis virus
cguaggcagcauaacacuac

SEQ ID NO: 3353500 - RNA, 18 nt, Western equine encephalomyelitis virus
gccgucgucuuggccaca

SEQ ID NO: 3353501 - RNA, 14 nt, Western equine encephalomyelitis virus
ugcaucaucagcag

SEQ ID NO: 3353502 - RNA, 18 nt, Western equine encephalomyelitis virus
cauaaggucgucaucaga

SEQ ID NO: 3353503 - RNA, 16 nt, Western equine encephalomyelitis virus
cagagucugggcccag

SEQ ID NO: 3353504 - RNA, 18 nt, Western equine encephalomyelitis virus
cggcccccgcuggcugcu

SEQ ID NO: 3353505 - RNA, 18 nt, Western equine encephalomyelitis virus
cagccuaaaaagaagaag

SEQ ID NO: 3353506 - RNA, 23 nt, Western equine encephalomyelitis virus
acuccacguugaaggaaaaauug

SEQ ID NO: 3353507 - RNA, 16 nt, Western equine encephalomyelitis virus
uacauauuaacaacac

SEQ ID NO: 3353508 - RNA, 16 nt, Western equine encephalomyelitis virus
accuucaacuaacaag

SEQ ID NO: 3353509 - RNA, 16 nt, Western equine encephalomyelitis virus
ugcaucgccaaagcaa

SEQ ID NO: 3353510 - RNA, 16 nt, Western equine encephalomyelitis virus
agcuugcaucgccaaa

SEQ ID NO: 3353511 - RNA, 16 nt, Western equine encephalomyelitis virus
aaacauuuggagaaac

SEQ ID NO: 3353512 - RNA, 18 nt, Western equine encephalomyelitis virus
caugcaccguggagaaaa

SEQ ID NO: 3353513 - RNA, 21 nt, Western equine encephalomyelitis virus
cucgauguacuuccgaggaag

SEQ ID NO: 3353514 - RNA, 21 nt, Western equine encephalomyelitis virus
aguucgcuccagacugcacua

SEQ ID NO: 3353515 - RNA, 11 nt, Western equine encephalomyelitis virus
gccaaagcaag

SEQ ID NO: 3353516 - RNA, 22 nt, Western equine encephalomyelitis virus
ucugugacagugagaacacaca

SEQ ID NO: 3353517 - RNA, 14 nt, Western equine encephalomyelitis virus
uaaaaauugagaac

SEQ ID NO: 3353518 - RNA, 16 nt, Western equine encephalomyelitis virus
agcuaucagcacaucu

SEQ ID NO: 3353519 - RNA, 15 nt, Western equine encephalomyelitis virus
gcugaugaaaccacu

SEQ ID NO: 3353520 - RNA, 15 nt, Western equine encephalomyelitis virus
uauugcagacacuca

SEQ ID NO: 3353521 - RNA, 21 nt, Western equine encephalomyelitis virus
cucgauguauuuccgaggaag

SEQ ID NO: 3353522 - RNA, 13 nt, Western equine encephalomyelitis virus
cacgccggcccaa

SEQ ID NO: 3353523 - RNA, 15 nt, Western equine encephalomyelitis virus
gcaacgguacccaca

SEQ ID NO: 3353524 - RNA, 20 nt, Western equine encephalomyelitis virus
gcucuaugcuuauaaacaca

SEQ ID NO: 3353525 - RNA, 14 nt, Western equine encephalomyelitis virus
aagagacugccuga

SEQ ID NO: 3353526 - RNA, 13 nt, Western equine encephalomyelitis virus
gcacugcaucauc

SEQ ID NO: 3353527 - RNA, 22 nt, Western equine encephalomyelitis virus
guucacucccacuccacgacag

SEQ ID NO: 3353528 - RNA, 18 nt, Western equine encephalomyelitis virus
cgauguauuuccgaggaa

SEQ ID NO: 3353529 - RNA, 17 nt, Western equine encephalomyelitis virus
gcaccaggcgacccaca

SEQ ID NO: 3353530 - RNA, 11 nt, Western equine encephalomyelitis virus
gcuggcugcuc

SEQ ID NO: 3353531 - RNA, 17 nt, Western equine encephalomyelitis virus
ugcucgaagagaacguc

SEQ ID NO: 3353532 - RNA, 15 nt, Western equine encephalomyelitis virus
caggccaggcccaca

SEQ ID NO: 3353533 - RNA, 15 nt, Western equine encephalomyelitis virus
gagaacgucuugaaa

SEQ ID NO: 3353534 - RNA, 13 nt, Western equine encephalomyelitis virus
ggcccaaacgaag

SEQ ID NO: 3353535 - RNA, 13 nt, Western equine encephalomyelitis virus
cgcgcuugcaccg

SEQ ID NO: 3353536 - RNA, 23 nt, Western equine encephalomyelitis virus
cagguccaccgccaaagaagaag

SEQ ID NO: 3353537 - RNA, 17 nt, Western equine encephalomyelitis virus
aucugugguuuaacaac

SEQ ID NO: 3353538 - RNA, 15 nt, Western equine encephalomyelitis virus
cacagaccacucagu

SEQ ID NO: 3353539 - RNA, 17 nt, Western equine encephalomyelitis virus
accgacagucugcccgg

SEQ ID NO: 3353540 - RNA, 13 nt, Western equine encephalomyelitis virus
gacuacagcacag

SEQ ID NO: 3353541 - RNA, 15 nt, Western equine encephalomyelitis virus
agguccaccgccaaa

SEQ ID NO: 3353542 - RNA, 13 nt, Western equine encephalomyelitis virus
gcgacaaaccacc

SEQ ID NO: 3353543 - RNA, 17 nt, Western equine encephalomyelitis virus
agugcuccuaagccaaa

SEQ ID NO: 3353544 - RNA, 18 nt, Western equine encephalomyelitis virus
acugacauacggcugcug

SEQ ID NO: 3353545 - RNA, 11 nt, Western equine encephalomyelitis virus
ccagaaagggg

SEQ ID NO: 3353546 - RNA, 15 nt, Western equine encephalomyelitis virus
aguucacacagcugc

SEQ ID NO: 3353547 - RNA, 13 nt, Western equine encephalomyelitis virus
gguaaaacucgau

SEQ ID NO: 3353548 - RNA, 17 nt, Western equine encephalomyelitis virus
guaaaacucgauguacu

SEQ ID NO: 3353549 - RNA, 22 nt, Western equine encephalomyelitis virus
ccgcuugacacuaaaacucgau

SEQ ID NO: 3353550 - RNA, 19 nt, Western equine encephalomyelitis virus
ggaucgauuagaauccagg

SEQ ID NO: 3353551 - RNA, 15 nt, Western equine encephalomyelitis virus
aggacgaaacgcaag

SEQ ID NO: 3353552 - RNA, 16 nt, Western equine encephalomyelitis virus
agugcaagguaaauug

SEQ ID NO: 3353553 - RNA, 21 nt, Western equine encephalomyelitis virus
cacgaccaugacaucaaggaa

SEQ ID NO: 3353554 - RNA, 21 nt, Western equine encephalomyelitis virus
cacgcgccgcuugacacuaaa

SEQ ID NO: 3353555 - RNA, 16 nt, Western equine encephalomyelitis virus
ucacacagcugcucug

SEQ ID NO: 3353556 - RNA, 14 nt, Western equine encephalomyelitis virus
aacuuugaaccauc

SEQ ID NO: 3353557 - RNA, 14 nt, Western equine encephalomyelitis virus
ugaaauugaagaag

SEQ ID NO: 3353558 - RNA, 20 nt, Western equine encephalomyelitis virus
ccgaggaagcacagugcaua

SEQ ID NO: 3353559 - RNA, 21 nt, Western equine encephalomyelitis virus
uggauggccgcaugagaucau

SEQ ID NO: 3353560 - RNA, 17 nt, Western equine encephalomyelitis virus
uuggaacuggcugcuug

SEQ ID NO: 3353561 - RNA, 23 nt, Western equine encephalomyelitis virus
cugcacaguagcagacugcauuu

SEQ ID NO: 3353562 - RNA, 18 nt, Western equine encephalomyelitis virus
acgaucacuugaaggaga

SEQ ID NO: 3353563 - RNA, 23 nt, Western equine encephalomyelitis virus
gccuggggaagguagacgccuuc

SEQ ID NO: 3353564 - RNA, 19 nt, Western equine encephalomyelitis virus
auggagcuaugaaaccagg

SEQ ID NO: 3353565 - RNA, 23 nt, Western equine encephalomyelitis virus
aucuuggaacuggcugcuugcac

SEQ ID NO: 3353566 - RNA, 11 nt, Western equine encephalomyelitis virus
ccgaggaagcg

SEQ ID NO: 3353567 - RNA, 19 nt, Western equine encephalomyelitis virus
cauuaaucguauaucacac

SEQ ID NO: 3353568 - RNA, 13 nt, Western equine encephalomyelitis virus
aacuggcugcuug

SEQ ID NO: 3353569 - RNA, 14 nt, Western equine encephalomyelitis virus
ugccacgcgccgcu

SEQ ID NO: 3353570 - RNA, 23 nt, Western equine encephalomyelitis virus
aaaacucgauguauuuccgagga

SEQ ID NO: 3353571 - RNA, 14 nt, Western equine encephalomyelitis virus
ugcuggagaacguc

SEQ ID NO: 3353572 - RNA, 16 nt, Western equine encephalomyelitis virus
aggcacacagaccacu

SEQ ID NO: 3353573 - RNA, 18 nt, Western equine encephalomyelitis virus
acauauuaacaacacuau

SEQ ID NO: 3353574 - RNA, 15 nt, Western equine encephalomyelitis virus
aagaagagacugccu

SEQ ID NO: 3353575 - RNA, 17 nt, Western equine encephalomyelitis virus
aaaguucacacagcugc

SEQ ID NO: 3353576 - RNA, 17 nt, Western equine encephalomyelitis virus
uacccaccggcagaaug

SEQ ID NO: 3353577 - RNA, 17 nt, Western equine encephalomyelitis virus
cuaggaggugcaaauga

SEQ ID NO: 3353578 - RNA, 21 nt, Western equine encephalomyelitis virus
aaacaucuuggaacuggcugc

SEQ ID NO: 3353579 - RNA, 18 nt, Western equine encephalomyelitis virus
caggagucggcaccaggc

SEQ ID NO: 3353580 - RNA, 22 nt, Western equine encephalomyelitis virus
cuucaccacaaguuaaaugcug

SEQ ID NO: 3353581 - RNA, 20 nt, Western equine encephalomyelitis virus
cagcuguuuugaaggaagcg

SEQ ID NO: 3353582 - RNA, 22 nt, Western equine encephalomyelitis virus
ccacgacagcuguuuugaagga

SEQ ID NO: 3353583 - RNA, 14 nt, Western equine encephalomyelitis virus
auacgcgcuugcac

SEQ ID NO: 3353584 - RNA, 17 nt, Western equine encephalomyelitis virus
cugucaagaacauccac

SEQ ID NO: 3353585 - RNA, 14 nt, Western equine encephalomyelitis virus
gccguaggcagcau

SEQ ID NO: 3353586 - RNA, 12 nt, Western equine encephalomyelitis virus
aacgaacacucg

SEQ ID NO: 3353587 - RNA, 18 nt, Western equine encephalomyelitis virus
aagacaguauggagaaaa

SEQ ID NO: 3353588 - RNA, 15 nt, Western equine encephalomyelitis virus
caaagcaagaagaga

SEQ ID NO: 3353589 - RNA, 21 nt, Western equine encephalomyelitis virus
gcguauaguauacggcaacac

SEQ ID NO: 3353590 - RNA, 19 nt, Western equine encephalomyelitis virus
caccaggcgacccacaugg

SEQ ID NO: 3353591 - RNA, 19 nt, Western equine encephalomyelitis virus
ccuguuagcucaauguccu

SEQ ID NO: 3353592 - RNA, 20 nt, Western equine encephalomyelitis virus
acuaaagcaaaacagugcau

SEQ ID NO: 3353593 - RNA, 16 nt, Western equine encephalomyelitis virus
caugcacaggccaggc

SEQ ID NO: 3353594 - RNA, 21 nt, Western equine encephalomyelitis virus
cacagaccacucagugcaagg

SEQ ID NO: 3353595 - RNA, 19 nt, Western equine encephalomyelitis virus
aaaauagcuaucagcacau

SEQ ID NO: 3353596 - RNA, 20 nt, Western equine encephalomyelitis virus
acauggauggccgcaugaga

SEQ ID NO: 3353597 - RNA, 20 nt, Western equine encephalomyelitis virus
cacaucgagcccacaagcaa

SEQ ID NO: 3353598 - RNA, 18 nt, Western equine encephalomyelitis virus
ugaccagucccuaccugg

SEQ ID NO: 3353599 - RNA, 22 nt, Western equine encephalomyelitis virus
agcugcacaguagcagacugca

SEQ ID NO: 3353600 - RNA, 17 nt, Western equine encephalomyelitis virus
cugugacagugagaaca

SEQ ID NO: 3353601 - RNA, 20 nt, Western equine encephalomyelitis virus
ugaagccuucugucaagaac

SEQ ID NO: 3353602 - RNA, 13 nt, Western equine encephalomyelitis virus
uguuuugaaggaa

SEQ ID NO: 3353603 - RNA, 22 nt, Western equine encephalomyelitis virus
aaguguggcgacuacagcacag

SEQ ID NO: 3353604 - RNA, 12 nt, Western equine encephalomyelitis virus
cacuauaucacu

SEQ ID NO: 3353605 - RNA, 19 nt, Western equine encephalomyelitis virus
aaguguacauuaaaccacc

SEQ ID NO: 3353606 - RNA, 23 nt, Western equine encephalomyelitis virus
uaugcggcaagaaguccaccugc

SEQ ID NO: 3353607 - RNA, 13 nt, Western equine encephalomyelitis virus
auaauuggagaac

SEQ ID NO: 3353608 - RNA, 12 nt, Western equine encephalomyelitis virus
cguugaaggaaa

SEQ ID NO: 3353609 - RNA, 19 nt, Western equine encephalomyelitis virus
gcacaguugugcauuccuc

SEQ ID NO: 3353610 - RNA, 23 nt, Western equine encephalomyelitis virus
gcgcagguuacgcgccacuuaac

SEQ ID NO: 3353611 - RNA, 17 nt, Western equine encephalomyelitis virus
ggcugcucaaaucgaag

SEQ ID NO: 3353612 - RNA, 12 nt, Western equine encephalomyelitis virus
acacuaaaacuc

SEQ ID NO: 3353613 - RNA, 22 nt, Western equine encephalomyelitis virus
gggcccaggagucggcaccagg

SEQ ID NO: 3353614 - RNA, 23 nt, Western equine encephalomyelitis virus
uccaaacccuccuaggcgccgcu

SEQ ID NO: 3353615 - RNA, 17 nt, Western equine encephalomyelitis virus
augaaauguggaagaac

SEQ ID NO: 3353616 - RNA, 15 nt, Western equine encephalomyelitis virus
cguaccgagaggagu

SEQ ID NO: 3353617 - RNA, 18 nt, Western equine encephalomyelitis virus
gcuucuacaacuggcacc

SEQ ID NO: 3353618 - RNA, 13 nt, Western equine encephalomyelitis virus
ggccaggcccaca

SEQ ID NO: 3353619 - RNA, 23 nt, Western equine encephalomyelitis virus
cauaaugcugugcagugucacau

SEQ ID NO: 3353620 - RNA, 20 nt, Western equine encephalomyelitis virus
caccagcgacaaaccaccgg

SEQ ID NO: 3353621 - RNA, 23 nt, Western equine encephalomyelitis virus
cguacggcgcuuucaguggucac

SEQ ID NO: 3353622 - RNA, 12 nt, Western equine encephalomyelitis virus
cccgcacugaca

SEQ ID NO: 3353623 - RNA, 16 nt, Western equine encephalomyelitis virus
aaucagacacgcugca

SEQ ID NO: 3353624 - RNA, 20 nt, Western equine encephalomyelitis virus
ccgaugacuucacacugacc

SEQ ID NO: 3353625 - RNA, 16 nt, Western equine encephalomyelitis virus
gcuuucaguggucacu

SEQ ID NO: 3353626 - RNA, 14 nt, Western equine encephalomyelitis virus
cugaaccgugguca

SEQ ID NO: 3353627 - RNA, 19 nt, Western equine encephalomyelitis virus
cgaccaugacaucaaggaa

SEQ ID NO: 3353628 - RNA, 14 nt, Western equine encephalomyelitis virus
agcagcaagccaag

SEQ ID NO: 3353629 - RNA, 18 nt, Western equine encephalomyelitis virus
ugggcgggaaaggcgaca

SEQ ID NO: 3353630 - RNA, 15 nt, Western equine encephalomyelitis virus
gaagagacugccuga

SEQ ID NO: 3353631 - RNA, 20 nt, Western equine encephalomyelitis virus
aggaggugcaaaugagggca

SEQ ID NO: 3353632 - RNA, 21 nt, Western equine encephalomyelitis virus
ccgaggaagcacagugcauaa

SEQ ID NO: 3353633 - RNA, 13 nt, Western equine encephalomyelitis virus
gcuccagacugca

SEQ ID NO: 3353634 - RNA, 16 nt, Western equine encephalomyelitis virus
gccacgcgccgcuuga

SEQ ID NO: 3353635 - RNA, 14 nt, Western equine encephalomyelitis virus
cuaucuggaggaag

SEQ ID NO: 3353636 - RNA, 14 nt, Western equine encephalomyelitis virus
cgccaaagaagaag

SEQ ID NO: 3353637 - RNA, 15 nt, Western equine encephalomyelitis virus
cagucgcacuaaaag

SEQ ID NO: 3353638 - RNA, 13 nt, Western equine encephalomyelitis virus
cggcauccagucu

SEQ ID NO: 3353639 - RNA, 14 nt, Western equine encephalomyelitis virus
ccaacauugcugac

SEQ ID NO: 3353640 - RNA, 17 nt, Western equine encephalomyelitis virus
caggacgaccccugcaa

SEQ ID NO: 3353641 - RNA, 14 nt, Western equine encephalomyelitis virus
agccuaaaaagaag

SEQ ID NO: 3353642 - RNA, 23 nt, Western equine encephalomyelitis virus
auaaguccuaucuggaggaagcg

SEQ ID NO: 3353643 - RNA, 22 nt, Western equine encephalomyelitis virus
acacugaccagucccuaccugg

SEQ ID NO: 3353644 - RNA, 16 nt, Western equine encephalomyelitis virus
acugccugacgccaua

SEQ ID NO: 3353645 - RNA, 14 nt, Western equine encephalomyelitis virus
acaacagaggcaga

SEQ ID NO: 3353646 - RNA, 22 nt, Western equine encephalomyelitis virus
acucgauguauuuccgaggaag

SEQ ID NO: 3353647 - RNA, 16 nt, Western equine encephalomyelitis virus
gaccacacaugugacu

SEQ ID NO: 3353648 - RNA, 16 nt, Western equine encephalomyelitis virus
acuacauauuaacaac

SEQ ID NO: 3353649 - RNA, 14 nt, Western equine encephalomyelitis virus
caagaggacgaaac

SEQ ID NO: 3353650 - RNA, 17 nt, Western equine encephalomyelitis virus
caaauuccacacaguca

SEQ ID NO: 3353651 - RNA, 22 nt, Western equine encephalomyelitis virus
gccggaucuuauuaggcacaca

SEQ ID NO: 3353652 - RNA, 21 nt, Western equine encephalomyelitis virus
gccggaucuuauuaggcacac

SEQ ID NO: 3353653 - RNA, 17 nt, Western equine encephalomyelitis virus
ugaugaaaccacuccac

SEQ ID NO: 3353654 - RNA, 15 nt, Western equine encephalomyelitis virus
ucacccuccaccuga

SEQ ID NO: 3353655 - RNA, 24 nt, Western equine encephalomyelitis virus
acgaucacuugaaggagacgucug

SEQ ID NO: 3353656 - RNA, 18 nt, Western equine encephalomyelitis virus
caggcgucugccugggga

SEQ ID NO: 3353657 - RNA, 15 nt, Western equine encephalomyelitis virus
gacauacggcugcug

SEQ ID NO: 3353658 - RNA, 22 nt, Western equine encephalomyelitis virus
gaugcagcuuuugugagaucau

SEQ ID NO: 3353659 - RNA, 21 nt, Western equine encephalomyelitis virus
caagaaguccaccugcaaugc

SEQ ID NO: 3353660 - RNA, 15 nt, Western equine encephalomyelitis virus
uugacacuaaaacuc

SEQ ID NO: 3353661 - RNA, 15 nt, Western equine encephalomyelitis virus
cugcuuuucaugcug

SEQ ID NO: 3353662 - RNA, 20 nt, Western equine encephalomyelitis virus
acgacacgcugcuggagaac

SEQ ID NO: 3353663 - RNA, 17 nt, Western equine encephalomyelitis virus
aaguucacacagcugcu

SEQ ID NO: 3353664 - RNA, 22 nt, Western equine encephalomyelitis virus
ugaaauguggaagaacaacuca

SEQ ID NO: 3353665 - RNA, 14 nt, Western equine encephalomyelitis virus
ggaacuggcugcuu

SEQ ID NO: 3353666 - RNA, 12 nt, Western equine encephalomyelitis virus
uacacacuuuau

SEQ ID NO: 3353667 - RNA, 15 nt, Western equine encephalomyelitis virus
gcucugaaagucggc

SEQ ID NO: 3353668 - RNA, 22 nt, Western equine encephalomyelitis virus
gcaucacccuccaccugacugc

SEQ ID NO: 3353669 - RNA, 23 nt, Western equine encephalomyelitis virus
auuuccgaggaagcacagugcau

SEQ ID NO: 3353670 - RNA, 13 nt, Western equine encephalomyelitis virus
cggccgaccacau

SEQ ID NO: 3353671 - RNA, 15 nt, Western equine encephalomyelitis virus
aagaagaagagugcu

SEQ ID NO: 3353672 - RNA, 22 nt, Western equine encephalomyelitis virus
cggaggaaggcugaugaaacca

SEQ ID NO: 3353673 - RNA, 16 nt, Western equine encephalomyelitis virus
ggaagcacagugcaua

SEQ ID NO: 3353674 - RNA, 16 nt, Western equine encephalomyelitis virus
cuggcugcuugcacug

SEQ ID NO: 3353675 - RNA, 21 nt, Western equine encephalomyelitis virus
ccgugaaauugaagaaggcua

SEQ ID NO: 3353676 - RNA, 14 nt, Western equine encephalomyelitis virus
gcuccuaagccaaa

SEQ ID NO: 3353677 - RNA, 16 nt, Western equine encephalomyelitis virus
cauauuaacaacacua

SEQ ID NO: 3353678 - RNA, 15 nt, Western equine encephalomyelitis virus
aaacauuuggagaaa

SEQ ID NO: 3353679 - RNA, 17 nt, Western equine encephalomyelitis virus
caauguccuccagguga

SEQ ID NO: 3353680 - RNA, 16 nt, Western equine encephalomyelitis virus
gcacaucgagcccaca

SEQ ID NO: 3353681 - RNA, 15 nt, Western equine encephalomyelitis virus
aaccuggagaucacg

SEQ ID NO: 3353682 - RNA, 20 nt, Western equine encephalomyelitis virus
acagcuguuuugaaggaagc

SEQ ID NO: 3353683 - RNA, 18 nt, Western equine encephalomyelitis virus
ucagcacaucuggacccu

SEQ ID NO: 3353684 - RNA, 20 nt, Western equine encephalomyelitis virus
uauggagcuaugaaaccagg

SEQ ID NO: 3353685 - RNA, 14 nt, Western equine encephalomyelitis virus
cacagucauuccuu

SEQ ID NO: 3353686 - RNA, 16 nt, Western equine encephalomyelitis virus
auuccauuccgcuuga

SEQ ID NO: 3353687 - RNA, 21 nt, Western equine encephalomyelitis virus
cguucggcgauauucaagcau

SEQ ID NO: 3353688 - RNA, 20 nt, Western equine encephalomyelitis virus
cgucugccuggggaagguag

SEQ ID NO: 3353689 - RNA, 20 nt, Western equine encephalomyelitis virus
accugcaaauuccacacagu

SEQ ID NO: 3353690 - RNA, 16 nt, Western equine encephalomyelitis virus
gucucuaauauacacu

SEQ ID NO: 3353691 - RNA, 14 nt, Western equine encephalomyelitis virus
ccuucugucaagaa

SEQ ID NO: 3353692 - RNA, 22 nt, Western equine encephalomyelitis virus
gucucuaauauacacuacacau

SEQ ID NO: 3353693 - RNA, 14 nt, Western equine encephalomyelitis virus
accaccuucuggca

SEQ ID NO: 3353694 - RNA, 11 nt, Western equine encephalomyelitis virus
uagagaggagu

SEQ ID NO: 3353695 - RNA, 13 nt, Western equine encephalomyelitis virus
ugagaucaucaga

SEQ ID NO: 3353696 - RNA, 20 nt, Western equine encephalomyelitis virus
caugcacaggccaggcccac

SEQ ID NO: 3353697 - RNA, 11 nt, Western equine encephalomyelitis virus
ccgagaggagu

SEQ ID NO: 3353698 - RNA, 22 nt, Western equine encephalomyelitis virus
uagucaacuugacuuucaaaca

SEQ ID NO: 3353699 - RNA, 15 nt, Western equine encephalomyelitis virus
cacaguugugcauuc

SEQ ID NO: 3353700 - RNA, 21 nt, Western equine encephalomyelitis virus
aguaucaggguaugaaaugug

SEQ ID NO: 3353701 - RNA, 18 nt, Western equine encephalomyelitis virus
cuuggaacuggcugcuug

SEQ ID NO: 3353702 - RNA, 16 nt, Western equine encephalomyelitis virus
aucagacacgcugcag

SEQ ID NO: 3353703 - RNA, 13 nt, Western equine encephalomyelitis virus
ccugcaaauucca

SEQ ID NO: 3353704 - RNA, 22 nt, Western equine encephalomyelitis virus
ugcaaugcgaccaacauugcug

SEQ ID NO: 3353705 - RNA, 22 nt, Western equine encephalomyelitis virus
cauuaaucguauaucacacuac

SEQ ID NO: 3353706 - RNA, 24 nt, Western equine encephalomyelitis virus
cauuaaucguauaucacacuacau

SEQ ID NO: 3353707 - RNA, 19 nt, Western equine encephalomyelitis virus
cgauguacuuccgaggaag

SEQ ID NO: 3353708 - RNA, 15 nt, Western equine encephalomyelitis virus
acacuaaaacucgau

SEQ ID NO: 3353709 - RNA, 21 nt, Western equine encephalomyelitis virus
cugaaacauuuggagaaacuu

SEQ ID NO: 3353710 - RNA, 22 nt, Western equine encephalomyelitis virus
cgccuucgaacaugcgaccacu

SEQ ID NO: 3353711 - RNA, 15 nt, Western equine encephalomyelitis virus
auuccuucaccacaa

SEQ ID NO: 3353712 - RNA, 17 nt, Western equine encephalomyelitis virus
cacagguaucgugagca

SEQ ID NO: 3353713 - RNA, 23 nt, Western equine encephalomyelitis virus
gaccacauaauuggagaaccaca

SEQ ID NO: 3353714 - RNA, 22 nt, Western equine encephalomyelitis virus
ucugcccguauugcagacacuc

SEQ ID NO: 3353715 - RNA, 15 nt, Western equine encephalomyelitis virus
guacauuaaaccacc

SEQ ID NO: 3353716 - RNA, 16 nt, Western equine encephalomyelitis virus
ggucacuuggaaccag

SEQ ID NO: 3353717 - RNA, 12 nt, Western equine encephalomyelitis virus
cgaggaagcgug

SEQ ID NO: 3353718 - RNA, 20 nt, Western equine encephalomyelitis virus
uaugaaauguggaagaacaa

SEQ ID NO: 3353719 - RNA, 14 nt, Western equine encephalomyelitis virus
uaacaacacuauau

SEQ ID NO: 3353720 - RNA, 17 nt, Western equine encephalomyelitis virus
ggguaaccaugaaccag

SEQ ID NO: 3353721 - RNA, 13 nt, Western equine encephalomyelitis virus
gcugcaugccuuu

SEQ ID NO: 3353722 - RNA, 16 nt, Western equine encephalomyelitis virus
guauaucacacuacau

SEQ ID NO: 3353723 - RNA, 13 nt, Western equine encephalomyelitis virus
ucacuugaaggag

SEQ ID NO: 3353724 - RNA, 17 nt, Western equine encephalomyelitis virus
agcaagaagagacugcc

SEQ ID NO: 3353725 - RNA, 16 nt, Western equine encephalomyelitis virus
augacaucaaggaaga

SEQ ID NO: 3353726 - RNA, 15 nt, Western equine encephalomyelitis virus
cagcagcuugcaucg

SEQ ID NO: 3353727 - RNA, 10 nt, Western equine encephalomyelitis virus
uggagaucac

SEQ ID NO: 3353728 - RNA, 16 nt, Western equine encephalomyelitis virus
gaagcguggugcauaa

SEQ ID NO: 3353729 - RNA, 16 nt, Western equine encephalomyelitis virus
agcgguaaaacucgau

SEQ ID NO: 3353730 - RNA, 18 nt, Western equine encephalomyelitis virus
uaacaacacuauaucacu

SEQ ID NO: 3353731 - RNA, 15 nt, Western equine encephalomyelitis virus
caaauguuccgggga

SEQ ID NO: 3353732 - RNA, 12 nt, Western equine encephalomyelitis virus
ugaagaaggcua

SEQ ID NO: 3353733 - RNA, 11 nt, Western equine encephalomyelitis virus
ccgcuggcugc

SEQ ID NO: 3353734 - RNA, 20 nt, Western equine encephalomyelitis virus
agacugcacuauagaucacg

SEQ ID NO: 3353735 - RNA, 18 nt, Western equine encephalomyelitis virus
gaagaugaacggcugcac

SEQ ID NO: 3353736 - RNA, 18 nt, Western equine encephalomyelitis virus
aauuacgacacgcugcug

SEQ ID NO: 3353737 - RNA, 19 nt, Western equine encephalomyelitis virus
gaggaagcacagugcauaa

SEQ ID NO: 3353738 - RNA, 20 nt, Western equine encephalomyelitis virus
cugacauagcgguaaaacuc

SEQ ID NO: 3353739 - RNA, 15 nt, Western equine encephalomyelitis virus
cguugucggaggaag

SEQ ID NO: 3353740 - RNA, 12 nt, Western equine encephalomyelitis virus
uuccgcugcuuu

SEQ ID NO: 3353741 - RNA, 16 nt, Western equine encephalomyelitis virus
agucggcaccaggcga

SEQ ID NO: 3353742 - RNA, 20 nt, Western equine encephalomyelitis virus
accaaccguuucucugggca

SEQ ID NO: 3353743 - RNA, 23 nt, Western equine encephalomyelitis virus
uagcggccgugaaauugaagaag

SEQ ID NO: 3353744 - RNA, 16 nt, Western equine encephalomyelitis virus
aguagcagacugcauu

SEQ ID NO: 3353745 - RNA, 19 nt, Western equine encephalomyelitis virus
cagcaagccaagaggacga

SEQ ID NO: 3353746 - RNA, 12 nt, Western equine encephalomyelitis virus
cacagucauucc

SEQ ID NO: 3353747 - RNA, 20 nt, Western equine encephalomyelitis virus
cucuaauauacacuacacau

SEQ ID NO: 3353748 - RNA, 20 nt, Western equine encephalomyelitis virus
ccaccaguuuacccuacaaa

SEQ ID NO: 3353749 - RNA, 14 nt, Western equine encephalomyelitis virus
uaaaaguucacaca

SEQ ID NO: 3353750 - RNA, 13 nt, Western equine encephalomyelitis virus
cacuugaaggaga

SEQ ID NO: 3353751 - RNA, 14 nt, Western equine encephalomyelitis virus
aacgcaagccuaaa

SEQ ID NO: 3353752 - RNA, 15 nt, Western equine encephalomyelitis virus
cccucgagugcaagg

SEQ ID NO: 3353753 - RNA, 17 nt, Western equine encephalomyelitis virus
ggcugcacuaaagcaaa

SEQ ID NO: 3353754 - RNA, 15 nt, Western equine encephalomyelitis virus
caugaaccagucaga

SEQ ID NO: 3353755 - RNA, 17 nt, Western equine encephalomyelitis virus
gacauagcgguaaaacu

SEQ ID NO: 3353756 - RNA, 14 nt, Western equine encephalomyelitis virus
cacuauacacacuu

SEQ ID NO: 3353757 - RNA, 19 nt, Western equine encephalomyelitis virus
cagucuacacugucauugu

SEQ ID NO: 3353758 - RNA, 16 nt, Western equine encephalomyelitis virus
agacaguauggagaaa

SEQ ID NO: 3353759 - RNA, 21 nt, Western equine encephalomyelitis virus
caccagcgacaaaccaccggg

SEQ ID NO: 3353760 - RNA, 19 nt, Western equine encephalomyelitis virus
cgcacuaaaaguucacaca

SEQ ID NO: 3353761 - RNA, 12 nt, Western equine encephalomyelitis virus
ucgaaugucacg

SEQ ID NO: 3353762 - RNA, 12 nt, Western equine encephalomyelitis virus
agaaccacauaa

SEQ ID NO: 3353763 - RNA, 18 nt, Western equine encephalomyelitis virus
gaggaagcguggugcaua

SEQ ID NO: 3353764 - RNA, 23 nt, Western equine encephalomyelitis virus
uggagaaaaagaucaggaggaag

SEQ ID NO: 3353765 - RNA, 14 nt, Western equine encephalomyelitis virus
aaacaucuuggaac

SEQ ID NO: 3353766 - RNA, 18 nt, Western equine encephalomyelitis virus
ggcaccaggcgacccaca

SEQ ID NO: 3353767 - RNA, 18 nt, Western equine encephalomyelitis virus
auguauuuccgaggaagc

SEQ ID NO: 3353768 - RNA, 21 nt, Western equine encephalomyelitis virus
gauguauuuccgaggaagcac

SEQ ID NO: 3353769 - RNA, 15 nt, Western equine encephalomyelitis virus
aucagcagcuugcau

SEQ ID NO: 3353770 - RNA, 20 nt, Western equine encephalomyelitis virus
agcaagaagagacugccuga

SEQ ID NO: 3353771 - RNA, 14 nt, Western equine encephalomyelitis virus
ugcaccgaacgcaa

SEQ ID NO: 3353772 - RNA, 13 nt, Western equine encephalomyelitis virus
aguccaccugcaa

SEQ ID NO: 3353773 - RNA, 12 nt, Western equine encephalomyelitis virus
aguucacacagc

SEQ ID NO: 3353774 - RNA, 21 nt, Western equine encephalomyelitis virus
acggcgcaguccaguaugaga

SEQ ID NO: 3353775 - RNA, 18 nt, Western equine encephalomyelitis virus
acaacagaggcagaguug

SEQ ID NO: 3353776 - RNA, 11 nt, Western equine encephalomyelitis virus
ccuaaaccagg

SEQ ID NO: 3353777 - RNA, 15 nt, Western equine encephalomyelitis virus
auagcgguaaaacuc

SEQ ID NO: 3353778 - RNA, 16 nt, Western equine encephalomyelitis virus
uucugucaagaacauc

SEQ ID NO: 3353779 - RNA, 16 nt, Western equine encephalomyelitis virus
aagaugaacggcugca

SEQ ID NO: 3353780 - RNA, 19 nt, Western equine encephalomyelitis virus
caguggucacuuggaacca

SEQ ID NO: 3353781 - RNA, 15 nt, Western equine encephalomyelitis virus
uucugucaagaacau

SEQ ID NO: 3353782 - RNA, 23 nt, Western equine encephalomyelitis virus
ccugcguugucggaggaaggcug

SEQ ID NO: 3353783 - RNA, 19 nt, Western equine encephalomyelitis virus
agguccaccgccaaagaag

SEQ ID NO: 3353784 - RNA, 15 nt, Western equine encephalomyelitis virus
uauacggcaacacca

SEQ ID NO: 3353785 - RNA, 21 nt, Western equine encephalomyelitis virus
guucccaugcgacaaaccacc

SEQ ID NO: 3353786 - RNA, 15 nt, Western equine encephalomyelitis virus
ccuacucagccuaaa

SEQ ID NO: 3353787 - RNA, 19 nt, Western equine encephalomyelitis virus
cagguccaccgccaaagaa

SEQ ID NO: 3353788 - RNA, 18 nt, Western equine encephalomyelitis virus
agggucuacauccaggaa

SEQ ID NO: 3353789 - RNA, 18 nt, Western equine encephalomyelitis virus
acgcugcuggagaacguc

SEQ ID NO: 3353790 - RNA, 21 nt, Western equine encephalomyelitis virus
acucagccuaaaaagaagaag

SEQ ID NO: 3353791 - RNA, 23 nt, Western equine encephalomyelitis virus
cugacagggagggacauugucca

SEQ ID NO: 3353792 - RNA, 11 nt, Western equine encephalomyelitis virus
cgccgccaggu

SEQ ID NO: 3353793 - RNA, 20 nt, Western equine encephalomyelitis virus
agcagacgcaacagcagaau

SEQ ID NO: 3353794 - RNA, 15 nt, Western equine encephalomyelitis virus
acauuuuagcacauc

SEQ ID NO: 3353795 - RNA, 13 nt, Western equine encephalomyelitis virus
cuugaaaugucca

SEQ ID NO: 3353796 - RNA, 15 nt, Western equine encephalomyelitis virus
gcugcugaagccuuc

SEQ ID NO: 3353797 - RNA, 18 nt, Western equine encephalomyelitis virus
uaccgaugacuucacacu

SEQ ID NO: 3353798 - RNA, 18 nt, Western equine encephalomyelitis virus
agaugaacggcugcacua

SEQ ID NO: 3353799 - RNA, 16 nt, Western equine encephalomyelitis virus
gcuguuuugaaggaag

SEQ ID NO: 3353800 - RNA, 11 nt, Western equine encephalomyelitis virus
uuggagaacca

SEQ ID NO: 3353801 - RNA, 23 nt, Western equine encephalomyelitis virus
uaaaccaccggccgaccacauaa

SEQ ID NO: 3353802 - RNA, 13 nt, Western equine encephalomyelitis virus
cccugaguaugga

SEQ ID NO: 3353803 - RNA, 15 nt, Western equine encephalomyelitis virus
cgauguauuuccgag

SEQ ID NO: 3353804 - RNA, 21 nt, Western equine encephalomyelitis virus
agccuaaaccagggaaacgac

SEQ ID NO: 3353805 - RNA, 13 nt, Western equine encephalomyelitis virus
aaguucacacagc

SEQ ID NO: 3353806 - RNA, 18 nt, Western equine encephalomyelitis virus
gaaggagacgucugccgg

SEQ ID NO: 3353807 - RNA, 18 nt, Western equine encephalomyelitis virus
cagcuguuuugaaggaag

SEQ ID NO: 3353808 - RNA, 17 nt, Western equine encephalomyelitis virus
gcugaauguaaaccacc

SEQ ID NO: 3353809 - RNA, 13 nt, Western equine encephalomyelitis virus
caucagaaagggg

SEQ ID NO: 3353810 - RNA, 11 nt, Western equine encephalomyelitis virus
ccgaggaagca

SEQ ID NO: 3353811 - RNA, 18 nt, Western equine encephalomyelitis virus
acagucauuccuucacca

SEQ ID NO: 3353812 - RNA, 12 nt, Western equine encephalomyelitis virus
cacuacacauau

SEQ ID NO: 3353813 - RNA, 14 nt, Western equine encephalomyelitis virus
gaucacgcagucgc

SEQ ID NO: 3353814 - RNA, 17 nt, Western equine encephalomyelitis virus
acgccagaacgaacacu

SEQ ID NO: 3353815 - RNA, 23 nt, Western equine encephalomyelitis virus
aacgagaaaauuggggcugcgag

SEQ ID NO: 3353816 - RNA, 14 nt, Western equine encephalomyelitis virus
uccgcuugacaccg

SEQ ID NO: 3353817 - RNA, 21 nt, Western equine encephalomyelitis virus
gaagccuucugucaagaacau

SEQ ID NO: 3353818 - RNA, 18 nt, Western equine encephalomyelitis virus
uauggagcuaugaaacca

SEQ ID NO: 3353819 - RNA, 20 nt, Western equine encephalomyelitis virus
acugagcgcggacacugaca

SEQ ID NO: 3353820 - RNA, 21 nt, Western equine encephalomyelitis virus
cccgugugcuauucacugacg

SEQ ID NO: 3353821 - RNA, 20 nt, Western equine encephalomyelitis virus
agguucugaaccguggucac

SEQ ID NO: 3353822 - RNA, 21 nt, Western equine encephalomyelitis virus
agcucaauguccuccagguga

SEQ ID NO: 3353823 - RNA, 15 nt, Western equine encephalomyelitis virus
agcaaaacagugcau

SEQ ID NO: 3353824 - RNA, 17 nt, Western equine encephalomyelitis virus
gcacugcggaugucacc

SEQ ID NO: 3353825 - RNA, 23 nt, Western equine encephalomyelitis virus
gugaccugcaaauuccacacagu

SEQ ID NO: 3353826 - RNA, 18 nt, Western equine encephalomyelitis virus
aaggcugaugaaaccacu

SEQ ID NO: 3353827 - RNA, 22 nt, Western equine encephalomyelitis virus
accaccuucuggcaagaacguc

SEQ ID NO: 3353828 - RNA, 14 nt, Western equine encephalomyelitis virus
auuaggcacacaga

SEQ ID NO: 3353829 - RNA, 22 nt, Western equine encephalomyelitis virus
accaugaaccagucagagucug

SEQ ID NO: 3353830 - RNA, 21 nt, Western equine encephalomyelitis virus
caaugcugaauguaaaccacc

SEQ ID NO: 3353831 - RNA, 15 nt, Western equine encephalomyelitis virus
acuuccgaggaagcg

SEQ ID NO: 3353832 - RNA, 17 nt, Western equine encephalomyelitis virus
auauuaacaacacuaua

SEQ ID NO: 3353833 - RNA, 18 nt, Western equine encephalomyelitis virus
auuacaguacaaagcuga

SEQ ID NO: 3353834 - RNA, 17 nt, Western equine encephalomyelitis virus
ccugcaagaaacagcac

SEQ ID NO: 3353835 - RNA, 15 nt, Western equine encephalomyelitis virus
agccuaaaccaggga

SEQ ID NO: 3353836 - RNA, 21 nt, Western equine encephalomyelitis virus
uccucaaaggcggauuacaca

SEQ ID NO: 3353837 - RNA, 22 nt, Western equine encephalomyelitis virus
ugaagccuucugucaagaacau

SEQ ID NO: 3353838 - RNA, 23 nt, Western equine encephalomyelitis virus
cauauuuuacuuaaaaacacuau

SEQ ID NO: 3353839 - RNA, 17 nt, Western equine encephalomyelitis virus
agccuaaaaagaagaag

SEQ ID NO: 3353840 - RNA, 13 nt, Western equine encephalomyelitis virus
aaguccaccugca

SEQ ID NO: 3353841 - RNA, 22 nt, Western equine encephalomyelitis virus
aagaugaacggcugcacuaaag

SEQ ID NO: 3353842 - RNA, 18 nt, Western equine encephalomyelitis virus
cacuacauuuuagcacau

SEQ ID NO: 3353843 - RNA, 14 nt, Western equine encephalomyelitis virus
agcgucuaacugug

SEQ ID NO: 3353844 - RNA, 18 nt, Western equine encephalomyelitis virus
agcuguuuugaaggaagc

SEQ ID NO: 3353845 - RNA, 19 nt, Western equine encephalomyelitis virus
cacagugcauaaugcugug

SEQ ID NO: 3353846 - RNA, 12 nt, Western equine encephalomyelitis virus
ccaagaauucca

SEQ ID NO: 3353847 - RNA, 14 nt, Western equine encephalomyelitis virus
ggcagcauaacacu

SEQ ID NO: 3353848 - RNA, 20 nt, Western equine encephalomyelitis virus
ccgaggaagcguggugcaua

SEQ ID NO: 3353849 - RNA, 15 nt, Western equine encephalomyelitis virus
guggucacuuggaac

SEQ ID NO: 3353850 - RNA, 15 nt, Western equine encephalomyelitis virus
ugcacauuccauucc

SEQ ID NO: 3353851 - RNA, 17 nt, Western equine encephalomyelitis virus
gaaauguggaagaacaa

SEQ ID NO: 3353852 - RNA, 21 nt, Western equine encephalomyelitis virus
ccuggauacguuugucaaugg

SEQ ID NO: 3353853 - RNA, 22 nt, Western equine encephalomyelitis virus
auaaguccuaucuggaggaagc

SEQ ID NO: 3353854 - RNA, 17 nt, Western equine encephalomyelitis virus
ggaggugcaaaugaggg

SEQ ID NO: 3353855 - RNA, 13 nt, Western equine encephalomyelitis virus
cgucacgccaggu

SEQ ID NO: 3353856 - RNA, 22 nt, Human
acgccagacuucccacggcucc

SEQ ID NO: 3353857 - RNA, 16 nt, Human
acgccagacuucccac

SEQ ID NO: 3353858 - RNA, 11 nt, Human
acacugccagc

SEQ ID NO: 3353859 - RNA, 15 nt, Human
acagguuagcugcuc

SEQ ID NO: 3353860 - RNA, 15 nt, Human
accccgacuuuuguu

SEQ ID NO: 3353861 - RNA, 12 nt, Human
accccgacuuuu

SEQ ID NO: 3353862 - RNA, 14 nt, Human
agacgggcccuggu

SEQ ID NO: 3353863 - RNA, 16 nt, Human
agaggguguccugcac

SEQ ID NO: 3353864 - RNA, 23 nt, Human
aggugcuucuaguucugccagga

SEQ ID NO: 3353865 - RNA, 22 nt, Human
aggugcuucuaguucugccagg

SEQ ID NO: 3353866 - RNA, 21 nt, Human
aggugcuucuaguucugccag

SEQ ID NO: 3353867 - RNA, 15 nt, Human
cuuccucuccugucu

SEQ ID NO: 3353868 - RNA, 16 nt, Human
gagacgggcccuggug

SEQ ID NO: 3353869 - RNA, 20 nt, Human
gacccucaucuuucuuccaa

SEQ ID NO: 3353870 - RNA, 21 nt, Human
gcauccagagucccugccugg

SEQ ID NO: 3353871 - RNA, 23 nt, Human
gcauccagagucccugccuggac

SEQ ID NO: 3353872 - RNA, 22 nt, Human
gcauccagagucccugccugga

SEQ ID NO: 3353873 - RNA, 17 nt, Human
gcaucggggagccggga

SEQ ID NO: 3353874 - RNA, 19 nt, Human
gaucccaacacugccagca

SEQ ID NO: 3353875 - RNA, 18 nt, Human
gaucccaacacugccagc

SEQ ID NO: 3353876 - RNA, 17 nt, Human
gaucccaacacugccag

SEQ ID NO: 3353877 - RNA, 16 nt, Human
gaucccaacacugcca

SEQ ID NO: 3353878 - RNA, 23 nt, Human
ggcaucggggagccgggagccug

SEQ ID NO: 3353879 - RNA, 22 nt, Human
ggcaucggggagccgggagccu

SEQ ID NO: 3353880 - RNA, 16 nt, Human
ggcauccagagucccu

SEQ ID NO: 3353881 - RNA, 14 nt, Human
ggcaggagggaggu

SEQ ID NO: 3353882 - RNA, 12 nt, Human
ggcaggggccgg

SEQ ID NO: 3353883 - RNA, 14 nt, Human
ggagggggagaggg

SEQ ID NO: 3353884 - RNA, 22 nt, Human
gggggcagucugagagaggcca

SEQ ID NO: 3353885 - RNA, 21 nt, Human
ggguguccugcaccggggccu

SEQ ID NO: 3353886 - RNA, 17 nt, Human
ggguguccugcaccggg

SEQ ID NO: 3353887 - RNA, 22 nt, Human
gguggggggggggcgcggcugg

SEQ ID NO: 3353888 - RNA, 18 nt, Human
gcuaggguggggagagac

SEQ ID NO: 3353889 - RNA, 17 nt, Human
gcuaggguggggagaga

SEQ ID NO: 3353890 - RNA, 19 nt, Human
gcucagaggguguccugca

SEQ ID NO: 3353891 - RNA, 18 nt, Human
gcucagaggguguccugc

SEQ ID NO: 3353892 - RNA, 21 nt, Human
gcguggaacucgugucuggca

SEQ ID NO: 3353893 - RNA, 12 nt, Human
gccauucuuucc

SEQ ID NO: 3353894 - RNA, 19 nt, Human
gccauucuuucccaacacc

SEQ ID NO: 3353895 - RNA, 16 nt, Human
ggacaccuaggcuagg

SEQ ID NO: 3353896 - RNA, 16 nt, Human
ggacaccccgacuuuu

SEQ ID NO: 3353897 - RNA, 17 nt, Human
cagaggguguccugcac

SEQ ID NO: 3353898 - RNA, 13 nt, Human
cacuggggcaggg

SEQ ID NO: 3353899 - RNA, 15 nt, Human
cacuggggcaggggc

SEQ ID NO: 3353900 - RNA, 18 nt, Human
caacaccucuuggggagu

SEQ ID NO: 3353901 - RNA, 15 nt, Human
cucgugucuggcaca

SEQ ID NO: 3353902 - RNA, 14 nt, Human
cucaugugacucuu

SEQ ID NO: 3353903 - RNA, 18 nt, Human
cucaugugacucuuucca

SEQ ID NO: 3353904 - RNA, 13 nt, Human
cugagagaggcca

SEQ ID NO: 3353905 - RNA, 22 nt, Human
cugagagaggccauucuuuccc

SEQ ID NO: 3353906 - RNA, 21 nt, Human
cugagagaggccauucuuucc

SEQ ID NO: 3353907 - RNA, 14 nt, Human
cugagagaggccau

SEQ ID NO: 3353908 - RNA, 15 nt, Human
guccaucagccucca

SEQ ID NO: 3353909 - RNA, 22 nt, Human
gucccgggacaccuaggcuagg

SEQ ID NO: 3353910 - RNA, 16 nt, Human
acaccucuuggggagu

SEQ ID NO: 3353911 - RNA, 18 nt, Human
uccugcaccggggccugg

SEQ ID NO: 3353912 - RNA, 19 nt, Human
ucaugugacucuuuccaac

SEQ ID NO: 3353913 - RNA, 18 nt, Human
ucaugugacucuuuccaa

SEQ ID NO: 3353914 - RNA, 17 nt, Human
ucaugugacucuuucca

SEQ ID NO: 3353915 - RNA, 14 nt, Human
ucaugugacucuuu

SEQ ID NO: 3353916 - RNA, 17 nt, Human
accuaggcuaggguggg

SEQ ID NO: 3353917 - RNA, 12 nt, Human
accuaggcuagg

SEQ ID NO: 3353918 - RNA, 13 nt, Human
accgaggcaggga

SEQ ID NO: 3353919 - RNA, 14 nt, Human
ucuaguucugccag

SEQ ID NO: 3353920 - RNA, 17 nt, Human
ucuaguucugccaggag

SEQ ID NO: 3353921 - RNA, 16 nt, Human
ucuaguucugccagga

SEQ ID NO: 3353922 - RNA, 15 nt, Human
ucuaguucugccagg

SEQ ID NO: 3353923 - RNA, 13 nt, Human
ugagagaggccau

SEQ ID NO: 3353924 - RNA, 16 nt, Human
uuuuguuuaccagaga

SEQ ID NO: 3353925 - RNA, 20 nt, Human
auuucccuuccuuccucucc

SEQ ID NO: 3353926 - RNA, 16 nt, Human
aucggggagccgggag

SEQ ID NO: 3353927 - RNA, 18 nt, Human
aucggggagccgggagcc

SEQ ID NO: 3353928 - RNA, 20 nt, Human
uugucacgccagacuuccca

SEQ ID NO: 3353929 - RNA, 13 nt, Human
uugucacgccaga

SEQ ID NO: 3353930 - RNA, 22 nt, Human
uuguccucagccccgcguggaa

SEQ ID NO: 3353931 - RNA, 19 nt, Human
aggccauucuuucccaaca

SEQ ID NO: 3353932 - RNA, 18 nt, Human
aggccauucuuucccaac

SEQ ID NO: 3353933 - RNA, 17 nt, Human
aggccauucuuucccaa

SEQ ID NO: 3353934 - RNA, 15 nt, Human
aggccauucuuuccc

SEQ ID NO: 3353935 - RNA, 13 nt, Human
ugcuccccacguc

SEQ ID NO: 3353936 - RNA, 22 nt, Human
uggaccagccucuccacucaug

SEQ ID NO: 3353937 - RNA, 16 nt, Human
uggaccagccucucca

SEQ ID NO: 3353938 - RNA, 14 nt, Human
aguccaucagccuc

SEQ ID NO: 3353939 - RNA, 13 nt, Human
aguccaucagccu

SEQ ID NO: 3353940 - RNA, 12 nt, Human
caacacugccag

SEQ ID NO: 3353941 - RNA, 14 nt, Human
caacacugccagca

SEQ ID NO: 3353942 - RNA, 13 nt, Human
caacacugccagc

SEQ ID NO: 3353943 - RNA, 22 nt, Human
caaccggcuuuguggcacuggg

SEQ ID NO: 3353944 - RNA, 13 nt, Human
caaccggcuuugu

SEQ ID NO: 3353945 - RNA, 23 nt, Human
caggagacagguuagcugcuccc

SEQ ID NO: 3353946 - RNA, 21 nt, Human
caggcaucggggagccgggag

SEQ ID NO: 3353947 - RNA, 20 nt, Human
caggcaucggggagccggga

SEQ ID NO: 3353948 - RNA, 18 nt, Human
cagggaaggaucccauga

SEQ ID NO: 3353949 - RNA, 13 nt, Human
cagggaaggaucc

SEQ ID NO: 3353950 - RNA, 11 nt, Human
caggcucagag

SEQ ID NO: 3353951 - RNA, 15 nt, Human
caggcucagagggug

SEQ ID NO: 3353952 - RNA, 23 nt, Human
cagccucuccacucaugugacuc

SEQ ID NO: 3353953 - RNA, 23 nt, Human
cagccuggcuguggccuaaccug

SEQ ID NO: 3353954 - RNA, 21 nt, Human
cagccuccauccuacccccug

SEQ ID NO: 3353955 - RNA, 18 nt, Human
cagccuccauccuacccc

SEQ ID NO: 3353956 - RNA, 18 nt, Human
caggaaccgaggcaggga

SEQ ID NO: 3353957 - RNA, 17 nt, Human
caggaaccgaggcaggg

SEQ ID NO: 3353958 - RNA, 15 nt, Human
caggaaccgaggcag

SEQ ID NO: 3353959 - RNA, 15 nt, Human
cagcauuucccuucc

SEQ ID NO: 3353960 - RNA, 18 nt, Human
cagagucccugccuggac

SEQ ID NO: 3353961 - RNA, 14 nt, Human
cagagucccugccu

SEQ ID NO: 3353962 - RNA, 12 nt, Human
cagagaaaaagg

SEQ ID NO: 3353963 - RNA, 18 nt, Human
cagagaaaaagggagggg

SEQ ID NO: 3353964 - RNA, 17 nt, Human
cagagaaaaagggaggg

SEQ ID NO: 3353965 - RNA, 22 nt, Human
cagacuucccacggcuccucga

SEQ ID NO: 3353966 - RNA, 12 nt, Human
cagacuucccac

SEQ ID NO: 3353967 - RNA, 22 nt, Human
cacucaugugacucuuuccaac

SEQ ID NO: 3353968 - RNA, 16 nt, Human
cacucaugugacucuu

SEQ ID NO: 3353969 - RNA, 22 nt, Human
cacggcuccucgagaucccaac

SEQ ID NO: 3353970 - RNA, 20 nt, Human
cacggcuccucgagauccca

SEQ ID NO: 3353971 - RNA, 22 nt, Human
caccggggccugggcaggaggg

SEQ ID NO: 3353972 - RNA, 21 nt, Human
caccggggccugggcaggagg

SEQ ID NO: 3353973 - RNA, 14 nt, Human
caccggggccuggg

SEQ ID NO: 3353974 - RNA, 19 nt, Human
ggagacagguuagcugcuc

SEQ ID NO: 3353975 - RNA, 12 nt, Human
ggaccagccucu

SEQ ID NO: 3353976 - RNA, 14 nt, Human
ggagggcaggcauc

SEQ ID NO: 3353977 - RNA, 21 nt, Human
ggagcucaggaaccgaggcag

SEQ ID NO: 3353978 - RNA, 14 nt, Human
gggacaccuaggcu

SEQ ID NO: 3353979 - RNA, 16 nt, Human
gggaggagggcaggca

SEQ ID NO: 3353980 - RNA, 12 nt, Human
gggaggagggca

SEQ ID NO: 3353981 - RNA, 23 nt, Human
gggagcucaggaaccgaggcagg

SEQ ID NO: 3353982 - RNA, 22 nt, Human
gggagcucaggaaccgaggcag

SEQ ID NO: 3353983 - RNA, 12 nt, Human
gggagcucagga

SEQ ID NO: 3353984 - RNA, 13 nt, Human
gggagccgggagc

SEQ ID NO: 3353985 - RNA, 23 nt, Human
ggcuguggcauccagagucccug

SEQ ID NO: 3353986 - RNA, 21 nt, Human
ggcuguggcauccagaguccc

SEQ ID NO: 3353987 - RNA, 13 nt, Human
ggcugggaggagg

SEQ ID NO: 3353988 - RNA, 21 nt, Human
ggcugggaggagggcaggcau

SEQ ID NO: 3353989 - RNA, 20 nt, Human
ggcugggaggagggcaggca

SEQ ID NO: 3353990 - RNA, 19 nt, Human
ggccugggcaggagggagg

SEQ ID NO: 3353991 - RNA, 17 nt, Human
ggccugggcaggaggga

SEQ ID NO: 3353992 - RNA, 15 nt, Human
ggccugggcaggagg

SEQ ID NO: 3353993 - RNA, 16 nt, Human
ggccuaaccugccgag

SEQ ID NO: 3353994 - RNA, 15 nt, Human
ggccuaaccugccga

SEQ ID NO: 3353995 - RNA, 16 nt, Human
gccuggaccagccucu

SEQ ID NO: 3353996 - RNA, 17 nt, Human
gccuggaccagccucuc

SEQ ID NO: 3353997 - RNA, 16 nt, Human
gccugggcaggaggga

SEQ ID NO: 3353998 - RNA, 17 nt, Human
gccuugucacgccagac

SEQ ID NO: 3353999 - RNA, 16 nt, Human
gccuugucacgccaga

SEQ ID NO: 3354000 - RNA, 15 nt, Human
gccuugucacgccag

SEQ ID NO: 3354001 - RNA, 17 nt, Human
gcgaagcguuguccuca

SEQ ID NO: 3354002 - RNA, 21 nt, Human
gcuccuuaaggcucuuuugua

SEQ ID NO: 3354003 - RNA, 17 nt, Human
gcuccuuaaggcucuuu

SEQ ID NO: 3354004 - RNA, 15 nt, Human
gcuccuuaaggcucu

SEQ ID NO: 3354005 - RNA, 19 nt, Human
gcugggaggagggcaggca

SEQ ID NO: 3354006 - RNA, 21 nt, Human
gcugggaggagggcaggcauc

SEQ ID NO: 3354007 - RNA, 20 nt, Human
gcuguggccuaaccugccga

SEQ ID NO: 3354008 - RNA, 19 nt, Human
gcuguggccuaaccugccg

SEQ ID NO: 3354009 - RNA, 22 nt, Human
gcaggcaucggggagccgggag

SEQ ID NO: 3354010 - RNA, 21 nt, Human
gcaggcaucggggagccggga

SEQ ID NO: 3354011 - RNA, 23 nt, Human
gcaggcaucggggagccgggagc

SEQ ID NO: 3354012 - RNA, 16 nt, Human
gccaccugaauaaaga

SEQ ID NO: 3354013 - RNA, 15 nt, Human
gaggagggcaggcau

SEQ ID NO: 3354014 - RNA, 14 nt, Human
gaggagggcaggca

SEQ ID NO: 3354015 - RNA, 13 nt, Human
gaggagggcaggc

SEQ ID NO: 3354016 - RNA, 22 nt, Human
gagcucaggaaccgaggcaggg

SEQ ID NO: 3354017 - RNA, 23 nt, Human
gagcucaggaaccgaggcaggga

SEQ ID NO: 3354018 - RNA, 15 nt, Human
gagucccugccugga

SEQ ID NO: 3354019 - RNA, 14 nt, Human
gagucccugccugg

SEQ ID NO: 3354020 - RNA, 16 nt, Human
gagucccugccuggac

SEQ ID NO: 3354021 - RNA, 20 nt, Human
cucugcccgggagcucagga

SEQ ID NO: 3354022 - RNA, 14 nt, Human
cucugcccgggagc

SEQ ID NO: 3354023 - RNA, 17 nt, Human
cugccuggaccagccuc

SEQ ID NO: 3354024 - RNA, 13 nt, Human
cucgagaucccaa

SEQ ID NO: 3354025 - RNA, 23 nt, Human
cucgagaucccaacacugccagc

SEQ ID NO: 3354026 - RNA, 22 nt, Human
cucgagaucccaacacugccag

SEQ ID NO: 3354027 - RNA, 21 nt, Human
cucgagaucccaacacugcca

SEQ ID NO: 3354028 - RNA, 17 nt, Human
gaauaaagaaugaaugg

SEQ ID NO: 3354029 - RNA, 19 nt, Human
gaaggaucccaugagcucc

SEQ ID NO: 3354030 - RNA, 17 nt, Human
cuuucccaacaccucuu

SEQ ID NO: 3354031 - RNA, 13 nt, Human
cuuucccaacacc

SEQ ID NO: 3354032 - RNA, 19 nt, Human
cuuccaaacaggcucagag

SEQ ID NO: 3354033 - RNA, 15 nt, Human
cuuaaggcucuuuug

SEQ ID NO: 3354034 - RNA, 18 nt, Human
cuguggccuaaccugccg

SEQ ID NO: 3354035 - RNA, 22 nt, Human
cuggugguggcucgggaggcga

SEQ ID NO: 3354036 - RNA, 14 nt, Human
cuggugguggcucg

SEQ ID NO: 3354037 - RNA, 19 nt, Human
ccgggacaccuaggcuagg

SEQ ID NO: 3354038 - RNA, 20 nt, Human
ccgggacaccuaggcuaggg

SEQ ID NO: 3354039 - RNA, 15 nt, Human
ccgaggcagggaagg

SEQ ID NO: 3354040 - RNA, 16 nt, Human
ccuaggcuaggguggg

SEQ ID NO: 3354041 - RNA, 18 nt, Human
ccucuccacucaugugac

SEQ ID NO: 3354042 - RNA, 18 nt, Human
ccuugucacgccagacuu

SEQ ID NO: 3354043 - RNA, 15 nt, Human
ccuugucacgccaga

SEQ ID NO: 3354044 - RNA, 13 nt, Human
ccuuaaggcucuu

SEQ ID NO: 3354045 - RNA, 18 nt, Human
ccuuaaggcucuuuugua

SEQ ID NO: 3354046 - RNA, 16 nt, Human
ccuuaaggcucuuuug

SEQ ID NO: 3354047 - RNA, 22 nt, Human
cgagaucccaacacugccagca

SEQ ID NO: 3354048 - RNA, 13 nt, Human
cgagaucccaaca

SEQ ID NO: 3354049 - RNA, 21 nt, Human
cgagaucccaacacugccagc

SEQ ID NO: 3354050 - RNA, 15 nt, Human
cgagaucccaacacu

SEQ ID NO: 3354051 - RNA, 12 nt, Human
ccugggcaggag

SEQ ID NO: 3354052 - RNA, 14 nt, Human
ccugggcaggaggg

SEQ ID NO: 3354053 - RNA, 17 nt, Human
ccauccuacccccugug

SEQ ID NO: 3354054 - RNA, 18 nt, Human
ccauccuacccccugugc

SEQ ID NO: 3354055 - RNA, 13 nt, Human
ccaggagacaggu

SEQ ID NO: 3354056 - RNA, 21 nt, Human
ccagcauuucccuuccuuccu

SEQ ID NO: 3354057 - RNA, 16 nt, Human
ccagcauuucccuucc

SEQ ID NO: 3354058 - RNA, 20 nt, Human
ccaccugaauaaagaaugaa

SEQ ID NO: 3354059 - RNA, 19 nt, Human
ccacucaugugacucuuuc

SEQ ID NO: 3354060 - RNA, 22 nt, Human
ccacucaugugacucuuuccaa

SEQ ID NO: 3354061 - RNA, 23 nt, Human
caugagcuccuuaaggcucuuuu

SEQ ID NO: 3354062 - RNA, 18 nt, Human
cauccuacccccugugcc

SEQ ID NO: 3354063 - RNA, 15 nt, Human
cauccuacccccugu

SEQ ID NO: 3354064 - RNA, 20 nt, Human
cauccagagucccugccugg

SEQ ID NO: 3354065 - RNA, 18 nt, Human
cauccagagucccugccu

SEQ ID NO: 3354066 - RNA, 17 nt, Human
cauccagagucccugcc

SEQ ID NO: 3354067 - RNA, 13 nt, Human
cauccagaguccc

SEQ ID NO: 3354068 - RNA, 14 nt, Human
caugugacucuuuc

SEQ ID NO: 3354069 - RNA, 17 nt, Human
caugugacucuuuccaa

SEQ ID NO: 3354070 - RNA, 16 nt, Human
caugugacucuuucca

SEQ ID NO: 3354071 - RNA, 12 nt, Human
cauucuuuccca

SEQ ID NO: 3354072 - RNA, 14 nt, Human
cauucuuucccaac

SEQ ID NO: 3354073 - RNA, 19 nt, Human
uuuccaaccggcuuugugg

SEQ ID NO: 3354074 - RNA, 18 nt, Human
ugggaggagggcaggcau

SEQ ID NO: 3354075 - RNA, 17 nt, Human
ugggaggagggcaggca

SEQ ID NO: 3354076 - RNA, 14 nt, Human
ugggaggagggcag

SEQ ID NO: 3354077 - RNA, 23 nt, Human
uggccuaaccugccgagagucca

SEQ ID NO: 3354078 - RNA, 16 nt, Human
uggccuaaccugccga

SEQ ID NO: 3354079 - RNA, 18 nt, Human
uguccugcaccggggccu

SEQ ID NO: 3354080 - RNA, 13 nt, Human
uguccucagcccc

SEQ ID NO: 3354081 - RNA, 21 nt, Human
ugacccucaucuuucuuccaa

SEQ ID NO: 3354082 - RNA, 17 nt, Human
ugcccgggagcucagga

SEQ ID NO: 3354083 - RNA, 18 nt, Human
ugcccgggagcucaggaa

SEQ ID NO: 3354084 - RNA, 18 nt, Human
ugauuuuuaugccaccug

SEQ ID NO: 3354085 - RNA, 21 nt, Human
ucgugucuggcacagccuggc

SEQ ID NO: 3354086 - RNA, 14 nt, Human
ucgugucuggcaca

SEQ ID NO: 3354087 - RNA, 19 nt, Human
ucccuuccuuccucuccug

SEQ ID NO: 3354088 - RNA, 16 nt, Human
ucccuuccuuccucuc

SEQ ID NO: 3354089 - RNA, 13 nt, Human
ucccugccuggac

SEQ ID NO: 3354090 - RNA, 21 nt, Human
ucccgggacaccuaggcuagg

SEQ ID NO: 3354091 - RNA, 16 nt, Human
ucccuccucugcccgg

SEQ ID NO: 3354092 - RNA, 15 nt, Human
ucugccaggagacag

SEQ ID NO: 3354093 - RNA, 19 nt, Human
ucagaggguguccugcacc

SEQ ID NO: 3354094 - RNA, 19 nt, Human
cuuccucuccugucucccu

SEQ ID NO: 3354095 - RNA, 19 nt, Human
cuucuaguucugccaggag

SEQ ID NO: 3354096 - RNA, 16 nt, Human
cuucuaguucugccag

SEQ ID NO: 3354097 - RNA, 18 nt, Human
cuucuaguucugccagga

SEQ ID NO: 3354098 - RNA, 17 nt, Human
cuucuaguucugccagg

SEQ ID NO: 3354099 - RNA, 20 nt, Human
cugugccuugucacgccaga

SEQ ID NO: 3354100 - RNA, 18 nt, Human
gcauuucccuuccuuccu

SEQ ID NO: 3354101 - RNA, 19 nt, Human
gacccucaucuuucuucca

SEQ ID NO: 3354102 - RNA, 15 nt, Human
gacccucaucuuucu

SEQ ID NO: 3354103 - RNA, 15 nt, Human
ggcacuggggcaggg

SEQ ID NO: 3354104 - RNA, 20 nt, Human
ggcucagaggguguccugca

SEQ ID NO: 3354105 - RNA, 22 nt, Human
gggacaccuaggcuaggguggg

SEQ ID NO: 3354106 - RNA, 17 nt, Human
ggggccgggggcagucu

SEQ ID NO: 3354107 - RNA, 18 nt, Human
gggggcgcggcugggagg

SEQ ID NO: 3354108 - RNA, 18 nt, Human
ggguggggagagacgggc

SEQ ID NO: 3354109 - RNA, 14 nt, Human
ggguggggagagac

SEQ ID NO: 3354110 - RNA, 13 nt, Human
ggguggggagaga

SEQ ID NO: 3354111 - RNA, 22 nt, Human
ggugcuucuaguucugccagga

SEQ ID NO: 3354112 - RNA, 21 nt, Human
ggugcuucuaguucugccagg

SEQ ID NO: 3354113 - RNA, 19 nt, Human
gcucaggaaccgaggcagg

SEQ ID NO: 3354114 - RNA, 16 nt, Human
gcucaggaaccgaggc

SEQ ID NO: 3354115 - RNA, 21 nt, Human
gcucaggaaccgaggcaggga

SEQ ID NO: 3354116 - RNA, 20 nt, Human
gcucaggaaccgaggcaggg

SEQ ID NO: 3354117 - RNA, 23 nt, Human
gccuccauccuacccccugugcc

SEQ ID NO: 3354118 - RNA, 17 nt, Human
gcuucuaguucugccag

SEQ ID NO: 3354119 - RNA, 16 nt, Human
gcuucuaguucugcca

SEQ ID NO: 3354120 - RNA, 18 nt, Human
cugacccucaucuuucuu

SEQ ID NO: 3354121 - RNA, 16 nt, Human
cuaguucugccaggag

SEQ ID NO: 3354122 - RNA, 15 nt, Human
cuaguucugccagga

SEQ ID NO: 3354123 - RNA, 14 nt, Human
cuaguucugccagg

SEQ ID NO: 3354124 - RNA, 15 nt, Human
cuaggguggggagag

SEQ ID NO: 3354125 - RNA, 13 nt, Human
cuaguucugccag

SEQ ID NO: 3354126 - RNA, 15 nt, Human
cuaggcuaggguggg

SEQ ID NO: 3354127 - RNA, 12 nt, Human
ccauucuuuccc

SEQ ID NO: 3354128 - RNA, 20 nt, Human
ccauucuuucccaacaccuc

SEQ ID NO: 3354129 - RNA, 14 nt, Human
ccauucuuucccaa

SEQ ID NO: 3354130 - RNA, 18 nt, Human
ccugacccucaucuuucu

SEQ ID NO: 3354131 - RNA, 19 nt, Human
ccugacccucaucuuucuu

SEQ ID NO: 3354132 - RNA, 18 nt, Human
ccuggugguggcucggga

SEQ ID NO: 3354133 - RNA, 21 nt, Human
ccuggugguggcucgggaggc

SEQ ID NO: 3354134 - RNA, 21 nt, Human
ccugucucccuccucugcccg

SEQ ID NO: 3354135 - RNA, 18 nt, Human
cagucugagagaggccau

SEQ ID NO: 3354136 - RNA, 17 nt, Human
cagucugagagaggcca

SEQ ID NO: 3354137 - RNA, 12 nt, Human
acagccuggcug

SEQ ID NO: 3354138 - RNA, 20 nt, Human
acaccuaggcuagggugggg

SEQ ID NO: 3354139 - RNA, 23 nt, Human
acaccuaggcuaggguggggaga

SEQ ID NO: 3354140 - RNA, 14 nt, Human
uaguucugccagga

SEQ ID NO: 3354141 - RNA, 13 nt, Human
uaguucugccagg

SEQ ID NO: 3354142 - RNA, 23 nt, Human
guggggggggggcgcggcuggga

SEQ ID NO: 3354143 - RNA, 18 nt, Human
guggcacuggggcagggg

SEQ ID NO: 3354144 - RNA, 17 nt, Human
guggcacuggggcaggg

SEQ ID NO: 3354145 - RNA, 20 nt, Human
guccugcaccggggccuggg

SEQ ID NO: 3354146 - RNA, 19 nt, Human
guccugcaccggggccugg

SEQ ID NO: 3354147 - RNA, 15 nt, Human
guccugcaccggggc

SEQ ID NO: 3354148 - RNA, 21 nt, Human
uccugcaccggggccugggca

SEQ ID NO: 3354149 - RNA, 19 nt, Human
uccugcaccggggccuggg

SEQ ID NO: 3354150 - RNA, 20 nt, Human
uccugcaccggggccugggc

SEQ ID NO: 3354151 - RNA, 14 nt, Human
acuggggcaggggc

SEQ ID NO: 3354152 - RNA, 23 nt, Human
ucgagaucccaacacugccagca

SEQ ID NO: 3354153 - RNA, 22 nt, Human
ucgagaucccaacacugccagc

SEQ ID NO: 3354154 - RNA, 11 nt, Human
uccucagcccc

SEQ ID NO: 3354155 - RNA, 17 nt, Human
acucaugugacucuuuc

SEQ ID NO: 3354156 - RNA, 16 nt, Human
acucaugugacucuuu

SEQ ID NO: 3354157 - RNA, 15 nt, Human
acucaugugacucuu

SEQ ID NO: 3354158 - RNA, 18 nt, Human
ucaggaaccgaggcaggg

SEQ ID NO: 3354159 - RNA, 17 nt, Human
ucaggaaccgaggcagg

SEQ ID NO: 3354160 - RNA, 16 nt, Human
ucagccccgcguggaa

SEQ ID NO: 3354161 - RNA, 18 nt, Human
accagagaaaaagggagg

SEQ ID NO: 3354162 - RNA, 20 nt, Human
accagagaaaaagggagggg

SEQ ID NO: 3354163 - RNA, 18 nt, Human
accugaauaaagaaugaa

SEQ ID NO: 3354164 - RNA, 16 nt, Human
aguccaucagccucca

SEQ ID NO: 3354165 - RNA, 20 nt, Human
uguagugauuuuuaugccac

SEQ ID NO: 3354166 - RNA, 21 nt, Human
agugauuuuuaugccaccuga

SEQ ID NO: 3354167 - RNA, 20 nt, Human
agugauuuuuaugccaccug

SEQ ID NO: 3354168 - RNA, 16 nt, Human
agugauuuuuaugcca

SEQ ID NO: 3354169 - RNA, 20 nt, Human
uggcuguggccuaaccugcc

SEQ ID NO: 3354170 - RNA, 17 nt, Human
uggcuguggcauccaga

SEQ ID NO: 3354171 - RNA, 20 nt, Human
uggcauccagagucccugcc

SEQ ID NO: 3354172 - RNA, 22 nt, Human
uggcauccagagucccugccug

SEQ ID NO: 3354173 - RNA, 21 nt, Human
uggcauccagagucccugccu

SEQ ID NO: 3354174 - RNA, 14 nt, Human
aggccauucuuucc

SEQ ID NO: 3354175 - RNA, 22 nt, Human
uggcacagccuggcuguggccu

SEQ ID NO: 3354176 - RNA, 20 nt, Human
aggcucagaggguguccugc

SEQ ID NO: 3354177 - RNA, 19 nt, Human
aggcucagaggguguccug

SEQ ID NO: 3354178 - RNA, 18 nt, Human
aggcucagaggguguccu

SEQ ID NO: 3354179 - RNA, 18 nt, Human
aggcgaagcguuguccuc

SEQ ID NO: 3354180 - RNA, 17 nt, Human
ugccuugucacgccaga

SEQ ID NO: 3354181 - RNA, 18 nt, Human
agccugacccucaucuuu

SEQ ID NO: 3354182 - RNA, 19 nt, Human
agccugacccucaucuuuc

SEQ ID NO: 3354183 - RNA, 16 nt, Human
auuucccuuccuuccu

SEQ ID NO: 3354184 - RNA, 13 nt, Human
uucugccaggaga

SEQ ID NO: 3354185 - RNA, 16 nt, Human
auccuacccccugugc

SEQ ID NO: 3354186 - RNA, 14 nt, Human
auccuacccccugu

SEQ ID NO: 3354187 - RNA, 21 nt, Human
augugacucuuuccaaccggc

SEQ ID NO: 3354188 - RNA, 16 nt, Human
augugacucuuuccaa

SEQ ID NO: 3354189 - RNA, 12 nt, Human
augugacucuuu

SEQ ID NO: 3354190 - RNA, 19 nt, Human
augagcuccuuaaggcucu

SEQ ID NO: 3354191 - RNA, 17 nt, Human
aggggccgggggcaguc

SEQ ID NO: 3354192 - RNA, 22 nt, Human
agcuccuuaaggcucuuuugua

SEQ ID NO: 3354193 - RNA, 18 nt, Human
agcuccuuaaggcucuuu

SEQ ID NO: 3354194 - RNA, 17 nt, Human
agcugcuccccacguca

SEQ ID NO: 3354195 - RNA, 14 nt, Human
agcugcuccccacg

SEQ ID NO: 3354196 - RNA, 14 nt, Human
agccgggagccuga

SEQ ID NO: 3354197 - RNA, 13 nt, Human
acccccugugccu

SEQ ID NO: 3354198 - RNA, 12 nt, Human
acugccagcauu

SEQ ID NO: 3354199 - RNA, 23 nt, Human
accugccgagaguccaucagccu

SEQ ID NO: 3354200 - RNA, 16 nt, Human
accugccgagagucca

SEQ ID NO: 3354201 - RNA, 16 nt, Human
caccccgacuuuuguu

SEQ ID NO: 3354202 - RNA, 16 nt, Human
cuccacucaugugacu

SEQ ID NO: 3354203 - RNA, 22 nt, Human
cuccacucaugugacucuuucc

SEQ ID NO: 3354204 - RNA, 20 nt, Human
cuccccacgucagcugggac

SEQ ID NO: 3354205 - RNA, 17 nt, Human
cucaggaaccgaggcag

SEQ ID NO: 3354206 - RNA, 19 nt, Human
cucaggaaccgaggcaggg

SEQ ID NO: 3354207 - RNA, 18 nt, Human
cucaggaaccgaggcagg

SEQ ID NO: 3354208 - RNA, 16 nt, Human
cucagaggguguccug

SEQ ID NO: 3354209 - RNA, 17 nt, Human
cucagccccgcguggaa

SEQ ID NO: 3354210 - RNA, 14 nt, Human
ccugccgagagucc

SEQ ID NO: 3354211 - RNA, 23 nt, Human
ccugccgagaguccaucagccuc

SEQ ID NO: 3354212 - RNA, 22 nt, Human
ccugccgagaguccaucagccu

SEQ ID NO: 3354213 - RNA, 15 nt, Human
ccugcaccggggccu

SEQ ID NO: 3354214 - RNA, 17 nt, Human
ccugcaccggggccugg

SEQ ID NO: 3354215 - RNA, 21 nt, Human
cgaagcguuguccucagcccc

SEQ ID NO: 3354216 - RNA, 17 nt, Human
cgaagcguuguccucag

SEQ ID NO: 3354217 - RNA, 16 nt, Human
cgaagcguuguccuca

SEQ ID NO: 3354218 - RNA, 15 nt, Human
cgaagcguuguccuc

SEQ ID NO: 3354219 - RNA, 19 nt, Human
cgggacaccuaggcuaggg

SEQ ID NO: 3354220 - RNA, 18 nt, Human
cgggacaccuaggcuagg

SEQ ID NO: 3354221 - RNA, 16 nt, Human
cgcggcugggaggagg

SEQ ID NO: 3354222 - RNA, 12 nt, Human
cgcggcugggag

SEQ ID NO: 3354223 - RNA, 11 nt, Human
cgcggcuggga

SEQ ID NO: 3354224 - RNA, 15 nt, Human
cccacggcuccucga

SEQ ID NO: 3354225 - RNA, 15 nt, Human
cccacgucagcuggg

SEQ ID NO: 3354226 - RNA, 14 nt, Human
cccaacacugccag

SEQ ID NO: 3354227 - RNA, 16 nt, Human
cccaacacugccagca

SEQ ID NO: 3354228 - RNA, 15 nt, Human
cccaacacugccagc

SEQ ID NO: 3354229 - RNA, 14 nt, Human
ccccugugccuugu

SEQ ID NO: 3354230 - RNA, 13 nt, Human
cccaugagcuccu

SEQ ID NO: 3354231 - RNA, 22 nt, Human
cccaugagcuccuuaaggcucu

SEQ ID NO: 3354232 - RNA, 15 nt, Human
cccaugagcuccuua

SEQ ID NO: 3354233 - RNA, 14 nt, Human
cccaugagcuccuu

SEQ ID NO: 3354234 - RNA, 19 nt, Human
ccggggccugggcaggagg

SEQ ID NO: 3354235 - RNA, 20 nt, Human
ccggggccugggcaggaggg

SEQ ID NO: 3354236 - RNA, 21 nt, Human
ccgggggcagucugagagagg

SEQ ID NO: 3354237 - RNA, 21 nt, Human
ccgagaguccaucagccucca

SEQ ID NO: 3354238 - RNA, 20 nt, Human
ccgagaguccaucagccucc

SEQ ID NO: 3354239 - RNA, 13 nt, Human
ccuaaccugccga

SEQ ID NO: 3354240 - RNA, 12 nt, Human
ccuaaccugccg

SEQ ID NO: 3354241 - RNA, 23 nt, Human
ccguggcuguggcauccagaguc

SEQ ID NO: 3354242 - RNA, 18 nt, Human
cuggaccagccucuccac

SEQ ID NO: 3354243 - RNA, 14 nt, Human
cuggaccagccucu

SEQ ID NO: 3354244 - RNA, 22 nt, Human
cugccgagaguccaucagccuc

SEQ ID NO: 3354245 - RNA, 23 nt, Human
cugccgagaguccaucagccucc

SEQ ID NO: 3354246 - RNA, 21 nt, Human
cugucucccuccucugcccgg

SEQ ID NO: 3354247 - RNA, 14 nt, Human
cuuuguggcacugg

SEQ ID NO: 3354248 - RNA, 22 nt, Human
cuuucuuccaaacaggcucaga

SEQ ID NO: 3354249 - RNA, 13 nt, Human
cuugucacgccag

SEQ ID NO: 3354250 - RNA, 16 nt, Human
cuugucacgccagacu

SEQ ID NO: 3354251 - RNA, 23 nt, Human
gcacuggggcaggggccgggggc

SEQ ID NO: 3354252 - RNA, 18 nt, Human
gcacuggggcaggggccg

SEQ ID NO: 3354253 - RNA, 15 nt, Human
gcacuggggcagggg

SEQ ID NO: 3354254 - RNA, 20 nt, Human
gaggcgaagcguuguccuca

SEQ ID NO: 3354255 - RNA, 21 nt, Human
gaggcgaagcguuguccucag

SEQ ID NO: 3354256 - RNA, 14 nt, Human
gaggcagggaagga

SEQ ID NO: 3354257 - RNA, 13 nt, Human
gaggguguccugc

SEQ ID NO: 3354258 - RNA, 14 nt, Human
gagggggagagggc

SEQ ID NO: 3354259 - RNA, 19 nt, Human
gagucccugccuggaccag

SEQ ID NO: 3354260 - RNA, 23 nt, Human
gagucccugccuggaccagccuc

SEQ ID NO: 3354261 - RNA, 21 nt, Human
gagucccugccuggaccagcc

SEQ ID NO: 3354262 - RNA, 14 nt, Human
gaccagccucucca

SEQ ID NO: 3354263 - RNA, 13 nt, Human
gagagacgggccc

SEQ ID NO: 3354264 - RNA, 20 nt, Human
gagaucccaacacugccagc

SEQ ID NO: 3354265 - RNA, 19 nt, Human
gagaucccaacacugccag

SEQ ID NO: 3354266 - RNA, 18 nt, Human
gagaucccaacacugcca

SEQ ID NO: 3354267 - RNA, 23 nt, Human
gcccuggugguggcucgggaggc

SEQ ID NO: 3354268 - RNA, 21 nt, Human
gcucagaggguguccugcacc

SEQ ID NO: 3354269 - RNA, 16 nt, Human
ggcuaggguggggaga

SEQ ID NO: 3354270 - RNA, 13 nt, Human
ggccugggcagga

SEQ ID NO: 3354271 - RNA, 14 nt, Human
ggccugggcaggag

SEQ ID NO: 3354272 - RNA, 16 nt, Human
ggcgcggcugggagga

SEQ ID NO: 3354273 - RNA, 22 nt, Human
ggccuaaccugccgagagucca

SEQ ID NO: 3354274 - RNA, 21 nt, Human
ggccuaaccugccgagagucc

SEQ ID NO: 3354275 - RNA, 20 nt, Human
ggccauucuuucccaacacc

SEQ ID NO: 3354276 - RNA, 22 nt, Human
ggaaggaucccaugagcuccuu

SEQ ID NO: 3354277 - RNA, 14 nt, Human
gcuuuguggcacug

SEQ ID NO: 3354278 - RNA, 22 nt, Human
gcuuuguggcacuggggcaggg

SEQ ID NO: 3354279 - RNA, 18 nt, Human
ggggaguuuagggugggg

SEQ ID NO: 3354280 - RNA, 14 nt, Human
gggcgcggcuggga

SEQ ID NO: 3354281 - RNA, 14 nt, Human
gucacgccagacuu

SEQ ID NO: 3354282 - RNA, 23 nt, Human
gucccugccuggaccagccucuc

SEQ ID NO: 3354283 - RNA, 22 nt, Human
gucccugccuggaccagccucu

SEQ ID NO: 3354284 - RNA, 14 nt, Human
gucccugccuggac

SEQ ID NO: 3354285 - RNA, 21 nt, Human
gucccugccuggaccagccuc

SEQ ID NO: 3354286 - RNA, 20 nt, Human
gucccugccuggaccagccu

SEQ ID NO: 3354287 - RNA, 12 nt, Human
guccucagcccc

SEQ ID NO: 3354288 - RNA, 16 nt, Human
gugauuuuuaugccac

SEQ ID NO: 3354289 - RNA, 20 nt, Human
gugauuuuuaugccaccuga

SEQ ID NO: 3354290 - RNA, 19 nt, Human
gugauuuuuaugccaccug

SEQ ID NO: 3354291 - RNA, 17 nt, Human
gugauuuuuaugccacc

SEQ ID NO: 3354292 - RNA, 12 nt, Human
gugacucuuucc

SEQ ID NO: 3354293 - RNA, 19 nt, Human
gugccuugucacgccagac

SEQ ID NO: 3354294 - RNA, 20 nt, Human
gugcuucuaguucugccagg

SEQ ID NO: 3354295 - RNA, 22 nt, Human
gugcuucuaguucugccaggag

SEQ ID NO: 3354296 - RNA, 21 nt, Human
gugcuucuaguucugccagga

SEQ ID NO: 3354297 - RNA, 14 nt, Human
guggcauccagagu

SEQ ID NO: 3354298 - RNA, 18 nt, Human
guggcucgggaggcgaag

SEQ ID NO: 3354299 - RNA, 16 nt, Human
guggcucgggaggcga

SEQ ID NO: 3354300 - RNA, 15 nt, Human
uggaccagccucucc

SEQ ID NO: 3354301 - RNA, 20 nt, Human
uggggaguuuaggguggggg

SEQ ID NO: 3354302 - RNA, 18 nt, Human
ugggcaggagggaggugc

SEQ ID NO: 3354303 - RNA, 16 nt, Human
ugggcaggagggaggu

SEQ ID NO: 3354304 - RNA, 15 nt, Human
ugggcaggagggagg

SEQ ID NO: 3354305 - RNA, 13 nt, Human
ugggcaggaggga

SEQ ID NO: 3354306 - RNA, 21 nt, Human
ugagcuccuuaaggcucuuuu

SEQ ID NO: 3354307 - RNA, 19 nt, Human
ugagcuccuuaaggcucuu

SEQ ID NO: 3354308 - RNA, 18 nt, Human
uccagagucccugccugg

SEQ ID NO: 3354309 - RNA, 15 nt, Human
uccagagucccugcc

SEQ ID NO: 3354310 - RNA, 21 nt, Human
uccagagucccugccuggacc

SEQ ID NO: 3354311 - RNA, 20 nt, Human
uccagagucccugccuggac

SEQ ID NO: 3354312 - RNA, 19 nt, Human
uccagagucccugccugga

SEQ ID NO: 3354313 - RNA, 14 nt, Human
uccaaacaggcuca

SEQ ID NO: 3354314 - RNA, 23 nt, Human
uccugucucccuccucugcccgg

SEQ ID NO: 3354315 - RNA, 15 nt, Human
uccugucucccuccu

SEQ ID NO: 3354316 - RNA, 17 nt, Human
uccuacccccugugccu

SEQ ID NO: 3354317 - RNA, 16 nt, Human
uccuacccccugugcc

SEQ ID NO: 3354318 - RNA, 15 nt, Human
uccuacccccugugc

SEQ ID NO: 3354319 - RNA, 13 nt, Human
uccuacccccugu

SEQ ID NO: 3354320 - RNA, 16 nt, Human
uaggcuagggugggga

SEQ ID NO: 3354321 - RNA, 15 nt, Human
uaggcuagggugggg

SEQ ID NO: 3354322 - RNA, 16 nt, Human
uuaugccaccugaaua

SEQ ID NO: 3354323 - RNA, 13 nt, Human
uuaugccaccuga

SEQ ID NO: 3354324 - RNA, 14 nt, Human
uuuaugccaccuga

SEQ ID NO: 3354325 - RNA, 19 nt, Human
auccagagucccugccugg

SEQ ID NO: 3354326 - RNA, 21 nt, Human
auccagagucccugccuggac

SEQ ID NO: 3354327 - RNA, 20 nt, Human
auccagagucccugccugga

SEQ ID NO: 3354328 - RNA, 16 nt, Human
agucugagagaggcca

SEQ ID NO: 3354329 - RNA, 23 nt, Human
agucugagagaggccauucuuuc

SEQ ID NO: 3354330 - RNA, 16 nt, Human
aggaaccgaggcaggg

SEQ ID NO: 3354331 - RNA, 17 nt, Human
agcuccuuaaggcucuu

SEQ ID NO: 3354332 - RNA, 16 nt, Human
agcuccuuaaggcucu

SEQ ID NO: 3354333 - RNA, 23 nt, Human
agagaggccauucuuucccaaca

SEQ ID NO: 3354334 - RNA, 10 nt, Human
agagggcugc

SEQ ID NO: 3354335 - RNA, 13 nt, Human
aagggagggggag

SEQ ID NO: 3354336 - RNA, 19 nt, Human
accggggccugggcaggag

SEQ ID NO: 3354337 - RNA, 15 nt, Human
gaguccaucagccuc

SEQ ID NO: 3354338 - RNA, 14 nt, Human
gaguccaucagccu

SEQ ID NO: 3354339 - RNA, 13 nt, Human
gaguccaucagcc

SEQ ID NO: 3354340 - RNA, 15 nt, Human
gaguuuagggugggg

SEQ ID NO: 3354341 - RNA, 14 nt, Human
gaguuuaggguggg

SEQ ID NO: 3354342 - RNA, 12 nt, Human
gaucccaacacu

SEQ ID NO: 3354343 - RNA, 19 nt, Human
gcaccggggccugggcagg

SEQ ID NO: 3354344 - RNA, 20 nt, Human
gcaccggggccugggcagga

SEQ ID NO: 3354345 - RNA, 16 nt, Human
gacagguuagcugcuc

SEQ ID NO: 3354346 - RNA, 22 nt, Human
ggcgaagcguuguccucagccc

SEQ ID NO: 3354347 - RNA, 18 nt, Human
ggcauccagagucccugc

SEQ ID NO: 3354348 - RNA, 22 nt, Human
ggcauccagagucccugccugg

SEQ ID NO: 3354349 - RNA, 13 nt, Human
ggcacagccuggc

SEQ ID NO: 3354350 - RNA, 12 nt, Human
ggcacagccugg

SEQ ID NO: 3354351 - RNA, 14 nt, Human
aaaagggaggggga

SEQ ID NO: 3354352 - RNA, 22 nt, Human
gggcccuggugguggcucggga

SEQ ID NO: 3354353 - RNA, 21 nt, Human
gguggggagagacgggcccug

SEQ ID NO: 3354354 - RNA, 23 nt, Human
ggguguccugcaccggggccugg

SEQ ID NO: 3354355 - RNA, 22 nt, Human
gcugcuccccacgucagcuggg

SEQ ID NO: 3354356 - RNA, 13 nt, Human
gcugcuccccacg

SEQ ID NO: 3354357 - RNA, 18 nt, Human
gcuccucgagaucccaac

SEQ ID NO: 3354358 - RNA, 14 nt, Human
gcggcugggaggag

SEQ ID NO: 3354359 - RNA, 13 nt, Human
gcggcugggagga

SEQ ID NO: 3354360 - RNA, 22 nt, Human
gcggcugggaggagggcaggca

SEQ ID NO: 3354361 - RNA, 19 nt, Human
gcggcugggaggagggcag

SEQ ID NO: 3354362 - RNA, 18 nt, Human
gcggcugggaggagggca

SEQ ID NO: 3354363 - RNA, 17 nt, Human
gcggcugggaggagggc

SEQ ID NO: 3354364 - RNA, 13 nt, Human
cucccuccucugc

SEQ ID NO: 3354365 - RNA, 14 nt, Human
cucccuccucugcc

SEQ ID NO: 3354366 - RNA, 16 nt, Human
cucaucuuucuuccaa

SEQ ID NO: 3354367 - RNA, 23 nt, Human
cggcuccucgagaucccaacacu

SEQ ID NO: 3354368 - RNA, 12 nt, Human
cuaaccugccga

SEQ ID NO: 3354369 - RNA, 21 nt, Human
cuaaccugccgagaguccauc

SEQ ID NO: 3354370 - RNA, 19 nt, Human
cuaaccugccgagagucca

SEQ ID NO: 3354371 - RNA, 21 nt, Human
cgugucuggcacagccuggcu

SEQ ID NO: 3354372 - RNA, 13 nt, Human
cgugucuggcaca

SEQ ID NO: 3354373 - RNA, 14 nt, Human
cgugucuggcacag

SEQ ID NO: 3354374 - RNA, 22 nt, Human
ccugacccucaucuuucuucca

SEQ ID NO: 3354375 - RNA, 15 nt, Human
cccugugccuuguca

SEQ ID NO: 3354376 - RNA, 22 nt, Human
cccugugccuugucacgccaga

SEQ ID NO: 3354377 - RNA, 20 nt, Human
cccugugccuugucacgcca

SEQ ID NO: 3354378 - RNA, 14 nt, Human
cccgggagcucagg

SEQ ID NO: 3354379 - RNA, 14 nt, Human
ccccgacuuuuguu

SEQ ID NO: 3354380 - RNA, 16 nt, Human
ccagagucccugccug

SEQ ID NO: 3354381 - RNA, 22 nt, Human
ccagagucccugccuggaccag

SEQ ID NO: 3354382 - RNA, 19 nt, Human
ccagagucccugccuggac

SEQ ID NO: 3354383 - RNA, 18 nt, Human
ccagagucccugccugga

SEQ ID NO: 3354384 - RNA, 17 nt, Human
ccagagucccugccugg

SEQ ID NO: 3354385 - RNA, 24 nt, Human
cagccucuccacucaugugacucu

SEQ ID NO: 3354386 - RNA, 24 nt, Human
cagccccgcguggaacucgugucu

SEQ ID NO: 3354387 - RNA, 15 nt, Human
caaacaggcucagag

SEQ ID NO: 3354388 - RNA, 14 nt, Human
caaacaggcucaga

SEQ ID NO: 3354389 - RNA, 19 nt, Human
auucuuucccaacaccucu

SEQ ID NO: 3354390 - RNA, 16 nt, Human
auucuuucccaacacc

SEQ ID NO: 3354391 - RNA, 13 nt, Human
auucuuucccaac

SEQ ID NO: 3354392 - RNA, 22 nt, Human
cacugccagcauuucccuuccu

SEQ ID NO: 3354393 - RNA, 18 nt, Human
cacugccagcauuucccu

SEQ ID NO: 3354394 - RNA, 19 nt, Human
cacuggggcaggggccggg

SEQ ID NO: 3354395 - RNA, 20 nt, Human
uaugccaccugaauaaagaa

SEQ ID NO: 3354396 - RNA, 19 nt, Human
uaccagagaaaaagggagg

SEQ ID NO: 3354397 - RNA, 15 nt, Human
uacccccugugccuu

SEQ ID NO: 3354398 - RNA, 22 nt, Human
guggccuaaccugccgagaguc

SEQ ID NO: 3354399 - RNA, 21 nt, Human
guggccuaaccugccgagagu

SEQ ID NO: 3354400 - RNA, 14 nt, Human
aaggcucuuuugua

SEQ ID NO: 3354401 - RNA, 19 nt, Human
gucuggcacagccuggcug

SEQ ID NO: 3354402 - RNA, 17 nt, Human
gucuggcacagccuggc

SEQ ID NO: 3354403 - RNA, 19 nt, Human
gucucccuccucugcccgg

SEQ ID NO: 3354404 - RNA, 17 nt, Human
agagacgggcccuggug

SEQ ID NO: 3354405 - RNA, 23 nt, Human
ucuuggggaguuuaggguggggg

SEQ ID NO: 3354406 - RNA, 22 nt, Human
ucuuggggaguuuagggugggg

SEQ ID NO: 3354407 - RNA, 22 nt, Human
ucuggcacagccuggcuguggc

SEQ ID NO: 3354408 - RNA, 23 nt, Human
acuugucccgggacaccuaggcu

SEQ ID NO: 3354409 - RNA, 16 nt, Human
acuggggcaggggccg

SEQ ID NO: 3354410 - RNA, 20 nt, Human
ucggggagccgggagccuga

SEQ ID NO: 3354411 - RNA, 20 nt, Human
uccauccuacccccugugcc

SEQ ID NO: 3354412 - RNA, 16 nt, Human
uccauccuacccccug

SEQ ID NO: 3354413 - RNA, 22 nt, Human
uccucugcccgggagcucagga

SEQ ID NO: 3354414 - RNA, 16 nt, Human
uccucugcccgggagc

SEQ ID NO: 3354415 - RNA, 13 nt, Human
uccucuccugucu

SEQ ID NO: 3354416 - RNA, 23 nt, Human
acucgugucuggcacagccuggc

SEQ ID NO: 3354417 - RNA, 22 nt, Human
acucgugucuggcacagccugg

SEQ ID NO: 3354418 - RNA, 19 nt, Human
uguggcacuggggcagggg

SEQ ID NO: 3354419 - RNA, 23 nt, Human
agucccugccuggaccagccucu

SEQ ID NO: 3354420 - RNA, 22 nt, Human
agucccugccuggaccagccuc

SEQ ID NO: 3354421 - RNA, 14 nt, Human
agucccugccugga

SEQ ID NO: 3354422 - RNA, 21 nt, Human
agucccugccuggaccagccu

SEQ ID NO: 3354423 - RNA, 15 nt, Human
agucccugccuggac

SEQ ID NO: 3354424 - RNA, 13 nt, Human
agucccugccugg

SEQ ID NO: 3354425 - RNA, 19 nt, Human
uggggaguuuagggugggg

SEQ ID NO: 3354426 - RNA, 18 nt, Human
uggggaguuuaggguggg

SEQ ID NO: 3354427 - RNA, 16 nt, Human
agggggagagggcugc

SEQ ID NO: 3354428 - RNA, 15 nt, Human
agggggagagggcug

SEQ ID NO: 3354429 - RNA, 21 nt, Human
agcugggacaccccgacuuuu

SEQ ID NO: 3354430 - RNA, 19 nt, Human
aggaucccaugagcuccuu

SEQ ID NO: 3354431 - RNA, 20 nt, Human
agcucaggaaccgaggcagg

SEQ ID NO: 3354432 - RNA, 22 nt, Human
agcucaggaaccgaggcaggga

SEQ ID NO: 3354433 - RNA, 21 nt, Human
agcucaggaaccgaggcaggg

SEQ ID NO: 3354434 - RNA, 17 nt, Human
agcauuucccuuccuuc

SEQ ID NO: 3354435 - RNA, 15 nt, Human
uucuaguucugccag

SEQ ID NO: 3354436 - RNA, 23 nt, Human
ccuccauccuacccccugugccu

SEQ ID NO: 3354437 - RNA, 22 nt, Human
ccuccauccuacccccugugcc

SEQ ID NO: 3354438 - RNA, 17 nt, Human
ccuccauccuacccccu

SEQ ID NO: 3354439 - RNA, 16 nt, Human
ccggcuuuguggcacu

SEQ ID NO: 3354440 - RNA, 19 nt, Human
ccggcuuuguggcacuggg

SEQ ID NO: 3354441 - RNA, 17 nt, Human
ccggcuuuguggcacug

SEQ ID NO: 3354442 - RNA, 15 nt, Human
ccgggagcucaggaa

SEQ ID NO: 3354443 - RNA, 13 nt, Human
ccgggagcucagg

SEQ ID NO: 3354444 - RNA, 15 nt, Human
ccggggccugggcag

SEQ ID NO: 3354445 - RNA, 18 nt, Human
ccucagccccgcguggaa

SEQ ID NO: 3354446 - RNA, 18 nt, Human
cccugccuggaccagccu

SEQ ID NO: 3354447 - RNA, 13 nt, Human
cccugccuggacc

SEQ ID NO: 3354448 - RNA, 12 nt, Human
cccugccuggac

SEQ ID NO: 3354449 - RNA, 14 nt, Human
cccucaucuuucuu

SEQ ID NO: 3354450 - RNA, 19 nt, Human
cauccuacccccugugccu

SEQ ID NO: 3354451 - RNA, 21 nt, Human
cauccagagucccugccugga

SEQ ID NO: 3354452 - RNA, 15 nt, Human
gcccgggagcucagg

SEQ ID NO: 3354453 - RNA, 19 nt, Human
gcccgggagcucaggaacc

SEQ ID NO: 3354454 - RNA, 17 nt, Human
gcccgggagcucaggaa

SEQ ID NO: 3354455 - RNA, 21 nt, Human
gccucuccacucaugugacuc

SEQ ID NO: 3354456 - RNA, 24 nt, Human
gccucuccacucaugugacucuuu

SEQ ID NO: 3354457 - RNA, 17 nt, Human
gccugacccucaucuuu

SEQ ID NO: 3354458 - RNA, 12 nt, Human
gcgcggcuggga

SEQ ID NO: 3354459 - RNA, 18 nt, Human
gcgcggcugggaggaggg

SEQ ID NO: 3354460 - RNA, 18 nt, Human
gccuuuggacuugucccg

SEQ ID NO: 3354461 - RNA, 20 nt, Human
gcaggggccgggggcagucu

SEQ ID NO: 3354462 - RNA, 19 nt, Human
gcaggggccgggggcaguc

SEQ ID NO: 3354463 - RNA, 17 nt, Human
gaucccaugagcuccuu

SEQ ID NO: 3354464 - RNA, 15 nt, Human
gaucccaugagcucc

SEQ ID NO: 3354465 - RNA, 18 nt, Human
gacuugucccgggacacc

SEQ ID NO: 3354466 - RNA, 21 nt, Human
gagagaggccauucuuuccca

SEQ ID NO: 3354467 - RNA, 13 nt, Human
gagagaggccauu

SEQ ID NO: 3354468 - RNA, 20 nt, Human
gagcuccuuaaggcucuuuu

SEQ ID NO: 3354469 - RNA, 20 nt, Human
gagcucaggaaccgaggcag

SEQ ID NO: 3354470 - RNA, 21 nt, Human
gagcucaggaaccgaggcagg

SEQ ID NO: 3354471 - RNA, 21 nt, Human
gagccugacccucaucuuucu

SEQ ID NO: 3354472 - RNA, 20 nt, Human
gacaccuaggcuaggguggg

SEQ ID NO: 3354473 - RNA, 16 nt, Human
gacaccuaggcuaggg

SEQ ID NO: 3354474 - RNA, 15 nt, Human
gacaccuaggcuagg

SEQ ID NO: 3354475 - RNA, 18 nt, Human
cuugucacgccagacuuc

SEQ ID NO: 3354476 - RNA, 23 nt, Human
cuugucacgccagacuucccacg

SEQ ID NO: 3354477 - RNA, 21 nt, Human
cuuggggaguuuagggugggg

SEQ ID NO: 3354478 - RNA, 20 nt, Human
cuuggggaguuuaggguggg

SEQ ID NO: 3354479 - RNA, 13 nt, Human
cuuucuuccaaac

SEQ ID NO: 3354480 - RNA, 19 nt, Human
cuuucuuccaaacaggcuc

SEQ ID NO: 3354481 - RNA, 12 nt, Human
cuuuggacuugu

SEQ ID NO: 3354482 - RNA, 21 nt, Human
gaaggaucccaugagcuccuu

SEQ ID NO: 3354483 - RNA, 23 nt, Human
cuggcacagccuggcuguggccu

SEQ ID NO: 3354484 - RNA, 15 nt, Human
cuggcacagccuggc

SEQ ID NO: 3354485 - RNA, 21 nt, Human
cuggcacagccuggcuguggc

SEQ ID NO: 3354486 - RNA, 16 nt, Human
cuggcacagccuggcu

SEQ ID NO: 3354487 - RNA, 18 nt, Human
cuggcuguggccuaaccu

SEQ ID NO: 3354488 - RNA, 19 nt, Human
cugggaggagggcaggcau

SEQ ID NO: 3354489 - RNA, 18 nt, Human
cugcccgggagcucagga

SEQ ID NO: 3354490 - RNA, 19 nt, Human
cugcccgggagcucaggaa

SEQ ID NO: 3354491 - RNA, 11 nt, Human
cugccaggaga

SEQ ID NO: 3354492 - RNA, 18 nt, Human
cuccauccuacccccugu

SEQ ID NO: 3354493 - RNA, 23 nt, Human
cuccauccuacccccugugccuu

SEQ ID NO: 3354494 - RNA, 22 nt, Human
cuccauccuacccccugugccu

SEQ ID NO: 3354495 - RNA, 20 nt, Human
cuccauccuacccccugugc

SEQ ID NO: 3354496 - RNA, 17 nt, Human
cuccucgagaucccaac

SEQ ID NO: 3354497 - RNA, 24 nt, Human
cuccucgagaucccaacacugcca

SEQ ID NO: 3354498 - RNA, 21 nt, Human
cuccucgagaucccaacacug

SEQ ID NO: 3354499 - RNA, 18 nt, Human
cucuccugucucccuccu

SEQ ID NO: 3354500 - RNA, 17 nt, Human
cucuccugucucccucc

SEQ ID NO: 3354501 - RNA, 15 nt, Human
cucuccugucucccu

SEQ ID NO: 3354502 - RNA, 22 nt, Human
cucuccacucaugugacucuuu

SEQ ID NO: 3354503 - RNA, 19 nt, Human
cucuccacucaugugacuc

SEQ ID NO: 3354504 - RNA, 21 nt, Human
cucuccacucaugugacucuu

SEQ ID NO: 3354505 - RNA, 23 nt, Human
cucuuggggaguuuagggugggg

SEQ ID NO: 3354506 - RNA, 21 nt, Human
cucuuggggaguuuagggugg

SEQ ID NO: 3354507 - RNA, 17 nt, Human
cggggccugggcaggag

SEQ ID NO: 3354508 - RNA, 19 nt, Human
cggggccugggcaggaggg

SEQ ID NO: 3354509 - RNA, 17 nt, Human
cgggggcagucugagag

SEQ ID NO: 3354510 - RNA, 21 nt, Human
cgggggcagucugagagaggc

SEQ ID NO: 3354511 - RNA, 18 nt, Human
cgggggcagucugagaga

SEQ ID NO: 3354512 - RNA, 12 nt, Human
cggcugggagga

SEQ ID NO: 3354513 - RNA, 17 nt, Human
cgggagccugacccuca

SEQ ID NO: 3354514 - RNA, 16 nt, Human
cguuguccucagcccc

SEQ ID NO: 3354515 - RNA, 23 nt, Human
cguggcuguggcauccagagucc

SEQ ID NO: 3354516 - RNA, 14 nt, Human
cuacccccugugcc

SEQ ID NO: 3354517 - RNA, 13 nt, Human
cuacccccugugc

SEQ ID NO: 3354518 - RNA, 22 nt, Human
gucagcugggacaccccgacuu

SEQ ID NO: 3354519 - RNA, 19 nt, Human
guagugauuuuuaugccac

SEQ ID NO: 3354520 - RNA, 21 nt, Human
gugauuuuuaugccaccugaa

SEQ ID NO: 3354521 - RNA, 18 nt, Human
gucugagagaggccauuc

SEQ ID NO: 3354522 - RNA, 15 nt, Human
gucugagagaggcca

SEQ ID NO: 3354523 - RNA, 14 nt, Human
gucugagagaggcc

SEQ ID NO: 3354524 - RNA, 13 nt, Human
gucugagagaggc

SEQ ID NO: 3354525 - RNA, 13 nt, Human
gucccugccugga

SEQ ID NO: 3354526 - RNA, 12 nt, Human
guucugccagga

SEQ ID NO: 3354527 - RNA, 14 nt, Human
guucugccaggaga

SEQ ID NO: 3354528 - RNA, 13 nt, Human
guucugccaggag

SEQ ID NO: 3354529 - RNA, 17 nt, Human
gugucuggcacagccug

SEQ ID NO: 3354530 - RNA, 21 nt, Human
guguccugcaccggggccugg

SEQ ID NO: 3354531 - RNA, 21 nt, Human
guggggagagacgggcccugg

SEQ ID NO: 3354532 - RNA, 23 nt, Human
guuguccucagccccgcguggaa

SEQ ID NO: 3354533 - RNA, 17 nt, Human
guuguccucagccccgc

SEQ ID NO: 3354534 - RNA, 15 nt, Human
uguggccuaaccugc

SEQ ID NO: 3354535 - RNA, 17 nt, Human
ugugccuugucacgcca

SEQ ID NO: 3354536 - RNA, 20 nt, Human
ugugccuugucacgccagac

SEQ ID NO: 3354537 - RNA, 19 nt, Human
ugugccuugucacgccaga

SEQ ID NO: 3354538 - RNA, 17 nt, Human
ugucuggcacagccugg

SEQ ID NO: 3354539 - RNA, 21 nt, Human
uguccucagccccgcguggaa

SEQ ID NO: 3354540 - RNA, 12 nt, Human
ugcaccggggcc

SEQ ID NO: 3354541 - RNA, 22 nt, Human
ugcaccggggccugggcaggag

SEQ ID NO: 3354542 - RNA, 16 nt, Human
ugcaccggggccuggg

SEQ ID NO: 3354543 - RNA, 21 nt, Human
ugggacaccccgacuuuuguu

SEQ ID NO: 3354544 - RNA, 18 nt, Human
uggaacucgugucuggca

SEQ ID NO: 3354545 - RNA, 23 nt, Human
uccucgagaucccaacacugcca

SEQ ID NO: 3354546 - RNA, 16 nt, Human
uccucgagaucccaac

SEQ ID NO: 3354547 - RNA, 23 nt, Human
ucccaugagcuccuuaaggcucu

SEQ ID NO: 3354548 - RNA, 23 nt, Human
ucagccuccauccuacccccugu

SEQ ID NO: 3354549 - RNA, 17 nt, Human
ucaucuuucuuccaaac

SEQ ID NO: 3354550 - RNA, 14 nt, Human
ucaucuuucuucca

SEQ ID NO: 3354551 - RNA, 12 nt, Human
ucaucuuucuuc

SEQ ID NO: 3354552 - RNA, 16 nt, Human
ucccaacacugccagc

SEQ ID NO: 3354553 - RNA, 15 nt, Human
ucccaacacugccag

SEQ ID NO: 3354554 - RNA, 14 nt, Human
ucccaacacugcca

SEQ ID NO: 3354555 - RNA, 19 nt, Human
ucuuuccaaccggcuuugu

SEQ ID NO: 3354556 - RNA, 16 nt, Human
ugacucuuuccaaccg

SEQ ID NO: 3354557 - RNA, 14 nt, Human
ugacucuuuccaac

SEQ ID NO: 3354558 - RNA, 13 nt, Human
ugacucuuuccaa

SEQ ID NO: 3354559 - RNA, 19 nt, Human
ugacucuuuccaaccggcu

SEQ ID NO: 3354560 - RNA, 23 nt, Human
ggcaggcaucggggagccgggag

SEQ ID NO: 3354561 - RNA, 17 nt, Human
ggagagacgggcccugg

SEQ ID NO: 3354562 - RNA, 15 nt, Human
ggagagacgggcccu

SEQ ID NO: 3354563 - RNA, 15 nt, Human
aaaaagggaggggga

SEQ ID NO: 3354564 - RNA, 20 nt, Human
ggcuccucgagaucccaaca

SEQ ID NO: 3354565 - RNA, 14 nt, Human
gggagggggagagg

SEQ ID NO: 3354566 - RNA, 15 nt, Human
ggggccugggcagga

SEQ ID NO: 3354567 - RNA, 12 nt, Human
ggggccugggca

SEQ ID NO: 3354568 - RNA, 15 nt, Human
gaaccgaggcaggga

SEQ ID NO: 3354569 - RNA, 12 nt, Human
gaaccgaggcag

SEQ ID NO: 3354570 - RNA, 16 nt, Human
gagggcugccuuugga

SEQ ID NO: 3354571 - RNA, 9 nt, Human
gagggcugc

SEQ ID NO: 3354572 - RNA, 17 nt, Human
gaguccaucagccucca

SEQ ID NO: 3354573 - RNA, 16 nt, Human
gaguccaucagccucc

SEQ ID NO: 3354574 - RNA, 23 nt, Human
gaggugcuucuaguucugccagg

SEQ ID NO: 3354575 - RNA, 22 nt, Human
gaggugcuucuaguucugccag

SEQ ID NO: 3354576 - RNA, 14 nt, Human
gcaccggggccugg

SEQ ID NO: 3354577 - RNA, 16 nt, Human
gcaccggggccugggc

SEQ ID NO: 3354578 - RNA, 13 nt, Human
cugggcaggaggg

SEQ ID NO: 3354579 - RNA, 16 nt, Human
cugcaccggggccugg

SEQ ID NO: 3354580 - RNA, 14 nt, Human
cugcaccggggccu

SEQ ID NO: 3354581 - RNA, 19 nt, Human
cugcaccggggccugggca

SEQ ID NO: 3354582 - RNA, 18 nt, Human
cugcaccggggccugggc

SEQ ID NO: 3354583 - RNA, 24 nt, Human
cuccucugcccgggagcucaggaa

SEQ ID NO: 3354584 - RNA, 22 nt, Human
cuccucugcccgggagcucagg

SEQ ID NO: 3354585 - RNA, 16 nt, Human
cuccugucucccuccu

SEQ ID NO: 3354586 - RNA, 23 nt, Human
ccucuuggggaguuuaggguggg

SEQ ID NO: 3354587 - RNA, 22 nt, Human
ccucuuggggaguuuagggugg

SEQ ID NO: 3354588 - RNA, 12 nt, Human
ccugccuggacc

SEQ ID NO: 3354589 - RNA, 19 nt, Human
ccugccuggaccagccucu

SEQ ID NO: 3354590 - RNA, 22 nt, Human
ccucugcccgggagcucaggaa

SEQ ID NO: 3354591 - RNA, 21 nt, Human
ccucugcccgggagcucagga

SEQ ID NO: 3354592 - RNA, 12 nt, Human
ccaugagcuccu

SEQ ID NO: 3354593 - RNA, 21 nt, Human
ccaugagcuccuuaaggcucu

SEQ ID NO: 3354594 - RNA, 22 nt, Human
cccccugugccuugucacgcca

SEQ ID NO: 3354595 - RNA, 21 nt, Human
ccccgcguggaacucgugucu

SEQ ID NO: 3354596 - RNA, 18 nt, Human
ccagagaaaaagggaggg

SEQ ID NO: 3354597 - RNA, 23 nt, Human
ccagacuucccacggcuccucga

SEQ ID NO: 3354598 - RNA, 17 nt, Human
auuuuuaugccaccuga

SEQ ID NO: 3354599 - RNA, 17 nt, Human
caccuaggcuagggugg

SEQ ID NO: 3354600 - RNA, 19 nt, Human
caccuaggcuagggugggg

SEQ ID NO: 3354601 - RNA, 18 nt, Human
caccuaggcuaggguggg

SEQ ID NO: 3354602 - RNA, 17 nt, Human
acaccccgacuuuuguu

SEQ ID NO: 3354603 - RNA, 14 nt, Human
guggcacuggggca

SEQ ID NO: 3354604 - RNA, 14 nt, Human
gugguggcucggga

SEQ ID NO: 3354605 - RNA, 19 nt, Human
aacucgugucuggcacagc

SEQ ID NO: 3354606 - RNA, 16 nt, Human
gucucccuccucugcc

SEQ ID NO: 3354607 - RNA, 12 nt, Human
gucucccuccuc

SEQ ID NO: 3354608 - RNA, 22 nt, Human
aacacugccagcauuucccuuc

SEQ ID NO: 3354609 - RNA, 12 nt, Human
aacacugccagc

SEQ ID NO: 3354610 - RNA, 19 nt, Human
agacuucccacggcuccuc

SEQ ID NO: 3354611 - RNA, 13 nt, Human
ucuuucuuccaaa

SEQ ID NO: 3354612 - RNA, 20 nt, Human
agaucccaacacugccagca

SEQ ID NO: 3354613 - RNA, 19 nt, Human
agaucccaacacugccagc

SEQ ID NO: 3354614 - RNA, 18 nt, Human
agaucccaacacugccag

SEQ ID NO: 3354615 - RNA, 17 nt, Human
agagucccugccuggac

SEQ ID NO: 3354616 - RNA, 14 nt, Human
agagucccugccug

SEQ ID NO: 3354617 - RNA, 23 nt, Human
agaguccaucagccuccauccua

SEQ ID NO: 3354618 - RNA, 21 nt, Human
agaggccauucuuucccaaca

SEQ ID NO: 3354619 - RNA, 17 nt, Human
ucgagaucccaacacug

SEQ ID NO: 3354620 - RNA, 21 nt, Human
ucgagaucccaacacugccag

SEQ ID NO: 3354621 - RNA, 18 nt, Human
ucgagaucccaacacugc

SEQ ID NO: 3354622 - RNA, 20 nt, Human
ucugagagaggccauucuuu

SEQ ID NO: 3354623 - RNA, 14 nt, Human
ucugagagaggcca

SEQ ID NO: 3354624 - RNA, 19 nt, Human
acucaugugacucuuucca

SEQ ID NO: 3354625 - RNA, 18 nt, Human
acucaugugacucuuucc

SEQ ID NO: 3354626 - RNA, 21 nt, Human
uccacucaugugacucuuucc

SEQ ID NO: 3354627 - RNA, 14 nt, Human
uccacucaugugac

SEQ ID NO: 3354628 - RNA, 21 nt, Human
uccaaccggcuuuguggcacu

SEQ ID NO: 3354629 - RNA, 16 nt, Human
uguggcauccagaguc

SEQ ID NO: 3354630 - RNA, 21 nt, Human
uguggcauccagagucccugc

SEQ ID NO: 3354631 - RNA, 19 nt, Human
uguggcauccagagucccu

SEQ ID NO: 3354632 - RNA, 17 nt, Human
ugugacucuuuccaacc

SEQ ID NO: 3354633 - RNA, 15 nt, Human
ugugacucuuuccaa

SEQ ID NO: 3354634 - RNA, 14 nt, Human
ugugacucuuucca

SEQ ID NO: 3354635 - RNA, 12 nt, Human
ugugacucuuuc

SEQ ID NO: 3354636 - RNA, 14 nt, Human
aguuuagggugggg

SEQ ID NO: 3354637 - RNA, 13 nt, Human
aguuuaggguggg

SEQ ID NO: 3354638 - RNA, 12 nt, Human
aguuuagggugg

SEQ ID NO: 3354639 - RNA, 20 nt, Human
aguucugccaggagacaggu

SEQ ID NO: 3354640 - RNA, 14 nt, Human
aguucugccaggag

SEQ ID NO: 3354641 - RNA, 13 nt, Human
aguucugccagga

SEQ ID NO: 3354642 - RNA, 12 nt, Human
aguucugccagg

SEQ ID NO: 3354643 - RNA, 22 nt, Human
agggaaggaucccaugagcucc

SEQ ID NO: 3354644 - RNA, 15 nt, Human
agggaaggaucccau

SEQ ID NO: 3354645 - RNA, 23 nt, Human
agggaaggaucccaugagcuccu

SEQ ID NO: 3354646 - RNA, 13 nt, Human
uggggagagacgg

SEQ ID NO: 3354647 - RNA, 21 nt, Human
aggguggggggggggcgcggc

SEQ ID NO: 3354648 - RNA, 19 nt, Human
agguuuuuguagugauuuu

SEQ ID NO: 3354649 - RNA, 21 nt, Human
uguagugauuuuuaugccacc

SEQ ID NO: 3354650 - RNA, 15 nt, Human
ugccuugucacgcca

SEQ ID NO: 3354651 - RNA, 22 nt, Human
ugccgagaguccaucagccucc

SEQ ID NO: 3354652 - RNA, 23 nt, Human
agccccgcguggaacucgugucu

SEQ ID NO: 3354653 - RNA, 16 nt, Human
agccucuccacucaug

SEQ ID NO: 3354654 - RNA, 19 nt, Human
uuucccuuccuuccucucc

SEQ ID NO: 3354655 - RNA, 15 nt, Human
uuuguagugauuuuu

SEQ ID NO: 3354656 - RNA, 22 nt, Human
uuuguagugauuuuuaugccac

SEQ ID NO: 3354657 - RNA, 18 nt, Human
uuuguaagguuuuuguag

SEQ ID NO: 3354658 - RNA, 17 nt, Human
uucuaguucugccagga

SEQ ID NO: 3354659 - RNA, 16 nt, Human
uucuaguucugccagg

SEQ ID NO: 3354660 - RNA, 17 nt, Human
aucccaacacugccagc

SEQ ID NO: 3354661 - RNA, 16 nt, Human
aucccaacacugccag

SEQ ID NO: 3354662 - RNA, 15 nt, Human
aucccaacacugcca

SEQ ID NO: 3354663 - RNA, 11 nt, Human
aucccaacacu

SEQ ID NO: 3354664 - RNA, 12 nt, Human
uucugccaggag

SEQ ID NO: 3354665 - RNA, 16 nt, Human
uuggacuugucccggg

SEQ ID NO: 3354666 - RNA, 15 nt, Human
aggagggcaggcauc

SEQ ID NO: 3354667 - RNA, 13 nt, Human
aggagggcaggca

SEQ ID NO: 3354668 - RNA, 15 nt, Human
aggagggaggugcuu

SEQ ID NO: 3354669 - RNA, 20 nt, Human
aggagacagguuagcugcuc

SEQ ID NO: 3354670 - RNA, 19 nt, Human
aggcaucggggagccggga

SEQ ID NO: 3354671 - RNA, 19 nt, Human
aggcuaggguggggagaga

SEQ ID NO: 3354672 - RNA, 16 nt, Human
aggcuaggguggggag

SEQ ID NO: 3354673 - RNA, 15 nt, Human
aggcuagggugggga

SEQ ID NO: 3354674 - RNA, 14 nt, Human
aggcuagggugggg

SEQ ID NO: 3354675 - RNA, 22 nt, Human
agagaggccauucuuucccaac

SEQ ID NO: 3354676 - RNA, 12 nt, Human
agagaggccauu

SEQ ID NO: 3354677 - RNA, 14 nt, Human
acccucaucuuucu

SEQ ID NO: 3354678 - RNA, 13 nt, Human
acccucaucuuuc

SEQ ID NO: 3354679 - RNA, 19 nt, Human
acccucaucuuucuuccaa

SEQ ID NO: 3354680 - RNA, 16 nt, Human
acccucaucuuucuuc

SEQ ID NO: 3354681 - RNA, 13 nt, Human
accggggccuggg

SEQ ID NO: 3354682 - RNA, 14 nt, Human
aacaggcucagagg

SEQ ID NO: 3354683 - RNA, 16 nt, Human
gggaguuuaggguggg

SEQ ID NO: 3354684 - RNA, 23 nt, Human
gggaggugcuucuaguucugcca

SEQ ID NO: 3354685 - RNA, 17 nt, Human
gggcagucugagagagg

SEQ ID NO: 3354686 - RNA, 19 nt, Human
gggcagucugagagaggcc

SEQ ID NO: 3354687 - RNA, 18 nt, Human
gggcagucugagagaggc

SEQ ID NO: 3354688 - RNA, 12 nt, Human
gggccugggcag

SEQ ID NO: 3354689 - RNA, 15 nt, Human
gggccugggcaggag

SEQ ID NO: 3354690 - RNA, 13 nt, Human
gggccugggcagg

SEQ ID NO: 3354691 - RNA, 21 nt, Human
gggcagucugagagaggccau

SEQ ID NO: 3354692 - RNA, 20 nt, Human
gggcagucugagagaggcca

SEQ ID NO: 3354693 - RNA, 15 nt, Human
gggaaggaucccaug

SEQ ID NO: 3354694 - RNA, 21 nt, Human
gguguccugcaccggggccug

SEQ ID NO: 3354695 - RNA, 15 nt, Human
ggugguggcucggga

SEQ ID NO: 3354696 - RNA, 15 nt, Human
ggggcagucugagag

SEQ ID NO: 3354697 - RNA, 18 nt, Human
ggggcagucugagagagg

SEQ ID NO: 3354698 - RNA, 19 nt, Human
ggggcagucugagagaggc

SEQ ID NO: 3354699 - RNA, 16 nt, Human
ggggcgcggcugggag

SEQ ID NO: 3354700 - RNA, 15 nt, Human
ggggcgcggcuggga

SEQ ID NO: 3354701 - RNA, 17 nt, Human
gggccugggcaggaggg

SEQ ID NO: 3354702 - RNA, 16 nt, Human
gggccugggcaggagg

SEQ ID NO: 3354703 - RNA, 15 nt, Human
gggggagagggcugc

SEQ ID NO: 3354704 - RNA, 13 nt, Human
ggagggcaggcau

SEQ ID NO: 3354705 - RNA, 16 nt, Human
ggagccgggagccuga

SEQ ID NO: 3354706 - RNA, 20 nt, Human
ggaggagggcaggcaucggg

SEQ ID NO: 3354707 - RNA, 15 nt, Human
ggaggagggcaggca

SEQ ID NO: 3354708 - RNA, 14 nt, Human
ggaggagggcaggc

SEQ ID NO: 3354709 - RNA, 17 nt, Human
ggaaggaucccaugagc

SEQ ID NO: 3354710 - RNA, 20 nt, Human
ggcagucugagagaggccau

SEQ ID NO: 3354711 - RNA, 20 nt, Human
ggaucccaugagcuccuuaa

SEQ ID NO: 3354712 - RNA, 17 nt, Human
ggaucccaugagcuccu

SEQ ID NO: 3354713 - RNA, 23 nt, Human
gcugggacaccccgacuuuuguu

SEQ ID NO: 3354714 - RNA, 20 nt, Human
gcugccuuuggacuuguccc

SEQ ID NO: 3354715 - RNA, 15 nt, Human
gcugccuuuggacuu

SEQ ID NO: 3354716 - RNA, 17 nt, Human
gcugggaggagggcagg

SEQ ID NO: 3354717 - RNA, 18 nt, Human
gcuucuaguucugccagg

SEQ ID NO: 3354718 - RNA, 21 nt, Human
gcuucuaguucugccaggaga

SEQ ID NO: 3354719 - RNA, 20 nt, Human
gcuucuaguucugccaggag

SEQ ID NO: 3354720 - RNA, 19 nt, Human
gcuucuaguucugccagga

SEQ ID NO: 3354721 - RNA, 20 nt, Human
ggaaccgaggcagggaagga

SEQ ID NO: 3354722 - RNA, 16 nt, Human
ggaaccgaggcaggga

SEQ ID NO: 3354723 - RNA, 15 nt, Human
ggaaccgaggcaggg

SEQ ID NO: 3354724 - RNA, 17 nt, Human
ggaacucgugucuggca

SEQ ID NO: 3354725 - RNA, 13 nt, Human
gccccgcguggaa

SEQ ID NO: 3354726 - RNA, 21 nt, Human
gccagacuucccacggcuccu

SEQ ID NO: 3354727 - RNA, 21 nt, Human
gccgagaguccaucagccucc

SEQ ID NO: 3354728 - RNA, 14 nt, Human
gccgggagccugac

SEQ ID NO: 3354729 - RNA, 13 nt, Human
gccgggagccuga

SEQ ID NO: 3354730 - RNA, 19 nt, Human
gccgggagccugacccuca

SEQ ID NO: 3354731 - RNA, 17 nt, Human
gccuaaccugccgagag

SEQ ID NO: 3354732 - RNA, 19 nt, Human
gcacagccuggcuguggcc

SEQ ID NO: 3354733 - RNA, 12 nt, Human
gcacagccuggc

SEQ ID NO: 3354734 - RNA, 15 nt, Human
gcaggagggaggugc

SEQ ID NO: 3354735 - RNA, 18 nt, Human
gacuucccacggcuccuc

SEQ ID NO: 3354736 - RNA, 20 nt, Human
gaagcguuguccucagcccc

SEQ ID NO: 3354737 - RNA, 19 nt, Human
gaagcguuguccucagccc

SEQ ID NO: 3354738 - RNA, 13 nt, Human
gaagcguuguccu

SEQ ID NO: 3354739 - RNA, 14 nt, Human
cuuccuuccucucc

SEQ ID NO: 3354740 - RNA, 13 nt, Human
cuccuuaaggcuc

SEQ ID NO: 3354741 - RNA, 22 nt, Human
cuccuuaaggcucuuuuguaag

SEQ ID NO: 3354742 - RNA, 14 nt, Human
cuggcacagccugg

SEQ ID NO: 3354743 - RNA, 12 nt, Human
cuggaccagccu

SEQ ID NO: 3354744 - RNA, 20 nt, Human
cugccagcauuucccuuccu

SEQ ID NO: 3354745 - RNA, 16 nt, Human
cugccaggagacaggu

SEQ ID NO: 3354746 - RNA, 14 nt, Human
ccuggaccagccuc

SEQ ID NO: 3354747 - RNA, 16 nt, Human
ccuggaccagccucuc

SEQ ID NO: 3354748 - RNA, 15 nt, Human
ccuggaccagccucu

SEQ ID NO: 3354749 - RNA, 16 nt, Human
cgggagcucaggaacc

SEQ ID NO: 3354750 - RNA, 23 nt, Human
cggcugggaggagggcaggcauc

SEQ ID NO: 3354751 - RNA, 18 nt, Human
cggcugggaggagggcag

SEQ ID NO: 3354752 - RNA, 22 nt, Human
cggcugggaggagggcaggcau

SEQ ID NO: 3354753 - RNA, 19 nt, Human
cgucagcugggacaccccg

SEQ ID NO: 3354754 - RNA, 15 nt, Human
ccuccucugcccggg

SEQ ID NO: 3354755 - RNA, 14 nt, Human
ccuccucugcccgg

SEQ ID NO: 3354756 - RNA, 23 nt, Human
ccucuccacucaugugacucuuu

SEQ ID NO: 3354757 - RNA, 22 nt, Human
ccgacuuuuguuuaccagagaa

SEQ ID NO: 3354758 - RNA, 16 nt, Human
ccaaacaggcucagag

SEQ ID NO: 3354759 - RNA, 13 nt, Human
ccaacacugccag

SEQ ID NO: 3354760 - RNA, 16 nt, Human
ccaacacugccagcau

SEQ ID NO: 3354761 - RNA, 15 nt, Human
ccaacacugccagca

SEQ ID NO: 3354762 - RNA, 14 nt, Human
ccaacacugccagc

SEQ ID NO: 3354763 - RNA, 21 nt, Human
ccacgucagcugggacacccc

SEQ ID NO: 3354764 - RNA, 13 nt, Human
ccaucagccucca

SEQ ID NO: 3354765 - RNA, 13 nt, Human
cccaacaccucuu

SEQ ID NO: 3354766 - RNA, 14 nt, Human
ugucacgccagacu

SEQ ID NO: 3354767 - RNA, 20 nt, Human
ugcuucuaguucugccagga

SEQ ID NO: 3354768 - RNA, 19 nt, Human
ugcuucuaguucugccagg

SEQ ID NO: 3354769 - RNA, 18 nt, Human
ugcuucuaguucugccag

SEQ ID NO: 3354770 - RNA, 16 nt, Human
uggggcaggggccggg

SEQ ID NO: 3354771 - RNA, 18 nt, Human
uggggcaggggccggggg

SEQ ID NO: 3354772 - RNA, 13 nt, Human
uaggcuagggugg

SEQ ID NO: 3354773 - RNA, 21 nt, Human
uagugauuuuuaugccaccug

SEQ ID NO: 3354774 - RNA, 20 nt, Human
uagugauuuuuaugccaccu

SEQ ID NO: 3354775 - RNA, 22 nt, Human
uagugauuuuuaugccaccuga

SEQ ID NO: 3354776 - RNA, 19 nt, Human
ucuuuuguaagguuuuugu

SEQ ID NO: 3354777 - RNA, 18 nt, Human
ucucccuccucugcccgg

SEQ ID NO: 3354778 - RNA, 16 nt, Human
uccuuaaggcucuuuu

SEQ ID NO: 3354779 - RNA, 19 nt, Human
uccuuaaggcucuuuugua

SEQ ID NO: 3354780 - RNA, 18 nt, Human
ucacgccagacuucccac

SEQ ID NO: 3354781 - RNA, 18 nt, Zaire Ebola virus (ZEBOV)
agccaaaaacaucagugg

SEQ ID NO: 3354782 - RNA, 22 nt, Zaire Ebola virus (ZEBOV)
gcaccuuuucaauccucaaccg

SEQ ID NO: 3354783 - RNA, 21 nt, Zaire Ebola virus (ZEBOV)
uacacgaucguuuuauaauua

SEQ ID NO: 3354784 - RNA, 17 nt, Zaire Ebola virus (ZEBOV)
agaccacaaaaucaugg

SEQ ID NO: 3354785 - RNA, 18 nt, Zaire Ebola virus (ZEBOV)
aucaaagaaaaucauaau

SEQ ID NO: 3354786 - RNA, 19 nt, Zaire Ebola virus (ZEBOV)
uauacucguaauuaacauu

SEQ ID NO: 3354787 - RNA, 13 nt, Zaire Ebola virus (ZEBOV)
ugauacuugcaaa

SEQ ID NO: 3354788 - RNA, 16 nt, Zaire Ebola virus (ZEBOV)
aaauuccucugcaaug

SEQ ID NO: 3354789 - RNA, 23 nt, Zaire Ebola virus (ZEBOV)
uaccauauuucgggccagcagcc

SEQ ID NO: 3354790 - RNA, 19 nt, Zaire Ebola virus (ZEBOV)
ucuacuugaucacaauacu

SEQ ID NO: 3354791 - RNA, 18 nt, Zaire Ebola virus (ZEBOV)
caaaccaaaagugaugaa

SEQ ID NO: 3354792 - RNA, 16 nt, Zaire Ebola virus (ZEBOV)
uuacaccauugucuuu

SEQ ID NO: 3354793 - RNA, 13 nt, Zaire Ebola virus (ZEBOV)
uguauaaacuuga

SEQ ID NO: 3354794 - RNA, 16 nt, Zaire Ebola virus (ZEBOV)
gaacauaacagacaaa

SEQ ID NO: 3354795 - RNA, 22 nt, Zaire Ebola virus (ZEBOV)
agccuccgacacucccucugcc

SEQ ID NO: 3354796 - RNA, 19 nt, Zaire Ebola virus (ZEBOV)
uuacuagccguuuuucaaa

SEQ ID NO: 3354797 - RNA, 16 nt, Zaire Ebola virus (ZEBOV)
aaaucaaugaaaccag

SEQ ID NO: 3354798 - RNA, 21 nt, Zaire Ebola virus (ZEBOV)
gcuucagaaaauuccucugca

SEQ ID NO: 3354799 - RNA, 13 nt, Zaire Ebola virus (ZEBOV)
gaacuucuuccga

SEQ ID NO: 3354800 - RNA, 20 nt, Zaire Ebola virus (ZEBOV)
uucuguauaugcaaauuugu

SEQ ID NO: 3354801 - RNA, 20 nt, Zaire Ebola virus (ZEBOV)
cacuugugaguaucagcccu

SEQ ID NO: 3354802 - RNA, 18 nt, Zaire Ebola virus (ZEBOV)
uuaaauuacauuaugcuu

SEQ ID NO: 3354803 - RNA, 18 nt, Zaire Ebola virus (ZEBOV)
gaccagggggacaaugac

SEQ ID NO: 3354804 - RNA, 14 nt, Zaire Ebola virus (ZEBOV)
aaaauauaaaugua

SEQ ID NO: 3354805 - RNA, 23 nt, Zaire Ebola virus (ZEBOV)
aacagacaacgacagcacagccu

SEQ ID NO: 3354806 - RNA, 23 nt, Zaire Ebola virus (ZEBOV)
gaauuauuaucacaauaaaagug

SEQ ID NO: 3354807 - RNA, 17 nt, Zaire Ebola virus (ZEBOV)
aaagcagagaacaccaa

SEQ ID NO: 3354808 - RNA, 12 nt, Zaire Ebola virus (ZEBOV)
aguauccugaua

SEQ ID NO: 3354809 - RNA, 14 nt, Zaire Ebola virus (ZEBOV)
uugucaaugcucaa

SEQ ID NO: 3354810 - RNA, 13 nt, Zaire Ebola virus (ZEBOV)
auaauauacuugu

SEQ ID NO: 3354811 - RNA, 16 nt, Zaire Ebola virus (ZEBOV)
cuaauaacauuacaaa

SEQ ID NO: 3354812 - RNA, 20 nt, Zaire Ebola virus (ZEBOV)
cuuucucauugcacauacuu

SEQ ID NO: 3354813 - RNA, 17 nt, Zaire Ebola virus (ZEBOV)
cauaguauccugauacu

SEQ ID NO: 3354814 - RNA, 14 nt, Zaire Ebola virus (ZEBOV)
cucauauuucuuga

SEQ ID NO: 3354815 - RNA, 17 nt, Zaire Ebola virus (ZEBOV)
cuuaaaauauaaaugua

SEQ ID NO: 3354816 - RNA, 18 nt, Zaire Ebola virus (ZEBOV)
cuuauuuuugaauuuaaa

SEQ ID NO: 3354817 - RNA, 19 nt, Zaire Ebola virus (ZEBOV)
ggacccccaaaagcagaga

SEQ ID NO: 3354818 - RNA, 13 nt, Zaire Ebola virus (ZEBOV)
caacaacaacacu

SEQ ID NO: 3354819 - RNA, 14 nt, Zaire Ebola virus (ZEBOV)
cuuacaucugagga

SEQ ID NO: 3354820 - RNA, 18 nt, Zaire Ebola virus (ZEBOV)
cgcagaacagacaacgac

SEQ ID NO: 3354821 - RNA, 17 nt, Zaire Ebola virus (ZEBOV)
uagccagugugacuugg

SEQ ID NO: 3354822 - RNA, 14 nt, Zaire Ebola virus (ZEBOV)
ucgggccagcagcc

SEQ ID NO: 3354823 - RNA, 13 nt, Zaire Ebola virus (ZEBOV)
gauacuugcaaag

SEQ ID NO: 3354824 - RNA, 16 nt, Zaire Ebola virus (ZEBOV)
accagaaauccuauau

SEQ ID NO: 3354825 - RNA, 21 nt, Zaire Ebola virus (ZEBOV)
acagcgagaccgcuggcaaca

SEQ ID NO: 3354826 - RNA, 22 nt, Zaire Ebola virus (ZEBOV)
aacacgagcaagagcacugacu

SEQ ID NO: 3354827 - RNA, 13 nt, Zaire Ebola virus (ZEBOV)
acagauucuauau

SEQ ID NO: 3354828 - RNA, 14 nt, Zaire Ebola virus (ZEBOV)
cuucaacugcugaa

SEQ ID NO: 3354829 - RNA, 15 nt, Zaire Ebola virus (ZEBOV)
ucugaggcaacucaa

SEQ ID NO: 3354830 - RNA, 17 nt, Zaire Ebola virus (ZEBOV)
aagugauucuuguacac

SEQ ID NO: 3354831 - RNA, 17 nt, Zaire Ebola virus (ZEBOV)
cagcuuccaaguugaca

SEQ ID NO: 3354832 - RNA, 14 nt, Zaire Ebola virus (ZEBOV)
agaacucgaagaga

SEQ ID NO: 3354833 - RNA, 13 nt, Zaire Ebola virus (ZEBOV)
agauuacuugaca

SEQ ID NO: 3354834 - RNA, 18 nt, Zaire Ebola virus (ZEBOV)
cugagagccacaacugag

SEQ ID NO: 3354835 - RNA, 12 nt, Zaire Ebola virus (ZEBOV)
auugcacauacu

SEQ ID NO: 3354836 - RNA, 15 nt, Zaire Ebola virus (ZEBOV)
auugacucagaucca

SEQ ID NO: 3354837 - RNA, 12 nt, Zaire Ebola virus (ZEBOV)
auaaacuugaca

SEQ ID NO: 3354838 - RNA, 20 nt, Zaire Ebola virus (ZEBOV)
ccggacccccaaaagcagag

SEQ ID NO: 3354839 - RNA, 16 nt, Zaire Ebola virus (ZEBOV)
aggauggagacaaugg

SEQ ID NO: 3354840 - RNA, 18 nt, Zaire Ebola virus (ZEBOV)
gauaaacuugaugaagau

SEQ ID NO: 3354841 - RNA, 15 nt, Zaire Ebola virus (ZEBOV)
uccacgaguccccaa

SEQ ID NO: 3354842 - RNA, 16 nt, Zaire Ebola virus (ZEBOV)
ucauggaaaagcucag

SEQ ID NO: 3354843 - RNA, 20 nt, Zaire Ebola virus (ZEBOV)
acguuacauuaaugauacac

SEQ ID NO: 3354844 - RNA, 18 nt, Zaire Ebola virus (ZEBOV)
aauugguggacaggaugg

SEQ ID NO: 3354845 - RNA, 17 nt, Zaire Ebola virus (ZEBOV)
caauacggugauucaaa

SEQ ID NO: 3354846 - RNA, 13 nt, Zaire Ebola virus (ZEBOV)
guuguucacaauc

SEQ ID NO: 3354847 - RNA, 15 nt, Zaire Ebola virus (ZEBOV)
ucaaccgacaaauag

SEQ ID NO: 3354848 - RNA, 14 nt, Zaire Ebola virus (ZEBOV)
acaaccaaaccagg

SEQ ID NO: 3354849 - RNA, 20 nt, Zaire Ebola virus (ZEBOV)
uucuuguacacaaauaaugu

SEQ ID NO: 3354850 - RNA, 21 nt, Zaire Ebola virus (ZEBOV)
gccaccacaacaaguccccaa

SEQ ID NO: 3354851 - RNA, 22 nt, Zaire Ebola virus (ZEBOV)
aacgacagcacagccuccgaca

SEQ ID NO: 3354852 - RNA, 20 nt, Zaire Ebola virus (ZEBOV)
aaccaaaccagguccggaca

SEQ ID NO: 3354853 - RNA, 15 nt, Zaire Ebola virus (ZEBOV)
agcuaacucauauau

SEQ ID NO: 3354854 - RNA, 12 nt, Zaire Ebola virus (ZEBOV)
aaugaaaccagg

SEQ ID NO: 3354855 - RNA, 19 nt, Zaire Ebola virus (ZEBOV)
uugagaaugauaaacuuga

SEQ ID NO: 3354856 - RNA, 19 nt, Zaire Ebola virus (ZEBOV)
aguauccugauacuugcaa

SEQ ID NO: 3354857 - RNA, 12 nt, Zaire Ebola virus (ZEBOV)
ugaauuuaaagc

SEQ ID NO: 3354858 - RNA, 16 nt, Zaire Ebola virus (ZEBOV)
auaauuuguuuaacca

SEQ ID NO: 3354859 - RNA, 17 nt, Zaire Ebola virus (ZEBOV)
ugccagcagcgggaagc

SEQ ID NO: 3354860 - RNA, 12 nt, Zaire Ebola virus (ZEBOV)
aucaucauauau

SEQ ID NO: 3354861 - RNA, 15 nt, Zaire Ebola virus (ZEBOV)
auuuuugaugucuaa

SEQ ID NO: 3354862 - RNA, 13 nt, Zaire Ebola virus (ZEBOV)
cacucccucugcc

SEQ ID NO: 3354863 - RNA, 23 nt, Zaire Ebola virus (ZEBOV)
ugcugacucaauaguuaucuuga

SEQ ID NO: 3354864 - RNA, 19 nt, Zaire Ebola virus (ZEBOV)
aggaagggaagcugcagug

SEQ ID NO: 3354865 - RNA, 17 nt, Zaire Ebola virus (ZEBOV)
ucaaggaacgaaaacag

SEQ ID NO: 3354866 - RNA, 21 nt, Zaire Ebola virus (ZEBOV)
agaauuuuugaugucuaaggu

SEQ ID NO: 3354867 - RNA, 19 nt, Zaire Ebola virus (ZEBOV)
cuugaugaagauuaagaaa

SEQ ID NO: 3354868 - RNA, 14 nt, Zaire Ebola virus (ZEBOV)
ucaacuguuccuga

SEQ ID NO: 3354869 - RNA, 20 nt, Zaire Ebola virus (ZEBOV)
auuuacacgaucguuuuaua

SEQ ID NO: 3354870 - RNA, 21 nt, Zaire Ebola virus (ZEBOV)
gauugaugaaagaucauaacu

SEQ ID NO: 3354871 - RNA, 21 nt, Zaire Ebola virus (ZEBOV)
uucaugacuuacuaaugaucu

SEQ ID NO: 3354872 - RNA, 13 nt, Zaire Ebola virus (ZEBOV)
uugagacagcugg

SEQ ID NO: 3354873 - RNA, 15 nt, Zaire Ebola virus (ZEBOV)
agagaacaccaacac

SEQ ID NO: 3354874 - RNA, 16 nt, Zaire Ebola virus (ZEBOV)
caaucggacuggccug

SEQ ID NO: 3354875 - RNA, 20 nt, Zaire Ebola virus (ZEBOV)
cuucagaaaauuccucugca

SEQ ID NO: 3354876 - RNA, 14 nt, Zaire Ebola virus (ZEBOV)
aguuuuauagaauc

SEQ ID NO: 3354877 - RNA, 15 nt, Zaire Ebola virus (ZEBOV)
caacaucaccgcaga

SEQ ID NO: 3354878 - RNA, 12 nt, Zaire Ebola virus (ZEBOV)
guucacaaucca

SEQ ID NO: 3354879 - RNA, 19 nt, Zaire Ebola virus (ZEBOV)
ggagaagaacucgaagaga

SEQ ID NO: 3354880 - RNA, 18 nt, Zaire Ebola virus (ZEBOV)
agaugguuuaaucugugg

SEQ ID NO: 3354881 - RNA, 13 nt, Zaire Ebola virus (ZEBOV)
gacauugcccuuc

SEQ ID NO: 3354882 - RNA, 21 nt, Zaire Ebola virus (ZEBOV)
cccagggaccaacacaacaac

SEQ ID NO: 3354883 - RNA, 14 nt, Zaire Ebola virus (ZEBOV)
ucaaugaaaccagg

SEQ ID NO: 3354884 - RNA, 13 nt, Zaire Ebola virus (ZEBOV)
auuuaucuaaauu

SEQ ID NO: 3354885 - RNA, 19 nt, Zaire Ebola virus (ZEBOV)
caaagguugguuauuaaca

SEQ ID NO: 3354886 - RNA, 19 nt, Zaire Ebola virus (ZEBOV)
caaggaagggaagcugcag

SEQ ID NO: 3354887 - RNA, 21 nt, Zaire Ebola virus (ZEBOV)
ucacauguguuagguuucaca

SEQ ID NO: 3354888 - RNA, 10 nt, Zaire Ebola virus (ZEBOV)
auaauacacc

SEQ ID NO: 3354889 - RNA, 19 nt, Zaire Ebola virus (ZEBOV)
caagauaccggagaagaga

SEQ ID NO: 3354890 - RNA, 19 nt, Zaire Ebola virus (ZEBOV)
cagcacagccuccgacacu

SEQ ID NO: 3354891 - RNA, 19 nt, Zaire Ebola virus (ZEBOV)
cucugccacgaccgcagcc

SEQ ID NO: 3354892 - RNA, 18 nt, Zaire Ebola virus (ZEBOV)
uaauauaugaagagguau

SEQ ID NO: 3354893 - RNA, 18 nt, Zaire Ebola virus (ZEBOV)
aacauuagauaaguagau

SEQ ID NO: 3354894 - RNA, 11 nt, Zaire Ebola virus (ZEBOV)
acauuaaugau

SEQ ID NO: 3354895 - RNA, 23 nt, Zaire Ebola virus (ZEBOV)
aagguugguuauuaacauacaga

SEQ ID NO: 3354896 - RNA, 12 nt, Zaire Ebola virus (ZEBOV)
acagcuggccaa

SEQ ID NO: 3354897 - RNA, 20 nt, Zaire Ebola virus (ZEBOV)
aaguccccaaaaccacagcg

SEQ ID NO: 3354898 - RNA, 14 nt, Zaire Ebola virus (ZEBOV)
caugcuuacaucug

SEQ ID NO: 3354899 - RNA, 17 nt, Zaire Ebola virus (ZEBOV)
augcacaaucaagaugg

SEQ ID NO: 3354900 - RNA, 23 nt, Zaire Ebola virus (ZEBOV)
uuaaacauagccaaugugauucu

SEQ ID NO: 3354901 - RNA, 16 nt, Zaire Ebola virus (ZEBOV)
cauaauuguaacucaa

SEQ ID NO: 3354902 - RNA, 14 nt, Zaire Ebola virus (ZEBOV)
auuaugcuuuuaua

SEQ ID NO: 3354903 - RNA, 20 nt, Zaire Ebola virus (ZEBOV)
uuuaaagcuagcuuauuauu

SEQ ID NO: 3354904 - RNA, 13 nt, Zaire Ebola virus (ZEBOV)
gacaaaugauaau

SEQ ID NO: 3354905 - RNA, 20 nt, Zaire Ebola virus (ZEBOV)
auuguaacucaauauucuaa

SEQ ID NO: 3354906 - RNA, 12 nt, Zaire Ebola virus (ZEBOV)
gcucuucaacug

SEQ ID NO: 3354907 - RNA, 20 nt, Zaire Ebola virus (ZEBOV)
ugcaaagguugguuauuaac

SEQ ID NO: 3354908 - RNA, 15 nt, Zaire Ebola virus (ZEBOV)
agcuuccaaguugac

SEQ ID NO: 3354909 - RNA, 17 nt, Zaire Ebola virus (ZEBOV)
uucaaauguuaaucuuu

SEQ ID NO: 3354910 - RNA, 17 nt, Zaire Ebola virus (ZEBOV)
ucaaguugaacaacauc

SEQ ID NO: 3354911 - RNA, 18 nt, Zaire Ebola virus (ZEBOV)
gacaauugguggacagga

SEQ ID NO: 3354912 - RNA, 14 nt, Zaire Ebola virus (ZEBOV)
gagugccagcagcg

SEQ ID NO: 3354913 - RNA, 18 nt, Zaire Ebola virus (ZEBOV)
aaggaagggaagcugcag

SEQ ID NO: 3354914 - RNA, 17 nt, Zaire Ebola virus (ZEBOV)
uacguuacauuaaugau

SEQ ID NO: 3354915 - RNA, 19 nt, Zaire Ebola virus (ZEBOV)
uaccauauuucgggccagc

SEQ ID NO: 3354916 - RNA, 22 nt, Zaire Ebola virus (ZEBOV)
ucaaacggagccaaaaacauca

SEQ ID NO: 3354917 - RNA, 20 nt, Zaire Ebola virus (ZEBOV)
uaacauuaaguagucaagga

SEQ ID NO: 3354918 - RNA, 12 nt, Zaire Ebola virus (ZEBOV)
aacauacagauu

SEQ ID NO: 3354919 - RNA, 22 nt, Zaire Ebola virus (ZEBOV)
gccggacccccaaaagcagaga

SEQ ID NO: 3354920 - RNA, 18 nt, Zaire Ebola virus (ZEBOV)
ucaaguugaacaacauca

SEQ ID NO: 3354921 - RNA, 21 nt, Zaire Ebola virus (ZEBOV)
aacauaacagacaaaauugau

SEQ ID NO: 3354922 - RNA, 21 nt, Zaire Ebola virus (ZEBOV)
uugacaucaaucuaguuaucu

SEQ ID NO: 3354923 - RNA, 11 nt, Zaire Ebola virus (ZEBOV)
uuauuaacaua

SEQ ID NO: 3354924 - RNA, 18 nt, Zaire Ebola virus (ZEBOV)
caaggaagggaagcugca

SEQ ID NO: 3354925 - RNA, 20 nt, Zaire Ebola virus (ZEBOV)
acaguuaaucauaaacaagg

SEQ ID NO: 3354926 - RNA, 21 nt, Zaire Ebola virus (ZEBOV)
acgacucaagcucuucaacug

SEQ ID NO: 3354927 - RNA, 17 nt, Zaire Ebola virus (ZEBOV)
cagagaacaccaacacg

SEQ ID NO: 3354928 - RNA, 14 nt, Zaire Ebola virus (ZEBOV)
agacagcuggccaa

SEQ ID NO: 3354929 - RNA, 17 nt, Zaire Ebola virus (ZEBOV)
ccaaaagcagagaacac

SEQ ID NO: 3354930 - RNA, 15 nt, Zaire Ebola virus (ZEBOV)
auaaauacucauauu

SEQ ID NO: 3354931 - RNA, 14 nt, Zaire Ebola virus (ZEBOV)
ccacgaccgcagcc

SEQ ID NO: 3354932 - RNA, 22 nt, Zaire Ebola virus (ZEBOV)
ccucugcaaugguucaagugca

SEQ ID NO: 3354933 - RNA, 15 nt, Zaire Ebola virus (ZEBOV)
ucaaaaaauaaguau

SEQ ID NO: 3354934 - RNA, 17 nt, Zaire Ebola virus (ZEBOV)
gacaacgacagcacagc

SEQ ID NO: 3354935 - RNA, 13 nt, Zaire Ebola virus (ZEBOV)
ugagucuuaaugc

SEQ ID NO: 3354936 - RNA, 16 nt, Zaire Ebola virus (ZEBOV)
cccagggaccaacaca

SEQ ID NO: 3354937 - RNA, 19 nt, Zaire Ebola virus (ZEBOV)
augaauaagcauuuuauca

SEQ ID NO: 3354938 - RNA, 17 nt, Zaire Ebola virus (ZEBOV)
uaacaacccuugccaca

SEQ ID NO: 3354939 - RNA, 18 nt, Zaire Ebola virus (ZEBOV)
ccagcagcgggaagcuag

SEQ ID NO: 3354940 - RNA, 14 nt, Zaire Ebola virus (ZEBOV)
gaaccacaugauug

SEQ ID NO: 3354941 - RNA, 16 nt, Zaire Ebola virus (ZEBOV)
gauaauauaagucaau

SEQ ID NO: 3354942 - RNA, 23 nt, Zaire Ebola virus (ZEBOV)
cugacucaauaguuaucuugaca

SEQ ID NO: 3354943 - RNA, 22 nt, Zaire Ebola virus (ZEBOV)
auaguauccugauacuugcaaa

SEQ ID NO: 3354944 - RNA, 22 nt, Zaire Ebola virus (ZEBOV)
uucaauuugagucuuaaugcaa

SEQ ID NO: 3354945 - RNA, 16 nt, Zaire Ebola virus (ZEBOV)
aagagguaugauacaa

SEQ ID NO: 3354946 - RNA, 14 nt, Zaire Ebola virus (ZEBOV)
aagugauucuuauu

SEQ ID NO: 3354947 - RNA, 23 nt, Zaire Ebola virus (ZEBOV)
gccacaguuauagccauaauugu

SEQ ID NO: 3354948 - RNA, 13 nt, Zaire Ebola virus (ZEBOV)
aacucaaguugaa

SEQ ID NO: 3354949 - RNA, 12 nt, Zaire Ebola virus (ZEBOV)
caacaacacuca

SEQ ID NO: 3354950 - RNA, 15 nt, Zaire Ebola virus (ZEBOV)
ucaaggaagggaagc

SEQ ID NO: 3354951 - RNA, 18 nt, Zaire Ebola virus (ZEBOV)
auuuuugaugucuaaggu

SEQ ID NO: 3354952 - RNA, 21 nt, Zaire Ebola virus (ZEBOV)
agccuccgacacucccucugc

SEQ ID NO: 3354953 - RNA, 21 nt, Zaire Ebola virus (ZEBOV)
aguucaauuugagucuuaaug

SEQ ID NO: 3354954 - RNA, 22 nt, Zaire Ebola virus (ZEBOV)
ccaaaccagguccggacaacag

SEQ ID NO: 3354955 - RNA, 11 nt, Zaire Ebola virus (ZEBOV)
ugccagcagcg

SEQ ID NO: 3354956 - RNA, 22 nt, Zaire Ebola virus (ZEBOV)
ugcaaagguugguuauuaacau

SEQ ID NO: 3354957 - RNA, 16 nt, Zaire Ebola virus (ZEBOV)
agcacugacuuccugg

SEQ ID NO: 3354958 - RNA, 14 nt, Zaire Ebola virus (ZEBOV)
agauauauaagcau

SEQ ID NO: 3354959 - RNA, 12 nt, Zaire Ebola virus (ZEBOV)
augaauaagcau

SEQ ID NO: 3354960 - RNA, 20 nt, Zaire Ebola virus (ZEBOV)
agaacagacaacgacagcac

SEQ ID NO: 3354961 - RNA, 14 nt, Zaire Ebola virus (ZEBOV)
uaauauaauacacu

SEQ ID NO: 3354962 - RNA, 23 nt, Zaire Ebola virus (ZEBOV)
gcaauugauuucuugcugcagcg

SEQ ID NO: 3354963 - RNA, 11 nt, Zaire Ebola virus (ZEBOV)
gaacagacaac

SEQ ID NO: 3354964 - RNA, 20 nt, Zaire Ebola virus (ZEBOV)
ucacuguaagccagcuucca

SEQ ID NO: 3354965 - RNA, 23 nt, Zaire Ebola virus (ZEBOV)
gcaaagguugguuauuaacauac

SEQ ID NO: 3354966 - RNA, 15 nt, Zaire Ebola virus (ZEBOV)
uucuuguacacaaau

SEQ ID NO: 3354967 - RNA, 16 nt, Zaire Ebola virus (ZEBOV)
uagaaucuucucaggg

SEQ ID NO: 3354968 - RNA, 17 nt, Zaire Ebola virus (ZEBOV)
cacagucaaggaaggga

SEQ ID NO: 3354969 - RNA, 19 nt, Zaire Ebola virus (ZEBOV)
acuggacuacucaggauga

SEQ ID NO: 3354970 - RNA, 12 nt, Zaire Ebola virus (ZEBOV)
ggcaauugauuu

SEQ ID NO: 3354971 - RNA, 22 nt, Zaire Ebola virus (ZEBOV)
acaaucaagaugguuuaaucug

SEQ ID NO: 3354972 - RNA, 20 nt, Zaire Ebola virus (ZEBOV)
gcacauacuuuuugcccuua

SEQ ID NO: 3354973 - RNA, 12 nt, Human
aaaaacaacuuu

SEQ ID NO: 3354974 - RNA, 12 nt, Human
aaaacaacuuua

SEQ ID NO: 3354975 - RNA, 19 nt, Human
aaaaacuucaguaaguacg

SEQ ID NO: 3354976 - RNA, 21 nt, Human
aggugcuucuaguucugccag

SEQ ID NO: 3354977 - RNA, 22 nt, Human
aggugcuucuaguucugccagg

SEQ ID NO: 3354978 - RNA, 15 nt, Human
agguggaaauaaacu

SEQ ID NO: 3354979 - RNA, 23 nt, Human
aggugcuucuaguucugccagga

SEQ ID NO: 3354980 - RNA, 16 nt, Human
agguggaagagggcug

SEQ ID NO: 3354981 - RNA, 22 nt, Human
agguuaauuccaauuauaugag

SEQ ID NO: 3354982 - RNA, 15 nt, Human
agguuaauuccaauu

SEQ ID NO: 3354983 - RNA, 23 nt, Human
agguggcaucagugucuuuccac

SEQ ID NO: 3354984 - RNA, 22 nt, Human
agguggcaucagugucuuucca

SEQ ID NO: 3354985 - RNA, 17 nt, Human
agguucaugcaaacuuu

SEQ ID NO: 3354986 - RNA, 17 nt, Human
aggucccuaauaaagcu

SEQ ID NO: 3354987 - RNA, 20 nt, Human
aggucccuaauaaagcugug

SEQ ID NO: 3354988 - RNA, 16 nt, Human
aggucccuaauaaagc

SEQ ID NO: 3354989 - RNA, 19 nt, Human
aggucccuaauaaagcugu

SEQ ID NO: 3354990 - RNA, 18 nt, Human
aggucccuaauaaagcug

SEQ ID NO: 3354991 - RNA, 21 nt, Human
aggcuauggggauagaugugu

SEQ ID NO: 3354992 - RNA, 22 nt, Human
aggcuauggggauagaugugug

SEQ ID NO: 3354993 - RNA, 19 nt, Human
aggcuauggggauagaugu

SEQ ID NO: 3354994 - RNA, 18 nt, Human
aggcugcagccaggccac

SEQ ID NO: 3354995 - RNA, 15 nt, Human
aggaacuacugagga

SEQ ID NO: 3354996 - RNA, 15 nt, Human
agcuuuucccuuuuu

SEQ ID NO: 3354997 - RNA, 21 nt, Human
agcuuuuaugugaaacauguu

SEQ ID NO: 3354998 - RNA, 20 nt, Human
aggaaauggcuguggagugu

SEQ ID NO: 3354999 - RNA, 19 nt, Human
agcuuccuucugugaaagu

SEQ ID NO: 3355000 - RNA, 18 nt, Human
agcuucacuguaaaauaa

SEQ ID NO: 3355001 - RNA, 16 nt, Human
agaggguguccugcac

SEQ ID NO: 3355002 - RNA, 18 nt, Human
agaggggaaaagagauga

SEQ ID NO: 3355003 - RNA, 16 nt, Human
agaggggaaaagagau

SEQ ID NO: 3355004 - RNA, 21 nt, Human
agauaggucagugcaaauacu

SEQ ID NO: 3355005 - RNA, 14 nt, Human
agacgggcccuggu

SEQ ID NO: 3355006 - RNA, 14 nt, Human
agacacaacuauuu

SEQ ID NO: 3355007 - RNA, 15 nt, Human
agaccauagugacca

SEQ ID NO: 3355008 - RNA, 13 nt, Human
agccagaggucug

SEQ ID NO: 3355009 - RNA, 14 nt, Human
agcaugcacaaauu

SEQ ID NO: 3355010 - RNA, 15 nt, Human
auauccuuucuaaca

SEQ ID NO: 3355011 - RNA, 16 nt, Human
auauuuauaaaaauaa

SEQ ID NO: 3355012 - RNA, 18 nt, Human
auauuuaguguucauaaa

SEQ ID NO: 3355013 - RNA, 16 nt, Human
auacuugaaaauuaac

SEQ ID NO: 3355014 - RNA, 15 nt, Human
auacuugaaaauuaa

SEQ ID NO: 3355015 - RNA, 22 nt, Human
auauaaguauucuaaauuuuau

SEQ ID NO: 3355016 - RNA, 19 nt, Human
auauaaguauucuaaauuu

SEQ ID NO: 3355017 - RNA, 15 nt, Human
auauaagugauugcu

SEQ ID NO: 3355018 - RNA, 22 nt, Human
auaaguguguguuuuucauaaa

SEQ ID NO: 3355019 - RNA, 19 nt, Human
auaaguguguguuuuucau

SEQ ID NO: 3355020 - RNA, 19 nt, Human
auaaguauuuaauucaugu

SEQ ID NO: 3355021 - RNA, 16 nt, Human
agugucuuuccacucc

SEQ ID NO: 3355022 - RNA, 20 nt, Human
aguuguaucagcacgugugg

SEQ ID NO: 3355023 - RNA, 23 nt, Human
aguuguaucagcacguguggccu

SEQ ID NO: 3355024 - RNA, 16 nt, Human
augugggggucugugu

SEQ ID NO: 3355025 - RNA, 17 nt, Human
augugggggucugugug

SEQ ID NO: 3355026 - RNA, 18 nt, Human
augugggggucugugugu

SEQ ID NO: 3355027 - RNA, 18 nt, Human
auguuucuuuguaaugaa

SEQ ID NO: 3355028 - RNA, 17 nt, Human
auguaauaacugugaag

SEQ ID NO: 3355029 - RNA, 23 nt, Human
auggugacuuuugaaaagaggug

SEQ ID NO: 3355030 - RNA, 21 nt, Human
augccuuuguacuuuagggaa

SEQ ID NO: 3355031 - RNA, 13 nt, Human
auccuuucuaaca

SEQ ID NO: 3355032 - RNA, 14 nt, Human
augacucagaauau

SEQ ID NO: 3355033 - RNA, 20 nt, Human
augaagcuuuuaugugaaac

SEQ ID NO: 3355034 - RNA, 19 nt, Human
augaagcuuuuaugugaaa

SEQ ID NO: 3355035 - RNA, 18 nt, Human
augaagcuuuuaugugaa

SEQ ID NO: 3355036 - RNA, 20 nt, Human
augaaacacucaguuguuca

SEQ ID NO: 3355037 - RNA, 17 nt, Human
augaaaaaauauauauc

SEQ ID NO: 3355038 - RNA, 14 nt, Human
augaaaaaauauau

SEQ ID NO: 3355039 - RNA, 22 nt, Human
augaaaaaauauauaucaaaua

SEQ ID NO: 3355040 - RNA, 16 nt, Human
aucuuauaauuuaaaa

SEQ ID NO: 3355041 - RNA, 22 nt, Human
aucuuauaauuuaaaauaugcu

SEQ ID NO: 3355042 - RNA, 12 nt, Human
accccgacuuuu

SEQ ID NO: 3355043 - RNA, 15 nt, Human
accccgacuuuuguu

SEQ ID NO: 3355044 - RNA, 15 nt, Human
acagguuagcugcuc

SEQ ID NO: 3355045 - RNA, 15 nt, Human
acagguuugggaccc

SEQ ID NO: 3355046 - RNA, 18 nt, Human
acagguuugggaccccug

SEQ ID NO: 3355047 - RNA, 23 nt, Human
accacuaaaagaucgcaguuugc

SEQ ID NO: 3355048 - RNA, 19 nt, Human
accaagccuggucagccca

SEQ ID NO: 3355049 - RNA, 20 nt, Human
accaagccuggucagcccaa

SEQ ID NO: 3355050 - RNA, 18 nt, Human
accaagccuggucagccc

SEQ ID NO: 3355051 - RNA, 11 nt, Human
acacugccagc

SEQ ID NO: 3355052 - RNA, 15 nt, Human
acacugauccagccc

SEQ ID NO: 3355053 - RNA, 19 nt, Human
acagaauauguuucaaacu

SEQ ID NO: 3355054 - RNA, 21 nt, Human
acagaauauguuucaaacuuu

SEQ ID NO: 3355055 - RNA, 16 nt, Human
acagaauauguuucaa

SEQ ID NO: 3355056 - RNA, 17 nt, Human
acagaauauguuucaaa

SEQ ID NO: 3355057 - RNA, 19 nt, Human
acaggucauauuaauauau

SEQ ID NO: 3355058 - RNA, 15 nt, Human
acaggggcaggagga

SEQ ID NO: 3355059 - RNA, 20 nt, Human
aauuuugaguucuacauaag

SEQ ID NO: 3355060 - RNA, 15 nt, Human
aauuuuauaucuugu

SEQ ID NO: 3355061 - RNA, 13 nt, Human
aauuuugaaaaac

SEQ ID NO: 3355062 - RNA, 16 nt, Human
acaacuauuuuuccaa

SEQ ID NO: 3355063 - RNA, 17 nt, Human
acaacuucaauauccaa

SEQ ID NO: 3355064 - RNA, 18 nt, Human
acaacuucccagugaauu

SEQ ID NO: 3355065 - RNA, 13 nt, Human
acaacuuuauacc

SEQ ID NO: 3355066 - RNA, 14 nt, Human
acaacuuuauaccc

SEQ ID NO: 3355067 - RNA, 16 nt, Human
acgccagacuucccac

SEQ ID NO: 3355068 - RNA, 22 nt, Human
acgccagacuucccacggcucc

SEQ ID NO: 3355069 - RNA, 13 nt, Human
acucuaccucaua

SEQ ID NO: 3355070 - RNA, 22 nt, Human
acucuaccucauaucaguuugc

SEQ ID NO: 3355071 - RNA, 12 nt, Human
acuccccuccuu

SEQ ID NO: 3355072 - RNA, 13 nt, Human
acucagucuuuaa

SEQ ID NO: 3355073 - RNA, 17 nt, Human
acucaggcccaaagccu

SEQ ID NO: 3355074 - RNA, 16 nt, Human
acucaggcccaaagcc

SEQ ID NO: 3355075 - RNA, 14 nt, Human
acuagcuauggugu

SEQ ID NO: 3355076 - RNA, 22 nt, Human
acuucugccagcauaauacuug

SEQ ID NO: 3355077 - RNA, 18 nt, Human
acuuguaaaggaauuuaa

SEQ ID NO: 3355078 - RNA, 19 nt, Human
acuuguaaaggaauuuaaa

SEQ ID NO: 3355079 - RNA, 20 nt, Human
acuuguaaaggaauuuaaaa

SEQ ID NO: 3355080 - RNA, 12 nt, Human
acuguuuugaau

SEQ ID NO: 3355081 - RNA, 23 nt, Human
agaaaauauuauguguuuccaua

SEQ ID NO: 3355082 - RNA, 13 nt, Human
acuuuagggaagu

SEQ ID NO: 3355083 - RNA, 23 nt, Human
acuuuagggaaguacuuuuggca

SEQ ID NO: 3355084 - RNA, 17 nt, Human
aauaagugccaggaugg

SEQ ID NO: 3355085 - RNA, 18 nt, Human
aauaaacuggcagcucag

SEQ ID NO: 3355086 - RNA, 19 nt, Human
aauaaacuauuuguaaagu

SEQ ID NO: 3355087 - RNA, 21 nt, Human
aauaauccuaaacauaugaau

SEQ ID NO: 3355088 - RNA, 13 nt, Human
aauaaucauugga

SEQ ID NO: 3355089 - RNA, 19 nt, Human
aauaauguaagacaaauau

SEQ ID NO: 3355090 - RNA, 12 nt, Human
aauaauguaaga

SEQ ID NO: 3355091 - RNA, 19 nt, Human
aagucucuggaauuugaaa

SEQ ID NO: 3355092 - RNA, 15 nt, Human
aaguacuuuuggcau

SEQ ID NO: 3355093 - RNA, 14 nt, Human
aaguacuuuuggca

SEQ ID NO: 3355094 - RNA, 23 nt, Human
aaguccaggcuuuuuuaucaugu

SEQ ID NO: 3355095 - RNA, 22 nt, Human
aagaaauuaugugccagauuua

SEQ ID NO: 3355096 - RNA, 13 nt, Human
aagaaauuaugug

SEQ ID NO: 3355097 - RNA, 16 nt, Human
aaugucaguaugugga

SEQ ID NO: 3355098 - RNA, 22 nt, Human
aaugucaguauguggaagugug

SEQ ID NO: 3355099 - RNA, 14 nt, Human
aauuaaauuuugag

SEQ ID NO: 3355100 - RNA, 18 nt, Human
aaucucauaauuuauaca

SEQ ID NO: 3355101 - RNA, 21 nt, Human
aaugauaaguaaaugcuaggu

SEQ ID NO: 3355102 - RNA, 18 nt, Human
aaugauaaguaaaugcua

SEQ ID NO: 3355103 - RNA, 16 nt, Human
aaucucauaauuuaua

SEQ ID NO: 3355104 - RNA, 14 nt, Human
aauauuauguguuu

SEQ ID NO: 3355105 - RNA, 17 nt, Human
aacaaagaaauuaugug

SEQ ID NO: 3355106 - RNA, 15 nt, Human
aacaaagaaauuaug

SEQ ID NO: 3355107 - RNA, 21 nt, Human
aaauugauguguuuauuuaua

SEQ ID NO: 3355108 - RNA, 12 nt, Human
aaccagaucauu

SEQ ID NO: 3355109 - RNA, 14 nt, Human
aaccagaucauugu

SEQ ID NO: 3355110 - RNA, 13 nt, Human
aacaugauuuggg

SEQ ID NO: 3355111 - RNA, 16 nt, Human
aacuuuggaacaagau

SEQ ID NO: 3355112 - RNA, 14 nt, Human
aaauaguauuugag

SEQ ID NO: 3355113 - RNA, 12 nt, Human
aaauaacaauga

SEQ ID NO: 3355114 - RNA, 13 nt, Human
aaauaaaggaacc

SEQ ID NO: 3355115 - RNA, 22 nt, Human
aaagucucuggaauuugaaaca

SEQ ID NO: 3355116 - RNA, 20 nt, Human
aaagucucuggaauuugaaa

SEQ ID NO: 3355117 - RNA, 16 nt, Human
aaagggacugagaaau

SEQ ID NO: 3355118 - RNA, 19 nt, Human
aaagucucuggaauuugaa

SEQ ID NO: 3355119 - RNA, 11 nt, Human
aaagaacaucc

SEQ ID NO: 3355120 - RNA, 15 nt, Human
aaagaaauuaugugc

SEQ ID NO: 3355121 - RNA, 13 nt, Human
aaagaaauuaugu

SEQ ID NO: 3355122 - RNA, 17 nt, Human
aaagaguacucuuguuu

SEQ ID NO: 3355123 - RNA, 12 nt, Human
aaagaguacucu

SEQ ID NO: 3355124 - RNA, 20 nt, Human
aaagaaaacuuguauuaugu

SEQ ID NO: 3355125 - RNA, 12 nt, Human
aaagaaaacuug

SEQ ID NO: 3355126 - RNA, 21 nt, Human
aaaauuauuuuguucauacau

SEQ ID NO: 3355127 - RNA, 17 nt, Human
aaacacucuugaaaaau

SEQ ID NO: 3355128 - RNA, 14 nt, Human
aaacacucuugaaa

SEQ ID NO: 3355129 - RNA, 13 nt, Human
aaacacucuugaa

SEQ ID NO: 3355130 - RNA, 16 nt, Human
cuguacuugcucuuga

SEQ ID NO: 3355131 - RNA, 20 nt, Human
cuguacuugcucuugaugcc

SEQ ID NO: 3355132 - RNA, 19 nt, Human
cuguacuugcucuugaugc

SEQ ID NO: 3355133 - RNA, 22 nt, Human
cuggugaccuuccaagagccug

SEQ ID NO: 3355134 - RNA, 23 nt, Human
cuggugaccuuccaagagccuga

SEQ ID NO: 3355135 - RNA, 23 nt, Human
cugugaaguuuacauuguaaaua

SEQ ID NO: 3355136 - RNA, 18 nt, Human
cugugaaguuuacauugu

SEQ ID NO: 3355137 - RNA, 19 nt, Human
cuguuaucccugccugguc

SEQ ID NO: 3355138 - RNA, 23 nt, Human
cuggcccuaugcuuccggccucc

SEQ ID NO: 3355139 - RNA, 16 nt, Human
gaacaagaugguucua

SEQ ID NO: 3355140 - RNA, 19 nt, Human
gaaaucaaagagagaaaau

SEQ ID NO: 3355141 - RNA, 11 nt, Human
gaaacuuggau

SEQ ID NO: 3355142 - RNA, 18 nt, Human
cuuuuaugugaaacaugu

SEQ ID NO: 3355143 - RNA, 19 nt, Human
cuuuuaugugaaacauguu

SEQ ID NO: 3355144 - RNA, 14 nt, Human
cuuuugucccagaa

SEQ ID NO: 3355145 - RNA, 14 nt, Human
gaaaaaauauauau

SEQ ID NO: 3355146 - RNA, 14 nt, Human
gaaaauuaacauga

SEQ ID NO: 3355147 - RNA, 13 nt, Human
cuugaugccuggc

SEQ ID NO: 3355148 - RNA, 17 nt, Human
cuugguuccagccugcc

SEQ ID NO: 3355149 - RNA, 19 nt, Human
cuugguuccagccugccac

SEQ ID NO: 3355150 - RNA, 20 nt, Human
cuugguuccagccugccacu

SEQ ID NO: 3355151 - RNA, 15 nt, Human
cuuccucuccugucu

SEQ ID NO: 3355152 - RNA, 17 nt, Human
cuucuaccucuuggcug

SEQ ID NO: 3355153 - RNA, 15 nt, Human
gacaaagucaagcca

SEQ ID NO: 3355154 - RNA, 13 nt, Human
gaauuauuuuaaa

SEQ ID NO: 3355155 - RNA, 16 nt, Human
gaauuauuuuaaaaga

SEQ ID NO: 3355156 - RNA, 18 nt, Human
gaauuauuuuaaaagaua

SEQ ID NO: 3355157 - RNA, 20 nt, Human
gacccucaucuuucuuccaa

SEQ ID NO: 3355158 - RNA, 16 nt, Human
gagacgggcccuggug

SEQ ID NO: 3355159 - RNA, 20 nt, Human
gaggcucuggagcccacugu

SEQ ID NO: 3355160 - RNA, 22 nt, Human
gaggacaguauuuguggggagg

SEQ ID NO: 3355161 - RNA, 12 nt, Human
gagcccugggag

SEQ ID NO: 3355162 - RNA, 20 nt, Human
gagcccugggaggcucugga

SEQ ID NO: 3355163 - RNA, 19 nt, Human
gagcccugggaggcucugg

SEQ ID NO: 3355164 - RNA, 18 nt, Human
gagcccugggaggcucug

SEQ ID NO: 3355165 - RNA, 16 nt, Human
gagcccugggaggcuc

SEQ ID NO: 3355166 - RNA, 20 nt, Human
gcagccaggccacuggcccc

SEQ ID NO: 3355167 - RNA, 17 nt, Human
gcagagcugcgggcugg

SEQ ID NO: 3355168 - RNA, 19 nt, Human
gcagagcugcgggcugggu

SEQ ID NO: 3355169 - RNA, 22 nt, Human
gcauccagagucccugccugga

SEQ ID NO: 3355170 - RNA, 23 nt, Human
gcauccagagucccugccuggac

SEQ ID NO: 3355171 - RNA, 21 nt, Human
gcauccagagucccugccugg

SEQ ID NO: 3355172 - RNA, 17 nt, Human
gcaucggggagccggga

SEQ ID NO: 3355173 - RNA, 17 nt, Human
gauacuugaaaauuaac

SEQ ID NO: 3355174 - RNA, 16 nt, Human
gaucccaacacugcca

SEQ ID NO: 3355175 - RNA, 17 nt, Human
gaucccaacacugccag

SEQ ID NO: 3355176 - RNA, 23 nt, Human
gauccagcccugaguuccuagcc

SEQ ID NO: 3355177 - RNA, 18 nt, Human
gaucccaacacugccagc

SEQ ID NO: 3355178 - RNA, 19 nt, Human
gaucccaacacugccagca

SEQ ID NO: 3355179 - RNA, 23 nt, Human
gaucucugcaggaaauggcugug

SEQ ID NO: 3355180 - RNA, 12 nt, Human
gaucucugcagg

SEQ ID NO: 3355181 - RNA, 13 nt, Human
gauggaaugaugg

SEQ ID NO: 3355182 - RNA, 20 nt, Human
ggcuaagcuucacuguaaaa

SEQ ID NO: 3355183 - RNA, 19 nt, Human
ggccccugccucucugcag

SEQ ID NO: 3355184 - RNA, 18 nt, Human
ggccccugccucucugca

SEQ ID NO: 3355185 - RNA, 17 nt, Human
ggccccugccucucugc

SEQ ID NO: 3355186 - RNA, 13 nt, Human
ggccccugccucu

SEQ ID NO: 3355187 - RNA, 18 nt, Human
ggcucuugaacugagcuu

SEQ ID NO: 3355188 - RNA, 19 nt, Human
ggcucuugaacugagcuug

SEQ ID NO: 3355189 - RNA, 20 nt, Human
ggcucuugaacugagcuugg

SEQ ID NO: 3355190 - RNA, 23 nt, Human
aaaaagauuuucagaaaauauua

SEQ ID NO: 3355191 - RNA, 14 nt, Human
aaaaauaaaaaaca

SEQ ID NO: 3355192 - RNA, 16 nt, Human
ggcauccagagucccu

SEQ ID NO: 3355193 - RNA, 22 nt, Human
ggcaucggggagccgggagccu

SEQ ID NO: 3355194 - RNA, 23 nt, Human
ggcaucggggagccgggagccug

SEQ ID NO: 3355195 - RNA, 12 nt, Human
ggcaggggccgg

SEQ ID NO: 3355196 - RNA, 14 nt, Human
ggcaggagggaggu

SEQ ID NO: 3355197 - RNA, 14 nt, Human
ggagggggagaggg

SEQ ID NO: 3355198 - RNA, 11 nt, Human
ggaguguguaa

SEQ ID NO: 3355199 - RNA, 22 nt, Human
ggaguguguaauuuaaaauugu

SEQ ID NO: 3355200 - RNA, 14 nt, Human
ggauuguaguccca

SEQ ID NO: 3355201 - RNA, 22 nt, Human
ggaucuucaucugacuaugaca

SEQ ID NO: 3355202 - RNA, 23 nt, Human
ggaucuucaucugacuaugacau

SEQ ID NO: 3355203 - RNA, 22 nt, Human
gguggggggggggcgcggcugg

SEQ ID NO: 3355204 - RNA, 16 nt, Human
gguggggggcuucaua

SEQ ID NO: 3355205 - RNA, 18 nt, Human
gguggggggcuucauaca

SEQ ID NO: 3355206 - RNA, 20 nt, Human
gguucuagcauggcauauuu

SEQ ID NO: 3355207 - RNA, 14 nt, Human
gguuccagccugcc

SEQ ID NO: 3355208 - RNA, 15 nt, Human
gguuccagccugcca

SEQ ID NO: 3355209 - RNA, 16 nt, Human
gguuccagccugccac

SEQ ID NO: 3355210 - RNA, 22 nt, Human
gguuuguuuagaagaagugugu

SEQ ID NO: 3355211 - RNA, 14 nt, Human
gguuugggaccccu

SEQ ID NO: 3355212 - RNA, 14 nt, Human
aaagcuguguggca

SEQ ID NO: 3355213 - RNA, 18 nt, Human
aaagguucaugcaaacuu

SEQ ID NO: 3355214 - RNA, 21 nt, Human
aaaguaaaaacaaagaaauua

SEQ ID NO: 3355215 - RNA, 15 nt, Human
guaauagagcaaaau

SEQ ID NO: 3355216 - RNA, 13 nt, Human
guaaaccuuuuau

SEQ ID NO: 3355217 - RNA, 20 nt, Human
aaauauuguguugugaaugu

SEQ ID NO: 3355218 - RNA, 18 nt, Human
aaauauaugcuaagucuu

SEQ ID NO: 3355219 - RNA, 14 nt, Human
aaauauauaucaaa

SEQ ID NO: 3355220 - RNA, 14 nt, Human
aaauauauuuaaug

SEQ ID NO: 3355221 - RNA, 15 nt, Human
aaauauauuuaauga

SEQ ID NO: 3355222 - RNA, 22 nt, Human
aaauauauuuuaagacgaaaca

SEQ ID NO: 3355223 - RNA, 16 nt, Human
aaauauauuuuaagac

SEQ ID NO: 3355224 - RNA, 17 nt, Human
ggguguccugcaccggg

SEQ ID NO: 3355225 - RNA, 22 nt, Human
gguaaaucagacuaugaaguuu

SEQ ID NO: 3355226 - RNA, 16 nt, Human
gguaggaacugcuggg

SEQ ID NO: 3355227 - RNA, 18 nt, Human
gguaggaacugcugggcu

SEQ ID NO: 3355228 - RNA, 21 nt, Human
aaacuucccuuucugcuugug

SEQ ID NO: 3355229 - RNA, 14 nt, Human
ggucagugcaaaua

SEQ ID NO: 3355230 - RNA, 22 nt, Human
gggggcagucugagagaggcca

SEQ ID NO: 3355231 - RNA, 21 nt, Human
gggucaucuguaccucugccu

SEQ ID NO: 3355232 - RNA, 18 nt, Human
gggucauucauggccugg

SEQ ID NO: 3355233 - RNA, 15 nt, Human
aaaccaccagaagcc

SEQ ID NO: 3355234 - RNA, 18 nt, Human
aaaccaccagaagcccag

SEQ ID NO: 3355235 - RNA, 14 nt, Human
aaaccaccagaagc

SEQ ID NO: 3355236 - RNA, 19 nt, Human
aaaccaccagaagcccaga

SEQ ID NO: 3355237 - RNA, 14 nt, Human
aaaauauuuaaagg

SEQ ID NO: 3355238 - RNA, 15 nt, Human
aaaauauauuuaaug

SEQ ID NO: 3355239 - RNA, 16 nt, Human
aaaauauauuuaauga

SEQ ID NO: 3355240 - RNA, 12 nt, Human
aaaaugagaaau

SEQ ID NO: 3355241 - RNA, 11 nt, Human
aaaaugagaaa

SEQ ID NO: 3355242 - RNA, 18 nt, Human
gcucagaggguguccugc

SEQ ID NO: 3355243 - RNA, 19 nt, Human
gcucagaggguguccugca

SEQ ID NO: 3355244 - RNA, 22 nt, Human
gcucaggagcccugggaggcuc

SEQ ID NO: 3355245 - RNA, 23 nt, Human
gcucaggagcccugggaggcucu

SEQ ID NO: 3355246 - RNA, 21 nt, Human
gcucaggagcccugggaggcu

SEQ ID NO: 3355247 - RNA, 16 nt, Human
gcucagagcaguguuu

SEQ ID NO: 3355248 - RNA, 21 nt, Human
gcucacugcuaagaauauuug

SEQ ID NO: 3355249 - RNA, 17 nt, Human
gcuaggguggggagaga

SEQ ID NO: 3355250 - RNA, 18 nt, Human
gcuaggguggggagagac

SEQ ID NO: 3355251 - RNA, 21 nt, Human
gcuaggaauuguguuuauaau

SEQ ID NO: 3355252 - RNA, 21 nt, Human
gcguggaacucgugucuggca

SEQ ID NO: 3355253 - RNA, 16 nt, Human
gcggcuggacuuggag

SEQ ID NO: 3355254 - RNA, 15 nt, Human
gcggcuggacuugga

SEQ ID NO: 3355255 - RNA, 19 nt, Human
gccauucuuucccaacacc

SEQ ID NO: 3355256 - RNA, 12 nt, Human
gccauucuuucc

SEQ ID NO: 3355257 - RNA, 22 nt, Human
gcccacuguacuugcucuugau

SEQ ID NO: 3355258 - RNA, 20 nt, Human
gcccacuguacuugcucuug

SEQ ID NO: 3355259 - RNA, 15 nt, Human
gcccacuguacuugc

SEQ ID NO: 3355260 - RNA, 13 nt, Human
gcuggacuuggag

SEQ ID NO: 3355261 - RNA, 20 nt, Human
gcugggaauaagugccagga

SEQ ID NO: 3355262 - RNA, 18 nt, Human
gcugggccccugccucuc

SEQ ID NO: 3355263 - RNA, 12 nt, Human
gcugggccccug

SEQ ID NO: 3355264 - RNA, 14 nt, Human
gcugggccccugcc

SEQ ID NO: 3355265 - RNA, 13 nt, Human
gcugggccccugc

SEQ ID NO: 3355266 - RNA, 23 nt, Human
gcugcagccaggccacuggcccc

SEQ ID NO: 3355267 - RNA, 15 nt, Human
gcugcagccaggcca

SEQ ID NO: 3355268 - RNA, 16 nt, Human
ggacaccccgacuuuu

SEQ ID NO: 3355269 - RNA, 18 nt, Human
ggaaugaagcaaugcuuc

SEQ ID NO: 3355270 - RNA, 16 nt, Human
ggacaccuaggcuagg

SEQ ID NO: 3355271 - RNA, 18 nt, Human
ggacaguauuugugggga

SEQ ID NO: 3355272 - RNA, 17 nt, Human
ggacaggggcaggagga

SEQ ID NO: 3355273 - RNA, 19 nt, Human
ggacaguauuuguggggag

SEQ ID NO: 3355274 - RNA, 21 nt, Human
ggaaacuaggugcauauuuau

SEQ ID NO: 3355275 - RNA, 20 nt, Human
gcuuuucccuuuuuuuaagu

SEQ ID NO: 3355276 - RNA, 22 nt, Human
gcuuuuccucaaagggagagag

SEQ ID NO: 3355277 - RNA, 21 nt, Human
gcuuuucccuuuuuuuaagua

SEQ ID NO: 3355278 - RNA, 17 nt, Human
gcuuuucuuucuaccaa

SEQ ID NO: 3355279 - RNA, 14 nt, Human
cugagagaggccau

SEQ ID NO: 3355280 - RNA, 21 nt, Human
cugagagaggccauucuuucc

SEQ ID NO: 3355281 - RNA, 22 nt, Human
cugagagaggccauucuuuccc

SEQ ID NO: 3355282 - RNA, 13 nt, Human
cugagagaggcca

SEQ ID NO: 3355283 - RNA, 12 nt, Human
cugagaggccac

SEQ ID NO: 3355284 - RNA, 16 nt, Human
cugagaucucugcagg

SEQ ID NO: 3355285 - RNA, 17 nt, Human
cugagaucucugcagga

SEQ ID NO: 3355286 - RNA, 18 nt, Human
cugagaucucugcaggaa

SEQ ID NO: 3355287 - RNA, 13 nt, Human
cucugcagguccc

SEQ ID NO: 3355288 - RNA, 17 nt, Human
cucugcaggucccuaau

SEQ ID NO: 3355289 - RNA, 16 nt, Human
cucugcaggucccuaa

SEQ ID NO: 3355290 - RNA, 15 nt, Human
cucugcaggucccua

SEQ ID NO: 3355291 - RNA, 14 nt, Human
cucugcaggucccu

SEQ ID NO: 3355292 - RNA, 22 nt, Human
cugaagcuaucguaaaauuaag

SEQ ID NO: 3355293 - RNA, 21 nt, Human
cugaagcuaucguaaaauuaa

SEQ ID NO: 3355294 - RNA, 13 nt, Human
cugaaacuucccu

SEQ ID NO: 3355295 - RNA, 22 nt, Human
cugaaaauugaugggauuuggu

SEQ ID NO: 3355296 - RNA, 21 nt, Human
cucuugaugccuggcggggug

SEQ ID NO: 3355297 - RNA, 16 nt, Human
cucuugaugccuggcg

SEQ ID NO: 3355298 - RNA, 15 nt, Human
cucuugaugccuggc

SEQ ID NO: 3355299 - RNA, 13 nt, Human
cucuugaugccug

SEQ ID NO: 3355300 - RNA, 18 nt, Human
cucaugugacucuuucca

SEQ ID NO: 3355301 - RNA, 14 nt, Human
cucaugugacucuu

SEQ ID NO: 3355302 - RNA, 23 nt, Human
cuccaagcccaguucagcuuggg

SEQ ID NO: 3355303 - RNA, 15 nt, Human
cucgugucuggcaca

SEQ ID NO: 3355304 - RNA, 12 nt, Human
cuccuacagccc

SEQ ID NO: 3355305 - RNA, 21 nt, Human
cuaauucuuugaccuguuggg

SEQ ID NO: 3355306 - RNA, 22 nt, Human
cuaauucuuugaccuguuggga

SEQ ID NO: 3355307 - RNA, 19 nt, Human
cuagccaccgccuccuaca

SEQ ID NO: 3355308 - RNA, 17 nt, Human
cuaucguaaaauuaaga

SEQ ID NO: 3355309 - RNA, 18 nt, Human
cuaucguaaaauuaagaa

SEQ ID NO: 3355310 - RNA, 23 nt, Human
cgccacuguuuugaaucucauaa

SEQ ID NO: 3355311 - RNA, 16 nt, Human
cgacagagcgagacuu

SEQ ID NO: 3355312 - RNA, 16 nt, Human
cgaauuuuaaaagaug

SEQ ID NO: 3355313 - RNA, 14 nt, Human
cguaaaauuaagaa

SEQ ID NO: 3355314 - RNA, 18 nt, Human
caacaccucuuggggagu

SEQ ID NO: 3355315 - RNA, 20 nt, Human
caaauccuugugggaaaaga

SEQ ID NO: 3355316 - RNA, 22 nt, Human
caaauccagccugcugccugcu

SEQ ID NO: 3355317 - RNA, 22 nt, Human
caaaugagggucuugguuccag

SEQ ID NO: 3355318 - RNA, 20 nt, Human
caacuauuuuuccaaaauaa

SEQ ID NO: 3355319 - RNA, 15 nt, Human
caaaccaccagaagc

SEQ ID NO: 3355320 - RNA, 16 nt, Human
caaaccaccagaagcc

SEQ ID NO: 3355321 - RNA, 20 nt, Human
caaaccaccagaagcccaga

SEQ ID NO: 3355322 - RNA, 22 nt, Human
caaaccaccagaagcccagaau

SEQ ID NO: 3355323 - RNA, 22 nt, Human
auucaagaaaacaacuucaaua

SEQ ID NO: 3355324 - RNA, 18 nt, Human
auuaaauuuugaguucua

SEQ ID NO: 3355325 - RNA, 21 nt, Human
auuauguguguuuuaaaauga

SEQ ID NO: 3355326 - RNA, 20 nt, Human
auuauguguguuuuaaaaug

SEQ ID NO: 3355327 - RNA, 15 nt, Human
auuauguguguuuua

SEQ ID NO: 3355328 - RNA, 23 nt, Human
auuaugugccagauuuaugcaua

SEQ ID NO: 3355329 - RNA, 19 nt, Human
auucuuugaccuguuggga

SEQ ID NO: 3355330 - RNA, 13 nt, Human
auucugagagcug

SEQ ID NO: 3355331 - RNA, 14 nt, Human
auucugagagcugu

SEQ ID NO: 3355332 - RNA, 17 nt, Human
auucuugccaaauauaa

SEQ ID NO: 3355333 - RNA, 17 nt, Human
auugauccagaaagaaa

SEQ ID NO: 3355334 - RNA, 16 nt, Human
auugauccagaaagaa

SEQ ID NO: 3355335 - RNA, 18 nt, Human
auuguaagcaugcacaaa

SEQ ID NO: 3355336 - RNA, 14 nt, Human
auuguaaauaguau

SEQ ID NO: 3355337 - RNA, 19 nt, Human
auugauccagaaagaaaac

SEQ ID NO: 3355338 - RNA, 18 nt, Human
auugauccagaaagaaaa

SEQ ID NO: 3355339 - RNA, 22 nt, Human
auugauccagaaagaaaacuug

SEQ ID NO: 3355340 - RNA, 22 nt, Human
auuuaaugauaaguaaaugcua

SEQ ID NO: 3355341 - RNA, 19 nt, Human
auuuauacaggucauauua

SEQ ID NO: 3355342 - RNA, 15 nt, Human
cacuggggcaggggc

SEQ ID NO: 3355343 - RNA, 13 nt, Human
cacuggggcaggg

SEQ ID NO: 3355344 - RNA, 23 nt, Human
cacuggggauugggccccugcca

SEQ ID NO: 3355345 - RNA, 15 nt, Human
cacuggggauugggc

SEQ ID NO: 3355346 - RNA, 16 nt, Human
cacuggggauugggcc

SEQ ID NO: 3355347 - RNA, 17 nt, Human
cacuggggauugggccc

SEQ ID NO: 3355348 - RNA, 18 nt, Human
cacuggggauugggcccc

SEQ ID NO: 3355349 - RNA, 21 nt, Human
cagaauaaacuggcagcucag

SEQ ID NO: 3355350 - RNA, 12 nt, Human
cagaauauguuu

SEQ ID NO: 3355351 - RNA, 13 nt, Human
cagaauauguuuc

SEQ ID NO: 3355352 - RNA, 14 nt, Human
cagaauauguuuca

SEQ ID NO: 3355353 - RNA, 15 nt, Human
cagaauauguuucaa

SEQ ID NO: 3355354 - RNA, 17 nt, Human
cagaauauguuucaaac

SEQ ID NO: 3355355 - RNA, 18 nt, Human
cagaauauguuucaaacu

SEQ ID NO: 3355356 - RNA, 20 nt, Human
cagaauauguuucaaacuuu

SEQ ID NO: 3355357 - RNA, 13 nt, Human
cagaauauugcuu

SEQ ID NO: 3355358 - RNA, 17 nt, Human
cacucuugaaaaaugca

SEQ ID NO: 3355359 - RNA, 15 nt, Human
cacucuuggagccug

SEQ ID NO: 3355360 - RNA, 16 nt, Human
cacucuuggagccugc

SEQ ID NO: 3355361 - RNA, 14 nt, Human
cacucuuggagccu

SEQ ID NO: 3355362 - RNA, 17 nt, Human
cacucuuggagccugca

SEQ ID NO: 3355363 - RNA, 19 nt, Human
cacucuuggagccugcaga

SEQ ID NO: 3355364 - RNA, 17 nt, Human
cagaggguguccugcac

SEQ ID NO: 3355365 - RNA, 17 nt, Human
cagagguugcagugugg

SEQ ID NO: 3355366 - RNA, 21 nt, Human
cagaguaauccaagcaaaugu

SEQ ID NO: 3355367 - RNA, 13 nt, Human
cagcauaauacuu

SEQ ID NO: 3355368 - RNA, 23 nt, Human
cagguuugggaccccuggugguu

SEQ ID NO: 3355369 - RNA, 23 nt, Human
caguaaagaacaucccuccuggg

SEQ ID NO: 3355370 - RNA, 21 nt, Human
cagugggccuggccagcaggu

SEQ ID NO: 3355371 - RNA, 14 nt, Human
cagugggccuggcc

SEQ ID NO: 3355372 - RNA, 15 nt, Human
cagugggccuggcca

SEQ ID NO: 3355373 - RNA, 16 nt, Human
cagggcugaggccucu

SEQ ID NO: 3355374 - RNA, 18 nt, Human
cagggcugaggccucuca

SEQ ID NO: 3355375 - RNA, 16 nt, Human
cagggaugguguucaa

SEQ ID NO: 3355376 - RNA, 21 nt, Human
ccaccacacugauccagcccu

SEQ ID NO: 3355377 - RNA, 13 nt, Human
ccaccgccuccua

SEQ ID NO: 3355378 - RNA, 14 nt, Human
ccacuccuccuagc

SEQ ID NO: 3355379 - RNA, 23 nt, Human
cauaugcuguauauccuuucuaa

SEQ ID NO: 3355380 - RNA, 14 nt, Human
cauauuaauauauu

SEQ ID NO: 3355381 - RNA, 15 nt, Human
cauauuaauauauuu

SEQ ID NO: 3355382 - RNA, 19 nt, Human
cauauuaauauauuuccau

SEQ ID NO: 3355383 - RNA, 17 nt, Human
cauggcucccccuccac

SEQ ID NO: 3355384 - RNA, 13 nt, Human
aguccaucagccu

SEQ ID NO: 3355385 - RNA, 14 nt, Human
aguccaucagccuc

SEQ ID NO: 3355386 - RNA, 22 nt, Human
aguccaggcuuuuuuaucaugu

SEQ ID NO: 3355387 - RNA, 18 nt, Human
ugucuaaauuugaauguu

SEQ ID NO: 3355388 - RNA, 14 nt, Human
ugucuaagauagua

SEQ ID NO: 3355389 - RNA, 15 nt, Human
ugucuaagauaguaa

SEQ ID NO: 3355390 - RNA, 21 nt, Human
aguauuuaauucauguugccu

SEQ ID NO: 3355391 - RNA, 14 nt, Human
aguauguguaaaau

SEQ ID NO: 3355392 - RNA, 20 nt, Human
uguaugugggggucugugug

SEQ ID NO: 3355393 - RNA, 21 nt, Human
uguaugugggggucugugugu

SEQ ID NO: 3355394 - RNA, 22 nt, Human
uguaugugggggucuguguguu

SEQ ID NO: 3355395 - RNA, 22 nt, Human
uguauccauccauggggcugau

SEQ ID NO: 3355396 - RNA, 16 nt, Human
agguuugggaccccug

SEQ ID NO: 3355397 - RNA, 21 nt, Human
agguuugggaccccugguggu

SEQ ID NO: 3355398 - RNA, 22 nt, Human
uguauuacaaauccaaugaaau

SEQ ID NO: 3355399 - RNA, 22 nt, Human
ugucucuggauuauauuaugaa

SEQ ID NO: 3355400 - RNA, 19 nt, Human
agucuccaaagucucugga

SEQ ID NO: 3355401 - RNA, 17 nt, Human
agugaaagaaaauaaca

SEQ ID NO: 3355402 - RNA, 16 nt, Human
ugugauguauucuagc

SEQ ID NO: 3355403 - RNA, 11 nt, Human
ugugauguguc

SEQ ID NO: 3355404 - RNA, 22 nt, Human
ugguguucaaaaaacuuguaaa

SEQ ID NO: 3355405 - RNA, 21 nt, Human
ugguguucaaaaaacuuguaa

SEQ ID NO: 3355406 - RNA, 20 nt, Human
ugguucacucuuggagccug

SEQ ID NO: 3355407 - RNA, 21 nt, Human
ugguucacucuuggagccugc

SEQ ID NO: 3355408 - RNA, 22 nt, Human
ugguucacucuuggagccugca

SEQ ID NO: 3355409 - RNA, 17 nt, Human
ugguucacucuuggagc

SEQ ID NO: 3355410 - RNA, 18 nt, Human
ugguuuuaguugcaacuu

SEQ ID NO: 3355411 - RNA, 15 nt, Human
uguacuuaacuauuc

SEQ ID NO: 3355412 - RNA, 15 nt, Human
uguacuugcucuuga

SEQ ID NO: 3355413 - RNA, 14 nt, Human
uguacauauaagug

SEQ ID NO: 3355414 - RNA, 15 nt, Human
uguaaggcaaucaug

SEQ ID NO: 3355415 - RNA, 23 nt, Human
agguagcuuugagguggaagagg

SEQ ID NO: 3355416 - RNA, 15 nt, Human
aggucagugcaaaua

SEQ ID NO: 3355417 - RNA, 16 nt, Human
uggucugggacucucu

SEQ ID NO: 3355418 - RNA, 22 nt, Human
ugguccaugggccauaugaaaa

SEQ ID NO: 3355419 - RNA, 15 nt, Human
ugggucugugugugu

SEQ ID NO: 3355420 - RNA, 13 nt, Human
ugggucugugugu

SEQ ID NO: 3355421 - RNA, 15 nt, Human
agggugaaaauuauu

SEQ ID NO: 3355422 - RNA, 23 nt, Human
ugggaauaagugccaggauggaa

SEQ ID NO: 3355423 - RNA, 22 nt, Human
agggucuugguuccagccugcc

SEQ ID NO: 3355424 - RNA, 21 nt, Human
agggucuugguuccagccugc

SEQ ID NO: 3355425 - RNA, 22 nt, Human
aguugcauagguuuaauaauuu

SEQ ID NO: 3355426 - RNA, 16 nt, Human
aguuucguuuucaaaa

SEQ ID NO: 3355427 - RNA, 15 nt, Human
aguuucguuuucaaa

SEQ ID NO: 3355428 - RNA, 20 nt, Human
aguucucuucacucaaggau

SEQ ID NO: 3355429 - RNA, 15 nt, Human
uguuugcaucugaaa

SEQ ID NO: 3355430 - RNA, 19 nt, Human
aguugcaacuuuguauaaa

SEQ ID NO: 3355431 - RNA, 18 nt, Human
uguugggagugaggaugu

SEQ ID NO: 3355432 - RNA, 15 nt, Human
aguucuaaauuuugu

SEQ ID NO: 3355433 - RNA, 20 nt, Human
aguucggugagcuacaaaug

SEQ ID NO: 3355434 - RNA, 17 nt, Human
aguuauugauaaguuca

SEQ ID NO: 3355435 - RNA, 19 nt, Human
aguuauugauaaguucaua

SEQ ID NO: 3355436 - RNA, 21 nt, Human
aguuauugauaaguucauaca

SEQ ID NO: 3355437 - RNA, 22 nt, Human
aguuauugauaaguucauacau

SEQ ID NO: 3355438 - RNA, 23 nt, Human
aguuauugauaaguucauacauu

SEQ ID NO: 3355439 - RNA, 20 nt, Human
aguuauuauauuuacaaaug

SEQ ID NO: 3355440 - RNA, 21 nt, Human
auaauuuuaagaaaucaaaga

SEQ ID NO: 3355441 - RNA, 15 nt, Human
auaauuuuaagaaau

SEQ ID NO: 3355442 - RNA, 14 nt, Human
auaauuuuaagaaa

SEQ ID NO: 3355443 - RNA, 19 nt, Human
uuauauauauauauauuuc

SEQ ID NO: 3355444 - RNA, 14 nt, Human
uuauauaaguauuc

SEQ ID NO: 3355445 - RNA, 16 nt, Human
uuauauaaguauucua

SEQ ID NO: 3355446 - RNA, 13 nt, Human
uuauauaaguauu

SEQ ID NO: 3355447 - RNA, 18 nt, Human
uuauacccagaaaguuau

SEQ ID NO: 3355448 - RNA, 19 nt, Human
uuauacccagaaaguuauu

SEQ ID NO: 3355449 - RNA, 23 nt, Human
uuauacccagaaaguuauugaua

SEQ ID NO: 3355450 - RNA, 23 nt, Human
uuauagaguguacuuaacuauuc

SEQ ID NO: 3355451 - RNA, 14 nt, Human
uuaucaacauuugu

SEQ ID NO: 3355452 - RNA, 22 nt, Human
uuaucaaagggugaaaauuauu

SEQ ID NO: 3355453 - RNA, 17 nt, Human
uuaucaugugaaaucau

SEQ ID NO: 3355454 - RNA, 20 nt, Human
uuaucaugugaaaucauuca

SEQ ID NO: 3355455 - RNA, 18 nt, Human
uuaucaugugaaaucauu

SEQ ID NO: 3355456 - RNA, 22 nt, Human
uuaucaugugaaaucauucauu

SEQ ID NO: 3355457 - RNA, 21 nt, Human
auacauuguacgaagaguauu

SEQ ID NO: 3355458 - RNA, 22 nt, Human
auacauuguacgaagaguauuu

SEQ ID NO: 3355459 - RNA, 14 nt, Human
auacauuguacgaa

SEQ ID NO: 3355460 - RNA, 19 nt, Human
auacauauuuuuguagcac

SEQ ID NO: 3355461 - RNA, 16 nt, Human
auacagggaugguguu

SEQ ID NO: 3355462 - RNA, 21 nt, Human
auacaguucggugagcuacaa

SEQ ID NO: 3355463 - RNA, 15 nt, Human
auacaggucauauua

SEQ ID NO: 3355464 - RNA, 21 nt, Human
auacaggucauauuaauauau

SEQ ID NO: 3355465 - RNA, 14 nt, Human
auaaugaauacuuu

SEQ ID NO: 3355466 - RNA, 18 nt, Human
auaaucacaacccuucag

SEQ ID NO: 3355467 - RNA, 20 nt, Human
auaaucagugugucuaaauu

SEQ ID NO: 3355468 - RNA, 11 nt, Human
auaaguucaua

SEQ ID NO: 3355469 - RNA, 13 nt, Human
auaaguucauaca

SEQ ID NO: 3355470 - RNA, 14 nt, Human
auaaguucauacau

SEQ ID NO: 3355471 - RNA, 15 nt, Human
auaaguucauacauu

SEQ ID NO: 3355472 - RNA, 21 nt, Human
auaaguucauacauuguacga

SEQ ID NO: 3355473 - RNA, 12 nt, Human
auaacugugaag

SEQ ID NO: 3355474 - RNA, 19 nt, Human
auaaauaaaguuuguugaa

SEQ ID NO: 3355475 - RNA, 13 nt, Human
auaaauaaaguuu

SEQ ID NO: 3355476 - RNA, 14 nt, Human
auaaauaaaaauaa

SEQ ID NO: 3355477 - RNA, 18 nt, Human
auaaacuggcagcucagc

SEQ ID NO: 3355478 - RNA, 16 nt, Human
auaaaccucaaaaugu

SEQ ID NO: 3355479 - RNA, 18 nt, Human
auaaacacucuugaaaaa

SEQ ID NO: 3355480 - RNA, 23 nt, Human
auaaacacucuugaaaaaugcau

SEQ ID NO: 3355481 - RNA, 16 nt, Human
uggaccagccucucca

SEQ ID NO: 3355482 - RNA, 22 nt, Human
uggaccagccucuccacucaug

SEQ ID NO: 3355483 - RNA, 22 nt, Human
uggaauuggguggggggcuuca

SEQ ID NO: 3355484 - RNA, 18 nt, Human
aggagcccugggaggcuc

SEQ ID NO: 3355485 - RNA, 19 nt, Human
aggagcccugggaggcucu

SEQ ID NO: 3355486 - RNA, 13 nt, Human
ugcuccccacguc

SEQ ID NO: 3355487 - RNA, 18 nt, Human
ugcuauuguagagccaga

SEQ ID NO: 3355488 - RNA, 22 nt, Human
ugcuauuguagagccagagguc

SEQ ID NO: 3355489 - RNA, 11 nt, Human
aggaauuuaaa

SEQ ID NO: 3355490 - RNA, 23 nt, Human
aggaauuguguuuauaauuuuaa

SEQ ID NO: 3355491 - RNA, 11 nt, Human
ugcuucauaca

SEQ ID NO: 3355492 - RNA, 14 nt, Human
ugcuucauacaggg

SEQ ID NO: 3355493 - RNA, 15 nt, Human
ugcuucauacaggga

SEQ ID NO: 3355494 - RNA, 16 nt, Human
ugcuucauacagggau

SEQ ID NO: 3355495 - RNA, 15 nt, Human
aggccauucuuuccc

SEQ ID NO: 3355496 - RNA, 22 nt, Human
uggaccuuuccugaggaagagg

SEQ ID NO: 3355497 - RNA, 18 nt, Human
uggacgagaaaacaauaa

SEQ ID NO: 3355498 - RNA, 17 nt, Human
aggccauucuuucccaa

SEQ ID NO: 3355499 - RNA, 18 nt, Human
aggccauucuuucccaac

SEQ ID NO: 3355500 - RNA, 19 nt, Human
aggccauucuuucccaaca

SEQ ID NO: 3355501 - RNA, 12 nt, Human
aggcccaaagcc

SEQ ID NO: 3355502 - RNA, 13 nt, Human
aggcccaaagccu

SEQ ID NO: 3355503 - RNA, 15 nt, Human
aggcccaaagccucg

SEQ ID NO: 3355504 - RNA, 21 nt, Human
aggccucucauuccagaggaa

SEQ ID NO: 3355505 - RNA, 16 nt, Human
uggccaguggcuggau

SEQ ID NO: 3355506 - RNA, 14 nt, Human
uggccaguggcugg

SEQ ID NO: 3355507 - RNA, 15 nt, Human
uggccaguggcugga

SEQ ID NO: 3355508 - RNA, 22 nt, Human
uggcugccuugugaaggaauua

SEQ ID NO: 3355509 - RNA, 16 nt, Human
uggcuaugagggccuu

SEQ ID NO: 3355510 - RNA, 16 nt, Human
uggcucuugaacugag

SEQ ID NO: 3355511 - RNA, 13 nt, Human
aggcucuggagcc

SEQ ID NO: 3355512 - RNA, 15 nt, Human
aggcucuggagccca

SEQ ID NO: 3355513 - RNA, 14 nt, Human
aggcucuggagccc

SEQ ID NO: 3355514 - RNA, 18 nt, Human
aggcucuggagcccacug

SEQ ID NO: 3355515 - RNA, 15 nt, Human
aggcugcuuuccaaa

SEQ ID NO: 3355516 - RNA, 17 nt, Human
aggcugcuuuccaaagc

SEQ ID NO: 3355517 - RNA, 18 nt, Human
aggcugcuuuccaaagcc

SEQ ID NO: 3355518 - RNA, 19 nt, Human
aggcugcuuuccaaagcca

SEQ ID NO: 3355519 - RNA, 21 nt, Human
aggcugcuuuccaaagccaau

SEQ ID NO: 3355520 - RNA, 13 nt, Human
aggcugcuuucca

SEQ ID NO: 3355521 - RNA, 14 nt, Human
aggcugcuuuccaa

SEQ ID NO: 3355522 - RNA, 14 nt, Human
ugaugggauuuggu

SEQ ID NO: 3355523 - RNA, 15 nt, Human
agccacgguguucug

SEQ ID NO: 3355524 - RNA, 16 nt, Human
agcccacuguacuugc

SEQ ID NO: 3355525 - RNA, 14 nt, Human
agcccacuguacuu

SEQ ID NO: 3355526 - RNA, 12 nt, Human
ugccucucugca

SEQ ID NO: 3355527 - RNA, 11 nt, Human
ugccucucugc

SEQ ID NO: 3355528 - RNA, 14 nt, Human
agcugccugugccu

SEQ ID NO: 3355529 - RNA, 23 nt, Human
ugccucucugcaggucccuaaua

SEQ ID NO: 3355530 - RNA, 21 nt, Human
ugccucucugcaggucccuaa

SEQ ID NO: 3355531 - RNA, 19 nt, Human
agcuauggugucauaggcu

SEQ ID NO: 3355532 - RNA, 17 nt, Human
agcuaucguaaaauuaa

SEQ ID NO: 3355533 - RNA, 17 nt, Human
agcggcuggacuuggag

SEQ ID NO: 3355534 - RNA, 21 nt, Human
agcggcuggacuuggagguag

SEQ ID NO: 3355535 - RNA, 22 nt, Human
uuguccucagccccgcguggaa

SEQ ID NO: 3355536 - RNA, 18 nt, Human
uugucccugaagagaagg

SEQ ID NO: 3355537 - RNA, 13 nt, Human
uugugaaauuauu

SEQ ID NO: 3355538 - RNA, 13 nt, Human
uugucacgccaga

SEQ ID NO: 3355539 - RNA, 20 nt, Human
uugucacgccagacuuccca

SEQ ID NO: 3355540 - RNA, 19 nt, Human
augacauaaaaacaacuuu

SEQ ID NO: 3355541 - RNA, 10 nt, Human
uugugugugg

SEQ ID NO: 3355542 - RNA, 13 nt, Human
uugugugugggag

SEQ ID NO: 3355543 - RNA, 16 nt, Human
uugugugugggagugu

SEQ ID NO: 3355544 - RNA, 18 nt, Human
uugugaagguggaaauaa

SEQ ID NO: 3355545 - RNA, 17 nt, Human
uugugaagguggaaaua

SEQ ID NO: 3355546 - RNA, 22 nt, Human
augcaaacuuuauuuuguguuu

SEQ ID NO: 3355547 - RNA, 14 nt, Human
uugcugaaagaucu

SEQ ID NO: 3355548 - RNA, 16 nt, Human
uugcuuuuaaaaucca

SEQ ID NO: 3355549 - RNA, 12 nt, Human
uuguaaugaaaa

SEQ ID NO: 3355550 - RNA, 13 nt, Human
uuguaaugaaaac

SEQ ID NO: 3355551 - RNA, 22 nt, Human
uuguaagcaugcacaaauucug

SEQ ID NO: 3355552 - RNA, 17 nt, Human
uuuaaaggcccuaucug

SEQ ID NO: 3355553 - RNA, 14 nt, Human
uuuaugugaaacau

SEQ ID NO: 3355554 - RNA, 19 nt, Human
augcuguauauccuuucua

SEQ ID NO: 3355555 - RNA, 22 nt, Human
uuucagaaaauauuauguguuu

SEQ ID NO: 3355556 - RNA, 12 nt, Human
uuucauaaagca

SEQ ID NO: 3355557 - RNA, 17 nt, Human
uuuauuuuuuucugaau

SEQ ID NO: 3355558 - RNA, 19 nt, Human
uuugaaacacuuugcauaa

SEQ ID NO: 3355559 - RNA, 17 nt, Human
uuugaaacacuuugcau

SEQ ID NO: 3355560 - RNA, 18 nt, Human
aucggggagccgggagcc

SEQ ID NO: 3355561 - RNA, 12 nt, Human
aucguaaaauua

SEQ ID NO: 3355562 - RNA, 16 nt, Human
aucggggagccgggag

SEQ ID NO: 3355563 - RNA, 17 nt, Human
aucguaaaauuaagaaa

SEQ ID NO: 3355564 - RNA, 14 nt, Human
aucguaaaauuaag

SEQ ID NO: 3355565 - RNA, 13 nt, Human
aucguaaaauuaa

SEQ ID NO: 3355566 - RNA, 17 nt, Human
uugaaggaaaaugauac

SEQ ID NO: 3355567 - RNA, 17 nt, Human
uugaagggaaauuucag

SEQ ID NO: 3355568 - RNA, 16 nt, Human
uugauaaguucauaca

SEQ ID NO: 3355569 - RNA, 17 nt, Human
uugauaaguucauacau

SEQ ID NO: 3355570 - RNA, 14 nt, Human
uugagaguucuaaa

SEQ ID NO: 3355571 - RNA, 20 nt, Human
auccauggggcugauuguau

SEQ ID NO: 3355572 - RNA, 16 nt, Human
auccaagcaaauguga

SEQ ID NO: 3355573 - RNA, 22 nt, Human
uucuuaaccagaucauugugaa

SEQ ID NO: 3355574 - RNA, 20 nt, Human
aucagugugucuaaauuuga

SEQ ID NO: 3355575 - RNA, 23 nt, Human
aucagugugucuaaauuugaaug

SEQ ID NO: 3355576 - RNA, 22 nt, Human
aucaguuugcuagcagaaaucu

SEQ ID NO: 3355577 - RNA, 19 nt, Human
aucauugugaaauuauuca

SEQ ID NO: 3355578 - RNA, 15 nt, Human
aucauugugaaauua

SEQ ID NO: 3355579 - RNA, 13 nt, Human
aucauugugaaau

SEQ ID NO: 3355580 - RNA, 17 nt, Human
auauuuuucacauaucu

SEQ ID NO: 3355581 - RNA, 18 nt, Human
auauuuuucacauaucua

SEQ ID NO: 3355582 - RNA, 16 nt, Human
auauuuuuguagcacu

SEQ ID NO: 3355583 - RNA, 23 nt, Human
auauuuuuguagcacugacagau

SEQ ID NO: 3355584 - RNA, 15 nt, Human
auauuuuuguagcac

SEQ ID NO: 3355585 - RNA, 15 nt, Human
uucccuuuuuuuaag

SEQ ID NO: 3355586 - RNA, 21 nt, Human
auauuugaauguaugcuucau

SEQ ID NO: 3355587 - RNA, 21 nt, Human
uuccuaaauauauuuuaagac

SEQ ID NO: 3355588 - RNA, 20 nt, Human
uuccuaaauauauuuuaaga

SEQ ID NO: 3355589 - RNA, 17 nt, Human
uucccagugaauucuug

SEQ ID NO: 3355590 - RNA, 16 nt, Human
auauguucugacauaa

SEQ ID NO: 3355591 - RNA, 13 nt, Human
auauguuucaaac

SEQ ID NO: 3355592 - RNA, 14 nt, Human
auauguuucaaacu

SEQ ID NO: 3355593 - RNA, 16 nt, Human
auauguuucaaacuuu

SEQ ID NO: 3355594 - RNA, 22 nt, Human
auauuuaaaggcccuaucuguu

SEQ ID NO: 3355595 - RNA, 23 nt, Human
auauuuaaugauaaguaaaugcu

SEQ ID NO: 3355596 - RNA, 13 nt, Human
auauuuaaugaua

SEQ ID NO: 3355597 - RNA, 12 nt, Human
auauuuaaugau

SEQ ID NO: 3355598 - RNA, 13 nt, Human
auauuuacaaaug

SEQ ID NO: 3355599 - RNA, 22 nt, Human
auaugagcuuccuucugugaaa

SEQ ID NO: 3355600 - RNA, 21 nt, Human
auaugagcuuccuucugugaa

SEQ ID NO: 3355601 - RNA, 15 nt, Human
auauauuuaaugaua

SEQ ID NO: 3355602 - RNA, 16 nt, Human
auauauuuaaugauaa

SEQ ID NO: 3355603 - RNA, 9 nt, Human
auauauuuc

SEQ ID NO: 3355604 - RNA, 15 nt, Human
auauauuuuaagacg

SEQ ID NO: 3355605 - RNA, 13 nt, Human
auauaugcuaagu

SEQ ID NO: 3355606 - RNA, 16 nt, Human
uucagauuugccuuau

SEQ ID NO: 3355607 - RNA, 20 nt, Human
auuucccuuccuuccucucc

SEQ ID NO: 3355608 - RNA, 22 nt, Human
auuuauaaaaauaaaaaacacu

SEQ ID NO: 3355609 - RNA, 17 nt, Human
auuuauaaaaauaaaaa

SEQ ID NO: 3355610 - RNA, 20 nt, Human
auuuaguaucuuuuuauuca

SEQ ID NO: 3355611 - RNA, 16 nt, Human
auugggccccugccag

SEQ ID NO: 3355612 - RNA, 15 nt, Human
auugggccccugcca

SEQ ID NO: 3355613 - RNA, 20 nt, Human
auuggguggggggcuucaua

SEQ ID NO: 3355614 - RNA, 21 nt, Human
auuggguggggggcuucauac

SEQ ID NO: 3355615 - RNA, 24 nt, Human
auucugucucuggauuauauuaug

SEQ ID NO: 3355616 - RNA, 13 nt, Human
auugugauguguc

SEQ ID NO: 3355617 - RNA, 14 nt, Human
auugugaugugucc

SEQ ID NO: 3355618 - RNA, 15 nt, Human
auugugauguguccu

SEQ ID NO: 3355619 - RNA, 12 nt, Human
auugguguugac

SEQ ID NO: 3355620 - RNA, 15 nt, Human
auuguauuacaaauc

SEQ ID NO: 3355621 - RNA, 13 nt, Human
auuguauucagag

SEQ ID NO: 3355622 - RNA, 23 nt, Human
auuugugaagguggaaauaaacu

SEQ ID NO: 3355623 - RNA, 17 nt, Human
auuuucagaaaauauua

SEQ ID NO: 3355624 - RNA, 14 nt, Human
auuuucagaaaaua

SEQ ID NO: 3355625 - RNA, 22 nt, Human
auuuucaguuauuauauuuaca

SEQ ID NO: 3355626 - RNA, 21 nt, Human
auuuuauuuuuuucugaauua

SEQ ID NO: 3355627 - RNA, 16 nt, Human
uuuuguuuaccagaga

SEQ ID NO: 3355628 - RNA, 17 nt, Human
uuuuguucauacauauu

SEQ ID NO: 3355629 - RNA, 14 nt, Human
uuuuguucauacau

SEQ ID NO: 3355630 - RNA, 12 nt, Human
uuuuuaucaugu

SEQ ID NO: 3355631 - RNA, 14 nt, Human
uuuugaguucuaca

SEQ ID NO: 3355632 - RNA, 19 nt, Human
uuuuugugaaaagcuccau

SEQ ID NO: 3355633 - RNA, 14 nt, Human
auuauauaaguauu

SEQ ID NO: 3355634 - RNA, 17 nt, Human
auuauauaaguauucua

SEQ ID NO: 3355635 - RNA, 20 nt, Human
auuauauaaguauucuaaau

SEQ ID NO: 3355636 - RNA, 22 nt, Human
auguggaagugugggucugugu

SEQ ID NO: 3355637 - RNA, 23 nt, Human
auguggaagugugggucugugug

SEQ ID NO: 3355638 - RNA, 15 nt, Human
auguggaaguguggg

SEQ ID NO: 3355639 - RNA, 16 nt, Human
auguggaagugugggu

SEQ ID NO: 3355640 - RNA, 13 nt, Human
auguggaagugug

SEQ ID NO: 3355641 - RNA, 10 nt, Human
augugugugu

SEQ ID NO: 3355642 - RNA, 23 nt, Human
auguguguuuuaaaaugagaaau

SEQ ID NO: 3355643 - RNA, 15 nt, Human
auguguguuuuaaaa

SEQ ID NO: 3355644 - RNA, 14 nt, Human
uuuuaauaaacacu

SEQ ID NO: 3355645 - RNA, 15 nt, Human
auguugcauagaaua

SEQ ID NO: 3355646 - RNA, 18 nt, Human
auguugcauagaauaaaa

SEQ ID NO: 3355647 - RNA, 17 nt, Human
auguugcauagaauaaa

SEQ ID NO: 3355648 - RNA, 20 nt, Human
auguugcccuguugcugccu

SEQ ID NO: 3355649 - RNA, 13 nt, Human
auguuaagcagau

SEQ ID NO: 3355650 - RNA, 17 nt, Human
auguuuaguaaucauau

SEQ ID NO: 3355651 - RNA, 17 nt, Human
auucagaguugaugguu

SEQ ID NO: 3355652 - RNA, 13 nt, Human
ugagagaggccau

SEQ ID NO: 3355653 - RNA, 17 nt, Human
ugagagcugugcaucag

SEQ ID NO: 3355654 - RNA, 23 nt, Human
ugagauguagccccucuccugga

SEQ ID NO: 3355655 - RNA, 14 nt, Human
ugagauguguucac

SEQ ID NO: 3355656 - RNA, 15 nt, Human
agcaagucagaauag

SEQ ID NO: 3355657 - RNA, 14 nt, Human
ugacuaugacauaa

SEQ ID NO: 3355658 - RNA, 15 nt, Human
ugacagguuugggac

SEQ ID NO: 3355659 - RNA, 21 nt, Human
agauguagccccucuccugga

SEQ ID NO: 3355660 - RNA, 22 nt, Human
agauguagccccucuccuggaa

SEQ ID NO: 3355661 - RNA, 23 nt, Human
ugaauaauguaagacaaauaugu

SEQ ID NO: 3355662 - RNA, 18 nt, Human
ugaauauuuaguguucau

SEQ ID NO: 3355663 - RNA, 20 nt, Human
agaguaauccaagcaaaugu

SEQ ID NO: 3355664 - RNA, 18 nt, Human
agaguaauccaagcaaau

SEQ ID NO: 3355665 - RNA, 16 nt, Human
agaggcugcagccagg

SEQ ID NO: 3355666 - RNA, 16 nt, Human
ucuuuguaaugaaaac

SEQ ID NO: 3355667 - RNA, 22 nt, Human
ucuuuuuucuaaaguaaaaaca

SEQ ID NO: 3355668 - RNA, 21 nt, Human
ucuuuuuucuaaaguaaaaac

SEQ ID NO: 3355669 - RNA, 12 nt, Human
agacuuuuauga

SEQ ID NO: 3355670 - RNA, 15 nt, Human
agacuuuuaugauac

SEQ ID NO: 3355671 - RNA, 12 nt, Human
agacuccaccaa

SEQ ID NO: 3355672 - RNA, 16 nt, Human
agacuccaccaagccu

SEQ ID NO: 3355673 - RNA, 13 nt, Human
ugaaagaaaauaa

SEQ ID NO: 3355674 - RNA, 20 nt, Human
ugaaaaucuuauaauuuaaa

SEQ ID NO: 3355675 - RNA, 15 nt, Human
ucuaguucugccagg

SEQ ID NO: 3355676 - RNA, 16 nt, Human
ucuaguucugccagga

SEQ ID NO: 3355677 - RNA, 17 nt, Human
ucuaguucugccaggag

SEQ ID NO: 3355678 - RNA, 14 nt, Human
ucuaguucugccag

SEQ ID NO: 3355679 - RNA, 22 nt, Human
ucuagcauggcauauuuuucac

SEQ ID NO: 3355680 - RNA, 23 nt, Human
ucuagcauggcauauuuuucaca

SEQ ID NO: 3355681 - RNA, 21 nt, Human
ucuagcauggcauauuuuuca

SEQ ID NO: 3355682 - RNA, 18 nt, Human
ucuagcauggcauauuuu

SEQ ID NO: 3355683 - RNA, 23 nt, Human
acuuaacuauucaggagaguaga

SEQ ID NO: 3355684 - RNA, 15 nt, Human
acuuguauuaugugu

SEQ ID NO: 3355685 - RNA, 19 nt, Human
acuuguauuauguguguuu

SEQ ID NO: 3355686 - RNA, 18 nt, Human
acuuguauuauguguguu

SEQ ID NO: 3355687 - RNA, 14 nt, Human
acuugcuuuuaaaa

SEQ ID NO: 3355688 - RNA, 16 nt, Human
acuugcucuugaugcc

SEQ ID NO: 3355689 - RNA, 14 nt, Human
acuugcucuugaug

SEQ ID NO: 3355690 - RNA, 20 nt, Human
acuugcucuugaugccuggc

SEQ ID NO: 3355691 - RNA, 18 nt, Human
acuugcucuugaugccug

SEQ ID NO: 3355692 - RNA, 17 nt, Human
acuugcucuugaugccu

SEQ ID NO: 3355693 - RNA, 15 nt, Human
acuuuggaacaagau

SEQ ID NO: 3355694 - RNA, 14 nt, Human
ucugcuuguguuaa

SEQ ID NO: 3355695 - RNA, 19 nt, Human
agaauauguuucaaacuuu

SEQ ID NO: 3355696 - RNA, 21 nt, Human
agaauauguuucaaacuuugg

SEQ ID NO: 3355697 - RNA, 17 nt, Human
agaauauguuucaaacu

SEQ ID NO: 3355698 - RNA, 18 nt, Human
agaauauguuucaaacuu

SEQ ID NO: 3355699 - RNA, 13 nt, Human
agaauauguuuca

SEQ ID NO: 3355700 - RNA, 14 nt, Human
agaauaaaauuuuu

SEQ ID NO: 3355701 - RNA, 12 nt, Human
agaauaaaauuu

SEQ ID NO: 3355702 - RNA, 17 nt, Human
agaauaaaauuuuuaau

SEQ ID NO: 3355703 - RNA, 16 nt, Human
ucugugaaaguacauu

SEQ ID NO: 3355704 - RNA, 14 nt, Human
ucuguuuacagugu

SEQ ID NO: 3355705 - RNA, 15 nt, Human
ucugaauuauuuucu

SEQ ID NO: 3355706 - RNA, 10 nt, Human
ucugaauuau

SEQ ID NO: 3355707 - RNA, 12 nt, Human
ucugcagguccc

SEQ ID NO: 3355708 - RNA, 11 nt, Human
ucugcaggucc

SEQ ID NO: 3355709 - RNA, 13 nt, Human
ucugcaggucccu

SEQ ID NO: 3355710 - RNA, 12 nt, Human
agaagcccagaa

SEQ ID NO: 3355711 - RNA, 13 nt, Human
agaagcccagaau

SEQ ID NO: 3355712 - RNA, 11 nt, Human
agaagcccaga

SEQ ID NO: 3355713 - RNA, 14 nt, Human
agaagaaguguguc

SEQ ID NO: 3355714 - RNA, 13 nt, Human
accgaggcaggga

SEQ ID NO: 3355715 - RNA, 16 nt, Human
ucauaaauuuaugguu

SEQ ID NO: 3355716 - RNA, 14 nt, Human
ucaguauguggaag

SEQ ID NO: 3355717 - RNA, 12 nt, Human
ucaguaugugga

SEQ ID NO: 3355718 - RNA, 15 nt, Human
ucaguuuuugugaaa

SEQ ID NO: 3355719 - RNA, 17 nt, Human
ucaguuuuugugaaaag

SEQ ID NO: 3355720 - RNA, 22 nt, Human
ucauaaaaagccugcaauuuca

SEQ ID NO: 3355721 - RNA, 12 nt, Human
accuaggcuagg

SEQ ID NO: 3355722 - RNA, 17 nt, Human
accuaggcuaggguggg

SEQ ID NO: 3355723 - RNA, 14 nt, Human
ucaugugacucuuu

SEQ ID NO: 3355724 - RNA, 17 nt, Human
ucaugugacucuuucca

SEQ ID NO: 3355725 - RNA, 16 nt, Human
ucaugugaaaucauuc

SEQ ID NO: 3355726 - RNA, 17 nt, Human
ucaugugaaaucauuca

SEQ ID NO: 3355727 - RNA, 23 nt, Human
ucaugcaaacuuuauuuuguguu

SEQ ID NO: 3355728 - RNA, 18 nt, Human
ucaugugacucuuuccaa

SEQ ID NO: 3355729 - RNA, 19 nt, Human
ucaugugacucuuuccaac

SEQ ID NO: 3355730 - RNA, 17 nt, Human
ucauguuuacagaggac

SEQ ID NO: 3355731 - RNA, 13 nt, Human
ucaucuaggauuu

SEQ ID NO: 3355732 - RNA, 14 nt, Human
ucaugcaaacuuua

SEQ ID NO: 3355733 - RNA, 17 nt, Human
ucagauuugccuuauug

SEQ ID NO: 3355734 - RNA, 14 nt, Human
accccugcuucuga

SEQ ID NO: 3355735 - RNA, 16 nt, Human
accccuggugguucac

SEQ ID NO: 3355736 - RNA, 12 nt, Human
ucagcucaugga

SEQ ID NO: 3355737 - RNA, 20 nt, Human
acaugaauauuuaguguuca

SEQ ID NO: 3355738 - RNA, 18 nt, Human
ucaauauccaaaccaaau

SEQ ID NO: 3355739 - RNA, 19 nt, Human
acauucuuccaaaaagauu

SEQ ID NO: 3355740 - RNA, 19 nt, Human
acauuguacgaagaguauu

SEQ ID NO: 3355741 - RNA, 23 nt, Human
ucacagcaagucacuggccagug

SEQ ID NO: 3355742 - RNA, 16 nt, Human
ucaauucuugccaaau

SEQ ID NO: 3355743 - RNA, 16 nt, Human
accaaagcgaauuuua

SEQ ID NO: 3355744 - RNA, 24 nt, Human
accacauuggagauguuuaguaau

SEQ ID NO: 3355745 - RNA, 18 nt, Human
uccugcaccggggccugg

SEQ ID NO: 3355746 - RNA, 23 nt, Human
uccuggaagugcuaauuuugaaa

SEQ ID NO: 3355747 - RNA, 12 nt, Human
acugagaaauuu

SEQ ID NO: 3355748 - RNA, 21 nt, Human
acugagaaauuuauaaacuuu

SEQ ID NO: 3355749 - RNA, 17 nt, Human
acugagaaauuuauaaa

SEQ ID NO: 3355750 - RNA, 15 nt, Human
acucuuguuuccuua

SEQ ID NO: 3355751 - RNA, 13 nt, Human
ucccuuuuuuuaa

SEQ ID NO: 3355752 - RNA, 21 nt, Human
ucccuuuuuuuaaguaaggaa

SEQ ID NO: 3355753 - RNA, 16 nt, Human
ucccuuuuuuuaagua

SEQ ID NO: 3355754 - RNA, 21 nt, Human
acucuggagguuuguuuagaa

SEQ ID NO: 3355755 - RNA, 21 nt, Human
acucuugaaaaaugcauguug

SEQ ID NO: 3355756 - RNA, 22 nt, Human
acucuuggagccugcagagcug

SEQ ID NO: 3355757 - RNA, 23 nt, Human
acucuuggagccugcagagcugc

SEQ ID NO: 3355758 - RNA, 15 nt, Human
acucuuggagccugc

SEQ ID NO: 3355759 - RNA, 16 nt, Human
acucuuggagccugca

SEQ ID NO: 3355760 - RNA, 14 nt, Human
acucuuggagccug

SEQ ID NO: 3355761 - RNA, 21 nt, Human
uccacuccuccuagccaccca

SEQ ID NO: 3355762 - RNA, 22 nt, Human
accuuuguuugcaucugaaaau

SEQ ID NO: 3355763 - RNA, 18 nt, Human
accuuugacaaagguaaa

SEQ ID NO: 3355764 - RNA, 17 nt, Human
accuuugacaaagguaa

SEQ ID NO: 3355765 - RNA, 11 nt, Human
uccagccugcc

SEQ ID NO: 3355766 - RNA, 13 nt, Human
uccagccugccac

SEQ ID NO: 3355767 - RNA, 20 nt, Human
uccagccugcugccugcuuu

SEQ ID NO: 3355768 - RNA, 20 nt, Human
uccagcccugaguuccuagc

SEQ ID NO: 3355769 - RNA, 22 nt, Human
uccagcccugaguuccuagcca

SEQ ID NO: 3355770 - RNA, 18 nt, Human
acguaaugaaacuuggau

SEQ ID NO: 3355771 - RNA, 15 nt, Human
acuaauuuuaaaaug

SEQ ID NO: 3355772 - RNA, 16 nt, Human
acaccucuuggggagu

SEQ ID NO: 3355773 - RNA, 15 nt, Human
uauaaguguguguuu

SEQ ID NO: 3355774 - RNA, 20 nt, Human
uauaaaagccuguuuaagag

SEQ ID NO: 3355775 - RNA, 19 nt, Human
uauaaaaauaaaaaacacu

SEQ ID NO: 3355776 - RNA, 22 nt, Human
uauaaaagggacugagaaauuu

SEQ ID NO: 3355777 - RNA, 19 nt, Human
uauaaaagccuguuuaaga

SEQ ID NO: 3355778 - RNA, 19 nt, Human
acaauggauaggcacagga

SEQ ID NO: 3355779 - RNA, 24 nt, Human
uagugaaaccccaucucuacugaa

SEQ ID NO: 3355780 - RNA, 22 nt, Human
uagcauggcauauuuuucacau

SEQ ID NO: 3355781 - RNA, 21 nt, Human
uagcauggcauauuuuucaca

SEQ ID NO: 3355782 - RNA, 22 nt, Human
uagagcaaaauugauguguuua

SEQ ID NO: 3355783 - RNA, 21 nt, Human
uagagcaaaauugauguguuu

SEQ ID NO: 3355784 - RNA, 14 nt, Human
uagagcaaaauuga

SEQ ID NO: 3355785 - RNA, 16 nt, Human
aauuguuacaaauugu

SEQ ID NO: 3355786 - RNA, 20 nt, Human
aauuguguuuauaauuuuaa

SEQ ID NO: 3355787 - RNA, 21 nt, Human
aauuguguuuauaauuuuaaa

SEQ ID NO: 3355788 - RNA, 18 nt, Human
uaggcaaccuuuauuuuu

SEQ ID NO: 3355789 - RNA, 19 nt, Human
uagcuaauguaauaacugu

SEQ ID NO: 3355790 - RNA, 12 nt, Human
uagcuaauguaa

SEQ ID NO: 3355791 - RNA, 20 nt, Human
uauggggauagaugugugga

SEQ ID NO: 3355792 - RNA, 19 nt, Human
uauggggauagaugugugg

SEQ ID NO: 3355793 - RNA, 19 nt, Human
acagcggcuggacuuggag

SEQ ID NO: 3355794 - RNA, 20 nt, Human
acagauuuccauccuaguca

SEQ ID NO: 3355795 - RNA, 19 nt, Human
uaugaaauuauauaaguau

SEQ ID NO: 3355796 - RNA, 16 nt, Human
uauauuuaguaucuuu

SEQ ID NO: 3355797 - RNA, 23 nt, Human
uauaaguguguguuuuucauaaa

SEQ ID NO: 3355798 - RNA, 17 nt, Human
uauaaguguguguuuuu

SEQ ID NO: 3355799 - RNA, 19 nt, Human
uauccaaaccaaauaaaaa

SEQ ID NO: 3355800 - RNA, 15 nt, Human
uauucagcucaugga

SEQ ID NO: 3355801 - RNA, 21 nt, Human
uauucagcucauggacuucug

SEQ ID NO: 3355802 - RNA, 22 nt, Human
acagcggcuggacuuggaggua

SEQ ID NO: 3355803 - RNA, 21 nt, Human
acagcggcuggacuuggaggu

SEQ ID NO: 3355804 - RNA, 12 nt, Human
uauguggaagug

SEQ ID NO: 3355805 - RNA, 16 nt, Human
uauguggaaguguggg

SEQ ID NO: 3355806 - RNA, 23 nt, Human
uaugugccagauuuaugcauauu

SEQ ID NO: 3355807 - RNA, 17 nt, Human
uaugugaaacauguuuc

SEQ ID NO: 3355808 - RNA, 14 nt, Human
uaugugaaacaugu

SEQ ID NO: 3355809 - RNA, 17 nt, Human
uauguguaaaaugugaa

SEQ ID NO: 3355810 - RNA, 18 nt, Human
aauuccaagugauugaaa

SEQ ID NO: 3355811 - RNA, 16 nt, Human
aauuauuuuguucaua

SEQ ID NO: 3355812 - RNA, 18 nt, Human
aauuauuuuguucauaca

SEQ ID NO: 3355813 - RNA, 19 nt, Human
aauuauuuuguucauacau

SEQ ID NO: 3355814 - RNA, 20 nt, Human
aauuauuuuguucauacaua

SEQ ID NO: 3355815 - RNA, 21 nt, Human
aauuauuuuguucauacauau

SEQ ID NO: 3355816 - RNA, 22 nt, Human
aauuauuuuguucauacauauu

SEQ ID NO: 3355817 - RNA, 16 nt, Human
aauuauuauuuggccc

SEQ ID NO: 3355818 - RNA, 13 nt, Human
aauugauguguuu

SEQ ID NO: 3355819 - RNA, 14 nt, Human
aauugauguguuua

SEQ ID NO: 3355820 - RNA, 19 nt, Human
aauugaugggauuugguca

SEQ ID NO: 3355821 - RNA, 19 nt, Human
uacuguaaggcaaucaugg

SEQ ID NO: 3355822 - RNA, 18 nt, Human
uacuguaaggcaaucaug

SEQ ID NO: 3355823 - RNA, 13 nt, Human
aaugcuguguuaa

SEQ ID NO: 3355824 - RNA, 12 nt, Human
aaugcuguguua

SEQ ID NO: 3355825 - RNA, 16 nt, Human
aaugcuucaucccuuu

SEQ ID NO: 3355826 - RNA, 13 nt, Human
aauguuaagcaga

SEQ ID NO: 3355827 - RNA, 17 nt, Human
uacauuguaaauaguau

SEQ ID NO: 3355828 - RNA, 20 nt, Human
aauuaagaaaggauaaaguu

SEQ ID NO: 3355829 - RNA, 21 nt, Human
aauuaagaaaggauaaaguug

SEQ ID NO: 3355830 - RNA, 23 nt, Human
uacaggucauauuaauauauuuc

SEQ ID NO: 3355831 - RNA, 22 nt, Human
uacauauaagugauugcugguu

SEQ ID NO: 3355832 - RNA, 19 nt, Human
aaugaaacacucaguuguu

SEQ ID NO: 3355833 - RNA, 14 nt, Human
aaugaaacuuggau

SEQ ID NO: 3355834 - RNA, 18 nt, Human
uaauguaauaacugugaa

SEQ ID NO: 3355835 - RNA, 16 nt, Human
aaucuuuaauuuuaca

SEQ ID NO: 3355836 - RNA, 15 nt, Human
aaucuuuaauuuuac

SEQ ID NO: 3355837 - RNA, 21 nt, Human
uaauagagcaaaauugaugug

SEQ ID NO: 3355838 - RNA, 12 nt, Human
uaauagagcaaa

SEQ ID NO: 3355839 - RNA, 16 nt, Human
aaucuuauaauuuaaa

SEQ ID NO: 3355840 - RNA, 12 nt, Human
aauccgcccauc

SEQ ID NO: 3355841 - RNA, 19 nt, Human
aaucuuauaauuuaaaaua

SEQ ID NO: 3355842 - RNA, 16 nt, Human
uaaguauucuaaauuu

SEQ ID NO: 3355843 - RNA, 14 nt, Human
uaaguucauacauu

SEQ ID NO: 3355844 - RNA, 13 nt, Human
uaaguaaaugcua

SEQ ID NO: 3355845 - RNA, 18 nt, Human
uaauaaacacucuugaaa

SEQ ID NO: 3355846 - RNA, 12 nt, Human
uaauaaacacuc

SEQ ID NO: 3355847 - RNA, 17 nt, Human
aauauuguguugugaau

SEQ ID NO: 3355848 - RNA, 12 nt, Human
aauauuuagugu

SEQ ID NO: 3355849 - RNA, 21 nt, Human
aauauuugaauguaugcuuca

SEQ ID NO: 3355850 - RNA, 23 nt, Human
aauauuugaauguaugcuucaua

SEQ ID NO: 3355851 - RNA, 14 nt, Human
aauauuugaaugua

SEQ ID NO: 3355852 - RNA, 13 nt, Human
uaagaauauuuga

SEQ ID NO: 3355853 - RNA, 14 nt, Human
uaagaauauuugaa

SEQ ID NO: 3355854 - RNA, 13 nt, Human
uaagacaaauaug

SEQ ID NO: 3355855 - RNA, 22 nt, Human
uaacuuaaaagaacauguauau

SEQ ID NO: 3355856 - RNA, 23 nt, Human
aauaguauuugagaguucuaaau

SEQ ID NO: 3355857 - RNA, 15 nt, Human
aauaguauuugagag

SEQ ID NO: 3355858 - RNA, 22 nt, Human
aauaguauuugagaguucuaaa

SEQ ID NO: 3355859 - RNA, 20 nt, Human
aauaguauuugagaguucua

SEQ ID NO: 3355860 - RNA, 15 nt, Human
aauauauuuuaagac

SEQ ID NO: 3355861 - RNA, 14 nt, Human
aauauauuuuaaga

SEQ ID NO: 3355862 - RNA, 22 nt, Human
gucccgggacaccuaggcuagg

SEQ ID NO: 3355863 - RNA, 12 nt, Human
gucccuaauaaa

SEQ ID NO: 3355864 - RNA, 15 nt, Human
guccaucagccucca

SEQ ID NO: 3355865 - RNA, 22 nt, Human
guccccagacuccaccaagccu

SEQ ID NO: 3355866 - RNA, 21 nt, Human
aacacugggagaaaugaaaaa

SEQ ID NO: 3355867 - RNA, 18 nt, Human
gucgcccuggacugugug

SEQ ID NO: 3355868 - RNA, 21 nt, Human
guauucuaaauuuuauaucuu

SEQ ID NO: 3355869 - RNA, 24 nt, Human
guauucuaaauuuuauaucuugua

SEQ ID NO: 3355870 - RNA, 19 nt, Human
guauucuagcuaauguaau

SEQ ID NO: 3355871 - RNA, 16 nt, Human
aaaucauucauuuucu

SEQ ID NO: 3355872 - RNA, 17 nt, Human
aaauuccaagugauuga

SEQ ID NO: 3355873 - RNA, 17 nt, Human
aaauuguauuacaaauc

SEQ ID NO: 3355874 - RNA, 15 nt, Human
aaauucuacaacaca

SEQ ID NO: 3355875 - RNA, 19 nt, Human
aaauucuauuacaguaugu

SEQ ID NO: 3355876 - RNA, 23 nt, Human
aaauuaugugccagauuuaugca

SEQ ID NO: 3355877 - RNA, 14 nt, Human
gugaaguuuacauu

SEQ ID NO: 3355878 - RNA, 19 nt, Human
gucuuauauauuguagaua

SEQ ID NO: 3355879 - RNA, 22 nt, Human
gucuuuccacuccuccuagcca

SEQ ID NO: 3355880 - RNA, 21 nt, Human
aacuaggugcauauuuauaaa

SEQ ID NO: 3355881 - RNA, 23 nt, Human
aacuauucaggagaguagaacag

SEQ ID NO: 3355882 - RNA, 12 nt, Human
aacuauggccug

SEQ ID NO: 3355883 - RNA, 19 nt, Human
aacugugaaguuuacauug

SEQ ID NO: 3355884 - RNA, 17 nt, Human
aacugugaaguuuacau

SEQ ID NO: 3355885 - RNA, 10 nt, Human
gugauguguc

SEQ ID NO: 3355886 - RNA, 23 nt, Human
aagaaagagcaacaauccaucuc

SEQ ID NO: 3355887 - RNA, 14 nt, Human
aagaaaacaacuuc

SEQ ID NO: 3355888 - RNA, 19 nt, Human
gugccagauuuaugcauau

SEQ ID NO: 3355889 - RNA, 19 nt, Human
aagaagugugucacccuua

SEQ ID NO: 3355890 - RNA, 15 nt, Human
gugcucuccaagccc

SEQ ID NO: 3355891 - RNA, 16 nt, Human
gugcucaggagcccug

SEQ ID NO: 3355892 - RNA, 18 nt, Human
gugcucaggagcccuggg

SEQ ID NO: 3355893 - RNA, 19 nt, Human
gugcucaggagcccuggga

SEQ ID NO: 3355894 - RNA, 12 nt, Human
aaguaaaugcua

SEQ ID NO: 3355895 - RNA, 21 nt, Human
aagucacuggccaguggcugg

SEQ ID NO: 3355896 - RNA, 18 nt, Human
aaguauguguaaaaugug

SEQ ID NO: 3355897 - RNA, 19 nt, Human
aaguauguguaaaauguga

SEQ ID NO: 3355898 - RNA, 17 nt, Human
guuuuaaaaugagaaau

SEQ ID NO: 3355899 - RNA, 21 nt, Human
uaaaaauauuguguugugaau

SEQ ID NO: 3355900 - RNA, 22 nt, Human
uaaaaagccugcaauuucauau

SEQ ID NO: 3355901 - RNA, 19 nt, Human
uaaaaagccugcaauuuca

SEQ ID NO: 3355902 - RNA, 14 nt, Human
uaaaaauauugugu

SEQ ID NO: 3355903 - RNA, 20 nt, Human
aagugugggucugugugugu

SEQ ID NO: 3355904 - RNA, 12 nt, Human
aaguguguguuu

SEQ ID NO: 3355905 - RNA, 10 nt, Human
aagugugggu

SEQ ID NO: 3355906 - RNA, 17 nt, Human
aagugugggucugugug

SEQ ID NO: 3355907 - RNA, 18 nt, Human
aagugugggucugugugu

SEQ ID NO: 3355908 - RNA, 21 nt, Human
aaguguguguuuuucauaaag

SEQ ID NO: 3355909 - RNA, 16 nt, Human
aaguguguguuuuuca

SEQ ID NO: 3355910 - RNA, 11 nt, Human
uaaaaugugaa

SEQ ID NO: 3355911 - RNA, 15 nt, Human
uaaaauugugaugug

SEQ ID NO: 3355912 - RNA, 16 nt, Human
uaaaauugugaugugu

SEQ ID NO: 3355913 - RNA, 13 nt, Human
uaaaaugugaagu

SEQ ID NO: 3355914 - RNA, 13 nt, Human
guguauguggggg

SEQ ID NO: 3355915 - RNA, 21 nt, Human
guguaugugggggucugugug

SEQ ID NO: 3355916 - RNA, 20 nt, Human
aagcaaaugugaaucauuuu

SEQ ID NO: 3355917 - RNA, 22 nt, Human
gugguucacucuuggagccugc

SEQ ID NO: 3355918 - RNA, 23 nt, Human
gugguucacucuuggagccugca

SEQ ID NO: 3355919 - RNA, 21 nt, Human
gugguucacucuuggagccug

SEQ ID NO: 3355920 - RNA, 15 nt, Human
guguaaaaugugaag

SEQ ID NO: 3355921 - RNA, 16 nt, Human
aagaggugugcaagag

SEQ ID NO: 3355922 - RNA, 18 nt, Human
aagaggugugcaagagag

SEQ ID NO: 3355923 - RNA, 23 nt, Human
aagcaugcacaaauucugucucu

SEQ ID NO: 3355924 - RNA, 16 nt, Human
aagcacuaaacaaaga

SEQ ID NO: 3355925 - RNA, 19 nt, Human
guuauuauauuuacaaaug

SEQ ID NO: 3355926 - RNA, 17 nt, Human
guuauuauauuuacaaa

SEQ ID NO: 3355927 - RNA, 18 nt, Human
guuauugauaaguucaua

SEQ ID NO: 3355928 - RNA, 21 nt, Human
guuauugauaaguucauacau

SEQ ID NO: 3355929 - RNA, 22 nt, Human
guuauugauaaguucauacauu

SEQ ID NO: 3355930 - RNA, 19 nt, Human
guuaauuccaauuauauga

SEQ ID NO: 3355931 - RNA, 12 nt, Human
guucagcuuggg

SEQ ID NO: 3355932 - RNA, 17 nt, Human
aagccuggucagcccaa

SEQ ID NO: 3355933 - RNA, 18 nt, Human
aagccuggucagcccaaa

SEQ ID NO: 3355934 - RNA, 18 nt, Human
aagccuguuuaagagaca

SEQ ID NO: 3355935 - RNA, 15 nt, Human
aagccuguuuaagag

SEQ ID NO: 3355936 - RNA, 19 nt, Human
guucuagcauggcauauuu

SEQ ID NO: 3355937 - RNA, 22 nt, Human
guucuagcauggcauauuuuuc

SEQ ID NO: 3355938 - RNA, 21 nt, Human
aagcuuuuaugugaaacaugu

SEQ ID NO: 3355939 - RNA, 19 nt, Human
aagcuuuuaugugaaacau

SEQ ID NO: 3355940 - RNA, 16 nt, Human
aagcuuuuaugugaaa

SEQ ID NO: 3355941 - RNA, 19 nt, Human
aaggaaaaaauaacaauga

SEQ ID NO: 3355942 - RNA, 13 nt, Human
caaccggcuuugu

SEQ ID NO: 3355943 - RNA, 22 nt, Human
caaccggcuuuguggcacuggg

SEQ ID NO: 3355944 - RNA, 13 nt, Human
caacacugccagc

SEQ ID NO: 3355945 - RNA, 14 nt, Human
caacacugccagca

SEQ ID NO: 3355946 - RNA, 12 nt, Human
caacacugccag

SEQ ID NO: 3355947 - RNA, 15 nt, Human
caagaaaacaacuuc

SEQ ID NO: 3355948 - RNA, 12 nt, Human
caacuuuguaua

SEQ ID NO: 3355949 - RNA, 14 nt, Human
caagaggcugcagc

SEQ ID NO: 3355950 - RNA, 16 nt, Human
caagaggcugcagcca

SEQ ID NO: 3355951 - RNA, 19 nt, Human
caauguagaggggaaaaga

SEQ ID NO: 3355952 - RNA, 16 nt, Human
caaaaauucucaguuc

SEQ ID NO: 3355953 - RNA, 19 nt, Human
caaagcugaugacaacuuc

SEQ ID NO: 3355954 - RNA, 20 nt, Human
caaagcgaauuuuaaaagau

SEQ ID NO: 3355955 - RNA, 14 nt, Human
caaagcgaauuuua

SEQ ID NO: 3355956 - RNA, 19 nt, Human
caaagcgaauuuuaaaaga

SEQ ID NO: 3355957 - RNA, 16 nt, Human
caaaauugauguguuu

SEQ ID NO: 3355958 - RNA, 15 nt, Human
caaaauugauguguu

SEQ ID NO: 3355959 - RNA, 22 nt, Human
caaaauugauguguuuauuuau

SEQ ID NO: 3355960 - RNA, 16 nt, Human
caaaauuguuacaaau

SEQ ID NO: 3355961 - RNA, 21 nt, Human
caaauuguaagcaugcacaaa

SEQ ID NO: 3355962 - RNA, 17 nt, Human
caaauuguaagcaugca

SEQ ID NO: 3355963 - RNA, 19 nt, Human
ucagaggguguccugcacc

SEQ ID NO: 3355964 - RNA, 22 nt, Human
ucagaguaauccaagcaaaugu

SEQ ID NO: 3355965 - RNA, 21 nt, Human
ucagaguaauccaagcaaaug

SEQ ID NO: 3355966 - RNA, 19 nt, Human
ucacugcuaagaauauuug

SEQ ID NO: 3355967 - RNA, 18 nt, Human
ucaggagcccugggaggc

SEQ ID NO: 3355968 - RNA, 19 nt, Human
ucaggagcccugggaggcu

SEQ ID NO: 3355969 - RNA, 20 nt, Human
ucaggaugauacacuaugaa

SEQ ID NO: 3355970 - RNA, 23 nt, Human
ucaggagcccugggaggcucugg

SEQ ID NO: 3355971 - RNA, 20 nt, Human
ucaggagcccugggaggcuc

SEQ ID NO: 3355972 - RNA, 14 nt, Human
uccagguggcauca

SEQ ID NO: 3355973 - RNA, 19 nt, Human
uccaaaauaauuuuaagaa

SEQ ID NO: 3355974 - RNA, 15 nt, Human
uccaaaauaauuuua

SEQ ID NO: 3355975 - RNA, 17 nt, Human
ucaucugacuaugacau

SEQ ID NO: 3355976 - RNA, 18 nt, Human
ucaucugacuaugacaua

SEQ ID NO: 3355977 - RNA, 14 nt, Human
ucauuccagaggaa

SEQ ID NO: 3355978 - RNA, 18 nt, Human
ucauugugaaauuauuca

SEQ ID NO: 3355979 - RNA, 17 nt, Human
ucauugugaaauuauuc

SEQ ID NO: 3355980 - RNA, 15 nt, Human
ucauugugaaauuau

SEQ ID NO: 3355981 - RNA, 12 nt, Human
ucauugugaaau

SEQ ID NO: 3355982 - RNA, 20 nt, Human
ucaaauuguaagcaugcaca

SEQ ID NO: 3355983 - RNA, 17 nt, Human
ucaaauuguaagcaugc

SEQ ID NO: 3355984 - RNA, 21 nt, Human
ucaaauauauucagccuggcu

SEQ ID NO: 3355985 - RNA, 23 nt, Human
ucaaauauauucagccuggcuuc

SEQ ID NO: 3355986 - RNA, 22 nt, Human
ucaaauauauucagccuggcuu

SEQ ID NO: 3355987 - RNA, 14 nt, Human
ucaaaaaacuugua

SEQ ID NO: 3355988 - RNA, 15 nt, Human
ucaaaaaacuuguaa

SEQ ID NO: 3355989 - RNA, 22 nt, Human
uauuuuuuucugaauuauuuuc

SEQ ID NO: 3355990 - RNA, 17 nt, Human
uauuuuauguugcauag

SEQ ID NO: 3355991 - RNA, 14 nt, Human
uauuguguugugaa

SEQ ID NO: 3355992 - RNA, 24 nt, Human
uauuuauaaaaauaaaaaacacug

SEQ ID NO: 3355993 - RNA, 12 nt, Human
uauucccaugag

SEQ ID NO: 3355994 - RNA, 19 nt, Human
uauucuagcuaauguaaua

SEQ ID NO: 3355995 - RNA, 15 nt, Human
uauucuaaauuuuau

SEQ ID NO: 3355996 - RNA, 19 nt, Human
uauucuaaauuuuauaucu

SEQ ID NO: 3355997 - RNA, 20 nt, Human
uauucuaaauuuuauaucuu

SEQ ID NO: 3355998 - RNA, 14 nt, Human
uauucuaaauuuua

SEQ ID NO: 3355999 - RNA, 16 nt, Human
uauguugcauagaaua

SEQ ID NO: 3356000 - RNA, 13 nt, Human
uauguuucaaacu

SEQ ID NO: 3356001 - RNA, 15 nt, Human
uauguuucaaacuuu

SEQ ID NO: 3356002 - RNA, 16 nt, Human
uauguuucaaacuuug

SEQ ID NO: 3356003 - RNA, 12 nt, Human
uauguugcauag

SEQ ID NO: 3356004 - RNA, 12 nt, Human
uauuaauauauu

SEQ ID NO: 3356005 - RNA, 15 nt, Human
ucugccaggagacag

SEQ ID NO: 3356006 - RNA, 22 nt, Human
ucugucucuggauuauauuaug

SEQ ID NO: 3356007 - RNA, 17 nt, Human
ucuuaaccagaucauug

SEQ ID NO: 3356008 - RNA, 16 nt, Human
ucuuaaccagaucauu

SEQ ID NO: 3356009 - RNA, 22 nt, Human
ucuuaaccagaucauugugaaa

SEQ ID NO: 3356010 - RNA, 19 nt, Human
ucuucaucugacuaugaca

SEQ ID NO: 3356011 - RNA, 13 nt, Human
ucuugaaaaaugc

SEQ ID NO: 3356012 - RNA, 14 nt, Human
ucucugcagguccc

SEQ ID NO: 3356013 - RNA, 13 nt, Human
ucucugcaggucc

SEQ ID NO: 3356014 - RNA, 16 nt, Human
ucucugcaggucccua

SEQ ID NO: 3356015 - RNA, 15 nt, Human
ucucugcaggucccu

SEQ ID NO: 3356016 - RNA, 21 nt, Human
ucuccuggaagugcuaauuuu

SEQ ID NO: 3356017 - RNA, 14 nt, Human
ucugaaaauugaug

SEQ ID NO: 3356018 - RNA, 22 nt, Human
ucugaaaauugaugggauuugg

SEQ ID NO: 3356019 - RNA, 15 nt, Human
ucugacauaaguauu

SEQ ID NO: 3356020 - RNA, 16 nt, Human
ucccuccucugcccgg

SEQ ID NO: 3356021 - RNA, 11 nt, Human
ucccuccuggg

SEQ ID NO: 3356022 - RNA, 19 nt, Human
ucccuccugggaaugaagc

SEQ ID NO: 3356023 - RNA, 15 nt, Human
ucccucuacugggag

SEQ ID NO: 3356024 - RNA, 16 nt, Human
ucccuaauaaagcugu

SEQ ID NO: 3356025 - RNA, 21 nt, Human
ucccgggacaccuaggcuagg

SEQ ID NO: 3356026 - RNA, 15 nt, Human
ucccuaauaaagcug

SEQ ID NO: 3356027 - RNA, 14 nt, Human
ucccuaauaaagcu

SEQ ID NO: 3356028 - RNA, 13 nt, Human
ucccugccuggac

SEQ ID NO: 3356029 - RNA, 23 nt, Human
ucccugccugguccucacacuca

SEQ ID NO: 3356030 - RNA, 16 nt, Human
ucccuuccuuccucuc

SEQ ID NO: 3356031 - RNA, 19 nt, Human
ucccuuccuuccucuccug

SEQ ID NO: 3356032 - RNA, 20 nt, Human
uccuaauaaucauuggauuc

SEQ ID NO: 3356033 - RNA, 14 nt, Human
ucgugucuggcaca

SEQ ID NO: 3356034 - RNA, 21 nt, Human
ucgugucuggcacagccuggc

SEQ ID NO: 3356035 - RNA, 22 nt, Human
ucuaugauuccagguggcauca

SEQ ID NO: 3356036 - RNA, 18 nt, Human
ugauuuuuaugccaccug

SEQ ID NO: 3356037 - RNA, 18 nt, Human
ugcaacuuuguauaaaag

SEQ ID NO: 3356038 - RNA, 20 nt, Human
ugcaauuucauaugcuguau

SEQ ID NO: 3356039 - RNA, 14 nt, Human
ugcaauuucauaug

SEQ ID NO: 3356040 - RNA, 22 nt, Human
ugcaauguagaggggaaaagag

SEQ ID NO: 3356041 - RNA, 17 nt, Human
ugcaaugguuaacaucu

SEQ ID NO: 3356042 - RNA, 18 nt, Human
ugcccgggagcucaggaa

SEQ ID NO: 3356043 - RNA, 17 nt, Human
ugcccgggagcucagga

SEQ ID NO: 3356044 - RNA, 17 nt, Human
ugcccagaaugaggcug

SEQ ID NO: 3356045 - RNA, 18 nt, Human
ugcccagaaugaggcugc

SEQ ID NO: 3356046 - RNA, 16 nt, Human
ugccaucauguuuaca

SEQ ID NO: 3356047 - RNA, 22 nt, Human
ugccaucauguuuacagaggac

SEQ ID NO: 3356048 - RNA, 21 nt, Human
ugcauuauauuuguaaauuua

SEQ ID NO: 3356049 - RNA, 21 nt, Human
ugacccucaucuuucuuccaa

SEQ ID NO: 3356050 - RNA, 19 nt, Human
ucuugaaggaaaaugauac

SEQ ID NO: 3356051 - RNA, 16 nt, Human
ucuugaauaauguaag

SEQ ID NO: 3356052 - RNA, 13 nt, Human
ugagaaaucuaaa

SEQ ID NO: 3356053 - RNA, 17 nt, Human
ugagaaaucuaaaaaac

SEQ ID NO: 3356054 - RNA, 23 nt, Human
ugauauaaguguguguuuuucau

SEQ ID NO: 3356055 - RNA, 17 nt, Human
ugauauaaguguguguu

SEQ ID NO: 3356056 - RNA, 23 nt, Human
ugaugcuacaggauuugaaauug

SEQ ID NO: 3356057 - RNA, 13 nt, Human
ugauguauucuag

SEQ ID NO: 3356058 - RNA, 20 nt, Human
ugauguauucuagcuaaugu

SEQ ID NO: 3356059 - RNA, 14 nt, Human
ugauguauucuagc

SEQ ID NO: 3356060 - RNA, 21 nt, Human
ugaugguuguacauauaagug

SEQ ID NO: 3356061 - RNA, 13 nt, Human
ugauguacaugua

SEQ ID NO: 3356062 - RNA, 14 nt, Human
ugaugaaaauauuu

SEQ ID NO: 3356063 - RNA, 14 nt, Human
ugaguuggcuggga

SEQ ID NO: 3356064 - RNA, 16 nt, Human
ugaguuggcugggaau

SEQ ID NO: 3356065 - RNA, 17 nt, Human
ugaguuggcugggaaua

SEQ ID NO: 3356066 - RNA, 19 nt, Human
ugagguggaagagggcugc

SEQ ID NO: 3356067 - RNA, 16 nt, Human
ugaggcugcuuuccaa

SEQ ID NO: 3356068 - RNA, 20 nt, Human
ugaggcugcuuuccaaagcc

SEQ ID NO: 3356069 - RNA, 23 nt, Human
ugaggcugcuuuccaaagccaau

SEQ ID NO: 3356070 - RNA, 13 nt, Human
uguccucagcccc

SEQ ID NO: 3356071 - RNA, 18 nt, Human
uguccugcaccggggccu

SEQ ID NO: 3356072 - RNA, 13 nt, Human
uguaugcuucaua

SEQ ID NO: 3356073 - RNA, 14 nt, Human
uguaugcuucauac

SEQ ID NO: 3356074 - RNA, 16 nt, Human
uguaugcuucauacag

SEQ ID NO: 3356075 - RNA, 19 nt, Human
uguaugcuucauacaggga

SEQ ID NO: 3356076 - RNA, 14 nt, Human
uguagcuuuaucaa

SEQ ID NO: 3356077 - RNA, 15 nt, Human
uguagcuuuaucaaa

SEQ ID NO: 3356078 - RNA, 20 nt, Human
ugguuguacauauaagugau

SEQ ID NO: 3356079 - RNA, 17 nt, Human
uguaaauuuaugugaug

SEQ ID NO: 3356080 - RNA, 22 nt, Human
uguaauaacugugaaguuuaca

SEQ ID NO: 3356081 - RNA, 14 nt, Human
uguaauaacuguga

SEQ ID NO: 3356082 - RNA, 17 nt, Human
uguaaugaaaaccacau

SEQ ID NO: 3356083 - RNA, 11 nt, Human
uguaaugaaaa

SEQ ID NO: 3356084 - RNA, 13 nt, Human
uguaaugaaaacc

SEQ ID NO: 3356085 - RNA, 12 nt, Human
uguaaugaaaac

SEQ ID NO: 3356086 - RNA, 15 nt, Human
ugguuccagccugcc

SEQ ID NO: 3356087 - RNA, 16 nt, Human
ugguuccagccugcca

SEQ ID NO: 3356088 - RNA, 16 nt, Human
uggccuaaccugccga

SEQ ID NO: 3356089 - RNA, 14 nt, Human
uggccccugagauc

SEQ ID NO: 3356090 - RNA, 23 nt, Human
uggccuaaccugccgagagucca

SEQ ID NO: 3356091 - RNA, 15 nt, Human
uggcuccaggccagg

SEQ ID NO: 3356092 - RNA, 21 nt, Human
uggcuugaguuuaaauuguaa

SEQ ID NO: 3356093 - RNA, 14 nt, Human
ugggaaugaagcaa

SEQ ID NO: 3356094 - RNA, 14 nt, Human
ugggaggagggcag

SEQ ID NO: 3356095 - RNA, 17 nt, Human
ugggaggagggcaggca

SEQ ID NO: 3356096 - RNA, 18 nt, Human
ugggaggagggcaggcau

SEQ ID NO: 3356097 - RNA, 13 nt, Human
ugggaguguguaa

SEQ ID NO: 3356098 - RNA, 17 nt, Human
uggggggcuucauacac

SEQ ID NO: 3356099 - RNA, 17 nt, Human
uggggccaggcuggguc

SEQ ID NO: 3356100 - RNA, 17 nt, Human
uggagacacaacuauuu

SEQ ID NO: 3356101 - RNA, 19 nt, Human
uggaucaaauccagccugc

SEQ ID NO: 3356102 - RNA, 12 nt, Human
ugcuuguguuaa

SEQ ID NO: 3356103 - RNA, 15 nt, Human
ugcuuguguuaagua

SEQ ID NO: 3356104 - RNA, 17 nt, Human
ugcuuuggaaaacccag

SEQ ID NO: 3356105 - RNA, 16 nt, Human
uggaaaagccaagagg

SEQ ID NO: 3356106 - RNA, 19 nt, Human
uggaaaagccaagaggcug

SEQ ID NO: 3356107 - RNA, 19 nt, Human
uuuccaaccggcuuugugg

SEQ ID NO: 3356108 - RNA, 19 nt, Human
uuuaacucuauaauguguu

SEQ ID NO: 3356109 - RNA, 23 nt, Human
uuuauaaaaauaaaaaacacugg

SEQ ID NO: 3356110 - RNA, 21 nt, Human
uuuauaaaaauaaaaaacacu

SEQ ID NO: 3356111 - RNA, 20 nt, Human
uuuacauuguaaauaguauu

SEQ ID NO: 3356112 - RNA, 13 nt, Human
uuguguugugaau

SEQ ID NO: 3356113 - RNA, 17 nt, Human
uuguaaauaguauuuga

SEQ ID NO: 3356114 - RNA, 21 nt, Human
uuguauucagaguugaugguu

SEQ ID NO: 3356115 - RNA, 19 nt, Human
uuguacgaagaguauuuuu

SEQ ID NO: 3356116 - RNA, 21 nt, Human
uuguacgaagaguauuuuuga

SEQ ID NO: 3356117 - RNA, 23 nt, Human
uuguacgaagaguauuuuugaca

SEQ ID NO: 3356118 - RNA, 19 nt, Human
uugacaaagucaagccaca

SEQ ID NO: 3356119 - RNA, 20 nt, Human
uugacaaagucaagccacau

SEQ ID NO: 3356120 - RNA, 13 nt, Human
uugaaaagaggug

SEQ ID NO: 3356121 - RNA, 14 nt, Human
uugaaaagaggugu

SEQ ID NO: 3356122 - RNA, 21 nt, Human
uugaaaagaggugugcaagag

SEQ ID NO: 3356123 - RNA, 17 nt, Human
uucuuccaaaaagauuu

SEQ ID NO: 3356124 - RNA, 18 nt, Human
uucugcuuguguuaagua

SEQ ID NO: 3356125 - RNA, 21 nt, Human
uuccugaggaagagggacugu

SEQ ID NO: 3356126 - RNA, 18 nt, Human
uucggugagcuacaaaug

SEQ ID NO: 3356127 - RNA, 22 nt, Human
uucuacauaaguaauucaagaa

SEQ ID NO: 3356128 - RNA, 14 nt, Human
uucuauaauuuaaa

SEQ ID NO: 3356129 - RNA, 14 nt, Human
uucuauagcuuuuc

SEQ ID NO: 3356130 - RNA, 13 nt, Human
uucugagagcugu

SEQ ID NO: 3356131 - RNA, 19 nt, Human
uucugagagcugugcauca

SEQ ID NO: 3356132 - RNA, 17 nt, Human
uuauguugcauagaaua

SEQ ID NO: 3356133 - RNA, 16 nt, Human
uuaucuugaauaaugu

SEQ ID NO: 3356134 - RNA, 14 nt, Human
uuaucuugaauaau

SEQ ID NO: 3356135 - RNA, 16 nt, Human
uuauauuuacaaaugg

SEQ ID NO: 3356136 - RNA, 16 nt, Human
uuauauuaugaagcuu

SEQ ID NO: 3356137 - RNA, 22 nt, Human
uuauaucuuguagcuuuaucaa

SEQ ID NO: 3356138 - RNA, 15 nt, Human
uuauaucuuguagcu

SEQ ID NO: 3356139 - RNA, 22 nt, Human
uuauacaggucauauuaauaua

SEQ ID NO: 3356140 - RNA, 14 nt, Human
uuauacaggucaua

SEQ ID NO: 3356141 - RNA, 21 nt, Human
uuauaauuuuaaauguuuuuu

SEQ ID NO: 3356142 - RNA, 17 nt, Human
uuauaauuuuaaauguu

SEQ ID NO: 3356143 - RNA, 12 nt, Human
uuauaauuuaaa

SEQ ID NO: 3356144 - RNA, 12 nt, Human
uuauaauuuuaa

SEQ ID NO: 3356145 - RNA, 13 nt, Human
uuauuuuaaaaga

SEQ ID NO: 3356146 - RNA, 16 nt, Human
uucaauaauaaauauu

SEQ ID NO: 3356147 - RNA, 14 nt, Human
uuauuuuguucaua

SEQ ID NO: 3356148 - RNA, 21 nt, Human
uuccaaaaagauuuucagaaa

SEQ ID NO: 3356149 - RNA, 20 nt, Human
uucaucugacuaugacauaa

SEQ ID NO: 3356150 - RNA, 23 nt, Human
uucaguuauuauauuuacaaaug

SEQ ID NO: 3356151 - RNA, 20 nt, Human
uucauaaauaaaguuuguug

SEQ ID NO: 3356152 - RNA, 13 nt, Human
uucagcuugggga

SEQ ID NO: 3356153 - RNA, 21 nt, Human
uuuuauuuuucucaugaugag

SEQ ID NO: 3356154 - RNA, 19 nt, Human
uuuuacguccaucucuugu

SEQ ID NO: 3356155 - RNA, 21 nt, Human
uuuuaaaguaacccuacaaaa

SEQ ID NO: 3356156 - RNA, 23 nt, Human
uuuucagaaaauauuauguguuu

SEQ ID NO: 3356157 - RNA, 16 nt, Human
uuuucacauaucuagu

SEQ ID NO: 3356158 - RNA, 21 nt, Human
uuuucaaaauuguuacaaauu

SEQ ID NO: 3356159 - RNA, 22 nt, Human
uuuucagaaaauauuauguguu

SEQ ID NO: 3356160 - RNA, 21 nt, Human
uuuucuuaaccagaucauugu

SEQ ID NO: 3356161 - RNA, 15 nt, Human
uuuggucaacacuaa

SEQ ID NO: 3356162 - RNA, 14 nt, Human
uuuuaaaauccacu

SEQ ID NO: 3356163 - RNA, 23 nt, Human
uuuuaaaauccacuuuaucuuga

SEQ ID NO: 3356164 - RNA, 18 nt, Human
uuugcauaacguauaaaa

SEQ ID NO: 3356165 - RNA, 23 nt, Human
uuuugacagaauauguuucaaac

SEQ ID NO: 3356166 - RNA, 22 nt, Human
uuuugacagaauauguuucaaa

SEQ ID NO: 3356167 - RNA, 11 nt, Human
uuuugacagaa

SEQ ID NO: 3356168 - RNA, 13 nt, Human
uuuuuaaucuuua

SEQ ID NO: 3356169 - RNA, 14 nt, Human
cauucuuucccaac

SEQ ID NO: 3356170 - RNA, 12 nt, Human
cauucuuuccca

SEQ ID NO: 3356171 - RNA, 13 nt, Human
cauucuggaauaa

SEQ ID NO: 3356172 - RNA, 14 nt, Human
cauuccagaggaag

SEQ ID NO: 3356173 - RNA, 13 nt, Human
cauuccagaggaa

SEQ ID NO: 3356174 - RNA, 19 nt, Human
cauucauuuucuggguguu

SEQ ID NO: 3356175 - RNA, 19 nt, Human
cauuguacgaagaguauuu

SEQ ID NO: 3356176 - RNA, 23 nt, Human
cauuuuaccuuugacaaagguaa

SEQ ID NO: 3356177 - RNA, 17 nt, Human
ccaaaccaccagaagcc

SEQ ID NO: 3356178 - RNA, 16 nt, Human
caugugacucuuucca

SEQ ID NO: 3356179 - RNA, 17 nt, Human
caugugacucuuuccaa

SEQ ID NO: 3356180 - RNA, 14 nt, Human
caugugacucuuuc

SEQ ID NO: 3356181 - RNA, 21 nt, Human
cauuaaaaaaucaguuguaca

SEQ ID NO: 3356182 - RNA, 15 nt, Human
cauggcauauuuuuc

SEQ ID NO: 3356183 - RNA, 19 nt, Human
cauggcauauuuuucacau

SEQ ID NO: 3356184 - RNA, 23 nt, Human
cauggcauauuuuucacauaucu

SEQ ID NO: 3356185 - RNA, 13 nt, Human
cauggcauauuuu

SEQ ID NO: 3356186 - RNA, 13 nt, Human
cauccagaguccc

SEQ ID NO: 3356187 - RNA, 17 nt, Human
cauccagagucccugcc

SEQ ID NO: 3356188 - RNA, 18 nt, Human
cauccagagucccugccu

SEQ ID NO: 3356189 - RNA, 20 nt, Human
cauccagagucccugccugg

SEQ ID NO: 3356190 - RNA, 13 nt, Human
caucccuccuggg

SEQ ID NO: 3356191 - RNA, 19 nt, Human
caucauguuuacagaggac

SEQ ID NO: 3356192 - RNA, 21 nt, Human
caucauguuuacagaggacag

SEQ ID NO: 3356193 - RNA, 13 nt, Human
caucauguuuaca

SEQ ID NO: 3356194 - RNA, 21 nt, Human
cauaucuaguaugaaauuaua

SEQ ID NO: 3356195 - RNA, 13 nt, Human
cauauuguuacug

SEQ ID NO: 3356196 - RNA, 19 nt, Human
cauauuguuacugguacca

SEQ ID NO: 3356197 - RNA, 16 nt, Human
cauagguuuaauaauu

SEQ ID NO: 3356198 - RNA, 16 nt, Human
cauauaagugauugcu

SEQ ID NO: 3356199 - RNA, 17 nt, Human
cauaucuaguaugaaau

SEQ ID NO: 3356200 - RNA, 18 nt, Human
cauaucuaguaugaaauu

SEQ ID NO: 3356201 - RNA, 15 nt, Human
cauaucuaguaugaa

SEQ ID NO: 3356202 - RNA, 15 nt, Human
cauccuacccccugu

SEQ ID NO: 3356203 - RNA, 18 nt, Human
cauccuacccccugugcc

SEQ ID NO: 3356204 - RNA, 17 nt, Human
caucugacuaugacaua

SEQ ID NO: 3356205 - RNA, 16 nt, Human
caucucuuguuuaaau

SEQ ID NO: 3356206 - RNA, 23 nt, Human
caugagcuccuuaaggcucuuuu

SEQ ID NO: 3356207 - RNA, 19 nt, Human
caugaguuggcugggaaua

SEQ ID NO: 3356208 - RNA, 18 nt, Human
caugagauaauaugcaga

SEQ ID NO: 3356209 - RNA, 22 nt, Human
ccacucaugugacucuuuccaa

SEQ ID NO: 3356210 - RNA, 19 nt, Human
ccacucaugugacucuuuc

SEQ ID NO: 3356211 - RNA, 22 nt, Human
ccacuaaaagaucgcaguuugc

SEQ ID NO: 3356212 - RNA, 20 nt, Human
ccaccugaauaaagaaugaa

SEQ ID NO: 3356213 - RNA, 15 nt, Human
ccacccuccacucuc

SEQ ID NO: 3356214 - RNA, 20 nt, Human
ccaaaccaccagaagcccag

SEQ ID NO: 3356215 - RNA, 22 nt, Human
ccacacugauccagcccugagu

SEQ ID NO: 3356216 - RNA, 19 nt, Human
ccacacugauccagcccug

SEQ ID NO: 3356217 - RNA, 22 nt, Human
ccaccaagccuggucagcccaa

SEQ ID NO: 3356218 - RNA, 21 nt, Human
ccaccaagccuggucagccca

SEQ ID NO: 3356219 - RNA, 16 nt, Human
ccagcauuucccuucc

SEQ ID NO: 3356220 - RNA, 21 nt, Human
ccagcauuucccuuccuuccu

SEQ ID NO: 3356221 - RNA, 23 nt, Human
ccagcauaauacuugcuuuggaa

SEQ ID NO: 3356222 - RNA, 20 nt, Human
ccacuguacuugcucuugau

SEQ ID NO: 3356223 - RNA, 19 nt, Human
ccacuguacuugcucuuga

SEQ ID NO: 3356224 - RNA, 18 nt, Human
ccacuguacuugcucuug

SEQ ID NO: 3356225 - RNA, 17 nt, Human
ccacuguacuugcucuu

SEQ ID NO: 3356226 - RNA, 18 nt, Human
ccagacccccuggagacu

SEQ ID NO: 3356227 - RNA, 12 nt, Human
ccagacccccug

SEQ ID NO: 3356228 - RNA, 16 nt, Human
ccagacccccuggaga

SEQ ID NO: 3356229 - RNA, 22 nt, Human
ccagauuuaugcauauuauuuu

SEQ ID NO: 3356230 - RNA, 13 nt, Human
ccagauuuaugca

SEQ ID NO: 3356231 - RNA, 13 nt, Human
ccaggagacaggu

SEQ ID NO: 3356232 - RNA, 19 nt, Human
ccaggccagggggccaguc

SEQ ID NO: 3356233 - RNA, 18 nt, Human
ccauccuacccccugugc

SEQ ID NO: 3356234 - RNA, 17 nt, Human
ccauccuacccccugug

SEQ ID NO: 3356235 - RNA, 21 nt, Human
cccaaaacaccggguuccagc

SEQ ID NO: 3356236 - RNA, 19 nt, Human
cccaaaacaccggguucca

SEQ ID NO: 3356237 - RNA, 14 nt, Human
ccugggcaggaggg

SEQ ID NO: 3356238 - RNA, 12 nt, Human
ccugggcaggag

SEQ ID NO: 3356239 - RNA, 14 nt, Human
ccuggucagcccaa

SEQ ID NO: 3356240 - RNA, 12 nt, Human
ccuggucagccc

SEQ ID NO: 3356241 - RNA, 19 nt, Human
ccuggagacuaaccccacc

SEQ ID NO: 3356242 - RNA, 15 nt, Human
ccuggcuccaggcca

SEQ ID NO: 3356243 - RNA, 16 nt, Human
ccuggcuccaggccag

SEQ ID NO: 3356244 - RNA, 17 nt, Human
ccuggcuccaggccagg

SEQ ID NO: 3356245 - RNA, 18 nt, Human
ccugccugguccucacac

SEQ ID NO: 3356246 - RNA, 19 nt, Human
ccugaggaagagggacugu

SEQ ID NO: 3356247 - RNA, 19 nt, Human
ccugcaauuucauaugcug

SEQ ID NO: 3356248 - RNA, 22 nt, Human
ccugccacucaggcccaaagcc

SEQ ID NO: 3356249 - RNA, 23 nt, Human
ccugccacucaggcccaaagccu

SEQ ID NO: 3356250 - RNA, 14 nt, Human
ccugccagaccccc

SEQ ID NO: 3356251 - RNA, 14 nt, Human
ccugccacucaggc

SEQ ID NO: 3356252 - RNA, 15 nt, Human
cgagaucccaacacu

SEQ ID NO: 3356253 - RNA, 21 nt, Human
cgagaucccaacacugccagc

SEQ ID NO: 3356254 - RNA, 13 nt, Human
cgagaucccaaca

SEQ ID NO: 3356255 - RNA, 22 nt, Human
cgagaucccaacacugccagca

SEQ ID NO: 3356256 - RNA, 21 nt, Human
cgaagaguauuuuugacagaa

SEQ ID NO: 3356257 - RNA, 16 nt, Human
ccuuaaggcucuuuug

SEQ ID NO: 3356258 - RNA, 18 nt, Human
ccuuaaggcucuuuugua

SEQ ID NO: 3356259 - RNA, 13 nt, Human
ccuuaaggcucuu

SEQ ID NO: 3356260 - RNA, 15 nt, Human
ccuguuuaagagaca

SEQ ID NO: 3356261 - RNA, 12 nt, Human
ccuguuuaagag

SEQ ID NO: 3356262 - RNA, 15 nt, Human
ccuugucacgccaga

SEQ ID NO: 3356263 - RNA, 18 nt, Human
ccuugucacgccagacuu

SEQ ID NO: 3356264 - RNA, 13 nt, Human
ccuugaacuagga

SEQ ID NO: 3356265 - RNA, 15 nt, Human
ccuucugugaaagua

SEQ ID NO: 3356266 - RNA, 16 nt, Human
ccuuccaagagccuga

SEQ ID NO: 3356267 - RNA, 17 nt, Human
ccuuccaagagccugag

SEQ ID NO: 3356268 - RNA, 15 nt, Human
ccuuccaagagccug

SEQ ID NO: 3356269 - RNA, 18 nt, Human
ccucuccacucaugugac

SEQ ID NO: 3356270 - RNA, 18 nt, Human
ccucucauuccagaggaa

SEQ ID NO: 3356271 - RNA, 21 nt, Human
ccucaucuccccaucauuggu

SEQ ID NO: 3356272 - RNA, 16 nt, Human
ccuaggcuaggguggg

SEQ ID NO: 3356273 - RNA, 18 nt, Human
ccuaaauauauuuuaaga

SEQ ID NO: 3356274 - RNA, 16 nt, Human
ccuaaauauauuuuaa

SEQ ID NO: 3356275 - RNA, 15 nt, Human
ccgaggcagggaagg

SEQ ID NO: 3356276 - RNA, 20 nt, Human
ccgggacaccuaggcuaggg

SEQ ID NO: 3356277 - RNA, 19 nt, Human
ccgggacaccuaggcuagg

SEQ ID NO: 3356278 - RNA, 22 nt, Human
ccgggucaucuguaccucugcc

SEQ ID NO: 3356279 - RNA, 12 nt, Human
ccggguuccagc

SEQ ID NO: 3356280 - RNA, 15 nt, Human
ccggguuccagcacc

SEQ ID NO: 3356281 - RNA, 21 nt, Human
cccacaggagguggucuggga

SEQ ID NO: 3356282 - RNA, 16 nt, Human
cccacaggaggugguc

SEQ ID NO: 3356283 - RNA, 17 nt, Human
cccaccacacccucccu

SEQ ID NO: 3356284 - RNA, 15 nt, Human
cccuggacugugugc

SEQ ID NO: 3356285 - RNA, 13 nt, Human
cccugccagaccc

SEQ ID NO: 3356286 - RNA, 21 nt, Human
cccugccagacccccuggaga

SEQ ID NO: 3356287 - RNA, 13 nt, Human
cccuccaccugcu

SEQ ID NO: 3356288 - RNA, 23 nt, Human
cccuccacucuccucuuccaggc

SEQ ID NO: 3356289 - RNA, 14 nt, Human
cuggugguggcucg

SEQ ID NO: 3356290 - RNA, 22 nt, Human
cuggugguggcucgggaggcga

SEQ ID NO: 3356291 - RNA, 12 nt, Human
cuggugguucac

SEQ ID NO: 3356292 - RNA, 20 nt, Human
cuggugguucacucuuggag

SEQ ID NO: 3356293 - RNA, 21 nt, Human
cuggugguucacucuuggagc

SEQ ID NO: 3356294 - RNA, 23 nt, Human
cuggugguucacucuuggagccu

SEQ ID NO: 3356295 - RNA, 16 nt, Human
cugggggccucuucug

SEQ ID NO: 3356296 - RNA, 13 nt, Human
cugggucgcccug

SEQ ID NO: 3356297 - RNA, 15 nt, Human
cugggucgcccugga

SEQ ID NO: 3356298 - RNA, 23 nt, Human
cugggccccugccucucugcagg

SEQ ID NO: 3356299 - RNA, 20 nt, Human
cugggccccugccucucugc

SEQ ID NO: 3356300 - RNA, 19 nt, Human
cugggccccugccucucug

SEQ ID NO: 3356301 - RNA, 18 nt, Human
cuguggccuaaccugccg

SEQ ID NO: 3356302 - RNA, 24 nt, Human
cuguggaucaaauccagccugcug

SEQ ID NO: 3356303 - RNA, 14 nt, Human
cuguggaucaaauc

SEQ ID NO: 3356304 - RNA, 14 nt, Human
cugugugcucagga

SEQ ID NO: 3356305 - RNA, 18 nt, Human
cuguguguguguaugugg

SEQ ID NO: 3356306 - RNA, 20 nt, Human
cuguguguguguaugugggg

SEQ ID NO: 3356307 - RNA, 18 nt, Human
cuguguguuuaugugugu

SEQ ID NO: 3356308 - RNA, 20 nt, Human
cuguguguuuaugugugugu

SEQ ID NO: 3356309 - RNA, 15 nt, Human
cuguguguguguaug

SEQ ID NO: 3356310 - RNA, 16 nt, Human
cuguguguguguaugu

SEQ ID NO: 3356311 - RNA, 14 nt, Human
cuguguguguguau

SEQ ID NO: 3356312 - RNA, 18 nt, Human
cugugaaaguacauuugg

SEQ ID NO: 3356313 - RNA, 17 nt, Human
cugugcccacccuccac

SEQ ID NO: 3356314 - RNA, 23 nt, Human
cugugcccacccuccacucuccu

SEQ ID NO: 3356315 - RNA, 21 nt, Human
cugucuuuuuucuaaaguaaa

SEQ ID NO: 3356316 - RNA, 15 nt, Human
cuuaaggcucuuuug

SEQ ID NO: 3356317 - RNA, 17 nt, Human
cuuaaccagaucauugu

SEQ ID NO: 3356318 - RNA, 19 nt, Human
cuuccaaacaggcucagag

SEQ ID NO: 3356319 - RNA, 13 nt, Human
cuuucccaacacc

SEQ ID NO: 3356320 - RNA, 17 nt, Human
cuuucccaacaccucuu

SEQ ID NO: 3356321 - RNA, 19 nt, Human
cuuguguuaaguaugugua

SEQ ID NO: 3356322 - RNA, 18 nt, Human
cuuguaaaggaauuuaaa

SEQ ID NO: 3356323 - RNA, 19 nt, Human
cuuguaaaggaauuuaaaa

SEQ ID NO: 3356324 - RNA, 20 nt, Human
cuuggggacaggggcaggag

SEQ ID NO: 3356325 - RNA, 17 nt, Human
cuuggagguagcuuuga

SEQ ID NO: 3356326 - RNA, 18 nt, Human
gaaaaucuuauaauuuaa

SEQ ID NO: 3356327 - RNA, 19 nt, Human
gaaaaucuuauaauuuaaa

SEQ ID NO: 3356328 - RNA, 19 nt, Human
gaaaauaacgauaaaagac

SEQ ID NO: 3356329 - RNA, 19 nt, Human
gaaaauaacaauaaaagac

SEQ ID NO: 3356330 - RNA, 16 nt, Human
gaaacacuuugcauaa

SEQ ID NO: 3356331 - RNA, 22 nt, Human
gaaaacaauaacgauaaaagac

SEQ ID NO: 3356332 - RNA, 14 nt, Human
cuuuuuucuaaagu

SEQ ID NO: 3356333 - RNA, 20 nt, Human
cuuuuacguccaucucuugu

SEQ ID NO: 3356334 - RNA, 19 nt, Human
gaaggaucccaugagcucc

SEQ ID NO: 3356335 - RNA, 14 nt, Human
gaaggaaaaugaua

SEQ ID NO: 3356336 - RNA, 22 nt, Human
gaagggguaggauuacuaggug

SEQ ID NO: 3356337 - RNA, 22 nt, Human
gaagcuucuggugaccuuccaa

SEQ ID NO: 3356338 - RNA, 18 nt, Human
gaagcuuuuaugugaaac

SEQ ID NO: 3356339 - RNA, 10 nt, Human
gaagcccaga

SEQ ID NO: 3356340 - RNA, 12 nt, Human
gaagcccagaau

SEQ ID NO: 3356341 - RNA, 22 nt, Human
gaagccacgguguucugugaua

SEQ ID NO: 3356342 - RNA, 17 nt, Human
gaauaaagaaugaaugg

SEQ ID NO: 3356343 - RNA, 12 nt, Human
gaauaaaauuuu

SEQ ID NO: 3356344 - RNA, 17 nt, Human
gaaguuuacauuguaaa

SEQ ID NO: 3356345 - RNA, 16 nt, Human
gaaguuuacauuguaa

SEQ ID NO: 3356346 - RNA, 20 nt, Human
gaauaagugccaggauggaa

SEQ ID NO: 3356347 - RNA, 20 nt, Human
gaauaauccuaaacauauga

SEQ ID NO: 3356348 - RNA, 14 nt, Human
gaauacuuuauaaa

SEQ ID NO: 3356349 - RNA, 14 nt, Human
gaaugccuccugca

SEQ ID NO: 3356350 - RNA, 22 nt, Human
gaacucaucuagguaaauuaca

SEQ ID NO: 3356351 - RNA, 21 nt, Human
gaacuuguaaaggaauuuaaa

SEQ ID NO: 3356352 - RNA, 13 nt, Human
gaacuauuagagc

SEQ ID NO: 3356353 - RNA, 18 nt, Human
gaaauuguauuacaaauc

SEQ ID NO: 3356354 - RNA, 21 nt, Human
cucgagaucccaacacugcca

SEQ ID NO: 3356355 - RNA, 22 nt, Human
cucgagaucccaacacugccag

SEQ ID NO: 3356356 - RNA, 23 nt, Human
cucgagaucccaacacugccagc

SEQ ID NO: 3356357 - RNA, 13 nt, Human
cucgagaucccaa

SEQ ID NO: 3356358 - RNA, 12 nt, Human
cuccuccuagcc

SEQ ID NO: 3356359 - RNA, 13 nt, Human
cuccaccugcucu

SEQ ID NO: 3356360 - RNA, 23 nt, Human
cuccaccaagccuggucagccca

SEQ ID NO: 3356361 - RNA, 21 nt, Human
cuccaaugcuguuaucccugc

SEQ ID NO: 3356362 - RNA, 15 nt, Human
cucauaucaguuugc

SEQ ID NO: 3356363 - RNA, 12 nt, Human
cucaaauuugga

SEQ ID NO: 3356364 - RNA, 14 nt, Human
cuauuguagagcca

SEQ ID NO: 3356365 - RNA, 13 nt, Human
cucacauuuauau

SEQ ID NO: 3356366 - RNA, 13 nt, Human
cuauaauuuaaau

SEQ ID NO: 3356367 - RNA, 13 nt, Human
cuauggccugugg

SEQ ID NO: 3356368 - RNA, 13 nt, Human
cuaugagggccuu

SEQ ID NO: 3356369 - RNA, 16 nt, Human
cuaucuguuuacagug

SEQ ID NO: 3356370 - RNA, 15 nt, Human
cuaugagggccuuga

SEQ ID NO: 3356371 - RNA, 17 nt, Human
cuaugagggccuugagu

SEQ ID NO: 3356372 - RNA, 22 nt, Human
cuagguaaauuacaguuccuag

SEQ ID NO: 3356373 - RNA, 15 nt, Human
cuaggguggggagag

SEQ ID NO: 3356374 - RNA, 17 nt, Human
cugccuggaccagccuc

SEQ ID NO: 3356375 - RNA, 18 nt, Human
cugccucucugcaggucc

SEQ ID NO: 3356376 - RNA, 17 nt, Human
cugccucucugcagguc

SEQ ID NO: 3356377 - RNA, 16 nt, Human
cugccucucugcaggu

SEQ ID NO: 3356378 - RNA, 15 nt, Human
cugccucucugcagg

SEQ ID NO: 3356379 - RNA, 16 nt, Human
cugccacucaggccca

SEQ ID NO: 3356380 - RNA, 23 nt, Human
cugccacucaggcccaaagccuc

SEQ ID NO: 3356381 - RNA, 15 nt, Human
cugaguuccuagcca

SEQ ID NO: 3356382 - RNA, 16 nt, Human
cugaguuccuagccac

SEQ ID NO: 3356383 - RNA, 17 nt, Human
cugaguuccuagccacc

SEQ ID NO: 3356384 - RNA, 18 nt, Human
cugaguuccuagccaccg

SEQ ID NO: 3356385 - RNA, 13 nt, Human
cugauuguauuua

SEQ ID NO: 3356386 - RNA, 14 nt, Human
cucugcccgggagc

SEQ ID NO: 3356387 - RNA, 20 nt, Human
cucugcccgggagcucagga

SEQ ID NO: 3356388 - RNA, 20 nt, Human
cucugcaggucccuaauaaa

SEQ ID NO: 3356389 - RNA, 19 nt, Human
cucugcaggucccuaauaa

SEQ ID NO: 3356390 - RNA, 18 nt, Human
cucugcaggucccuaaua

SEQ ID NO: 3356391 - RNA, 21 nt, Human
cucugcaggucccuaauaaag

SEQ ID NO: 3356392 - RNA, 20 nt, Human
cucuggauuauauuaugaag

SEQ ID NO: 3356393 - RNA, 19 nt, Human
cucuggauuauauuaugaa

SEQ ID NO: 3356394 - RNA, 12 nt, Human
cugagcaggugu

SEQ ID NO: 3356395 - RNA, 16 nt, Human
gagucccugccuggac

SEQ ID NO: 3356396 - RNA, 14 nt, Human
gagucccugccugg

SEQ ID NO: 3356397 - RNA, 15 nt, Human
gagucccugccugga

SEQ ID NO: 3356398 - RNA, 14 nt, Human
gagucccugccauc

SEQ ID NO: 3356399 - RNA, 18 nt, Human
gaguauuuuugacagaau

SEQ ID NO: 3356400 - RNA, 14 nt, Human
gaguauuuuugaca

SEQ ID NO: 3356401 - RNA, 16 nt, Human
gaguauuuuugacaga

SEQ ID NO: 3356402 - RNA, 17 nt, Human
gaguauuuuugacagaa

SEQ ID NO: 3356403 - RNA, 22 nt, Human
gagguuuguuuagaagaagugu

SEQ ID NO: 3356404 - RNA, 13 nt, Human
gaguuccuagcca

SEQ ID NO: 3356405 - RNA, 21 nt, Human
gaguugaaaaucuuauaauuu

SEQ ID NO: 3356406 - RNA, 21 nt, Human
gauaaucagugugucuaaauu

SEQ ID NO: 3356407 - RNA, 17 nt, Human
gauauaaguguguguuu

SEQ ID NO: 3356408 - RNA, 21 nt, Human
gauauaaguguguguuuuuca

SEQ ID NO: 3356409 - RNA, 21 nt, Human
gaugccuggcgggguggggug

SEQ ID NO: 3356410 - RNA, 20 nt, Human
gauggcaaagaaggagagca

SEQ ID NO: 3356411 - RNA, 14 nt, Human
gaugacuauggaaa

SEQ ID NO: 3356412 - RNA, 13 nt, Human
gaugcauggagau

SEQ ID NO: 3356413 - RNA, 20 nt, Human
gaugcauggagauagcccca

SEQ ID NO: 3356414 - RNA, 17 nt, Human
gaugcaauguagagggg

SEQ ID NO: 3356415 - RNA, 13 nt, Human
gaucgcaguuugc

SEQ ID NO: 3356416 - RNA, 16 nt, Human
gaucuucaucugacua

SEQ ID NO: 3356417 - RNA, 18 nt, Human
gaucgcaguuugccuggu

SEQ ID NO: 3356418 - RNA, 23 nt, Human
gaucuucaucugacuaugacaua

SEQ ID NO: 3356419 - RNA, 21 nt, Human
gauguguccugauaagcugag

SEQ ID NO: 3356420 - RNA, 21 nt, Human
gauguggaaaagccaagaggc

SEQ ID NO: 3356421 - RNA, 23 nt, Human
gauguggaaaagccaagaggcug

SEQ ID NO: 3356422 - RNA, 22 nt, Human
gauuaagaucucagugguuaag

SEQ ID NO: 3356423 - RNA, 23 nt, Human
gagcucaggaaccgaggcaggga

SEQ ID NO: 3356424 - RNA, 22 nt, Human
gagcucaggaaccgaggcaggg

SEQ ID NO: 3356425 - RNA, 14 nt, Human
gagcuacaaaugca

SEQ ID NO: 3356426 - RNA, 12 nt, Human
gagcuacaaaug

SEQ ID NO: 3356427 - RNA, 13 nt, Human
gagcuacaaaugc

SEQ ID NO: 3356428 - RNA, 12 nt, Human
gagccugcagag

SEQ ID NO: 3356429 - RNA, 15 nt, Human
gagccugcagagcug

SEQ ID NO: 3356430 - RNA, 13 nt, Human
gaggagggcaggc

SEQ ID NO: 3356431 - RNA, 14 nt, Human
gaggagggcaggca

SEQ ID NO: 3356432 - RNA, 15 nt, Human
gaggagggcaggcau

SEQ ID NO: 3356433 - RNA, 15 nt, Human
gaggaugucugggcc

SEQ ID NO: 3356434 - RNA, 16 nt, Human
gccaccugaauaaaga

SEQ ID NO: 3356435 - RNA, 19 nt, Human
gccaccgccuccuacagcc

SEQ ID NO: 3356436 - RNA, 15 nt, Human
gccacgauugcagga

SEQ ID NO: 3356437 - RNA, 20 nt, Human
gccaaugugaacagcggcug

SEQ ID NO: 3356438 - RNA, 21 nt, Human
gcccaaaccaccagaagccca

SEQ ID NO: 3356439 - RNA, 22 nt, Human
gcccaaaccaccagaagcccag

SEQ ID NO: 3356440 - RNA, 23 nt, Human
gcccaaaccaccagaagcccaga

SEQ ID NO: 3356441 - RNA, 13 nt, Human
gccaggcuggguc

SEQ ID NO: 3356442 - RNA, 23 nt, Human
gcaggcaucggggagccgggagc

SEQ ID NO: 3356443 - RNA, 21 nt, Human
gcaggcaucggggagccggga

SEQ ID NO: 3356444 - RNA, 22 nt, Human
gcaggcaucggggagccgggag

SEQ ID NO: 3356445 - RNA, 15 nt, Human
gcaggucccuaauaa

SEQ ID NO: 3356446 - RNA, 14 nt, Human
gcaggucccuaaua

SEQ ID NO: 3356447 - RNA, 16 nt, Human
gcagugggccuggcca

SEQ ID NO: 3356448 - RNA, 15 nt, Human
gcagugggccuggcc

SEQ ID NO: 3356449 - RNA, 17 nt, Human
gcagugggccuggccag

SEQ ID NO: 3356450 - RNA, 19 nt, Human
gcaggucccuaauaaagcu

SEQ ID NO: 3356451 - RNA, 18 nt, Human
gcaggucccuaauaaagc

SEQ ID NO: 3356452 - RNA, 17 nt, Human
gcaggucccuaauaaag

SEQ ID NO: 3356453 - RNA, 16 nt, Human
gcaggucccuaauaaa

SEQ ID NO: 3356454 - RNA, 21 nt, Human
gcaggucccuaauaaagcugu

SEQ ID NO: 3356455 - RNA, 20 nt, Human
gcaggucccuaauaaagcug

SEQ ID NO: 3356456 - RNA, 23 nt, Human
gcaggucccuaauaaagcugugu

SEQ ID NO: 3356457 - RNA, 13 nt, Human
gcaggucccuaau

SEQ ID NO: 3356458 - RNA, 20 nt, Human
gcaucuagcaugucgucaaa

SEQ ID NO: 3356459 - RNA, 22 nt, Human
gcagauggaaugcuguguuaaa

SEQ ID NO: 3356460 - RNA, 18 nt, Human
gcaggaaauggcugugga

SEQ ID NO: 3356461 - RNA, 15 nt, Human
gcaccacacucagcc

SEQ ID NO: 3356462 - RNA, 17 nt, Human
gcaccacacucagcccu

SEQ ID NO: 3356463 - RNA, 19 nt, Human
gcuguggccuaaccugccg

SEQ ID NO: 3356464 - RNA, 20 nt, Human
gcuguggccuaaccugccga

SEQ ID NO: 3356465 - RNA, 16 nt, Human
gcugugugcucuccaa

SEQ ID NO: 3356466 - RNA, 16 nt, Human
gcuguguggcagucug

SEQ ID NO: 3356467 - RNA, 18 nt, Human
gcuguguuaaauaaaccu

SEQ ID NO: 3356468 - RNA, 21 nt, Human
gcugggaggagggcaggcauc

SEQ ID NO: 3356469 - RNA, 19 nt, Human
gcugggaggagggcaggca

SEQ ID NO: 3356470 - RNA, 22 nt, Human
gcugggcuuggcagcccggguc

SEQ ID NO: 3356471 - RNA, 14 nt, Human
gcuggggaugucuc

SEQ ID NO: 3356472 - RNA, 10 nt, Human
gcuucauaca

SEQ ID NO: 3356473 - RNA, 12 nt, Human
gcuuguguuaag

SEQ ID NO: 3356474 - RNA, 15 nt, Human
gcuuuuaugugaaac

SEQ ID NO: 3356475 - RNA, 13 nt, Human
gcuuuuaugugaa

SEQ ID NO: 3356476 - RNA, 14 nt, Human
gcuuuccaaagcca

SEQ ID NO: 3356477 - RNA, 14 nt, Human
gcugauuguauuua

SEQ ID NO: 3356478 - RNA, 15 nt, Human
gcucuccaagcccag

SEQ ID NO: 3356479 - RNA, 19 nt, Human
gcucuugaugccuggcggg

SEQ ID NO: 3356480 - RNA, 17 nt, Human
gcucuugaugccuggcg

SEQ ID NO: 3356481 - RNA, 15 nt, Human
gcuccuuaaggcucu

SEQ ID NO: 3356482 - RNA, 17 nt, Human
gcuccuuaaggcucuuu

SEQ ID NO: 3356483 - RNA, 21 nt, Human
gcuccuuaaggcucuuuugua

SEQ ID NO: 3356484 - RNA, 20 nt, Human
gcuccauuuuuagugaaaua

SEQ ID NO: 3356485 - RNA, 18 nt, Human
gcuccaggccagggggcc

SEQ ID NO: 3356486 - RNA, 17 nt, Human
gcuccaggccagggggc

SEQ ID NO: 3356487 - RNA, 17 nt, Human
gcuaucguaaaauuaag

SEQ ID NO: 3356488 - RNA, 16 nt, Human
gcuaucguaaaauuaa

SEQ ID NO: 3356489 - RNA, 15 nt, Human
gcuaucguaaaauua

SEQ ID NO: 3356490 - RNA, 18 nt, Human
gcucauggacuucugcca

SEQ ID NO: 3356491 - RNA, 17 nt, Human
gcgaagcguuguccuca

SEQ ID NO: 3356492 - RNA, 15 nt, Human
gcgaauuuuaaaaga

SEQ ID NO: 3356493 - RNA, 16 nt, Human
gcgaauuuuaaaagau

SEQ ID NO: 3356494 - RNA, 14 nt, Human
gcgaauuuuaaaag

SEQ ID NO: 3356495 - RNA, 15 nt, Human
gccuugucacgccag

SEQ ID NO: 3356496 - RNA, 16 nt, Human
gccuugucacgccaga

SEQ ID NO: 3356497 - RNA, 17 nt, Human
gccuugucacgccagac

SEQ ID NO: 3356498 - RNA, 16 nt, Human
gccugggcaggaggga

SEQ ID NO: 3356499 - RNA, 14 nt, Human
gccuggucagccca

SEQ ID NO: 3356500 - RNA, 15 nt, Human
gccuggucagcccaa

SEQ ID NO: 3356501 - RNA, 13 nt, Human
gccuggucagccc

SEQ ID NO: 3356502 - RNA, 17 nt, Human
gccuggaccagccucuc

SEQ ID NO: 3356503 - RNA, 16 nt, Human
gccuggaccagccucu

SEQ ID NO: 3356504 - RNA, 22 nt, Human
gccugcuuuuuauggccuguga

SEQ ID NO: 3356505 - RNA, 15 nt, Human
ggccuaaccugccga

SEQ ID NO: 3356506 - RNA, 16 nt, Human
ggccuaaccugccgag

SEQ ID NO: 3356507 - RNA, 20 nt, Human
ggccucucauuccagaggaa

SEQ ID NO: 3356508 - RNA, 15 nt, Human
ggccugggcaggagg

SEQ ID NO: 3356509 - RNA, 17 nt, Human
ggccugggcaggaggga

SEQ ID NO: 3356510 - RNA, 19 nt, Human
ggccugggcaggagggagg

SEQ ID NO: 3356511 - RNA, 16 nt, Human
ggccugacucucagca

SEQ ID NO: 3356512 - RNA, 16 nt, Human
ggcucuggagcccacu

SEQ ID NO: 3356513 - RNA, 19 nt, Human
ggcucuggagcccacugua

SEQ ID NO: 3356514 - RNA, 17 nt, Human
ggcucuggagcccacug

SEQ ID NO: 3356515 - RNA, 20 nt, Human
ggcugggaggagggcaggca

SEQ ID NO: 3356516 - RNA, 21 nt, Human
ggcugggaggagggcaggcau

SEQ ID NO: 3356517 - RNA, 13 nt, Human
ggcugggaggagg

SEQ ID NO: 3356518 - RNA, 23 nt, Human
ggcucuggagcccacuguacuug

SEQ ID NO: 3356519 - RNA, 13 nt, Human
ggcuggacuugga

SEQ ID NO: 3356520 - RNA, 18 nt, Human
ggcuggacuuggagguag

SEQ ID NO: 3356521 - RNA, 21 nt, Human
ggcuguggcauccagaguccc

SEQ ID NO: 3356522 - RNA, 23 nt, Human
ggcuguggcauccagagucccug

SEQ ID NO: 3356523 - RNA, 13 nt, Human
gggagccgggagc

SEQ ID NO: 3356524 - RNA, 12 nt, Human
gggagcucagga

SEQ ID NO: 3356525 - RNA, 22 nt, Human
gggagcucaggaaccgaggcag

SEQ ID NO: 3356526 - RNA, 23 nt, Human
gggagcucaggaaccgaggcagg

SEQ ID NO: 3356527 - RNA, 12 nt, Human
gggaggagggca

SEQ ID NO: 3356528 - RNA, 16 nt, Human
gggaggagggcaggca

SEQ ID NO: 3356529 - RNA, 20 nt, Human
gggacaccaagccuuggcuc

SEQ ID NO: 3356530 - RNA, 15 nt, Human
gggacugagaaauuu

SEQ ID NO: 3356531 - RNA, 21 nt, Human
ggagcucaggaaccgaggcag

SEQ ID NO: 3356532 - RNA, 17 nt, Human
ggagccugcagagcugc

SEQ ID NO: 3356533 - RNA, 16 nt, Human
ggagccuacccacccc

SEQ ID NO: 3356534 - RNA, 13 nt, Human
ggagcccugggag

SEQ ID NO: 3356535 - RNA, 20 nt, Human
ggagcccugggaggcucugg

SEQ ID NO: 3356536 - RNA, 19 nt, Human
ggagcccugggaggcucug

SEQ ID NO: 3356537 - RNA, 16 nt, Human
ggagcccugggaggcu

SEQ ID NO: 3356538 - RNA, 14 nt, Human
ggagggcaggcauc

SEQ ID NO: 3356539 - RNA, 17 nt, Human
ggaggcaggaguuucgu

SEQ ID NO: 3356540 - RNA, 12 nt, Human
ggaccagccucu

SEQ ID NO: 3356541 - RNA, 21 nt, Human
gcuuuuaugugaaacauguuu

SEQ ID NO: 3356542 - RNA, 20 nt, Human
gcuuuuaugugaaacauguu

SEQ ID NO: 3356543 - RNA, 19 nt, Human
gcuuuuaugugaaacaugu

SEQ ID NO: 3356544 - RNA, 19 nt, Human
ggagacagguuagcugcuc

SEQ ID NO: 3356545 - RNA, 18 nt, Human
ggacugagaaauuuauaa

SEQ ID NO: 3356546 - RNA, 14 nt, Human
ggacugagaaauuu

SEQ ID NO: 3356547 - RNA, 12 nt, Human
ggauuauauuau

SEQ ID NO: 3356548 - RNA, 16 nt, Human
ggauucugagagcugu

SEQ ID NO: 3356549 - RNA, 18 nt, Human
ggaugaugacuauggaaa

SEQ ID NO: 3356550 - RNA, 14 nt, Human
caccggggccuggg

SEQ ID NO: 3356551 - RNA, 21 nt, Human
caccggggccugggcaggagg

SEQ ID NO: 3356552 - RNA, 22 nt, Human
caccggggccugggcaggaggg

SEQ ID NO: 3356553 - RNA, 17 nt, Human
caccgccuccuacagcc

SEQ ID NO: 3356554 - RNA, 20 nt, Human
cacggcuccucgagauccca

SEQ ID NO: 3356555 - RNA, 22 nt, Human
cacggcuccucgagaucccaac

SEQ ID NO: 3356556 - RNA, 19 nt, Human
cacguguggccuguucuuc

SEQ ID NO: 3356557 - RNA, 13 nt, Human
cacuaaacaaaga

SEQ ID NO: 3356558 - RNA, 16 nt, Human
cacguaaugaaacuug

SEQ ID NO: 3356559 - RNA, 19 nt, Human
cacguaaugaaacuuggau

SEQ ID NO: 3356560 - RNA, 16 nt, Human
cacucaugugacucuu

SEQ ID NO: 3356561 - RNA, 22 nt, Human
cacucaugugacucuuuccaac

SEQ ID NO: 3356562 - RNA, 18 nt, Human
cacuccuccuagccaccc

SEQ ID NO: 3356563 - RNA, 13 nt, Human
cacuccuccuagc

SEQ ID NO: 3356564 - RNA, 16 nt, Human
cacuaacaugauuugg

SEQ ID NO: 3356565 - RNA, 14 nt, Human
cacuaugaagaugu

SEQ ID NO: 3356566 - RNA, 21 nt, Human
cacuaugaagauguuucaaaa

SEQ ID NO: 3356567 - RNA, 19 nt, Human
cacuguucugaaagugacu

SEQ ID NO: 3356568 - RNA, 18 nt, Human
cacuguacuugcucuuga

SEQ ID NO: 3356569 - RNA, 15 nt, Human
cacuguacuugcucu

SEQ ID NO: 3356570 - RNA, 19 nt, Human
cacuguacuugcucuugau

SEQ ID NO: 3356571 - RNA, 17 nt, Human
cacuggccccugagauc

SEQ ID NO: 3356572 - RNA, 18 nt, Human
cacugcuaagaauauuug

SEQ ID NO: 3356573 - RNA, 13 nt, Human
cacugacagauuu

SEQ ID NO: 3356574 - RNA, 11 nt, Human
cacugacagau

SEQ ID NO: 3356575 - RNA, 17 nt, Human
cacugacagauuuccau

SEQ ID NO: 3356576 - RNA, 22 nt, Human
cacugacagauuuccauccuag

SEQ ID NO: 3356577 - RNA, 14 nt, Human
cacugauccagccc

SEQ ID NO: 3356578 - RNA, 15 nt, Human
cacugauccagcccu

SEQ ID NO: 3356579 - RNA, 16 nt, Human
cacugauccagcccug

SEQ ID NO: 3356580 - RNA, 12 nt, Human
cagacuucccac

SEQ ID NO: 3356581 - RNA, 22 nt, Human
cagacuucccacggcuccucga

SEQ ID NO: 3356582 - RNA, 17 nt, Human
cagagaaaaagggaggg

SEQ ID NO: 3356583 - RNA, 18 nt, Human
cagagaaaaagggagggg

SEQ ID NO: 3356584 - RNA, 12 nt, Human
cagagaaaaagg

SEQ ID NO: 3356585 - RNA, 15 nt, Human
cagacccccuggaga

SEQ ID NO: 3356586 - RNA, 14 nt, Human
cagaaugaggcugc

SEQ ID NO: 3356587 - RNA, 15 nt, Human
cagaaugaggcugcu

SEQ ID NO: 3356588 - RNA, 19 nt, Human
cagaaaauauuauguguuu

SEQ ID NO: 3356589 - RNA, 12 nt, Human
cacuuugcauaa

SEQ ID NO: 3356590 - RNA, 12 nt, Human
cagaagcccaga

SEQ ID NO: 3356591 - RNA, 14 nt, Human
cagaagcccagaau

SEQ ID NO: 3356592 - RNA, 11 nt, Human
cagaagcccag

SEQ ID NO: 3356593 - RNA, 23 nt, Human
cagaaccccuggcuccaggccag

SEQ ID NO: 3356594 - RNA, 17 nt, Human
cagaaggaucuucaucu

SEQ ID NO: 3356595 - RNA, 14 nt, Human
cagagucccugccu

SEQ ID NO: 3356596 - RNA, 18 nt, Human
cagagucccugccuggac

SEQ ID NO: 3356597 - RNA, 23 nt, Human
cagaggcgcaugaauuugugaag

SEQ ID NO: 3356598 - RNA, 22 nt, Human
cagauaaagguucaugcaaacu

SEQ ID NO: 3356599 - RNA, 14 nt, Human
cagauaaucagugu

SEQ ID NO: 3356600 - RNA, 22 nt, Human
cagaggacaguauuugugggga

SEQ ID NO: 3356601 - RNA, 15 nt, Human
cagagcagugggccu

SEQ ID NO: 3356602 - RNA, 17 nt, Human
cagagcagugggccugg

SEQ ID NO: 3356603 - RNA, 20 nt, Human
cagagcagugggccuggcca

SEQ ID NO: 3356604 - RNA, 21 nt, Human
cagagcagugggccuggccag

SEQ ID NO: 3356605 - RNA, 22 nt, Human
cagagcagugggccuggccagc

SEQ ID NO: 3356606 - RNA, 15 nt, Human
cagcauuucccuucc

SEQ ID NO: 3356607 - RNA, 18 nt, Human
cagccaacuauggccugu

SEQ ID NO: 3356608 - RNA, 16 nt, Human
cagcccaccuggcuuu

SEQ ID NO: 3356609 - RNA, 20 nt, Human
cagcccaaaccaccagaagc

SEQ ID NO: 3356610 - RNA, 21 nt, Human
cagcccaaaccaccagaagcc

SEQ ID NO: 3356611 - RNA, 23 nt, Human
cagcccaaaccaccagaagccca

SEQ ID NO: 3356612 - RNA, 16 nt, Human
cagcccaaaccaccag

SEQ ID NO: 3356613 - RNA, 19 nt, Human
cagcccaaaccaccagaag

SEQ ID NO: 3356614 - RNA, 21 nt, Human
cagauggaaugcuguguuaaa

SEQ ID NO: 3356615 - RNA, 19 nt, Human
cagauggaaugcuguguua

SEQ ID NO: 3356616 - RNA, 17 nt, Human
cagauggaaugcugugu

SEQ ID NO: 3356617 - RNA, 16 nt, Human
cagauggaaugcugug

SEQ ID NO: 3356618 - RNA, 15 nt, Human
caggaaccgaggcag

SEQ ID NO: 3356619 - RNA, 17 nt, Human
caggaaccgaggcaggg

SEQ ID NO: 3356620 - RNA, 18 nt, Human
caggaaccgaggcaggga

SEQ ID NO: 3356621 - RNA, 22 nt, Human
cagcuggggccaggcugggucg

SEQ ID NO: 3356622 - RNA, 21 nt, Human
cagcuggggccaggcuggguc

SEQ ID NO: 3356623 - RNA, 20 nt, Human
cagcuggggccaggcugggu

SEQ ID NO: 3356624 - RNA, 19 nt, Human
cagcuggggccaggcuggg

SEQ ID NO: 3356625 - RNA, 18 nt, Human
cagcuggggccaggcugg

SEQ ID NO: 3356626 - RNA, 18 nt, Human
cagccuccauccuacccc

SEQ ID NO: 3356627 - RNA, 21 nt, Human
cagccuccauccuacccccug

SEQ ID NO: 3356628 - RNA, 18 nt, Human
cagcccugaguuccuagc

SEQ ID NO: 3356629 - RNA, 19 nt, Human
cagcccugaguuccuagcc

SEQ ID NO: 3356630 - RNA, 21 nt, Human
cagcccugaguuccuagccac

SEQ ID NO: 3356631 - RNA, 18 nt, Human
cagcccucauuggcucuu

SEQ ID NO: 3356632 - RNA, 23 nt, Human
cagccuggcuguggccuaaccug

SEQ ID NO: 3356633 - RNA, 23 nt, Human
cagccucuccacucaugugacuc

SEQ ID NO: 3356634 - RNA, 15 nt, Human
caggcucagagggug

SEQ ID NO: 3356635 - RNA, 11 nt, Human
caggcucagag

SEQ ID NO: 3356636 - RNA, 21 nt, Human
caggcugggucgcccuggacu

SEQ ID NO: 3356637 - RNA, 23 nt, Human
caggcugggucgcccuggacugu

SEQ ID NO: 3356638 - RNA, 23 nt, Human
caggcuuuuuuaucaugugaaau

SEQ ID NO: 3356639 - RNA, 13 nt, Human
cagggaaggaucc

SEQ ID NO: 3356640 - RNA, 18 nt, Human
cagggaaggaucccauga

SEQ ID NO: 3356641 - RNA, 14 nt, Human
caggggcaggagga

SEQ ID NO: 3356642 - RNA, 22 nt, Human
cagggggccagucccugaggca

SEQ ID NO: 3356643 - RNA, 20 nt, Human
caggcaucggggagccggga

SEQ ID NO: 3356644 - RNA, 21 nt, Human
caggcaucggggagccgggag

SEQ ID NO: 3356645 - RNA, 22 nt, Human
caggaugaugacuauggaaaga

SEQ ID NO: 3356646 - RNA, 20 nt, Human
caggaugaugacuauggaaa

SEQ ID NO: 3356647 - RNA, 18 nt, Human
caggaugaugacuaugga

SEQ ID NO: 3356648 - RNA, 21 nt, Human
caggcccccagaaccccuggc

SEQ ID NO: 3356649 - RNA, 21 nt, Human
caggccagggggccagucccu

SEQ ID NO: 3356650 - RNA, 23 nt, Human
caggagacagguuagcugcuccc

SEQ ID NO: 3356651 - RNA, 12 nt, Human
caggagaguaga

SEQ ID NO: 3356652 - RNA, 15 nt, Human
caggagucccugcca

SEQ ID NO: 3356653 - RNA, 21 nt, Human
caggagucccugccaucaugu

SEQ ID NO: 3356654 - RNA, 14 nt, Human
caggagucccugcc

SEQ ID NO: 3356655 - RNA, 21 nt, Human
caggagcccugggaggcucug

SEQ ID NO: 3356656 - RNA, 11 nt, Human
caggagcccug

SEQ ID NO: 3356657 - RNA, 19 nt, Human
caggagcccugggaggcuc

SEQ ID NO: 3356658 - RNA, 18 nt, Human
caggagcccugggaggcu

SEQ ID NO: 3356659 - RNA, 16 nt, Human
caggagcccugggagg

SEQ ID NO: 3356660 - RNA, 14 nt, Human
caggagcccuggga

SEQ ID NO: 3356661 - RNA, 19 nt, Human
caggaguuucguuuucaaa

SEQ ID NO: 3356662 - RNA, 12 nt, Human
cagguguucuuc

SEQ ID NO: 3356663 - RNA, 21 nt, Human
caggucauauuaauauauuuc

SEQ ID NO: 3356664 - RNA, 20 nt, Human
caggucauauuaauauauuu

SEQ ID NO: 3356665 - RNA, 13 nt, Human
cagguccccagac

SEQ ID NO: 3356666 - RNA, 18 nt, Human
cagguccccagcuuuggc

SEQ ID NO: 3356667 - RNA, 12 nt, Human
cagguccccaga

SEQ ID NO: 3356668 - RNA, 18 nt, Human
caggucccuaauaaagcu

SEQ ID NO: 3356669 - RNA, 17 nt, Human
caggucccuaauaaagc

SEQ ID NO: 3356670 - RNA, 16 nt, Human
caggucccuaauaaag

SEQ ID NO: 3356671 - RNA, 15 nt, Human
caggucccuaauaaa

SEQ ID NO: 3356672 - RNA, 14 nt, Human
caggucccuaauaa

SEQ ID NO: 3356673 - RNA, 13 nt, Human
caggucccuaaua

SEQ ID NO: 3356674 - RNA, 12 nt, Human
caggucccuaau

SEQ ID NO: 3356675 - RNA, 11 nt, Human
caggucccuaa

SEQ ID NO: 3356676 - RNA, 22 nt, Human
caggucccuaauaaagcugugu

SEQ ID NO: 3356677 - RNA, 21 nt, Human
caggucccuaauaaagcugug

SEQ ID NO: 3356678 - RNA, 20 nt, Human
caggucccuaauaaagcugu

SEQ ID NO: 3356679 - RNA, 19 nt, Human
caggucccuaauaaagcug

SEQ ID NO: 3356680 - RNA, 22 nt, Human
caguaguagccuccagguuucc

SEQ ID NO: 3356681 - RNA, 12 nt, Human
caguauguggaa

SEQ ID NO: 3356682 - RNA, 20 nt, Human
cagucccugaggcagguccc

SEQ ID NO: 3356683 - RNA, 23 nt, Human
cagucccugaggcagguccccag

SEQ ID NO: 3356684 - RNA, 14 nt, Human
cagucccugaggca

SEQ ID NO: 3356685 - RNA, 12 nt, Human
cagugaauucuu

SEQ ID NO: 3356686 - RNA, 22 nt, Human
cagucuuuaaucugagaggcca

SEQ ID NO: 3356687 - RNA, 16 nt, Human
cagugaaagaaaauaa

SEQ ID NO: 3356688 - RNA, 20 nt, Human
cagugaaagaaaauaacaau

SEQ ID NO: 3356689 - RNA, 11 nt, Human
gaaaugaaaaa

SEQ ID NO: 3356690 - RNA, 20 nt, Human
gaaaucuaugauuccaggug

SEQ ID NO: 3356691 - RNA, 18 nt, Human
gaaaucuaugauuccagg

SEQ ID NO: 3356692 - RNA, 18 nt, Human
gaaaacuuguauuaugug

SEQ ID NO: 3356693 - RNA, 22 nt, Human
gaaaacuuguauuauguguguu

SEQ ID NO: 3356694 - RNA, 19 nt, Human
gaaaacuuguauuaugugu

SEQ ID NO: 3356695 - RNA, 20 nt, Human
gaaaauuauuuuguucauac

SEQ ID NO: 3356696 - RNA, 21 nt, Human
gaaaauuauuuuguucauaca

SEQ ID NO: 3356697 - RNA, 22 nt, Human
gaaaauuauuuuguucauacau

SEQ ID NO: 3356698 - RNA, 22 nt, Human
gaaaagaaaucuaugauuccag

SEQ ID NO: 3356699 - RNA, 23 nt, Human
gaaaauuauuuuguucauacaua

SEQ ID NO: 3356700 - RNA, 18 nt, Human
gaaccccuggcuccaggc

SEQ ID NO: 3356701 - RNA, 22 nt, Human
gaaccccuggcuccaggccagg

SEQ ID NO: 3356702 - RNA, 15 nt, Human
gaacugagcuuggaa

SEQ ID NO: 3356703 - RNA, 16 nt, Human
gaacugagcuuggaag

SEQ ID NO: 3356704 - RNA, 21 nt, Human
gaacugagcuuggaagcuucu

SEQ ID NO: 3356705 - RNA, 22 nt, Human
gaacugagcuuggaagcuucug

SEQ ID NO: 3356706 - RNA, 14 nt, Human
gaacugagcuugga

SEQ ID NO: 3356707 - RNA, 13 nt, Human
cuuuguaaugaaa

SEQ ID NO: 3356708 - RNA, 16 nt, Human
cuuuguaaugaaaacc

SEQ ID NO: 3356709 - RNA, 15 nt, Human
cuuuguaaugaaaac

SEQ ID NO: 3356710 - RNA, 14 nt, Human
cuuuguaaugaaaa

SEQ ID NO: 3356711 - RNA, 14 nt, Human
cuuugaccuguugg

SEQ ID NO: 3356712 - RNA, 20 nt, Human
cuugauuaagaucucagugg

SEQ ID NO: 3356713 - RNA, 19 nt, Human
cuuccucuccugucucccu

SEQ ID NO: 3356714 - RNA, 17 nt, Human
cuucuaguucugccagg

SEQ ID NO: 3356715 - RNA, 18 nt, Human
cuucuaguucugccagga

SEQ ID NO: 3356716 - RNA, 16 nt, Human
cuucuaguucugccag

SEQ ID NO: 3356717 - RNA, 19 nt, Human
cuucuaguucugccaggag

SEQ ID NO: 3356718 - RNA, 13 nt, Human
cuucucacauuua

SEQ ID NO: 3356719 - RNA, 20 nt, Human
cuucucacauuuauauuuuu

SEQ ID NO: 3356720 - RNA, 16 nt, Human
cuggggaugucucuca

SEQ ID NO: 3356721 - RNA, 15 nt, Human
cuggggccaggcugg

SEQ ID NO: 3356722 - RNA, 18 nt, Human
cuggccccugagaucucu

SEQ ID NO: 3356723 - RNA, 22 nt, Human
cuggccccugagaucucugcag

SEQ ID NO: 3356724 - RNA, 23 nt, Human
cuggccccugagaucucugcagg

SEQ ID NO: 3356725 - RNA, 18 nt, Human
cugggaauaagugccagg

SEQ ID NO: 3356726 - RNA, 13 nt, Human
cuggacuuggagg

SEQ ID NO: 3356727 - RNA, 17 nt, Human
cugccugguccucacac

SEQ ID NO: 3356728 - RNA, 19 nt, Human
cugccugguccucacacuc

SEQ ID NO: 3356729 - RNA, 23 nt, Human
cugccugguccucacacucaccc

SEQ ID NO: 3356730 - RNA, 16 nt, Human
cugccugguccucaca

SEQ ID NO: 3356731 - RNA, 14 nt, Human
cuguuuaagagaca

SEQ ID NO: 3356732 - RNA, 12 nt, Human
cuguuuaagaga

SEQ ID NO: 3356733 - RNA, 15 nt, Human
cuuaggccagcacca

SEQ ID NO: 3356734 - RNA, 20 nt, Human
cugugccuugucacgccaga

SEQ ID NO: 3356735 - RNA, 16 nt, Human
cugugccuuuugccau

SEQ ID NO: 3356736 - RNA, 14 nt, Human
gaugaugacuaugg

SEQ ID NO: 3356737 - RNA, 17 nt, Human
gccaagaggcugcagcc

SEQ ID NO: 3356738 - RNA, 18 nt, Human
gcauuucccuuccuuccu

SEQ ID NO: 3356739 - RNA, 13 nt, Human
gccaagaggcugc

SEQ ID NO: 3356740 - RNA, 14 nt, Human
gccaagaggcugca

SEQ ID NO: 3356741 - RNA, 12 nt, Human
gccaagaggcug

SEQ ID NO: 3356742 - RNA, 19 nt, Human
gccaacuauggccugugga

SEQ ID NO: 3356743 - RNA, 15 nt, Human
gccaacuauggccug

SEQ ID NO: 3356744 - RNA, 14 nt, Human
gccaacuauggccu

SEQ ID NO: 3356745 - RNA, 18 nt, Human
gcauggcauauuuuucac

SEQ ID NO: 3356746 - RNA, 15 nt, Human
gagcagugggccugg

SEQ ID NO: 3356747 - RNA, 17 nt, Human
gagcagugggccuggcc

SEQ ID NO: 3356748 - RNA, 18 nt, Human
gagcagugggccuggcca

SEQ ID NO: 3356749 - RNA, 21 nt, Human
gagcgagacuugguuucaaaa

SEQ ID NO: 3356750 - RNA, 20 nt, Human
gagcugugcaucagcuagaa

SEQ ID NO: 3356751 - RNA, 19 nt, Human
gaggcucuggagcccacug

SEQ ID NO: 3356752 - RNA, 14 nt, Human
gaggcucuggagcc

SEQ ID NO: 3356753 - RNA, 19 nt, Human
gaggcugcagccaggccac

SEQ ID NO: 3356754 - RNA, 18 nt, Human
gagguggaauuauuuuaa

SEQ ID NO: 3356755 - RNA, 18 nt, Human
gacaggggcaggaggaag

SEQ ID NO: 3356756 - RNA, 20 nt, Human
gacaggggcaggaggaaggg

SEQ ID NO: 3356757 - RNA, 22 nt, Human
gacagguuugggaccccuggug

SEQ ID NO: 3356758 - RNA, 19 nt, Human
gacagguuugggaccccug

SEQ ID NO: 3356759 - RNA, 15 nt, Human
gacccucaucuuucu

SEQ ID NO: 3356760 - RNA, 19 nt, Human
gacccucaucuuucuucca

SEQ ID NO: 3356761 - RNA, 13 nt, Human
gacuaugacauaa

SEQ ID NO: 3356762 - RNA, 15 nt, Human
gacuauggagcugag

SEQ ID NO: 3356763 - RNA, 20 nt, Human
gacugugugcucaggagccc

SEQ ID NO: 3356764 - RNA, 17 nt, Human
gacugugugcucaggag

SEQ ID NO: 3356765 - RNA, 16 nt, Human
gacugugugcucagga

SEQ ID NO: 3356766 - RNA, 14 nt, Human
gacugugugcucag

SEQ ID NO: 3356767 - RNA, 21 nt, Human
ggccccugccucucugcaggu

SEQ ID NO: 3356768 - RNA, 17 nt, Human
ggccagucccugaggca

SEQ ID NO: 3356769 - RNA, 23 nt, Human
ggccagucccugaggcagguccc

SEQ ID NO: 3356770 - RNA, 15 nt, Human
ggcagggcugaggcc

SEQ ID NO: 3356771 - RNA, 15 nt, Human
ggcacuggggcaggg

SEQ ID NO: 3356772 - RNA, 20 nt, Human
ggcucagaggguguccugca

SEQ ID NO: 3356773 - RNA, 14 nt, Human
ggcucagagugggg

SEQ ID NO: 3356774 - RNA, 22 nt, Human
gggacaccuaggcuaggguggg

SEQ ID NO: 3356775 - RNA, 14 nt, Human
gggacaccuaggcu

SEQ ID NO: 3356776 - RNA, 17 nt, Human
gggacaggggcaggagg

SEQ ID NO: 3356777 - RNA, 18 nt, Human
gggacaggggcaggagga

SEQ ID NO: 3356778 - RNA, 14 nt, Human
aaaaauaacaauga

SEQ ID NO: 3356779 - RNA, 14 nt, Human
ggcugggucgcccu

SEQ ID NO: 3356780 - RNA, 20 nt, Human
ggcugggucgcccuggacug

SEQ ID NO: 3356781 - RNA, 17 nt, Human
ggcugggucgcccugga

SEQ ID NO: 3356782 - RNA, 12 nt, Human
ggcuucauacac

SEQ ID NO: 3356783 - RNA, 9 nt, Human
ggcuucaua

SEQ ID NO: 3356784 - RNA, 11 nt, Human
ggcuucauaca

SEQ ID NO: 3356785 - RNA, 21 nt, Human
aaaagauuuucagaaaauauu

SEQ ID NO: 3356786 - RNA, 18 nt, Human
aaaagccaagaggcugca

SEQ ID NO: 3356787 - RNA, 21 nt, Human
ggugcuucuaguucugccagg

SEQ ID NO: 3356788 - RNA, 22 nt, Human
ggugcuucuaguucugccagga

SEQ ID NO: 3356789 - RNA, 15 nt, Human
gguggaauuauuuua

SEQ ID NO: 3356790 - RNA, 21 nt, Human
ggugcauauuuauaaaaauaa

SEQ ID NO: 3356791 - RNA, 16 nt, Human
ggugcugggccccugc

SEQ ID NO: 3356792 - RNA, 15 nt, Human
ggugcugggccccug

SEQ ID NO: 3356793 - RNA, 13 nt, Human
ggugcugggcccc

SEQ ID NO: 3356794 - RNA, 11 nt, Human
ggugcugggcc

SEQ ID NO: 3356795 - RNA, 13 nt, Human
ggugaaaauuauu

SEQ ID NO: 3356796 - RNA, 14 nt, Human
ggugaaaauuauuu

SEQ ID NO: 3356797 - RNA, 22 nt, Human
ggugaaaauuauuuuguucaua

SEQ ID NO: 3356798 - RNA, 14 nt, Human
ggucgcccuggacu

SEQ ID NO: 3356799 - RNA, 20 nt, Human
aaagggacugagaaauuuau

SEQ ID NO: 3356800 - RNA, 14 nt, Human
aaagguaaaucaga

SEQ ID NO: 3356801 - RNA, 17 nt, Human
aaagggugaaaauuauu

SEQ ID NO: 3356802 - RNA, 13 nt, Human
ggguggggagaga

SEQ ID NO: 3356803 - RNA, 14 nt, Human
ggguggggagagac

SEQ ID NO: 3356804 - RNA, 18 nt, Human
ggguggggagagacgggc

SEQ ID NO: 3356805 - RNA, 17 nt, Human
ggguggggggcuucaua

SEQ ID NO: 3356806 - RNA, 19 nt, Human
ggguggggggcuucauaca

SEQ ID NO: 3356807 - RNA, 19 nt, Human
aaacuuguaaauaaaggaa

SEQ ID NO: 3356808 - RNA, 16 nt, Human
aaacuuguauuaugug

SEQ ID NO: 3356809 - RNA, 13 nt, Human
aaagacagugaaa

SEQ ID NO: 3356810 - RNA, 22 nt, Human
aaagaccuuuggagcaaagcug

SEQ ID NO: 3356811 - RNA, 19 nt, Human
aaagagaugaugaaaauau

SEQ ID NO: 3356812 - RNA, 20 nt, Human
aaagagaugaugaaaauauu

SEQ ID NO: 3356813 - RNA, 22 nt, Human
aaagagaugaugaaaauauuua

SEQ ID NO: 3356814 - RNA, 18 nt, Human
gggggcgcggcugggagg

SEQ ID NO: 3356815 - RNA, 22 nt, Human
gggggcuucauacacaugagau

SEQ ID NO: 3356816 - RNA, 19 nt, Human
gggggugcugggccccugc

SEQ ID NO: 3356817 - RNA, 15 nt, Human
gggucgcccuggacu

SEQ ID NO: 3356818 - RNA, 13 nt, Human
gggucgcccugga

SEQ ID NO: 3356819 - RNA, 22 nt, Human
aaaccucaaaaugucuaagaua

SEQ ID NO: 3356820 - RNA, 18 nt, Human
aaaccuuuuauauuuagu

SEQ ID NO: 3356821 - RNA, 18 nt, Human
aaaccuuuguuugcaucu

SEQ ID NO: 3356822 - RNA, 18 nt, Human
aaacuaggugcauauuua

SEQ ID NO: 3356823 - RNA, 22 nt, Human
aaacuaggugcauauuuauaaa

SEQ ID NO: 3356824 - RNA, 17 nt, Human
ggggccgggggcagucu

SEQ ID NO: 3356825 - RNA, 14 nt, Human
aaauaaaaauauug

SEQ ID NO: 3356826 - RNA, 16 nt, Human
aaaguugguaaaccuu

SEQ ID NO: 3356827 - RNA, 17 nt, Human
aaaguugguaaaccuuu

SEQ ID NO: 3356828 - RNA, 23 nt, Human
guaauuuaaaauugugauguguc

SEQ ID NO: 3356829 - RNA, 19 nt, Human
guaauuuaaaauugugaug

SEQ ID NO: 3356830 - RNA, 20 nt, Human
guaauuuaaaauugugaugu

SEQ ID NO: 3356831 - RNA, 21 nt, Human
guaauccaagcaaaugugaau

SEQ ID NO: 3356832 - RNA, 22 nt, Human
guaauaacugugaaguuuacau

SEQ ID NO: 3356833 - RNA, 16 nt, Human
guaauaacugugaagu

SEQ ID NO: 3356834 - RNA, 15 nt, Human
guaauaacugugaag

SEQ ID NO: 3356835 - RNA, 20 nt, Human
guaauaggcguaacuaauuu

SEQ ID NO: 3356836 - RNA, 19 nt, Human
guaauagagcaaaauugau

SEQ ID NO: 3356837 - RNA, 15 nt, Human
guagagccagagguc

SEQ ID NO: 3356838 - RNA, 14 nt, Human
guacuuaacuauuc

SEQ ID NO: 3356839 - RNA, 14 nt, Human
aaauauuauguguu

SEQ ID NO: 3356840 - RNA, 15 nt, Human
aaauauuauguguuu

SEQ ID NO: 3356841 - RNA, 21 nt, Human
aaaucagacuaugaaguuuuu

SEQ ID NO: 3356842 - RNA, 14 nt, Human
aaaucagacuauga

SEQ ID NO: 3356843 - RNA, 15 nt, Human
aaauccacuuuaucu

SEQ ID NO: 3356844 - RNA, 15 nt, Human
guacauuuggagaca

SEQ ID NO: 3356845 - RNA, 23 nt, Human
guaccaagacuacuagggaaaug

SEQ ID NO: 3356846 - RNA, 20 nt, Human
guaccaagacuacuagggaa

SEQ ID NO: 3356847 - RNA, 17 nt, Human
gcucccccuccaccugc

SEQ ID NO: 3356848 - RNA, 20 nt, Human
gcucaggaaccgaggcaggg

SEQ ID NO: 3356849 - RNA, 21 nt, Human
gcucaggaaccgaggcaggga

SEQ ID NO: 3356850 - RNA, 16 nt, Human
gcucaggaaccgaggc

SEQ ID NO: 3356851 - RNA, 19 nt, Human
gcucaggaaccgaggcagg

SEQ ID NO: 3356852 - RNA, 17 nt, Human
gcuaugagcuggggaug

SEQ ID NO: 3356853 - RNA, 14 nt, Human
gcuaugagggccuu

SEQ ID NO: 3356854 - RNA, 22 nt, Human
gcuaauucuuugaccuguuggg

SEQ ID NO: 3356855 - RNA, 23 nt, Human
gccuccauccuacccccugugcc

SEQ ID NO: 3356856 - RNA, 19 nt, Human
gccuggcgacagagcgaga

SEQ ID NO: 3356857 - RNA, 23 nt, Human
gccccugccucucugcagguccc

SEQ ID NO: 3356858 - RNA, 20 nt, Human
gccccugccucucugcaggu

SEQ ID NO: 3356859 - RNA, 11 nt, Human
gccccugccag

SEQ ID NO: 3356860 - RNA, 16 nt, Human
gccccugccagacccc

SEQ ID NO: 3356861 - RNA, 15 nt, Human
ggaacugcugggcuu

SEQ ID NO: 3356862 - RNA, 20 nt, Human
ggaacugcugggcuuggcag

SEQ ID NO: 3356863 - RNA, 21 nt, Human
ggaagugugggucugugugug

SEQ ID NO: 3356864 - RNA, 22 nt, Human
ggaagugugggucugugugugu

SEQ ID NO: 3356865 - RNA, 12 nt, Human
ggaagugugggu

SEQ ID NO: 3356866 - RNA, 23 nt, Human
gcugggccccugccucucugcag

SEQ ID NO: 3356867 - RNA, 22 nt, Human
gcugggccccugccucucugca

SEQ ID NO: 3356868 - RNA, 21 nt, Human
gcugggccccugccucucugc

SEQ ID NO: 3356869 - RNA, 20 nt, Human
gcugggccccugccucucug

SEQ ID NO: 3356870 - RNA, 16 nt, Human
gcuucuaguucugcca

SEQ ID NO: 3356871 - RNA, 17 nt, Human
cagucugagagaggcca

SEQ ID NO: 3356872 - RNA, 18 nt, Human
cagucugagagaggccau

SEQ ID NO: 3356873 - RNA, 15 nt, Human
cagguuugggacccc

SEQ ID NO: 3356874 - RNA, 18 nt, Human
cagguuugggaccccugg

SEQ ID NO: 3356875 - RNA, 15 nt, Human
caggccugacucuca

SEQ ID NO: 3356876 - RNA, 15 nt, Human
caggagguggucugg

SEQ ID NO: 3356877 - RNA, 13 nt, Human
caggaggaagggg

SEQ ID NO: 3356878 - RNA, 12 nt, Human
caggaccccuga

SEQ ID NO: 3356879 - RNA, 14 nt, Human
caggaccccugagu

SEQ ID NO: 3356880 - RNA, 21 nt, Human
cagcagguccccagcuuuggc

SEQ ID NO: 3356881 - RNA, 19 nt, Human
cauccauggggcugauugu

SEQ ID NO: 3356882 - RNA, 20 nt, Human
cauaauuuauacaggucaua

SEQ ID NO: 3356883 - RNA, 13 nt, Human
cauaauuuauaca

SEQ ID NO: 3356884 - RNA, 21 nt, Human
cauauuauuuuauguugcaua

SEQ ID NO: 3356885 - RNA, 12 nt, Human
caugcacaaauu

SEQ ID NO: 3356886 - RNA, 21 nt, Human
cauuuggagacacaacuauuu

SEQ ID NO: 3356887 - RNA, 19 nt, Human
cauuguaaauaguauuuga

SEQ ID NO: 3356888 - RNA, 17 nt, Human
ccaccgccuccuacagc

SEQ ID NO: 3356889 - RNA, 19 nt, Human
cagaaaucuagaagacugu

SEQ ID NO: 3356890 - RNA, 11 nt, Human
cagaaaguuau

SEQ ID NO: 3356891 - RNA, 16 nt, Human
cagaaaguuauugaua

SEQ ID NO: 3356892 - RNA, 22 nt, Human
cacuguuuugaaucucauaauu

SEQ ID NO: 3356893 - RNA, 19 nt, Human
cacugggagaaaugaaaaa

SEQ ID NO: 3356894 - RNA, 18 nt, Human
cacugggagaaaugaaaa

SEQ ID NO: 3356895 - RNA, 13 nt, Human
caagaugguucua

SEQ ID NO: 3356896 - RNA, 16 nt, Human
caagaugguucuagca

SEQ ID NO: 3356897 - RNA, 18 nt, Human
caaagggugaaaauuauu

SEQ ID NO: 3356898 - RNA, 14 nt, Human
caaagguaaaucag

SEQ ID NO: 3356899 - RNA, 16 nt, Human
caaagucaagccacau

SEQ ID NO: 3356900 - RNA, 12 nt, Human
auuuuauaucuu

SEQ ID NO: 3356901 - RNA, 14 nt, Human
auuuuauaucuugu

SEQ ID NO: 3356902 - RNA, 16 nt, Human
auuuuauaucuuguag

SEQ ID NO: 3356903 - RNA, 14 nt, Human
caaaccaaauaaaa

SEQ ID NO: 3356904 - RNA, 15 nt, Human
caaaccaaauaaaaa

SEQ ID NO: 3356905 - RNA, 22 nt, Human
auuuaugcauauuauuuuaugu

SEQ ID NO: 3356906 - RNA, 16 nt, Human
auuuaugcauauuauu

SEQ ID NO: 3356907 - RNA, 16 nt, Human
auuucauaugcuguau

SEQ ID NO: 3356908 - RNA, 17 nt, Human
auuguguugugaauguu

SEQ ID NO: 3356909 - RNA, 14 nt, Human
auuguguugugaau

SEQ ID NO: 3356910 - RNA, 20 nt, Human
auuaguacuccccuccuuga

SEQ ID NO: 3356911 - RNA, 21 nt, Human
ccugucucccuccucugcccg

SEQ ID NO: 3356912 - RNA, 21 nt, Human
ccuggugguggcucgggaggc

SEQ ID NO: 3356913 - RNA, 12 nt, Human
ccuggugguuca

SEQ ID NO: 3356914 - RNA, 13 nt, Human
ccuggugguucac

SEQ ID NO: 3356915 - RNA, 22 nt, Human
ccuggugguucacucuuggagc

SEQ ID NO: 3356916 - RNA, 18 nt, Human
ccuggugguggcucggga

SEQ ID NO: 3356917 - RNA, 19 nt, Human
ccugacccucaucuuucuu

SEQ ID NO: 3356918 - RNA, 17 nt, Human
ccugagaucucugcagg

SEQ ID NO: 3356919 - RNA, 18 nt, Human
ccugagaucucugcagga

SEQ ID NO: 3356920 - RNA, 18 nt, Human
ccugacccucaucuuucu

SEQ ID NO: 3356921 - RNA, 19 nt, Human
ccugaguuccuagccaccg

SEQ ID NO: 3356922 - RNA, 18 nt, Human
ccugaguuccuagccacc

SEQ ID NO: 3356923 - RNA, 20 nt, Human
ccugaguuccuagccaccgc

SEQ ID NO: 3356924 - RNA, 21 nt, Human
ccugaguuccuagccaccgcc

SEQ ID NO: 3356925 - RNA, 18 nt, Human
ccugccaucauguuuaca

SEQ ID NO: 3356926 - RNA, 20 nt, Human
ccugccaucauguuuacaga

SEQ ID NO: 3356927 - RNA, 15 nt, Human
ccugccucucugcag

SEQ ID NO: 3356928 - RNA, 14 nt, Human
ccugccucucugca

SEQ ID NO: 3356929 - RNA, 13 nt, Human
ccugccucucugc

SEQ ID NO: 3356930 - RNA, 15 nt, Human
ccuccuagccaccca

SEQ ID NO: 3356931 - RNA, 16 nt, Human
ccuagccacccaccac

SEQ ID NO: 3356932 - RNA, 12 nt, Human
ccuagccaccca

SEQ ID NO: 3356933 - RNA, 12 nt, Human
ccuaauaaagcu

SEQ ID NO: 3356934 - RNA, 14 nt, Human
ccauucuuucccaa

SEQ ID NO: 3356935 - RNA, 20 nt, Human
ccauucuuucccaacaccuc

SEQ ID NO: 3356936 - RNA, 12 nt, Human
ccauucuuuccc

SEQ ID NO: 3356937 - RNA, 15 nt, Human
ccagucccugaggca

SEQ ID NO: 3356938 - RNA, 22 nt, Human
ccagggggccagucccugaggc

SEQ ID NO: 3356939 - RNA, 23 nt, Human
ccagggggccagucccugaggca

SEQ ID NO: 3356940 - RNA, 10 nt, Human
ccccugccag

SEQ ID NO: 3356941 - RNA, 15 nt, Human
cuaggcuaggguggg

SEQ ID NO: 3356942 - RNA, 13 nt, Human
cuaguucugccag

SEQ ID NO: 3356943 - RNA, 14 nt, Human
cuaguucugccagg

SEQ ID NO: 3356944 - RNA, 15 nt, Human
cuaguucugccagga

SEQ ID NO: 3356945 - RNA, 16 nt, Human
cuaguucugccaggag

SEQ ID NO: 3356946 - RNA, 20 nt, Human
cuacuagggaaaugccuuug

SEQ ID NO: 3356947 - RNA, 12 nt, Human
cucagaauauug

SEQ ID NO: 3356948 - RNA, 21 nt, Human
cucacuuaucccaagagaaug

SEQ ID NO: 3356949 - RNA, 23 nt, Human
cucaaagugacuauucaguuuuc

SEQ ID NO: 3356950 - RNA, 18 nt, Human
cugacccucaucuuucuu

SEQ ID NO: 3356951 - RNA, 18 nt, Human
cugaggaagagggacugu

SEQ ID NO: 3356952 - RNA, 23 nt, Human
cugaggaagagggacuguucuuu

SEQ ID NO: 3356953 - RNA, 14 nt, Human
cugagcuuggaagc

SEQ ID NO: 3356954 - RNA, 20 nt, Human
cugagcuuggaagcuucugg

SEQ ID NO: 3356955 - RNA, 21 nt, Human
cugagcuuggaagcuucuggu

SEQ ID NO: 3356956 - RNA, 12 nt, Human
cugagcuuggaa

SEQ ID NO: 3356957 - RNA, 21 nt, Human
cugaggugggagauguggaaa

SEQ ID NO: 3356958 - RNA, 21 nt, Human
cugaguaaaaaagcugugugc

SEQ ID NO: 3356959 - RNA, 16 nt, Human
cuccuagccacccacc

SEQ ID NO: 3356960 - RNA, 20 nt, Human
cucucuugauuaagaucuca

SEQ ID NO: 3356961 - RNA, 12 nt, Human
augugacucuuu

SEQ ID NO: 3356962 - RNA, 16 nt, Human
augugacucuuuccaa

SEQ ID NO: 3356963 - RNA, 21 nt, Human
augugacucuuuccaaccggc

SEQ ID NO: 3356964 - RNA, 20 nt, Human
uuugugaagguggaaauaaa

SEQ ID NO: 3356965 - RNA, 14 nt, Human
uuuguaaugaaaac

SEQ ID NO: 3356966 - RNA, 13 nt, Human
uuuguaaugaaaa

SEQ ID NO: 3356967 - RNA, 16 nt, Human
augucaguauguggaa

SEQ ID NO: 3356968 - RNA, 15 nt, Human
auguaugcuucauac

SEQ ID NO: 3356969 - RNA, 14 nt, Human
auguaugcuucaua

SEQ ID NO: 3356970 - RNA, 21 nt, Human
uuugacagaauauguuucaaa

SEQ ID NO: 3356971 - RNA, 22 nt, Human
uuugacagaauauguuucaaac

SEQ ID NO: 3356972 - RNA, 19 nt, Human
auguagccccucuccugga

SEQ ID NO: 3356973 - RNA, 19 nt, Human
auguagaggggaaaagaga

SEQ ID NO: 3356974 - RNA, 23 nt, Human
uuuggcaaacucuccaccacacg

SEQ ID NO: 3356975 - RNA, 20 nt, Human
auggggauagauguguggac

SEQ ID NO: 3356976 - RNA, 16 nt, Human
augguucucaggccug

SEQ ID NO: 3356977 - RNA, 13 nt, Human
augguuguacaua

SEQ ID NO: 3356978 - RNA, 17 nt, Human
auguacauguacugauu

SEQ ID NO: 3356979 - RNA, 19 nt, Human
augguguucaaaaaacuug

SEQ ID NO: 3356980 - RNA, 22 nt, Human
uuucaaaauuguuacaaauugu

SEQ ID NO: 3356981 - RNA, 16 nt, Human
uuuauuuuguguuuag

SEQ ID NO: 3356982 - RNA, 20 nt, Human
uuuauuuuguguuuaggaac

SEQ ID NO: 3356983 - RNA, 18 nt, Human
augcuagguuaauuccaa

SEQ ID NO: 3356984 - RNA, 21 nt, Human
uuuaucaaagggugaaaauua

SEQ ID NO: 3356985 - RNA, 18 nt, Human
uuuaucaugugaaaucau

SEQ ID NO: 3356986 - RNA, 17 nt, Human
uuuaucaugugaaauca

SEQ ID NO: 3356987 - RNA, 20 nt, Human
auggcauauuuuucacauau

SEQ ID NO: 3356988 - RNA, 21 nt, Human
auggcauauuuuucacauauc

SEQ ID NO: 3356989 - RNA, 22 nt, Human
auggcauauuuuucacauaucu

SEQ ID NO: 3356990 - RNA, 23 nt, Human
auggcauauuuuucacauaucua

SEQ ID NO: 3356991 - RNA, 18 nt, Human
auggcauauuuuucacau

SEQ ID NO: 3356992 - RNA, 14 nt, Human
uuucaaacuuugga

SEQ ID NO: 3356993 - RNA, 22 nt, Human
augcagauuuugcccuugacaa

SEQ ID NO: 3356994 - RNA, 21 nt, Human
augauacuugaaaauuaacau

SEQ ID NO: 3356995 - RNA, 17 nt, Human
augauacuugaaaauua

SEQ ID NO: 3356996 - RNA, 20 nt, Human
uuguguuaaguauguguaaa

SEQ ID NO: 3356997 - RNA, 17 nt, Human
augauaaguaaaugcua

SEQ ID NO: 3356998 - RNA, 14 nt, Human
auccuacccccugu

SEQ ID NO: 3356999 - RNA, 16 nt, Human
auccuacccccugugc

SEQ ID NO: 3357000 - RNA, 17 nt, Human
uugaaauuguauuacaa

SEQ ID NO: 3357001 - RNA, 23 nt, Human
uucuuaaccagaucauugugaaa

SEQ ID NO: 3357002 - RNA, 15 nt, Human
uucuuuguaaugaaa

SEQ ID NO: 3357003 - RNA, 13 nt, Human
uucugccaggaga

SEQ ID NO: 3357004 - RNA, 12 nt, Human
uucugccaggag

SEQ ID NO: 3357005 - RNA, 19 nt, Human
auccauagcaccuccacau

SEQ ID NO: 3357006 - RNA, 20 nt, Human
aucauuuuaccuuugacaaa

SEQ ID NO: 3357007 - RNA, 18 nt, Human
auccaagcaaaugugaau

SEQ ID NO: 3357008 - RNA, 13 nt, Human
auauuuuucacau

SEQ ID NO: 3357009 - RNA, 14 nt, Human
auauuuuucacaua

SEQ ID NO: 3357010 - RNA, 15 nt, Human
auauuuuucacauau

SEQ ID NO: 3357011 - RNA, 12 nt, Human
auauuuuucaca

SEQ ID NO: 3357012 - RNA, 19 nt, Human
uuccguagguuauuuucag

SEQ ID NO: 3357013 - RNA, 22 nt, Human
uucuagcauggcauauuuuuca

SEQ ID NO: 3357014 - RNA, 17 nt, Human
uucuagcuaauguaaua

SEQ ID NO: 3357015 - RNA, 15 nt, Human
uucuagcauggcaua

SEQ ID NO: 3357016 - RNA, 18 nt, Human
uucuagcauggcauauuu

SEQ ID NO: 3357017 - RNA, 20 nt, Human
uucuagcauggcauauuuuu

SEQ ID NO: 3357018 - RNA, 21 nt, Human
uucuagcauggcauauuuuuc

SEQ ID NO: 3357019 - RNA, 14 nt, Human
uucuagcauggcau

SEQ ID NO: 3357020 - RNA, 14 nt, Human
uucuaaauuuuaua

SEQ ID NO: 3357021 - RNA, 13 nt, Human
aucaggccauugu

SEQ ID NO: 3357022 - RNA, 16 nt, Human
aucaggccauuguccc

SEQ ID NO: 3357023 - RNA, 20 nt, Human
uugacagaauauguuucaaa

SEQ ID NO: 3357024 - RNA, 16 nt, Human
uugagauguguucaca

SEQ ID NO: 3357025 - RNA, 17 nt, Human
uugacagaauauguuuc

SEQ ID NO: 3357026 - RNA, 22 nt, Human
uugauuaagaucucagugguua

SEQ ID NO: 3357027 - RNA, 12 nt, Human
aucuagaagacu

SEQ ID NO: 3357028 - RNA, 23 nt, Human
uuggggacaggggcaggaggaag

SEQ ID NO: 3357029 - RNA, 21 nt, Human
augaauauuuaguguucauaa

SEQ ID NO: 3357030 - RNA, 21 nt, Human
augaaauuauauaaguauucu

SEQ ID NO: 3357031 - RNA, 19 nt, Human
augaaauuauauaaguauu

SEQ ID NO: 3357032 - RNA, 16 nt, Human
augaauauuuaguguu

SEQ ID NO: 3357033 - RNA, 20 nt, Human
uuggagacacaacuauuuuu

SEQ ID NO: 3357034 - RNA, 18 nt, Human
uuggagacacaacuauuu

SEQ ID NO: 3357035 - RNA, 18 nt, Human
aucuuguagcuuuaucaa

SEQ ID NO: 3357036 - RNA, 12 nt, Human
aucuguuuacag

SEQ ID NO: 3357037 - RNA, 15 nt, Human
aucuguuuacagugu

SEQ ID NO: 3357038 - RNA, 17 nt, Human
aucuguuuacaguguuc

SEQ ID NO: 3357039 - RNA, 20 nt, Human
uugcuaugagcuggggaugu

SEQ ID NO: 3357040 - RNA, 19 nt, Human
aucuuguagcuuuaucaaa

SEQ ID NO: 3357041 - RNA, 20 nt, Human
aucuuguagcuuuaucaaag

SEQ ID NO: 3357042 - RNA, 16 nt, Human
auuucccuuccuuccu

SEQ ID NO: 3357043 - RNA, 17 nt, Human
auuucccugaaggaacc

SEQ ID NO: 3357044 - RNA, 23 nt, Human
auuucccugaaggaaccaaagcg

SEQ ID NO: 3357045 - RNA, 18 nt, Human
auuugaaacacuuugcau

SEQ ID NO: 3357046 - RNA, 21 nt, Human
auuugugaagguggaaauaaa

SEQ ID NO: 3357047 - RNA, 18 nt, Human
auuugugaagguggaaau

SEQ ID NO: 3357048 - RNA, 20 nt, Human
auuuuaaaagauaaauauua

SEQ ID NO: 3357049 - RNA, 20 nt, Human
auuuuaaaagaugcaaugua

SEQ ID NO: 3357050 - RNA, 19 nt, Human
auuuguaaauuuaugugau

SEQ ID NO: 3357051 - RNA, 18 nt, Human
auuuguaaauuuauguga

SEQ ID NO: 3357052 - RNA, 19 nt, Human
auuggacaguaaaauccac

SEQ ID NO: 3357053 - RNA, 14 nt, Human
auugcuuuggucau

SEQ ID NO: 3357054 - RNA, 18 nt, Human
auugcuuuggucauauga

SEQ ID NO: 3357055 - RNA, 23 nt, Human
auuggguggggggcuucauacac

SEQ ID NO: 3357056 - RNA, 22 nt, Human
auuggguggggggcuucauaca

SEQ ID NO: 3357057 - RNA, 19 nt, Human
auuggauucugagagcugu

SEQ ID NO: 3357058 - RNA, 22 nt, Human
auuggauucugagagcugugca

SEQ ID NO: 3357059 - RNA, 16 nt, Human
auuguacgaagaguau

SEQ ID NO: 3357060 - RNA, 20 nt, Human
auuuuuguagcacugacaga

SEQ ID NO: 3357061 - RNA, 21 nt, Human
auuuuuguagcacugacagau

SEQ ID NO: 3357062 - RNA, 22 nt, Human
auuuuugugauuuugugauuga

SEQ ID NO: 3357063 - RNA, 12 nt, Human
auuuuucucaug

SEQ ID NO: 3357064 - RNA, 15 nt, Human
auuuuuccaaaauaa

SEQ ID NO: 3357065 - RNA, 18 nt, Human
auuuuucacauaucuagu

SEQ ID NO: 3357066 - RNA, 21 nt, Human
auuuuucacauaucuaguaug

SEQ ID NO: 3357067 - RNA, 15 nt, Human
auuuuucacauaucu

SEQ ID NO: 3357068 - RNA, 12 nt, Human
auuuuugacaga

SEQ ID NO: 3357069 - RNA, 13 nt, Human
auuuuugacagaa

SEQ ID NO: 3357070 - RNA, 14 nt, Human
auuuuugacagaau

SEQ ID NO: 3357071 - RNA, 15 nt, Human
auuuuugacagaaua

SEQ ID NO: 3357072 - RNA, 22 nt, Human
auuuuugacagaauauguuuca

SEQ ID NO: 3357073 - RNA, 14 nt, Human
auuuuguucauaca

SEQ ID NO: 3357074 - RNA, 15 nt, Human
auuuuguucauacau

SEQ ID NO: 3357075 - RNA, 16 nt, Human
auuuuguucauacaua

SEQ ID NO: 3357076 - RNA, 18 nt, Human
auuuuguucauacauauu

SEQ ID NO: 3357077 - RNA, 12 nt, Human
auuuuguucaua

SEQ ID NO: 3357078 - RNA, 17 nt, Human
auuuuguguuuaggaac

SEQ ID NO: 3357079 - RNA, 14 nt, Human
auuuucuauaauuu

SEQ ID NO: 3357080 - RNA, 15 nt, Human
auuuucuauaauuua

SEQ ID NO: 3357081 - RNA, 17 nt, Human
auuuuaauaaacacucu

SEQ ID NO: 3357082 - RNA, 16 nt, Human
auuuuaauaaacacuc

SEQ ID NO: 3357083 - RNA, 15 nt, Human
auuuuaauaaacacu

SEQ ID NO: 3357084 - RNA, 15 nt, Human
auuuugcccuugaca

SEQ ID NO: 3357085 - RNA, 23 nt, Human
auuuugcccuugacaaagucaag

SEQ ID NO: 3357086 - RNA, 18 nt, Human
auucuagcuaauguaaua

SEQ ID NO: 3357087 - RNA, 15 nt, Human
auucuagcuaaugua

SEQ ID NO: 3357088 - RNA, 24 nt, Human
auucagaaggaucuucaucugacu

SEQ ID NO: 3357089 - RNA, 18 nt, Human
auucagaaggaucuucau

SEQ ID NO: 3357090 - RNA, 20 nt, Human
auucacauuguauucagagu

SEQ ID NO: 3357091 - RNA, 13 nt, Human
auucacauuguau

SEQ ID NO: 3357092 - RNA, 12 nt, Human
auuccagaggaa

SEQ ID NO: 3357093 - RNA, 14 nt, Human
auucuaaauuuuau

SEQ ID NO: 3357094 - RNA, 15 nt, Human
auuauuauuuggccc

SEQ ID NO: 3357095 - RNA, 15 nt, Human
auuauuuuguucaua

SEQ ID NO: 3357096 - RNA, 16 nt, Human
auuauuuuguucauac

SEQ ID NO: 3357097 - RNA, 17 nt, Human
auuauuuuguucauaca

SEQ ID NO: 3357098 - RNA, 18 nt, Human
auuauuuuguucauacau

SEQ ID NO: 3357099 - RNA, 19 nt, Human
auuauuuuguucauacaua

SEQ ID NO: 3357100 - RNA, 17 nt, Human
auuauauuuacaaaugg

SEQ ID NO: 3357101 - RNA, 14 nt, Human
auuauauuaugaag

SEQ ID NO: 3357102 - RNA, 19 nt, Human
agccugacccucaucuuuc

SEQ ID NO: 3357103 - RNA, 18 nt, Human
agccugacccucaucuuu

SEQ ID NO: 3357104 - RNA, 17 nt, Human
ugcaggucccuaauaaa

SEQ ID NO: 3357105 - RNA, 20 nt, Human
ugcaggucccuaauaaagcu

SEQ ID NO: 3357106 - RNA, 19 nt, Human
ugcaggucccuaauaaagc

SEQ ID NO: 3357107 - RNA, 18 nt, Human
ugcaggucccuaauaaag

SEQ ID NO: 3357108 - RNA, 15 nt, Human
ugcauaauggucaga

SEQ ID NO: 3357109 - RNA, 18 nt, Human
agccugccacucaggccc

SEQ ID NO: 3357110 - RNA, 21 nt, Human
agccugcaauuucauaugcug

SEQ ID NO: 3357111 - RNA, 12 nt, Human
agccugcagagc

SEQ ID NO: 3357112 - RNA, 13 nt, Human
agccugcagagcu

SEQ ID NO: 3357113 - RNA, 14 nt, Human
agccugcagagcug

SEQ ID NO: 3357114 - RNA, 15 nt, Human
agccugcagagcugc

SEQ ID NO: 3357115 - RNA, 19 nt, Human
agccugcaauuucauaugc

SEQ ID NO: 3357116 - RNA, 19 nt, Human
agcuacuaauuuuaaaaug

SEQ ID NO: 3357117 - RNA, 20 nt, Human
agcggcuggaauuggguggg

SEQ ID NO: 3357118 - RNA, 17 nt, Human
ugccuugucacgccaga

SEQ ID NO: 3357119 - RNA, 19 nt, Human
ugccuugugaaggaauuau

SEQ ID NO: 3357120 - RNA, 15 nt, Human
agcuggggaugucuc

SEQ ID NO: 3357121 - RNA, 20 nt, Human
agcuggggccaggcuggguc

SEQ ID NO: 3357122 - RNA, 17 nt, Human
agcuggggccaggcugg

SEQ ID NO: 3357123 - RNA, 9 nt, Human
ugccucucu

SEQ ID NO: 3357124 - RNA, 20 nt, Human
ugccucucugcaggucccua

SEQ ID NO: 3357125 - RNA, 19 nt, Human
ugccucucugcaggucccu

SEQ ID NO: 3357126 - RNA, 15 nt, Human
ugccucucugcaggu

SEQ ID NO: 3357127 - RNA, 18 nt, Human
ugccucucugcagguccc

SEQ ID NO: 3357128 - RNA, 16 nt, Human
ugccucucugcagguc

SEQ ID NO: 3357129 - RNA, 20 nt, Human
aggaauuuuauuuuuuucug

SEQ ID NO: 3357130 - RNA, 22 nt, Human
aggaauuuuauuuuuuucugaa

SEQ ID NO: 3357131 - RNA, 19 nt, Human
ugcucugugcccacccucc

SEQ ID NO: 3357132 - RNA, 23 nt, Human
aggaaaccaguuaggucucaaua

SEQ ID NO: 3357133 - RNA, 18 nt, Human
aggcgaagcguuguccuc

SEQ ID NO: 3357134 - RNA, 18 nt, Human
aggcucagaggguguccu

SEQ ID NO: 3357135 - RNA, 19 nt, Human
aggcucagaggguguccug

SEQ ID NO: 3357136 - RNA, 20 nt, Human
aggcucagaggguguccugc

SEQ ID NO: 3357137 - RNA, 22 nt, Human
uggcacagccuggcuguggccu

SEQ ID NO: 3357138 - RNA, 14 nt, Human
aggccauucuuucc

SEQ ID NO: 3357139 - RNA, 21 nt, Human
uggcauccagagucccugccu

SEQ ID NO: 3357140 - RNA, 22 nt, Human
uggcauccagagucccugccug

SEQ ID NO: 3357141 - RNA, 20 nt, Human
uggcauccagagucccugcc

SEQ ID NO: 3357142 - RNA, 16 nt, Human
aggccugacucucagc

SEQ ID NO: 3357143 - RNA, 13 nt, Human
uggaagugugggu

SEQ ID NO: 3357144 - RNA, 14 nt, Human
uggaaguguggguc

SEQ ID NO: 3357145 - RNA, 14 nt, Human
uggaagugcuaauu

SEQ ID NO: 3357146 - RNA, 19 nt, Human
aggaguuucguuuucaaaa

SEQ ID NO: 3357147 - RNA, 21 nt, Human
uggaacaagaugguucuagca

SEQ ID NO: 3357148 - RNA, 14 nt, Human
uggaauuugaaaca

SEQ ID NO: 3357149 - RNA, 16 nt, Human
uggagccugcagagcu

SEQ ID NO: 3357150 - RNA, 11 nt, Human
uggagccugca

SEQ ID NO: 3357151 - RNA, 23 nt, Human
uggagcccacuguacuugcucuu

SEQ ID NO: 3357152 - RNA, 19 nt, Human
uggagcccacuguacuugc

SEQ ID NO: 3357153 - RNA, 16 nt, Human
uggagcccacuguacu

SEQ ID NO: 3357154 - RNA, 16 nt, Human
aggcagguccccagac

SEQ ID NO: 3357155 - RNA, 12 nt, Human
aggcaggucccc

SEQ ID NO: 3357156 - RNA, 13 nt, Human
aggcaggucccca

SEQ ID NO: 3357157 - RNA, 14 nt, Human
aggcagguccccag

SEQ ID NO: 3357158 - RNA, 15 nt, Human
aggcagguccccaga

SEQ ID NO: 3357159 - RNA, 11 nt, Human
aggcagguccc

SEQ ID NO: 3357160 - RNA, 20 nt, Human
aggcaggaguuucguuuuca

SEQ ID NO: 3357161 - RNA, 17 nt, Human
uggcuguggcauccaga

SEQ ID NO: 3357162 - RNA, 20 nt, Human
uggcuguggccuaaccugcc

SEQ ID NO: 3357163 - RNA, 16 nt, Human
uggcuguggagugugg

SEQ ID NO: 3357164 - RNA, 15 nt, Human
uggcugcagagcagu

SEQ ID NO: 3357165 - RNA, 18 nt, Human
uggcugcagagcaguggg

SEQ ID NO: 3357166 - RNA, 22 nt, Human
uggcugcagagcagugggccug

SEQ ID NO: 3357167 - RNA, 18 nt, Human
ugggaaacaaaaggauaa

SEQ ID NO: 3357168 - RNA, 22 nt, Human
uggcucuugaacugagcuugga

SEQ ID NO: 3357169 - RNA, 21 nt, Human
aggcuuuuuuaucaugugaaa

SEQ ID NO: 3357170 - RNA, 18 nt, Human
aggcuuuuuuaucaugug

SEQ ID NO: 3357171 - RNA, 15 nt, Human
aggcuuuuuuaucau

SEQ ID NO: 3357172 - RNA, 21 nt, Human
aggcugggucgcccuggacug

SEQ ID NO: 3357173 - RNA, 20 nt, Human
aggcugggucgcccuggacu

SEQ ID NO: 3357174 - RNA, 10 nt, Human
aggcuggguc

SEQ ID NO: 3357175 - RNA, 18 nt, Human
aggcugggucgcccugga

SEQ ID NO: 3357176 - RNA, 15 nt, Human
aggcugggucgcccu

SEQ ID NO: 3357177 - RNA, 16 nt, Human
ugggagaaaugaaaaa

SEQ ID NO: 3357178 - RNA, 23 nt, Human
ugggaggcucuggagcccacugu

SEQ ID NO: 3357179 - RNA, 17 nt, Human
ugggaggcucuggagcc

SEQ ID NO: 3357180 - RNA, 14 nt, Human
ugggaggcucugga

SEQ ID NO: 3357181 - RNA, 16 nt, Human
ugggauuuggucaaca

SEQ ID NO: 3357182 - RNA, 15 nt, Human
ugggagaaaugaaaa

SEQ ID NO: 3357183 - RNA, 16 nt, Human
agugauuuuuaugcca

SEQ ID NO: 3357184 - RNA, 20 nt, Human
agugauuuuuaugccaccug

SEQ ID NO: 3357185 - RNA, 21 nt, Human
agugauuuuuaugccaccuga

SEQ ID NO: 3357186 - RNA, 14 nt, Human
agugaggaugucug

SEQ ID NO: 3357187 - RNA, 18 nt, Human
agugccaggauggaauga

SEQ ID NO: 3357188 - RNA, 19 nt, Human
ugugcucuccaagcccagu

SEQ ID NO: 3357189 - RNA, 14 nt, Human
ugugcucuccaagc

SEQ ID NO: 3357190 - RNA, 21 nt, Human
ugugcucaggagcccugggag

SEQ ID NO: 3357191 - RNA, 20 nt, Human
ugugcucaggagcccuggga

SEQ ID NO: 3357192 - RNA, 21 nt, Human
uguggaucaaauccagccugc

SEQ ID NO: 3357193 - RNA, 16 nt, Human
agucuuucacauuuaa

SEQ ID NO: 3357194 - RNA, 15 nt, Human
uguugcauagaauaa

SEQ ID NO: 3357195 - RNA, 21 nt, Human
aguguuccgugguuaaacucg

SEQ ID NO: 3357196 - RNA, 21 nt, Human
aguguucauaaauaaaguuug

SEQ ID NO: 3357197 - RNA, 18 nt, Human
aguguguguuuuucauaa

SEQ ID NO: 3357198 - RNA, 9 nt, Human
aguguguaa

SEQ ID NO: 3357199 - RNA, 16 nt, Human
aguguggcaguuuggc

SEQ ID NO: 3357200 - RNA, 17 nt, Human
aguguggcaguuuggca

SEQ ID NO: 3357201 - RNA, 22 nt, Human
ugugucuaaauuugaauguuaa

SEQ ID NO: 3357202 - RNA, 19 nt, Human
ugugucuaaauuugaaugu

SEQ ID NO: 3357203 - RNA, 18 nt, Human
uguguguuguguguggga

SEQ ID NO: 3357204 - RNA, 14 nt, Human
uguguaaaauguga

SEQ ID NO: 3357205 - RNA, 16 nt, Human
agugggguagguuggg

SEQ ID NO: 3357206 - RNA, 22 nt, Human
uguguuaaguauguguaaaaug

SEQ ID NO: 3357207 - RNA, 23 nt, Human
uguuaagcagauggaaugcugug

SEQ ID NO: 3357208 - RNA, 18 nt, Human
uguuacaaauuguagaag

SEQ ID NO: 3357209 - RNA, 17 nt, Human
uguuacaaauuguagaa

SEQ ID NO: 3357210 - RNA, 14 nt, Human
uguuacaaauugua

SEQ ID NO: 3357211 - RNA, 20 nt, Human
uguagugauuuuuaugccac

SEQ ID NO: 3357212 - RNA, 16 nt, Human
aguacauuuggagaca

SEQ ID NO: 3357213 - RNA, 18 nt, Human
uguauauccuuucuaaca

SEQ ID NO: 3357214 - RNA, 19 nt, Human
aguacauuuggagacacaa

SEQ ID NO: 3357215 - RNA, 19 nt, Human
aguaauucaagaaaacaac

SEQ ID NO: 3357216 - RNA, 15 nt, Human
aguaauucaagaaaa

SEQ ID NO: 3357217 - RNA, 23 nt, Human
aguaaaaacaaagaaauuaugug

SEQ ID NO: 3357218 - RNA, 16 nt, Human
aguaaaaacaaagaaa

SEQ ID NO: 3357219 - RNA, 14 nt, Human
aggugugcaagaga

SEQ ID NO: 3357220 - RNA, 16 nt, Human
aguccaucagccucca

SEQ ID NO: 3357221 - RNA, 14 nt, Human
aguauuugugggga

SEQ ID NO: 3357222 - RNA, 17 nt, Human
auaauucagaaggaucu

SEQ ID NO: 3357223 - RNA, 21 nt, Human
auaauuuauacaggucauauu

SEQ ID NO: 3357224 - RNA, 19 nt, Human
auaauuuauacaggucaua

SEQ ID NO: 3357225 - RNA, 23 nt, Human
auaauucacauuguauucagagu

SEQ ID NO: 3357226 - RNA, 14 nt, Human
auaauuuuaaaugu

SEQ ID NO: 3357227 - RNA, 13 nt, Human
auaauuuuaaaug

SEQ ID NO: 3357228 - RNA, 12 nt, Human
auaauuuuaaau

SEQ ID NO: 3357229 - RNA, 14 nt, Human
uuaguaaucauauu

SEQ ID NO: 3357230 - RNA, 13 nt, Human
uuaguaaucauau

SEQ ID NO: 3357231 - RNA, 22 nt, Human
uuauaaaaauaaaaaacacugg

SEQ ID NO: 3357232 - RNA, 21 nt, Human
uuauaaaaauaaaaaacacug

SEQ ID NO: 3357233 - RNA, 15 nt, Human
uuauaaaaauaaaaa

SEQ ID NO: 3357234 - RNA, 19 nt, Human
uuaguacuccccuccuuga

SEQ ID NO: 3357235 - RNA, 23 nt, Human
uuacuguacagacagaaaaaacu

SEQ ID NO: 3357236 - RNA, 13 nt, Human
uuacaguguuccg

SEQ ID NO: 3357237 - RNA, 20 nt, Human
auaaaagccuguuuaagaga

SEQ ID NO: 3357238 - RNA, 19 nt, Human
auaaaagccuguuuaagag

SEQ ID NO: 3357239 - RNA, 19 nt, Human
uuaagacgaaacauuuguu

SEQ ID NO: 3357240 - RNA, 15 nt, Human
aguuuuuuuuauaca

SEQ ID NO: 3357241 - RNA, 22 nt, Human
uuaagacgaaacauuuguucua

SEQ ID NO: 3357242 - RNA, 17 nt, Human
uuaaucuuuaauuuuac

SEQ ID NO: 3357243 - RNA, 13 nt, Human
uuaaucuuuaauu

SEQ ID NO: 3357244 - RNA, 20 nt, Human
uuaaauuuugaguucuacau

SEQ ID NO: 3357245 - RNA, 15 nt, Human
uuaaauuuugaguuc

SEQ ID NO: 3357246 - RNA, 15 nt, Human
aguuuguugaaacac

SEQ ID NO: 3357247 - RNA, 19 nt, Human
uuaaaaugagaaaucuaaa

SEQ ID NO: 3357248 - RNA, 12 nt, Human
uuaaaaugagaa

SEQ ID NO: 3357249 - RNA, 17 nt, Human
aguuuaaauuguaauag

SEQ ID NO: 3357250 - RNA, 20 nt, Human
aguuuaaauuguaauaggcg

SEQ ID NO: 3357251 - RNA, 13 nt, Human
aguuuacauugua

SEQ ID NO: 3357252 - RNA, 17 nt, Human
aguuuacauuguaaaua

SEQ ID NO: 3357253 - RNA, 15 nt, Human
aguuuacauuguaaa

SEQ ID NO: 3357254 - RNA, 12 nt, Human
uuaugugugugu

SEQ ID NO: 3357255 - RNA, 14 nt, Human
uuaugugugugugu

SEQ ID NO: 3357256 - RNA, 10 nt, Human
uuaugugugu

SEQ ID NO: 3357257 - RNA, 22 nt, Human
uuaugugccagauuuaugcaua

SEQ ID NO: 3357258 - RNA, 15 nt, Human
uuaugugaaacaugu

SEQ ID NO: 3357259 - RNA, 13 nt, Human
uuaugugaaacau

SEQ ID NO: 3357260 - RNA, 20 nt, Human
uuaugauacuugaaaauuaa

SEQ ID NO: 3357261 - RNA, 20 nt, Human
uuaugaagcuuuuaugugaa

SEQ ID NO: 3357262 - RNA, 23 nt, Human
auacgcaacauaauuaaauuuug

SEQ ID NO: 3357263 - RNA, 21 nt, Human
auacaggaugaugacuaugga

SEQ ID NO: 3357264 - RNA, 16 nt, Human
uuauaaacuuuuuucu

SEQ ID NO: 3357265 - RNA, 12 nt, Human
uuauaaacuuuu

SEQ ID NO: 3357266 - RNA, 22 nt, Human
uuauaaacuuuuuucuuacugu

SEQ ID NO: 3357267 - RNA, 15 nt, Human
uuauuauauuuacaa

SEQ ID NO: 3357268 - RNA, 14 nt, Human
uuauuauauuuaca

SEQ ID NO: 3357269 - RNA, 12 nt, Human
uuauucauaauu

SEQ ID NO: 3357270 - RNA, 19 nt, Human
auagaauaaaauuuuuaau

SEQ ID NO: 3357271 - RNA, 14 nt, Human
auagaauaaaauuu

SEQ ID NO: 3357272 - RNA, 22 nt, Human
auagaauaaaauuuuuaaucuu

SEQ ID NO: 3357273 - RNA, 19 nt, Human
auagaaggcuauggggaua

SEQ ID NO: 3357274 - RNA, 13 nt, Human
auagaaguaaaaa

SEQ ID NO: 3357275 - RNA, 22 nt, Human
auagagcaaaauugauguguuu

SEQ ID NO: 3357276 - RNA, 21 nt, Human
auagagcaaaauugauguguu

SEQ ID NO: 3357277 - RNA, 17 nt, Human
auagagcaaaauugaug

SEQ ID NO: 3357278 - RNA, 15 nt, Human
auagagcaaaauuga

SEQ ID NO: 3357279 - RNA, 18 nt, Human
auagauaggucagugcaa

SEQ ID NO: 3357280 - RNA, 19 nt, Human
auagaguguacuuaacuau

SEQ ID NO: 3357281 - RNA, 14 nt, Human
auagaguguacuua

SEQ ID NO: 3357282 - RNA, 21 nt, Human
auagaguguacuuaacuauuc

SEQ ID NO: 3357283 - RNA, 14 nt, Human
auagauguguggac

SEQ ID NO: 3357284 - RNA, 12 nt, Human
auagaugugugg

SEQ ID NO: 3357285 - RNA, 13 nt, Human
auagaugugugga

SEQ ID NO: 3357286 - RNA, 11 nt, Human
auagaugugug

SEQ ID NO: 3357287 - RNA, 18 nt, Human
accugaauaaagaaugaa

SEQ ID NO: 3357288 - RNA, 23 nt, Human
uccaaagucucuggaauuugaaa

SEQ ID NO: 3357289 - RNA, 22 nt, Human
uccaccaagccuggucagccca

SEQ ID NO: 3357290 - RNA, 23 nt, Human
uccaccaagccuggucagcccaa

SEQ ID NO: 3357291 - RNA, 18 nt, Human
uccaccaagccuggucag

SEQ ID NO: 3357292 - RNA, 18 nt, Human
accuuuggagcaaagcug

SEQ ID NO: 3357293 - RNA, 17 nt, Human
accuuccaagagccuga

SEQ ID NO: 3357294 - RNA, 22 nt, Human
ucaugauagaaggcuaugggga

SEQ ID NO: 3357295 - RNA, 14 nt, Human
ucaugugaaaucau

SEQ ID NO: 3357296 - RNA, 21 nt, Human
ucauuggauucugagagcugu

SEQ ID NO: 3357297 - RNA, 22 nt, Human
accugaagcuaucguaaaauua

SEQ ID NO: 3357298 - RNA, 19 nt, Human
ucauauuaauauauuucca

SEQ ID NO: 3357299 - RNA, 16 nt, Human
accgccuccuacagcc

SEQ ID NO: 3357300 - RNA, 20 nt, Human
accagagaaaaagggagggg

SEQ ID NO: 3357301 - RNA, 18 nt, Human
accagagaaaaagggagg

SEQ ID NO: 3357302 - RNA, 19 nt, Human
acccacuugcuuuuaaaau

SEQ ID NO: 3357303 - RNA, 16 nt, Human
ucagccccgcguggaa

SEQ ID NO: 3357304 - RNA, 22 nt, Human
acccagcuaugguucucucgca

SEQ ID NO: 3357305 - RNA, 22 nt, Human
ucagauuugccuuauuggcagc

SEQ ID NO: 3357306 - RNA, 16 nt, Human
acccccaggaccccug

SEQ ID NO: 3357307 - RNA, 19 nt, Human
ucagccuggcuucaaauug

SEQ ID NO: 3357308 - RNA, 19 nt, Human
accccuggcuccaggccag

SEQ ID NO: 3357309 - RNA, 20 nt, Human
accccuggcuccaggccagg

SEQ ID NO: 3357310 - RNA, 22 nt, Human
accccuggcuccaggccagggg

SEQ ID NO: 3357311 - RNA, 17 nt, Human
ucaggaaccgaggcagg

SEQ ID NO: 3357312 - RNA, 18 nt, Human
ucaggaaccgaggcaggg

SEQ ID NO: 3357313 - RNA, 14 nt, Human
ucaggcccaaagcc

SEQ ID NO: 3357314 - RNA, 15 nt, Human
acccuccacucuccu

SEQ ID NO: 3357315 - RNA, 23 nt, Human
acccucccucuacugggagccua

SEQ ID NO: 3357316 - RNA, 15 nt, Human
acucaugugacucuu

SEQ ID NO: 3357317 - RNA, 16 nt, Human
acucaugugacucuuu

SEQ ID NO: 3357318 - RNA, 17 nt, Human
acucaugugacucuuuc

SEQ ID NO: 3357319 - RNA, 18 nt, Human
acucaucuagguaaauua

SEQ ID NO: 3357320 - RNA, 16 nt, Human
acucaucuagguaaau

SEQ ID NO: 3357321 - RNA, 11 nt, Human
uccucagcccc

SEQ ID NO: 3357322 - RNA, 12 nt, Human
acuaaaagaucg

SEQ ID NO: 3357323 - RNA, 15 nt, Human
ucccagugaauucuu

SEQ ID NO: 3357324 - RNA, 22 nt, Human
acuaugaaguuuuuuuuauaca

SEQ ID NO: 3357325 - RNA, 22 nt, Human
ucgagaucccaacacugccagc

SEQ ID NO: 3357326 - RNA, 23 nt, Human
ucgagaucccaacacugccagca

SEQ ID NO: 3357327 - RNA, 12 nt, Human
ucgacacagagu

SEQ ID NO: 3357328 - RNA, 14 nt, Human
acuggggcaggggc

SEQ ID NO: 3357329 - RNA, 16 nt, Human
acuguaaggcaaucau

SEQ ID NO: 3357330 - RNA, 17 nt, Human
acugggagaaaugaaaa

SEQ ID NO: 3357331 - RNA, 12 nt, Human
acugggagccua

SEQ ID NO: 3357332 - RNA, 23 nt, Human
acugggagccuacccacccccag

SEQ ID NO: 3357333 - RNA, 20 nt, Human
acuguacagacagaaaaaac

SEQ ID NO: 3357334 - RNA, 20 nt, Human
uccugcaccggggccugggc

SEQ ID NO: 3357335 - RNA, 19 nt, Human
uccugcaccggggccuggg

SEQ ID NO: 3357336 - RNA, 21 nt, Human
uccugcaccggggccugggca

SEQ ID NO: 3357337 - RNA, 13 nt, Human
acugagcuuggaa

SEQ ID NO: 3357338 - RNA, 16 nt, Human
acugagcuuggaagcu

SEQ ID NO: 3357339 - RNA, 12 nt, Human
acugagcuugga

SEQ ID NO: 3357340 - RNA, 17 nt, Human
acugagcuuggaagcuu

SEQ ID NO: 3357341 - RNA, 14 nt, Human
acugaggaucagag

SEQ ID NO: 3357342 - RNA, 16 nt, Human
agaaaacagaaaacaa

SEQ ID NO: 3357343 - RNA, 12 nt, Human
agaaaacagaaa

SEQ ID NO: 3357344 - RNA, 14 nt, Human
acuuuuggcauuuu

SEQ ID NO: 3357345 - RNA, 22 nt, Human
acuuuuuuuuuuuaagaguaaa

SEQ ID NO: 3357346 - RNA, 11 nt, Human
ucuggcccuau

SEQ ID NO: 3357347 - RNA, 18 nt, Human
ucuggauuauauuaugaa

SEQ ID NO: 3357348 - RNA, 12 nt, Human
ucuggauuauau

SEQ ID NO: 3357349 - RNA, 14 nt, Human
agacuuaucaacau

SEQ ID NO: 3357350 - RNA, 22 nt, Human
agagaaugaaauugcugaaaga

SEQ ID NO: 3357351 - RNA, 15 nt, Human
ucuuggagccugcag

SEQ ID NO: 3357352 - RNA, 18 nt, Human
ucuuggagccugcagagc

SEQ ID NO: 3357353 - RNA, 19 nt, Human
ucuuggagccugcagagcu

SEQ ID NO: 3357354 - RNA, 14 nt, Human
ucuugaugccuggc

SEQ ID NO: 3357355 - RNA, 20 nt, Human
ucuugaugccuggcggggug

SEQ ID NO: 3357356 - RNA, 13 nt, Human
ucuuggagccugc

SEQ ID NO: 3357357 - RNA, 14 nt, Human
ucuuggagccugca

SEQ ID NO: 3357358 - RNA, 12 nt, Human
ucuuggagccug

SEQ ID NO: 3357359 - RNA, 20 nt, Human
agaauugucuuucugucucu

SEQ ID NO: 3357360 - RNA, 18 nt, Human
ugaagguggaaauaaacu

SEQ ID NO: 3357361 - RNA, 19 nt, Human
agauaaucagugugucuaa

SEQ ID NO: 3357362 - RNA, 15 nt, Human
agaucaagagaucaa

SEQ ID NO: 3357363 - RNA, 24 nt, Human
agaggcaccacuaaaagaucgcag

SEQ ID NO: 3357364 - RNA, 21 nt, Human
agaggcgcaugaauuugugaa

SEQ ID NO: 3357365 - RNA, 22 nt, Human
ugaacuuguaaaggaauuuaaa

SEQ ID NO: 3357366 - RNA, 15 nt, Human
ucuuuguaaugaaaa

SEQ ID NO: 3357367 - RNA, 13 nt, Human
ucuuuguaaugaa

SEQ ID NO: 3357368 - RNA, 12 nt, Human
ucuuuguaauga

SEQ ID NO: 3357369 - RNA, 14 nt, Human
agauuuaugcauau

SEQ ID NO: 3357370 - RNA, 12 nt, Human
agauuuucagaa

SEQ ID NO: 3357371 - RNA, 17 nt, Human
agauuuucagaaaauau

SEQ ID NO: 3357372 - RNA, 18 nt, Human
ugacucacuuaucccaag

SEQ ID NO: 3357373 - RNA, 18 nt, Human
agauguguucacaaugga

SEQ ID NO: 3357374 - RNA, 15 nt, Human
agauguguucacaau

SEQ ID NO: 3357375 - RNA, 15 nt, Human
agaucgcaguuugcc

SEQ ID NO: 3357376 - RNA, 14 nt, Human
agaucgcaguuugc

SEQ ID NO: 3357377 - RNA, 21 nt, Human
agaucauugugaaauuauuca

SEQ ID NO: 3357378 - RNA, 12 nt, Human
agaucauuguga

SEQ ID NO: 3357379 - RNA, 17 nt, Human
ugacagguuugggaccc

SEQ ID NO: 3357380 - RNA, 15 nt, Human
agcagaaaucuagaa

SEQ ID NO: 3357381 - RNA, 17 nt, Human
ugaggaagagggacugu

SEQ ID NO: 3357382 - RNA, 13 nt, Human
ugagcuacaaaug

SEQ ID NO: 3357383 - RNA, 14 nt, Human
ugagcuacaaaugc

SEQ ID NO: 3357384 - RNA, 16 nt, Human
ugagcuacaaaugcau

SEQ ID NO: 3357385 - RNA, 14 nt, Human
ugagcuaggaauug

SEQ ID NO: 3357386 - RNA, 22 nt, Human
ugagggugacuauggagcugag

SEQ ID NO: 3357387 - RNA, 21 nt, Human
agcagauggaaugcuguguua

SEQ ID NO: 3357388 - RNA, 15 nt, Human
guccugcaccggggc

SEQ ID NO: 3357389 - RNA, 19 nt, Human
guccugcaccggggccugg

SEQ ID NO: 3357390 - RNA, 20 nt, Human
guccugcaccggggccuggg

SEQ ID NO: 3357391 - RNA, 14 nt, Human
gucgcccuggacug

SEQ ID NO: 3357392 - RNA, 22 nt, Human
aacauuuguucuauagcuuuuc

SEQ ID NO: 3357393 - RNA, 12 nt, Human
aacauaauuaaa

SEQ ID NO: 3357394 - RNA, 16 nt, Human
gugaagugaaugaaac

SEQ ID NO: 3357395 - RNA, 21 nt, Human
gugagguggaauuauuuuaaa

SEQ ID NO: 3357396 - RNA, 17 nt, Human
guggcacuggggcaggg

SEQ ID NO: 3357397 - RNA, 14 nt, Human
guggcacuggggca

SEQ ID NO: 3357398 - RNA, 18 nt, Human
guggcacuggggcagggg

SEQ ID NO: 3357399 - RNA, 11 nt, Human
aagaauauuug

SEQ ID NO: 3357400 - RNA, 15 nt, Human
aagaauauuugaaug

SEQ ID NO: 3357401 - RNA, 19 nt, Human
guggaauuauuuuaaaaga

SEQ ID NO: 3357402 - RNA, 17 nt, Human
guggaagagggcugcaa

SEQ ID NO: 3357403 - RNA, 14 nt, Human
guggaagagggcug

SEQ ID NO: 3357404 - RNA, 20 nt, Human
guggaauuauuuuaaaagau

SEQ ID NO: 3357405 - RNA, 16 nt, Human
gugcugggccccugcc

SEQ ID NO: 3357406 - RNA, 19 nt, Human
gugcugggccccugccucu

SEQ ID NO: 3357407 - RNA, 23 nt, Human
guggggggggggcgcggcuggga

SEQ ID NO: 3357408 - RNA, 18 nt, Human
guggggggggugcugggc

SEQ ID NO: 3357409 - RNA, 15 nt, Human
gugggggucugugug

SEQ ID NO: 3357410 - RNA, 16 nt, Human
gugggggucugugugu

SEQ ID NO: 3357411 - RNA, 14 nt, Human
gugggggucugugu

SEQ ID NO: 3357412 - RNA, 20 nt, Human
guggguagaucacgagauca

SEQ ID NO: 3357413 - RNA, 20 nt, Human
aagagaugaugaaaauauuu

SEQ ID NO: 3357414 - RNA, 20 nt, Human
gugguucacucuuggagccu

SEQ ID NO: 3357415 - RNA, 15 nt, Human
aagaugcaauguaga

SEQ ID NO: 3357416 - RNA, 13 nt, Human
aagcaaaugugaa

SEQ ID NO: 3357417 - RNA, 14 nt, Human
aagcaaaugugaau

SEQ ID NO: 3357418 - RNA, 13 nt, Human
guguguguaugug

SEQ ID NO: 3357419 - RNA, 16 nt, Human
gugugugggagugugu

SEQ ID NO: 3357420 - RNA, 17 nt, Human
guguguguugugugugg

SEQ ID NO: 3357421 - RNA, 14 nt, Human
guguguguaugugg

SEQ ID NO: 3357422 - RNA, 15 nt, Human
guguuguguguggga

SEQ ID NO: 3357423 - RNA, 13 nt, Human
guguucugugaua

SEQ ID NO: 3357424 - RNA, 19 nt, Human
aaguuauugauaaguucau

SEQ ID NO: 3357425 - RNA, 20 nt, Human
aaguuauugauaaguucaua

SEQ ID NO: 3357426 - RNA, 17 nt, Human
guuuuuuuuuaaagacu

SEQ ID NO: 3357427 - RNA, 19 nt, Human
aaguuuacauuguaaauag

SEQ ID NO: 3357428 - RNA, 18 nt, Human
aaguuuacauuguaaaua

SEQ ID NO: 3357429 - RNA, 22 nt, Human
aaguuauugauaaguucauaca

SEQ ID NO: 3357430 - RNA, 23 nt, Human
aaguuauugauaaguucauacau

SEQ ID NO: 3357431 - RNA, 12 nt, Human
aaguucauacau

SEQ ID NO: 3357432 - RNA, 13 nt, Human
aaguucauacauu

SEQ ID NO: 3357433 - RNA, 15 nt, Human
aaguucauacauugu

SEQ ID NO: 3357434 - RNA, 19 nt, Human
uaaaauuuuuaaucuuuaa

SEQ ID NO: 3357435 - RNA, 17 nt, Human
uaaaauuuuuaaucuuu

SEQ ID NO: 3357436 - RNA, 19 nt, Human
uaaaccucaaaaugucuaa

SEQ ID NO: 3357437 - RNA, 18 nt, Human
uaaaccucaaaaugucua

SEQ ID NO: 3357438 - RNA, 16 nt, Human
uaaagacuuuuaugau

SEQ ID NO: 3357439 - RNA, 20 nt, Human
uaaauguuuuuuuuuaaaga

SEQ ID NO: 3357440 - RNA, 14 nt, Human
uaaauuuuauaucu

SEQ ID NO: 3357441 - RNA, 16 nt, Human
uaaauuuugaguucua

SEQ ID NO: 3357442 - RNA, 23 nt, Human
uaacaaaaaaauauauuuaauga

SEQ ID NO: 3357443 - RNA, 20 nt, Human
uaacaaaaaaauauauuuaa

SEQ ID NO: 3357444 - RNA, 18 nt, Human
uaaauaguauuugagagu

SEQ ID NO: 3357445 - RNA, 15 nt, Human
aauaacgauaaaaga

SEQ ID NO: 3357446 - RNA, 15 nt, Human
aauaacaauaaaaga

SEQ ID NO: 3357447 - RNA, 12 nt, Human
aauaaaaauaau

SEQ ID NO: 3357448 - RNA, 22 nt, Human
aauaaaaauauuguguugugaa

SEQ ID NO: 3357449 - RNA, 16 nt, Human
guguuuaugugugugu

SEQ ID NO: 3357450 - RNA, 12 nt, Human
guguuuaugugu

SEQ ID NO: 3357451 - RNA, 18 nt, Human
aagcuguguggcagucug

SEQ ID NO: 3357452 - RNA, 16 nt, Human
aaggaaaaaauaacaa

SEQ ID NO: 3357453 - RNA, 14 nt, Human
guugggagaauguc

SEQ ID NO: 3357454 - RNA, 21 nt, Human
guugggagaaugucaguaugu

SEQ ID NO: 3357455 - RNA, 12 nt, Human
aaggaaaaugau

SEQ ID NO: 3357456 - RNA, 14 nt, Human
aaggaaaaugauac

SEQ ID NO: 3357457 - RNA, 22 nt, Human
aaggagcaagucagaauagaaa

SEQ ID NO: 3357458 - RNA, 14 nt, Human
aaggaucuucaucu

SEQ ID NO: 3357459 - RNA, 11 nt, Human
aaggauaaagu

SEQ ID NO: 3357460 - RNA, 23 nt, Human
aaggauaaaguugguaaaccuuu

SEQ ID NO: 3357461 - RNA, 21 nt, Human
aaggauaaaguugguaaaccu

SEQ ID NO: 3357462 - RNA, 22 nt, Human
aaguaaaaacaaagaaauuaug

SEQ ID NO: 3357463 - RNA, 15 nt, Human
aaguauucuaaauuu

SEQ ID NO: 3357464 - RNA, 13 nt, Human
aaguauucuaaau

SEQ ID NO: 3357465 - RNA, 15 nt, Human
guuuuuuuuuaaaga

SEQ ID NO: 3357466 - RNA, 13 nt, Human
uaguucugccagg

SEQ ID NO: 3357467 - RNA, 14 nt, Human
uaguucugccagga

SEQ ID NO: 3357468 - RNA, 17 nt, Human
uauaaaagccuguuuaa

SEQ ID NO: 3357469 - RNA, 14 nt, Human
uauaaaagccuguu

SEQ ID NO: 3357470 - RNA, 12 nt, Human
uauaaaagccug

SEQ ID NO: 3357471 - RNA, 23 nt, Human
acaccuaggcuaggguggggaga

SEQ ID NO: 3357472 - RNA, 20 nt, Human
acaccuaggcuagggugggg

SEQ ID NO: 3357473 - RNA, 21 nt, Human
uauacaggucauauuaauaua

SEQ ID NO: 3357474 - RNA, 16 nt, Human
uauauccuuucuaaca

SEQ ID NO: 3357475 - RNA, 13 nt, Human
uauauaucaaaua

SEQ ID NO: 3357476 - RNA, 12 nt, Human
acagccuggcug

SEQ ID NO: 3357477 - RNA, 17 nt, Human
uauggggauagaugugu

SEQ ID NO: 3357478 - RNA, 18 nt, Human
uauggggauagaugugug

SEQ ID NO: 3357479 - RNA, 14 nt, Human
uauggccuguggau

SEQ ID NO: 3357480 - RNA, 22 nt, Human
uauggccugugagcuaggaauu

SEQ ID NO: 3357481 - RNA, 21 nt, Human
uaugagcuuccuucugugaaa

SEQ ID NO: 3357482 - RNA, 15 nt, Human
uaucuugaauaaugu

SEQ ID NO: 3357483 - RNA, 18 nt, Human
uaugagcuuccuucugug

SEQ ID NO: 3357484 - RNA, 13 nt, Human
acagcccaccugg

SEQ ID NO: 3357485 - RNA, 21 nt, Human
acagacacucccacuuggcau

SEQ ID NO: 3357486 - RNA, 16 nt, Human
uauauugauccagaaa

SEQ ID NO: 3357487 - RNA, 15 nt, Human
uauauuuacaaaugg

SEQ ID NO: 3357488 - RNA, 14 nt, Human
uauauuuacaaaug

SEQ ID NO: 3357489 - RNA, 16 nt, Human
uaucuaguaugaaauu

SEQ ID NO: 3357490 - RNA, 17 nt, Human
uaucuaguaugaaauua

SEQ ID NO: 3357491 - RNA, 14 nt, Human
uaucuaguaugaaa

SEQ ID NO: 3357492 - RNA, 22 nt, Human
acagaguggacuguucccugag

SEQ ID NO: 3357493 - RNA, 11 nt, Human
acaguguuccg

SEQ ID NO: 3357494 - RNA, 20 nt, Human
acagugaaagaaaauaacaa

SEQ ID NO: 3357495 - RNA, 16 nt, Human
uauucaggagaguaga

SEQ ID NO: 3357496 - RNA, 14 nt, Human
uauucauaauuauu

SEQ ID NO: 3357497 - RNA, 14 nt, Human
uauguguguguguu

SEQ ID NO: 3357498 - RNA, 22 nt, Human
uauguguguguguugugugugg

SEQ ID NO: 3357499 - RNA, 11 nt, Human
uaugugugugu

SEQ ID NO: 3357500 - RNA, 23 nt, Human
acaguucggugagcuacaaaugc

SEQ ID NO: 3357501 - RNA, 19 nt, Human
acaguucggugagcuacaa

SEQ ID NO: 3357502 - RNA, 22 nt, Human
acaguucggugagcuacaaaug

SEQ ID NO: 3357503 - RNA, 14 nt, Human
uauuuaauucaugu

SEQ ID NO: 3357504 - RNA, 19 nt, Human
uauuuaaugauaaguaaau

SEQ ID NO: 3357505 - RNA, 19 nt, Human
uauuuaguguucauaaaua

SEQ ID NO: 3357506 - RNA, 20 nt, Human
aaugaauacuuuauaaagga

SEQ ID NO: 3357507 - RNA, 17 nt, Human
uaauguaauaacuguga

SEQ ID NO: 3357508 - RNA, 15 nt, Human
uaauguaagacaaau

SEQ ID NO: 3357509 - RNA, 18 nt, Human
uaaucagugugucuaaau

SEQ ID NO: 3357510 - RNA, 17 nt, Human
uaaucagugugucuaaa

SEQ ID NO: 3357511 - RNA, 22 nt, Human
uaauccaagcaaaugugaauca

SEQ ID NO: 3357512 - RNA, 17 nt, Human
uaaucuuuaauuuuaca

SEQ ID NO: 3357513 - RNA, 18 nt, Human
uaauacuugcuuuggaaa

SEQ ID NO: 3357514 - RNA, 13 nt, Human
uaauucauguugc

SEQ ID NO: 3357515 - RNA, 13 nt, Human
aauguaagacaaa

SEQ ID NO: 3357516 - RNA, 17 nt, Human
uacauaaguaauucaag

SEQ ID NO: 3357517 - RNA, 16 nt, Human
uacauaaguaauucaa

SEQ ID NO: 3357518 - RNA, 15 nt, Human
uacauaaguaauuca

SEQ ID NO: 3357519 - RNA, 19 nt, Human
uacauaaguaauucaagaa

SEQ ID NO: 3357520 - RNA, 12 nt, Human
aauguagagggg

SEQ ID NO: 3357521 - RNA, 15 nt, Human
aauguaugcuucaua

SEQ ID NO: 3357522 - RNA, 16 nt, Human
aauguaugcuucauac

SEQ ID NO: 3357523 - RNA, 17 nt, Human
uacauguacugauuacu

SEQ ID NO: 3357524 - RNA, 20 nt, Human
uacauuguacgaagaguauu

SEQ ID NO: 3357525 - RNA, 22 nt, Human
uacauuguacgaagaguauuuu

SEQ ID NO: 3357526 - RNA, 23 nt, Human
uacauuguacgaagaguauuuuu

SEQ ID NO: 3357527 - RNA, 19 nt, Human
uacauuguacgaagaguau

SEQ ID NO: 3357528 - RNA, 22 nt, Human
aauuaaauuuugaguucuacau

SEQ ID NO: 3357529 - RNA, 19 nt, Human
aauuaacaugaauauuuag

SEQ ID NO: 3357530 - RNA, 19 nt, Human
aaugugaacagcggcugga

SEQ ID NO: 3357531 - RNA, 17 nt, Human
acaaaaaaauauauuua

SEQ ID NO: 3357532 - RNA, 13 nt, Human
acaaaaaaauaua

SEQ ID NO: 3357533 - RNA, 20 nt, Human
acaaaaaaauauauuuaaug

SEQ ID NO: 3357534 - RNA, 18 nt, Human
acaagcacuaaacaaaga

SEQ ID NO: 3357535 - RNA, 21 nt, Human
uagcaugucgucaaagcugaa

SEQ ID NO: 3357536 - RNA, 18 nt, Human
uagcaugucgucaaagcu

SEQ ID NO: 3357537 - RNA, 17 nt, Human
uagaucacgagaucaag

SEQ ID NO: 3357538 - RNA, 16 nt, Human
uagaucacgagaucaa

SEQ ID NO: 3357539 - RNA, 18 nt, Human
aauucuuugaccuguugg

SEQ ID NO: 3357540 - RNA, 22 nt, Human
aauucuuugaccuguugggagu

SEQ ID NO: 3357541 - RNA, 21 nt, Human
aauucuugccaaauauaaaua

SEQ ID NO: 3357542 - RNA, 21 nt, Human
aauucuugaaggaaaaugaua

SEQ ID NO: 3357543 - RNA, 16 nt, Human
aauucuugaaggaaaa

SEQ ID NO: 3357544 - RNA, 15 nt, Human
aauucuugaaggaaa

SEQ ID NO: 3357545 - RNA, 15 nt, Human
aauuugaaacacuuu

SEQ ID NO: 3357546 - RNA, 20 nt, Human
aauuugaaacacuuugcaua

SEQ ID NO: 3357547 - RNA, 16 nt, Human
accugccgagagucca

SEQ ID NO: 3357548 - RNA, 23 nt, Human
accugccgagaguccaucagccu

SEQ ID NO: 3357549 - RNA, 22 nt, Human
acuauucaggagaguagaacag

SEQ ID NO: 3357550 - RNA, 21 nt, Human
acucauaaaaagccugcaauu

SEQ ID NO: 3357551 - RNA, 21 nt, Human
acucagcccucauuggcucuu

SEQ ID NO: 3357552 - RNA, 17 nt, Human
acucagcccucauuggc

SEQ ID NO: 3357553 - RNA, 12 nt, Human
acugccagcauu

SEQ ID NO: 3357554 - RNA, 22 nt, Human
acugugaaguuuacauuguaaa

SEQ ID NO: 3357555 - RNA, 18 nt, Human
acugguaggaaacuaggu

SEQ ID NO: 3357556 - RNA, 14 nt, Human
agaaaauaacaaua

SEQ ID NO: 3357557 - RNA, 23 nt, Human
acuuuuaugauacuugaaaauua

SEQ ID NO: 3357558 - RNA, 22 nt, Human
acuuuauuuucuauaauuuaaa

SEQ ID NO: 3357559 - RNA, 22 nt, Human
acuuuaucuugaauaauguaag

SEQ ID NO: 3357560 - RNA, 16 nt, Human
acuuuuaugauacuug

SEQ ID NO: 3357561 - RNA, 12 nt, Human
acuuuuaugaua

SEQ ID NO: 3357562 - RNA, 20 nt, Human
acuuuauacccagaaaguua

SEQ ID NO: 3357563 - RNA, 22 nt, Human
acuuuauacccagaaaguuauu

SEQ ID NO: 3357564 - RNA, 19 nt, Human
acuuuauacccagaaaguu

SEQ ID NO: 3357565 - RNA, 16 nt, Human
agaaaggauaaaguug

SEQ ID NO: 3357566 - RNA, 23 nt, Human
agaaaguuauugauaaguucaua

SEQ ID NO: 3357567 - RNA, 11 nt, Human
agaaaguuauu

SEQ ID NO: 3357568 - RNA, 13 nt, Human
acccccugugccu

SEQ ID NO: 3357569 - RNA, 19 nt, Human
acauuuguucuauagcuuu

SEQ ID NO: 3357570 - RNA, 13 nt, Human
accagaucauugu

SEQ ID NO: 3357571 - RNA, 22 nt, Human
acauguuucuuuguaaugaaaa

SEQ ID NO: 3357572 - RNA, 19 nt, Human
acauguuucuuuguaauga

SEQ ID NO: 3357573 - RNA, 17 nt, Human
acagccaacuauggccu

SEQ ID NO: 3357574 - RNA, 19 nt, Human
acagccaacuauggccugu

SEQ ID NO: 3357575 - RNA, 21 nt, Human
acaggaugaugacuauggaaa

SEQ ID NO: 3357576 - RNA, 17 nt, Human
aaaaucaguuguacagu

SEQ ID NO: 3357577 - RNA, 14 nt, Human
aaaauugauguguu

SEQ ID NO: 3357578 - RNA, 12 nt, Human
aaaauugaugug

SEQ ID NO: 3357579 - RNA, 21 nt, Human
aaaauugaugggauuugguca

SEQ ID NO: 3357580 - RNA, 21 nt, Human
aaaauugauguguuuauuuau

SEQ ID NO: 3357581 - RNA, 22 nt, Human
aaacacugggagaaaugaaaaa

SEQ ID NO: 3357582 - RNA, 24 nt, Human
aaacacucaguuguucaauaauaa

SEQ ID NO: 3357583 - RNA, 21 nt, Human
aaacacugggagaaaugaaaa

SEQ ID NO: 3357584 - RNA, 17 nt, Human
aaagaaauauaccuaaa

SEQ ID NO: 3357585 - RNA, 15 nt, Human
aaagaaauauaccua

SEQ ID NO: 3357586 - RNA, 15 nt, Human
aaagccaaugugaac

SEQ ID NO: 3357587 - RNA, 17 nt, Human
aaagccaaugugaacag

SEQ ID NO: 3357588 - RNA, 22 nt, Human
aacuuuauacccagaaaguuau

SEQ ID NO: 3357589 - RNA, 23 nt, Human
aacuuuauacccagaaaguuauu

SEQ ID NO: 3357590 - RNA, 17 nt, Human
aaaucuuauaauuuaaa

SEQ ID NO: 3357591 - RNA, 15 nt, Human
aaaugccuuuguacu

SEQ ID NO: 3357592 - RNA, 22 nt, Human
aaccacuggaaaguuuaugguu

SEQ ID NO: 3357593 - RNA, 18 nt, Human
aaccaccagaagcccaga

SEQ ID NO: 3357594 - RNA, 19 nt, Human
aaccaccagaagcccagaa

SEQ ID NO: 3357595 - RNA, 21 nt, Human
aaugcuagguuaauuccaauu

SEQ ID NO: 3357596 - RNA, 13 nt, Human
aaugucaguaugu

SEQ ID NO: 3357597 - RNA, 15 nt, Human
aaugucaguaugugg

SEQ ID NO: 3357598 - RNA, 19 nt, Human
aaugcuagguuaauuccaa

SEQ ID NO: 3357599 - RNA, 18 nt, Human
aaugcuagguuaauucca

SEQ ID NO: 3357600 - RNA, 22 nt, Human
aauguuuuuuuuuaaagacuuu

SEQ ID NO: 3357601 - RNA, 20 nt, Human
aauguuuuuuuuuaaagacu

SEQ ID NO: 3357602 - RNA, 15 nt, Human
aauguuuuuuuuuaa

SEQ ID NO: 3357603 - RNA, 16 nt, Human
aauauguuucaaacuu

SEQ ID NO: 3357604 - RNA, 17 nt, Human
aauauguuucaaacuuu

SEQ ID NO: 3357605 - RNA, 13 nt, Human
aauauguuucaaa

SEQ ID NO: 3357606 - RNA, 15 nt, Human
aauauguuucaaacu

SEQ ID NO: 3357607 - RNA, 16 nt, Human
aauauauaucaaauau

SEQ ID NO: 3357608 - RNA, 15 nt, Human
aaucaccaaaggcuc

SEQ ID NO: 3357609 - RNA, 13 nt, Human
aauccagccugcu

SEQ ID NO: 3357610 - RNA, 18 nt, Human
aauccaagcaaaugugaa

SEQ ID NO: 3357611 - RNA, 17 nt, Human
aauccaagcaaauguga

SEQ ID NO: 3357612 - RNA, 20 nt, Human
aaggugaggagcuugaaacc

SEQ ID NO: 3357613 - RNA, 17 nt, Human
aaguaguguaucacagu

SEQ ID NO: 3357614 - RNA, 14 nt, Human
aagucuccaaaguc

SEQ ID NO: 3357615 - RNA, 15 nt, Human
aagucuccaaagucu

SEQ ID NO: 3357616 - RNA, 21 nt, Human
aagcugugugcucuccaagcc

SEQ ID NO: 3357617 - RNA, 19 nt, Human
aagcagauggaaugcugug

SEQ ID NO: 3357618 - RNA, 17 nt, Human
aagcagauggaaugcug

SEQ ID NO: 3357619 - RNA, 20 nt, Human
aagcagauggaaugcugugu

SEQ ID NO: 3357620 - RNA, 14 nt, Human
agccgggagccuga

SEQ ID NO: 3357621 - RNA, 13 nt, Human
agcacugacagau

SEQ ID NO: 3357622 - RNA, 14 nt, Human
agcacugacagauu

SEQ ID NO: 3357623 - RNA, 18 nt, Human
agcacugacagauuucca

SEQ ID NO: 3357624 - RNA, 14 nt, Human
agcagugggccugg

SEQ ID NO: 3357625 - RNA, 18 nt, Human
agcagugggccuggccag

SEQ ID NO: 3357626 - RNA, 20 nt, Human
agaggacaguauuugugggg

SEQ ID NO: 3357627 - RNA, 17 nt, Human
agagggaugcauggaga

SEQ ID NO: 3357628 - RNA, 14 nt, Human
agcugcuccccacg

SEQ ID NO: 3357629 - RNA, 17 nt, Human
agcugcuccccacguca

SEQ ID NO: 3357630 - RNA, 21 nt, Human
agcuucuggugaccuuccaag

SEQ ID NO: 3357631 - RNA, 22 nt, Human
agcuucuggugaccuuccaaga

SEQ ID NO: 3357632 - RNA, 18 nt, Human
agcuccuuaaggcucuuu

SEQ ID NO: 3357633 - RNA, 22 nt, Human
agcuccuuaaggcucuuuugua

SEQ ID NO: 3357634 - RNA, 21 nt, Human
aggagucccugccaucauguu

SEQ ID NO: 3357635 - RNA, 21 nt, Human
agcuuuucccuuuuuuuaagu

SEQ ID NO: 3357636 - RNA, 17 nt, Human
aggggccgggggcaguc

SEQ ID NO: 3357637 - RNA, 18 nt, Human
agguaaaucagacuauga

SEQ ID NO: 3357638 - RNA, 20 nt, Human
agguaaaagcaucacaugaa

SEQ ID NO: 3357639 - RNA, 11 nt, Human
aggucccuaau

SEQ ID NO: 3357640 - RNA, 12 nt, Human
aggucccuaaua

SEQ ID NO: 3357641 - RNA, 23 nt, Human
agguaaaucagacuaugaaguuu

SEQ ID NO: 3357642 - RNA, 15 nt, Human
aggucccuaauaaag

SEQ ID NO: 3357643 - RNA, 13 nt, Human
aggucccuaauaa

SEQ ID NO: 3357644 - RNA, 17 nt, Human
agguggaauuauuuuaa

SEQ ID NO: 3357645 - RNA, 21 nt, Human
agguggaauuauuuuaaaaga

SEQ ID NO: 3357646 - RNA, 23 nt, Human
aggcuacuguaaggcaaucaugg

SEQ ID NO: 3357647 - RNA, 19 nt, Human
augagcuccuuaaggcucu

SEQ ID NO: 3357648 - RNA, 21 nt, Human
augaagcuuuuaugugaaaca

SEQ ID NO: 3357649 - RNA, 23 nt, Human
augaaaaaauauauaucaaauau

SEQ ID NO: 3357650 - RNA, 19 nt, Human
augaaguuuuuuuuauaca

SEQ ID NO: 3357651 - RNA, 22 nt, Human
augaagcuuuuaugugaaacau

SEQ ID NO: 3357652 - RNA, 18 nt, Human
aucuugaauaauguaaga

SEQ ID NO: 3357653 - RNA, 14 nt, Human
aucagccugugcca

SEQ ID NO: 3357654 - RNA, 15 nt, Human
aucaugugaaaucau

SEQ ID NO: 3357655 - RNA, 14 nt, Human
aucaugugaaauca

SEQ ID NO: 3357656 - RNA, 16 nt, Human
aucaugugaaaucauu

SEQ ID NO: 3357657 - RNA, 16 nt, Human
auccagaaagaaaacu

SEQ ID NO: 3357658 - RNA, 18 nt, Human
auccagaaagaaaacuug

SEQ ID NO: 3357659 - RNA, 14 nt, Human
auguuucaaacuuu

SEQ ID NO: 3357660 - RNA, 17 nt, Human
auguuucaaacuuugga

SEQ ID NO: 3357661 - RNA, 12 nt, Human
auguuucaaacu

SEQ ID NO: 3357662 - RNA, 13 nt, Human
auguuucaaacuu

SEQ ID NO: 3357663 - RNA, 19 nt, Human
auguauucuagcuaaugua

SEQ ID NO: 3357664 - RNA, 20 nt, Human
auguauucuagcuaauguaa

SEQ ID NO: 3357665 - RNA, 15 nt, Human
augugaaacauguuu

SEQ ID NO: 3357666 - RNA, 21 nt, Human
augcauagguuuagcaguaua

SEQ ID NO: 3357667 - RNA, 17 nt, Human
augcauagguuuagcag

SEQ ID NO: 3357668 - RNA, 16 nt, Human
augcauauuauuuuau

SEQ ID NO: 3357669 - RNA, 16 nt, Human
auggcuguggagugug

SEQ ID NO: 3357670 - RNA, 23 nt, Human
auaguauuugagaguucuaaauu

SEQ ID NO: 3357671 - RNA, 21 nt, Human
auaguauuugagaguucuaaa

SEQ ID NO: 3357672 - RNA, 20 nt, Human
auaguauuugagaguucuaa

SEQ ID NO: 3357673 - RNA, 15 nt, Human
auagguuuaauaauu

SEQ ID NO: 3357674 - RNA, 23 nt, Human
auauuaugaagcuuuuaugugaa

SEQ ID NO: 3357675 - RNA, 16 nt, Human
auaucaaauauauuca

SEQ ID NO: 3357676 - RNA, 20 nt, Human
auaauuaaauuuugaguucu

SEQ ID NO: 3357677 - RNA, 14 nt, Human
auaaaaauauugug

SEQ ID NO: 3357678 - RNA, 20 nt, Human
auaaacuuuuuucuuacugu

SEQ ID NO: 3357679 - RNA, 15 nt, Human
auaaagcaggcagaa

SEQ ID NO: 3357680 - RNA, 18 nt, Human
auaaagcuguguggcagu

SEQ ID NO: 3357681 - RNA, 18 nt, Human
auaaaggauuaaugucaa

SEQ ID NO: 3357682 - RNA, 18 nt, Human
aguucauaaauuuauggu

SEQ ID NO: 3357683 - RNA, 10 nt, Human
aguucauaca

SEQ ID NO: 3357684 - RNA, 11 nt, Human
aguucauacau

SEQ ID NO: 3357685 - RNA, 15 nt, Human
aguucauacauugua

SEQ ID NO: 3357686 - RNA, 22 nt, Human
aguugaaaaucuuauaauuuaa

SEQ ID NO: 3357687 - RNA, 23 nt, Human
aguugaaaaucuuauaauuuaaa

SEQ ID NO: 3357688 - RNA, 16 nt, Human
aguggcuggaucugug

SEQ ID NO: 3357689 - RNA, 14 nt, Human
aguaugaaauuaua

SEQ ID NO: 3357690 - RNA, 16 nt, Human
aguaucuuuuuauuca

SEQ ID NO: 3357691 - RNA, 16 nt, Human
aguaugaaauuauaua

SEQ ID NO: 3357692 - RNA, 12 nt, Human
aguccuguaaug

SEQ ID NO: 3357693 - RNA, 16 nt, Human
caccccgacuuuuguu

SEQ ID NO: 3357694 - RNA, 16 nt, Human
caccagaagcccagaa

SEQ ID NO: 3357695 - RNA, 17 nt, Human
caccagaagcccagaau

SEQ ID NO: 3357696 - RNA, 13 nt, Human
caccagaagccca

SEQ ID NO: 3357697 - RNA, 14 nt, Human
caccagaagcccag

SEQ ID NO: 3357698 - RNA, 15 nt, Human
caccagaagcccaga

SEQ ID NO: 3357699 - RNA, 21 nt, Human
cacaaauucugucucuggauu

SEQ ID NO: 3357700 - RNA, 19 nt, Human
cacaacuauuuuuccaaaa

SEQ ID NO: 3357701 - RNA, 14 nt, Human
cacaacuauuuuuc

SEQ ID NO: 3357702 - RNA, 23 nt, Human
cacauaucuaguaugaaauuaua

SEQ ID NO: 3357703 - RNA, 20 nt, Human
caccaagccuggucagccca

SEQ ID NO: 3357704 - RNA, 21 nt, Human
caccaagccuggucagcccaa

SEQ ID NO: 3357705 - RNA, 19 nt, Human
caccaagccuggucagccc

SEQ ID NO: 3357706 - RNA, 18 nt, Human
cacauuggagauguuuag

SEQ ID NO: 3357707 - RNA, 22 nt, Human
caccaagccuggucagcccaaa

SEQ ID NO: 3357708 - RNA, 22 nt, Human
cacauggugacuuuugaaaaga

SEQ ID NO: 3357709 - RNA, 15 nt, Human
caaauucugucucug

SEQ ID NO: 3357710 - RNA, 18 nt, Human
caagaaaacaacuucaau

SEQ ID NO: 3357711 - RNA, 11 nt, Human
caacuuuguau

SEQ ID NO: 3357712 - RNA, 12 nt, Human
caacuuuauacc

SEQ ID NO: 3357713 - RNA, 17 nt, Human
caagcacuaaacaaaga

SEQ ID NO: 3357714 - RNA, 20 nt, Human
caaggaaaaaauaacaauga

SEQ ID NO: 3357715 - RNA, 12 nt, Human
caaauauauuca

SEQ ID NO: 3357716 - RNA, 23 nt, Human
caaaaaaauauauuuaaugauaa

SEQ ID NO: 3357717 - RNA, 18 nt, Human
caaaaaaauauauuuaau

SEQ ID NO: 3357718 - RNA, 14 nt, Human
uuuaugccaccuga

SEQ ID NO: 3357719 - RNA, 14 nt, Human
uuuaugcauauuau

SEQ ID NO: 3357720 - RNA, 15 nt, Human
uuucacauaucuagu

SEQ ID NO: 3357721 - RNA, 18 nt, Human
uuuccacuccuccuagcc

SEQ ID NO: 3357722 - RNA, 19 nt, Human
uuuccacuccuccuagcca

SEQ ID NO: 3357723 - RNA, 20 nt, Human
uuuccuaaauauauuuuaag

SEQ ID NO: 3357724 - RNA, 22 nt, Human
uuucuaaaguaaaaacaaagaa

SEQ ID NO: 3357725 - RNA, 17 nt, Human
uuucuaaaguaaaaaca

SEQ ID NO: 3357726 - RNA, 14 nt, Human
uuucuaaaguaaaa

SEQ ID NO: 3357727 - RNA, 16 nt, Human
uuugagaguucuaaau

SEQ ID NO: 3357728 - RNA, 14 nt, Human
uuugagaguucuaa

SEQ ID NO: 3357729 - RNA, 13 nt, Human
uuugaguucuaca

SEQ ID NO: 3357730 - RNA, 12 nt, Human
uuugaguucuac

SEQ ID NO: 3357731 - RNA, 18 nt, Human
uuucuuaaccagaucauu

SEQ ID NO: 3357732 - RNA, 21 nt, Human
uuugaaauuguauuacaaauc

SEQ ID NO: 3357733 - RNA, 16 nt, Human
uuuaaaauugugaugu

SEQ ID NO: 3357734 - RNA, 12 nt, Human
uuuaaaaugucu

SEQ ID NO: 3357735 - RNA, 16 nt, Human
uuuaaaaugagaaauc

SEQ ID NO: 3357736 - RNA, 20 nt, Human
uuuaaaagauaaauauuaua

SEQ ID NO: 3357737 - RNA, 18 nt, Human
uuuaaaagaugcaaugua

SEQ ID NO: 3357738 - RNA, 15 nt, Human
uuguuuagaagaagu

SEQ ID NO: 3357739 - RNA, 18 nt, Human
uuguuuagaagaagugug

SEQ ID NO: 3357740 - RNA, 15 nt, Human
uuuaauaaacacucu

SEQ ID NO: 3357741 - RNA, 14 nt, Human
uuuaauaaacacuc

SEQ ID NO: 3357742 - RNA, 22 nt, Human
uuuaauaaacacucuugaaaaa

SEQ ID NO: 3357743 - RNA, 20 nt, Human
uuuacagaggacaguauuug

SEQ ID NO: 3357744 - RNA, 15 nt, Human
uuuauacaggucaua

SEQ ID NO: 3357745 - RNA, 18 nt, Human
uuuaguugcaacuuugua

SEQ ID NO: 3357746 - RNA, 17 nt, Human
uuuaguugcaacuuugu

SEQ ID NO: 3357747 - RNA, 16 nt, Human
uuguacgaagaguauu

SEQ ID NO: 3357748 - RNA, 14 nt, Human
uuguagcacugaca

SEQ ID NO: 3357749 - RNA, 16 nt, Human
uuguagcacugacaga

SEQ ID NO: 3357750 - RNA, 17 nt, Human
uuguagcacugacagau

SEQ ID NO: 3357751 - RNA, 18 nt, Human
uuguagcacugacagauu

SEQ ID NO: 3357752 - RNA, 22 nt, Human
uuguagcacugacagauuucca

SEQ ID NO: 3357753 - RNA, 18 nt, Human
uuguacuuuagggaagua

SEQ ID NO: 3357754 - RNA, 14 nt, Human
uugggaccccuggu

SEQ ID NO: 3357755 - RNA, 15 nt, Human
uugggaccccuggug

SEQ ID NO: 3357756 - RNA, 16 nt, Human
uugggaccccuggugg

SEQ ID NO: 3357757 - RNA, 20 nt, Human
uugggaccccuggugguuca

SEQ ID NO: 3357758 - RNA, 16 nt, Human
uuggcagcucuacucu

SEQ ID NO: 3357759 - RNA, 17 nt, Human
uugaauguuaagcagau

SEQ ID NO: 3357760 - RNA, 14 nt, Human
uugaauguuaagca

SEQ ID NO: 3357761 - RNA, 21 nt, Human
uugaaaaucuuauaauuuaaa

SEQ ID NO: 3357762 - RNA, 18 nt, Human
uugaaaauuaacaugaau

SEQ ID NO: 3357763 - RNA, 17 nt, Human
uugauccagaaagaaaa

SEQ ID NO: 3357764 - RNA, 20 nt, Human
uugcaguguggugagaucau

SEQ ID NO: 3357765 - RNA, 16 nt, Human
uugcauaacguauaaa

SEQ ID NO: 3357766 - RNA, 13 nt, Human
uuaugccaccuga

SEQ ID NO: 3357767 - RNA, 16 nt, Human
uuaugccaccugaaua

SEQ ID NO: 3357768 - RNA, 20 nt, Human
uuaucuugaauaauguaaga

SEQ ID NO: 3357769 - RNA, 13 nt, Human
uuaguugcaacuu

SEQ ID NO: 3357770 - RNA, 20 nt, Human
uuaguugcaacuuuguauaa

SEQ ID NO: 3357771 - RNA, 15 nt, Human
uuauugauaaguuca

SEQ ID NO: 3357772 - RNA, 19 nt, Human
uuauugauaaguucauaca

SEQ ID NO: 3357773 - RNA, 20 nt, Human
uuauugauaaguucauacau

SEQ ID NO: 3357774 - RNA, 22 nt, Human
uucagaguugaugguuguacau

SEQ ID NO: 3357775 - RNA, 21 nt, Human
uucagaguugaugguuguaca

SEQ ID NO: 3357776 - RNA, 20 nt, Human
uuauuuuauguugcauagaa

SEQ ID NO: 3357777 - RNA, 20 nt, Human
uuccuucugugaaaguacau

SEQ ID NO: 3357778 - RNA, 12 nt, Human
uucccugaggug

SEQ ID NO: 3357779 - RNA, 16 nt, Human
uucccugaaggaacca

SEQ ID NO: 3357780 - RNA, 12 nt, Human
uuccaaaauaau

SEQ ID NO: 3357781 - RNA, 19 nt, Human
uucaugcauagguuuagca

SEQ ID NO: 3357782 - RNA, 17 nt, Human
uucaugcaaacuuuauu

SEQ ID NO: 3357783 - RNA, 21 nt, Human
uuccaaaauaauuuuaagaaa

SEQ ID NO: 3357784 - RNA, 13 nt, Human
uuccaaaauaauu

SEQ ID NO: 3357785 - RNA, 16 nt, Human
uuccacuccuccuagc

SEQ ID NO: 3357786 - RNA, 18 nt, Human
uuccacuccuccuagcca

SEQ ID NO: 3357787 - RNA, 21 nt, Human
uuccacuccuccuagccaccc

SEQ ID NO: 3357788 - RNA, 14 nt, Human
uuaguguucauaaa

SEQ ID NO: 3357789 - RNA, 21 nt, Human
uuacuaggugcccagaaugag

SEQ ID NO: 3357790 - RNA, 19 nt, Human
uuacugucuuuuuucuaaa

SEQ ID NO: 3357791 - RNA, 17 nt, Human
uuacugucuuuuuucua

SEQ ID NO: 3357792 - RNA, 21 nt, Human
uuaagcagauggaaugcugug

SEQ ID NO: 3357793 - RNA, 12 nt, Human
uuaacucagucu

SEQ ID NO: 3357794 - RNA, 23 nt, Human
uuaaauguuuuuuuuuaaagacu

SEQ ID NO: 3357795 - RNA, 21 nt, Human
uuaaauguuuuuuuuuaaaga

SEQ ID NO: 3357796 - RNA, 17 nt, Human
uuaaugauaaguaaaug

SEQ ID NO: 3357797 - RNA, 21 nt, Human
uuaaugauaaguaaaugcuag

SEQ ID NO: 3357798 - RNA, 13 nt, Human
uuaauauauuucc

SEQ ID NO: 3357799 - RNA, 14 nt, Human
uuaauauauuucca

SEQ ID NO: 3357800 - RNA, 19 nt, Human
uguuuagaagaaguguguc

SEQ ID NO: 3357801 - RNA, 16 nt, Human
uguuuagaagaagugu

SEQ ID NO: 3357802 - RNA, 21 nt, Human
uuaaaagaugcaauguagagg

SEQ ID NO: 3357803 - RNA, 18 nt, Human
uuaaaagauaaauauuau

SEQ ID NO: 3357804 - RNA, 18 nt, Human
uguuuuuuuuuaaagacu

SEQ ID NO: 3357805 - RNA, 11 nt, Human
uuuguggggag

SEQ ID NO: 3357806 - RNA, 15 nt, Human
uaggcuagggugggg

SEQ ID NO: 3357807 - RNA, 16 nt, Human
uaggcuagggugggga

SEQ ID NO: 3357808 - RNA, 16 nt, Human
uaggucagugcaaaua

SEQ ID NO: 3357809 - RNA, 16 nt, Human
uagguaaauuacaguu

SEQ ID NO: 3357810 - RNA, 16 nt, Human
uaggaauuguguuuau

SEQ ID NO: 3357811 - RNA, 15 nt, Human
uaguaugaaauuaua

SEQ ID NO: 3357812 - RNA, 23 nt, Human
uaguaugaaauuauauaaguauu

SEQ ID NO: 3357813 - RNA, 13 nt, Human
uaguaugaaauua

SEQ ID NO: 3357814 - RNA, 20 nt, Human
uaguugcaacuuuguauaaa

SEQ ID NO: 3357815 - RNA, 15 nt, Human
uauaauucacauugu

SEQ ID NO: 3357816 - RNA, 18 nt, Human
uaucguaaaauuaagaaa

SEQ ID NO: 3357817 - RNA, 15 nt, Human
uaucguaaaauuaag

SEQ ID NO: 3357818 - RNA, 17 nt, Human
uauccuuucuaacaaaa

SEQ ID NO: 3357819 - RNA, 19 nt, Human
uaugacauaaaaacaacuu

SEQ ID NO: 3357820 - RNA, 22 nt, Human
uaugacauaaaaacaacuuuau

SEQ ID NO: 3357821 - RNA, 23 nt, Human
uaugacauaaaaacaacuuuaua

SEQ ID NO: 3357822 - RNA, 20 nt, Human
uaugaaguuuuuuuuauaca

SEQ ID NO: 3357823 - RNA, 17 nt, Human
uaucuguuuacaguguu

SEQ ID NO: 3357824 - RNA, 16 nt, Human
uaucuguuuacagugu

SEQ ID NO: 3357825 - RNA, 23 nt, Human
uaugagcuggggaugucucucau

SEQ ID NO: 3357826 - RNA, 12 nt, Human
uaugcuucauac

SEQ ID NO: 3357827 - RNA, 13 nt, Human
uaugcuucauaca

SEQ ID NO: 3357828 - RNA, 14 nt, Human
uaugcuucauacag

SEQ ID NO: 3357829 - RNA, 16 nt, Human
uaugcuucauacaggg

SEQ ID NO: 3357830 - RNA, 20 nt, Human
uaugcauauuauuuuauguu

SEQ ID NO: 3357831 - RNA, 17 nt, Human
uaugcuucauacaggga

SEQ ID NO: 3357832 - RNA, 12 nt, Human
ucacauuuaaau

SEQ ID NO: 3357833 - RNA, 22 nt, Human
ucacauuguauucagaguugau

SEQ ID NO: 3357834 - RNA, 15 nt, Human
ucaaagagagaaaau

SEQ ID NO: 3357835 - RNA, 20 nt, Human
ucaaagagagaaaauaaaga

SEQ ID NO: 3357836 - RNA, 22 nt, Human
uauuugaauguaugcuucauac

SEQ ID NO: 3357837 - RNA, 23 nt, Human
uauuugaauguaugcuucauaca

SEQ ID NO: 3357838 - RNA, 23 nt, Human
uauguguguguguuguguguggg

SEQ ID NO: 3357839 - RNA, 13 nt, Human
uauguguguuuua

SEQ ID NO: 3357840 - RNA, 14 nt, Human
uauggaggcaggag

SEQ ID NO: 3357841 - RNA, 17 nt, Human
uauuauauuuacaaaug

SEQ ID NO: 3357842 - RNA, 20 nt, Human
uauuauggaggcaggaguuu

SEQ ID NO: 3357843 - RNA, 12 nt, Human
uauuauguguuu

SEQ ID NO: 3357844 - RNA, 21 nt, Human
uauuugaauguaugcuucaua

SEQ ID NO: 3357845 - RNA, 23 nt, Human
uauugauaaguucauacauugua

SEQ ID NO: 3357846 - RNA, 14 nt, Human
uauugauaaguuca

SEQ ID NO: 3357847 - RNA, 16 nt, Human
uauugauaaguucaua

SEQ ID NO: 3357848 - RNA, 13 nt, Human
uccuacccccugu

SEQ ID NO: 3357849 - RNA, 15 nt, Human
uccuacccccugugc

SEQ ID NO: 3357850 - RNA, 16 nt, Human
uccuacccccugugcc

SEQ ID NO: 3357851 - RNA, 17 nt, Human
uccuacccccugugccu

SEQ ID NO: 3357852 - RNA, 15 nt, Human
uccugucucccuccu

SEQ ID NO: 3357853 - RNA, 23 nt, Human
uccugucucccuccucugcccgg

SEQ ID NO: 3357854 - RNA, 23 nt, Human
ucucauaauuuauacaggucaua

SEQ ID NO: 3357855 - RNA, 16 nt, Human
ucuacugggagccuac

SEQ ID NO: 3357856 - RNA, 19 nt, Human
ucuacugggagccuaccca

SEQ ID NO: 3357857 - RNA, 14 nt, Human
uccaaacaggcuca

SEQ ID NO: 3357858 - RNA, 16 nt, Human
uccaaaccaaauaaaa

SEQ ID NO: 3357859 - RNA, 20 nt, Human
uccaaaaagauuuucagaaa

SEQ ID NO: 3357860 - RNA, 22 nt, Human
uccaaaaagauuuucagaaaau

SEQ ID NO: 3357861 - RNA, 14 nt, Human
ucauggugcucaga

SEQ ID NO: 3357862 - RNA, 16 nt, Human
ucaucuccccaucauu

SEQ ID NO: 3357863 - RNA, 22 nt, Human
ucagucuuuaaucugagaggcc

SEQ ID NO: 3357864 - RNA, 15 nt, Human
ucaggccgaaggagg

SEQ ID NO: 3357865 - RNA, 15 nt, Human
ucaggagcccuggga

SEQ ID NO: 3357866 - RNA, 14 nt, Human
ucaggagcccuggg

SEQ ID NO: 3357867 - RNA, 12 nt, Human
ucaggagcccug

SEQ ID NO: 3357868 - RNA, 11 nt, Human
ucaggagcccu

SEQ ID NO: 3357869 - RNA, 19 nt, Human
uccagagucccugccugga

SEQ ID NO: 3357870 - RNA, 20 nt, Human
uccagagucccugccuggac

SEQ ID NO: 3357871 - RNA, 21 nt, Human
uccagagucccugccuggacc

SEQ ID NO: 3357872 - RNA, 15 nt, Human
uccagagucccugcc

SEQ ID NO: 3357873 - RNA, 18 nt, Human
uccagagucccugccugg

SEQ ID NO: 3357874 - RNA, 23 nt, Human
uccagaaagaaaacuuguauuau

SEQ ID NO: 3357875 - RNA, 14 nt, Human
uccagcaccacacu

SEQ ID NO: 3357876 - RNA, 19 nt, Human
ugagcuccuuaaggcucuu

SEQ ID NO: 3357877 - RNA, 21 nt, Human
ugagcuccuuaaggcucuuuu

SEQ ID NO: 3357878 - RNA, 23 nt, Human
ugagacguuuuuggaagaguagu

SEQ ID NO: 3357879 - RNA, 17 nt, Human
ugagaaauuuauaaacu

SEQ ID NO: 3357880 - RNA, 14 nt, Human
ugaggugggagaug

SEQ ID NO: 3357881 - RNA, 20 nt, Human
ugagcuggggaugucucuca

SEQ ID NO: 3357882 - RNA, 14 nt, Human
ugaggcaggucccc

SEQ ID NO: 3357883 - RNA, 16 nt, Human
ugaggcagguccccag

SEQ ID NO: 3357884 - RNA, 17 nt, Human
ugaggcagguccccaga

SEQ ID NO: 3357885 - RNA, 13 nt, Human
ugaggcagguccc

SEQ ID NO: 3357886 - RNA, 16 nt, Human
ugaggagcuugaaacc

SEQ ID NO: 3357887 - RNA, 22 nt, Human
ugaguucuacauaaguaauuca

SEQ ID NO: 3357888 - RNA, 13 nt, Human
ugauuauauguca

SEQ ID NO: 3357889 - RNA, 18 nt, Human
ugauguguuuauuuauag

SEQ ID NO: 3357890 - RNA, 14 nt, Human
ugauguguuuauuu

SEQ ID NO: 3357891 - RNA, 21 nt, Human
ugauguauucuagcuaaugua

SEQ ID NO: 3357892 - RNA, 14 nt, Human
ugaugguuguacau

SEQ ID NO: 3357893 - RNA, 13 nt, Human
ugaugguuguaca

SEQ ID NO: 3357894 - RNA, 20 nt, Human
ugaugcuacaggauuugaaa

SEQ ID NO: 3357895 - RNA, 11 nt, Human
ugaugccuggc

SEQ ID NO: 3357896 - RNA, 21 nt, Human
ugaacagcggcuggacuugga

SEQ ID NO: 3357897 - RNA, 22 nt, Human
ugaacagcggcuggacuuggag

SEQ ID NO: 3357898 - RNA, 15 nt, Human
ugaacagcggcugga

SEQ ID NO: 3357899 - RNA, 19 nt, Human
ugaaauggacuuuuguaca

SEQ ID NO: 3357900 - RNA, 12 nt, Human
ugaaauuauuca

SEQ ID NO: 3357901 - RNA, 17 nt, Human
ucuuucacauuuaaaua

SEQ ID NO: 3357902 - RNA, 12 nt, Human
ucuuugccaagu

SEQ ID NO: 3357903 - RNA, 21 nt, Human
ucuuuccacuccuccuagcca

SEQ ID NO: 3357904 - RNA, 22 nt, Human
ucuuuccacuccuccuagccac

SEQ ID NO: 3357905 - RNA, 16 nt, Human
ugaaggaaccaaagcg

SEQ ID NO: 3357906 - RNA, 23 nt, Human
ugaaucauuuuaccuuugacaaa

SEQ ID NO: 3357907 - RNA, 22 nt, Human
ugaaucauuuuaccuuugacaa

SEQ ID NO: 3357908 - RNA, 16 nt, Human
ugaauuauuuucucuc

SEQ ID NO: 3357909 - RNA, 17 nt, Human
ugacauacauccaacau

SEQ ID NO: 3357910 - RNA, 23 nt, Human
ugacauaaguauuuaauucaugu

SEQ ID NO: 3357911 - RNA, 16 nt, Human
ugacagaauauguuuc

SEQ ID NO: 3357912 - RNA, 22 nt, Human
ugacaacuucccagugaauucu

SEQ ID NO: 3357913 - RNA, 13 nt, Human
ugggcaggaggga

SEQ ID NO: 3357914 - RNA, 15 nt, Human
ugggcaggagggagg

SEQ ID NO: 3357915 - RNA, 16 nt, Human
ugggcaggagggaggu

SEQ ID NO: 3357916 - RNA, 18 nt, Human
ugggcaggagggaggugc

SEQ ID NO: 3357917 - RNA, 23 nt, Human
ugggccccugccucucugcaggu

SEQ ID NO: 3357918 - RNA, 21 nt, Human
ugggccccugccucucugcag

SEQ ID NO: 3357919 - RNA, 20 nt, Human
ugggccccugccucucugca

SEQ ID NO: 3357920 - RNA, 11 nt, Human
ugggagugugu

SEQ ID NO: 3357921 - RNA, 22 nt, Human
ugggagugaggaugucugggcc

SEQ ID NO: 3357922 - RNA, 20 nt, Human
uggggaguuuaggguggggg

SEQ ID NO: 3357923 - RNA, 16 nt, Human
uggggauagaugugug

SEQ ID NO: 3357924 - RNA, 17 nt, Human
uggggauagaugugugg

SEQ ID NO: 3357925 - RNA, 18 nt, Human
uggggauagaugugugga

SEQ ID NO: 3357926 - RNA, 20 nt, Human
uggggauagauguguggaca

SEQ ID NO: 3357927 - RNA, 20 nt, Human
uggggccaggcugggucgcc

SEQ ID NO: 3357928 - RNA, 22 nt, Human
uggggccaggcugggucgcccu

SEQ ID NO: 3357929 - RNA, 21 nt, Human
uggggccaggcugggucgccc

SEQ ID NO: 3357930 - RNA, 13 nt, Human
uggggggggugcu

SEQ ID NO: 3357931 - RNA, 14 nt, Human
ugggggucugugug

SEQ ID NO: 3357932 - RNA, 14 nt, Human
ugguccucacacuc

SEQ ID NO: 3357933 - RNA, 21 nt, Human
uggugaccuuccaagagccug

SEQ ID NO: 3357934 - RNA, 22 nt, Human
uggugaccuuccaagagccuga

SEQ ID NO: 3357935 - RNA, 15 nt, Human
uggaccagccucucc

SEQ ID NO: 3357936 - RNA, 15 nt, Human
uggaucugugagggg

SEQ ID NO: 3357937 - RNA, 19 nt, Human
uggaucugugaggggcucu

SEQ ID NO: 3357938 - RNA, 19 nt, Human
uggcaaacucuccaccaca

SEQ ID NO: 3357939 - RNA, 20 nt, Human
uggcuccauugguguugaca

SEQ ID NO: 3357940 - RNA, 15 nt, Human
uggcgggguggggug

SEQ ID NO: 3357941 - RNA, 18 nt, Human
ugcuguguuaaauaaacc

SEQ ID NO: 3357942 - RNA, 11 nt, Human
ugcuguguuaa

SEQ ID NO: 3357943 - RNA, 16 nt, Human
ugcuguuaucccugcc

SEQ ID NO: 3357944 - RNA, 13 nt, Human
ugcugguuuuagu

SEQ ID NO: 3357945 - RNA, 17 nt, Human
ugcugccugcuuuuuau

SEQ ID NO: 3357946 - RNA, 15 nt, Human
ugcugccugcuuuuu

SEQ ID NO: 3357947 - RNA, 14 nt, Human
ugcugggccccugc

SEQ ID NO: 3357948 - RNA, 24 nt, Human
ugcugggccccugccucucugcag

SEQ ID NO: 3357949 - RNA, 23 nt, Human
ugcugggccccugccucucugca

SEQ ID NO: 3357950 - RNA, 22 nt, Human
ugcugggccccugccucucugc

SEQ ID NO: 3357951 - RNA, 21 nt, Human
ugcugggccccugccucucug

SEQ ID NO: 3357952 - RNA, 19 nt, Human
ugcugggccccugccucuc

SEQ ID NO: 3357953 - RNA, 18 nt, Human
ugcugggccccugccucu

SEQ ID NO: 3357954 - RNA, 17 nt, Human
ugcugggccccugccuc

SEQ ID NO: 3357955 - RNA, 16 nt, Human
ugcugggccccugccu

SEQ ID NO: 3357956 - RNA, 15 nt, Human
ugcucaggagcccug

SEQ ID NO: 3357957 - RNA, 19 nt, Human
ugcucagugucuggcugca

SEQ ID NO: 3357958 - RNA, 20 nt, Human
ugcucaggagcccugggagg

SEQ ID NO: 3357959 - RNA, 19 nt, Human
ugcucaggagcccugggag

SEQ ID NO: 3357960 - RNA, 18 nt, Human
ugcucaggagcccuggga

SEQ ID NO: 3357961 - RNA, 17 nt, Human
ugcucuugaugccuggc

SEQ ID NO: 3357962 - RNA, 17 nt, Human
ugcuaagaauauuugaa

SEQ ID NO: 3357963 - RNA, 21 nt, Human
ugcuaagaauauuugaaugua

SEQ ID NO: 3357964 - RNA, 22 nt, Human
ugcuaagaauauuugaauguau

SEQ ID NO: 3357965 - RNA, 20 nt, Human
ugccuugcauaauggucaga

SEQ ID NO: 3357966 - RNA, 16 nt, Human
ugcauagguuuagcag

SEQ ID NO: 3357967 - RNA, 18 nt, Human
ugcauauuauuuuauguu

SEQ ID NO: 3357968 - RNA, 19 nt, Human
ugcccagaaugaggcugcu

SEQ ID NO: 3357969 - RNA, 16 nt, Human
guggcucgggaggcga

SEQ ID NO: 3357970 - RNA, 18 nt, Human
guggcucgggaggcgaag

SEQ ID NO: 3357971 - RNA, 14 nt, Human
guggcauccagagu

SEQ ID NO: 3357972 - RNA, 15 nt, Human
guggcaguuuggcaa

SEQ ID NO: 3357973 - RNA, 11 nt, Human
guggcagucug

SEQ ID NO: 3357974 - RNA, 21 nt, Human
gugcuucuaguucugccagga

SEQ ID NO: 3357975 - RNA, 22 nt, Human
gugcuucuaguucugccaggag

SEQ ID NO: 3357976 - RNA, 20 nt, Human
gugcuucuaguucugccagg

SEQ ID NO: 3357977 - RNA, 23 nt, Human
guggaaaagccaagaggcugcag

SEQ ID NO: 3357978 - RNA, 19 nt, Human
gugccuugucacgccagac

SEQ ID NO: 3357979 - RNA, 12 nt, Human
gugacucuuucc

SEQ ID NO: 3357980 - RNA, 19 nt, Human
gugaccuuccaagagccug

SEQ ID NO: 3357981 - RNA, 14 nt, Human
gugagcuacaaaug

SEQ ID NO: 3357982 - RNA, 17 nt, Human
gugaaaguacauuugga

SEQ ID NO: 3357983 - RNA, 13 nt, Human
gugaaaucauuca

SEQ ID NO: 3357984 - RNA, 20 nt, Human
gugaaauuauucauaauuau

SEQ ID NO: 3357985 - RNA, 18 nt, Human
gugaaauuauucauaauu

SEQ ID NO: 3357986 - RNA, 19 nt, Human
gugaaagaaaauaacaaua

SEQ ID NO: 3357987 - RNA, 12 nt, Human
gugaaaauuauu

SEQ ID NO: 3357988 - RNA, 15 nt, Human
gugaaaauuauuuug

SEQ ID NO: 3357989 - RNA, 17 nt, Human
gugauuuuuaugccacc

SEQ ID NO: 3357990 - RNA, 19 nt, Human
gugauuuuuaugccaccug

SEQ ID NO: 3357991 - RNA, 20 nt, Human
gugauuuuuaugccaccuga

SEQ ID NO: 3357992 - RNA, 16 nt, Human
gugauuuuuaugccac

SEQ ID NO: 3357993 - RNA, 15 nt, Human
gugaggaugucuggg

SEQ ID NO: 3357994 - RNA, 12 nt, Human
guccucagcccc

SEQ ID NO: 3357995 - RNA, 13 nt, Human
guccucacacuca

SEQ ID NO: 3357996 - RNA, 20 nt, Human
gucccugccuggaccagccu

SEQ ID NO: 3357997 - RNA, 21 nt, Human
gucccugccuggaccagccuc

SEQ ID NO: 3357998 - RNA, 14 nt, Human
gucccugccuggac

SEQ ID NO: 3357999 - RNA, 22 nt, Human
gucccugccuggaccagccucu

SEQ ID NO: 3358000 - RNA, 23 nt, Human
gucccugccuggaccagccucuc

SEQ ID NO: 3358001 - RNA, 23 nt, Human
gucuaagauaguaacaaugaaga

SEQ ID NO: 3358002 - RNA, 14 nt, Human
gucacgccagacuu

SEQ ID NO: 3358003 - RNA, 23 nt, Human
gucagcccaaaccaccagaagcc

SEQ ID NO: 3358004 - RNA, 22 nt, Human
gucagcccaaaccaccagaagc

SEQ ID NO: 3358005 - RNA, 20 nt, Human
gucccagaaugccuccugca

SEQ ID NO: 3358006 - RNA, 15 nt, Human
guauuauguguguuu

SEQ ID NO: 3358007 - RNA, 21 nt, Human
guauuugagaguucuaaauuu

SEQ ID NO: 3358008 - RNA, 19 nt, Human
guauuugagaguucuaaau

SEQ ID NO: 3358009 - RNA, 14 nt, Human
gggcgcggcuggga

SEQ ID NO: 3358010 - RNA, 18 nt, Human
ggggaguuuagggugggg

SEQ ID NO: 3358011 - RNA, 13 nt, Human
ggggauagaugug

SEQ ID NO: 3358012 - RNA, 19 nt, Human
gggcuucauacacaugaga

SEQ ID NO: 3358013 - RNA, 13 nt, Human
gggcuucauacac

SEQ ID NO: 3358014 - RNA, 23 nt, Human
ggggucuguguguuuaugugugu

SEQ ID NO: 3358015 - RNA, 20 nt, Human
ggugcccagaaugaggcugc

SEQ ID NO: 3358016 - RNA, 18 nt, Human
ggucccuaauaaagcugu

SEQ ID NO: 3358017 - RNA, 17 nt, Human
ggucccuaauaaagcug

SEQ ID NO: 3358018 - RNA, 16 nt, Human
ggucccuaauaaagcu

SEQ ID NO: 3358019 - RNA, 13 nt, Human
ggucccuaauaaa

SEQ ID NO: 3358020 - RNA, 12 nt, Human
ggucccuaauaa

SEQ ID NO: 3358021 - RNA, 19 nt, Human
gggugcugggccccugccu

SEQ ID NO: 3358022 - RNA, 18 nt, Human
gggugcugggccccugcc

SEQ ID NO: 3358023 - RNA, 19 nt, Human
ggguuccagcaccacacuc

SEQ ID NO: 3358024 - RNA, 23 nt, Human
ggucagcccaaaccaccagaagc

SEQ ID NO: 3358025 - RNA, 15 nt, Human
guacgaagaguauuu

SEQ ID NO: 3358026 - RNA, 23 nt, Human
guacuuuauuuucuauaauuuaa

SEQ ID NO: 3358027 - RNA, 22 nt, Human
guacuugcucuugaugccuggc

SEQ ID NO: 3358028 - RNA, 19 nt, Human
guacuugcucuugaugccu

SEQ ID NO: 3358029 - RNA, 18 nt, Human
guacuugcucuugaugcc

SEQ ID NO: 3358030 - RNA, 16 nt, Human
guacuugcucuugaug

SEQ ID NO: 3358031 - RNA, 15 nt, Human
guacuugcucuugau

SEQ ID NO: 3358032 - RNA, 14 nt, Human
guacuugcucuuga

SEQ ID NO: 3358033 - RNA, 14 nt, Human
guaauucaagaaaa

SEQ ID NO: 3358034 - RNA, 13 nt, Human
guaauucaagaaa

SEQ ID NO: 3358035 - RNA, 15 nt, Human
guaaugaaacuugga

SEQ ID NO: 3358036 - RNA, 16 nt, Human
guaaugaaacuuggau

SEQ ID NO: 3358037 - RNA, 13 nt, Human
guaaugaaaacca

SEQ ID NO: 3358038 - RNA, 11 nt, Human
guaaugaaaac

SEQ ID NO: 3358039 - RNA, 15 nt, Human
guacagacagaaaaa

SEQ ID NO: 3358040 - RNA, 19 nt, Human
gguugggagaaugucagua

SEQ ID NO: 3358041 - RNA, 20 nt, Human
guaaaaacaaagaaauuaug

SEQ ID NO: 3358042 - RNA, 18 nt, Human
guaaaaacaaagaaauua

SEQ ID NO: 3358043 - RNA, 17 nt, Human
guaaauaguauuugaga

SEQ ID NO: 3358044 - RNA, 16 nt, Human
guaaauaguauuugag

SEQ ID NO: 3358045 - RNA, 15 nt, Human
guaaauaguauuuga

SEQ ID NO: 3358046 - RNA, 16 nt, Human
guaaauaaaggaacca

SEQ ID NO: 3358047 - RNA, 22 nt, Human
gcuuuguggcacuggggcaggg

SEQ ID NO: 3358048 - RNA, 14 nt, Human
gcuuuguggcacug

SEQ ID NO: 3358049 - RNA, 20 nt, Human
ggaaaagccaagaggcugca

SEQ ID NO: 3358050 - RNA, 21 nt, Human
ggaaccaaagcgaauuuuaaa

SEQ ID NO: 3358051 - RNA, 22 nt, Human
ggaaccaaagcgaauuuuaaaa

SEQ ID NO: 3358052 - RNA, 11 nt, Human
gcuucauacag

SEQ ID NO: 3358053 - RNA, 11 nt, Human
gcuucauacac

SEQ ID NO: 3358054 - RNA, 22 nt, Human
gcuucauacagggaugguguuc

SEQ ID NO: 3358055 - RNA, 22 nt, Human
ggaaggaucccaugagcuccuu

SEQ ID NO: 3358056 - RNA, 23 nt, Human
ggaagggacaccaagccuuggcu

SEQ ID NO: 3358057 - RNA, 18 nt, Human
ggaagugcuaauuuugaa

SEQ ID NO: 3358058 - RNA, 14 nt, Human
ggaaugcuguguua

SEQ ID NO: 3358059 - RNA, 14 nt, Human
ggaauuauuuuaaa

SEQ ID NO: 3358060 - RNA, 15 nt, Human
ggaauuauuuuaaaa

SEQ ID NO: 3358061 - RNA, 16 nt, Human
ggaauuauuuuaaaag

SEQ ID NO: 3358062 - RNA, 17 nt, Human
ggaauuauuuuaaaaga

SEQ ID NO: 3358063 - RNA, 19 nt, Human
ggaauuuucaucuaggauu

SEQ ID NO: 3358064 - RNA, 23 nt, Human
ggaauuggguggggggcuucaua

SEQ ID NO: 3358065 - RNA, 12 nt, Human
ggaauuguguuu

SEQ ID NO: 3358066 - RNA, 22 nt, Human
ggagaaugucaguauguggaag

SEQ ID NO: 3358067 - RNA, 20 nt, Human
ggagauagccccacaggagg

SEQ ID NO: 3358068 - RNA, 21 nt, Human
ggagauagccccacaggaggu

SEQ ID NO: 3358069 - RNA, 20 nt, Human
ggccauucuuucccaacacc

SEQ ID NO: 3358070 - RNA, 12 nt, Human
ggcagcucagcu

SEQ ID NO: 3358071 - RNA, 17 nt, Human
ggauggaaugauggguc

SEQ ID NO: 3358072 - RNA, 16 nt, Human
ggaugcauggagauag

SEQ ID NO: 3358073 - RNA, 18 nt, Human
ggauugggccccugccag

SEQ ID NO: 3358074 - RNA, 17 nt, Human
ggauugggccccugcca

SEQ ID NO: 3358075 - RNA, 19 nt, Human
ggcaaucauggugcucaga

SEQ ID NO: 3358076 - RNA, 21 nt, Human
ggccuaaccugccgagagucc

SEQ ID NO: 3358077 - RNA, 22 nt, Human
ggccuaaccugccgagagucca

SEQ ID NO: 3358078 - RNA, 12 nt, Human
ggcccugugccu

SEQ ID NO: 3358079 - RNA, 16 nt, Human
ggcgcggcugggagga

SEQ ID NO: 3358080 - RNA, 14 nt, Human
ggccugggcaggag

SEQ ID NO: 3358081 - RNA, 11 nt, Human
ggccugugagc

SEQ ID NO: 3358082 - RNA, 13 nt, Human
ggccugggcagga

SEQ ID NO: 3358083 - RNA, 16 nt, Human
ggcuaggguggggaga

SEQ ID NO: 3358084 - RNA, 21 nt, Human
ggcuauggggauagaugugug

SEQ ID NO: 3358085 - RNA, 18 nt, Human
ggcuccaggccagggggc

SEQ ID NO: 3358086 - RNA, 14 nt, Human
ggcuccaggccagg

SEQ ID NO: 3358087 - RNA, 16 nt, Human
ggcuccaggccagggg

SEQ ID NO: 3358088 - RNA, 21 nt, Human
gcucagaggguguccugcacc

SEQ ID NO: 3358089 - RNA, 22 nt, Human
gcucagugucuggcugcagagc

SEQ ID NO: 3358090 - RNA, 23 nt, Human
gccugugagcuaggaauuguguu

SEQ ID NO: 3358091 - RNA, 14 nt, Human
gcucuugaugccug

SEQ ID NO: 3358092 - RNA, 16 nt, Human
gcucuugaugccuggc

SEQ ID NO: 3358093 - RNA, 15 nt, Human
gcucuugaugccugg

SEQ ID NO: 3358094 - RNA, 23 nt, Human
gcccuggugguggcucgggaggc

SEQ ID NO: 3358095 - RNA, 16 nt, Human
gcccugggaggcucug

SEQ ID NO: 3358096 - RNA, 15 nt, Human
gcccugggaggcucu

SEQ ID NO: 3358097 - RNA, 14 nt, Human
gcccugggaggcuc

SEQ ID NO: 3358098 - RNA, 13 nt, Human
gcccugggaggcu

SEQ ID NO: 3358099 - RNA, 23 nt, Human
gcccugggaggcucuggagccca

SEQ ID NO: 3358100 - RNA, 21 nt, Human
gcccugggaggcucuggagcc

SEQ ID NO: 3358101 - RNA, 19 nt, Human
gcccugggaggcucuggag

SEQ ID NO: 3358102 - RNA, 18 nt, Human
gcccugggaggcucugga

SEQ ID NO: 3358103 - RNA, 17 nt, Human
gcccugggaggcucugg

SEQ ID NO: 3358104 - RNA, 12 nt, Human
gcccuggacugu

SEQ ID NO: 3358105 - RNA, 22 nt, Human
gcccuggacugugugcucagga

SEQ ID NO: 3358106 - RNA, 16 nt, Human
gcccuggacugugugc

SEQ ID NO: 3358107 - RNA, 16 nt, Human
gcccugaguuccuagc

SEQ ID NO: 3358108 - RNA, 18 nt, Human
gcccugaguuccuagcca

SEQ ID NO: 3358109 - RNA, 19 nt, Human
gccucucugcaggucccua

SEQ ID NO: 3358110 - RNA, 12 nt, Human
gccugcagagcu

SEQ ID NO: 3358111 - RNA, 15 nt, Human
gccugcaauuucaua

SEQ ID NO: 3358112 - RNA, 19 nt, Human
gccugcuuuuuauggccug

SEQ ID NO: 3358113 - RNA, 18 nt, Human
gccugcuuuuuauggccu

SEQ ID NO: 3358114 - RNA, 18 nt, Human
gccucucugcaggucccu

SEQ ID NO: 3358115 - RNA, 21 nt, Human
gccucucugcaggucccuaau

SEQ ID NO: 3358116 - RNA, 20 nt, Human
gccucucugcaggucccuaa

SEQ ID NO: 3358117 - RNA, 23 nt, Human
gccuggccagcagguccccagcu

SEQ ID NO: 3358118 - RNA, 18 nt, Human
gagaucccaacacugcca

SEQ ID NO: 3358119 - RNA, 19 nt, Human
gagaucccaacacugccag

SEQ ID NO: 3358120 - RNA, 20 nt, Human
gagaucccaacacugccagc

SEQ ID NO: 3358121 - RNA, 13 nt, Human
gagcaaagcugau

SEQ ID NO: 3358122 - RNA, 18 nt, Human
gagaugaugaaaauauuu

SEQ ID NO: 3358123 - RNA, 23 nt, Human
gagcccacuguacuugcucuuga

SEQ ID NO: 3358124 - RNA, 13 nt, Human
gagagacgggccc

SEQ ID NO: 3358125 - RNA, 15 nt, Human
gagaguagaacagau

SEQ ID NO: 3358126 - RNA, 17 nt, Human
gagaaugucaguaugug

SEQ ID NO: 3358127 - RNA, 21 nt, Human
gagaaaugaaaaaauauauau

SEQ ID NO: 3358128 - RNA, 12 nt, Human
gagaaaugaaaa

SEQ ID NO: 3358129 - RNA, 19 nt, Human
gacucuaccucauaucagu

SEQ ID NO: 3358130 - RNA, 23 nt, Human
gacucuaccucauaucaguuugc

SEQ ID NO: 3358131 - RNA, 14 nt, Human
gaccagccucucca

SEQ ID NO: 3358132 - RNA, 18 nt, Human
gaauucuugaaggaaaau

SEQ ID NO: 3358133 - RNA, 15 nt, Human
gaauguuaagcagau

SEQ ID NO: 3358134 - RNA, 16 nt, Human
gaaugucaguaugugg

SEQ ID NO: 3358135 - RNA, 18 nt, Human
gaaugucaguauguggaa

SEQ ID NO: 3358136 - RNA, 13 nt, Human
gaaugucaguaug

SEQ ID NO: 3358137 - RNA, 19 nt, Human
gaaugucaguauguggaag

SEQ ID NO: 3358138 - RNA, 14 nt, Human
gaauguuaagcaga

SEQ ID NO: 3358139 - RNA, 18 nt, Human
gaaucucauaauuuauac

SEQ ID NO: 3358140 - RNA, 19 nt, Human
gaaucucauaauuuauaca

SEQ ID NO: 3358141 - RNA, 16 nt, Human
gaaugaaauugcugaa

SEQ ID NO: 3358142 - RNA, 13 nt, Human
gaaugcuguguua

SEQ ID NO: 3358143 - RNA, 14 nt, Human
gaaugcuguguuaa

SEQ ID NO: 3358144 - RNA, 13 nt, Human
gacacaacuauuu

SEQ ID NO: 3358145 - RNA, 16 nt, Human
gacaaggaaaaaauaa

SEQ ID NO: 3358146 - RNA, 22 nt, Human
gaauuggguggggggcuucaua

SEQ ID NO: 3358147 - RNA, 23 nt, Human
gaauuggguggggggcuucauac

SEQ ID NO: 3358148 - RNA, 20 nt, Human
gaauuggguggggggcuuca

SEQ ID NO: 3358149 - RNA, 21 nt, Human
gagucccugccuggaccagcc

SEQ ID NO: 3358150 - RNA, 23 nt, Human
gagucccugccuggaccagccuc

SEQ ID NO: 3358151 - RNA, 19 nt, Human
gagucccugccuggaccag

SEQ ID NO: 3358152 - RNA, 22 nt, Human
gaguaauccaagcaaaugugaa

SEQ ID NO: 3358153 - RNA, 13 nt, Human
gagguugcagugu

SEQ ID NO: 3358154 - RNA, 14 nt, Human
gauagaugugugga

SEQ ID NO: 3358155 - RNA, 22 nt, Human
gauagauguguggacacauugg

SEQ ID NO: 3358156 - RNA, 13 nt, Human
gauagaugugugg

SEQ ID NO: 3358157 - RNA, 15 nt, Human
gauauaagugugugu

SEQ ID NO: 3358158 - RNA, 13 nt, Human
gaguguguaauuu

SEQ ID NO: 3358159 - RNA, 18 nt, Human
gaguguacuuaacuauuc

SEQ ID NO: 3358160 - RNA, 14 nt, Human
gagggggagagggc

SEQ ID NO: 3358161 - RNA, 13 nt, Human
gaggguguccugc

SEQ ID NO: 3358162 - RNA, 21 nt, Human
gagguagcuuugagguggaag

SEQ ID NO: 3358163 - RNA, 23 nt, Human
gagggucuugguuccagccugcc

SEQ ID NO: 3358164 - RNA, 14 nt, Human
gaggcagggaagga

SEQ ID NO: 3358165 - RNA, 21 nt, Human
gaggcgaagcguuguccucag

SEQ ID NO: 3358166 - RNA, 21 nt, Human
gaggcgcaugaauuugugaag

SEQ ID NO: 3358167 - RNA, 20 nt, Human
gaggcgaagcguuguccuca

SEQ ID NO: 3358168 - RNA, 22 nt, Human
gaggccucucauuccagaggaa

SEQ ID NO: 3358169 - RNA, 15 nt, Human
gcacuggggcagggg

SEQ ID NO: 3358170 - RNA, 18 nt, Human
gcacuggggcaggggccg

SEQ ID NO: 3358171 - RNA, 23 nt, Human
gcacuggggcaggggccgggggc

SEQ ID NO: 3358172 - RNA, 22 nt, Human
gcaccccagcuggggccaggcu

SEQ ID NO: 3358173 - RNA, 14 nt, Human
gcaauuucauaugc

SEQ ID NO: 3358174 - RNA, 22 nt, Human
gcaauguagaggggaaaagaga

SEQ ID NO: 3358175 - RNA, 23 nt, Human
gcacaaauucugucucuggauua

SEQ ID NO: 3358176 - RNA, 16 nt, Human
gauguuuaguaaucau

SEQ ID NO: 3358177 - RNA, 24 nt, Human
gaugguguucaaaaaacuuguaaa

SEQ ID NO: 3358178 - RNA, 15 nt, Human
gaugggucaguugua

SEQ ID NO: 3358179 - RNA, 21 nt, Human
gaugggucaguuguaucagca

SEQ ID NO: 3358180 - RNA, 17 nt, Human
gauugggccccugccag

SEQ ID NO: 3358181 - RNA, 15 nt, Human
gauugggccccugcc

SEQ ID NO: 3358182 - RNA, 23 nt, Human
gauugcaggagucccugccauca

SEQ ID NO: 3358183 - RNA, 21 nt, Human
gcaaagcugaugacaacuucc

SEQ ID NO: 3358184 - RNA, 23 nt, Human
gcaaaugugaaucauuuuaccuu

SEQ ID NO: 3358185 - RNA, 16 nt, Human
cuugucacgccagacu

SEQ ID NO: 3358186 - RNA, 13 nt, Human
cuugucacgccag

SEQ ID NO: 3358187 - RNA, 19 nt, Human
cuugaguuuaaauuguaau

SEQ ID NO: 3358188 - RNA, 21 nt, Human
cuuuaucaaagggugaaaauu

SEQ ID NO: 3358189 - RNA, 22 nt, Human
cuuuaucaaagggugaaaauua

SEQ ID NO: 3358190 - RNA, 23 nt, Human
cuuuaucuugaauaauguaagac

SEQ ID NO: 3358191 - RNA, 21 nt, Human
cuuuaucuugaauaauguaag

SEQ ID NO: 3358192 - RNA, 18 nt, Human
cuuuaucuugaauaaugu

SEQ ID NO: 3358193 - RNA, 22 nt, Human
cuuucuuccaaacaggcucaga

SEQ ID NO: 3358194 - RNA, 16 nt, Human
cuuucugcuuguguua

SEQ ID NO: 3358195 - RNA, 19 nt, Human
cuuuggcuaugagggccuu

SEQ ID NO: 3358196 - RNA, 14 nt, Human
cuuuguggcacugg

SEQ ID NO: 3358197 - RNA, 17 nt, Human
cuuuuuauggccuguga

SEQ ID NO: 3358198 - RNA, 20 nt, Human
gaaaaucuuauaauuuaaaa

SEQ ID NO: 3358199 - RNA, 21 nt, Human
gaaaauauuauguguuuccau

SEQ ID NO: 3358200 - RNA, 17 nt, Human
gaaaauauuauguguuu

SEQ ID NO: 3358201 - RNA, 13 nt, Human
gaaaauauuuaaa

SEQ ID NO: 3358202 - RNA, 21 nt, Human
gaaagaguacucuuguuuccu

SEQ ID NO: 3358203 - RNA, 20 nt, Human
gaaaaugauacgcaacauaa

SEQ ID NO: 3358204 - RNA, 14 nt, Human
cuucugugaaagua

SEQ ID NO: 3358205 - RNA, 18 nt, Human
cuugaaaaaugcauguug

SEQ ID NO: 3358206 - RNA, 12 nt, Human
cuugaaaaaugc

SEQ ID NO: 3358207 - RNA, 13 nt, Human
cuugaaaauuaac

SEQ ID NO: 3358208 - RNA, 12 nt, Human
cuugaaaauuaa

SEQ ID NO: 3358209 - RNA, 18 nt, Human
cuugaaaauuaacaugaa

SEQ ID NO: 3358210 - RNA, 18 nt, Human
cuucuggugaccuuccaa

SEQ ID NO: 3358211 - RNA, 20 nt, Human
cuucuggugaccuuccaaga

SEQ ID NO: 3358212 - RNA, 21 nt, Human
cuucuggugaccuuccaagag

SEQ ID NO: 3358213 - RNA, 13 nt, Human
cuuauauuaugga

SEQ ID NO: 3358214 - RNA, 21 nt, Human
cugucucccuccucugcccgg

SEQ ID NO: 3358215 - RNA, 19 nt, Human
cugugaggggcucucucau

SEQ ID NO: 3358216 - RNA, 21 nt, Human
cuguguguguguauguggggg

SEQ ID NO: 3358217 - RNA, 16 nt, Human
cuguguguuuaugugu

SEQ ID NO: 3358218 - RNA, 17 nt, Human
cuguguguuuaugugug

SEQ ID NO: 3358219 - RNA, 21 nt, Human
cugugugcucaggagcccugg

SEQ ID NO: 3358220 - RNA, 20 nt, Human
cugugugcucaggagcccug

SEQ ID NO: 3358221 - RNA, 16 nt, Human
cugugugcucaggagc

SEQ ID NO: 3358222 - RNA, 19 nt, Human
cugugugcucaggagcccu

SEQ ID NO: 3358223 - RNA, 23 nt, Human
cugugugcucaggagcccuggga

SEQ ID NO: 3358224 - RNA, 15 nt, Human
cuguguggcagucug

SEQ ID NO: 3358225 - RNA, 23 nt, Human
cugccgagaguccaucagccucc

SEQ ID NO: 3358226 - RNA, 22 nt, Human
cugccgagaguccaucagccuc

SEQ ID NO: 3358227 - RNA, 22 nt, Human
cugccucucugcaggucccuaa

SEQ ID NO: 3358228 - RNA, 21 nt, Human
cugccucucugcaggucccua

SEQ ID NO: 3358229 - RNA, 20 nt, Human
cugccucucugcaggucccu

SEQ ID NO: 3358230 - RNA, 19 nt, Human
cugccucucugcagguccc

SEQ ID NO: 3358231 - RNA, 11 nt, Human
cugcugggcuu

SEQ ID NO: 3358232 - RNA, 14 nt, Human
cuggaccagccucu

SEQ ID NO: 3358233 - RNA, 18 nt, Human
cuggaccagccucuccac

SEQ ID NO: 3358234 - RNA, 13 nt, Human
cuggaauuugaaa

SEQ ID NO: 3358235 - RNA, 12 nt, Human
cuggagguuugu

SEQ ID NO: 3358236 - RNA, 17 nt, Human
cuggagguuuguuuaga

SEQ ID NO: 3358237 - RNA, 23 nt, Human
cuggcugcagagcagugggccug

SEQ ID NO: 3358238 - RNA, 21 nt, Human
cuggccaguggcuggaucugu

SEQ ID NO: 3358239 - RNA, 23 nt, Human
ccguggcuguggcauccagaguc

SEQ ID NO: 3358240 - RNA, 12 nt, Human
ccuaaccugccg

SEQ ID NO: 3358241 - RNA, 13 nt, Human
ccuaaccugccga

SEQ ID NO: 3358242 - RNA, 20 nt, Human
ccgagaguccaucagccucc

SEQ ID NO: 3358243 - RNA, 21 nt, Human
ccgagaguccaucagccucca

SEQ ID NO: 3358244 - RNA, 21 nt, Human
ccgggggcagucugagagagg

SEQ ID NO: 3358245 - RNA, 20 nt, Human
ccggggccugggcaggaggg

SEQ ID NO: 3358246 - RNA, 19 nt, Human
ccggggccugggcaggagg

SEQ ID NO: 3358247 - RNA, 17 nt, Human
ccgccuccuacagccca

SEQ ID NO: 3358248 - RNA, 21 nt, Human
cccugaggcagguccccagac

SEQ ID NO: 3358249 - RNA, 18 nt, Human
cccugaggcaggucccca

SEQ ID NO: 3358250 - RNA, 20 nt, Human
cccugaggcagguccccaga

SEQ ID NO: 3358251 - RNA, 17 nt, Human
cccugaggcaggucccc

SEQ ID NO: 3358252 - RNA, 14 nt, Human
cccugccucucugc

SEQ ID NO: 3358253 - RNA, 13 nt, Human
cccugccucucug

SEQ ID NO: 3358254 - RNA, 15 nt, Human
cccugccucucugca

SEQ ID NO: 3358255 - RNA, 14 nt, Human
cccaugagcuccuu

SEQ ID NO: 3358256 - RNA, 15 nt, Human
cccaugagcuccuua

SEQ ID NO: 3358257 - RNA, 22 nt, Human
cccaugagcuccuuaaggcucu

SEQ ID NO: 3358258 - RNA, 13 nt, Human
cccaugagcuccu

SEQ ID NO: 3358259 - RNA, 17 nt, Human
cccagaaugaggcugcu

SEQ ID NO: 3358260 - RNA, 14 nt, Human
ccccugugccuugu

SEQ ID NO: 3358261 - RNA, 20 nt, Human
ccccuggcuccaggccaggg

SEQ ID NO: 3358262 - RNA, 12 nt, Human
ccccuggugguu

SEQ ID NO: 3358263 - RNA, 19 nt, Human
ccccugccucucugcaggu

SEQ ID NO: 3358264 - RNA, 17 nt, Human
ccccugccucucugcag

SEQ ID NO: 3358265 - RNA, 16 nt, Human
ccccugccucucugca

SEQ ID NO: 3358266 - RNA, 15 nt, Human
ccccugccucucugc

SEQ ID NO: 3358267 - RNA, 14 nt, Human
ccccugccucucug

SEQ ID NO: 3358268 - RNA, 13 nt, Human
ccccuccaccugc

SEQ ID NO: 3358269 - RNA, 17 nt, Human
ccccaucauugguaccc

SEQ ID NO: 3358270 - RNA, 15 nt, Human
cccaacacugccagc

SEQ ID NO: 3358271 - RNA, 16 nt, Human
cccaacacugccagca

SEQ ID NO: 3358272 - RNA, 14 nt, Human
cccaacacugccag

SEQ ID NO: 3358273 - RNA, 15 nt, Human
cccacgucagcuggg

SEQ ID NO: 3358274 - RNA, 15 nt, Human
cccacggcuccucga

SEQ ID NO: 3358275 - RNA, 24 nt, Human
cccagaauaaacuggcagcucagc

SEQ ID NO: 3358276 - RNA, 22 nt, Human
cccagaauaaacuggcagcuca

SEQ ID NO: 3358277 - RNA, 16 nt, Human
cccagaaugaggcugc

SEQ ID NO: 3358278 - RNA, 23 nt, Human
ccagugaauucuugaaggaaaau

SEQ ID NO: 3358279 - RNA, 23 nt, Human
ccaggccacuggccccugagauc

SEQ ID NO: 3358280 - RNA, 16 nt, Human
ccaggccacuggcccc

SEQ ID NO: 3358281 - RNA, 16 nt, Human
ccaggcugggucgccc

SEQ ID NO: 3358282 - RNA, 12 nt, Human
ccaggcuggguc

SEQ ID NO: 3358283 - RNA, 24 nt, Human
ccaggcugggucgcccuggacugu

SEQ ID NO: 3358284 - RNA, 23 nt, Human
ccaggcugggucgcccuggacug

SEQ ID NO: 3358285 - RNA, 22 nt, Human
ccaggcugggucgcccuggacu

SEQ ID NO: 3358286 - RNA, 21 nt, Human
ccaggcugggucgcccuggac

SEQ ID NO: 3358287 - RNA, 22 nt, Human
ccagaauaaacuggcagcucag

SEQ ID NO: 3358288 - RNA, 15 nt, Human
ccagaaugaggcugc

SEQ ID NO: 3358289 - RNA, 15 nt, Human
ccagaagcccagaau

SEQ ID NO: 3358290 - RNA, 18 nt, Human
ccagaaaccuuuguuugc

SEQ ID NO: 3358291 - RNA, 16 nt, Human
ccacccccaggacccc

SEQ ID NO: 3358292 - RNA, 18 nt, Human
ccacccccaggaccccug

SEQ ID NO: 3358293 - RNA, 19 nt, Human
ccacccccaggaccccuga

SEQ ID NO: 3358294 - RNA, 10 nt, Human
ccagccugcc

SEQ ID NO: 3358295 - RNA, 14 nt, Human
ccagcccugaguuc

SEQ ID NO: 3358296 - RNA, 18 nt, Human
ccagcccugaguuccuag

SEQ ID NO: 3358297 - RNA, 11 nt, Human
cgcggcuggga

SEQ ID NO: 3358298 - RNA, 12 nt, Human
cgcggcugggag

SEQ ID NO: 3358299 - RNA, 16 nt, Human
cgcggcugggaggagg

SEQ ID NO: 3358300 - RNA, 18 nt, Human
cgggacaccuaggcuagg

SEQ ID NO: 3358301 - RNA, 19 nt, Human
cgggacaccuaggcuaggg

SEQ ID NO: 3358302 - RNA, 20 nt, Human
cgggaauuuucaucuaggau

SEQ ID NO: 3358303 - RNA, 18 nt, Human
cgggaauuuucaucuagg

SEQ ID NO: 3358304 - RNA, 15 nt, Human
cgaagcguuguccuc

SEQ ID NO: 3358305 - RNA, 16 nt, Human
cgaagcguuguccuca

SEQ ID NO: 3358306 - RNA, 17 nt, Human
cgaagcguuguccucag

SEQ ID NO: 3358307 - RNA, 21 nt, Human
cgaagcguuguccucagcccc

SEQ ID NO: 3358308 - RNA, 23 nt, Human
cgaagaguauuuuugacagaaua

SEQ ID NO: 3358309 - RNA, 18 nt, Human
cgagacuugguuucaaaa

SEQ ID NO: 3358310 - RNA, 14 nt, Human
ccuuugucccagaa

SEQ ID NO: 3358311 - RNA, 17 nt, Human
ccugugccuuuugccau

SEQ ID NO: 3358312 - RNA, 18 nt, Human
ccuguggaucaaauccag

SEQ ID NO: 3358313 - RNA, 17 nt, Human
ccugcaccggggccugg

SEQ ID NO: 3358314 - RNA, 15 nt, Human
ccugcaccggggccu

SEQ ID NO: 3358315 - RNA, 19 nt, Human
ccugaagagaagggcaggg

SEQ ID NO: 3358316 - RNA, 22 nt, Human
ccuaucuguuuacaguguuccg

SEQ ID NO: 3358317 - RNA, 15 nt, Human
ccucuuccaggcccc

SEQ ID NO: 3358318 - RNA, 22 nt, Human
ccugccgagaguccaucagccu

SEQ ID NO: 3358319 - RNA, 23 nt, Human
ccugccgagaguccaucagccuc

SEQ ID NO: 3358320 - RNA, 14 nt, Human
ccugccgagagucc

SEQ ID NO: 3358321 - RNA, 20 nt, Human
ccugguccucacacucaccc

SEQ ID NO: 3358322 - RNA, 17 nt, Human
cucagccccgcguggaa

SEQ ID NO: 3358323 - RNA, 16 nt, Human
cucagaggguguccug

SEQ ID NO: 3358324 - RNA, 20 nt, Human
cucacugcuaagaauauuug

SEQ ID NO: 3358325 - RNA, 21 nt, Human
cucacugcuaagaauauuuga

SEQ ID NO: 3358326 - RNA, 22 nt, Human
cucacugcuaagaauauuugaa

SEQ ID NO: 3358327 - RNA, 23 nt, Human
cucacugcuaagaauauuugaau

SEQ ID NO: 3358328 - RNA, 18 nt, Human
cucaggaaccgaggcagg

SEQ ID NO: 3358329 - RNA, 19 nt, Human
cucaggaaccgaggcaggg

SEQ ID NO: 3358330 - RNA, 17 nt, Human
cucaggaaccgaggcag

SEQ ID NO: 3358331 - RNA, 13 nt, Human
cucaggagcccug

SEQ ID NO: 3358332 - RNA, 12 nt, Human
cucaggagcccu

SEQ ID NO: 3358333 - RNA, 23 nt, Human
cucaggagcccugggaggcucug

SEQ ID NO: 3358334 - RNA, 22 nt, Human
cucaggagcccugggaggcucu

SEQ ID NO: 3358335 - RNA, 21 nt, Human
cucaggagcccugggaggcuc

SEQ ID NO: 3358336 - RNA, 20 nt, Human
cucaggagcccugggaggcu

SEQ ID NO: 3358337 - RNA, 17 nt, Human
cucaggagcccugggag

SEQ ID NO: 3358338 - RNA, 16 nt, Human
cucaggagcccuggga

SEQ ID NO: 3358339 - RNA, 15 nt, Human
cucaggagcccuggg

SEQ ID NO: 3358340 - RNA, 14 nt, Human
cucaggagcccugg

SEQ ID NO: 3358341 - RNA, 24 nt, Human
cucaggagcccugggaggcucugg

SEQ ID NO: 3358342 - RNA, 20 nt, Human
cuccccacgucagcugggac

SEQ ID NO: 3358343 - RNA, 22 nt, Human
cuccacucaugugacucuuucc

SEQ ID NO: 3358344 - RNA, 16 nt, Human
cuccacucaugugacu

SEQ ID NO: 3358345 - RNA, 14 nt, Human
cuccacucuccucu

SEQ ID NO: 3358346 - RNA, 16 nt, Human
cucaguucucuucacu

SEQ ID NO: 3358347 - RNA, 17 nt, Human
cucaguucucuucacuc

SEQ ID NO: 3358348 - RNA, 21 nt, Human
cuauucaggagaguagaacag

SEQ ID NO: 3358349 - RNA, 19 nt, Human
cuauggggauagaugugug

SEQ ID NO: 3358350 - RNA, 20 nt, Human
cuauggggauagaugugugg

SEQ ID NO: 3358351 - RNA, 21 nt, Human
cuauggggauagaugugugga

SEQ ID NO: 3358352 - RNA, 22 nt, Human
cuaugaaguuuuuuuuauacag

SEQ ID NO: 3358353 - RNA, 12 nt, Human
cuauaauuuaaa

SEQ ID NO: 3358354 - RNA, 13 nt, Human
cucacacucaccc

SEQ ID NO: 3358355 - RNA, 22 nt, Human
cuacucuggagguuuguuuaga

SEQ ID NO: 3358356 - RNA, 18 nt, Human
cuacugggagccuaccca

SEQ ID NO: 3358357 - RNA, 14 nt, Human
cuacugggagccua

SEQ ID NO: 3358358 - RNA, 15 nt, Human
cuacugggagccuac

SEQ ID NO: 3358359 - RNA, 22 nt, Human
cuagcuaauguaauaacuguga

SEQ ID NO: 3358360 - RNA, 20 nt, Human
cuaaauuuuauaucuuguag

SEQ ID NO: 3358361 - RNA, 15 nt, Human
cuaaauuuuauaucu

SEQ ID NO: 3358362 - RNA, 16 nt, Human
cuaaauuuuauaucuu

SEQ ID NO: 3358363 - RNA, 13 nt, Human
cuaaauuuuauau

SEQ ID NO: 3358364 - RNA, 16 nt, Human
cuaagauaguaacaau

SEQ ID NO: 3358365 - RNA, 22 nt, Human
cgggaggcagagguugcagugu

SEQ ID NO: 3358366 - RNA, 20 nt, Human
cgggaggcagagguugcagu

SEQ ID NO: 3358367 - RNA, 21 nt, Human
cuaagcuucacuguaaaauaa

SEQ ID NO: 3358368 - RNA, 14 nt, Human
cuaauaaagcugug

SEQ ID NO: 3358369 - RNA, 18 nt, Human
cuaauaaucauuggauuc

SEQ ID NO: 3358370 - RNA, 23 nt, Human
cuacacgagauacagaauuuuau

SEQ ID NO: 3358371 - RNA, 19 nt, Human
accggggccugggcaggag

SEQ ID NO: 3358372 - RNA, 22 nt, Human
acuaggugcccagaaugaggcu

SEQ ID NO: 3358373 - RNA, 15 nt, Human
acuuuauuuuguguu

SEQ ID NO: 3358374 - RNA, 14 nt, Human
acugauuacugccu

SEQ ID NO: 3358375 - RNA, 12 nt, Human
acaaagaaauua

SEQ ID NO: 3358376 - RNA, 16 nt, Human
acaaagaaauuaugug

SEQ ID NO: 3358377 - RNA, 14 nt, Human
acaaagaaauuaug

SEQ ID NO: 3358378 - RNA, 18 nt, Human
aauuuucaucuaggauuu

SEQ ID NO: 3358379 - RNA, 14 nt, Human
aauugugauguguc

SEQ ID NO: 3358380 - RNA, 15 nt, Human
aauugugaugugucc

SEQ ID NO: 3358381 - RNA, 11 nt, Human
aauugugaugu

SEQ ID NO: 3358382 - RNA, 21 nt, Human
aauuggguggggggcuucaua

SEQ ID NO: 3358383 - RNA, 22 nt, Human
aauuggguggggggcuucauac

SEQ ID NO: 3358384 - RNA, 23 nt, Human
aauuggguggggggcuucauaca

SEQ ID NO: 3358385 - RNA, 23 nt, Human
acagaggacaguauuugugggga

SEQ ID NO: 3358386 - RNA, 20 nt, Human
acacugggagaaaugaaaaa

SEQ ID NO: 3358387 - RNA, 20 nt, Human
acacguaaugaaacuuggau

SEQ ID NO: 3358388 - RNA, 19 nt, Human
acauaauuaaauuuugagu

SEQ ID NO: 3358389 - RNA, 15 nt, Human
acauaaguaauucaa

SEQ ID NO: 3358390 - RNA, 17 nt, Human
acauuuccuaaauauau

SEQ ID NO: 3358391 - RNA, 16 nt, Human
acauuuccuaaauaua

SEQ ID NO: 3358392 - RNA, 14 nt, Human
accaucucuuuacc

SEQ ID NO: 3358393 - RNA, 13 nt, Human
aagggagggggag

SEQ ID NO: 3358394 - RNA, 17 nt, Human
aagggacugagaaauuu

SEQ ID NO: 3358395 - RNA, 15 nt, Human
aagggacugagaaau

SEQ ID NO: 3358396 - RNA, 12 nt, Human
aaggaauuuuau

SEQ ID NO: 3358397 - RNA, 13 nt, Human
aagauuuucagaa

SEQ ID NO: 3358398 - RNA, 15 nt, Human
aagacuuuuaugaua

SEQ ID NO: 3358399 - RNA, 18 nt, Human
aagagaagggcagggcug

SEQ ID NO: 3358400 - RNA, 21 nt, Human
aagacauucuuccaaaaagau

SEQ ID NO: 3358401 - RNA, 23 nt, Human
aagacagugaaagaaaauaacaa

SEQ ID NO: 3358402 - RNA, 17 nt, Human
aauaaaccucaaaaugu

SEQ ID NO: 3358403 - RNA, 12 nt, Human
aauaaaauuuuu

SEQ ID NO: 3358404 - RNA, 20 nt, Human
aauaaaccucaaaaugucua

SEQ ID NO: 3358405 - RNA, 19 nt, Human
aauaaagcuguguggcagu

SEQ ID NO: 3358406 - RNA, 11 nt, Human
aauaaagcugu

SEQ ID NO: 3358407 - RNA, 14 nt, Human
aauaauaaauauuu

SEQ ID NO: 3358408 - RNA, 15 nt, Human
aauccaaugaaauga

SEQ ID NO: 3358409 - RNA, 15 nt, Human
aaagccaagaggcug

SEQ ID NO: 3358410 - RNA, 19 nt, Human
aaauaaaccucaaaauguc

SEQ ID NO: 3358411 - RNA, 20 nt, Human
aaauaaaaauauuguguugu

SEQ ID NO: 3358412 - RNA, 17 nt, Human
aaaccucaaaaugucua

SEQ ID NO: 3358413 - RNA, 16 nt, Human
aaagauaaauauuaua

SEQ ID NO: 3358414 - RNA, 14 nt, Human
aaagauaaauauua

SEQ ID NO: 3358415 - RNA, 15 nt, Human
aaagauaaauauuau

SEQ ID NO: 3358416 - RNA, 13 nt, Human
aaagauaaauauu

SEQ ID NO: 3358417 - RNA, 13 nt, Human
aaagaggugugca

SEQ ID NO: 3358418 - RNA, 12 nt, Human
aaaauuaagaaa

SEQ ID NO: 3358419 - RNA, 22 nt, Human
aaaauuaacaugaauauuuagu

SEQ ID NO: 3358420 - RNA, 20 nt, Human
aaaauuaagaaaggauaaag

SEQ ID NO: 3358421 - RNA, 13 nt, Human
aaaauuaagaaag

SEQ ID NO: 3358422 - RNA, 21 nt, Human
aaaauccacuuuaucuugaau

SEQ ID NO: 3358423 - RNA, 15 nt, Human
aaaauaaaaaacacu

SEQ ID NO: 3358424 - RNA, 16 nt, Human
aaaauuauuuuguuca

SEQ ID NO: 3358425 - RNA, 18 nt, Human
aaaauuauuuuguucaua

SEQ ID NO: 3358426 - RNA, 20 nt, Human
aaaauuauuuuguucauaca

SEQ ID NO: 3358427 - RNA, 22 nt, Human
aaauguuuuuuuuuaaagacuu

SEQ ID NO: 3358428 - RNA, 14 nt, Human
aaauugauguguuu

SEQ ID NO: 3358429 - RNA, 18 nt, Human
aaauugaugggauuuggu

SEQ ID NO: 3358430 - RNA, 17 nt, Human
aacacuaacaugauuug

SEQ ID NO: 3358431 - RNA, 21 nt, Human
aaauguuuuuuuuuaaagacu

SEQ ID NO: 3358432 - RNA, 18 nt, Human
aaauguuuuuuuuuaaag

SEQ ID NO: 3358433 - RNA, 17 nt, Human
aaaucugaccaaaacaa

SEQ ID NO: 3358434 - RNA, 20 nt, Human
aaaugcuagguuaauuccaa

SEQ ID NO: 3358435 - RNA, 15 nt, Human
aacguauaaaagccu

SEQ ID NO: 3358436 - RNA, 13 nt, Human
aacugagcuugga

SEQ ID NO: 3358437 - RNA, 17 nt, Human
aacugagcuuggaagcu

SEQ ID NO: 3358438 - RNA, 21 nt, Human
aacugagcuuggaagcuucug

SEQ ID NO: 3358439 - RNA, 20 nt, Human
aacagcggcuggacuuggag

SEQ ID NO: 3358440 - RNA, 15 nt, Human
aacaucccuccuggg

SEQ ID NO: 3358441 - RNA, 10 nt, Human
agagggcugc

SEQ ID NO: 3358442 - RNA, 23 nt, Human
agagaggccauucuuucccaaca

SEQ ID NO: 3358443 - RNA, 15 nt, Human
agagccugagaguga

SEQ ID NO: 3358444 - RNA, 20 nt, Human
agaaugaaauugcugaaaga

SEQ ID NO: 3358445 - RNA, 22 nt, Human
agacagccaacuauggccugug

SEQ ID NO: 3358446 - RNA, 18 nt, Human
agaugaugaaaauauuua

SEQ ID NO: 3358447 - RNA, 14 nt, Human
agaugguucuagca

SEQ ID NO: 3358448 - RNA, 23 nt, Human
agaugaugaaaauauuuaaaggc

SEQ ID NO: 3358449 - RNA, 21 nt, Human
agcaaagcugaugacaacuuc

SEQ ID NO: 3358450 - RNA, 23 nt, Human
agcaaagcugaugacaacuuccc

SEQ ID NO: 3358451 - RNA, 15 nt, Human
agccaagaggcugca

SEQ ID NO: 3358452 - RNA, 16 nt, Human
agcuccuuaaggcucu

SEQ ID NO: 3358453 - RNA, 17 nt, Human
agcuccuuaaggcucuu

SEQ ID NO: 3358454 - RNA, 14 nt, Human
agcugagcaggugu

SEQ ID NO: 3358455 - RNA, 15 nt, Human
agcugcgggcugggu

SEQ ID NO: 3358456 - RNA, 18 nt, Human
agccuggcuucaaauugu

SEQ ID NO: 3358457 - RNA, 17 nt, Human
agccuggcuucaaauug

SEQ ID NO: 3358458 - RNA, 19 nt, Human
agcuaauucuuugaccugu

SEQ ID NO: 3358459 - RNA, 23 nt, Human
agcuaauguaauaacugugaagu

SEQ ID NO: 3358460 - RNA, 16 nt, Human
aggaaccgaggcaggg

SEQ ID NO: 3358461 - RNA, 16 nt, Human
aggaacugcugggcuu

SEQ ID NO: 3358462 - RNA, 22 nt, Human
aggaacugcugggcuuggcagc

SEQ ID NO: 3358463 - RNA, 13 nt, Human
aggaaccaaagcg

SEQ ID NO: 3358464 - RNA, 15 nt, Human
aggaaccaaagcgaa

SEQ ID NO: 3358465 - RNA, 16 nt, Human
aggaaccauaaucaau

SEQ ID NO: 3358466 - RNA, 15 nt, Human
agcuuuuaugugaaa

SEQ ID NO: 3358467 - RNA, 17 nt, Human
agggacugagaaauuua

SEQ ID NO: 3358468 - RNA, 22 nt, Human
agggauuuggggcucagagugg

SEQ ID NO: 3358469 - RNA, 14 nt, Human
agggaugguguuca

SEQ ID NO: 3358470 - RNA, 16 nt, Human
agggaugguguucaaa

SEQ ID NO: 3358471 - RNA, 12 nt, Human
aggggcaggagg

SEQ ID NO: 3358472 - RNA, 13 nt, Human
aggggcaggagga

SEQ ID NO: 3358473 - RNA, 18 nt, Human
aggggcaggaggaagggg

SEQ ID NO: 3358474 - RNA, 23 nt, Human
aggucccuaauaaagcugugugg

SEQ ID NO: 3358475 - RNA, 23 nt, Human
agucugagagaggccauucuuuc

SEQ ID NO: 3358476 - RNA, 16 nt, Human
agucugagagaggcca

SEQ ID NO: 3358477 - RNA, 20 nt, Human
agugaauucuugaaggaaaa

SEQ ID NO: 3358478 - RNA, 13 nt, Human
aguauuuuugaca

SEQ ID NO: 3358479 - RNA, 16 nt, Human
aguauuuuugacagaa

SEQ ID NO: 3358480 - RNA, 17 nt, Human
aguauuuuugacagaau

SEQ ID NO: 3358481 - RNA, 18 nt, Human
aguauuuuugacagaaua

SEQ ID NO: 3358482 - RNA, 19 nt, Human
aguaacaaugaagauaaaa

SEQ ID NO: 3358483 - RNA, 22 nt, Human
aguaaaugcuagguuaauucca

SEQ ID NO: 3358484 - RNA, 11 nt, Human
aguaaaugcua

SEQ ID NO: 3358485 - RNA, 23 nt, Human
aguaaaugcuagguuaauuccaa

SEQ ID NO: 3358486 - RNA, 12 nt, Human
agugucuggcug

SEQ ID NO: 3358487 - RNA, 13 nt, Human
agugucuggcugc

SEQ ID NO: 3358488 - RNA, 14 nt, Human
agugucuggcugca

SEQ ID NO: 3358489 - RNA, 15 nt, Human
agugcuaauuuugaa

SEQ ID NO: 3358490 - RNA, 18 nt, Human
agugcuaauuuugaaaaa

SEQ ID NO: 3358491 - RNA, 13 nt, Human
aguucagcuuggg

SEQ ID NO: 3358492 - RNA, 14 nt, Human
aguucagcuugggg

SEQ ID NO: 3358493 - RNA, 13 nt, Human
auaauggucagag

SEQ ID NO: 3358494 - RNA, 17 nt, Human
auacccagaaaguuauu

SEQ ID NO: 3358495 - RNA, 20 nt, Human
auaaaaagccugcaauuuca

SEQ ID NO: 3358496 - RNA, 18 nt, Human
aguuuggcaaacucucca

SEQ ID NO: 3358497 - RNA, 16 nt, Human
aguuuggcaaacucuc

SEQ ID NO: 3358498 - RNA, 22 nt, Human
auaaaaagccugcaauuucaua

SEQ ID NO: 3358499 - RNA, 14 nt, Human
auaacaaugaaagu

SEQ ID NO: 3358500 - RNA, 15 nt, Human
auauaaguguguguu

SEQ ID NO: 3358501 - RNA, 17 nt, Human
auauuauguguuuccau

SEQ ID NO: 3358502 - RNA, 13 nt, Human
auauuauguguuu

SEQ ID NO: 3358503 - RNA, 17 nt, Human
auaugcagauuuugccc

SEQ ID NO: 3358504 - RNA, 13 nt, Human
auaucaguuugcu

SEQ ID NO: 3358505 - RNA, 14 nt, Human
auauuauuuuaugu

SEQ ID NO: 3358506 - RNA, 22 nt, Human
auauuauuuuauguugcauaga

SEQ ID NO: 3358507 - RNA, 15 nt, Human
auauuauuuuauguu

SEQ ID NO: 3358508 - RNA, 19 nt, Human
auauuucccugaaggaacc

SEQ ID NO: 3358509 - RNA, 20 nt, Human
auccagagucccugccugga

SEQ ID NO: 3358510 - RNA, 21 nt, Human
auccagagucccugccuggac

SEQ ID NO: 3358511 - RNA, 19 nt, Human
auccagagucccugccugg

SEQ ID NO: 3358512 - RNA, 19 nt, Human
auccucaguuuuugugaaa

SEQ ID NO: 3358513 - RNA, 12 nt, Human
aucaugugaaau

SEQ ID NO: 3358514 - RNA, 22 nt, Human
aucaaauauauucagccuggcu

SEQ ID NO: 3358515 - RNA, 21 nt, Human
auauuucccugaaggaaccaa

SEQ ID NO: 3358516 - RNA, 14 nt, Human
aucaaauauauuca

SEQ ID NO: 3358517 - RNA, 13 nt, Human
augagggucuugg

SEQ ID NO: 3358518 - RNA, 12 nt, Human
augaaaauauuu

SEQ ID NO: 3358519 - RNA, 13 nt, Human
augaaaauauuua

SEQ ID NO: 3358520 - RNA, 14 nt, Human
augaaaauauuuaa

SEQ ID NO: 3358521 - RNA, 16 nt, Human
augaaaauauuuaaag

SEQ ID NO: 3358522 - RNA, 14 nt, Human
aucuaguaugaaau

SEQ ID NO: 3358523 - RNA, 15 nt, Human
aucuaguaugaaauu

SEQ ID NO: 3358524 - RNA, 16 nt, Human
aucuaguaugaaauua

SEQ ID NO: 3358525 - RNA, 17 nt, Human
aucuaguaugaaauuau

SEQ ID NO: 3358526 - RNA, 18 nt, Human
aucuaguaugaaauuaua

SEQ ID NO: 3358527 - RNA, 19 nt, Human
aucuaguaugaaauuauau

SEQ ID NO: 3358528 - RNA, 18 nt, Human
aucugggggccucuucug

SEQ ID NO: 3358529 - RNA, 22 nt, Human
aucucugcaggaaauggcugug

SEQ ID NO: 3358530 - RNA, 16 nt, Human
augaugggucaguugu

SEQ ID NO: 3358531 - RNA, 23 nt, Human
augcacaaauucugucucuggau

SEQ ID NO: 3358532 - RNA, 22 nt, Human
augcacaaauucugucucugga

SEQ ID NO: 3358533 - RNA, 15 nt, Human
augcacaaauucugu

SEQ ID NO: 3358534 - RNA, 19 nt, Human
augaugaaaauauuuaaag

SEQ ID NO: 3358535 - RNA, 13 nt, Human
augaugaaaauau

SEQ ID NO: 3358536 - RNA, 15 nt, Human
augaugaaaauauuu

SEQ ID NO: 3358537 - RNA, 18 nt, Human
auggauaggcacaggaaa

SEQ ID NO: 3358538 - RNA, 17 nt, Human
auggauaggcacaggaa

SEQ ID NO: 3358539 - RNA, 14 nt, Human
augugaaacauguu

SEQ ID NO: 3358540 - RNA, 14 nt, Human
augugaaaucauuc

SEQ ID NO: 3358541 - RNA, 16 nt, Human
augugaacagcggcug

SEQ ID NO: 3358542 - RNA, 18 nt, Human
augugaaaucauucauuu

SEQ ID NO: 3358543 - RNA, 17 nt, Human
augugaaaucauucauu

SEQ ID NO: 3358544 - RNA, 15 nt, Human
auguguaaaauguga

SEQ ID NO: 3358545 - RNA, 17 nt, Human
cugcuuuuuauggccug

SEQ ID NO: 3358546 - RNA, 18 nt, Human
cugcuuuuuauggccugu

SEQ ID NO: 3358547 - RNA, 13 nt, Human
cuggacugugugc

SEQ ID NO: 3358548 - RNA, 23 nt, Human
cugccaucauguuuacagaggac

SEQ ID NO: 3358549 - RNA, 17 nt, Human
cugccaucauguuuaca

SEQ ID NO: 3358550 - RNA, 22 nt, Human
cugccaucauguuuacagagga

SEQ ID NO: 3358551 - RNA, 23 nt, Human
cuguacuugcucuugaugccugg

SEQ ID NO: 3358552 - RNA, 22 nt, Human
cuguacuugcucuugaugccug

SEQ ID NO: 3358553 - RNA, 21 nt, Human
cuguacuugcucuugaugccu

SEQ ID NO: 3358554 - RNA, 18 nt, Human
cuggggccaggcuggguc

SEQ ID NO: 3358555 - RNA, 17 nt, Human
cuggggaugucucucau

SEQ ID NO: 3358556 - RNA, 22 nt, Human
cuggggaugucucucaugacca

SEQ ID NO: 3358557 - RNA, 18 nt, Human
cuggggauugggccccug

SEQ ID NO: 3358558 - RNA, 22 nt, Human
cuggggauugggccccugccag

SEQ ID NO: 3358559 - RNA, 16 nt, Human
cuggggauugggcccc

SEQ ID NO: 3358560 - RNA, 16 nt, Human
cuggcuccaggccagg

SEQ ID NO: 3358561 - RNA, 17 nt, Human
cuggagacuaaccccac

SEQ ID NO: 3358562 - RNA, 16 nt, Human
cuggacugugugcuca

SEQ ID NO: 3358563 - RNA, 18 nt, Human
cuuauuggcagcucuacu

SEQ ID NO: 3358564 - RNA, 20 nt, Human
cuucaugcauagguuuagca

SEQ ID NO: 3358565 - RNA, 19 nt, Human
cuucaucugacuaugacau

SEQ ID NO: 3358566 - RNA, 12 nt, Human
cuucauacaggg

SEQ ID NO: 3358567 - RNA, 13 nt, Human
cuucauacaggga

SEQ ID NO: 3358568 - RNA, 22 nt, Human
cuucauacagggaugguguuca

SEQ ID NO: 3358569 - RNA, 21 nt, Human
cuucaucugacuaugacauaa

SEQ ID NO: 3358570 - RNA, 15 nt, Human
cuucacuguaaaaua

SEQ ID NO: 3358571 - RNA, 9 nt, Human
cuucauaca

SEQ ID NO: 3358572 - RNA, 10 nt, Human
cuucauacac

SEQ ID NO: 3358573 - RNA, 16 nt, Human
cuugacaaagucaagc

SEQ ID NO: 3358574 - RNA, 19 nt, Human
cuugacaaagucaagccac

SEQ ID NO: 3358575 - RNA, 12 nt, Human
cuugaugccugg

SEQ ID NO: 3358576 - RNA, 14 nt, Human
cuuuuaugugaaac

SEQ ID NO: 3358577 - RNA, 15 nt, Human
cuuuuggcauuuuac

SEQ ID NO: 3358578 - RNA, 22 nt, Human
gcauaacguauaaaagccuguu

SEQ ID NO: 3358579 - RNA, 21 nt, Human
gcaguuugccuggugcagugg

SEQ ID NO: 3358580 - RNA, 12 nt, Human
gcacugacagau

SEQ ID NO: 3358581 - RNA, 17 nt, Human
gcacugacagauuucca

SEQ ID NO: 3358582 - RNA, 14 nt, Human
gcagaaaucuagaa

SEQ ID NO: 3358583 - RNA, 15 nt, Human
gcagaaaucuagaag

SEQ ID NO: 3358584 - RNA, 21 nt, Human
gcagagcagugggccuggcca

SEQ ID NO: 3358585 - RNA, 13 nt, Human
gauucugagagcu

SEQ ID NO: 3358586 - RNA, 20 nt, Human
gcaauaaccucaaagugacu

SEQ ID NO: 3358587 - RNA, 20 nt, Human
gcaccggggccugggcagga

SEQ ID NO: 3358588 - RNA, 19 nt, Human
gcaccggggccugggcagg

SEQ ID NO: 3358589 - RNA, 12 nt, Human
gaucccaacacu

SEQ ID NO: 3358590 - RNA, 23 nt, Human
gaucucagugguuaagauuccua

SEQ ID NO: 3358591 - RNA, 18 nt, Human
gauuacugccuauuuuaa

SEQ ID NO: 3358592 - RNA, 14 nt, Human
gaguuuaggguggg

SEQ ID NO: 3358593 - RNA, 15 nt, Human
gaguuuagggugggg

SEQ ID NO: 3358594 - RNA, 16 nt, Human
gaguuuaaauuguaau

SEQ ID NO: 3358595 - RNA, 13 nt, Human
gaguuggcuggga

SEQ ID NO: 3358596 - RNA, 13 nt, Human
gaguccaucagcc

SEQ ID NO: 3358597 - RNA, 14 nt, Human
gaguccaucagccu

SEQ ID NO: 3358598 - RNA, 15 nt, Human
gaguccaucagccuc

SEQ ID NO: 3358599 - RNA, 18 nt, Human
gagugaggaugucugggc

SEQ ID NO: 3358600 - RNA, 16 nt, Human
gauacuugaaaauuaa

SEQ ID NO: 3358601 - RNA, 19 nt, Human
gagcuggggaugucucuca

SEQ ID NO: 3358602 - RNA, 14 nt, Human
gagauguagccccu

SEQ ID NO: 3358603 - RNA, 20 nt, Human
gagaugaugaaaauauuuaa

SEQ ID NO: 3358604 - RNA, 19 nt, Human
gagaugaugaaaauauuua

SEQ ID NO: 3358605 - RNA, 14 nt, Human
gacuauucaguuuu

SEQ ID NO: 3358606 - RNA, 18 nt, Human
gacuuuugaaaagaggug

SEQ ID NO: 3358607 - RNA, 22 nt, Human
gagacguuuuuggaagaguagu

SEQ ID NO: 3358608 - RNA, 23 nt, Human
gagacuaaccccaccacacccuc

SEQ ID NO: 3358609 - RNA, 12 nt, Human
gaauuuuaaaag

SEQ ID NO: 3358610 - RNA, 15 nt, Human
gaauuuuaaaagaug

SEQ ID NO: 3358611 - RNA, 21 nt, Human
gaauuuuaaaagaugcaaugu

SEQ ID NO: 3358612 - RNA, 23 nt, Human
gaauuuuaaaagaugcaauguag

SEQ ID NO: 3358613 - RNA, 20 nt, Human
gaauuugugaagguggaaau

SEQ ID NO: 3358614 - RNA, 16 nt, Human
gacagguuagcugcuc

SEQ ID NO: 3358615 - RNA, 15 nt, Human
gacaguauuuguggg

SEQ ID NO: 3358616 - RNA, 16 nt, Human
gacagaauauguuuca

SEQ ID NO: 3358617 - RNA, 17 nt, Human
gaagugugggucugugu

SEQ ID NO: 3358618 - RNA, 18 nt, Human
gaagugugggucugugug

SEQ ID NO: 3358619 - RNA, 15 nt, Human
gaaggcuauggggau

SEQ ID NO: 3358620 - RNA, 19 nt, Human
gaagggcagggcugaggcc

SEQ ID NO: 3358621 - RNA, 22 nt, Human
ggcgaagcguuguccucagccc

SEQ ID NO: 3358622 - RNA, 16 nt, Human
ggccuugaguccccca

SEQ ID NO: 3358623 - RNA, 20 nt, Human
ggccuguggaucaaauccag

SEQ ID NO: 3358624 - RNA, 17 nt, Human
ggcccugugccuuggug

SEQ ID NO: 3358625 - RNA, 22 nt, Human
ggcauccagagucccugccugg

SEQ ID NO: 3358626 - RNA, 18 nt, Human
ggcauuuuacuguacaga

SEQ ID NO: 3358627 - RNA, 18 nt, Human
ggcauccagagucccugc

SEQ ID NO: 3358628 - RNA, 15 nt, Human
ggcauauuuuucaca

SEQ ID NO: 3358629 - RNA, 17 nt, Human
ggcauauuuuucacaua

SEQ ID NO: 3358630 - RNA, 18 nt, Human
ggccagcaccaucucuuu

SEQ ID NO: 3358631 - RNA, 19 nt, Human
ggccaguggcuggaucugu

SEQ ID NO: 3358632 - RNA, 21 nt, Human
ggagguagcuuugagguggaa

SEQ ID NO: 3358633 - RNA, 22 nt, Human
ggagcccacuguacuugcucuu

SEQ ID NO: 3358634 - RNA, 12 nt, Human
ggcacagccugg

SEQ ID NO: 3358635 - RNA, 13 nt, Human
ggcacagccuggc

SEQ ID NO: 3358636 - RNA, 23 nt, Human
ggguguccugcaccggggccugg

SEQ ID NO: 3358637 - RNA, 18 nt, Human
ggguggggggggugcugg

SEQ ID NO: 3358638 - RNA, 15 nt, Human
ggguggggggggugc

SEQ ID NO: 3358639 - RNA, 21 nt, Human
ggguguccugcaccggggccu

SEQ ID NO: 3358640 - RNA, 17 nt, Human
gguagcuuugaggugga

SEQ ID NO: 3358641 - RNA, 20 nt, Human
ggucuguguguguguaugug

SEQ ID NO: 3358642 - RNA, 21 nt, Human
ggucuguguguguguaugugg

SEQ ID NO: 3358643 - RNA, 19 nt, Human
ggugcugggccccugccuc

SEQ ID NO: 3358644 - RNA, 20 nt, Human
ggugcugggccccugccucu

SEQ ID NO: 3358645 - RNA, 17 nt, Human
aaagcaggcagaacuca

SEQ ID NO: 3358646 - RNA, 19 nt, Human
aaagcaggcagaacucauc

SEQ ID NO: 3358647 - RNA, 11 nt, Human
ggucugugugu

SEQ ID NO: 3358648 - RNA, 17 nt, Human
ggucuguguguguguau

SEQ ID NO: 3358649 - RNA, 20 nt, Human
ggucgcccuggacugugugc

SEQ ID NO: 3358650 - RNA, 13 nt, Human
aaagauuuucaga

SEQ ID NO: 3358651 - RNA, 21 nt, Human
gguggggagagacgggcccug

SEQ ID NO: 3358652 - RNA, 18 nt, Human
aaagccuguuuaagagac

SEQ ID NO: 3358653 - RNA, 16 nt, Human
aaagccuguuuaagag

SEQ ID NO: 3358654 - RNA, 17 nt, Human
gguggggggggugcugg

SEQ ID NO: 3358655 - RNA, 16 nt, Human
guaaauuuaugugaug

SEQ ID NO: 3358656 - RNA, 17 nt, Human
guaaauuuaugugaugg

SEQ ID NO: 3358657 - RNA, 17 nt, Human
guaacaaugaagauaaa

SEQ ID NO: 3358658 - RNA, 16 nt, Human
guaaagacuguagaag

SEQ ID NO: 3358659 - RNA, 22 nt, Human
guaaaaugugaagugaaugaaa

SEQ ID NO: 3358660 - RNA, 20 nt, Human
guaaaaugugaagugaauga

SEQ ID NO: 3358661 - RNA, 19 nt, Human
guaaaaugugaagugaaug

SEQ ID NO: 3358662 - RNA, 12 nt, Human
guaaaaugugaa

SEQ ID NO: 3358663 - RNA, 23 nt, Human
aaaguuauugauaaguucauaca

SEQ ID NO: 3358664 - RNA, 20 nt, Human
aaaguuauugauaaguucau

SEQ ID NO: 3358665 - RNA, 16 nt, Human
aaaguuuguugaaaca

SEQ ID NO: 3358666 - RNA, 22 nt, Human
gggcccuggugguggcucggga

SEQ ID NO: 3358667 - RNA, 13 nt, Human
gggccaggcuggg

SEQ ID NO: 3358668 - RNA, 21 nt, Human
gggccagucccugaggcaggu

SEQ ID NO: 3358669 - RNA, 18 nt, Human
gggccagucccugaggca

SEQ ID NO: 3358670 - RNA, 15 nt, Human
gggccaggcuggguc

SEQ ID NO: 3358671 - RNA, 14 nt, Human
gggccaggcugggu

SEQ ID NO: 3358672 - RNA, 21 nt, Human
gggccaggcugggucgcccug

SEQ ID NO: 3358673 - RNA, 12 nt, Human
aaaaugugaagu

SEQ ID NO: 3358674 - RNA, 18 nt, Human
gggcucagagugggguag

SEQ ID NO: 3358675 - RNA, 17 nt, Human
aaacaccggguuccagc

SEQ ID NO: 3358676 - RNA, 14 nt, Human
aaaagggaggggga

SEQ ID NO: 3358677 - RNA, 19 nt, Human
aaaagggacugagaaauuu

SEQ ID NO: 3358678 - RNA, 15 nt, Human
gggauugggccccug

SEQ ID NO: 3358679 - RNA, 14 nt, Human
gggaugucucucau

SEQ ID NO: 3358680 - RNA, 16 nt, Human
gggaugguguucaaaa

SEQ ID NO: 3358681 - RNA, 22 nt, Human
gggaggcucuggagcccacugu

SEQ ID NO: 3358682 - RNA, 22 nt, Human
gggagaaugucaguauguggaa

SEQ ID NO: 3358683 - RNA, 19 nt, Human
gggagaaugucaguaugug

SEQ ID NO: 3358684 - RNA, 15 nt, Human
aaaagaugcaaugua

SEQ ID NO: 3358685 - RNA, 19 nt, Human
aaaaauauauuuaaugaua

SEQ ID NO: 3358686 - RNA, 15 nt, Human
aaaaauauauuuaau

SEQ ID NO: 3358687 - RNA, 13 nt, Human
aaaaauauauuua

SEQ ID NO: 3358688 - RNA, 15 nt, Human
aaaacccagauaaag

SEQ ID NO: 3358689 - RNA, 16 nt, Human
gcuucaaauuguaagc

SEQ ID NO: 3358690 - RNA, 20 nt, Human
gcuguagacauuugcuauga

SEQ ID NO: 3358691 - RNA, 19 nt, Human
gcuugaaacccguggcgcu

SEQ ID NO: 3358692 - RNA, 19 nt, Human
gcuuuccucaucaggccau

SEQ ID NO: 3358693 - RNA, 19 nt, Human
gcuuugagguggaagaggg

SEQ ID NO: 3358694 - RNA, 22 nt, Human
gcuuugagguggaagagggcug

SEQ ID NO: 3358695 - RNA, 15 nt, Human
gcuuuuuuaucaugu

SEQ ID NO: 3358696 - RNA, 20 nt, Human
gcuuuuuuaucaugugaaau

SEQ ID NO: 3358697 - RNA, 18 nt, Human
gcuuuuuuaucaugugaa

SEQ ID NO: 3358698 - RNA, 14 nt, Human
ggaacugcugggcu

SEQ ID NO: 3358699 - RNA, 13 nt, Human
gcugcuccccacg

SEQ ID NO: 3358700 - RNA, 22 nt, Human
gcugcuccccacgucagcuggg

SEQ ID NO: 3358701 - RNA, 21 nt, Human
gcugcagagcagugggccugg

SEQ ID NO: 3358702 - RNA, 20 nt, Human
gcugcagagcagugggccug

SEQ ID NO: 3358703 - RNA, 18 nt, Human
gcuccucgagaucccaac

SEQ ID NO: 3358704 - RNA, 16 nt, Human
gcucuggagcccacug

SEQ ID NO: 3358705 - RNA, 15 nt, Human
gcucuggagcccacu

SEQ ID NO: 3358706 - RNA, 14 nt, Human
gcugaggccucuca

SEQ ID NO: 3358707 - RNA, 17 nt, Human
gcucugugcccacccuc

SEQ ID NO: 3358708 - RNA, 14 nt, Human
gccaggauggaaug

SEQ ID NO: 3358709 - RNA, 14 nt, Human
gccaguggcuggau

SEQ ID NO: 3358710 - RNA, 23 nt, Human
gccaguggcuggaucugugaggg

SEQ ID NO: 3358711 - RNA, 11 nt, Human
gcccuaucugu

SEQ ID NO: 3358712 - RNA, 16 nt, Human
gccccugccucucugc

SEQ ID NO: 3358713 - RNA, 15 nt, Human
gccccugccucucug

SEQ ID NO: 3358714 - RNA, 18 nt, Human
gccccugccucucugcag

SEQ ID NO: 3358715 - RNA, 17 nt, Human
gccccugccucucugca

SEQ ID NO: 3358716 - RNA, 17 nt, Human
gccucgacacagagugg

SEQ ID NO: 3358717 - RNA, 17 nt, Human
gcggcugggaggagggc

SEQ ID NO: 3358718 - RNA, 18 nt, Human
gcggcugggaggagggca

SEQ ID NO: 3358719 - RNA, 19 nt, Human
gcggcugggaggagggcag

SEQ ID NO: 3358720 - RNA, 22 nt, Human
gcggcugggaggagggcaggca

SEQ ID NO: 3358721 - RNA, 13 nt, Human
gcggcugggagga

SEQ ID NO: 3358722 - RNA, 14 nt, Human
gcggcugggaggag

SEQ ID NO: 3358723 - RNA, 19 nt, Human
gcuacuguaaggcaaucau

SEQ ID NO: 3358724 - RNA, 18 nt, Human
gcuacuguaaggcaauca

SEQ ID NO: 3358725 - RNA, 18 nt, Human
gcuaauuuugaaaaacug

SEQ ID NO: 3358726 - RNA, 19 nt, Human
cacuggggcaggggccggg

SEQ ID NO: 3358727 - RNA, 18 nt, Human
cacugccagcauuucccu

SEQ ID NO: 3358728 - RNA, 22 nt, Human
cacugccagcauuucccuuccu

SEQ ID NO: 3358729 - RNA, 21 nt, Human
cacucuuggagccugcagagc

SEQ ID NO: 3358730 - RNA, 22 nt, Human
cacucuuggagccugcagagcu

SEQ ID NO: 3358731 - RNA, 23 nt, Human
cacucuuggagccugcagagcug

SEQ ID NO: 3358732 - RNA, 15 nt, Human
caauucuugccaaau

SEQ ID NO: 3358733 - RNA, 13 nt, Human
auucuuucccaac

SEQ ID NO: 3358734 - RNA, 16 nt, Human
auucuuucccaacacc

SEQ ID NO: 3358735 - RNA, 19 nt, Human
auucuuucccaacaccucu

SEQ ID NO: 3358736 - RNA, 18 nt, Human
auucuugaaggaaaauga

SEQ ID NO: 3358737 - RNA, 15 nt, Human
auucuugaaggaaaa

SEQ ID NO: 3358738 - RNA, 22 nt, Human
auugauaaguucauacauugua

SEQ ID NO: 3358739 - RNA, 21 nt, Human
auugauaaguucauacauugu

SEQ ID NO: 3358740 - RNA, 23 nt, Human
auuguaauaggcguaacuaauuu

SEQ ID NO: 3358741 - RNA, 21 nt, Human
auucauaauuauuauuuggcc

SEQ ID NO: 3358742 - RNA, 14 nt, Human
caaacaggcucaga

SEQ ID NO: 3358743 - RNA, 15 nt, Human
caaacaggcucagag

SEQ ID NO: 3358744 - RNA, 21 nt, Human
caaaaggauaaugaauacuuu

SEQ ID NO: 3358745 - RNA, 17 nt, Human
caacaaucccaaggccc

SEQ ID NO: 3358746 - RNA, 14 nt, Human
caacacuaacauga

SEQ ID NO: 3358747 - RNA, 21 nt, Human
caaagucucuggaauuugaaa

SEQ ID NO: 3358748 - RNA, 22 nt, Human
caaagguaaaucagacuaugaa

SEQ ID NO: 3358749 - RNA, 22 nt, Human
auuuguggggagggauuugggg

SEQ ID NO: 3358750 - RNA, 19 nt, Human
auuuuauagcuacuaauuu

SEQ ID NO: 3358751 - RNA, 17 nt, Human
auuuuauagcuacuaau

SEQ ID NO: 3358752 - RNA, 16 nt, Human
auuugcuaugagcugg

SEQ ID NO: 3358753 - RNA, 20 nt, Human
auuugcuaugagcuggggau

SEQ ID NO: 3358754 - RNA, 24 nt, Human
cagccccgcguggaacucgugucu

SEQ ID NO: 3358755 - RNA, 24 nt, Human
cagccucuccacucaugugacucu

SEQ ID NO: 3358756 - RNA, 11 nt, Human
cagccugccac

SEQ ID NO: 3358757 - RNA, 12 nt, Human
cagccugccacu

SEQ ID NO: 3358758 - RNA, 16 nt, Human
cagccugccacucagg

SEQ ID NO: 3358759 - RNA, 17 nt, Human
cagccugccacucaggc

SEQ ID NO: 3358760 - RNA, 17 nt, Human
cagcggcuggaauuggg

SEQ ID NO: 3358761 - RNA, 16 nt, Human
cagcggcuggacuugg

SEQ ID NO: 3358762 - RNA, 18 nt, Human
cagcggcuggacuuggag

SEQ ID NO: 3358763 - RNA, 23 nt, Human
cagaucauuaucagccugugcca

SEQ ID NO: 3358764 - RNA, 22 nt, Human
cagaucauugugaaauuauuca

SEQ ID NO: 3358765 - RNA, 16 nt, Human
cagaucauugugaaau

SEQ ID NO: 3358766 - RNA, 16 nt, Human
cagagcugcgggcugg

SEQ ID NO: 3358767 - RNA, 15 nt, Human
caguauuugugggga

SEQ ID NO: 3358768 - RNA, 18 nt, Human
ccaaaacaaacaaacaga

SEQ ID NO: 3358769 - RNA, 19 nt, Human
ccaaaaagauuuucagaaa

SEQ ID NO: 3358770 - RNA, 12 nt, Human
ccaaaacaaaca

SEQ ID NO: 3358771 - RNA, 20 nt, Human
ccaaaaaauucuacaacaca

SEQ ID NO: 3358772 - RNA, 22 nt, Human
ccaaaaaauucuacaacacaca

SEQ ID NO: 3358773 - RNA, 22 nt, Human
cauuggcucuugaacugagcuu

SEQ ID NO: 3358774 - RNA, 20 nt, Human
cauuggauucugagagcugu

SEQ ID NO: 3358775 - RNA, 22 nt, Human
ccaaaugagggucuugguucca

SEQ ID NO: 3358776 - RNA, 19 nt, Human
ccaaugugaacagcggcug

SEQ ID NO: 3358777 - RNA, 14 nt, Human
ccaccagaagccca

SEQ ID NO: 3358778 - RNA, 15 nt, Human
ccaccagaagcccag

SEQ ID NO: 3358779 - RNA, 16 nt, Human
ccaccagaagcccaga

SEQ ID NO: 3358780 - RNA, 18 nt, Human
ccaccagaagcccagaau

SEQ ID NO: 3358781 - RNA, 11 nt, Human
ccaccagaagc

SEQ ID NO: 3358782 - RNA, 12 nt, Human
ccaccagaagcc

SEQ ID NO: 3358783 - RNA, 13 nt, Human
ccaccagaagccc

SEQ ID NO: 3358784 - RNA, 17 nt, Human
caguuuggcaaacucuc

SEQ ID NO: 3358785 - RNA, 14 nt, Human
caugaauuugugaa

SEQ ID NO: 3358786 - RNA, 17 nt, Human
ccagagucccugccugg

SEQ ID NO: 3358787 - RNA, 18 nt, Human
ccagagucccugccugga

SEQ ID NO: 3358788 - RNA, 19 nt, Human
ccagagucccugccuggac

SEQ ID NO: 3358789 - RNA, 22 nt, Human
ccagagucccugccuggaccag

SEQ ID NO: 3358790 - RNA, 16 nt, Human
ccagagucccugccug

SEQ ID NO: 3358791 - RNA, 15 nt, Human
ccaguucagcuuggg

SEQ ID NO: 3358792 - RNA, 14 nt, Human
ccccgacuuuuguu

SEQ ID NO: 3358793 - RNA, 21 nt, Human
ccccagacuccaccaagccug

SEQ ID NO: 3358794 - RNA, 20 nt, Human
ccccagacuccaccaagccu

SEQ ID NO: 3358795 - RNA, 14 nt, Human
cccgggagcucagg

SEQ ID NO: 3358796 - RNA, 23 nt, Human
cccgggaggcagagguugcagug

SEQ ID NO: 3358797 - RNA, 20 nt, Human
cccugugccuugucacgcca

SEQ ID NO: 3358798 - RNA, 22 nt, Human
cccugugccuugucacgccaga

SEQ ID NO: 3358799 - RNA, 15 nt, Human
cccugugccuuguca

SEQ ID NO: 3358800 - RNA, 24 nt, Human
cccugugccuuggugugcuguauc

SEQ ID NO: 3358801 - RNA, 13 nt, Human
cccuggcuccagg

SEQ ID NO: 3358802 - RNA, 16 nt, Human
cccuggcuccaggcca

SEQ ID NO: 3358803 - RNA, 14 nt, Human
ccuaauaaagcugu

SEQ ID NO: 3358804 - RNA, 13 nt, Human
ccuaauaaagcug

SEQ ID NO: 3358805 - RNA, 23 nt, Human
ccuaauaaagcuguguggcaguc

SEQ ID NO: 3358806 - RNA, 16 nt, Human
ccguagguuauuuuca

SEQ ID NO: 3358807 - RNA, 15 nt, Human
ccuauuuuaauaaac

SEQ ID NO: 3358808 - RNA, 22 nt, Human
ccugacccucaucuuucuucca

SEQ ID NO: 3358809 - RNA, 14 nt, Human
ccugacucucagca

SEQ ID NO: 3358810 - RNA, 22 nt, Human
ccugaguaaaaaagcugugugc

SEQ ID NO: 3358811 - RNA, 23 nt, Human
ccucucugcaggucccuaauaaa

SEQ ID NO: 3358812 - RNA, 22 nt, Human
ccucucugcaggucccuaauaa

SEQ ID NO: 3358813 - RNA, 21 nt, Human
ccucucugcaggucccuaaua

SEQ ID NO: 3358814 - RNA, 13 nt, Human
ccucucugcaggu

SEQ ID NO: 3358815 - RNA, 20 nt, Human
ccucucugcaggucccuaau

SEQ ID NO: 3358816 - RNA, 14 nt, Human
cgugucuggcacag

SEQ ID NO: 3358817 - RNA, 13 nt, Human
cgugucuggcaca

SEQ ID NO: 3358818 - RNA, 21 nt, Human
cgugucuggcacagccuggcu

SEQ ID NO: 3358819 - RNA, 19 nt, Human
cuaaccugccgagagucca

SEQ ID NO: 3358820 - RNA, 21 nt, Human
cuaaccugccgagaguccauc

SEQ ID NO: 3358821 - RNA, 12 nt, Human
cuaaccugccga

SEQ ID NO: 3358822 - RNA, 23 nt, Human
cuacauaaguaauucaagaaaac

SEQ ID NO: 3358823 - RNA, 22 nt, Human
cuacauaaguaauucaagaaaa

SEQ ID NO: 3358824 - RNA, 18 nt, Human
cuagccaccgccuccuac

SEQ ID NO: 3358825 - RNA, 23 nt, Human
cggcuccucgagaucccaacacu

SEQ ID NO: 3358826 - RNA, 16 nt, Human
cucaucuuucuuccaa

SEQ ID NO: 3358827 - RNA, 16 nt, Human
cuccaaagucucugga

SEQ ID NO: 3358828 - RNA, 16 nt, Human
cucaggcccaaagccu

SEQ ID NO: 3358829 - RNA, 14 nt, Human
cucccuccucugcc

SEQ ID NO: 3358830 - RNA, 13 nt, Human
cucccuccucugc

SEQ ID NO: 3358831 - RNA, 14 nt, Human
cucuuggagccugc

SEQ ID NO: 3358832 - RNA, 15 nt, Human
uucuaguucugccag

SEQ ID NO: 3358833 - RNA, 13 nt, Human
uucuauaauuuaa

SEQ ID NO: 3358834 - RNA, 19 nt, Human
aucagacuaugaaguuuuu

SEQ ID NO: 3358835 - RNA, 20 nt, Human
uucuaacaaaaaaauauauu

SEQ ID NO: 3358836 - RNA, 19 nt, Human
uucuaacaaaaaaauauau

SEQ ID NO: 3358837 - RNA, 13 nt, Human
uucuaaaguaaaa

SEQ ID NO: 3358838 - RNA, 15 nt, Human
uucuaaaguaaaaac

SEQ ID NO: 3358839 - RNA, 14 nt, Human
auauuuuaagacga

SEQ ID NO: 3358840 - RNA, 20 nt, Human
auccuagucacuaccuucau

SEQ ID NO: 3358841 - RNA, 16 nt, Human
uucuuuguaaugaaaa

SEQ ID NO: 3358842 - RNA, 21 nt, Human
aucauuggauucugagagcug

SEQ ID NO: 3358843 - RNA, 22 nt, Human
aucauuggauucugagagcugu

SEQ ID NO: 3358844 - RNA, 22 nt, Human
auagcuuuucccuuuuuuuaag

SEQ ID NO: 3358845 - RNA, 17 nt, Human
auaggcguaacuaauuu

SEQ ID NO: 3358846 - RNA, 21 nt, Human
uuauuuuguucauacauauuu

SEQ ID NO: 3358847 - RNA, 16 nt, Human
uuauuuuguucauaca

SEQ ID NO: 3358848 - RNA, 17 nt, Human
uuauuuuguucauacau

SEQ ID NO: 3358849 - RNA, 17 nt, Human
uuauuuuuuucugaauu

SEQ ID NO: 3358850 - RNA, 13 nt, Human
uuauuuuuuucug

SEQ ID NO: 3358851 - RNA, 16 nt, Human
uucaaaauuguuacaa

SEQ ID NO: 3358852 - RNA, 21 nt, Human
uucaaaauuguuacaaauugu

SEQ ID NO: 3358853 - RNA, 13 nt, Human
auagucuuucagu

SEQ ID NO: 3358854 - RNA, 15 nt, Human
auauauauauauauu

SEQ ID NO: 3358855 - RNA, 13 nt, Human
auaucuuguagcu

SEQ ID NO: 3358856 - RNA, 14 nt, Human
auaucuaguaugaa

SEQ ID NO: 3358857 - RNA, 15 nt, Human
auaucuaguaugaaa

SEQ ID NO: 3358858 - RNA, 17 nt, Human
auaucuaguaugaaauu

SEQ ID NO: 3358859 - RNA, 14 nt, Human
auauauuuuaagac

SEQ ID NO: 3358860 - RNA, 13 nt, Human
auauauuuaauga

SEQ ID NO: 3358861 - RNA, 13 nt, Human
auauauuuuaaga

SEQ ID NO: 3358862 - RNA, 12 nt, Human
auauauuuuaag

SEQ ID NO: 3358863 - RNA, 12 nt, Human
uucauacauauu

SEQ ID NO: 3358864 - RNA, 23 nt, Human
uucauacauauuuuuguagcacu

SEQ ID NO: 3358865 - RNA, 21 nt, Human
uucauacagggaugguguuca

SEQ ID NO: 3358866 - RNA, 19 nt, Human
uucauaauuauuauuuggc

SEQ ID NO: 3358867 - RNA, 13 nt, Human
uucauacauugua

SEQ ID NO: 3358868 - RNA, 19 nt, Human
uucauacauuguacgaaga

SEQ ID NO: 3358869 - RNA, 13 nt, Human
uucauaugcugua

SEQ ID NO: 3358870 - RNA, 16 nt, Human
uuccagccugccacuc

SEQ ID NO: 3358871 - RNA, 14 nt, Human
uuccaagagccuga

SEQ ID NO: 3358872 - RNA, 22 nt, Human
uuccaagagccugagagugagg

SEQ ID NO: 3358873 - RNA, 13 nt, Human
uuccaagagccug

SEQ ID NO: 3358874 - RNA, 14 nt, Human
uuuaaauguuuuuu

SEQ ID NO: 3358875 - RNA, 12 nt, Human
uuuaauuuuaca

SEQ ID NO: 3358876 - RNA, 15 nt, Human
augauuccagguggc

SEQ ID NO: 3358877 - RNA, 16 nt, Human
augauuccagguggca

SEQ ID NO: 3358878 - RNA, 13 nt, Human
augcuucauacag

SEQ ID NO: 3358879 - RNA, 15 nt, Human
augcuucauacaggg

SEQ ID NO: 3358880 - RNA, 16 nt, Human
augcuucauacaggga

SEQ ID NO: 3358881 - RNA, 19 nt, Human
augcuucauacagggaugg

SEQ ID NO: 3358882 - RNA, 11 nt, Human
augcuucauac

SEQ ID NO: 3358883 - RNA, 12 nt, Human
augcuucauaca

SEQ ID NO: 3358884 - RNA, 10 nt, Human
augcuucaua

SEQ ID NO: 3358885 - RNA, 23 nt, Human
augcuucauacagggaugguguu

SEQ ID NO: 3358886 - RNA, 15 nt, Human
uuuaugugaaacaug

SEQ ID NO: 3358887 - RNA, 11 nt, Human
uuuaugugugu

SEQ ID NO: 3358888 - RNA, 13 nt, Human
uuuaugugugugu

SEQ ID NO: 3358889 - RNA, 12 nt, Human
uuuaugugaugg

SEQ ID NO: 3358890 - RNA, 16 nt, Human
uuuaguaucuuuuuau

SEQ ID NO: 3358891 - RNA, 16 nt, Human
auggccugggggaugu

SEQ ID NO: 3358892 - RNA, 21 nt, Human
auggaaugaugggucaguugu

SEQ ID NO: 3358893 - RNA, 16 nt, Human
auggaaugcuguguua

SEQ ID NO: 3358894 - RNA, 15 nt, Human
uuucauaugcuguau

SEQ ID NO: 3358895 - RNA, 22 nt, Human
aucuuuaauuuuacauuuccua

SEQ ID NO: 3358896 - RNA, 21 nt, Human
aucuuuaauuuuacauuuccu

SEQ ID NO: 3358897 - RNA, 16 nt, Human
aucuuuaauuuuacau

SEQ ID NO: 3358898 - RNA, 13 nt, Human
aucuuuuuauuca

SEQ ID NO: 3358899 - RNA, 18 nt, Human
augagaaaucuaaaaaac

SEQ ID NO: 3358900 - RNA, 15 nt, Human
augagaaaucuaaaa

SEQ ID NO: 3358901 - RNA, 23 nt, Human
augagaaaucuaaaaaacgaaaa

SEQ ID NO: 3358902 - RNA, 16 nt, Human
aucuguaccucugccu

SEQ ID NO: 3358903 - RNA, 20 nt, Human
aucugagaggccacagugca

SEQ ID NO: 3358904 - RNA, 11 nt, Human
uugauguguuu

SEQ ID NO: 3358905 - RNA, 15 nt, Human
uugaugggauuuggu

SEQ ID NO: 3358906 - RNA, 12 nt, Human
uugaugccuggc

SEQ ID NO: 3358907 - RNA, 14 nt, Human
uugcaucugaaaau

SEQ ID NO: 3358908 - RNA, 16 nt, Human
aucuccccaucauugg

SEQ ID NO: 3358909 - RNA, 17 nt, Human
aucucauaauuuauaca

SEQ ID NO: 3358910 - RNA, 23 nt, Human
aucucagugguuaagauuccuaa

SEQ ID NO: 3358911 - RNA, 18 nt, Human
aucucauaauuuauacag

SEQ ID NO: 3358912 - RNA, 14 nt, Human
auucagcucaugga

SEQ ID NO: 3358913 - RNA, 15 nt, Human
auucagccuggcuuc

SEQ ID NO: 3358914 - RNA, 16 nt, Human
auuauauuuacaaaug

SEQ ID NO: 3358915 - RNA, 13 nt, Human
auuauuuuaaaag

SEQ ID NO: 3358916 - RNA, 14 nt, Human
auuauuuuaaaaga

SEQ ID NO: 3358917 - RNA, 16 nt, Human
auuauuuuauguugca

SEQ ID NO: 3358918 - RNA, 18 nt, Human
auuauuuuauguugcaua

SEQ ID NO: 3358919 - RNA, 15 nt, Human
auuauauuuacaaau

SEQ ID NO: 3358920 - RNA, 16 nt, Human
auuaagaucucagugg

SEQ ID NO: 3358921 - RNA, 15 nt, Human
auuaauauauuucca

SEQ ID NO: 3358922 - RNA, 17 nt, Human
uuuguaaauuuauguga

SEQ ID NO: 3358923 - RNA, 17 nt, Human
uuuguagcacugacaga

SEQ ID NO: 3358924 - RNA, 19 nt, Human
uuuguagcacugacagauu

SEQ ID NO: 3358925 - RNA, 11 nt, Human
uuuuaagaaau

SEQ ID NO: 3358926 - RNA, 16 nt, Human
uuuuaaguaaggaauu

SEQ ID NO: 3358927 - RNA, 13 nt, Human
augucaguaugug

SEQ ID NO: 3358928 - RNA, 17 nt, Human
auguaugcuucauacag

SEQ ID NO: 3358929 - RNA, 16 nt, Human
auguaugcuucauaca

SEQ ID NO: 3358930 - RNA, 20 nt, Human
auguaugcuucauacaggga

SEQ ID NO: 3358931 - RNA, 14 nt, Human
augucaguaugugg

SEQ ID NO: 3358932 - RNA, 19 nt, Human
uuugcuaugagcuggggau

SEQ ID NO: 3358933 - RNA, 23 nt, Human
uuugcucagugucuggcugcaga

SEQ ID NO: 3358934 - RNA, 19 nt, Human
uuuuaguugcaacuuugua

SEQ ID NO: 3358935 - RNA, 18 nt, Human
uuuuaugugaaacauguu

SEQ ID NO: 3358936 - RNA, 19 nt, Human
uuuuaugugaaacauguuu

SEQ ID NO: 3358937 - RNA, 16 nt, Human
uuuucuauaauuuaaa

SEQ ID NO: 3358938 - RNA, 21 nt, Human
uuuuauucagcucauggacuu

SEQ ID NO: 3358939 - RNA, 15 nt, Human
auguuuacagaggac

SEQ ID NO: 3358940 - RNA, 17 nt, Human
auguuuacagaggacag

SEQ ID NO: 3358941 - RNA, 19 nt, Human
auguuuacagaggacagua

SEQ ID NO: 3358942 - RNA, 15 nt, Human
auguugugauguauu

SEQ ID NO: 3358943 - RNA, 20 nt, Human
auuaaaaaaucaguuguaca

SEQ ID NO: 3358944 - RNA, 21 nt, Human
auuaacaugaauauuuagugu

SEQ ID NO: 3358945 - RNA, 21 nt, Human
auugcuaaucaccaaaggcuc

SEQ ID NO: 3358946 - RNA, 21 nt, Human
auuggcucuugaacugagcuu

SEQ ID NO: 3358947 - RNA, 15 nt, Human
auugugaaauuauuc

SEQ ID NO: 3358948 - RNA, 14 nt, Human
auuguauuacaaau

SEQ ID NO: 3358949 - RNA, 18 nt, Human
auuuaaaggcccuaucug

SEQ ID NO: 3358950 - RNA, 20 nt, Human
auuuaaaggcccuaucuguu

SEQ ID NO: 3358951 - RNA, 21 nt, Human
auuuaaaggcccuaucuguuu

SEQ ID NO: 3358952 - RNA, 19 nt, Human
auuuaaaauugugaugugu

SEQ ID NO: 3358953 - RNA, 20 nt, Human
auuuaaaauugugauguguc

SEQ ID NO: 3358954 - RNA, 16 nt, Human
auuuacaaaugggaaa

SEQ ID NO: 3358955 - RNA, 23 nt, Human
auugcaggagucccugccaucau

SEQ ID NO: 3358956 - RNA, 14 nt, Human
auuuuauguugcau

SEQ ID NO: 3358957 - RNA, 21 nt, Human
auuuuauguugcauagaauaa

SEQ ID NO: 3358958 - RNA, 18 nt, Human
auuuuauguugcauagaa

SEQ ID NO: 3358959 - RNA, 22 nt, Human
auuuuacuguacagacagaaaa

SEQ ID NO: 3358960 - RNA, 17 nt, Human
auuuuaccuuugacaaa

SEQ ID NO: 3358961 - RNA, 20 nt, Human
auuuuacuguacagacagaa

SEQ ID NO: 3358962 - RNA, 20 nt, Human
auuuggagacacaacuauuu

SEQ ID NO: 3358963 - RNA, 20 nt, Human
auuugaauguaugcuucaua

SEQ ID NO: 3358964 - RNA, 21 nt, Human
auuugaauguaugcuucauac

SEQ ID NO: 3358965 - RNA, 17 nt, Human
auuugaauguaugcuuc

SEQ ID NO: 3358966 - RNA, 18 nt, Human
auuugaauguaugcuuca

SEQ ID NO: 3358967 - RNA, 17 nt, Human
agcauuucccuuccuuc

SEQ ID NO: 3358968 - RNA, 18 nt, Human
agcauggcauauuuuuca

SEQ ID NO: 3358969 - RNA, 19 nt, Human
agcauggcauauuuuucac

SEQ ID NO: 3358970 - RNA, 21 nt, Human
agcauggcauauuuuucacau

SEQ ID NO: 3358971 - RNA, 22 nt, Human
agcauggcauauuuuucacaua

SEQ ID NO: 3358972 - RNA, 17 nt, Human
agcaugucgucaaagcu

SEQ ID NO: 3358973 - RNA, 20 nt, Human
agcaugucgucaaagcugaa

SEQ ID NO: 3358974 - RNA, 21 nt, Human
ugauagaaggcuauggggaua

SEQ ID NO: 3358975 - RNA, 18 nt, Human
ugaguucauaaauuuaug

SEQ ID NO: 3358976 - RNA, 24 nt, Human
ugaguuacuugcugcccugugcuc

SEQ ID NO: 3358977 - RNA, 24 nt, Human
ugauaagcagucauccucagauca

SEQ ID NO: 3358978 - RNA, 19 nt, Human
ugauacgcaacauaauuaa

SEQ ID NO: 3358979 - RNA, 23 nt, Human
ugauacacuaugaagauguuuca

SEQ ID NO: 3358980 - RNA, 21 nt, Human
agcauaauacuugcuuuggaa

SEQ ID NO: 3358981 - RNA, 22 nt, Human
ugaguaacugauuuguaacaag

SEQ ID NO: 3358982 - RNA, 15 nt, Human
ugauccagcccugag

SEQ ID NO: 3358983 - RNA, 17 nt, Human
ugauccagcccugaguu

SEQ ID NO: 3358984 - RNA, 18 nt, Human
ugauccagcccugaguuc

SEQ ID NO: 3358985 - RNA, 15 nt, Human
agccaggccacuggc

SEQ ID NO: 3358986 - RNA, 21 nt, Human
agcucaggaaccgaggcaggg

SEQ ID NO: 3358987 - RNA, 22 nt, Human
agcucaggaaccgaggcaggga

SEQ ID NO: 3358988 - RNA, 20 nt, Human
agcucaggaaccgaggcagg

SEQ ID NO: 3358989 - RNA, 18 nt, Human
agcuaggaauuguguuua

SEQ ID NO: 3358990 - RNA, 17 nt, Human
ugccagacccccuggag

SEQ ID NO: 3358991 - RNA, 20 nt, Human
agccuggucagcccaaacca

SEQ ID NO: 3358992 - RNA, 13 nt, Human
agccuguuuaaga

SEQ ID NO: 3358993 - RNA, 15 nt, Human
agccuggucagccca

SEQ ID NO: 3358994 - RNA, 16 nt, Human
agccuggucagcccaa

SEQ ID NO: 3358995 - RNA, 18 nt, Human
agcccaguucagcuuggg

SEQ ID NO: 3358996 - RNA, 11 nt, Human
ugcaggucccu

SEQ ID NO: 3358997 - RNA, 23 nt, Human
ugcauaacguauaaaagccuguu

SEQ ID NO: 3358998 - RNA, 22 nt, Human
ugcauaacguauaaaagccugu

SEQ ID NO: 3358999 - RNA, 16 nt, Human
ugcaggucccuaauaa

SEQ ID NO: 3359000 - RNA, 15 nt, Human
ugcaggucccuaaua

SEQ ID NO: 3359001 - RNA, 14 nt, Human
ugcaggucccuaau

SEQ ID NO: 3359002 - RNA, 12 nt, Human
ugcaggucccua

SEQ ID NO: 3359003 - RNA, 19 nt, Human
aggaucccaugagcuccuu

SEQ ID NO: 3359004 - RNA, 20 nt, Human
uggaagcuucuggugaccuu

SEQ ID NO: 3359005 - RNA, 12 nt, Human
aggacaguauuu

SEQ ID NO: 3359006 - RNA, 19 nt, Human
aggacaguauuugugggga

SEQ ID NO: 3359007 - RNA, 15 nt, Human
uggacugugugcuca

SEQ ID NO: 3359008 - RNA, 13 nt, Human
aggcaaucauggu

SEQ ID NO: 3359009 - RNA, 20 nt, Human
uggaauuauuuuaaaagaua

SEQ ID NO: 3359010 - RNA, 19 nt, Human
uggaauuauuuuaaaagau

SEQ ID NO: 3359011 - RNA, 21 nt, Human
uggccuguucuucuauggguu

SEQ ID NO: 3359012 - RNA, 23 nt, Human
uggccaguggcuggaucugugag

SEQ ID NO: 3359013 - RNA, 16 nt, Human
uggcauauuuuucaca

SEQ ID NO: 3359014 - RNA, 17 nt, Human
uggcauauuuuucacau

SEQ ID NO: 3359015 - RNA, 17 nt, Human
uggauuauauuaugaag

SEQ ID NO: 3359016 - RNA, 21 nt, Human
agcugggacaccccgacuuuu

SEQ ID NO: 3359017 - RNA, 18 nt, Human
agcugugugcucuccaag

SEQ ID NO: 3359018 - RNA, 16 nt, Human
agcuguguggcagucu

SEQ ID NO: 3359019 - RNA, 14 nt, Human
agcuguguggcagu

SEQ ID NO: 3359020 - RNA, 20 nt, Human
agcugugugcucuccaagcc

SEQ ID NO: 3359021 - RNA, 15 nt, Human
ugccugcccuauucu

SEQ ID NO: 3359022 - RNA, 23 nt, Human
agcuuggggacaggggcaggagg

SEQ ID NO: 3359023 - RNA, 15 nt, Human
ugcuguagacauuug

SEQ ID NO: 3359024 - RNA, 23 nt, Human
ugcuguauccauccauggggcug

SEQ ID NO: 3359025 - RNA, 14 nt, Human
ugcuucaucccuuu

SEQ ID NO: 3359026 - RNA, 23 nt, Human
agcuuuaucaaagggugaaaauu

SEQ ID NO: 3359027 - RNA, 15 nt, Human
agggggagagggcug

SEQ ID NO: 3359028 - RNA, 16 nt, Human
agggggagagggcugc

SEQ ID NO: 3359029 - RNA, 12 nt, Human
ugggucugugug

SEQ ID NO: 3359030 - RNA, 21 nt, Human
ugggucgcccuggacugugug

SEQ ID NO: 3359031 - RNA, 13 nt, Human
ugguaggaacugc

SEQ ID NO: 3359032 - RNA, 20 nt, Human
ugguaggaacugcugggcuu

SEQ ID NO: 3359033 - RNA, 16 nt, Human
uggguggggggcuuca

SEQ ID NO: 3359034 - RNA, 16 nt, Human
aggucauauuaauaua

SEQ ID NO: 3359035 - RNA, 18 nt, Human
aggucauauuaauauauu

SEQ ID NO: 3359036 - RNA, 19 nt, Human
aggucauauuaauauauuu

SEQ ID NO: 3359037 - RNA, 23 nt, Human
agguauaauucacauuguauuca

SEQ ID NO: 3359038 - RNA, 11 nt, Human
uggucagccca

SEQ ID NO: 3359039 - RNA, 12 nt, Human
uggucagcccaa

SEQ ID NO: 3359040 - RNA, 10 nt, Human
uggucagccc

SEQ ID NO: 3359041 - RNA, 14 nt, Human
uggucuccacuggg

SEQ ID NO: 3359042 - RNA, 18 nt, Human
uggggaguuuaggguggg

SEQ ID NO: 3359043 - RNA, 19 nt, Human
uggggaguuuagggugggg

SEQ ID NO: 3359044 - RNA, 14 nt, Human
uggggcugauugua

SEQ ID NO: 3359045 - RNA, 21 nt, Human
ugggguagguugggagaaugu

SEQ ID NO: 3359046 - RNA, 15 nt, Human
ugggguagguuggga

SEQ ID NO: 3359047 - RNA, 20 nt, Human
uggggacaggggcaggagga

SEQ ID NO: 3359048 - RNA, 22 nt, Human
uggggacaggggcaggaggaag

SEQ ID NO: 3359049 - RNA, 13 nt, Human
agucccugccugg

SEQ ID NO: 3359050 - RNA, 22 nt, Human
agucccugaggcagguccccag

SEQ ID NO: 3359051 - RNA, 23 nt, Human
agucccugaggcagguccccaga

SEQ ID NO: 3359052 - RNA, 15 nt, Human
agucccugccuggac

SEQ ID NO: 3359053 - RNA, 21 nt, Human
agucccugccuggaccagccu

SEQ ID NO: 3359054 - RNA, 14 nt, Human
agucccugccugga

SEQ ID NO: 3359055 - RNA, 22 nt, Human
agucccugccuggaccagccuc

SEQ ID NO: 3359056 - RNA, 23 nt, Human
agucccugccuggaccagccucu

SEQ ID NO: 3359057 - RNA, 19 nt, Human
agucccugaggcagguccc

SEQ ID NO: 3359058 - RNA, 20 nt, Human
agucccugaggcaggucccc

SEQ ID NO: 3359059 - RNA, 15 nt, Human
aguauguggaagugu

SEQ ID NO: 3359060 - RNA, 17 nt, Human
aguauguggaagugugg

SEQ ID NO: 3359061 - RNA, 19 nt, Human
aguauguggaagugugggu

SEQ ID NO: 3359062 - RNA, 16 nt, Human
aguauuugagaguucu

SEQ ID NO: 3359063 - RNA, 19 nt, Human
ugucaguauguggaagugu

SEQ ID NO: 3359064 - RNA, 20 nt, Human
ugucaguauguggaagugug

SEQ ID NO: 3359065 - RNA, 18 nt, Human
ugucaguauguggaagug

SEQ ID NO: 3359066 - RNA, 22 nt, Human
ugucaguauguggaaguguggg

SEQ ID NO: 3359067 - RNA, 11 nt, Human
uguauuaugug

SEQ ID NO: 3359068 - RNA, 23 nt, Human
agguugggagaaugucaguaugu

SEQ ID NO: 3359069 - RNA, 17 nt, Human
uguaauuuaaaauugug

SEQ ID NO: 3359070 - RNA, 18 nt, Human
uguaauuuaaaauuguga

SEQ ID NO: 3359071 - RNA, 20 nt, Human
uguaauuuaaaauugugaug

SEQ ID NO: 3359072 - RNA, 18 nt, Human
agguccccagcuuuggcu

SEQ ID NO: 3359073 - RNA, 11 nt, Human
agguccccaga

SEQ ID NO: 3359074 - RNA, 17 nt, Human
agguccccagcuuuggc

SEQ ID NO: 3359075 - RNA, 10 nt, Human
aggucccuaa

SEQ ID NO: 3359076 - RNA, 21 nt, Human
uguaauuuaaaauugugaugu

SEQ ID NO: 3359077 - RNA, 22 nt, Human
uguaauuuaaaauugugaugug

SEQ ID NO: 3359078 - RNA, 23 nt, Human
aguaaggaauuuuauuuuuuucu

SEQ ID NO: 3359079 - RNA, 19 nt, Human
aguagaacagauaaucagu

SEQ ID NO: 3359080 - RNA, 13 nt, Human
aguagaacagaua

SEQ ID NO: 3359081 - RNA, 19 nt, Human
aguacuuuuggcauuuuac

SEQ ID NO: 3359082 - RNA, 15 nt, Human
aguaauccaagcaaa

SEQ ID NO: 3359083 - RNA, 21 nt, Human
aguaauccaagcaaaugugaa

SEQ ID NO: 3359084 - RNA, 19 nt, Human
uguggcacuggggcagggg

SEQ ID NO: 3359085 - RNA, 13 nt, Human
uguggucuccacu

SEQ ID NO: 3359086 - RNA, 16 nt, Human
uguguguguguaugug

SEQ ID NO: 3359087 - RNA, 13 nt, Human
uguguguguguau

SEQ ID NO: 3359088 - RNA, 16 nt, Human
agugugggucugugug

SEQ ID NO: 3359089 - RNA, 17 nt, Human
agugugggucugugugu

SEQ ID NO: 3359090 - RNA, 15 nt, Human
agugugggucugugu

SEQ ID NO: 3359091 - RNA, 21 nt, Human
aguggacuguucccugaggug

SEQ ID NO: 3359092 - RNA, 19 nt, Human
agugugggucugugugugu

SEQ ID NO: 3359093 - RNA, 23 nt, Human
agugugggucuguguguguguau

SEQ ID NO: 3359094 - RNA, 19 nt, Human
aguguguguuuuucauaaa

SEQ ID NO: 3359095 - RNA, 14 nt, Human
uguuguguguggga

SEQ ID NO: 3359096 - RNA, 15 nt, Human
uguugugugugggag

SEQ ID NO: 3359097 - RNA, 16 nt, Human
uguugugugugggagu

SEQ ID NO: 3359098 - RNA, 20 nt, Human
uguugugauguauucuagcu

SEQ ID NO: 3359099 - RNA, 14 nt, Human
uguugugauguauu

SEQ ID NO: 3359100 - RNA, 13 nt, Human
uguugugaauguu

SEQ ID NO: 3359101 - RNA, 12 nt, Human
uguugugaaugu

SEQ ID NO: 3359102 - RNA, 13 nt, Human
uguuuaguaauca

SEQ ID NO: 3359103 - RNA, 17 nt, Human
uguuuaguaaucauauu

SEQ ID NO: 3359104 - RNA, 14 nt, Human
uguuuaguaaucau

SEQ ID NO: 3359105 - RNA, 17 nt, Human
aguuccuagccaccgcc

SEQ ID NO: 3359106 - RNA, 15 nt, Human
aguucuacauaagua

SEQ ID NO: 3359107 - RNA, 19 nt, Human
aguucggugagcuacaaau

SEQ ID NO: 3359108 - RNA, 22 nt, Human
auaacgauaaaagacagugaaa

SEQ ID NO: 3359109 - RNA, 14 nt, Human
auaacguauaaaag

SEQ ID NO: 3359110 - RNA, 13 nt, Human
auaacugugaagu

SEQ ID NO: 3359111 - RNA, 18 nt, Human
auaaauauuuuugccaua

SEQ ID NO: 3359112 - RNA, 13 nt, Human
auaaauaaaaaua

SEQ ID NO: 3359113 - RNA, 17 nt, Human
auaaagguucaugcaaa

SEQ ID NO: 3359114 - RNA, 15 nt, Human
auaaagguucaugca

SEQ ID NO: 3359115 - RNA, 20 nt, Human
uuaccuuugacaaagguaaa

SEQ ID NO: 3359116 - RNA, 13 nt, Human
uuaccuuugacaa

SEQ ID NO: 3359117 - RNA, 16 nt, Human
uuagccuuugucccag

SEQ ID NO: 3359118 - RNA, 18 nt, Human
auaauccuaaacauauga

SEQ ID NO: 3359119 - RNA, 19 nt, Human
auaauacuugcuuuggaaa

SEQ ID NO: 3359120 - RNA, 14 nt, Human
aguuuaaauuguaa

SEQ ID NO: 3359121 - RNA, 14 nt, Human
uuaaguauguguaa

SEQ ID NO: 3359122 - RNA, 18 nt, Human
auaaaagccuguuuaaga

SEQ ID NO: 3359123 - RNA, 13 nt, Human
auaaaagccuguu

SEQ ID NO: 3359124 - RNA, 22 nt, Human
acucgugucuggcacagccugg

SEQ ID NO: 3359125 - RNA, 23 nt, Human
acucgugucuggcacagccuggc

SEQ ID NO: 3359126 - RNA, 13 nt, Human
acucuugaaaaau

SEQ ID NO: 3359127 - RNA, 20 nt, Human
uccuagccacccaccacacu

SEQ ID NO: 3359128 - RNA, 21 nt, Human
uccuagccaccgccuccuaca

SEQ ID NO: 3359129 - RNA, 13 nt, Human
uccucuccugucu

SEQ ID NO: 3359130 - RNA, 19 nt, Human
acucuugaaaaaugcaugu

SEQ ID NO: 3359131 - RNA, 14 nt, Human
acucuugaaaaaug

SEQ ID NO: 3359132 - RNA, 16 nt, Human
uccucugcccgggagc

SEQ ID NO: 3359133 - RNA, 22 nt, Human
uccucugcccgggagcucagga

SEQ ID NO: 3359134 - RNA, 13 nt, Human
acugaaacuuccc

SEQ ID NO: 3359135 - RNA, 14 nt, Human
acucagaauauugc

SEQ ID NO: 3359136 - RNA, 14 nt, Human
acuccaccaagccu

SEQ ID NO: 3359137 - RNA, 21 nt, Human
acucaucuagguaaauuacag

SEQ ID NO: 3359138 - RNA, 23 nt, Human
acucaucuagguaaauuacaguu

SEQ ID NO: 3359139 - RNA, 22 nt, Human
acuaugacauaaaaacaacuuu

SEQ ID NO: 3359140 - RNA, 16 nt, Human
uccauccuacccccug

SEQ ID NO: 3359141 - RNA, 20 nt, Human
uccauccuacccccugugcc

SEQ ID NO: 3359142 - RNA, 20 nt, Human
uccaucucuuguuuaaauuc

SEQ ID NO: 3359143 - RNA, 22 nt, Human
acgaagaguauuuuugacagaa

SEQ ID NO: 3359144 - RNA, 20 nt, Human
acgaagaguauuuuugacag

SEQ ID NO: 3359145 - RNA, 16 nt, Human
ucauaauaaguugcau

SEQ ID NO: 3359146 - RNA, 19 nt, Human
uccaaaaagauuuucagaa

SEQ ID NO: 3359147 - RNA, 20 nt, Human
accuggcuuuucuuucuacc

SEQ ID NO: 3359148 - RNA, 15 nt, Human
accuuccaagagccu

SEQ ID NO: 3359149 - RNA, 16 nt, Human
accuuccaagagccug

SEQ ID NO: 3359150 - RNA, 21 nt, Human
acccagauaaagguucaugca

SEQ ID NO: 3359151 - RNA, 14 nt, Human
ucacucuuggagcc

SEQ ID NO: 3359152 - RNA, 16 nt, Human
ucacucuuggagccug

SEQ ID NO: 3359153 - RNA, 17 nt, Human
ucacucuuggagccugc

SEQ ID NO: 3359154 - RNA, 18 nt, Human
ucacucuuggagccugca

SEQ ID NO: 3359155 - RNA, 19 nt, Human
ucacuuaucccaagagaau

SEQ ID NO: 3359156 - RNA, 19 nt, Human
accccagcuggggccaggc

SEQ ID NO: 3359157 - RNA, 16 nt, Human
ucagaauagaaauuag

SEQ ID NO: 3359158 - RNA, 16 nt, Human
ucaguauguggaagug

SEQ ID NO: 3359159 - RNA, 19 nt, Human
ucaguuugcuagcagaaau

SEQ ID NO: 3359160 - RNA, 18 nt, Human
ucauaaauaaaguuuguu

SEQ ID NO: 3359161 - RNA, 24 nt, Human
ucauaaagcaggcagaacucaucu

SEQ ID NO: 3359162 - RNA, 18 nt, Human
accaaauaaaaauauugu

SEQ ID NO: 3359163 - RNA, 16 nt, Human
accaaauaaaaauauu

SEQ ID NO: 3359164 - RNA, 21 nt, Human
acauuguaaauaguauuugag

SEQ ID NO: 3359165 - RNA, 19 nt, Human
acauuguaaauaguauuug

SEQ ID NO: 3359166 - RNA, 17 nt, Human
acauuguaaauaguauu

SEQ ID NO: 3359167 - RNA, 14 nt, Human
uauguguaaaaugu

SEQ ID NO: 3359168 - RNA, 18 nt, Human
uaugugggggucugugug

SEQ ID NO: 3359169 - RNA, 19 nt, Human
uaugugggggucugugugu

SEQ ID NO: 3359170 - RNA, 20 nt, Human
uaugugggggucuguguguu

SEQ ID NO: 3359171 - RNA, 19 nt, Human
uaugugccagauuuaugca

SEQ ID NO: 3359172 - RNA, 14 nt, Human
uaugugccagauuu

SEQ ID NO: 3359173 - RNA, 21 nt, Human
uauuuuaaaagauaaauauua

SEQ ID NO: 3359174 - RNA, 22 nt, Human
uauuuuaagacgaaacauuugu

SEQ ID NO: 3359175 - RNA, 14 nt, Human
uauuuuaagacgaa

SEQ ID NO: 3359176 - RNA, 13 nt, Human
uauuuuuguagca

SEQ ID NO: 3359177 - RNA, 12 nt, Human
uauuuuucacau

SEQ ID NO: 3359178 - RNA, 13 nt, Human
uauuuuucacaua

SEQ ID NO: 3359179 - RNA, 15 nt, Human
uauuuuguucauaca

SEQ ID NO: 3359180 - RNA, 16 nt, Human
uauuuuguucauacau

SEQ ID NO: 3359181 - RNA, 20 nt, Human
uauuuuguguuuaggaacua

SEQ ID NO: 3359182 - RNA, 17 nt, Human
uauuuuguguuuaggaa

SEQ ID NO: 3359183 - RNA, 17 nt, Human
uauuuuaauaaacacuc

SEQ ID NO: 3359184 - RNA, 14 nt, Human
uauuuuaauaaaca

SEQ ID NO: 3359185 - RNA, 15 nt, Human
uauuuuuguagcacu

SEQ ID NO: 3359186 - RNA, 13 nt, Human
ucaaauauauuca

SEQ ID NO: 3359187 - RNA, 20 nt, Human
ucggggagccgggagccuga

SEQ ID NO: 3359188 - RNA, 21 nt, Human
ucuaagauaguaacaaugaag

SEQ ID NO: 3359189 - RNA, 16 nt, Human
acuggggcaggggccg

SEQ ID NO: 3359190 - RNA, 18 nt, Human
ucgcccuggacugugugc

SEQ ID NO: 3359191 - RNA, 18 nt, Human
acuguacagacagaaaaa

SEQ ID NO: 3359192 - RNA, 23 nt, Human
acuguacuugcucuugaugccug

SEQ ID NO: 3359193 - RNA, 15 nt, Human
acuguacuugcucuu

SEQ ID NO: 3359194 - RNA, 23 nt, Human
acuugucccgggacaccuaggcu

SEQ ID NO: 3359195 - RNA, 14 nt, Human
acuuguauuaugug

SEQ ID NO: 3359196 - RNA, 13 nt, Human
acuuguauuaugu

SEQ ID NO: 3359197 - RNA, 18 nt, Human
acuugaaaauuaacauga

SEQ ID NO: 3359198 - RNA, 16 nt, Human
acuugaaaauuaacau

SEQ ID NO: 3359199 - RNA, 17 nt, Human
acuugaaaauuaacaug

SEQ ID NO: 3359200 - RNA, 22 nt, Human
acuucccuuucugcuuguguua

SEQ ID NO: 3359201 - RNA, 14 nt, Human
acuucccuuucugc

SEQ ID NO: 3359202 - RNA, 15 nt, Human
ucuaccucuuggcug

SEQ ID NO: 3359203 - RNA, 13 nt, Human
ucuauaauuuaaa

SEQ ID NO: 3359204 - RNA, 17 nt, Human
acuucccagugaauucu

SEQ ID NO: 3359205 - RNA, 17 nt, Human
ucuagcauggcauauuu

SEQ ID NO: 3359206 - RNA, 22 nt, Human
ucuggcacagccuggcuguggc

SEQ ID NO: 3359207 - RNA, 16 nt, Human
agaaggaucuucaucu

SEQ ID NO: 3359208 - RNA, 13 nt, Human
agaauaaacuggc

SEQ ID NO: 3359209 - RNA, 23 nt, Human
ucugcaggucccuaauaaagcug

SEQ ID NO: 3359210 - RNA, 22 nt, Human
ucugcaggucccuaauaaagcu

SEQ ID NO: 3359211 - RNA, 19 nt, Human
ucugcaggucccuaauaaa

SEQ ID NO: 3359212 - RNA, 21 nt, Human
ucugcaggucccuaauaaagc

SEQ ID NO: 3359213 - RNA, 14 nt, Human
agaaaucuagaaga

SEQ ID NO: 3359214 - RNA, 12 nt, Human
agaaaugaaaaa

SEQ ID NO: 3359215 - RNA, 13 nt, Human
agaaaugaaaaaa

SEQ ID NO: 3359216 - RNA, 15 nt, Human
agaaaucuaaaaaac

SEQ ID NO: 3359217 - RNA, 18 nt, Human
ucucugcaggucccuaau

SEQ ID NO: 3359218 - RNA, 20 nt, Human
agaaaacaaaaaaaccucua

SEQ ID NO: 3359219 - RNA, 22 nt, Human
ucucugcaggucccuaauaaag

SEQ ID NO: 3359220 - RNA, 21 nt, Human
ucucugcaggucccuaauaaa

SEQ ID NO: 3359221 - RNA, 20 nt, Human
ucucugcaggucccuaauaa

SEQ ID NO: 3359222 - RNA, 19 nt, Human
ucucugcaggucccuaaua

SEQ ID NO: 3359223 - RNA, 19 nt, Human
acuuuguauaaaagggacu

SEQ ID NO: 3359224 - RNA, 22 nt, Human
ucuuggggaguuuagggugggg

SEQ ID NO: 3359225 - RNA, 23 nt, Human
ucuuggggaguuuaggguggggg

SEQ ID NO: 3359226 - RNA, 15 nt, Human
ucuuuaacucauaaa

SEQ ID NO: 3359227 - RNA, 21 nt, Human
ucuugaugccuggcggggugg

SEQ ID NO: 3359228 - RNA, 19 nt, Human
agacauucuuccaaaaaga

SEQ ID NO: 3359229 - RNA, 13 nt, Human
agacccccuggag

SEQ ID NO: 3359230 - RNA, 14 nt, Human
agacccccuggaga

SEQ ID NO: 3359231 - RNA, 15 nt, Human
agacccccuggagac

SEQ ID NO: 3359232 - RNA, 19 nt, Human
agacccccuggagacuaac

SEQ ID NO: 3359233 - RNA, 17 nt, Human
agagacgggcccuggug

SEQ ID NO: 3359234 - RNA, 20 nt, Human
agagcaaaauugauguguuu

SEQ ID NO: 3359235 - RNA, 14 nt, Human
agagagaaaauaaa

SEQ ID NO: 3359236 - RNA, 20 nt, Human
ugaaaagcuccauuuuuagu

SEQ ID NO: 3359237 - RNA, 13 nt, Human
ugaaaauauuuaa

SEQ ID NO: 3359238 - RNA, 14 nt, Human
ugaaaauauuuaaa

SEQ ID NO: 3359239 - RNA, 11 nt, Human
ugaaaauauuu

SEQ ID NO: 3359240 - RNA, 12 nt, Human
ugaaaauauuua

SEQ ID NO: 3359241 - RNA, 12 nt, Human
ugaaacuuggau

SEQ ID NO: 3359242 - RNA, 22 nt, Human
ugaaaaagaccuuuggagcaaa

SEQ ID NO: 3359243 - RNA, 23 nt, Human
ugaaaaaauauauaucaaauaua

SEQ ID NO: 3359244 - RNA, 15 nt, Human
agauggaaugcugug

SEQ ID NO: 3359245 - RNA, 13 nt, Human
agauggaaugcug

SEQ ID NO: 3359246 - RNA, 18 nt, Human
agauggaaugcuguguua

SEQ ID NO: 3359247 - RNA, 18 nt, Human
ugaccuuccaagagccug

SEQ ID NO: 3359248 - RNA, 19 nt, Human
ugaccuuccaagagccuga

SEQ ID NO: 3359249 - RNA, 20 nt, Human
ugaccuuccaagagccugag

SEQ ID NO: 3359250 - RNA, 22 nt, Human
agagggacuguucuuuuguccc

SEQ ID NO: 3359251 - RNA, 14 nt, Human
ugaaaguacauuug

SEQ ID NO: 3359252 - RNA, 23 nt, Human
ugaaaguacauuuggagacacaa

SEQ ID NO: 3359253 - RNA, 22 nt, Human
agaggugugcaagagagggaug

SEQ ID NO: 3359254 - RNA, 23 nt, Human
agaggugugcaagagagggaugc

SEQ ID NO: 3359255 - RNA, 14 nt, Human
agaguauuuuugac

SEQ ID NO: 3359256 - RNA, 20 nt, Human
ugaagcuaucguaaaauuaa

SEQ ID NO: 3359257 - RNA, 15 nt, Human
ugaauacuuuauaaa

SEQ ID NO: 3359258 - RNA, 17 nt, Human
agaguauuuuugacaga

SEQ ID NO: 3359259 - RNA, 18 nt, Human
agaguauuuuugacagaa

SEQ ID NO: 3359260 - RNA, 14 nt, Human
ugaauguaugcuuc

SEQ ID NO: 3359261 - RNA, 19 nt, Human
ugaauguaugcuucauaca

SEQ ID NO: 3359262 - RNA, 20 nt, Human
ugaauguaugcuucauacag

SEQ ID NO: 3359263 - RNA, 23 nt, Human
ugaauguaugcuucauacaggga

SEQ ID NO: 3359264 - RNA, 20 nt, Human
agaguauuuuugacagaaua

SEQ ID NO: 3359265 - RNA, 15 nt, Human
agaguauuuuugaca

SEQ ID NO: 3359266 - RNA, 21 nt, Human
ugaauuugugaagguggaaau

SEQ ID NO: 3359267 - RNA, 13 nt, Human
ugaauuugugaag

SEQ ID NO: 3359268 - RNA, 23 nt, Human
ugaauuugugaagguggaaauaa

SEQ ID NO: 3359269 - RNA, 19 nt, Human
gucucccuccucugcccgg

SEQ ID NO: 3359270 - RNA, 20 nt, Human
aaccacauuggagauguuua

SEQ ID NO: 3359271 - RNA, 14 nt, Human
aaccaccagaagcc

SEQ ID NO: 3359272 - RNA, 17 nt, Human
aaccaccagaagcccag

SEQ ID NO: 3359273 - RNA, 22 nt, Human
aacccaagguggguagaucacg

SEQ ID NO: 3359274 - RNA, 14 nt, Human
aacccagauaaagg

SEQ ID NO: 3359275 - RNA, 17 nt, Human
aaccccccauuucuucc

SEQ ID NO: 3359276 - RNA, 20 nt, Human
aaccccuggcuccaggccag

SEQ ID NO: 3359277 - RNA, 17 nt, Human
gucuggcacagccuggc

SEQ ID NO: 3359278 - RNA, 19 nt, Human
gucuggcacagccuggcug

SEQ ID NO: 3359279 - RNA, 16 nt, Human
gucuuucacauuuaaa

SEQ ID NO: 3359280 - RNA, 22 nt, Human
aacucaucuagguaaauuacag

SEQ ID NO: 3359281 - RNA, 18 nt, Human
aacuucccagugaauucu

SEQ ID NO: 3359282 - RNA, 12 nt, Human
gugcaagagagg

SEQ ID NO: 3359283 - RNA, 18 nt, Human
guauaaaagggacugaga

SEQ ID NO: 3359284 - RNA, 21 nt, Human
guaugcuucauacagggaugg

SEQ ID NO: 3359285 - RNA, 12 nt, Human
guaugcuucaua

SEQ ID NO: 3359286 - RNA, 13 nt, Human
guaugcuucauac

SEQ ID NO: 3359287 - RNA, 14 nt, Human
guaugcuucauaca

SEQ ID NO: 3359288 - RNA, 15 nt, Human
guaugcuucauacag

SEQ ID NO: 3359289 - RNA, 19 nt, Human
guauaaaagggacugagaa

SEQ ID NO: 3359290 - RNA, 12 nt, Human
guauuuuugaca

SEQ ID NO: 3359291 - RNA, 15 nt, Human
guauuuuugacagaa

SEQ ID NO: 3359292 - RNA, 17 nt, Human
gucaacacuaacaugau

SEQ ID NO: 3359293 - RNA, 15 nt, Human
aaauugugauguguc

SEQ ID NO: 3359294 - RNA, 12 nt, Human
aaauugugaugu

SEQ ID NO: 3359295 - RNA, 12 nt, Human
aaauuuauguga

SEQ ID NO: 3359296 - RNA, 15 nt, Human
aaauuuaugugaugg

SEQ ID NO: 3359297 - RNA, 20 nt, Human
aaauuguaagcaugcacaaa

SEQ ID NO: 3359298 - RNA, 18 nt, Human
aaauucugucucuggauu

SEQ ID NO: 3359299 - RNA, 19 nt, Human
aaauuguaagcaugcacaa

SEQ ID NO: 3359300 - RNA, 16 nt, Human
aaauucugucucugga

SEQ ID NO: 3359301 - RNA, 14 nt, Human
aaauuaagaaagga

SEQ ID NO: 3359302 - RNA, 13 nt, Human
aacagauaaucag

SEQ ID NO: 3359303 - RNA, 13 nt, Human
gucaguuguauca

SEQ ID NO: 3359304 - RNA, 21 nt, Human
gucaguauguggaaguguggg

SEQ ID NO: 3359305 - RNA, 17 nt, Human
gucaguauguggaagug

SEQ ID NO: 3359306 - RNA, 13 nt, Human
gucagaauagaaa

SEQ ID NO: 3359307 - RNA, 17 nt, Human
gucagaauagaaauuag

SEQ ID NO: 3359308 - RNA, 19 nt, Human
aacaagaugguucuagcau

SEQ ID NO: 3359309 - RNA, 12 nt, Human
aacaauaaaaga

SEQ ID NO: 3359310 - RNA, 14 nt, Human
aaggcucuuuugua

SEQ ID NO: 3359311 - RNA, 16 nt, Human
aagggugaaaauuauu

SEQ ID NO: 3359312 - RNA, 15 nt, Human
aagggugaaaauuau

SEQ ID NO: 3359313 - RNA, 16 nt, Human
aaguaaggaauuuuau

SEQ ID NO: 3359314 - RNA, 12 nt, Human
guuucaaacuuu

SEQ ID NO: 3359315 - RNA, 13 nt, Human
guuuacaguguuc

SEQ ID NO: 3359316 - RNA, 15 nt, Human
guuuacaguguuccg

SEQ ID NO: 3359317 - RNA, 13 nt, Human
aaggauaaugaau

SEQ ID NO: 3359318 - RNA, 22 nt, Human
aaggcccuaucuguuuacagug

SEQ ID NO: 3359319 - RNA, 22 nt, Human
aaggaaccaaagcgaauuuuaa

SEQ ID NO: 3359320 - RNA, 23 nt, Human
aaggaaccaaagcgaauuuuaaa

SEQ ID NO: 3359321 - RNA, 20 nt, Human
uaaaagacagugaaagaaaa

SEQ ID NO: 3359322 - RNA, 22 nt, Human
uaaaaauauuguguugugaaug

SEQ ID NO: 3359323 - RNA, 21 nt, Human
uaaaaauaaaaaacacuggga

SEQ ID NO: 3359324 - RNA, 19 nt, Human
uaaaaauaaaaaacacugg

SEQ ID NO: 3359325 - RNA, 18 nt, Human
uaaaaauaaaaaacacug

SEQ ID NO: 3359326 - RNA, 12 nt, Human
uaaaagaauugu

SEQ ID NO: 3359327 - RNA, 15 nt, Human
guuuuucauaaagca

SEQ ID NO: 3359328 - RNA, 16 nt, Human
aagucuuucacauuua

SEQ ID NO: 3359329 - RNA, 22 nt, Human
aagucuuauauauuguagauaa

SEQ ID NO: 3359330 - RNA, 21 nt, Human
guggccuaaccugccgagagu

SEQ ID NO: 3359331 - RNA, 22 nt, Human
guggccuaaccugccgagaguc

SEQ ID NO: 3359332 - RNA, 21 nt, Human
aagaccuuuggagcaaagcug

SEQ ID NO: 3359333 - RNA, 23 nt, Human
aagaccuugcuuaugauugcaga

SEQ ID NO: 3359334 - RNA, 19 nt, Human
gugggguagguugggagaa

SEQ ID NO: 3359335 - RNA, 14 nt, Human
aagaggcugcagcc

SEQ ID NO: 3359336 - RNA, 18 nt, Human
aagaucucagugguuaag

SEQ ID NO: 3359337 - RNA, 12 nt, Human
guguguaugugg

SEQ ID NO: 3359338 - RNA, 14 nt, Human
gugugggucugugu

SEQ ID NO: 3359339 - RNA, 20 nt, Human
gugugucacccuuaggccag

SEQ ID NO: 3359340 - RNA, 13 nt, Human
guguguauguggg

SEQ ID NO: 3359341 - RNA, 15 nt, Human
guguguauguggggg

SEQ ID NO: 3359342 - RNA, 18 nt, Human
aagccaagaggcugcagc

SEQ ID NO: 3359343 - RNA, 22 nt, Human
aagccaagaggcugcagccagg

SEQ ID NO: 3359344 - RNA, 18 nt, Human
aagcccaguucagcuugg

SEQ ID NO: 3359345 - RNA, 19 nt, Human
aagcccaguucagcuuggg

SEQ ID NO: 3359346 - RNA, 22 nt, Human
aagccugcaauuucauaugcug

SEQ ID NO: 3359347 - RNA, 17 nt, Human
aagccugcaauuucaua

SEQ ID NO: 3359348 - RNA, 20 nt, Human
guuauuauauuuacaaaugg

SEQ ID NO: 3359349 - RNA, 14 nt, Human
guuaagauuccuaa

SEQ ID NO: 3359350 - RNA, 15 nt, Human
uacccccugugccuu

SEQ ID NO: 3359351 - RNA, 13 nt, Human
uaccucuuggcug

SEQ ID NO: 3359352 - RNA, 23 nt, Human
uaccugaagcuaucguaaaauua

SEQ ID NO: 3359353 - RNA, 21 nt, Human
aauucagaaggaucuucaucu

SEQ ID NO: 3359354 - RNA, 15 nt, Human
aauucagaaggaucu

SEQ ID NO: 3359355 - RNA, 12 nt, Human
aauuauuuuaaa

SEQ ID NO: 3359356 - RNA, 20 nt, Human
aauucaagaaaacaacuuca

SEQ ID NO: 3359357 - RNA, 12 nt, Human
aauucaagaaaa

SEQ ID NO: 3359358 - RNA, 15 nt, Human
aauuauuuuaaaaga

SEQ ID NO: 3359359 - RNA, 22 nt, Human
aauuaugugccagauuuaugca

SEQ ID NO: 3359360 - RNA, 19 nt, Human
uaccagagaaaaagggagg

SEQ ID NO: 3359361 - RNA, 13 nt, Human
uacauuuccuaaa

SEQ ID NO: 3359362 - RNA, 17 nt, Human
uacagggaugguguuca

SEQ ID NO: 3359363 - RNA, 13 nt, Human
uacagaauuuuau

SEQ ID NO: 3359364 - RNA, 19 nt, Human
uaauuuaaaauugugaugu

SEQ ID NO: 3359365 - RNA, 20 nt, Human
uaauuuaaaauugugaugug

SEQ ID NO: 3359366 - RNA, 16 nt, Human
uaauuuaaaauuguga

SEQ ID NO: 3359367 - RNA, 22 nt, Human
uaauuccguagguuauuuucag

SEQ ID NO: 3359368 - RNA, 22 nt, Human
aaugagaaaucuaaaaaacgaa

SEQ ID NO: 3359369 - RNA, 12 nt, Human
aaugagaaaucu

SEQ ID NO: 3359370 - RNA, 17 nt, Human
uaacguauaaaagccug

SEQ ID NO: 3359371 - RNA, 13 nt, Human
uaacguauaaaag

SEQ ID NO: 3359372 - RNA, 20 nt, Human
uaacgauaaaagacagugaa

SEQ ID NO: 3359373 - RNA, 14 nt, Human
uaacaugaauauuu

SEQ ID NO: 3359374 - RNA, 21 nt, Human
uaacaugaauauuuaguguuc

SEQ ID NO: 3359375 - RNA, 20 nt, Human
uaacaugaauauuuaguguu

SEQ ID NO: 3359376 - RNA, 19 nt, Human
uaacaugaauauuuagugu

SEQ ID NO: 3359377 - RNA, 18 nt, Human
aauauauuuuaagacgaa

SEQ ID NO: 3359378 - RNA, 14 nt, Human
aauauauuuaauga

SEQ ID NO: 3359379 - RNA, 21 nt, Human
aauauauuuuaagacgaaaca

SEQ ID NO: 3359380 - RNA, 21 nt, Human
aauauauucagccuggcuuca

SEQ ID NO: 3359381 - RNA, 20 nt, Human
aauagagcaaaauugaugug

SEQ ID NO: 3359382 - RNA, 22 nt, Human
aauagagcaaaauugauguguu

SEQ ID NO: 3359383 - RNA, 17 nt, Human
uaacaaugaagauaaaa

SEQ ID NO: 3359384 - RNA, 22 nt, Human
uaagcagauggaaugcuguguu

SEQ ID NO: 3359385 - RNA, 22 nt, Human
uaaggaauuuuauuuuuuucug

SEQ ID NO: 3359386 - RNA, 17 nt, Human
uaaguguguguuuuuca

SEQ ID NO: 3359387 - RNA, 16 nt, Human
uaaguaauucaagaaa

SEQ ID NO: 3359388 - RNA, 22 nt, Human
aaucagugugucuaaauuugaa

SEQ ID NO: 3359389 - RNA, 18 nt, Human
aaucagugugucuaaauu

SEQ ID NO: 3359390 - RNA, 17 nt, Human
aaucagugugucuaaau

SEQ ID NO: 3359391 - RNA, 14 nt, Human
aaucagugugucua

SEQ ID NO: 3359392 - RNA, 20 nt, Human
aauccucaguuuuugugaaa

SEQ ID NO: 3359393 - RNA, 15 nt, Human
aaucuaugauuccag

SEQ ID NO: 3359394 - RNA, 18 nt, Human
aaucuaugauuccaggug

SEQ ID NO: 3359395 - RNA, 20 nt, Human
uaugccaccugaauaaagaa

SEQ ID NO: 3359396 - RNA, 17 nt, Human
uaugauacuugaaaauu

SEQ ID NO: 3359397 - RNA, 21 nt, Human
uaugguaggaacugcugggcu

SEQ ID NO: 3359398 - RNA, 18 nt, Human
acagcggcuggacuugga

SEQ ID NO: 3359399 - RNA, 23 nt, Human
uaugaagcuuuuaugugaaacau

SEQ ID NO: 3359400 - RNA, 22 nt, Human
uaugaagcuuuuaugugaaaca

SEQ ID NO: 3359401 - RNA, 20 nt, Human
uaugaagcuuuuaugugaaa

SEQ ID NO: 3359402 - RNA, 16 nt, Human
acacucaguuguucaa

SEQ ID NO: 3359403 - RNA, 20 nt, Human
uauauccuuucuaacaaaaa

SEQ ID NO: 3359404 - RNA, 17 nt, Human
uauauccuuucuaacaa

SEQ ID NO: 3359405 - RNA, 11 nt, Human
uauauauuucc

SEQ ID NO: 3359406 - RNA, 15 nt, Human
uauacaggucauauu

SEQ ID NO: 3359407 - RNA, 16 nt, Human
uauacaggucauauua

SEQ ID NO: 3359408 - RNA, 19 nt, Human
uauaagugauugcugguuu

SEQ ID NO: 3359409 - RNA, 14 nt, Human
uaucagcacgugug

SEQ ID NO: 3359410 - RNA, 18 nt, Human
uaucaaagggugaaaauu

SEQ ID NO: 3359411 - RNA, 19 nt, Human
uaucaaagggugaaaauua

SEQ ID NO: 3359412 - RNA, 22 nt, Human
uaucaaagggugaaaauuauuu

SEQ ID NO: 3359413 - RNA, 12 nt, Human
uaguaaucauau

SEQ ID NO: 3359414 - RNA, 21 nt, Human
uagacauuugcuaugagcugg

SEQ ID NO: 3359415 - RNA, 16 nt, Human
aauuuggauugcuaau

SEQ ID NO: 3359416 - RNA, 14 nt, Human
uagaagaagugugu

SEQ ID NO: 3359417 - RNA, 16 nt, Human
aauuccacacccucac

SEQ ID NO: 3359418 - RNA, 17 nt, Human
aauuccaauuauaugag

SEQ ID NO: 3359419 - RNA, 12 nt, Human
aauuuuacauuu

SEQ ID NO: 3359420 - RNA, 18 nt, Human
acaaaaggauaaugaaua

SEQ ID NO: 3359421 - RNA, 19 nt, Human
acaaaaauucucaguucuc

SEQ ID NO: 3359422 - RNA, 24 nt, Human
uagaggggaaaagagaugaugaaa

SEQ ID NO: 3359423 - RNA, 14 nt, Human
uagcacugacagau

SEQ ID NO: 3359424 - RNA, 19 nt, Human
uagcacugacagauuucca

SEQ ID NO: 3359425 - RNA, 18 nt, Human
uagccacccaccacacug

SEQ ID NO: 3359426 - RNA, 18 nt, Human
uagccaccgccuccuaca

SEQ ID NO: 3359427 - RNA, 19 nt, Human
uagccaccgccuccuacag

SEQ ID NO: 3359428 - RNA, 23 nt, Human
caaauauauucagccuggcuuca

SEQ ID NO: 3359429 - RNA, 19 nt, Human
caaagagagaaaauaaaga

SEQ ID NO: 3359430 - RNA, 16 nt, Human
caaagagagaaaauaa

SEQ ID NO: 3359431 - RNA, 15 nt, Human
caaagaaauuaugug

SEQ ID NO: 3359432 - RNA, 15 nt, Human
caaauaaaaauauug

SEQ ID NO: 3359433 - RNA, 18 nt, Human
caaauaaaaauauugugu

SEQ ID NO: 3359434 - RNA, 16 nt, Human
caaauaaaaauauugu

SEQ ID NO: 3359435 - RNA, 22 nt, Human
caaaauaauuuuaagaaaucaa

SEQ ID NO: 3359436 - RNA, 18 nt, Human
caaaauaauuuuaagaaa

SEQ ID NO: 3359437 - RNA, 17 nt, Human
caagccuuggcucuacc

SEQ ID NO: 3359438 - RNA, 12 nt, Human
caagccugguca

SEQ ID NO: 3359439 - RNA, 15 nt, Human
caagccuggucagcc

SEQ ID NO: 3359440 - RNA, 16 nt, Human
caagccuggucagccc

SEQ ID NO: 3359441 - RNA, 17 nt, Human
caagccuggucagccca

SEQ ID NO: 3359442 - RNA, 18 nt, Human
caagccuggucagcccaa

SEQ ID NO: 3359443 - RNA, 18 nt, Human
caaggaaaaaauaacaau

SEQ ID NO: 3359444 - RNA, 19 nt, Human
caauaauaaauauuuuugc

SEQ ID NO: 3359445 - RNA, 13 nt, Human
cacaggaaaccag

SEQ ID NO: 3359446 - RNA, 19 nt, Human
ugacucuuuccaaccggcu

SEQ ID NO: 3359447 - RNA, 13 nt, Human
ugacucuuuccaa

SEQ ID NO: 3359448 - RNA, 14 nt, Human
ugacucuuuccaac

SEQ ID NO: 3359449 - RNA, 16 nt, Human
ugacucuuuccaaccg

SEQ ID NO: 3359450 - RNA, 19 nt, Human
ugaggaucagaguaaucca

SEQ ID NO: 3359451 - RNA, 17 nt, Human
ugaggaucagaguaauc

SEQ ID NO: 3359452 - RNA, 13 nt, Human
ugaggaucagagu

SEQ ID NO: 3359453 - RNA, 23 nt, Human
ugacagaauauguuucaaacuuu

SEQ ID NO: 3359454 - RNA, 18 nt, Human
ugacagaauauguuucaa

SEQ ID NO: 3359455 - RNA, 21 nt, Human
ugacagaauauguuucaaacu

SEQ ID NO: 3359456 - RNA, 22 nt, Human
ugacagaauauguuucaaacuu

SEQ ID NO: 3359457 - RNA, 20 nt, Human
ugacaaagguaaaucagacu

SEQ ID NO: 3359458 - RNA, 13 nt, Human
ugaaucucauaau

SEQ ID NO: 3359459 - RNA, 20 nt, Human
ugaaucucauaauuuauaca

SEQ ID NO: 3359460 - RNA, 14 nt, Human
ugaaguuuacauug

SEQ ID NO: 3359461 - RNA, 20 nt, Human
ugaaguuuacauuguaaaua

SEQ ID NO: 3359462 - RNA, 16 nt, Human
ugaaguuuacauugua

SEQ ID NO: 3359463 - RNA, 15 nt, Human
ugaaggaaaaugaua

SEQ ID NO: 3359464 - RNA, 16 nt, Human
ugaagcuuuuauguga

SEQ ID NO: 3359465 - RNA, 21 nt, Human
ugaagcuuuuaugugaaacau

SEQ ID NO: 3359466 - RNA, 20 nt, Human
ugaagagaagggcagggcug

SEQ ID NO: 3359467 - RNA, 22 nt, Human
ugaagagaagggcagggcugag

SEQ ID NO: 3359468 - RNA, 13 nt, Human
ugaaacauguuuc

SEQ ID NO: 3359469 - RNA, 16 nt, Human
ugaaacacuuugcaua

SEQ ID NO: 3359470 - RNA, 19 nt, Human
ucuuuccaaccggcuuugu

SEQ ID NO: 3359471 - RNA, 22 nt, Human
ugaaaauuauuuuguucauaca

SEQ ID NO: 3359472 - RNA, 23 nt, Human
ugaaaauuauuuuguucauacau

SEQ ID NO: 3359473 - RNA, 23 nt, Human
ugaaacacucaguuguucaauaa

SEQ ID NO: 3359474 - RNA, 15 nt, Human
ugaaacacuuugcau

SEQ ID NO: 3359475 - RNA, 14 nt, Human
ugaaaauuaacaug

SEQ ID NO: 3359476 - RNA, 19 nt, Human
ugaaaauuauuuuguucau

SEQ ID NO: 3359477 - RNA, 18 nt, Human
ugaaaaccacauuggaga

SEQ ID NO: 3359478 - RNA, 17 nt, Human
ucuugaacugagcuugg

SEQ ID NO: 3359479 - RNA, 15 nt, Human
ucuugaacugagcuu

SEQ ID NO: 3359480 - RNA, 18 nt, Human
ucuugaacugagcuugga

SEQ ID NO: 3359481 - RNA, 18 nt, Human
ucuuguagcuuuaucaaa

SEQ ID NO: 3359482 - RNA, 19 nt, Human
ucuugccaaauauaaauaa

SEQ ID NO: 3359483 - RNA, 22 nt, Human
ucuucauuaccucagugagaag

SEQ ID NO: 3359484 - RNA, 11 nt, Human
ucugugugugu

SEQ ID NO: 3359485 - RNA, 13 nt, Human
ucuuauaauuuaa

SEQ ID NO: 3359486 - RNA, 14 nt, Human
ucuuauaauuuaaa

SEQ ID NO: 3359487 - RNA, 18 nt, Human
ucuggugaccuuccaaga

SEQ ID NO: 3359488 - RNA, 23 nt, Human
ucuggugaccuuccaagagccug

SEQ ID NO: 3359489 - RNA, 16 nt, Human
ucuggugaccuuccaa

SEQ ID NO: 3359490 - RNA, 15 nt, Human
ucuggcugcagagca

SEQ ID NO: 3359491 - RNA, 14 nt, Human
ucuggcugcagagc

SEQ ID NO: 3359492 - RNA, 22 nt, Human
ucuggagcccacuguacuugcu

SEQ ID NO: 3359493 - RNA, 16 nt, Human
ucuggagcccacugua

SEQ ID NO: 3359494 - RNA, 12 nt, Human
ucuggagcccac

SEQ ID NO: 3359495 - RNA, 14 nt, Human
ucuggaauuugaaa

SEQ ID NO: 3359496 - RNA, 12 nt, Human
ucugagagcugu

SEQ ID NO: 3359497 - RNA, 14 nt, Human
ucccaacacugcca

SEQ ID NO: 3359498 - RNA, 15 nt, Human
ucccaacacugccag

SEQ ID NO: 3359499 - RNA, 16 nt, Human
ucccaacacugccagc

SEQ ID NO: 3359500 - RNA, 17 nt, Human
uccaagcaaaugugaau

SEQ ID NO: 3359501 - RNA, 15 nt, Human
uccaagcaaauguga

SEQ ID NO: 3359502 - RNA, 14 nt, Human
uccaagagccugag

SEQ ID NO: 3359503 - RNA, 13 nt, Human
uccaagagccuga

SEQ ID NO: 3359504 - RNA, 22 nt, Human
uccaagcccaguucagcuuggg

SEQ ID NO: 3359505 - RNA, 17 nt, Human
uccacuuuaucuugaau

SEQ ID NO: 3359506 - RNA, 15 nt, Human
uccacuuuaucuuga

SEQ ID NO: 3359507 - RNA, 12 nt, Human
ucaucuuucuuc

SEQ ID NO: 3359508 - RNA, 14 nt, Human
ucaucuuucuucca

SEQ ID NO: 3359509 - RNA, 17 nt, Human
ucaucuuucuuccaaac

SEQ ID NO: 3359510 - RNA, 24 nt, Human
ucauggacuucugccagcauaaua

SEQ ID NO: 3359511 - RNA, 17 nt, Human
ucaguucucuucacuca

SEQ ID NO: 3359512 - RNA, 14 nt, Human
ucaguucucuucac

SEQ ID NO: 3359513 - RNA, 19 nt, Human
ucagugugucuaaauuuga

SEQ ID NO: 3359514 - RNA, 23 nt, Human
ucagccuccauccuacccccugu

SEQ ID NO: 3359515 - RNA, 22 nt, Human
ucaggagaguagaacagauaau

SEQ ID NO: 3359516 - RNA, 20 nt, Human
ucagaucauuaucagccugu

SEQ ID NO: 3359517 - RNA, 23 nt, Human
ucccaugagcuccuuaaggcucu

SEQ ID NO: 3359518 - RNA, 18 nt, Human
ucccucuacugggagccu

SEQ ID NO: 3359519 - RNA, 22 nt, Human
ucccucuacugggagccuaccc

SEQ ID NO: 3359520 - RNA, 17 nt, Human
ucccucuacugggagcc

SEQ ID NO: 3359521 - RNA, 23 nt, Human
ucccucuacugggagccuaccca

SEQ ID NO: 3359522 - RNA, 16 nt, Human
uccucgagaucccaac

SEQ ID NO: 3359523 - RNA, 23 nt, Human
uccucgagaucccaacacugcca

SEQ ID NO: 3359524 - RNA, 15 nt, Human
ucuagguaaauuaca

SEQ ID NO: 3359525 - RNA, 19 nt, Human
ucuacuccuuguaaagacu

SEQ ID NO: 3359526 - RNA, 16 nt, Human
ucucauaauuuauaca

SEQ ID NO: 3359527 - RNA, 22 nt, Human
ucucauaauuuauacaggucau

SEQ ID NO: 3359528 - RNA, 19 nt, Human
uccugucccucauccauag

SEQ ID NO: 3359529 - RNA, 18 nt, Human
uggaacucgugucuggca

SEQ ID NO: 3359530 - RNA, 22 nt, Human
uggaauaauccuaaacauauga

SEQ ID NO: 3359531 - RNA, 20 nt, Human
uggaaugaugggucaguugu

SEQ ID NO: 3359532 - RNA, 16 nt, Human
uggaaugcuguguuaa

SEQ ID NO: 3359533 - RNA, 14 nt, Human
uggaaagaguacuc

SEQ ID NO: 3359534 - RNA, 21 nt, Human
ugggacaccccgacuuuuguu

SEQ ID NO: 3359535 - RNA, 14 nt, Human
ugggagauguggaa

SEQ ID NO: 3359536 - RNA, 21 nt, Human
ugggagugaggaugucugggc

SEQ ID NO: 3359537 - RNA, 14 nt, Human
ugggaguacaaaag

SEQ ID NO: 3359538 - RNA, 18 nt, Human
ugggggucuguguguuua

SEQ ID NO: 3359539 - RNA, 15 nt, Human
ugggggucugugugu

SEQ ID NO: 3359540 - RNA, 11 nt, Human
ugggggaugua

SEQ ID NO: 3359541 - RNA, 20 nt, Human
uggggauugggccccugcca

SEQ ID NO: 3359542 - RNA, 20 nt, Human
uggguggggggcuucauaca

SEQ ID NO: 3359543 - RNA, 21 nt, Human
uggguggggggcuucauacac

SEQ ID NO: 3359544 - RNA, 18 nt, Human
uggguggggggcuucaua

SEQ ID NO: 3359545 - RNA, 16 nt, Human
ugcaccggggccuggg

SEQ ID NO: 3359546 - RNA, 22 nt, Human
ugcaccggggccugggcaggag

SEQ ID NO: 3359547 - RNA, 12 nt, Human
ugcaccggggcc

SEQ ID NO: 3359548 - RNA, 11 nt, Human
ugcagagcugc

SEQ ID NO: 3359549 - RNA, 22 nt, Human
ugcagagcagugggccuggcca

SEQ ID NO: 3359550 - RNA, 18 nt, Human
ugccaggauggaaugaug

SEQ ID NO: 3359551 - RNA, 19 nt, Human
ugccaaauauaaauaaaaa

SEQ ID NO: 3359552 - RNA, 22 nt, Human
ugccaaauauaaauaaaaauaa

SEQ ID NO: 3359553 - RNA, 17 nt, Human
ugccaaauauaaauaaa

SEQ ID NO: 3359554 - RNA, 18 nt, Human
ugccaaauauaaauaaaa

SEQ ID NO: 3359555 - RNA, 20 nt, Human
ugcauauuuauaaaaauaaa

SEQ ID NO: 3359556 - RNA, 21 nt, Human
ugcauauuuauaaaaauaaaa

SEQ ID NO: 3359557 - RNA, 17 nt, Human
ugcccacccuccacucu

SEQ ID NO: 3359558 - RNA, 17 nt, Human
ugccugguccucacacu

SEQ ID NO: 3359559 - RNA, 15 nt, Human
ugccuggcggggugg

SEQ ID NO: 3359560 - RNA, 17 nt, Human
ugcucagagcaguguuu

SEQ ID NO: 3359561 - RNA, 17 nt, Human
ugcucuccaagcccagu

SEQ ID NO: 3359562 - RNA, 21 nt, Human
uguccucagccccgcguggaa

SEQ ID NO: 3359563 - RNA, 22 nt, Human
ugucacccuuaggccagcacca

SEQ ID NO: 3359564 - RNA, 22 nt, Human
uguauaaaagggacugagaaau

SEQ ID NO: 3359565 - RNA, 22 nt, Human
uguacgaagaguauuuuugaca

SEQ ID NO: 3359566 - RNA, 14 nt, Human
uguaccucugccuc

SEQ ID NO: 3359567 - RNA, 14 nt, Human
uguacgaagaguau

SEQ ID NO: 3359568 - RNA, 17 nt, Human
uguagauaauacaguuc

SEQ ID NO: 3359569 - RNA, 18 nt, Human
uguagccccucuccugga

SEQ ID NO: 3359570 - RNA, 17 nt, Human
ugucuggcacagccugg

SEQ ID NO: 3359571 - RNA, 21 nt, Human
ugucuuuccacuccuccuagc

SEQ ID NO: 3359572 - RNA, 18 nt, Human
ugugaagugaaugaaaca

SEQ ID NO: 3359573 - RNA, 21 nt, Human
ugugaauguugugauguauuc

SEQ ID NO: 3359574 - RNA, 16 nt, Human
ugugauauaagugugu

SEQ ID NO: 3359575 - RNA, 13 nt, Human
ugugauauaagug

SEQ ID NO: 3359576 - RNA, 19 nt, Human
ugugccuugucacgccaga

SEQ ID NO: 3359577 - RNA, 20 nt, Human
ugugccuugucacgccagac

SEQ ID NO: 3359578 - RNA, 17 nt, Human
ugugccuugucacgcca

SEQ ID NO: 3359579 - RNA, 17 nt, Human
ugugccuuggugugcug

SEQ ID NO: 3359580 - RNA, 16 nt, Human
ugugccuuuugccauc

SEQ ID NO: 3359581 - RNA, 17 nt, Human
ugugcucaggagcccug

SEQ ID NO: 3359582 - RNA, 16 nt, Human
ugugcucaggagcccu

SEQ ID NO: 3359583 - RNA, 15 nt, Human
ugugcucaggagccc

SEQ ID NO: 3359584 - RNA, 15 nt, Human
uguggccuaaccugc

SEQ ID NO: 3359585 - RNA, 15 nt, Human
uguggaagugugggu

SEQ ID NO: 3359586 - RNA, 14 nt, Human
ugugggagugugua

SEQ ID NO: 3359587 - RNA, 15 nt, Human
ugugggaguguguaa

SEQ ID NO: 3359588 - RNA, 19 nt, Human
uguguaauuuaaaauugug

SEQ ID NO: 3359589 - RNA, 22 nt, Human
uguguaauuuaaaauugugaug

SEQ ID NO: 3359590 - RNA, 23 nt, Human
uguguaauuuaaaauugugaugu

SEQ ID NO: 3359591 - RNA, 11 nt, Human
uguguaauuua

SEQ ID NO: 3359592 - RNA, 18 nt, Human
uguguaauuuaaaauugu

SEQ ID NO: 3359593 - RNA, 19 nt, Human
uguuuccauauuuuauagg

SEQ ID NO: 3359594 - RNA, 16 nt, Human
uuaaugauaaguaaau

SEQ ID NO: 3359595 - RNA, 13 nt, Human
uuacauuguaaau

SEQ ID NO: 3359596 - RNA, 12 nt, Human
uuacauuguaaa

SEQ ID NO: 3359597 - RNA, 12 nt, Human
uuaagaguaaaa

SEQ ID NO: 3359598 - RNA, 13 nt, Human
ugugugcucucca

SEQ ID NO: 3359599 - RNA, 14 nt, Human
ugugugggagugug

SEQ ID NO: 3359600 - RNA, 15 nt, Human
ugugugggagugugu

SEQ ID NO: 3359601 - RNA, 11 nt, Human
uguguaugugg

SEQ ID NO: 3359602 - RNA, 12 nt, Human
uguguauguggg

SEQ ID NO: 3359603 - RNA, 16 nt, Human
ugugugggagugugua

SEQ ID NO: 3359604 - RNA, 15 nt, Human
uguguuuuucauaaa

SEQ ID NO: 3359605 - RNA, 18 nt, Human
uguguuuuucauaaagca

SEQ ID NO: 3359606 - RNA, 12 nt, Human
uguucauacaua

SEQ ID NO: 3359607 - RNA, 17 nt, Human
uguucauaaauaaaguu

SEQ ID NO: 3359608 - RNA, 14 nt, Human
uguucauacauauu

SEQ ID NO: 3359609 - RNA, 23 nt, Human
uguucauacauauuuuuguagca

SEQ ID NO: 3359610 - RNA, 13 nt, Human
uguucauaaauaa

SEQ ID NO: 3359611 - RNA, 16 nt, Human
uguucuuuugucccag

SEQ ID NO: 3359612 - RNA, 12 nt, Human
uguuuaagagac

SEQ ID NO: 3359613 - RNA, 12 nt, Human
uguuuacagugu

SEQ ID NO: 3359614 - RNA, 18 nt, Human
uguuggcacaugccugua

SEQ ID NO: 3359615 - RNA, 17 nt, Human
guuguccucagccccgc

SEQ ID NO: 3359616 - RNA, 23 nt, Human
guuguccucagccccgcguggaa

SEQ ID NO: 3359617 - RNA, 12 nt, Human
guuguguguggg

SEQ ID NO: 3359618 - RNA, 13 nt, Human
guuguguguggga

SEQ ID NO: 3359619 - RNA, 14 nt, Human
guugugugugggag

SEQ ID NO: 3359620 - RNA, 16 nt, Human
guugugugugggagug

SEQ ID NO: 3359621 - RNA, 22 nt, Human
guugugugugggaguguguaau

SEQ ID NO: 3359622 - RNA, 14 nt, Human
guugugaauguugu

SEQ ID NO: 3359623 - RNA, 16 nt, Human
guuuagaagaagugug

SEQ ID NO: 3359624 - RNA, 19 nt, Human
guuuaggaacuacugagga

SEQ ID NO: 3359625 - RNA, 19 nt, Human
guuucuuuguaaugaaaac

SEQ ID NO: 3359626 - RNA, 18 nt, Human
guuucuuuguaaugaaaa

SEQ ID NO: 3359627 - RNA, 20 nt, Human
guuuucaaaauuguuacaaa

SEQ ID NO: 3359628 - RNA, 16 nt, Human
guuuuaaaaugagaaa

SEQ ID NO: 3359629 - RNA, 15 nt, Human
guuuuaaaaugagaa

SEQ ID NO: 3359630 - RNA, 22 nt, Human
uaaaacaagcacuaaacaaaga

SEQ ID NO: 3359631 - RNA, 21 nt, Human
uaaaaagacauucuuccaaaa

SEQ ID NO: 3359632 - RNA, 18 nt, Human
uaaaaacaacuuuauacc

SEQ ID NO: 3359633 - RNA, 19 nt, Human
uaaaaacaacuuuauaccc

SEQ ID NO: 3359634 - RNA, 13 nt, Human
uaaaaacaacuuu

SEQ ID NO: 3359635 - RNA, 17 nt, Human
uaaaaacaaagaaauua

SEQ ID NO: 3359636 - RNA, 21 nt, Human
uaaaaacaaagaaauuaugug

SEQ ID NO: 3359637 - RNA, 21 nt, Human
uaaaagggacugagaaauuua

SEQ ID NO: 3359638 - RNA, 17 nt, Human
uaaaagauaaauauuau

SEQ ID NO: 3359639 - RNA, 14 nt, Human
uaaaguguuugaaa

SEQ ID NO: 3359640 - RNA, 21 nt, Human
uaaaggcccuaucuguuuaca

SEQ ID NO: 3359641 - RNA, 18 nt, Human
uaaagcaggcagaacuca

SEQ ID NO: 3359642 - RNA, 18 nt, Human
uaaacacucuugaaaaau

SEQ ID NO: 3359643 - RNA, 17 nt, Human
uaaacacucuugaaaaa

SEQ ID NO: 3359644 - RNA, 15 nt, Human
uaaacacucuugaaa

SEQ ID NO: 3359645 - RNA, 13 nt, Human
uaaauuuauguga

SEQ ID NO: 3359646 - RNA, 22 nt, Human
uaaauuugaauguuaagcagau

SEQ ID NO: 3359647 - RNA, 14 nt, Human
uaaauuugaauguu

SEQ ID NO: 3359648 - RNA, 17 nt, Human
uaaaguugguaaaccuu

SEQ ID NO: 3359649 - RNA, 16 nt, Human
uaaaguugguaaaccu

SEQ ID NO: 3359650 - RNA, 19 nt, Human
uaagaaaucaaagagagaa

SEQ ID NO: 3359651 - RNA, 18 nt, Human
uaacugugaaguuuacau

SEQ ID NO: 3359652 - RNA, 17 nt, Human
uaacugugaaguuuaca

SEQ ID NO: 3359653 - RNA, 13 nt, Human
uaacugugaaguu

SEQ ID NO: 3359654 - RNA, 13 nt, Human
uaaccagaucauu

SEQ ID NO: 3359655 - RNA, 22 nt, Human
uaagugccaggauggaaugaug

SEQ ID NO: 3359656 - RNA, 22 nt, Human
uaagugauugcugguuuuaguu

SEQ ID NO: 3359657 - RNA, 15 nt, Human
uaauaacugugaagu

SEQ ID NO: 3359658 - RNA, 21 nt, Human
uaauaacugugaaguuuacau

SEQ ID NO: 3359659 - RNA, 12 nt, Human
uaauaaagcugu

SEQ ID NO: 3359660 - RNA, 11 nt, Human
uaauaaagcug

SEQ ID NO: 3359661 - RNA, 22 nt, Human
uaaucuacuccuuguaaagacu

SEQ ID NO: 3359662 - RNA, 23 nt, Human
uaauaaucauuggauucugagag

SEQ ID NO: 3359663 - RNA, 14 nt, Human
uacccagaaaguua

SEQ ID NO: 3359664 - RNA, 19 nt, Human
uacuugcucuugaugccug

SEQ ID NO: 3359665 - RNA, 18 nt, Human
uacuugcucuugaugccu

SEQ ID NO: 3359666 - RNA, 14 nt, Human
uacuugcucuugau

SEQ ID NO: 3359667 - RNA, 13 nt, Human
uacuugcucuuga

SEQ ID NO: 3359668 - RNA, 13 nt, Human
uacuuaacuauuc

SEQ ID NO: 3359669 - RNA, 15 nt, Human
uacuccccuccuuga

SEQ ID NO: 3359670 - RNA, 21 nt, Human
uacugccuauuuuaauaaaca

SEQ ID NO: 3359671 - RNA, 14 nt, Human
uacugccuauuuua

SEQ ID NO: 3359672 - RNA, 23 nt, Human
uacaguucggugagcuacaaaug

SEQ ID NO: 3359673 - RNA, 20 nt, Human
uacaggaugaugacuaugga

SEQ ID NO: 3359674 - RNA, 18 nt, Human
uacaguuccuagguauaa

SEQ ID NO: 3359675 - RNA, 16 nt, Human
uagccccucuccugga

SEQ ID NO: 3359676 - RNA, 17 nt, Human
uagcauggcauauuuuu

SEQ ID NO: 3359677 - RNA, 18 nt, Human
uagcauggcauauuuuuc

SEQ ID NO: 3359678 - RNA, 15 nt, Human
uagcauggcauauuu

SEQ ID NO: 3359679 - RNA, 22 nt, Human
uauaaacaugcuugcauuauau

SEQ ID NO: 3359680 - RNA, 22 nt, Human
uagguuaauuccaauuauauga

SEQ ID NO: 3359681 - RNA, 15 nt, Human
uaggucucaauaccu

SEQ ID NO: 3359682 - RNA, 14 nt, Human
uauaucuuguagcu

SEQ ID NO: 3359683 - RNA, 23 nt, Human
uaucaguuugcuagcagaaaucu

SEQ ID NO: 3359684 - RNA, 20 nt, Human
uauauuuguaaauuuaugug

SEQ ID NO: 3359685 - RNA, 21 nt, Human
guggggagagacgggcccugg

SEQ ID NO: 3359686 - RNA, 13 nt, Human
gugggccuggcca

SEQ ID NO: 3359687 - RNA, 17 nt, Human
guggcuggaucugugag

SEQ ID NO: 3359688 - RNA, 15 nt, Human
gugcuaauuuugaaa

SEQ ID NO: 3359689 - RNA, 13 nt, Human
gugcuaauuuuga

SEQ ID NO: 3359690 - RNA, 22 nt, Human
guguaauuuaaaauugugaugu

SEQ ID NO: 3359691 - RNA, 23 nt, Human
guguaauuuaaaauugugaugug

SEQ ID NO: 3359692 - RNA, 20 nt, Human
guguaauuuaaaauugugau

SEQ ID NO: 3359693 - RNA, 15 nt, Human
guguacuuaacuauu

SEQ ID NO: 3359694 - RNA, 13 nt, Human
guggugagaucau

SEQ ID NO: 3359695 - RNA, 18 nt, Human
guggucuccacuggggau

SEQ ID NO: 3359696 - RNA, 21 nt, Human
guguccugcaccggggccugg

SEQ ID NO: 3359697 - RNA, 17 nt, Human
gugucuggcacagccug

SEQ ID NO: 3359698 - RNA, 14 nt, Human
gugucuggcugcag

SEQ ID NO: 3359699 - RNA, 17 nt, Human
gugugggaguguguaau

SEQ ID NO: 3359700 - RNA, 16 nt, Human
guguguuuaugugugu

SEQ ID NO: 3359701 - RNA, 12 nt, Human
guguguuuuaaa

SEQ ID NO: 3359702 - RNA, 14 nt, Human
guguguuuaugugu

SEQ ID NO: 3359703 - RNA, 15 nt, Human
guguguuuaugugug

SEQ ID NO: 3359704 - RNA, 12 nt, Human
guguguugugug

SEQ ID NO: 3359705 - RNA, 14 nt, Human
guguguugugugug

SEQ ID NO: 3359706 - RNA, 17 nt, Human
guguguuguguguggga

SEQ ID NO: 3359707 - RNA, 19 nt, Human
gugugcucaggagcccugg

SEQ ID NO: 3359708 - RNA, 18 nt, Human
gugugcucaggagcccug

SEQ ID NO: 3359709 - RNA, 17 nt, Human
gugugcucaggagcccu

SEQ ID NO: 3359710 - RNA, 16 nt, Human
gugugcucaggagccc

SEQ ID NO: 3359711 - RNA, 17 nt, Human
guuaaacucgcucacug

SEQ ID NO: 3359712 - RNA, 19 nt, Human
guguguuuuaaaaugagaa

SEQ ID NO: 3359713 - RNA, 16 nt, Human
guguguuuuaaaauga

SEQ ID NO: 3359714 - RNA, 13 nt, Human
guguguuuuaaaa

SEQ ID NO: 3359715 - RNA, 14 nt, Human
guguguuuuucaua

SEQ ID NO: 3359716 - RNA, 18 nt, Human
guguuuuucauaaagcag

SEQ ID NO: 3359717 - RNA, 13 nt, Human
guucugccaggag

SEQ ID NO: 3359718 - RNA, 14 nt, Human
guucugccaggaga

SEQ ID NO: 3359719 - RNA, 12 nt, Human
guucugccagga

SEQ ID NO: 3359720 - RNA, 14 nt, Human
guugcaacuuugua

SEQ ID NO: 3359721 - RNA, 16 nt, Human
guugcaacuuuguaua

SEQ ID NO: 3359722 - RNA, 20 nt, Human
guucacucuuggagccugca

SEQ ID NO: 3359723 - RNA, 24 nt, Human
guucacucuuggagccugcagagc

SEQ ID NO: 3359724 - RNA, 17 nt, Human
guucacucuuggagccu

SEQ ID NO: 3359725 - RNA, 18 nt, Human
guucacucuuggagccug

SEQ ID NO: 3359726 - RNA, 19 nt, Human
guucacucuuggagccugc

SEQ ID NO: 3359727 - RNA, 16 nt, Human
guuccuagccaccgcc

SEQ ID NO: 3359728 - RNA, 15 nt, Human
guuccagccugccac

SEQ ID NO: 3359729 - RNA, 13 nt, Human
guuccagccugcc

SEQ ID NO: 3359730 - RNA, 14 nt, Human
guuccagccugcca

SEQ ID NO: 3359731 - RNA, 14 nt, Human
guuccagcaccaca

SEQ ID NO: 3359732 - RNA, 18 nt, Human
guucaauaauaaauauuu

SEQ ID NO: 3359733 - RNA, 13 nt, Human
gucccugccugga

SEQ ID NO: 3359734 - RNA, 13 nt, Human
gucuaaauuugaa

SEQ ID NO: 3359735 - RNA, 21 nt, Human
gucuaagauaguaacaaugaa

SEQ ID NO: 3359736 - RNA, 18 nt, Human
gucgucaaagcugaaaug

SEQ ID NO: 3359737 - RNA, 21 nt, Human
gucucuggauuauauuaugaa

SEQ ID NO: 3359738 - RNA, 17 nt, Human
gucucuggaauuugaaa

SEQ ID NO: 3359739 - RNA, 13 nt, Human
gucugagagaggc

SEQ ID NO: 3359740 - RNA, 14 nt, Human
gucugagagaggcc

SEQ ID NO: 3359741 - RNA, 15 nt, Human
gucugagagaggcca

SEQ ID NO: 3359742 - RNA, 18 nt, Human
gucugagagaggccauuc

SEQ ID NO: 3359743 - RNA, 11 nt, Human
gucugugugug

SEQ ID NO: 3359744 - RNA, 12 nt, Human
gucugugugugu

SEQ ID NO: 3359745 - RNA, 16 nt, Human
gucuguguguguguau

SEQ ID NO: 3359746 - RNA, 20 nt, Human
gucuguguguguguaugugg

SEQ ID NO: 3359747 - RNA, 11 nt, Human
gucuguguguu

SEQ ID NO: 3359748 - RNA, 21 nt, Human
gucuguguguuuaugugugug

SEQ ID NO: 3359749 - RNA, 22 nt, Human
gucuguguguuuaugugugugu

SEQ ID NO: 3359750 - RNA, 17 nt, Human
gucuugguuccagccug

SEQ ID NO: 3359751 - RNA, 19 nt, Human
gucuugguuccagccugcc

SEQ ID NO: 3359752 - RNA, 16 nt, Human
gucuugguuccagccu

SEQ ID NO: 3359753 - RNA, 21 nt, Human
gugauuuuuaugccaccugaa

SEQ ID NO: 3359754 - RNA, 14 nt, Human
gugccuuuugccau

SEQ ID NO: 3359755 - RNA, 21 nt, Human
gugccaggauggaaugauggg

SEQ ID NO: 3359756 - RNA, 18 nt, Human
gugaauucuugaaggaaa

SEQ ID NO: 3359757 - RNA, 22 nt, Human
gugaauucuugaaggaaaauga

SEQ ID NO: 3359758 - RNA, 20 nt, Human
gugaccuuccaagagccuga

SEQ ID NO: 3359759 - RNA, 21 nt, Human
gugaccuuccaagagccugag

SEQ ID NO: 3359760 - RNA, 22 nt, Human
gugaccuuccaagagccugaga

SEQ ID NO: 3359761 - RNA, 21 nt, Human
gugacuauggagcugagcagg

SEQ ID NO: 3359762 - RNA, 18 nt, Human
gugaggagcuugaaaccc

SEQ ID NO: 3359763 - RNA, 19 nt, Human
gugauauaaguguguguuu

SEQ ID NO: 3359764 - RNA, 19 nt, Human
guagugauuuuuaugccac

SEQ ID NO: 3359765 - RNA, 17 nt, Human
guauaauucacauugua

SEQ ID NO: 3359766 - RNA, 14 nt, Human
guagguugggagaa

SEQ ID NO: 3359767 - RNA, 14 nt, Human
guagcacugacaga

SEQ ID NO: 3359768 - RNA, 15 nt, Human
guagcacugacagau

SEQ ID NO: 3359769 - RNA, 13 nt, Human
guaugaaauuaua

SEQ ID NO: 3359770 - RNA, 23 nt, Human
guaugaaauuauauaaguauucu

SEQ ID NO: 3359771 - RNA, 22 nt, Human
gucagcugggacaccccgacuu

SEQ ID NO: 3359772 - RNA, 22 nt, Human
gucccugaggcagguccccaga

SEQ ID NO: 3359773 - RNA, 16 nt, Human
gucccugaagagaagg

SEQ ID NO: 3359774 - RNA, 18 nt, Human
gucccugaggcagguccc

SEQ ID NO: 3359775 - RNA, 20 nt, Human
gucccuaauaaagcugugug

SEQ ID NO: 3359776 - RNA, 18 nt, Human
gucccuaauaaagcugug

SEQ ID NO: 3359777 - RNA, 15 nt, Human
gucccuaauaaagcu

SEQ ID NO: 3359778 - RNA, 17 nt, Human
gucccuaauaaagcugu

SEQ ID NO: 3359779 - RNA, 16 nt, Human
gucccuaauaaagcug

SEQ ID NO: 3359780 - RNA, 12 nt, Human
uuucuaaaguaa

SEQ ID NO: 3359781 - RNA, 18 nt, Human
uuugaaucaucaagucuu

SEQ ID NO: 3359782 - RNA, 16 nt, Human
uuugaaucucauaauu

SEQ ID NO: 3359783 - RNA, 19 nt, Human
uuugaaucucauaauuuau

SEQ ID NO: 3359784 - RNA, 20 nt, Human
uuugaaucucauaauuuaua

SEQ ID NO: 3359785 - RNA, 21 nt, Human
uuugaaucucauaauuuauac

SEQ ID NO: 3359786 - RNA, 22 nt, Human
uuugaaucucauaauuuauaca

SEQ ID NO: 3359787 - RNA, 15 nt, Human
uuugcaucugaaaau

SEQ ID NO: 3359788 - RNA, 17 nt, Human
uuugaauguaugcuuca

SEQ ID NO: 3359789 - RNA, 22 nt, Human
uuugaauguaugcuucauacag

SEQ ID NO: 3359790 - RNA, 18 nt, Human
uuuuaaagacuuuuauga

SEQ ID NO: 3359791 - RNA, 20 nt, Human
uuuuaaaagaugcaauguag

SEQ ID NO: 3359792 - RNA, 12 nt, Human
uuuguauaaaag

SEQ ID NO: 3359793 - RNA, 20 nt, Human
uuuugaaucucauaauuuau

SEQ ID NO: 3359794 - RNA, 18 nt, Human
uuuucuaaaguaaaaaca

SEQ ID NO: 3359795 - RNA, 18 nt, Human
uuuuguagcacugacaga

SEQ ID NO: 3359796 - RNA, 19 nt, Human
uuuuguagcacugacagau

SEQ ID NO: 3359797 - RNA, 18 nt, Human
uuuuuaaagacuuuuaug

SEQ ID NO: 3359798 - RNA, 13 nt, Human
uuuuuaaagacuu

SEQ ID NO: 3359799 - RNA, 12 nt, Human
uuuuuaaagacu

SEQ ID NO: 3359800 - RNA, 13 nt, Human
cuacccccugugc

SEQ ID NO: 3359801 - RNA, 14 nt, Human
cuacccccugugcc

SEQ ID NO: 3359802 - RNA, 19 nt, Human
cuaauguaauaacugugaa

SEQ ID NO: 3359803 - RNA, 13 nt, Human
cuaauaaagcugu

SEQ ID NO: 3359804 - RNA, 12 nt, Human
cuaauaaagcug

SEQ ID NO: 3359805 - RNA, 21 nt, Human
cuacuguaaggcaaucauggu

SEQ ID NO: 3359806 - RNA, 15 nt, Human
cuacuugagaggcug

SEQ ID NO: 3359807 - RNA, 16 nt, Human
cuaguaugaaauuaua

SEQ ID NO: 3359808 - RNA, 17 nt, Human
cuagcagaaaucuagaa

SEQ ID NO: 3359809 - RNA, 20 nt, Human
cuaucuguuuacaguguucc

SEQ ID NO: 3359810 - RNA, 17 nt, Human
cuaucuguuuacagugu

SEQ ID NO: 3359811 - RNA, 21 nt, Human
cuaucuguuuacaguguuccg

SEQ ID NO: 3359812 - RNA, 18 nt, Human
cuaugacauaaaaacaac

SEQ ID NO: 3359813 - RNA, 21 nt, Human
cuaugacauaaaaacaacuuu

SEQ ID NO: 3359814 - RNA, 22 nt, Human
cuauuuuaauaaacacucuuga

SEQ ID NO: 3359815 - RNA, 18 nt, Human
cuauuuuaauaaacacuc

SEQ ID NO: 3359816 - RNA, 23 nt, Human
cguggcuguggcauccagagucc

SEQ ID NO: 3359817 - RNA, 16 nt, Human
cguuguccucagcccc

SEQ ID NO: 3359818 - RNA, 15 nt, Human
cuaacaugauuuggg

SEQ ID NO: 3359819 - RNA, 23 nt, Human
cuaaauuugaauguuaagcagau

SEQ ID NO: 3359820 - RNA, 17 nt, Human
cuaaauauauuuuaaga

SEQ ID NO: 3359821 - RNA, 20 nt, Human
cuaaauauauuuuaagacga

SEQ ID NO: 3359822 - RNA, 18 nt, Human
cuaaauauauuuuaagac

SEQ ID NO: 3359823 - RNA, 17 nt, Human
cgggagccugacccuca

SEQ ID NO: 3359824 - RNA, 12 nt, Human
cggcugggagga

SEQ ID NO: 3359825 - RNA, 18 nt, Human
cgggggcagucugagaga

SEQ ID NO: 3359826 - RNA, 21 nt, Human
cgggggcagucugagagaggc

SEQ ID NO: 3359827 - RNA, 17 nt, Human
cgggggcagucugagag

SEQ ID NO: 3359828 - RNA, 19 nt, Human
cggggccugggcaggaggg

SEQ ID NO: 3359829 - RNA, 17 nt, Human
cggggccugggcaggag

SEQ ID NO: 3359830 - RNA, 22 nt, Human
cgggucaucuguaccucugccu

SEQ ID NO: 3359831 - RNA, 15 nt, Human
cgggucaucuguacc

SEQ ID NO: 3359832 - RNA, 17 nt, Human
cggugagcuacaaaugc

SEQ ID NO: 3359833 - RNA, 15 nt, Human
cggcuggacuuggag

SEQ ID NO: 3359834 - RNA, 16 nt, Human
cgcccuggacugugug

SEQ ID NO: 3359835 - RNA, 21 nt, Human
cucuuggggaguuuagggugg

SEQ ID NO: 3359836 - RNA, 23 nt, Human
cucuuggggaguuuagggugggg

SEQ ID NO: 3359837 - RNA, 19 nt, Human
cucuggagcccacuguacu

SEQ ID NO: 3359838 - RNA, 22 nt, Human
cucugugcccacccuccacucu

SEQ ID NO: 3359839 - RNA, 14 nt, Human
cugaggcagguccc

SEQ ID NO: 3359840 - RNA, 17 nt, Human
cugaggcagguccccag

SEQ ID NO: 3359841 - RNA, 18 nt, Human
cugaggcagguccccaga

SEQ ID NO: 3359842 - RNA, 19 nt, Human
cugaggcagguccccagac

SEQ ID NO: 3359843 - RNA, 19 nt, Human
cugaggaucagaguaaucc

SEQ ID NO: 3359844 - RNA, 16 nt, Human
cugaggcaagagaauu

SEQ ID NO: 3359845 - RNA, 17 nt, Human
cugaggaucagaguaau

SEQ ID NO: 3359846 - RNA, 11 nt, Human
cugacagauuu

SEQ ID NO: 3359847 - RNA, 15 nt, Human
cugacagauuuccau

SEQ ID NO: 3359848 - RNA, 15 nt, Human
cugacuaugacauaa

SEQ ID NO: 3359849 - RNA, 14 nt, Human
cugagaaauuuaua

SEQ ID NO: 3359850 - RNA, 11 nt, Human
cugagaaauuu

SEQ ID NO: 3359851 - RNA, 21 nt, Human
cucuccacucaugugacucuu

SEQ ID NO: 3359852 - RNA, 19 nt, Human
cucuccacucaugugacuc

SEQ ID NO: 3359853 - RNA, 22 nt, Human
cucuccacucaugugacucuuu

SEQ ID NO: 3359854 - RNA, 15 nt, Human
cucuccugucucccu

SEQ ID NO: 3359855 - RNA, 17 nt, Human
cucuccugucucccucc

SEQ ID NO: 3359856 - RNA, 18 nt, Human
cucuccugucucccuccu

SEQ ID NO: 3359857 - RNA, 21 nt, Human
cucuccugauagucuuucagu

SEQ ID NO: 3359858 - RNA, 20 nt, Human
cucuaccucauaucaguuug

SEQ ID NO: 3359859 - RNA, 18 nt, Human
cucuacugggagccuacc

SEQ ID NO: 3359860 - RNA, 21 nt, Human
cucuacugggagccuacccac

SEQ ID NO: 3359861 - RNA, 21 nt, Human
cuccucgagaucccaacacug

SEQ ID NO: 3359862 - RNA, 24 nt, Human
cuccucgagaucccaacacugcca

SEQ ID NO: 3359863 - RNA, 17 nt, Human
cuccucgagaucccaac

SEQ ID NO: 3359864 - RNA, 20 nt, Human
cuccauccuacccccugugc

SEQ ID NO: 3359865 - RNA, 22 nt, Human
cuccauccuacccccugugccu

SEQ ID NO: 3359866 - RNA, 23 nt, Human
cuccauccuacccccugugccuu

SEQ ID NO: 3359867 - RNA, 18 nt, Human
cuccauccuacccccugu

SEQ ID NO: 3359868 - RNA, 19 nt, Human
cugccagacccccuggaga

SEQ ID NO: 3359869 - RNA, 17 nt, Human
cugccagacccccugga

SEQ ID NO: 3359870 - RNA, 19 nt, Human
cugcccgggagcucaggaa

SEQ ID NO: 3359871 - RNA, 18 nt, Human
cugcccgggagcucagga

SEQ ID NO: 3359872 - RNA, 23 nt, Human
cugcagagcugcgggcugggugu

SEQ ID NO: 3359873 - RNA, 22 nt, Human
cugcaggucccuaauaaagcug

SEQ ID NO: 3359874 - RNA, 21 nt, Human
cugcaggucccuaauaaagcu

SEQ ID NO: 3359875 - RNA, 20 nt, Human
cugcaggucccuaauaaagc

SEQ ID NO: 3359876 - RNA, 19 nt, Human
cugcaggucccuaauaaag

SEQ ID NO: 3359877 - RNA, 23 nt, Human
cugcaggucccuaauaaagcugu

SEQ ID NO: 3359878 - RNA, 18 nt, Human
cugcaggucccuaauaaa

SEQ ID NO: 3359879 - RNA, 17 nt, Human
cugcaggucccuaauaa

SEQ ID NO: 3359880 - RNA, 16 nt, Human
cugcaggucccuaaua

SEQ ID NO: 3359881 - RNA, 15 nt, Human
cugcaggucccuaau

SEQ ID NO: 3359882 - RNA, 14 nt, Human
cugcaggucccuaa

SEQ ID NO: 3359883 - RNA, 13 nt, Human
cugcaggucccua

SEQ ID NO: 3359884 - RNA, 12 nt, Human
cugcaggucccu

SEQ ID NO: 3359885 - RNA, 11 nt, Human
cugcagguccc

SEQ ID NO: 3359886 - RNA, 15 nt, Human
cugcucugugcccac

SEQ ID NO: 3359887 - RNA, 23 nt, Human
cugcugccugcuuuuuauggccu

SEQ ID NO: 3359888 - RNA, 14 nt, Human
cugcugccugcuuu

SEQ ID NO: 3359889 - RNA, 22 nt, Human
cugcgggcuggguguggucucc

SEQ ID NO: 3359890 - RNA, 22 nt, Human
cugccugcuuuuuauggccugu

SEQ ID NO: 3359891 - RNA, 19 nt, Human
cugggaggagggcaggcau

SEQ ID NO: 3359892 - RNA, 19 nt, Human
cugggagccuacccacccc

SEQ ID NO: 3359893 - RNA, 22 nt, Human
cugggagccuacccacccccag

SEQ ID NO: 3359894 - RNA, 16 nt, Human
cugggagccuacccac

SEQ ID NO: 3359895 - RNA, 17 nt, Human
cugggaggcucuggagc

SEQ ID NO: 3359896 - RNA, 21 nt, Human
cugggaggcucuggagcccac

SEQ ID NO: 3359897 - RNA, 20 nt, Human
cugggaggcucuggagccca

SEQ ID NO: 3359898 - RNA, 18 nt, Human
cugggaggcucuggagcc

SEQ ID NO: 3359899 - RNA, 18 nt, Human
cuggcuguggccuaaccu

SEQ ID NO: 3359900 - RNA, 16 nt, Human
cuggcacagccuggcu

SEQ ID NO: 3359901 - RNA, 21 nt, Human
cuggcacagccuggcuguggc

SEQ ID NO: 3359902 - RNA, 15 nt, Human
cuggcacagccuggc

SEQ ID NO: 3359903 - RNA, 23 nt, Human
cuggcacagccuggcuguggccu

SEQ ID NO: 3359904 - RNA, 20 nt, Human
cuggaagugcuaauuuugaa

SEQ ID NO: 3359905 - RNA, 14 nt, Human
cuguaccucugccu

SEQ ID NO: 3359906 - RNA, 18 nt, Human
cuguaaggcaaucauggu

SEQ ID NO: 3359907 - RNA, 18 nt, Human
cugggucgcccuggacug

SEQ ID NO: 3359908 - RNA, 17 nt, Human
cugggucgcccuggacu

SEQ ID NO: 3359909 - RNA, 22 nt, Human
cugggucgcccuggacugugug

SEQ ID NO: 3359910 - RNA, 16 nt, Human
cugggucgcccuggac

SEQ ID NO: 3359911 - RNA, 12 nt, Human
cuggucagccca

SEQ ID NO: 3359912 - RNA, 13 nt, Human
cuggucagcccaa

SEQ ID NO: 3359913 - RNA, 21 nt, Human
gaaggaucccaugagcuccuu

SEQ ID NO: 3359914 - RNA, 21 nt, Human
gaaggugaggagcuugaaacc

SEQ ID NO: 3359915 - RNA, 23 nt, Human
gaaggaaccaaagcgaauuuuaa

SEQ ID NO: 3359916 - RNA, 22 nt, Human
gaacuuguaaaggaauuuaaaa

SEQ ID NO: 3359917 - RNA, 13 nt, Human
gaagaaguguguc

SEQ ID NO: 3359918 - RNA, 20 nt, Human
gaagaguauuuuugacagaa

SEQ ID NO: 3359919 - RNA, 22 nt, Human
gaagauugagauguguucacaa

SEQ ID NO: 3359920 - RNA, 17 nt, Human
gaagauugagauguguu

SEQ ID NO: 3359921 - RNA, 23 nt, Human
gaaaguuauugauaaguucauac

SEQ ID NO: 3359922 - RNA, 19 nt, Human
gaaacuaggugcauauuua

SEQ ID NO: 3359923 - RNA, 20 nt, Human
gaaacuaggugcauauuuau

SEQ ID NO: 3359924 - RNA, 17 nt, Human
gaaauuauauaaguauu

SEQ ID NO: 3359925 - RNA, 23 nt, Human
gaaauuauauaaguauucuaaau

SEQ ID NO: 3359926 - RNA, 23 nt, Human
gaaauuaguacuccccuccuuga

SEQ ID NO: 3359927 - RNA, 14 nt, Human
gaacaucccuccug

SEQ ID NO: 3359928 - RNA, 20 nt, Human
gaaccaaagcgaauuuuaaa

SEQ ID NO: 3359929 - RNA, 23 nt, Human
gaaccaaagcgaauuuuaaaaga

SEQ ID NO: 3359930 - RNA, 11 nt, Human
gaaccaaagcg

SEQ ID NO: 3359931 - RNA, 12 nt, Human
cuuuggacuugu

SEQ ID NO: 3359932 - RNA, 16 nt, Human
cuuuggaacaagaugg

SEQ ID NO: 3359933 - RNA, 19 nt, Human
cuuuuuuaucaugugaaau

SEQ ID NO: 3359934 - RNA, 16 nt, Human
cuuuucuuucuaccaa

SEQ ID NO: 3359935 - RNA, 19 nt, Human
cuuucuuccaaacaggcuc

SEQ ID NO: 3359936 - RNA, 13 nt, Human
cuuucuuccaaac

SEQ ID NO: 3359937 - RNA, 21 nt, Human
cuuuccacuccuccuagccac

SEQ ID NO: 3359938 - RNA, 18 nt, Human
cuuuccacuccuccuagc

SEQ ID NO: 3359939 - RNA, 23 nt, Human
cuuuccaaagccaaugugaacag

SEQ ID NO: 3359940 - RNA, 20 nt, Human
cuuuccaaagccaaugugaa

SEQ ID NO: 3359941 - RNA, 21 nt, Human
cuuuauuuucuauaauuuaaa

SEQ ID NO: 3359942 - RNA, 19 nt, Human
cuuuauuuuguguuuagga

SEQ ID NO: 3359943 - RNA, 20 nt, Human
cuuggggaguuuaggguggg

SEQ ID NO: 3359944 - RNA, 21 nt, Human
cuuggggaguuuagggugggg

SEQ ID NO: 3359945 - RNA, 18 nt, Human
cuuguaaagacuguagaa

SEQ ID NO: 3359946 - RNA, 23 nt, Human
cuugucacgccagacuucccacg

SEQ ID NO: 3359947 - RNA, 18 nt, Human
cuugucacgccagacuuc

SEQ ID NO: 3359948 - RNA, 18 nt, Human
cuuguauuauguguguuu

SEQ ID NO: 3359949 - RNA, 13 nt, Human
cuuguauuaugug

SEQ ID NO: 3359950 - RNA, 15 nt, Human
cuugcuuuuaaaauc

SEQ ID NO: 3359951 - RNA, 20 nt, Human
cuugcugcccugugcuccuc

SEQ ID NO: 3359952 - RNA, 19 nt, Human
cuuggagccugcagagcug

SEQ ID NO: 3359953 - RNA, 20 nt, Human
cuuggagccugcagagcugc

SEQ ID NO: 3359954 - RNA, 15 nt, Human
cuuggagccugcaga

SEQ ID NO: 3359955 - RNA, 16 nt, Human
cuuggagccugcagag

SEQ ID NO: 3359956 - RNA, 17 nt, Human
cuuggagccugcagagc

SEQ ID NO: 3359957 - RNA, 18 nt, Human
cuuggagccugcagagcu

SEQ ID NO: 3359958 - RNA, 13 nt, Human
cuuggagccugca

SEQ ID NO: 3359959 - RNA, 17 nt, Human
cuugaacugagcuugga

SEQ ID NO: 3359960 - RNA, 19 nt, Human
cuugaacugagcuuggaag

SEQ ID NO: 3359961 - RNA, 15 nt, Human
gacaccuaggcuagg

SEQ ID NO: 3359962 - RNA, 16 nt, Human
gacaccuaggcuaggg

SEQ ID NO: 3359963 - RNA, 20 nt, Human
gacaccuaggcuaggguggg

SEQ ID NO: 3359964 - RNA, 22 nt, Human
gacagccaacuauggccugugg

SEQ ID NO: 3359965 - RNA, 19 nt, Human
gacagccaacuauggccug

SEQ ID NO: 3359966 - RNA, 23 nt, Human
gaccugauuucugagcauuuaau

SEQ ID NO: 3359967 - RNA, 17 nt, Human
gaccuuuccugaggaag

SEQ ID NO: 3359968 - RNA, 21 nt, Human
gagccugacccucaucuuucu

SEQ ID NO: 3359969 - RNA, 15 nt, Human
gagccuacccacccc

SEQ ID NO: 3359970 - RNA, 17 nt, Human
gagccuacccaccccca

SEQ ID NO: 3359971 - RNA, 21 nt, Human
gagcccacuguacuugcucuu

SEQ ID NO: 3359972 - RNA, 18 nt, Human
gagcccacuguacuugcu

SEQ ID NO: 3359973 - RNA, 21 nt, Human
gagcucaggaaccgaggcagg

SEQ ID NO: 3359974 - RNA, 20 nt, Human
gagcucaggaaccgaggcag

SEQ ID NO: 3359975 - RNA, 20 nt, Human
gagcuccuuaaggcucuuuu

SEQ ID NO: 3359976 - RNA, 22 nt, Human
gagcuugaaacccguggcgcuu

SEQ ID NO: 3359977 - RNA, 13 nt, Human
gagagaggccauu

SEQ ID NO: 3359978 - RNA, 21 nt, Human
gagagaggccauucuuuccca

SEQ ID NO: 3359979 - RNA, 15 nt, Human
gagagugagguggaa

SEQ ID NO: 3359980 - RNA, 17 nt, Human
gagauacagaauuuuau

SEQ ID NO: 3359981 - RNA, 18 nt, Human
gacuugucccgggacacc

SEQ ID NO: 3359982 - RNA, 14 nt, Human
gagaaauuuauaaa

SEQ ID NO: 3359983 - RNA, 22 nt, Human
gagaagccagcuuuccucauca

SEQ ID NO: 3359984 - RNA, 16 nt, Human
gagacagccaacuaug

SEQ ID NO: 3359985 - RNA, 15 nt, Human
gaucccaugagcucc

SEQ ID NO: 3359986 - RNA, 17 nt, Human
gaucccaugagcuccuu

SEQ ID NO: 3359987 - RNA, 14 nt, Human
gaucauuaucagcc

SEQ ID NO: 3359988 - RNA, 14 nt, Human
gaucauugugaaau

SEQ ID NO: 3359989 - RNA, 20 nt, Human
gaucauugugaaauuauuca

SEQ ID NO: 3359990 - RNA, 22 nt, Human
gauagucuuucaguuaaggaga

SEQ ID NO: 3359991 - RNA, 15 nt, Human
gauaguaacaaugaa

SEQ ID NO: 3359992 - RNA, 14 nt, Human
gauagucuuucagu

SEQ ID NO: 3359993 - RNA, 19 nt, Human
gauaaaguugguaaaccuu

SEQ ID NO: 3359994 - RNA, 22 nt, Human
gauaaauauuauauuauauaua

SEQ ID NO: 3359995 - RNA, 15 nt, Human
gauaaauauuauauu

SEQ ID NO: 3359996 - RNA, 14 nt, Human
gauaaguucauaca

SEQ ID NO: 3359997 - RNA, 12 nt, Human
gauaaguucaua

SEQ ID NO: 3359998 - RNA, 17 nt, Human
gauaggucagugcaaau

SEQ ID NO: 3359999 - RNA, 23 nt, Human
gauagauaggucagugcaaauac

SEQ ID NO: 3360000 - RNA, 17 nt, Human
gaugacaacuucccagu

SEQ ID NO: 3360001 - RNA, 21 nt, Human
gaucugugaggggcucucuca

SEQ ID NO: 3360002 - RNA, 17 nt, Human
gaugaaaauauuuaaag

SEQ ID NO: 3360003 - RNA, 15 nt, Human
gaugaaaauauuuaa

SEQ ID NO: 3360004 - RNA, 16 nt, Human
gaugaaaauauuuaaa

SEQ ID NO: 3360005 - RNA, 14 nt, Human
gaugaaaauauuua

SEQ ID NO: 3360006 - RNA, 20 nt, Human
gauuuggggcucagaguggg

SEQ ID NO: 3360007 - RNA, 23 nt, Human
gauuugcucagugucuggcugca

SEQ ID NO: 3360008 - RNA, 22 nt, Human
gauuuggucaacacuaacauga

SEQ ID NO: 3360009 - RNA, 17 nt, Human
gauuccagguggcauca

SEQ ID NO: 3360010 - RNA, 20 nt, Human
gcaaauccuugugggaaaag

SEQ ID NO: 3360011 - RNA, 17 nt, Human
gcaaaauugauguguuu

SEQ ID NO: 3360012 - RNA, 22 nt, Human
gcaaauccuugugggaaaagaa

SEQ ID NO: 3360013 - RNA, 19 nt, Human
gcaggggccgggggcaguc

SEQ ID NO: 3360014 - RNA, 20 nt, Human
gcaggggccgggggcagucu

SEQ ID NO: 3360015 - RNA, 13 nt, Human
gcagguccccaga

SEQ ID NO: 3360016 - RNA, 13 nt, Human
gcauagaaguaaa

SEQ ID NO: 3360017 - RNA, 14 nt, Human
gcauauuuuucaca

SEQ ID NO: 3360018 - RNA, 15 nt, Human
gcauauuuuucacau

SEQ ID NO: 3360019 - RNA, 16 nt, Human
gcauauuuuucacaua

SEQ ID NO: 3360020 - RNA, 19 nt, Human
gcauauuuuucacauaucu

SEQ ID NO: 3360021 - RNA, 20 nt, Human
gcauauuuuucacauaucua

SEQ ID NO: 3360022 - RNA, 19 nt, Human
gcauauuuauaaaaauaaa

SEQ ID NO: 3360023 - RNA, 17 nt, Human
gcauagguuuaauaauu

SEQ ID NO: 3360024 - RNA, 18 nt, Human
gcauuauauuuguaaauu

SEQ ID NO: 3360025 - RNA, 18 nt, Human
gcauggagauagccccac

SEQ ID NO: 3360026 - RNA, 16 nt, Human
gcaucugaaaauugau

SEQ ID NO: 3360027 - RNA, 18 nt, Human
gccuuuggacuugucccg

SEQ ID NO: 3360028 - RNA, 12 nt, Human
gccuguuuaaga

SEQ ID NO: 3360029 - RNA, 13 nt, Human
gccuguuuaagag

SEQ ID NO: 3360030 - RNA, 15 nt, Human
gccugccacucaggc

SEQ ID NO: 3360031 - RNA, 23 nt, Human
gccugccacucaggcccaaagcc

SEQ ID NO: 3360032 - RNA, 13 nt, Human
gccuggugcagug

SEQ ID NO: 3360033 - RNA, 17 nt, Human
gccugguccucacacuc

SEQ ID NO: 3360034 - RNA, 18 nt, Human
gcgcggcugggaggaggg

SEQ ID NO: 3360035 - RNA, 12 nt, Human
gcgcggcuggga

SEQ ID NO: 3360036 - RNA, 17 nt, Human
gcuaagaauauuugaau

SEQ ID NO: 3360037 - RNA, 16 nt, Human
gcuaagaauauuugaa

SEQ ID NO: 3360038 - RNA, 17 nt, Human
gccugacccucaucuuu

SEQ ID NO: 3360039 - RNA, 24 nt, Human
gccucuccacucaugugacucuuu

SEQ ID NO: 3360040 - RNA, 21 nt, Human
gccucuccacucaugugacuc

SEQ ID NO: 3360041 - RNA, 20 nt, Human
gccucucauuccagaggaag

SEQ ID NO: 3360042 - RNA, 19 nt, Human
gccucucauuccagaggaa

SEQ ID NO: 3360043 - RNA, 20 nt, Human
gccuccuacagcccaccugg

SEQ ID NO: 3360044 - RNA, 17 nt, Human
gcccgggagcucaggaa

SEQ ID NO: 3360045 - RNA, 19 nt, Human
gcccgggagcucaggaacc

SEQ ID NO: 3360046 - RNA, 15 nt, Human
gcccgggagcucagg

SEQ ID NO: 3360047 - RNA, 16 nt, Human
gccccugagaucucug

SEQ ID NO: 3360048 - RNA, 17 nt, Human
gccaucauguuuacaga

SEQ ID NO: 3360049 - RNA, 21 nt, Human
gccaucauguuuacagaggac

SEQ ID NO: 3360050 - RNA, 16 nt, Human
gccagucccugaggca

SEQ ID NO: 3360051 - RNA, 22 nt, Human
gccagucccugaggcagguccc

SEQ ID NO: 3360052 - RNA, 23 nt, Human
gccaggcugggucgcccuggacu

SEQ ID NO: 3360053 - RNA, 17 nt, Human
gccaggcugggucgccc

SEQ ID NO: 3360054 - RNA, 17 nt, Human
gcccagaaugaggcugc

SEQ ID NO: 3360055 - RNA, 16 nt, Human
gcccagaaugaggcug

SEQ ID NO: 3360056 - RNA, 21 nt, Human
cauccagagucccugccugga

SEQ ID NO: 3360057 - RNA, 19 nt, Human
cauccuacccccugugccu

SEQ ID NO: 3360058 - RNA, 12 nt, Human
caucuaggauuu

SEQ ID NO: 3360059 - RNA, 18 nt, Human
caucuagguaaauuacag

SEQ ID NO: 3360060 - RNA, 17 nt, Human
caucuagguaaauuaca

SEQ ID NO: 3360061 - RNA, 22 nt, Human
caucaagucuuucacauuuaaa

SEQ ID NO: 3360062 - RNA, 14 nt, Human
cauauuuuucacau

SEQ ID NO: 3360063 - RNA, 21 nt, Human
cauauuuuucacauaucuagu

SEQ ID NO: 3360064 - RNA, 18 nt, Human
cauauuuuucacauaucu

SEQ ID NO: 3360065 - RNA, 12 nt, Human
cauauuuauaaa

SEQ ID NO: 3360066 - RNA, 17 nt, Human
cauauuuauaaaaauaa

SEQ ID NO: 3360067 - RNA, 17 nt, Human
cauaugauguacaugua

SEQ ID NO: 3360068 - RNA, 15 nt, Human
cauaugauguacaug

SEQ ID NO: 3360069 - RNA, 21 nt, Human
cauaugauguacauguacuga

SEQ ID NO: 3360070 - RNA, 20 nt, Human
cauagaauaaaauuuuuaau

SEQ ID NO: 3360071 - RNA, 14 nt, Human
cauagaauaaaauu

SEQ ID NO: 3360072 - RNA, 15 nt, Human
cauaccuggcccugu

SEQ ID NO: 3360073 - RNA, 18 nt, Human
cauaaucacaacccuuca

SEQ ID NO: 3360074 - RNA, 11 nt, Human
cauacauauuu

SEQ ID NO: 3360075 - RNA, 15 nt, Human
cauaauacuugcuuu

SEQ ID NO: 3360076 - RNA, 12 nt, Human
cauacauauuuu

SEQ ID NO: 3360077 - RNA, 19 nt, Human
cauacauauuuuuguagca

SEQ ID NO: 3360078 - RNA, 15 nt, Human
cauacauuguacgaa

SEQ ID NO: 3360079 - RNA, 22 nt, Human
cauaaguaauucaagaaaacaa

SEQ ID NO: 3360080 - RNA, 18 nt, Human
cauaaguaauucaagaaa

SEQ ID NO: 3360081 - RNA, 17 nt, Human
cauaaguaauucaagaa

SEQ ID NO: 3360082 - RNA, 16 nt, Human
cauaaguaauucaaga

SEQ ID NO: 3360083 - RNA, 17 nt, Human
cauaaaaacaacuuuau

SEQ ID NO: 3360084 - RNA, 20 nt, Human
cauaaaaacaacuuuauacc

SEQ ID NO: 3360085 - RNA, 21 nt, Human
cauaaaaacaacuuuauaccc

SEQ ID NO: 3360086 - RNA, 23 nt, Human
cauaaaaacaacuuuauacccag

SEQ ID NO: 3360087 - RNA, 23 nt, Human
cauaaaaagccugcaauuucaua

SEQ ID NO: 3360088 - RNA, 16 nt, Human
cauaaagcaggcagaa

SEQ ID NO: 3360089 - RNA, 14 nt, Human
cauaaagcaggcag

SEQ ID NO: 3360090 - RNA, 15 nt, Human
cauaaaaacaacuuu

SEQ ID NO: 3360091 - RNA, 17 nt, Human
cagugucuggcugcaga

SEQ ID NO: 3360092 - RNA, 19 nt, Human
cagugucuggcugcagagc

SEQ ID NO: 3360093 - RNA, 23 nt, Human
cagugugucuaaauuugaauguu

SEQ ID NO: 3360094 - RNA, 14 nt, Human
cagugugucuaaau

SEQ ID NO: 3360095 - RNA, 11 nt, Human
cagugguuaag

SEQ ID NO: 3360096 - RNA, 18 nt, Human
caguggcuggaucuguga

SEQ ID NO: 3360097 - RNA, 20 nt, Human
caguggcuggaucugugagg

SEQ ID NO: 3360098 - RNA, 16 nt, Human
caguggcuggaucugu

SEQ ID NO: 3360099 - RNA, 18 nt, Human
caguguuccgugguuaaa

SEQ ID NO: 3360100 - RNA, 22 nt, Human
caguucggugagcuacaaaugc

SEQ ID NO: 3360101 - RNA, 16 nt, Human
caguucucuucacuca

SEQ ID NO: 3360102 - RNA, 12 nt, Human
ccaagaggcugc

SEQ ID NO: 3360103 - RNA, 13 nt, Human
ccaagaggcugca

SEQ ID NO: 3360104 - RNA, 16 nt, Human
ccaagagccugagagu

SEQ ID NO: 3360105 - RNA, 20 nt, Human
ccaagguggguagaucacga

SEQ ID NO: 3360106 - RNA, 12 nt, Human
ccaagagccuga

SEQ ID NO: 3360107 - RNA, 21 nt, Human
cauuaccucagugagaagcca

SEQ ID NO: 3360108 - RNA, 22 nt, Human
cauuaccucagugagaagccag

SEQ ID NO: 3360109 - RNA, 22 nt, Human
cauguuucuuuguaaugaaaac

SEQ ID NO: 3360110 - RNA, 21 nt, Human
cauguuucuuuguaaugaaaa

SEQ ID NO: 3360111 - RNA, 20 nt, Human
cauguuucuuuguaaugaaa

SEQ ID NO: 3360112 - RNA, 20 nt, Human
cauggugacuuuugaaaaga

SEQ ID NO: 3360113 - RNA, 17 nt, Human
caugugaaaucauucau

SEQ ID NO: 3360114 - RNA, 16 nt, Human
caugugaaaucauuca

SEQ ID NO: 3360115 - RNA, 15 nt, Human
caugugaaaucauuc

SEQ ID NO: 3360116 - RNA, 19 nt, Human
cauggggcugauuguauuu

SEQ ID NO: 3360117 - RNA, 21 nt, Human
cauggagauagccccacagga

SEQ ID NO: 3360118 - RNA, 22 nt, Human
cauggacuucugccagcauaau

SEQ ID NO: 3360119 - RNA, 19 nt, Human
caugccacuacacuccagc

SEQ ID NO: 3360120 - RNA, 14 nt, Human
cccucaucuuucuu

SEQ ID NO: 3360121 - RNA, 19 nt, Human
cccucauuggcucuugaac

SEQ ID NO: 3360122 - RNA, 23 nt, Human
cccucccucuacugggagccuac

SEQ ID NO: 3360123 - RNA, 18 nt, Human
cccuaauaaagcugugug

SEQ ID NO: 3360124 - RNA, 15 nt, Human
cccuaauaaagcugu

SEQ ID NO: 3360125 - RNA, 14 nt, Human
cccuaauaaagcug

SEQ ID NO: 3360126 - RNA, 13 nt, Human
cccuaauaaagcu

SEQ ID NO: 3360127 - RNA, 12 nt, Human
cccuaauaaagc

SEQ ID NO: 3360128 - RNA, 22 nt, Human
ccccagcuggggccaggcuggg

SEQ ID NO: 3360129 - RNA, 21 nt, Human
ccccagcuggggccaggcugg

SEQ ID NO: 3360130 - RNA, 23 nt, Human
ccccacaggagguggucugggac

SEQ ID NO: 3360131 - RNA, 23 nt, Human
ccccuggugguucacucuuggag

SEQ ID NO: 3360132 - RNA, 12 nt, Human
cccugccuggac

SEQ ID NO: 3360133 - RNA, 13 nt, Human
cccugccuggacc

SEQ ID NO: 3360134 - RNA, 18 nt, Human
cccugccuggaccagccu

SEQ ID NO: 3360135 - RNA, 16 nt, Human
cccugccucucugcag

SEQ ID NO: 3360136 - RNA, 22 nt, Human
cccugccucucugcaggucccu

SEQ ID NO: 3360137 - RNA, 21 nt, Human
cccugccucucugcagguccc

SEQ ID NO: 3360138 - RNA, 21 nt, Human
cccuggacugugugcucagga

SEQ ID NO: 3360139 - RNA, 18 nt, Human
cccugggaggcucuggag

SEQ ID NO: 3360140 - RNA, 17 nt, Human
cccugggaggcucugga

SEQ ID NO: 3360141 - RNA, 16 nt, Human
cccugggaggcucugg

SEQ ID NO: 3360142 - RNA, 15 nt, Human
cccugggaggcucug

SEQ ID NO: 3360143 - RNA, 20 nt, Human
cccugccaucauguuuacag

SEQ ID NO: 3360144 - RNA, 18 nt, Human
cccugccucucugcaggu

SEQ ID NO: 3360145 - RNA, 11 nt, Human
cccugccucuc

SEQ ID NO: 3360146 - RNA, 17 nt, Human
cccucuacugggagccu

SEQ ID NO: 3360147 - RNA, 20 nt, Human
cccucuacugggagccuacc

SEQ ID NO: 3360148 - RNA, 18 nt, Human
ccucagccccgcguggaa

SEQ ID NO: 3360149 - RNA, 14 nt, Human
ccucacacucaccc

SEQ ID NO: 3360150 - RNA, 15 nt, Human
ccggggccugggcag

SEQ ID NO: 3360151 - RNA, 13 nt, Human
ccgggagcucagg

SEQ ID NO: 3360152 - RNA, 15 nt, Human
ccgggagcucaggaa

SEQ ID NO: 3360153 - RNA, 17 nt, Human
ccggcuuuguggcacug

SEQ ID NO: 3360154 - RNA, 19 nt, Human
ccggcuuuguggcacuggg

SEQ ID NO: 3360155 - RNA, 16 nt, Human
ccggcuuuguggcacu

SEQ ID NO: 3360156 - RNA, 13 nt, Human
cccuggugguuca

SEQ ID NO: 3360157 - RNA, 13 nt, Human
ccuaaacauauga

SEQ ID NO: 3360158 - RNA, 15 nt, Human
ccuacagcccaccug

SEQ ID NO: 3360159 - RNA, 22 nt, Human
ccuagguauaauucacauugua

SEQ ID NO: 3360160 - RNA, 17 nt, Human
ccuccauccuacccccu

SEQ ID NO: 3360161 - RNA, 22 nt, Human
ccuccauccuacccccugugcc

SEQ ID NO: 3360162 - RNA, 23 nt, Human
ccuccauccuacccccugugccu

SEQ ID NO: 3360163 - RNA, 13 nt, Human
ccuccacucuccu

SEQ ID NO: 3360164 - RNA, 14 nt, Human
ccucuacugggagc

SEQ ID NO: 3360165 - RNA, 21 nt, Human
cccagcuaugguucucucgca

SEQ ID NO: 3360166 - RNA, 16 nt, Human
cccaggaccccugagu

SEQ ID NO: 3360167 - RNA, 18 nt, Human
cccagaaugccuccugca

SEQ ID NO: 3360168 - RNA, 20 nt, Human
ccaucauguuuacagaggac

SEQ ID NO: 3360169 - RNA, 22 nt, Human
ccaucauguuuacagaggacag

SEQ ID NO: 3360170 - RNA, 16 nt, Human
gccuacccacccccag

SEQ ID NO: 3360171 - RNA, 17 nt, Human
gccuacccacccccagg

SEQ ID NO: 3360172 - RNA, 21 nt, Human
gccacuguuuugaaucucaua

SEQ ID NO: 3360173 - RNA, 16 nt, Human
gccaccgccuccuaca

SEQ ID NO: 3360174 - RNA, 16 nt, Human
gccauaugaaaaggcu

SEQ ID NO: 3360175 - RNA, 19 nt, Human
gccaggccacuggccccug

SEQ ID NO: 3360176 - RNA, 17 nt, Human
gccagacccccuggaga

SEQ ID NO: 3360177 - RNA, 22 nt, Human
gcuuccuucugugaaaguacau

SEQ ID NO: 3360178 - RNA, 19 nt, Human
gcugggucgcccuggacug

SEQ ID NO: 3360179 - RNA, 18 nt, Human
gcugggucgcccuggacu

SEQ ID NO: 3360180 - RNA, 17 nt, Human
gcugggucgcccuggac

SEQ ID NO: 3360181 - RNA, 16 nt, Human
gcugggucgcccugga

SEQ ID NO: 3360182 - RNA, 12 nt, Human
gcugggucgccc

SEQ ID NO: 3360183 - RNA, 18 nt, Human
gcucccccuccaccugcu

SEQ ID NO: 3360184 - RNA, 17 nt, Human
gcucuggagcccacugu

SEQ ID NO: 3360185 - RNA, 23 nt, Human
gcucuggagcccacuguacuugc

SEQ ID NO: 3360186 - RNA, 21 nt, Human
gcuauggggauagaugugugg

SEQ ID NO: 3360187 - RNA, 19 nt, Human
gcuauggggauagaugugu

SEQ ID NO: 3360188 - RNA, 18 nt, Human
gcucaggagcccugggag

SEQ ID NO: 3360189 - RNA, 15 nt, Human
gcucaggagcccugg

SEQ ID NO: 3360190 - RNA, 14 nt, Human
gcucaggagcccug

SEQ ID NO: 3360191 - RNA, 23 nt, Human
ggcaggcaucggggagccgggag

SEQ ID NO: 3360192 - RNA, 13 nt, Human
ggaugucugggcc

SEQ ID NO: 3360193 - RNA, 15 nt, Human
ggaugguguucaaaa

SEQ ID NO: 3360194 - RNA, 15 nt, Human
ggaggcucuggagcc

SEQ ID NO: 3360195 - RNA, 21 nt, Human
ggaggcucuggagcccacugu

SEQ ID NO: 3360196 - RNA, 20 nt, Human
ggaggcucuggagcccacug

SEQ ID NO: 3360197 - RNA, 17 nt, Human
ggaggcucuggagccca

SEQ ID NO: 3360198 - RNA, 18 nt, Human
ggagcccacuguacuugc

SEQ ID NO: 3360199 - RNA, 15 nt, Human
ggagcccacuguacu

SEQ ID NO: 3360200 - RNA, 18 nt, Human
ggaccccuggugguucac

SEQ ID NO: 3360201 - RNA, 15 nt, Human
ggagagacgggcccu

SEQ ID NO: 3360202 - RNA, 17 nt, Human
ggagagacgggcccugg

SEQ ID NO: 3360203 - RNA, 22 nt, Human
ggacugugugcucaggagcccu

SEQ ID NO: 3360204 - RNA, 23 nt, Human
ggacugugugcucaggagcccug

SEQ ID NO: 3360205 - RNA, 17 nt, Human
ggacugugugcucagga

SEQ ID NO: 3360206 - RNA, 18 nt, Human
ggagaaaugaaaaaauau

SEQ ID NO: 3360207 - RNA, 16 nt, Human
ggacuuggagguagcu

SEQ ID NO: 3360208 - RNA, 12 nt, Human
ggggccugggca

SEQ ID NO: 3360209 - RNA, 15 nt, Human
ggggccugggcagga

SEQ ID NO: 3360210 - RNA, 19 nt, Human
aaacauguuucuuuguaau

SEQ ID NO: 3360211 - RNA, 23 nt, Human
aaacauguuucuuuguaaugaaa

SEQ ID NO: 3360212 - RNA, 22 nt, Human
aaacauguuucuuuguaaugaa

SEQ ID NO: 3360213 - RNA, 21 nt, Human
aaaccacauuggagauguuua

SEQ ID NO: 3360214 - RNA, 13 nt, Human
aaacaaagaaauu

SEQ ID NO: 3360215 - RNA, 19 nt, Human
aaacaacuucaauauccaa

SEQ ID NO: 3360216 - RNA, 20 nt, Human
aaacaagcacuaaacaaaga

SEQ ID NO: 3360217 - RNA, 16 nt, Human
aaaauugugauguguc

SEQ ID NO: 3360218 - RNA, 15 nt, Human
aaaauuuuuaaucuu

SEQ ID NO: 3360219 - RNA, 16 nt, Human
aaaauuuuuaaucuuu

SEQ ID NO: 3360220 - RNA, 19 nt, Human
aaaauuuuuaaucuuuaau

SEQ ID NO: 3360221 - RNA, 21 nt, Human
aaaauauuauguguuuccaua

SEQ ID NO: 3360222 - RNA, 15 nt, Human
aaaauauuauguguu

SEQ ID NO: 3360223 - RNA, 14 nt, Human
aaaauauuaugugu

SEQ ID NO: 3360224 - RNA, 16 nt, Human
ggggccaggcuggguc

SEQ ID NO: 3360225 - RNA, 14 nt, Human
ggggccaggcuggg

SEQ ID NO: 3360226 - RNA, 13 nt, Human
ggggccaggcugg

SEQ ID NO: 3360227 - RNA, 21 nt, Human
aaagauuuucagaaaauauua

SEQ ID NO: 3360228 - RNA, 20 nt, Human
ggucuugguuccagccugcc

SEQ ID NO: 3360229 - RNA, 21 nt, Human
ggucuugguuccagccugcca

SEQ ID NO: 3360230 - RNA, 13 nt, Human
aaaggaauuuaaa

SEQ ID NO: 3360231 - RNA, 14 nt, Human
aaagcgaauuuuaa

SEQ ID NO: 3360232 - RNA, 21 nt, Human
ggucauauuaauauauuucca

SEQ ID NO: 3360233 - RNA, 18 nt, Human
ggucauauuaauauauuu

SEQ ID NO: 3360234 - RNA, 15 nt, Human
aaagauuuucagaaa

SEQ ID NO: 3360235 - RNA, 14 nt, Human
aaagauuuucagaa

SEQ ID NO: 3360236 - RNA, 14 nt, Human
aaagaugcaaugua

SEQ ID NO: 3360237 - RNA, 14 nt, Human
gggagggggagagg

SEQ ID NO: 3360238 - RNA, 16 nt, Human
aaaagggacugagaaa

SEQ ID NO: 3360239 - RNA, 18 nt, Human
aaaauauauaucaaauau

SEQ ID NO: 3360240 - RNA, 14 nt, Human
aaaauauauuuaau

SEQ ID NO: 3360241 - RNA, 20 nt, Human
gggaggcagagguugcagug

SEQ ID NO: 3360242 - RNA, 19 nt, Human
aaaagccugcaauuucaua

SEQ ID NO: 3360243 - RNA, 18 nt, Human
aaaagccuguuuaagaga

SEQ ID NO: 3360244 - RNA, 16 nt, Human
aaaagccuguuuaaga

SEQ ID NO: 3360245 - RNA, 22 nt, Human
aaaagcuccauuuuuagugaaa

SEQ ID NO: 3360246 - RNA, 22 nt, Human
aaaaaucugaccaaaacaaaca

SEQ ID NO: 3360247 - RNA, 19 nt, Human
aaaacugcucauaugaugu

SEQ ID NO: 3360248 - RNA, 20 nt, Human
ggcuccucgagaucccaaca

SEQ ID NO: 3360249 - RNA, 17 nt, Human
ggcuggaucugugaggg

SEQ ID NO: 3360250 - RNA, 15 nt, Human
aaaaagggaggggga

SEQ ID NO: 3360251 - RNA, 20 nt, Human
aaaaagccugcaauuucaua

SEQ ID NO: 3360252 - RNA, 23 nt, Human
gacucacuuaucccaagagaaug

SEQ ID NO: 3360253 - RNA, 22 nt, Human
gacugugugcucaggagcccug

SEQ ID NO: 3360254 - RNA, 14 nt, Human
gacagugaaagaaa

SEQ ID NO: 3360255 - RNA, 20 nt, Human
gaagcuaucguaaaauuaag

SEQ ID NO: 3360256 - RNA, 22 nt, Human
gaauauugcuuuggucauauga

SEQ ID NO: 3360257 - RNA, 20 nt, Human
gaauauguuucaaacuuugg

SEQ ID NO: 3360258 - RNA, 14 nt, Human
gaauauguuucaaa

SEQ ID NO: 3360259 - RNA, 15 nt, Human
gaauauguuucaaac

SEQ ID NO: 3360260 - RNA, 19 nt, Human
gaagugugggucugugugu

SEQ ID NO: 3360261 - RNA, 21 nt, Human
gaagugugggucugugugugu

SEQ ID NO: 3360262 - RNA, 24 nt, Human
gaagugugggucugugugugugua

SEQ ID NO: 3360263 - RNA, 12 nt, Human
gaaccgaggcag

SEQ ID NO: 3360264 - RNA, 15 nt, Human
gaaccgaggcaggga

SEQ ID NO: 3360265 - RNA, 17 nt, Human
gaacugcugggcuuggc

SEQ ID NO: 3360266 - RNA, 20 nt, Human
gaacugcugggcuuggcagc

SEQ ID NO: 3360267 - RNA, 20 nt, Human
gaagcaaugcuucaucccuu

SEQ ID NO: 3360268 - RNA, 13 nt, Human
gaggcaggucccc

SEQ ID NO: 3360269 - RNA, 16 nt, Human
gaggcagguccccaga

SEQ ID NO: 3360270 - RNA, 12 nt, Human
gaggcagguccc

SEQ ID NO: 3360271 - RNA, 18 nt, Human
gaggcuacuguaaggcaa

SEQ ID NO: 3360272 - RNA, 9 nt, Human
gagggcugc

SEQ ID NO: 3360273 - RNA, 16 nt, Human
gagggcugccuuugga

SEQ ID NO: 3360274 - RNA, 18 nt, Human
gaggcugcagccaggcca

SEQ ID NO: 3360275 - RNA, 22 nt, Human
gaggugcuucuaguucugccag

SEQ ID NO: 3360276 - RNA, 23 nt, Human
gaggugcuucuaguucugccagg

SEQ ID NO: 3360277 - RNA, 17 nt, Human
gagguggaagagggcug

SEQ ID NO: 3360278 - RNA, 20 nt, Human
gagguggaagagggcugcaa

SEQ ID NO: 3360279 - RNA, 16 nt, Human
gaguccaucagccucc

SEQ ID NO: 3360280 - RNA, 17 nt, Human
gaguccaucagccucca

SEQ ID NO: 3360281 - RNA, 18 nt, Human
gagucagggagagcugaa

SEQ ID NO: 3360282 - RNA, 19 nt, Human
gaguggacuguucccugag

SEQ ID NO: 3360283 - RNA, 14 nt, Human
gauucugagagcug

SEQ ID NO: 3360284 - RNA, 14 nt, Human
gauuauauuaugaa

SEQ ID NO: 3360285 - RNA, 14 nt, Human
gaugguucuagcau

SEQ ID NO: 3360286 - RNA, 16 nt, Human
gcaccggggccugggc

SEQ ID NO: 3360287 - RNA, 14 nt, Human
gcaccggggccugg

SEQ ID NO: 3360288 - RNA, 18 nt, Human
gcaagucagaauagaaau

SEQ ID NO: 3360289 - RNA, 22 nt, Human
cuugacaaagucaagccacaug

SEQ ID NO: 3360290 - RNA, 16 nt, Human
cuuugagguggaagag

SEQ ID NO: 3360291 - RNA, 17 nt, Human
cuuugagguggaagagg

SEQ ID NO: 3360292 - RNA, 14 nt, Human
cuuugagguggaag

SEQ ID NO: 3360293 - RNA, 22 nt, Human
cuuugagguggaagagggcugc

SEQ ID NO: 3360294 - RNA, 12 nt, Human
cuucaucugacu

SEQ ID NO: 3360295 - RNA, 18 nt, Human
cuucaucugacuaugaca

SEQ ID NO: 3360296 - RNA, 14 nt, Human
cuggaucugugagg

SEQ ID NO: 3360297 - RNA, 22 nt, Human
cuggacugugugcucaggagcc

SEQ ID NO: 3360298 - RNA, 19 nt, Human
cuggacugugugcucagga

SEQ ID NO: 3360299 - RNA, 23 nt, Human
cuggacugugugcucaggagccc

SEQ ID NO: 3360300 - RNA, 13 nt, Human
cugggcaggaggg

SEQ ID NO: 3360301 - RNA, 12 nt, Human
cuggugcagugg

SEQ ID NO: 3360302 - RNA, 13 nt, Human
cuggcccugugcc

SEQ ID NO: 3360303 - RNA, 16 nt, Human
cugggagaaaugaaaa

SEQ ID NO: 3360304 - RNA, 17 nt, Human
cugggagaaaugaaaaa

SEQ ID NO: 3360305 - RNA, 18 nt, Human
cugcaccggggccugggc

SEQ ID NO: 3360306 - RNA, 19 nt, Human
cugcaccggggccugggca

SEQ ID NO: 3360307 - RNA, 14 nt, Human
cugcaccggggccu

SEQ ID NO: 3360308 - RNA, 16 nt, Human
cugcaccggggccugg

SEQ ID NO: 3360309 - RNA, 16 nt, Human
cugcaaauccuugugg

SEQ ID NO: 3360310 - RNA, 19 nt, Human
cugcaaauccuugugggaa

SEQ ID NO: 3360311 - RNA, 17 nt, Human
cugcaggaaauggcugu

SEQ ID NO: 3360312 - RNA, 18 nt, Human
caccuaggcuaggguggg

SEQ ID NO: 3360313 - RNA, 19 nt, Human
caccuaggcuagggugggg

SEQ ID NO: 3360314 - RNA, 17 nt, Human
caccuaggcuagggugg

SEQ ID NO: 3360315 - RNA, 15 nt, Human
caacuauuuuuccaa

SEQ ID NO: 3360316 - RNA, 14 nt, Human
caacuauggccugu

SEQ ID NO: 3360317 - RNA, 13 nt, Human
caacuauggccug

SEQ ID NO: 3360318 - RNA, 19 nt, Human
caagcaaaugugaaucauu

SEQ ID NO: 3360319 - RNA, 17 nt, Human
caagcaaaugugaauca

SEQ ID NO: 3360320 - RNA, 15 nt, Human
caagcaaaugugaau

SEQ ID NO: 3360321 - RNA, 17 nt, Human
auuuuuaugccaccuga

SEQ ID NO: 3360322 - RNA, 15 nt, Human
auuuuuuucugaauu

SEQ ID NO: 3360323 - RNA, 19 nt, Human
auuuguucuauagcuuuuc

SEQ ID NO: 3360324 - RNA, 17 nt, Human
auuuucuauaauuuaaa

SEQ ID NO: 3360325 - RNA, 18 nt, Human
auuuucuauaauuuaaau

SEQ ID NO: 3360326 - RNA, 19 nt, Human
auuuucuauaauuuaaaua

SEQ ID NO: 3360327 - RNA, 15 nt, Human
auuuugaaaaacugc

SEQ ID NO: 3360328 - RNA, 13 nt, Human
auuuugaaaaacu

SEQ ID NO: 3360329 - RNA, 16 nt, Human
auuucagcagcugcag

SEQ ID NO: 3360330 - RNA, 16 nt, Human
auugauaaguucauac

SEQ ID NO: 3360331 - RNA, 17 nt, Human
auugauaaguucauaca

SEQ ID NO: 3360332 - RNA, 18 nt, Human
auugauaaguucauacau

SEQ ID NO: 3360333 - RNA, 19 nt, Human
auugauaaguucauacauu

SEQ ID NO: 3360334 - RNA, 12 nt, Human
auugauaaguuc

SEQ ID NO: 3360335 - RNA, 15 nt, Human
auugauaaguucaua

SEQ ID NO: 3360336 - RNA, 17 nt, Human
auucauggccuggggga

SEQ ID NO: 3360337 - RNA, 21 nt, Human
auuaugugccagauuuaugca

SEQ ID NO: 3360338 - RNA, 13 nt, Human
auuaugugccaga

SEQ ID NO: 3360339 - RNA, 20 nt, Human
auuaaauuuugaguucuaca

SEQ ID NO: 3360340 - RNA, 17 nt, Human
cagcacguguggccugu

SEQ ID NO: 3360341 - RNA, 18 nt, Human
cagccaggccacuggccc

SEQ ID NO: 3360342 - RNA, 13 nt, Human
cagauuuaugcau

SEQ ID NO: 3360343 - RNA, 15 nt, Human
cauuggauucugaga

SEQ ID NO: 3360344 - RNA, 16 nt, Human
cauuggagauguuuag

SEQ ID NO: 3360345 - RNA, 22 nt, Human
ccaauuauaugagacguuuuug

SEQ ID NO: 3360346 - RNA, 19 nt, Human
ccaauucgaacuuuuucca

SEQ ID NO: 3360347 - RNA, 16 nt, Human
ccaacuauggccugug

SEQ ID NO: 3360348 - RNA, 15 nt, Human
ccaacuauggccugu

SEQ ID NO: 3360349 - RNA, 14 nt, Human
ccaacuauggccug

SEQ ID NO: 3360350 - RNA, 16 nt, Human
caugaauuugugaagg

SEQ ID NO: 3360351 - RNA, 21 nt, Human
caugaauauuuaguguucaua

SEQ ID NO: 3360352 - RNA, 17 nt, Human
caguuauuauauuuaca

SEQ ID NO: 3360353 - RNA, 21 nt, Human
caguuauuauauuuacaaaug

SEQ ID NO: 3360354 - RNA, 22 nt, Human
caguuauuauauuuacaaaugg

SEQ ID NO: 3360355 - RNA, 14 nt, Human
caguucagcuuggg

SEQ ID NO: 3360356 - RNA, 15 nt, Human
caguucagcuugggg

SEQ ID NO: 3360357 - RNA, 19 nt, Human
cauacagggaugguguuca

SEQ ID NO: 3360358 - RNA, 16 nt, Human
cauacagggauggugu

SEQ ID NO: 3360359 - RNA, 18 nt, Human
cauaauuauuauuuggcc

SEQ ID NO: 3360360 - RNA, 23 nt, Human
caguuguucaauaauaaauauuu

SEQ ID NO: 3360361 - RNA, 17 nt, Human
caucuguaccucugccu

SEQ ID NO: 3360362 - RNA, 23 nt, Human
ccagacuucccacggcuccucga

SEQ ID NO: 3360363 - RNA, 18 nt, Human
ccagagaaaaagggaggg

SEQ ID NO: 3360364 - RNA, 14 nt, Human
ccagacuccaccaa

SEQ ID NO: 3360365 - RNA, 18 nt, Human
ccagacuccaccaagccu

SEQ ID NO: 3360366 - RNA, 21 nt, Human
ccccgcguggaacucgugucu

SEQ ID NO: 3360367 - RNA, 22 nt, Human
cccccugugccuugucacgcca

SEQ ID NO: 3360368 - RNA, 20 nt, Human
cccagcuggggccaggcugg

SEQ ID NO: 3360369 - RNA, 23 nt, Human
cccagcuggggccaggcuggguc

SEQ ID NO: 3360370 - RNA, 22 nt, Human
cccagcuggggccaggcugggu

SEQ ID NO: 3360371 - RNA, 21 nt, Human
ccaugagcuccuuaaggcucu

SEQ ID NO: 3360372 - RNA, 12 nt, Human
ccaugagcuccu

SEQ ID NO: 3360373 - RNA, 13 nt, Human
ccauugguguuga

SEQ ID NO: 3360374 - RNA, 19 nt, Human
cccacuguacuugcucuug

SEQ ID NO: 3360375 - RNA, 18 nt, Human
cccacuguacuugcucuu

SEQ ID NO: 3360376 - RNA, 23 nt, Human
cccacuguacuugcucuugaugc

SEQ ID NO: 3360377 - RNA, 21 nt, Human
ccucugcccgggagcucagga

SEQ ID NO: 3360378 - RNA, 22 nt, Human
ccucugcccgggagcucaggaa

SEQ ID NO: 3360379 - RNA, 15 nt, Human
ccucucugcaggucc

SEQ ID NO: 3360380 - RNA, 19 nt, Human
ccucucugcaggucccuaa

SEQ ID NO: 3360381 - RNA, 18 nt, Human
ccucucugcaggucccua

SEQ ID NO: 3360382 - RNA, 17 nt, Human
ccucucugcaggucccu

SEQ ID NO: 3360383 - RNA, 16 nt, Human
ccucucugcagguccc

SEQ ID NO: 3360384 - RNA, 19 nt, Human
ccugccuggaccagccucu

SEQ ID NO: 3360385 - RNA, 12 nt, Human
ccugccuggacc

SEQ ID NO: 3360386 - RNA, 21 nt, Human
ccugccucucugcaggucccu

SEQ ID NO: 3360387 - RNA, 20 nt, Human
ccugccucucugcagguccc

SEQ ID NO: 3360388 - RNA, 17 nt, Human
ccugccucucugcaggu

SEQ ID NO: 3360389 - RNA, 22 nt, Human
ccucuuggggaguuuagggugg

SEQ ID NO: 3360390 - RNA, 15 nt, Human
ccucuuggcugccuu

SEQ ID NO: 3360391 - RNA, 23 nt, Human
ccucuuggggaguuuaggguggg

SEQ ID NO: 3360392 - RNA, 12 nt, Human
ccugcagagcug

SEQ ID NO: 3360393 - RNA, 13 nt, Human
ccugcagagcugc

SEQ ID NO: 3360394 - RNA, 14 nt, Human
ccugcagagcugcg

SEQ ID NO: 3360395 - RNA, 17 nt, Human
ccugcagagcugcgggc

SEQ ID NO: 3360396 - RNA, 14 nt, Human
ccugaguuccuagc

SEQ ID NO: 3360397 - RNA, 23 nt, Human
ccgaaggugaggagcuugaaacc

SEQ ID NO: 3360398 - RNA, 18 nt, Human
cccugagaucucugcagg

SEQ ID NO: 3360399 - RNA, 14 nt, Human
cccugaaggaacca

SEQ ID NO: 3360400 - RNA, 16 nt, Human
cuccugucucccuccu

SEQ ID NO: 3360401 - RNA, 16 nt, Human
cuccuuguaaagacug

SEQ ID NO: 3360402 - RNA, 14 nt, Human
cuccucuuccaggc

SEQ ID NO: 3360403 - RNA, 22 nt, Human
cuccucugcccgggagcucagg

SEQ ID NO: 3360404 - RNA, 24 nt, Human
cuccucugcccgggagcucaggaa

SEQ ID NO: 3360405 - RNA, 20 nt, Human
cucccucuacugggagccua

SEQ ID NO: 3360406 - RNA, 13 nt, Human
cucccucuacugg

SEQ ID NO: 3360407 - RNA, 19 nt, Human
cucccucuacugggagccu

SEQ ID NO: 3360408 - RNA, 20 nt, Human
cucugcaggaaauggcugug

SEQ ID NO: 3360409 - RNA, 20 nt, Human
cucaggccugacucucagca

SEQ ID NO: 3360410 - RNA, 23 nt, Human
cucaggccgaaggaggagucagg

SEQ ID NO: 3360411 - RNA, 23 nt, Human
cucaugauagaaggcuaugggga

SEQ ID NO: 3360412 - RNA, 14 nt, Human
ccuugcauaauggu

SEQ ID NO: 3360413 - RNA, 23 nt, Human
cuaaaguaaaaacaaagaaauua

SEQ ID NO: 3360414 - RNA, 16 nt, Human
uuggacuugucccggg

SEQ ID NO: 3360415 - RNA, 15 nt, Human
uuggagccugcagag

SEQ ID NO: 3360416 - RNA, 11 nt, Human
uuggagccugc

SEQ ID NO: 3360417 - RNA, 17 nt, Human
uugcucuugaugccugg

SEQ ID NO: 3360418 - RNA, 14 nt, Human
uugcucuugaugcc

SEQ ID NO: 3360419 - RNA, 18 nt, Human
uugcucuugaugccuggc

SEQ ID NO: 3360420 - RNA, 21 nt, Human
aucugugaggggcucucucau

SEQ ID NO: 3360421 - RNA, 22 nt, Human
aucugugaggggcucucucaug

SEQ ID NO: 3360422 - RNA, 14 nt, Human
aucuuauaauuuaa

SEQ ID NO: 3360423 - RNA, 15 nt, Human
aucuuauaauuuaaa

SEQ ID NO: 3360424 - RNA, 19 nt, Human
uuguaaauuuaugugaugg

SEQ ID NO: 3360425 - RNA, 15 nt, Human
augaagcaaugcuuc

SEQ ID NO: 3360426 - RNA, 18 nt, Human
augaacuuguaaaggaau

SEQ ID NO: 3360427 - RNA, 22 nt, Human
augaagauguuucaaaaaaucu

SEQ ID NO: 3360428 - RNA, 14 nt, Human
augaagcaaugcuu

SEQ ID NO: 3360429 - RNA, 18 nt, Human
uuggagccugcagagcug

SEQ ID NO: 3360430 - RNA, 14 nt, Human
aucugacuaugaca

SEQ ID NO: 3360431 - RNA, 17 nt, Human
aucugacuaugacauaa

SEQ ID NO: 3360432 - RNA, 20 nt, Human
uugauguguuuauuuauaga

SEQ ID NO: 3360433 - RNA, 17 nt, Human
uugcaacuuuguauaaa

SEQ ID NO: 3360434 - RNA, 16 nt, Human
uugcaacuuuguauaa

SEQ ID NO: 3360435 - RNA, 18 nt, Human
uugcaacuuuguauaaaa

SEQ ID NO: 3360436 - RNA, 16 nt, Human
aucucuuguuuaaauu

SEQ ID NO: 3360437 - RNA, 16 nt, Human
uuguucauacauauuu

SEQ ID NO: 3360438 - RNA, 18 nt, Human
uuguucauacauauuuuu

SEQ ID NO: 3360439 - RNA, 18 nt, Human
uuuaaaaaaauuccaagu

SEQ ID NO: 3360440 - RNA, 20 nt, Human
uuuaagacgaaacauuuguu

SEQ ID NO: 3360441 - RNA, 21 nt, Human
uuuaaauauaugcuaagucuu

SEQ ID NO: 3360442 - RNA, 18 nt, Human
uuuaaauauaugcuaagu

SEQ ID NO: 3360443 - RNA, 14 nt, Human
uuuaagagacagcc

SEQ ID NO: 3360444 - RNA, 20 nt, Human
augagggucuugguuccagc

SEQ ID NO: 3360445 - RNA, 16 nt, Human
uuguagcuuuaucaaa

SEQ ID NO: 3360446 - RNA, 17 nt, Human
uuguagcuuuaucaaag

SEQ ID NO: 3360447 - RNA, 18 nt, Human
augaguuggcugggaaua

SEQ ID NO: 3360448 - RNA, 12 nt, Human
uugugauguguc

SEQ ID NO: 3360449 - RNA, 13 nt, Human
uuguucauacaua

SEQ ID NO: 3360450 - RNA, 19 nt, Human
uuguucaauaauaaauauu

SEQ ID NO: 3360451 - RNA, 22 nt, Human
uuguucaauaauaaauauuuuu

SEQ ID NO: 3360452 - RNA, 20 nt, Human
uuguucaauaauaaauauuu

SEQ ID NO: 3360453 - RNA, 18 nt, Human
augcuacaggauuugaaa

SEQ ID NO: 3360454 - RNA, 21 nt, Human
uuucacauaucuaguaugaaa

SEQ ID NO: 3360455 - RNA, 22 nt, Human
uuucacauaucuaguaugaaau

SEQ ID NO: 3360456 - RNA, 17 nt, Human
auggaaugcuguguuaa

SEQ ID NO: 3360457 - RNA, 21 nt, Human
auggaaugcuguguuaaauaa

SEQ ID NO: 3360458 - RNA, 13 nt, Human
uucucuucacuca

SEQ ID NO: 3360459 - RNA, 11 nt, Human
aucccaacacu

SEQ ID NO: 3360460 - RNA, 15 nt, Human
aucccaacacugcca

SEQ ID NO: 3360461 - RNA, 16 nt, Human
aucccaacacugccag

SEQ ID NO: 3360462 - RNA, 17 nt, Human
aucccaacacugccagc

SEQ ID NO: 3360463 - RNA, 16 nt, Human
uucuaguucugccagg

SEQ ID NO: 3360464 - RNA, 17 nt, Human
uucuaguucugccagga

SEQ ID NO: 3360465 - RNA, 14 nt, Human
aucauucauuuucu

SEQ ID NO: 3360466 - RNA, 20 nt, Human
aucauuaucagccugugcca

SEQ ID NO: 3360467 - RNA, 18 nt, Human
aucauguuuacagaggac

SEQ ID NO: 3360468 - RNA, 23 nt, Human
aucauguuuacagaggacaguau

SEQ ID NO: 3360469 - RNA, 19 nt, Human
aucagugugucuaaauuug

SEQ ID NO: 3360470 - RNA, 16 nt, Human
aucagugucuuuccac

SEQ ID NO: 3360471 - RNA, 17 nt, Human
auauuguguugugaaug

SEQ ID NO: 3360472 - RNA, 18 nt, Human
auauuguguugugaaugu

SEQ ID NO: 3360473 - RNA, 20 nt, Human
auauuuguaaauuuauguga

SEQ ID NO: 3360474 - RNA, 17 nt, Human
auauguuucaaacuuug

SEQ ID NO: 3360475 - RNA, 22 nt, Human
auauugauccagaaagaaaacu

SEQ ID NO: 3360476 - RNA, 15 nt, Human
auauugauccagaaa

SEQ ID NO: 3360477 - RNA, 17 nt, Human
auaggcacaggaaacca

SEQ ID NO: 3360478 - RNA, 20 nt, Human
uucacauaucuaguaugaaa

SEQ ID NO: 3360479 - RNA, 21 nt, Human
uucacauaucuaguaugaaau

SEQ ID NO: 3360480 - RNA, 19 nt, Human
uucacauuguauucagagu

SEQ ID NO: 3360481 - RNA, 22 nt, Human
uucaagaaaacaacuucaauau

SEQ ID NO: 3360482 - RNA, 16 nt, Human
uucaaaaaacuuguaa

SEQ ID NO: 3360483 - RNA, 16 nt, Human
uucaaacuuuggaaca

SEQ ID NO: 3360484 - RNA, 18 nt, Human
auagcuacuaauuuuaaa

SEQ ID NO: 3360485 - RNA, 14 nt, Human
auagcuacuaauuu

SEQ ID NO: 3360486 - RNA, 17 nt, Human
auagcuacuaauuuuaa

SEQ ID NO: 3360487 - RNA, 16 nt, Human
auauccuuucuaacaa

SEQ ID NO: 3360488 - RNA, 18 nt, Human
auauauucagccuggcuu

SEQ ID NO: 3360489 - RNA, 20 nt, Human
uucagaaaauauuauguguu

SEQ ID NO: 3360490 - RNA, 14 nt, Human
uucagaaaauauua

SEQ ID NO: 3360491 - RNA, 13 nt, Human
uucagaaaauauu

SEQ ID NO: 3360492 - RNA, 21 nt, Human
uucagaaaauauuauguguuu

SEQ ID NO: 3360493 - RNA, 17 nt, Human
auauaaguauucuaaau

SEQ ID NO: 3360494 - RNA, 18 nt, Human
uuuguaagguuuuuguag

SEQ ID NO: 3360495 - RNA, 22 nt, Human
uuuguagugauuuuuaugccac

SEQ ID NO: 3360496 - RNA, 15 nt, Human
uuuguagugauuuuu

SEQ ID NO: 3360497 - RNA, 23 nt, Human
augucgucaaagcugaaauggac

SEQ ID NO: 3360498 - RNA, 19 nt, Human
uuucccuuccuuccucucc

SEQ ID NO: 3360499 - RNA, 18 nt, Human
uuugacagaauauguuuc

SEQ ID NO: 3360500 - RNA, 19 nt, Human
uuugacagaauauguuuca

SEQ ID NO: 3360501 - RNA, 20 nt, Human
uuugacagaauauguuucaa

SEQ ID NO: 3360502 - RNA, 18 nt, Human
uuugacaaagguaaauca

SEQ ID NO: 3360503 - RNA, 23 nt, Human
uuugaccuguugggagugaggau

SEQ ID NO: 3360504 - RNA, 13 nt, Human
uuugagaguucua

SEQ ID NO: 3360505 - RNA, 17 nt, Human
auguauauaaacaugcu

SEQ ID NO: 3360506 - RNA, 18 nt, Human
uuuggcaaacucuccacc

SEQ ID NO: 3360507 - RNA, 18 nt, Human
auguguguguguugugug

SEQ ID NO: 3360508 - RNA, 22 nt, Human
auguguguguguuguguguggg

SEQ ID NO: 3360509 - RNA, 23 nt, Human
auguguguguguuguguguggga

SEQ ID NO: 3360510 - RNA, 23 nt, Human
auguggaaaagccaagaggcugc

SEQ ID NO: 3360511 - RNA, 12 nt, Human
auguguuuccau

SEQ ID NO: 3360512 - RNA, 12 nt, Human
auguuaagcaga

SEQ ID NO: 3360513 - RNA, 22 nt, Human
uuuuauguugcauagaauaaaa

SEQ ID NO: 3360514 - RNA, 15 nt, Human
uuuuccaaaauaauu

SEQ ID NO: 3360515 - RNA, 15 nt, Human
auguuuuuuuuuaaa

SEQ ID NO: 3360516 - RNA, 17 nt, Human
auuccaagugauugaaa

SEQ ID NO: 3360517 - RNA, 22 nt, Human
auucaggagaguagaacagaua

SEQ ID NO: 3360518 - RNA, 21 nt, Human
auucaggagaguagaacagau

SEQ ID NO: 3360519 - RNA, 14 nt, Human
auucagccuggcuu

SEQ ID NO: 3360520 - RNA, 20 nt, Human
auuauauggcuugaguuuaa

SEQ ID NO: 3360521 - RNA, 21 nt, Human
auuauuuuguucauacauauu

SEQ ID NO: 3360522 - RNA, 17 nt, Human
uuuuuguagcacugaca

SEQ ID NO: 3360523 - RNA, 19 nt, Human
uuuuuguagcacugacaga

SEQ ID NO: 3360524 - RNA, 20 nt, Human
uuuuuguagcacugacagau

SEQ ID NO: 3360525 - RNA, 21 nt, Human
uuuuuguagcacugacagauu

SEQ ID NO: 3360526 - RNA, 12 nt, Human
uuuuugacagaa

SEQ ID NO: 3360527 - RNA, 13 nt, Human
uuuuugacagaau

SEQ ID NO: 3360528 - RNA, 15 nt, Human
uuuuugaagcuguau

SEQ ID NO: 3360529 - RNA, 17 nt, Human
auuguagagccagaggu

SEQ ID NO: 3360530 - RNA, 18 nt, Human
auuguagagccagagguc

SEQ ID NO: 3360531 - RNA, 16 nt, Human
auuguaguccuguaau

SEQ ID NO: 3360532 - RNA, 15 nt, Human
auuuaaaauugugau

SEQ ID NO: 3360533 - RNA, 16 nt, Human
auuuaguguucauaaa

SEQ ID NO: 3360534 - RNA, 23 nt, Human
auuuauaaaaauaaaaaacacug

SEQ ID NO: 3360535 - RNA, 17 nt, Human
auuuaguguucauaaau

SEQ ID NO: 3360536 - RNA, 13 nt, Human
auuuaguguucau

SEQ ID NO: 3360537 - RNA, 15 nt, Human
auuuauaaacuuuuu

SEQ ID NO: 3360538 - RNA, 14 nt, Human
auuuccuaaauaua

SEQ ID NO: 3360539 - RNA, 21 nt, Human
auuuccuaaauauauuuuaag

SEQ ID NO: 3360540 - RNA, 21 nt, Human
auuuggagacacaacuauuuu

SEQ ID NO: 3360541 - RNA, 19 nt, Human
auuugaauguuaagcagau

SEQ ID NO: 3360542 - RNA, 22 nt, Human
auuugaauguaugcuucauaca

SEQ ID NO: 3360543 - RNA, 20 nt, Human
auuucuugagguaaaagcau

SEQ ID NO: 3360544 - RNA, 18 nt, Human
auuugaauguuaagcaga

SEQ ID NO: 3360545 - RNA, 13 nt, Human
auuugaauguuaa

SEQ ID NO: 3360546 - RNA, 23 nt, Human
auuugaauguaugcuucauacag

SEQ ID NO: 3360547 - RNA, 17 nt, Human
auuguacgaagaguauu

SEQ ID NO: 3360548 - RNA, 12 nt, Human
auugauguguuu

SEQ ID NO: 3360549 - RNA, 18 nt, Human
auugaugggauuugguca

SEQ ID NO: 3360550 - RNA, 19 nt, Human
auugauguguuuauuuaua

SEQ ID NO: 3360551 - RNA, 16 nt, Human
agccucuccacucaug

SEQ ID NO: 3360552 - RNA, 17 nt, Human
agccucgacacagagug

SEQ ID NO: 3360553 - RNA, 18 nt, Human
agccucgacacagagugg

SEQ ID NO: 3360554 - RNA, 22 nt, Human
ugcaggucccuaauaaagcugu

SEQ ID NO: 3360555 - RNA, 21 nt, Human
ugcaggucccuaauaaagcug

SEQ ID NO: 3360556 - RNA, 17 nt, Human
ugcauagaauaaaauuu

SEQ ID NO: 3360557 - RNA, 15 nt, Human
agccuguuuaagaga

SEQ ID NO: 3360558 - RNA, 23 nt, Human
agccccgcguggaacucgugucu

SEQ ID NO: 3360559 - RNA, 18 nt, Human
agcccugaguuccuagcc

SEQ ID NO: 3360560 - RNA, 20 nt, Human
agcccugaguuccuagccac

SEQ ID NO: 3360561 - RNA, 23 nt, Human
agcccugaguuccuagccaccgc

SEQ ID NO: 3360562 - RNA, 14 nt, Human
agcccugaguuccu

SEQ ID NO: 3360563 - RNA, 17 nt, Human
agcccugggaggcucug

SEQ ID NO: 3360564 - RNA, 20 nt, Human
agcccugggaggcucuggag

SEQ ID NO: 3360565 - RNA, 18 nt, Human
agcccugggaggcucugg

SEQ ID NO: 3360566 - RNA, 15 nt, Human
ugaugggucaguugu

SEQ ID NO: 3360567 - RNA, 15 nt, Human
ugaugaaaauauuua

SEQ ID NO: 3360568 - RNA, 18 nt, Human
ugaugaaaauauuuaaag

SEQ ID NO: 3360569 - RNA, 23 nt, Human
ugauccagaaagaaaacuuguau

SEQ ID NO: 3360570 - RNA, 13 nt, Human
ugauccagaaaga

SEQ ID NO: 3360571 - RNA, 20 nt, Human
agcaucacaugaacuuguaa

SEQ ID NO: 3360572 - RNA, 21 nt, Human
agcagguccccagcuuuggcu

SEQ ID NO: 3360573 - RNA, 20 nt, Human
agcagguccccagcuuuggc

SEQ ID NO: 3360574 - RNA, 13 nt, Human
ugauaaguucaua

SEQ ID NO: 3360575 - RNA, 15 nt, Human
ugauaaguucauaca

SEQ ID NO: 3360576 - RNA, 17 nt, Human
ugauaaguucauacauu

SEQ ID NO: 3360577 - RNA, 19 nt, Human
ugauaaguucauacauugu

SEQ ID NO: 3360578 - RNA, 12 nt, Human
ugauaaguaaau

SEQ ID NO: 3360579 - RNA, 16 nt, Human
ugauaaguaaaugcua

SEQ ID NO: 3360580 - RNA, 20 nt, Human
ugaguucuacauaaguaauu

SEQ ID NO: 3360581 - RNA, 15 nt, Human
ugaguucuacauaag

SEQ ID NO: 3360582 - RNA, 14 nt, Human
ugaguuccuagcca

SEQ ID NO: 3360583 - RNA, 18 nt, Human
ugaguuccuagccaccgc

SEQ ID NO: 3360584 - RNA, 22 nt, Human
ugccgagaguccaucagccucc

SEQ ID NO: 3360585 - RNA, 22 nt, Human
ugccugcuuuuuauggccugug

SEQ ID NO: 3360586 - RNA, 21 nt, Human
ugccugcuuuuuauggccugu

SEQ ID NO: 3360587 - RNA, 20 nt, Human
ugccugcuuuuuauggccug

SEQ ID NO: 3360588 - RNA, 15 nt, Human
ugccuugucacgcca

SEQ ID NO: 3360589 - RNA, 16 nt, Human
ugccuuggugugcugu

SEQ ID NO: 3360590 - RNA, 20 nt, Human
ugcuaauuuugaaaaacugc

SEQ ID NO: 3360591 - RNA, 19 nt, Human
ugcuaauuuugaaaaacug

SEQ ID NO: 3360592 - RNA, 18 nt, Human
ugcuaauuuugaaaaacu

SEQ ID NO: 3360593 - RNA, 16 nt, Human
ugcuaauuuugaaaaa

SEQ ID NO: 3360594 - RNA, 21 nt, Human
agcuuuggcuaugagggccuu

SEQ ID NO: 3360595 - RNA, 20 nt, Human
agcuuuggcuaugagggccu

SEQ ID NO: 3360596 - RNA, 22 nt, Human
agcuuugagguggaagagggcu

SEQ ID NO: 3360597 - RNA, 22 nt, Human
ugcuaugagcuggggaugucuc

SEQ ID NO: 3360598 - RNA, 19 nt, Human
ugcuaugagcuggggaugu

SEQ ID NO: 3360599 - RNA, 20 nt, Human
ugcuaugagcuggggauguc

SEQ ID NO: 3360600 - RNA, 16 nt, Human
ugcuaugagcugggga

SEQ ID NO: 3360601 - RNA, 17 nt, Human
uggacuguucccugagg

SEQ ID NO: 3360602 - RNA, 16 nt, Human
uggacuguucccugag

SEQ ID NO: 3360603 - RNA, 15 nt, Human
uggagcaaagcugau

SEQ ID NO: 3360604 - RNA, 14 nt, Human
uggaguugaaaauc

SEQ ID NO: 3360605 - RNA, 16 nt, Human
uggauucugagagcug

SEQ ID NO: 3360606 - RNA, 17 nt, Human
uggauucugagagcugu

SEQ ID NO: 3360607 - RNA, 17 nt, Human
aggagaguagaacagau

SEQ ID NO: 3360608 - RNA, 23 nt, Human
aggagcccugggaggcucuggag

SEQ ID NO: 3360609 - RNA, 15 nt, Human
uggaagagggcugca

SEQ ID NO: 3360610 - RNA, 16 nt, Human
ugcuuuuuauggccug

SEQ ID NO: 3360611 - RNA, 21 nt, Human
uguagugauuuuuaugccacc

SEQ ID NO: 3360612 - RNA, 19 nt, Human
agguuuuuguagugauuuu

SEQ ID NO: 3360613 - RNA, 13 nt, Human
aguaaaauccaca

SEQ ID NO: 3360614 - RNA, 14 nt, Human
aguaauagagcaaa

SEQ ID NO: 3360615 - RNA, 13 nt, Human
aguaauagagcaa

SEQ ID NO: 3360616 - RNA, 23 nt, Human
agguuuguuuagaagaagugugu

SEQ ID NO: 3360617 - RNA, 23 nt, Human
uguacuugcucuugaugccuggc

SEQ ID NO: 3360618 - RNA, 22 nt, Human
uguacuugcucuugaugccugg

SEQ ID NO: 3360619 - RNA, 19 nt, Human
uguacuugcucuugaugcc

SEQ ID NO: 3360620 - RNA, 12 nt, Human
uguauguggggg

SEQ ID NO: 3360621 - RNA, 22 nt, Human
uguauucuagcuaauguaauaa

SEQ ID NO: 3360622 - RNA, 20 nt, Human
uguauucuagcuaauguaau

SEQ ID NO: 3360623 - RNA, 13 nt, Human
uguauuacaaauc

SEQ ID NO: 3360624 - RNA, 16 nt, Human
aguaguaauagagcaa

SEQ ID NO: 3360625 - RNA, 16 nt, Human
uguaaauaguauuuga

SEQ ID NO: 3360626 - RNA, 17 nt, Human
uguaaauaaaggaacca

SEQ ID NO: 3360627 - RNA, 16 nt, Human
uguaaaggaauuuaaa

SEQ ID NO: 3360628 - RNA, 20 nt, Human
aggugcauauuuauaaaaau

SEQ ID NO: 3360629 - RNA, 18 nt, Human
aggugcccagaaugaggc

SEQ ID NO: 3360630 - RNA, 22 nt, Human
aggugcccagaaugaggcugcu

SEQ ID NO: 3360631 - RNA, 21 nt, Human
aggguggggggggggcgcggc

SEQ ID NO: 3360632 - RNA, 18 nt, Human
ugggucgcccuggacugu

SEQ ID NO: 3360633 - RNA, 16 nt, Human
ugggucgcccuggacu

SEQ ID NO: 3360634 - RNA, 13 nt, Human
uggggagagacgg

SEQ ID NO: 3360635 - RNA, 14 nt, Human
uggggagggauuug

SEQ ID NO: 3360636 - RNA, 15 nt, Human
uggggcucagagugg

SEQ ID NO: 3360637 - RNA, 22 nt, Human
uggggagggauuuggggcucag

SEQ ID NO: 3360638 - RNA, 23 nt, Human
agggaaggaucccaugagcuccu

SEQ ID NO: 3360639 - RNA, 15 nt, Human
agggaaggaucccau

SEQ ID NO: 3360640 - RNA, 22 nt, Human
agggaaggaucccaugagcucc

SEQ ID NO: 3360641 - RNA, 13 nt, Human
agggaaauuucag

SEQ ID NO: 3360642 - RNA, 22 nt, Human
aggcccuaucuguuuacagugu

SEQ ID NO: 3360643 - RNA, 19 nt, Human
ugggagaaugucaguaugu

SEQ ID NO: 3360644 - RNA, 20 nt, Human
ugggagaaugucaguaugug

SEQ ID NO: 3360645 - RNA, 22 nt, Human
ugggagaaugucaguaugugga

SEQ ID NO: 3360646 - RNA, 15 nt, Human
ugggccccugccaga

SEQ ID NO: 3360647 - RNA, 19 nt, Human
ugggccccugccucucugc

SEQ ID NO: 3360648 - RNA, 15 nt, Human
ugggccccugccucu

SEQ ID NO: 3360649 - RNA, 12 nt, Human
aguucugccagg

SEQ ID NO: 3360650 - RNA, 13 nt, Human
aguucugccagga

SEQ ID NO: 3360651 - RNA, 14 nt, Human
aguucugccaggag

SEQ ID NO: 3360652 - RNA, 20 nt, Human
aguucugccaggagacaggu

SEQ ID NO: 3360653 - RNA, 19 nt, Human
uguuuugaaucucauaauu

SEQ ID NO: 3360654 - RNA, 16 nt, Human
uguuuaugugugugug

SEQ ID NO: 3360655 - RNA, 13 nt, Human
uguuuaugugugu

SEQ ID NO: 3360656 - RNA, 19 nt, Human
uguugccuugcauaauggu

SEQ ID NO: 3360657 - RNA, 24 nt, Human
uguuuauuuauagaguguacuuaa

SEQ ID NO: 3360658 - RNA, 14 nt, Human
uguuuauuuauaga

SEQ ID NO: 3360659 - RNA, 19 nt, Human
uguuucuuuguaaugaaaa

SEQ ID NO: 3360660 - RNA, 18 nt, Human
uguuucuuuguaaugaaa

SEQ ID NO: 3360661 - RNA, 12 nt, Human
aguuuagggugg

SEQ ID NO: 3360662 - RNA, 13 nt, Human
aguuuaggguggg

SEQ ID NO: 3360663 - RNA, 14 nt, Human
aguuuagggugggg

SEQ ID NO: 3360664 - RNA, 13 nt, Human
uuaaaauugugau

SEQ ID NO: 3360665 - RNA, 18 nt, Human
uuaaaauugugauguguc

SEQ ID NO: 3360666 - RNA, 16 nt, Human
uuagaagaaguguguc

SEQ ID NO: 3360667 - RNA, 14 nt, Human
uuagaagaagugug

SEQ ID NO: 3360668 - RNA, 15 nt, Human
uuagaagaagugugu

SEQ ID NO: 3360669 - RNA, 22 nt, Human
auaaauauuauauuauauauau

SEQ ID NO: 3360670 - RNA, 12 nt, Human
auaaauauuaua

SEQ ID NO: 3360671 - RNA, 17 nt, Human
uuaauuccaauuauaug

SEQ ID NO: 3360672 - RNA, 13 nt, Human
uuaauaaacacuc

SEQ ID NO: 3360673 - RNA, 17 nt, Human
uuaauaaacacucuuga

SEQ ID NO: 3360674 - RNA, 22 nt, Human
auaaaauucuauuacaguaugu

SEQ ID NO: 3360675 - RNA, 20 nt, Human
auaaaauuuuuaaucuuuaa

SEQ ID NO: 3360676 - RNA, 18 nt, Human
uuaaguaaggaauuuuau

SEQ ID NO: 3360677 - RNA, 22 nt, Human
auaaaagggacugagaaauuua

SEQ ID NO: 3360678 - RNA, 12 nt, Human
ugugacucuuuc

SEQ ID NO: 3360679 - RNA, 14 nt, Human
ugugacucuuucca

SEQ ID NO: 3360680 - RNA, 15 nt, Human
ugugaacagcggcug

SEQ ID NO: 3360681 - RNA, 12 nt, Human
ugugaaauuauu

SEQ ID NO: 3360682 - RNA, 18 nt, Human
agucacuaccuucaugca

SEQ ID NO: 3360683 - RNA, 15 nt, Human
ugugacucuuuccaa

SEQ ID NO: 3360684 - RNA, 17 nt, Human
ugugacucuuuccaacc

SEQ ID NO: 3360685 - RNA, 18 nt, Human
agucuuucacauuuaaau

SEQ ID NO: 3360686 - RNA, 19 nt, Human
uguggcauccagagucccu

SEQ ID NO: 3360687 - RNA, 21 nt, Human
uguggcauccagagucccugc

SEQ ID NO: 3360688 - RNA, 16 nt, Human
uguggcauccagaguc

SEQ ID NO: 3360689 - RNA, 23 nt, Human
uguggcaguuuggcaaacucucc

SEQ ID NO: 3360690 - RNA, 14 nt, Human
ugugauguauucua

SEQ ID NO: 3360691 - RNA, 15 nt, Human
agugaaagaaaauaa

SEQ ID NO: 3360692 - RNA, 18 nt, Human
ugugccagauuuaugcau

SEQ ID NO: 3360693 - RNA, 20 nt, Human
ugugccagauuuaugcauau

SEQ ID NO: 3360694 - RNA, 14 nt, Human
ugugcccacccucc

SEQ ID NO: 3360695 - RNA, 23 nt, Human
ugugcccacccuccacucuccuc

SEQ ID NO: 3360696 - RNA, 20 nt, Human
ugugggucugugugugugua

SEQ ID NO: 3360697 - RNA, 12 nt, Human
ugugugugggag

SEQ ID NO: 3360698 - RNA, 20 nt, Human
ugugugugggaguguguaau

SEQ ID NO: 3360699 - RNA, 14 nt, Human
uguguguguaugug

SEQ ID NO: 3360700 - RNA, 19 nt, Human
uguguuaaguauguguaaa

SEQ ID NO: 3360701 - RNA, 16 nt, Human
uguuaaguauguguaa

SEQ ID NO: 3360702 - RNA, 15 nt, Human
uguuaaguaugugua

SEQ ID NO: 3360703 - RNA, 17 nt, Human
aguguacuuaacuauuc

SEQ ID NO: 3360704 - RNA, 14 nt, Human
agugugucuaaauu

SEQ ID NO: 3360705 - RNA, 21 nt, Human
uguuccgugguuaaacucgcu

SEQ ID NO: 3360706 - RNA, 18 nt, Human
uguucugugauauaagug

SEQ ID NO: 3360707 - RNA, 15 nt, Human
uguucugugauauaa

SEQ ID NO: 3360708 - RNA, 21 nt, Human
uccaaccggcuuuguggcacu

SEQ ID NO: 3360709 - RNA, 14 nt, Human
uccacucaugugac

SEQ ID NO: 3360710 - RNA, 21 nt, Human
uccacucaugugacucuuucc

SEQ ID NO: 3360711 - RNA, 15 nt, Human
uccacuccuccuagc

SEQ ID NO: 3360712 - RNA, 18 nt, Human
uccacuccuccuagccac

SEQ ID NO: 3360713 - RNA, 18 nt, Human
uccacuggggauugggcc

SEQ ID NO: 3360714 - RNA, 14 nt, Human
acgagaaaacaaua

SEQ ID NO: 3360715 - RNA, 19 nt, Human
acgagaucaagagaucaag

SEQ ID NO: 3360716 - RNA, 18 nt, Human
uccaggccagggggccag

SEQ ID NO: 3360717 - RNA, 16 nt, Human
uccaggccagggggcc

SEQ ID NO: 3360718 - RNA, 19 nt, Human
accucaaaaugucuaagau

SEQ ID NO: 3360719 - RNA, 16 nt, Human
accucaaaaugucuaa

SEQ ID NO: 3360720 - RNA, 14 nt, Human
ucaucuaggauuuu

SEQ ID NO: 3360721 - RNA, 18 nt, Human
ucaucuagguaaauuaca

SEQ ID NO: 3360722 - RNA, 18 nt, Human
acucaugugacucuuucc

SEQ ID NO: 3360723 - RNA, 19 nt, Human
acucaugugacucuuucca

SEQ ID NO: 3360724 - RNA, 14 nt, Human
acuccuccuagcca

SEQ ID NO: 3360725 - RNA, 13 nt, Human
acuccuccuagcc

SEQ ID NO: 3360726 - RNA, 15 nt, Human
acuccuccuagccac

SEQ ID NO: 3360727 - RNA, 16 nt, Human
acuccuccuagccacc

SEQ ID NO: 3360728 - RNA, 18 nt, Human
acuccuccuagccaccca

SEQ ID NO: 3360729 - RNA, 19 nt, Human
acuccagccuggcgacaga

SEQ ID NO: 3360730 - RNA, 19 nt, Human
ucccuuucugcuuguguua

SEQ ID NO: 3360731 - RNA, 19 nt, Human
uccuaaauauauuuuaaga

SEQ ID NO: 3360732 - RNA, 20 nt, Human
ucccugaggcagguccccag

SEQ ID NO: 3360733 - RNA, 21 nt, Human
ucccugaggcagguccccaga

SEQ ID NO: 3360734 - RNA, 22 nt, Human
ucccugaggcagguccccagac

SEQ ID NO: 3360735 - RNA, 11 nt, Human
ucccugaggca

SEQ ID NO: 3360736 - RNA, 20 nt, Human
ucccugaaggaaccaaagcg

SEQ ID NO: 3360737 - RNA, 14 nt, Human
acuacuagggaaau

SEQ ID NO: 3360738 - RNA, 21 nt, Human
acuacuagggaaaugccuuug

SEQ ID NO: 3360739 - RNA, 22 nt, Human
acguauaaaagccuguuuaaga

SEQ ID NO: 3360740 - RNA, 20 nt, Human
acauaucuaguaugaaauua

SEQ ID NO: 3360741 - RNA, 22 nt, Human
acauaucuaguaugaaauuaua

SEQ ID NO: 3360742 - RNA, 23 nt, Human
acauaucuaguaugaaauuauau

SEQ ID NO: 3360743 - RNA, 17 nt, Human
acauaucuaguaugaaa

SEQ ID NO: 3360744 - RNA, 22 nt, Human
uauuucccugaaggaaccaaag

SEQ ID NO: 3360745 - RNA, 21 nt, Human
uauuuccauuaaaaaaucagu

SEQ ID NO: 3360746 - RNA, 16 nt, Human
acauaaaaacaacuuu

SEQ ID NO: 3360747 - RNA, 19 nt, Human
acauaaaaacaacuuuaua

SEQ ID NO: 3360748 - RNA, 21 nt, Human
acauaaaaacaacuuuauacc

SEQ ID NO: 3360749 - RNA, 17 nt, Human
ucaaagggugaaaauua

SEQ ID NO: 3360750 - RNA, 14 nt, Human
ucaaagcugaaaug

SEQ ID NO: 3360751 - RNA, 19 nt, Human
uauuuuugacagaauaugu

SEQ ID NO: 3360752 - RNA, 23 nt, Human
uauuuuugacagaauauguuuca

SEQ ID NO: 3360753 - RNA, 14 nt, Human
uauuuuugacagaa

SEQ ID NO: 3360754 - RNA, 15 nt, Human
uauuuuugacagaau

SEQ ID NO: 3360755 - RNA, 13 nt, Human
uauuuuugacaga

SEQ ID NO: 3360756 - RNA, 17 nt, Human
uauuuguaaauuuaugu

SEQ ID NO: 3360757 - RNA, 22 nt, Human
uauuuguaaauuuaugugaugg

SEQ ID NO: 3360758 - RNA, 16 nt, Human
uauuuguaaauuuaug

SEQ ID NO: 3360759 - RNA, 14 nt, Human
ucaaaaugucuaag

SEQ ID NO: 3360760 - RNA, 19 nt, Human
ucaaaauuguuacaaauug

SEQ ID NO: 3360761 - RNA, 16 nt, Human
ucaaaauuguuacaaa

SEQ ID NO: 3360762 - RNA, 17 nt, Human
ucaagaaaacaacuuca

SEQ ID NO: 3360763 - RNA, 23 nt, Human
accauuucuugagguaaaagcau

SEQ ID NO: 3360764 - RNA, 13 nt, Human
ucacucuuggagc

SEQ ID NO: 3360765 - RNA, 21 nt, Human
ucagcccaaaccaccagaagc

SEQ ID NO: 3360766 - RNA, 22 nt, Human
ucagcccaaaccaccagaagcc

SEQ ID NO: 3360767 - RNA, 22 nt, Human
accccagcuggggccaggcugg

SEQ ID NO: 3360768 - RNA, 23 nt, Human
accccagcuggggccaggcuggg

SEQ ID NO: 3360769 - RNA, 17 nt, Human
ucacauaucuaguauga

SEQ ID NO: 3360770 - RNA, 21 nt, Human
ucacauaucuaguaugaaauu

SEQ ID NO: 3360771 - RNA, 22 nt, Human
ucacauaucuaguaugaaauua

SEQ ID NO: 3360772 - RNA, 14 nt, Human
ucacauaucuagua

SEQ ID NO: 3360773 - RNA, 19 nt, Human
ucacaccuguaaucccaac

SEQ ID NO: 3360774 - RNA, 15 nt, Human
ucaauucuugccaaa

SEQ ID NO: 3360775 - RNA, 22 nt, Human
accacacguaaugaaacuugga

SEQ ID NO: 3360776 - RNA, 17 nt, Human
ucacuaccuucaugcau

SEQ ID NO: 3360777 - RNA, 14 nt, Human
accagaagcccaga

SEQ ID NO: 3360778 - RNA, 16 nt, Human
accagaagcccagaau

SEQ ID NO: 3360779 - RNA, 13 nt, Human
accagaagcccag

SEQ ID NO: 3360780 - RNA, 14 nt, Human
ucugagagaggcca

SEQ ID NO: 3360781 - RNA, 20 nt, Human
ucugagagaggccauucuuu

SEQ ID NO: 3360782 - RNA, 16 nt, Human
ucugacuaugacauaa

SEQ ID NO: 3360783 - RNA, 14 nt, Human
ucugacuaugacau

SEQ ID NO: 3360784 - RNA, 15 nt, Human
ucugcaggucccuaa

SEQ ID NO: 3360785 - RNA, 17 nt, Human
ucugcaggucccuaaua

SEQ ID NO: 3360786 - RNA, 16 nt, Human
ucugcaggucccuaau

SEQ ID NO: 3360787 - RNA, 21 nt, Human
agaaauuaugugccagauuua

SEQ ID NO: 3360788 - RNA, 13 nt, Human
agaaauuaugugc

SEQ ID NO: 3360789 - RNA, 18 nt, Human
ucugcaggucccuaauaa

SEQ ID NO: 3360790 - RNA, 14 nt, Human
ucugcaggucccua

SEQ ID NO: 3360791 - RNA, 12 nt, Human
agaaauuaugug

SEQ ID NO: 3360792 - RNA, 17 nt, Human
agaaauuuauaaacuuu

SEQ ID NO: 3360793 - RNA, 16 nt, Human
agaaauuuauaaacuu

SEQ ID NO: 3360794 - RNA, 22 nt, Human
agaaauuaugugccagauuuau

SEQ ID NO: 3360795 - RNA, 17 nt, Human
agaaaucaaagagagaa

SEQ ID NO: 3360796 - RNA, 12 nt, Human
agaaaucuaaaa

SEQ ID NO: 3360797 - RNA, 17 nt, Human
agaaaugaaaaaauaua

SEQ ID NO: 3360798 - RNA, 16 nt, Human
agaaaugaaaaaauau

SEQ ID NO: 3360799 - RNA, 23 nt, Human
agaaaugaaaaaauauauaucaa

SEQ ID NO: 3360800 - RNA, 18 nt, Human
agaaaugaaaaaauauau

SEQ ID NO: 3360801 - RNA, 19 nt, Human
ucucuggaauuugaaacac

SEQ ID NO: 3360802 - RNA, 15 nt, Human
ucucuggaauuugaa

SEQ ID NO: 3360803 - RNA, 20 nt, Human
agaaaaagcaauaaccucaa

SEQ ID NO: 3360804 - RNA, 19 nt, Human
agaaaacuuguauuaugug

SEQ ID NO: 3360805 - RNA, 21 nt, Human
agaaaacuuguauuaugugug

SEQ ID NO: 3360806 - RNA, 16 nt, Human
ucucauuccagaggaa

SEQ ID NO: 3360807 - RNA, 18 nt, Human
ucgagaucccaacacugc

SEQ ID NO: 3360808 - RNA, 21 nt, Human
ucgagaucccaacacugccag

SEQ ID NO: 3360809 - RNA, 17 nt, Human
ucgagaucccaacacug

SEQ ID NO: 3360810 - RNA, 22 nt, Human
uccuuucuaacaaaaaaauaua

SEQ ID NO: 3360811 - RNA, 23 nt, Human
acuggccaguggcuggaucugug

SEQ ID NO: 3360812 - RNA, 21 nt, Human
acugccuauuuuaauaaacac

SEQ ID NO: 3360813 - RNA, 16 nt, Human
acugccuauuuuaaua

SEQ ID NO: 3360814 - RNA, 16 nt, Human
acugcuaagaauauuu

SEQ ID NO: 3360815 - RNA, 18 nt, Human
acugcuaagaauauuuga

SEQ ID NO: 3360816 - RNA, 22 nt, Human
ucguuuucaaaauuguuacaaa

SEQ ID NO: 3360817 - RNA, 16 nt, Human
ucguaaaauuaagaaa

SEQ ID NO: 3360818 - RNA, 13 nt, Human
ucguaaaauuaag

SEQ ID NO: 3360819 - RNA, 16 nt, Human
acugggagaaaugaaa

SEQ ID NO: 3360820 - RNA, 12 nt, Human
acugugugcuca

SEQ ID NO: 3360821 - RNA, 21 nt, Human
acugugugcucaggagcccug

SEQ ID NO: 3360822 - RNA, 20 nt, Human
acugugugcucaggagcccu

SEQ ID NO: 3360823 - RNA, 19 nt, Human
acugugugcucaggagccc

SEQ ID NO: 3360824 - RNA, 15 nt, Human
acugugugcucagga

SEQ ID NO: 3360825 - RNA, 20 nt, Human
ucuaaagccauuguaguccu

SEQ ID NO: 3360826 - RNA, 20 nt, Human
ucuacauaaguaauucaaga

SEQ ID NO: 3360827 - RNA, 17 nt, Human
ucuacauaaguaauuca

SEQ ID NO: 3360828 - RNA, 16 nt, Human
acuguucccugaggug

SEQ ID NO: 3360829 - RNA, 19 nt, Human
acuguucccugagguggga

SEQ ID NO: 3360830 - RNA, 22 nt, Human
ucuacauaaguaauucaagaaa

SEQ ID NO: 3360831 - RNA, 21 nt, Human
agaggccauucuuucccaaca

SEQ ID NO: 3360832 - RNA, 22 nt, Human
agaguaauccaagcaaauguga

SEQ ID NO: 3360833 - RNA, 21 nt, Human
ugaacuaggauuguaguccca

SEQ ID NO: 3360834 - RNA, 14 nt, Human
agagcugcgggcug

SEQ ID NO: 3360835 - RNA, 11 nt, Human
ugaaagugacu

SEQ ID NO: 3360836 - RNA, 15 nt, Human
ugaaauuguauuaca

SEQ ID NO: 3360837 - RNA, 14 nt, Human
agagcaaaauugau

SEQ ID NO: 3360838 - RNA, 16 nt, Human
agagcagugggccugg

SEQ ID NO: 3360839 - RNA, 23 nt, Human
agaguccaucagccuccauccua

SEQ ID NO: 3360840 - RNA, 14 nt, Human
agagucccugccug

SEQ ID NO: 3360841 - RNA, 17 nt, Human
agagucccugccuggac

SEQ ID NO: 3360842 - RNA, 20 nt, Human
agaguugaugguuguacaua

SEQ ID NO: 3360843 - RNA, 14 nt, Human
agauaaauauuaua

SEQ ID NO: 3360844 - RNA, 12 nt, Human
agauaaauauua

SEQ ID NO: 3360845 - RNA, 17 nt, Human
agauaaagguucaugca

SEQ ID NO: 3360846 - RNA, 18 nt, Human
agaucccaacacugccag

SEQ ID NO: 3360847 - RNA, 19 nt, Human
agaucccaacacugccagc

SEQ ID NO: 3360848 - RNA, 20 nt, Human
agaucccaacacugccagca

SEQ ID NO: 3360849 - RNA, 22 nt, Human
agauguggaaaagccaagaggc

SEQ ID NO: 3360850 - RNA, 17 nt, Human
agauguggaaaagccaa

SEQ ID NO: 3360851 - RNA, 18 nt, Human
ugacauaaaaacaacuuu

SEQ ID NO: 3360852 - RNA, 20 nt, Human
ugacauaaaaacaacuuuau

SEQ ID NO: 3360853 - RNA, 17 nt, Human
ugacauaaaaacaacuu

SEQ ID NO: 3360854 - RNA, 13 nt, Human
ucuuucuuccaaa

SEQ ID NO: 3360855 - RNA, 17 nt, Human
ucuugguuccagccugc

SEQ ID NO: 3360856 - RNA, 18 nt, Human
ucuugguuccagccugcc

SEQ ID NO: 3360857 - RNA, 19 nt, Human
ucuugguuccagccugcca

SEQ ID NO: 3360858 - RNA, 13 nt, Human
ucuugguuccagc

SEQ ID NO: 3360859 - RNA, 14 nt, Human
ucuuuaauuuuaca

SEQ ID NO: 3360860 - RNA, 19 nt, Human
agacuucccacggcuccuc

SEQ ID NO: 3360861 - RNA, 21 nt, Human
agacugucagcuuccaaacau

SEQ ID NO: 3360862 - RNA, 19 nt, Human
agagaauuguuugaacccg

SEQ ID NO: 3360863 - RNA, 21 nt, Human
agacauuugcuaugagcuggg

SEQ ID NO: 3360864 - RNA, 15 nt, Human
agaaugucaguaugu

SEQ ID NO: 3360865 - RNA, 16 nt, Human
agaaugucaguaugug

SEQ ID NO: 3360866 - RNA, 13 nt, Human
agaaugucaguau

SEQ ID NO: 3360867 - RNA, 22 nt, Human
agaaccccuggcuccaggccag

SEQ ID NO: 3360868 - RNA, 17 nt, Human
agaaugucaguaugugg

SEQ ID NO: 3360869 - RNA, 19 nt, Human
agaaugucaguauguggaa

SEQ ID NO: 3360870 - RNA, 20 nt, Human
agacacaacuauuuuuccaa

SEQ ID NO: 3360871 - RNA, 19 nt, Human
agacacaacuauuuuucca

SEQ ID NO: 3360872 - RNA, 12 nt, Human
agacagaaaaaa

SEQ ID NO: 3360873 - RNA, 19 nt, Human
ucuuacugucuuuuuucua

SEQ ID NO: 3360874 - RNA, 12 nt, Human
aacacugccagc

SEQ ID NO: 3360875 - RNA, 22 nt, Human
aacacugccagcauuucccuuc

SEQ ID NO: 3360876 - RNA, 14 nt, Human
aacaaugaagauaa

SEQ ID NO: 3360877 - RNA, 18 nt, Human
aacaaugaagauaaaaag

SEQ ID NO: 3360878 - RNA, 21 nt, Human
aacaagccuccuuuuaaagua

SEQ ID NO: 3360879 - RNA, 23 nt, Human
aaauuuuuaaucuuuaauuuuac

SEQ ID NO: 3360880 - RNA, 20 nt, Human
aacauuuguucuauagcuuu

SEQ ID NO: 3360881 - RNA, 12 nt, Human
gucucccuccuc

SEQ ID NO: 3360882 - RNA, 16 nt, Human
gucucccuccucugcc

SEQ ID NO: 3360883 - RNA, 19 nt, Human
aaccaaagcgaauuuuaaa

SEQ ID NO: 3360884 - RNA, 17 nt, Human
aaccucaaaaugucuaa

SEQ ID NO: 3360885 - RNA, 15 nt, Human
aaccucaaagugacu

SEQ ID NO: 3360886 - RNA, 19 nt, Human
aacucgugucuggcacagc

SEQ ID NO: 3360887 - RNA, 12 nt, Human
gucuggcugcag

SEQ ID NO: 3360888 - RNA, 13 nt, Human
gucuggcugcaga

SEQ ID NO: 3360889 - RNA, 14 nt, Human
gucuggcugcagag

SEQ ID NO: 3360890 - RNA, 9 nt, Human
aaaugaggg

SEQ ID NO: 3360891 - RNA, 14 nt, Human
aaaugagaaaucua

SEQ ID NO: 3360892 - RNA, 13 nt, Human
aaaugagaaaucu

SEQ ID NO: 3360893 - RNA, 16 nt, Human
aaaugagaaaucuaaa

SEQ ID NO: 3360894 - RNA, 11 nt, Human
aaaugagaaau

SEQ ID NO: 3360895 - RNA, 14 nt, Human
aaaugcauuucuaa

SEQ ID NO: 3360896 - RNA, 13 nt, Human
aaaugcauguugc

SEQ ID NO: 3360897 - RNA, 14 nt, Human
aaaugaaaaaauau

SEQ ID NO: 3360898 - RNA, 14 nt, Human
aaaucuaugauucc

SEQ ID NO: 3360899 - RNA, 16 nt, Human
aaaucuaugauuccag

SEQ ID NO: 3360900 - RNA, 16 nt, Human
guaggaacugcugggc

SEQ ID NO: 3360901 - RNA, 13 nt, Human
guaggauuacuag

SEQ ID NO: 3360902 - RNA, 18 nt, Human
guauguggaagugugggu

SEQ ID NO: 3360903 - RNA, 21 nt, Human
guauguggaagugugggucug

SEQ ID NO: 3360904 - RNA, 19 nt, Human
guaugugggggucugugug

SEQ ID NO: 3360905 - RNA, 20 nt, Human
guaugugggggucugugugu

SEQ ID NO: 3360906 - RNA, 16 nt, Human
guauguggaagugugg

SEQ ID NO: 3360907 - RNA, 17 nt, Human
guauguggaaguguggg

SEQ ID NO: 3360908 - RNA, 15 nt, Human
guauguggaagugug

SEQ ID NO: 3360909 - RNA, 17 nt, Human
guauaaaagccuguuua

SEQ ID NO: 3360910 - RNA, 22 nt, Human
guauauugauccagaaagaaaa

SEQ ID NO: 3360911 - RNA, 21 nt, Human
guauaaaagccuguuuaagag

SEQ ID NO: 3360912 - RNA, 18 nt, Human
guauaaaagccuguuuaa

SEQ ID NO: 3360913 - RNA, 20 nt, Human
aaauuauuuuguucauacau

SEQ ID NO: 3360914 - RNA, 21 nt, Human
aaauuauuuuguucauacaua

SEQ ID NO: 3360915 - RNA, 22 nt, Human
aaauuauuuuguucauacauau

SEQ ID NO: 3360916 - RNA, 16 nt, Human
aaauuauauaaguauu

SEQ ID NO: 3360917 - RNA, 18 nt, Human
aaauuauauaaguauucu

SEQ ID NO: 3360918 - RNA, 17 nt, Human
aaauuauuuuguucaua

SEQ ID NO: 3360919 - RNA, 19 nt, Human
aaauuauuuuguucauaca

SEQ ID NO: 3360920 - RNA, 22 nt, Human
aaauuauauaaguauucuaaau

SEQ ID NO: 3360921 - RNA, 16 nt, Human
guauuuaauucauguu

SEQ ID NO: 3360922 - RNA, 20 nt, Human
guauuuuugacagaauaugu

SEQ ID NO: 3360923 - RNA, 16 nt, Human
guauuuuugacagaau

SEQ ID NO: 3360924 - RNA, 17 nt, Human
aaauuucagcagcugca

SEQ ID NO: 3360925 - RNA, 18 nt, Human
aaauuucagcagcugcag

SEQ ID NO: 3360926 - RNA, 14 nt, Human
gugguggcucggga

SEQ ID NO: 3360927 - RNA, 13 nt, Human
gugggucugugug

SEQ ID NO: 3360928 - RNA, 16 nt, Human
gugggucugugugugu

SEQ ID NO: 3360929 - RNA, 16 nt, Human
guggggggcuucauac

SEQ ID NO: 3360930 - RNA, 15 nt, Human
guggggggcuucaua

SEQ ID NO: 3360931 - RNA, 13 nt, Human
gugggagugugua

SEQ ID NO: 3360932 - RNA, 14 nt, Human
gugggaguguguaa

SEQ ID NO: 3360933 - RNA, 14 nt, Human
guguguaauuuaaa

SEQ ID NO: 3360934 - RNA, 17 nt, Human
gugucuuuccacuccuc

SEQ ID NO: 3360935 - RNA, 18 nt, Human
guguuuccauauuuuaua

SEQ ID NO: 3360936 - RNA, 13 nt, Human
guguuuauuuaua

SEQ ID NO: 3360937 - RNA, 20 nt, Human
aagaauugucuuucugucuc

SEQ ID NO: 3360938 - RNA, 23 nt, Human
gugcuauuguagagccagagguc

SEQ ID NO: 3360939 - RNA, 15 nt, Human
gugcucaggagcccu

SEQ ID NO: 3360940 - RNA, 14 nt, Human
guggaagugugggu

SEQ ID NO: 3360941 - RNA, 15 nt, Human
guggaaguguggguc

SEQ ID NO: 3360942 - RNA, 19 nt, Human
guggaagugugggucugug

SEQ ID NO: 3360943 - RNA, 20 nt, Human
guggaagugugggucugugu

SEQ ID NO: 3360944 - RNA, 21 nt, Human
guggaagugugggucugugug

SEQ ID NO: 3360945 - RNA, 22 nt, Human
guggaagugugggucugugugu

SEQ ID NO: 3360946 - RNA, 16 nt, Human
guggaauuauuuuaaa

SEQ ID NO: 3360947 - RNA, 18 nt, Human
guggaauuauuuuaaaag

SEQ ID NO: 3360948 - RNA, 15 nt, Human
guggaauuauuuuaa

SEQ ID NO: 3360949 - RNA, 13 nt, Human
aagaaauauaccu

SEQ ID NO: 3360950 - RNA, 15 nt, Human
aacuuguauuaugug

SEQ ID NO: 3360951 - RNA, 16 nt, Human
aacuuguauuaugugu

SEQ ID NO: 3360952 - RNA, 16 nt, Human
guuuucuuaacuuaaa

SEQ ID NO: 3360953 - RNA, 20 nt, Human
guuuucuuaaccagaucauu

SEQ ID NO: 3360954 - RNA, 22 nt, Human
guuugggaccccuggugguuca

SEQ ID NO: 3360955 - RNA, 16 nt, Human
guuugggaccccuggu

SEQ ID NO: 3360956 - RNA, 19 nt, Human
guuugcaucugaaaauuga

SEQ ID NO: 3360957 - RNA, 21 nt, Human
aagggguaggauuacuaggug

SEQ ID NO: 3360958 - RNA, 20 nt, Human
aaguaaaaacaaagaaauua

SEQ ID NO: 3360959 - RNA, 13 nt, Human
aaguaaaaacaaa

SEQ ID NO: 3360960 - RNA, 23 nt, Human
aaggcuauggggauagaugugug

SEQ ID NO: 3360961 - RNA, 18 nt, Human
guuguaucagcacgugug

SEQ ID NO: 3360962 - RNA, 13 nt, Human
guuuaugugugug

SEQ ID NO: 3360963 - RNA, 16 nt, Human
guuuaugugugugugu

SEQ ID NO: 3360964 - RNA, 14 nt, Human
guuaaguaugugua

SEQ ID NO: 3360965 - RNA, 18 nt, Human
guguuuuaaaaugagaaa

SEQ ID NO: 3360966 - RNA, 11 nt, Human
guucauacauu

SEQ ID NO: 3360967 - RNA, 14 nt, Human
guucauacauugua

SEQ ID NO: 3360968 - RNA, 15 nt, Human
aagccucgacacaga

SEQ ID NO: 3360969 - RNA, 15 nt, Human
aagccuggucagccc

SEQ ID NO: 3360970 - RNA, 10 nt, Human
guucauacau

SEQ ID NO: 3360971 - RNA, 13 nt, Human
guucauacauauu

SEQ ID NO: 3360972 - RNA, 14 nt, Human
guucauacauauuu

SEQ ID NO: 3360973 - RNA, 23 nt, Human
guucauacauauuuuuguagcac

SEQ ID NO: 3360974 - RNA, 9 nt, Human
guucauaca

SEQ ID NO: 3360975 - RNA, 18 nt, Human
guucuagcauggcauauu

SEQ ID NO: 3360976 - RNA, 17 nt, Human
aagcuaucguaaaauua

SEQ ID NO: 3360977 - RNA, 17 nt, Human
acaccccgacuuuuguu

SEQ ID NO: 3360978 - RNA, 21 nt, Human
uauaaaaauaaaaaacacugg

SEQ ID NO: 3360979 - RNA, 20 nt, Human
uauaaaaauaaaaaacacug

SEQ ID NO: 3360980 - RNA, 20 nt, Human
uaguaauagagcaaaauuga

SEQ ID NO: 3360981 - RNA, 13 nt, Human
uaguguucauaaa

SEQ ID NO: 3360982 - RNA, 14 nt, Human
uaguaauagagcaa

SEQ ID NO: 3360983 - RNA, 18 nt, Human
acacaacuauuuuuccaa

SEQ ID NO: 3360984 - RNA, 16 nt, Human
acacucacccaacaau

SEQ ID NO: 3360985 - RNA, 16 nt, Human
uauaaguauucuaaau

SEQ ID NO: 3360986 - RNA, 14 nt, Human
acacuguucugaaa

SEQ ID NO: 3360987 - RNA, 20 nt, Human
acacuguucugaaagugacu

SEQ ID NO: 3360988 - RNA, 12 nt, Human
uauauuuacaaa

SEQ ID NO: 3360989 - RNA, 15 nt, Human
uauauuuaaugauaa

SEQ ID NO: 3360990 - RNA, 14 nt, Human
acagauaaucagug

SEQ ID NO: 3360991 - RNA, 16 nt, Human
uaucuuguagcuuuau

SEQ ID NO: 3360992 - RNA, 18 nt, Human
acaaauucugucucugga

SEQ ID NO: 3360993 - RNA, 21 nt, Human
acaaauucugucucuggauua

SEQ ID NO: 3360994 - RNA, 17 nt, Human
acaagaugguucuagca

SEQ ID NO: 3360995 - RNA, 18 nt, Human
acaaugaagauaaaaaga

SEQ ID NO: 3360996 - RNA, 16 nt, Human
uagcuacuaauuuuaa

SEQ ID NO: 3360997 - RNA, 22 nt, Human
uagauaggucagugcaaauacu

SEQ ID NO: 3360998 - RNA, 22 nt, Human
aauuuuuaaucuuuaauuuuac

SEQ ID NO: 3360999 - RNA, 18 nt, Human
uacuagggaaaugccuuu

SEQ ID NO: 3361000 - RNA, 16 nt, Human
uacugggagccuaccc

SEQ ID NO: 3361001 - RNA, 19 nt, Human
uacuguacagacagaaaaa

SEQ ID NO: 3361002 - RNA, 23 nt, Human
uacuguacagacagaaaaaacug

SEQ ID NO: 3361003 - RNA, 14 nt, Human
aauuuaugugaugg

SEQ ID NO: 3361004 - RNA, 16 nt, Human
aauuuauacaggucau

SEQ ID NO: 3361005 - RNA, 17 nt, Human
aauuuauacaggucaua

SEQ ID NO: 3361006 - RNA, 22 nt, Human
aauuuauaaacuuuuuucuuac

SEQ ID NO: 3361007 - RNA, 15 nt, Human
uacuugaaaauuaac

SEQ ID NO: 3361008 - RNA, 15 nt, Human
uaagaauauuugaau

SEQ ID NO: 3361009 - RNA, 18 nt, Human
uaagaauauuugaaugua

SEQ ID NO: 3361010 - RNA, 18 nt, Human
aauauuguguugugaaug

SEQ ID NO: 3361011 - RNA, 20 nt, Human
aauauugcuuuggucauaug

SEQ ID NO: 3361012 - RNA, 14 nt, Human
uaacaugauuuggg

SEQ ID NO: 3361013 - RNA, 19 nt, Human
uaaauuuugaguucuacau

SEQ ID NO: 3361014 - RNA, 18 nt, Human
uaaauuuugaguucuaca

SEQ ID NO: 3361015 - RNA, 20 nt, Human
uaaauuuugucuuuaacuca

SEQ ID NO: 3361016 - RNA, 18 nt, Human
aauaggcguaacuaauuu

SEQ ID NO: 3361017 - RNA, 17 nt, Human
uaaauuuugaguucuac

SEQ ID NO: 3361018 - RNA, 24 nt, Human
uaaauguuuuuuuuuaaagacuuu

SEQ ID NO: 3361019 - RNA, 23 nt, Human
uaaauguuuuuuuuuaaagacuu

SEQ ID NO: 3361020 - RNA, 21 nt, Human
uaaauaaaguuuguugaaaca

SEQ ID NO: 3361021 - RNA, 12 nt, Human
uaaauaaaguuu

SEQ ID NO: 3361022 - RNA, 16 nt, Human
aauaacugugaaguuu

SEQ ID NO: 3361023 - RNA, 14 nt, Human
aauaacugugaagu

SEQ ID NO: 3361024 - RNA, 20 nt, Human
aauaacugugaaguuuacau

SEQ ID NO: 3361025 - RNA, 21 nt, Human
aauaauuuuaagaaaucaaag

SEQ ID NO: 3361026 - RNA, 13 nt, Human
aauaacugugaag

SEQ ID NO: 3361027 - RNA, 18 nt, Human
aauaaccucaaagugacu

SEQ ID NO: 3361028 - RNA, 21 nt, Human
aauaacaaugaaaguugauaa

SEQ ID NO: 3361029 - RNA, 22 nt, Human
uaaaguaaaaacaaagaaauua

SEQ ID NO: 3361030 - RNA, 21 nt, Human
uaaaguaaaaacaaagaaauu

SEQ ID NO: 3361031 - RNA, 19 nt, Human
uaaaguaaaaacaaagaaa

SEQ ID NO: 3361032 - RNA, 22 nt, Human
uaaagguucaugcaaacuuuau

SEQ ID NO: 3361033 - RNA, 21 nt, Human
aauguaugcuucauacaggga

SEQ ID NO: 3361034 - RNA, 18 nt, Human
aauguaugcuucauacag

SEQ ID NO: 3361035 - RNA, 17 nt, Human
aauguaugcuucauaca

SEQ ID NO: 3361036 - RNA, 17 nt, Human
uacauauuuuuguagca

SEQ ID NO: 3361037 - RNA, 18 nt, Human
uacauauuuuuguagcac

SEQ ID NO: 3361038 - RNA, 19 nt, Human
uacauauaagugauugcug

SEQ ID NO: 3361039 - RNA, 14 nt, Human
uacagaggacagua

SEQ ID NO: 3361040 - RNA, 18 nt, Human
uacagaggacaguauuug

SEQ ID NO: 3361041 - RNA, 19 nt, Human
aauggacuuuuguacauag

SEQ ID NO: 3361042 - RNA, 13 nt, Human
uaauucaagaaaa

SEQ ID NO: 3361043 - RNA, 15 nt, Human
uaauuuaaaauugug

SEQ ID NO: 3361044 - RNA, 16 nt, Human
uaauuuauacagguca

SEQ ID NO: 3361045 - RNA, 17 nt, Human
uaauuuauacaggucau

SEQ ID NO: 3361046 - RNA, 23 nt, Human
uaaucagugugucuaaauuugaa

SEQ ID NO: 3361047 - RNA, 15 nt, Human
uaaugaaacuuggau

SEQ ID NO: 3361048 - RNA, 14 nt, Human
uaaugaaacuugga

SEQ ID NO: 3361049 - RNA, 14 nt, Human
uaaugguguuuuaa

SEQ ID NO: 3361050 - RNA, 20 nt, Human
aaugacucagaauauugcuu

SEQ ID NO: 3361051 - RNA, 22 nt, Human
aaugacagguuugggaccccug

SEQ ID NO: 3361052 - RNA, 15 nt, Human
aaugaaaaccacauu

SEQ ID NO: 3361053 - RNA, 14 nt, Human
aaucuuauaauuua

SEQ ID NO: 3361054 - RNA, 12 nt, Human
uaaguucauaca

SEQ ID NO: 3361055 - RNA, 13 nt, Human
uaaguucauacau

SEQ ID NO: 3361056 - RNA, 20 nt, Human
uaaguauguguaaaauguga

SEQ ID NO: 3361057 - RNA, 17 nt, Human
aaucagacuaugaaguu

SEQ ID NO: 3361058 - RNA, 14 nt, Human
aaucagacuaugaa

SEQ ID NO: 3361059 - RNA, 17 nt, Human
aaucauggugcucagag

SEQ ID NO: 3361060 - RNA, 15 nt, Human
aaucaucaagucuuu

SEQ ID NO: 3361061 - RNA, 14 nt, Human
aacaggcucagagg

SEQ ID NO: 3361062 - RNA, 18 nt, Human
aaccuuuguuugcaucug

SEQ ID NO: 3361063 - RNA, 23 nt, Human
aaaucucaaauuuggauugcuaa

SEQ ID NO: 3361064 - RNA, 13 nt, Human
aaagccugcaauu

SEQ ID NO: 3361065 - RNA, 18 nt, Human
aaagccugcaauuucaua

SEQ ID NO: 3361066 - RNA, 20 nt, Human
aaaagacaaggaaaaaauaa

SEQ ID NO: 3361067 - RNA, 16 nt, Human
aaaagagaugaugaaa

SEQ ID NO: 3361068 - RNA, 19 nt, Human
aaaagagaugaugaaaaua

SEQ ID NO: 3361069 - RNA, 14 nt, Human
aaaagauaaauauu

SEQ ID NO: 3361070 - RNA, 17 nt, Human
aaaagauaaauauuaua

SEQ ID NO: 3361071 - RNA, 13 nt, Human
aaaagaucgcagu

SEQ ID NO: 3361072 - RNA, 14 nt, Human
aaugaagcaaugcu

SEQ ID NO: 3361073 - RNA, 16 nt, Human
aauaaacacucuugaa

SEQ ID NO: 3361074 - RNA, 11 nt, Human
aauaaacacuc

SEQ ID NO: 3361075 - RNA, 19 nt, Human
aauaaacacucuugaaaaa

SEQ ID NO: 3361076 - RNA, 16 nt, Human
aagaguaguaauagag

SEQ ID NO: 3361077 - RNA, 19 nt, Human
aagaguauuuuugacagaa

SEQ ID NO: 3361078 - RNA, 14 nt, Human
aagagagaaaauaa

SEQ ID NO: 3361079 - RNA, 21 nt, Human
aagacaaggaaaaaauaacaa

SEQ ID NO: 3361080 - RNA, 13 nt, Human
accggggccuggg

SEQ ID NO: 3361081 - RNA, 16 nt, Human
acccucaucuuucuuc

SEQ ID NO: 3361082 - RNA, 19 nt, Human
acccucaucuuucuuccaa

SEQ ID NO: 3361083 - RNA, 13 nt, Human
acccucaucuuuc

SEQ ID NO: 3361084 - RNA, 14 nt, Human
acccucaucuuucu

SEQ ID NO: 3361085 - RNA, 16 nt, Human
acugauccagcccuga

SEQ ID NO: 3361086 - RNA, 17 nt, Human
acugauccagcccugag

SEQ ID NO: 3361087 - RNA, 16 nt, Human
acugacagauuuccau

SEQ ID NO: 3361088 - RNA, 12 nt, Human
acuugaaaauua

SEQ ID NO: 3361089 - RNA, 14 nt, Human
acuugaaaauuaac

SEQ ID NO: 3361090 - RNA, 15 nt, Human
acugccuauuuuaau

SEQ ID NO: 3361091 - RNA, 17 nt, Human
acuguaaaauaauaacu

SEQ ID NO: 3361092 - RNA, 23 nt, Human
acugucuuuuuucuaaaguaaaa

SEQ ID NO: 3361093 - RNA, 22 nt, Human
acugucuuuuuucuaaaguaaa

SEQ ID NO: 3361094 - RNA, 16 nt, Human
acugucuuuuuucuaa

SEQ ID NO: 3361095 - RNA, 21 nt, Human
acauaaguaauucaagaaaac

SEQ ID NO: 3361096 - RNA, 20 nt, Human
acauaaguauuuaauucaug

SEQ ID NO: 3361097 - RNA, 20 nt, Human
acauaaguaauucaagaaaa

SEQ ID NO: 3361098 - RNA, 23 nt, Human
acauguuucuuuguaaugaaaac

SEQ ID NO: 3361099 - RNA, 13 nt, Human
accaccagaagcc

SEQ ID NO: 3361100 - RNA, 15 nt, Human
accaccagaagccca

SEQ ID NO: 3361101 - RNA, 16 nt, Human
accaccagaagcccag

SEQ ID NO: 3361102 - RNA, 17 nt, Human
accaccagaagcccaga

SEQ ID NO: 3361103 - RNA, 15 nt, Human
aauuauauaaguauu

SEQ ID NO: 3361104 - RNA, 16 nt, Human
aauuauauaaguauuc

SEQ ID NO: 3361105 - RNA, 17 nt, Human
aauuauauaaguauucu

SEQ ID NO: 3361106 - RNA, 18 nt, Human
aauuucauaugcuguaua

SEQ ID NO: 3361107 - RNA, 16 nt, Human
aauuucauaugcugua

SEQ ID NO: 3361108 - RNA, 11 nt, Human
aauuguaauag

SEQ ID NO: 3361109 - RNA, 12 nt, Human
agagaggccauu

SEQ ID NO: 3361110 - RNA, 22 nt, Human
agagaggccauucuuucccaac

SEQ ID NO: 3361111 - RNA, 19 nt, Human
agacaaggaaaaaauaaca

SEQ ID NO: 3361112 - RNA, 18 nt, Human
agacgaaacauuuguucu

SEQ ID NO: 3361113 - RNA, 17 nt, Human
agaacaucccuccuggg

SEQ ID NO: 3361114 - RNA, 13 nt, Human
agaacaucccucc

SEQ ID NO: 3361115 - RNA, 19 nt, Human
agaacagauaaucagugug

SEQ ID NO: 3361116 - RNA, 12 nt, Human
agaaugaggcug

SEQ ID NO: 3361117 - RNA, 13 nt, Human
agaaugaggcugc

SEQ ID NO: 3361118 - RNA, 14 nt, Human
agaaugaggcugcu

SEQ ID NO: 3361119 - RNA, 20 nt, Human
agaaugaggcugcuuuccaa

SEQ ID NO: 3361120 - RNA, 19 nt, Human
agagugggguagguuggga

SEQ ID NO: 3361121 - RNA, 19 nt, Human
agauagccccacaggaggu

SEQ ID NO: 3361122 - RNA, 20 nt, Human
agauagauaggucagugcaa

SEQ ID NO: 3361123 - RNA, 23 nt, Human
agcaaaauugauguguuuauuua

SEQ ID NO: 3361124 - RNA, 19 nt, Human
agcaaaauugauguguuua

SEQ ID NO: 3361125 - RNA, 13 nt, Human
agcaaaauugaug

SEQ ID NO: 3361126 - RNA, 17 nt, Human
agauugagauguguuca

SEQ ID NO: 3361127 - RNA, 14 nt, Human
agccaagaggcugc

SEQ ID NO: 3361128 - RNA, 13 nt, Human
agcaucucccagu

SEQ ID NO: 3361129 - RNA, 17 nt, Human
agccaacuauggccugu

SEQ ID NO: 3361130 - RNA, 17 nt, Human
agcccaaaccaccagaa

SEQ ID NO: 3361131 - RNA, 19 nt, Human
agcccaaaccaccagaagc

SEQ ID NO: 3361132 - RNA, 20 nt, Human
agcccaaaccaccagaagcc

SEQ ID NO: 3361133 - RNA, 22 nt, Human
agcccaaaccaccagaagccca

SEQ ID NO: 3361134 - RNA, 14 nt, Human
aggcuagggugggg

SEQ ID NO: 3361135 - RNA, 15 nt, Human
aggcuagggugggga

SEQ ID NO: 3361136 - RNA, 16 nt, Human
aggcuaggguggggag

SEQ ID NO: 3361137 - RNA, 19 nt, Human
aggcuaggguggggagaga

SEQ ID NO: 3361138 - RNA, 22 nt, Human
aggcucuggagcccacuguacu

SEQ ID NO: 3361139 - RNA, 19 nt, Human
aggcucuggagcccacugu

SEQ ID NO: 3361140 - RNA, 15 nt, Human
agggaugcauggaga

SEQ ID NO: 3361141 - RNA, 14 nt, Human
agggacugagaaau

SEQ ID NO: 3361142 - RNA, 13 nt, Human
agggacugagaaa

SEQ ID NO: 3361143 - RNA, 15 nt, Human
agggacugagaaauu

SEQ ID NO: 3361144 - RNA, 19 nt, Human
aggcaucggggagccggga

SEQ ID NO: 3361145 - RNA, 19 nt, Human
aggccagggggccaguccc

SEQ ID NO: 3361146 - RNA, 23 nt, Human
aggccagggggccagucccugag

SEQ ID NO: 3361147 - RNA, 22 nt, Human
aggcagaacucaucuagguaaa

SEQ ID NO: 3361148 - RNA, 20 nt, Human
aggagacagguuagcugcuc

SEQ ID NO: 3361149 - RNA, 15 nt, Human
aggagggaggugcuu

SEQ ID NO: 3361150 - RNA, 13 nt, Human
aggagggcaggca

SEQ ID NO: 3361151 - RNA, 15 nt, Human
aggagggcaggcauc

SEQ ID NO: 3361152 - RNA, 18 nt, Human
aggaguuucguuuucaaa

SEQ ID NO: 3361153 - RNA, 13 nt, Human
aggaugucugggc

SEQ ID NO: 3361154 - RNA, 15 nt, Human
agcgaauuuuaaaag

SEQ ID NO: 3361155 - RNA, 16 nt, Human
agcgaauuuuaaaaga

SEQ ID NO: 3361156 - RNA, 13 nt, Human
agcgaauuuuaaa

SEQ ID NO: 3361157 - RNA, 12 nt, Human
agcuacaaaugc

SEQ ID NO: 3361158 - RNA, 13 nt, Human
agcuacaaaugca

SEQ ID NO: 3361159 - RNA, 17 nt, Human
agccugcugccugcuuu

SEQ ID NO: 3361160 - RNA, 18 nt, Human
aggaaaaaauaacaauga

SEQ ID NO: 3361161 - RNA, 20 nt, Human
aucaaagggugaaaauuauu

SEQ ID NO: 3361162 - RNA, 18 nt, Human
aucaaagagagaaaauaa

SEQ ID NO: 3361163 - RNA, 23 nt, Human
auccacuuuaucuugaauaaugu

SEQ ID NO: 3361164 - RNA, 21 nt, Human
auccagcccugaguuccuagc

SEQ ID NO: 3361165 - RNA, 23 nt, Human
auggagauagccccacaggaggu

SEQ ID NO: 3361166 - RNA, 24 nt, Human
augcauauuauuuuauguugcaua

SEQ ID NO: 3361167 - RNA, 20 nt, Human
augcauauuauuuuauguug

SEQ ID NO: 3361168 - RNA, 11 nt, Human
aucuaggauuu

SEQ ID NO: 3361169 - RNA, 19 nt, Human
aucuaggauuuuaagggaa

SEQ ID NO: 3361170 - RNA, 13 nt, Human
augaaacuuggau

SEQ ID NO: 3361171 - RNA, 23 nt, Human
augaaguuuuuuuuauacaggau

SEQ ID NO: 3361172 - RNA, 22 nt, Human
augaggcugcuuuccaaagcca

SEQ ID NO: 3361173 - RNA, 22 nt, Human
aguauauugauccagaaagaaa

SEQ ID NO: 3361174 - RNA, 20 nt, Human
agugcuaauuuugaaaaacu

SEQ ID NO: 3361175 - RNA, 13 nt, Human
agugaaugaaaca

SEQ ID NO: 3361176 - RNA, 17 nt, Human
auaaguaauucaagaaa

SEQ ID NO: 3361177 - RNA, 15 nt, Human
auaaguaaaugcuag

SEQ ID NO: 3361178 - RNA, 21 nt, Human
auacacuaugaagauguuuca

SEQ ID NO: 3361179 - RNA, 19 nt, Human
auacuugaaaauuaacaug

SEQ ID NO: 3361180 - RNA, 14 nt, Human
auaaaaacaacuuu

SEQ ID NO: 3361181 - RNA, 20 nt, Human
auaaaaagacauucuuccaa

SEQ ID NO: 3361182 - RNA, 23 nt, Human
aguuugcuagcagaaaucuagaa

SEQ ID NO: 3361183 - RNA, 16 nt, Human
auaaaagacagugaaa

SEQ ID NO: 3361184 - RNA, 15 nt, Human
auaaaagacagugaa

SEQ ID NO: 3361185 - RNA, 23 nt, Human
auaaaaauauuguguugugaaug

SEQ ID NO: 3361186 - RNA, 22 nt, Human
auaaaaauauuguguugugaau

SEQ ID NO: 3361187 - RNA, 20 nt, Human
aguuguucaauaauaaauau

SEQ ID NO: 3361188 - RNA, 19 nt, Human
cacacguaaugaaacuugg

SEQ ID NO: 3361189 - RNA, 20 nt, Human
cacacguaaugaaacuugga

SEQ ID NO: 3361190 - RNA, 15 nt, Human
cacaugagauaauau

SEQ ID NO: 3361191 - RNA, 16 nt, Human
cacaugagauaauaug

SEQ ID NO: 3361192 - RNA, 14 nt, Human
caccacacucagcc

SEQ ID NO: 3361193 - RNA, 15 nt, Human
caccacacucagccc

SEQ ID NO: 3361194 - RNA, 19 nt, Human
caccacacugauccagccc

SEQ ID NO: 3361195 - RNA, 11 nt, Human
caagagccuga

SEQ ID NO: 3361196 - RNA, 13 nt, Human
caagagccugaga

SEQ ID NO: 3361197 - RNA, 23 nt, Human
caagagccugagagugaggugga

SEQ ID NO: 3361198 - RNA, 20 nt, Human
caagcccaguucagcuuggg

SEQ ID NO: 3361199 - RNA, 12 nt, Human
caaagaaauuau

SEQ ID NO: 3361200 - RNA, 13 nt, Human
caaagaaauuaug

SEQ ID NO: 3361201 - RNA, 18 nt, Human
caaauucugucucuggau

SEQ ID NO: 3361202 - RNA, 18 nt, Human
ucacgccagacuucccac

SEQ ID NO: 3361203 - RNA, 22 nt, Human
ucagaguugaugguuguacaua

SEQ ID NO: 3361204 - RNA, 20 nt, Human
ucagaaaauauuauguguuu

SEQ ID NO: 3361205 - RNA, 19 nt, Human
ucagaaaauauuauguguu

SEQ ID NO: 3361206 - RNA, 17 nt, Human
ucagaaaauauuaugug

SEQ ID NO: 3361207 - RNA, 19 nt, Human
uauuuuuguagcacugaca

SEQ ID NO: 3361208 - RNA, 16 nt, Human
uauuuuauguugcaua

SEQ ID NO: 3361209 - RNA, 15 nt, Human
uauuuuauguugcau

SEQ ID NO: 3361210 - RNA, 19 nt, Human
uauuugagaguucuaaauu

SEQ ID NO: 3361211 - RNA, 18 nt, Human
uauuugagaguucuaaau

SEQ ID NO: 3361212 - RNA, 16 nt, Human
uauuugagaguucuaa

SEQ ID NO: 3361213 - RNA, 15 nt, Human
uauuugagaguucua

SEQ ID NO: 3361214 - RNA, 17 nt, Human
uccaaagccaaugugaa

SEQ ID NO: 3361215 - RNA, 13 nt, Human
uccaagcaaaugu

SEQ ID NO: 3361216 - RNA, 13 nt, Human
ucaguuguacagu

SEQ ID NO: 3361217 - RNA, 16 nt, Human
ucauacauuguacgaa

SEQ ID NO: 3361218 - RNA, 13 nt, Human
ucauacauuguac

SEQ ID NO: 3361219 - RNA, 15 nt, Human
ucauacauuguacga

SEQ ID NO: 3361220 - RNA, 15 nt, Human
ucauaauuuauacag

SEQ ID NO: 3361221 - RNA, 15 nt, Human
ucauaauuauuauuu

SEQ ID NO: 3361222 - RNA, 20 nt, Human
uccaugggccauaugaaaag

SEQ ID NO: 3361223 - RNA, 22 nt, Human
uccccagacuccaccaagccug

SEQ ID NO: 3361224 - RNA, 13 nt, Human
ucccuaauaaagc

SEQ ID NO: 3361225 - RNA, 12 nt, Human
ucccuaauaaag

SEQ ID NO: 3361226 - RNA, 11 nt, Human
ucccuaauaaa

SEQ ID NO: 3361227 - RNA, 16 nt, Human
ucccccuccaccugcu

SEQ ID NO: 3361228 - RNA, 19 nt, Human
uccuuaaggcucuuuugua

SEQ ID NO: 3361229 - RNA, 16 nt, Human
uccuuaaggcucuuuu

SEQ ID NO: 3361230 - RNA, 20 nt, Human
uccuucugugaaaguacauu

SEQ ID NO: 3361231 - RNA, 21 nt, Human
ucuagaagacugucagcuucc

SEQ ID NO: 3361232 - RNA, 20 nt, Human
ucuagaagacugucagcuuc

SEQ ID NO: 3361233 - RNA, 17 nt, Human
ucuaaauuugaauguua

SEQ ID NO: 3361234 - RNA, 13 nt, Human
ucuaaauuugaau

SEQ ID NO: 3361235 - RNA, 18 nt, Human
ucuaaauuuuauaucuug

SEQ ID NO: 3361236 - RNA, 23 nt, Human
ucuaaauuuuauaucuuguagcu

SEQ ID NO: 3361237 - RNA, 23 nt, Human
ucuaaauuugaauguuaagcaga

SEQ ID NO: 3361238 - RNA, 22 nt, Human
ucuaaauuugaauguuaagcag

SEQ ID NO: 3361239 - RNA, 19 nt, Human
ucuaacaaaaaaauauauu

SEQ ID NO: 3361240 - RNA, 21 nt, Human
ucucaaauuuggauugcuaau

SEQ ID NO: 3361241 - RNA, 15 nt, Human
ucuaguaugaaauua

SEQ ID NO: 3361242 - RNA, 17 nt, Human
ucuaguaugaaauuaua

SEQ ID NO: 3361243 - RNA, 18 nt, Human
ucucccuccucugcccgg

SEQ ID NO: 3361244 - RNA, 22 nt, Human
ucucagugguuaagauuccuaa

SEQ ID NO: 3361245 - RNA, 15 nt, Human
ucucucgugaguaua

SEQ ID NO: 3361246 - RNA, 11 nt, Human
ucucugcaggu

SEQ ID NO: 3361247 - RNA, 19 nt, Human
ucuuuuguaagguuuuugu

SEQ ID NO: 3361248 - RNA, 22 nt, Human
ugaaaagaggugugcaagagag

SEQ ID NO: 3361249 - RNA, 13 nt, Human
ugaaaagaggugu

SEQ ID NO: 3361250 - RNA, 15 nt, Human
ugaaaucauucauuu

SEQ ID NO: 3361251 - RNA, 16 nt, Human
ugaacugagcuuggaa

SEQ ID NO: 3361252 - RNA, 12 nt, Human
ugaacugagcuu

SEQ ID NO: 3361253 - RNA, 15 nt, Human
ugaacugagcuugga

SEQ ID NO: 3361254 - RNA, 23 nt, Human
ucuggagcccacuguacuugcuc

SEQ ID NO: 3361255 - RNA, 15 nt, Human
ucuguguguguguau

SEQ ID NO: 3361256 - RNA, 18 nt, Human
ucuguguguguguaugug

SEQ ID NO: 3361257 - RNA, 19 nt, Human
ucuguguguguguaugugg

SEQ ID NO: 3361258 - RNA, 21 nt, Human
ucuguguguguguaugugggg

SEQ ID NO: 3361259 - RNA, 13 nt, Human
ucugugugugugu

SEQ ID NO: 3361260 - RNA, 15 nt, Human
ucuguguguuuaugu

SEQ ID NO: 3361261 - RNA, 16 nt, Human
ucuguguguuuaugug

SEQ ID NO: 3361262 - RNA, 22 nt, Human
ucuguguguguguauguggggg

SEQ ID NO: 3361263 - RNA, 19 nt, Human
ucuguguguuuaugugugu

SEQ ID NO: 3361264 - RNA, 20 nt, Human
ucuguguguuuaugugugug

SEQ ID NO: 3361265 - RNA, 22 nt, Human
uagugauuuuuaugccaccuga

SEQ ID NO: 3361266 - RNA, 20 nt, Human
uagugauuuuuaugccaccu

SEQ ID NO: 3361267 - RNA, 21 nt, Human
uagugauuuuuaugccaccug

SEQ ID NO: 3361268 - RNA, 13 nt, Human
uaggcuagggugg

SEQ ID NO: 3361269 - RNA, 21 nt, Human
uauaauucagaaggaucuuca

SEQ ID NO: 3361270 - RNA, 20 nt, Human
uauaauucacauuguauuca

SEQ ID NO: 3361271 - RNA, 16 nt, Human
uauacccagaaaguua

SEQ ID NO: 3361272 - RNA, 18 nt, Human
uauauaaguauucuaaau

SEQ ID NO: 3361273 - RNA, 13 nt, Human
uauauuuuaagac

SEQ ID NO: 3361274 - RNA, 14 nt, Human
uauauuuuaagacg

SEQ ID NO: 3361275 - RNA, 21 nt, Human
uauauuucccugaaggaacca

SEQ ID NO: 3361276 - RNA, 15 nt, Human
uaucagcacgugugg

SEQ ID NO: 3361277 - RNA, 22 nt, Human
uaucaugugaaaucauucauuu

SEQ ID NO: 3361278 - RNA, 17 nt, Human
uaucaugugaaaucauu

SEQ ID NO: 3361279 - RNA, 11 nt, Human
uagaugugugg

SEQ ID NO: 3361280 - RNA, 14 nt, Human
uaggaauuguguuu

SEQ ID NO: 3361281 - RNA, 15 nt, Human
uaggaacugcugggc

SEQ ID NO: 3361282 - RNA, 18 nt, Human
uaggaacugcugggcuug

SEQ ID NO: 3361283 - RNA, 16 nt, Human
uagccccacaggaggu

SEQ ID NO: 3361284 - RNA, 20 nt, Human
uacgaagaguauuuuugaca

SEQ ID NO: 3361285 - RNA, 22 nt, Human
uacgaagaguauuuuugacaga

SEQ ID NO: 3361286 - RNA, 23 nt, Human
uacgaagaguauuuuugacagaa

SEQ ID NO: 3361287 - RNA, 19 nt, Human
uaccuuugacaaagguaaa

SEQ ID NO: 3361288 - RNA, 17 nt, Human
uagaacagauaaucagu

SEQ ID NO: 3361289 - RNA, 21 nt, Human
uacuugcucuugaugccuggc

SEQ ID NO: 3361290 - RNA, 20 nt, Human
uacuugcucuugaugccugg

SEQ ID NO: 3361291 - RNA, 23 nt, Human
uacauuuggagacacaacuauuu

SEQ ID NO: 3361292 - RNA, 14 nt, Human
uacaggauuugaaa

SEQ ID NO: 3361293 - RNA, 17 nt, Human
uacagcccaccuggcuu

SEQ ID NO: 3361294 - RNA, 17 nt, Human
uaauuuugaaaaacugc

SEQ ID NO: 3361295 - RNA, 13 nt, Human
uaauuuugaaaaa

SEQ ID NO: 3361296 - RNA, 13 nt, Human
guuuagcaguaua

SEQ ID NO: 3361297 - RNA, 16 nt, Human
guuuaguaaucauauu

SEQ ID NO: 3361298 - RNA, 16 nt, Human
guuuccuuauauuaug

SEQ ID NO: 3361299 - RNA, 14 nt, Human
guuucuuuguaaug

SEQ ID NO: 3361300 - RNA, 17 nt, Human
guuucuuuguaaugaaa

SEQ ID NO: 3361301 - RNA, 12 nt, Human
uaaaaaacacug

SEQ ID NO: 3361302 - RNA, 15 nt, Human
uaaaaaagcugugug

SEQ ID NO: 3361303 - RNA, 11 nt, Human
uaaaaaacacu

SEQ ID NO: 3361304 - RNA, 14 nt, Human
uaaaguuuguugaa

SEQ ID NO: 3361305 - RNA, 17 nt, Human
uaaauaaaaauaauccu

SEQ ID NO: 3361306 - RNA, 14 nt, Human
uaaaggaauuuaaa

SEQ ID NO: 3361307 - RNA, 20 nt, Human
uaaacuuuuuucuuacuguc

SEQ ID NO: 3361308 - RNA, 20 nt, Human
uaaaucagacuaugaaguuu

SEQ ID NO: 3361309 - RNA, 18 nt, Human
uaaauauaugcuaagucu

SEQ ID NO: 3361310 - RNA, 22 nt, Human
uaaauauauuuuaagacgaaac

SEQ ID NO: 3361311 - RNA, 16 nt, Human
uaaauauauuuuaaga

SEQ ID NO: 3361312 - RNA, 22 nt, Human
uaaauaaaccucaaaaugucua

SEQ ID NO: 3361313 - RNA, 21 nt, Human
uaaacacucuugaaaaaugca

SEQ ID NO: 3361314 - RNA, 16 nt, Human
uaaaaugagaaaucua

SEQ ID NO: 3361315 - RNA, 15 nt, Human
uaaaaugagaaaucu

SEQ ID NO: 3361316 - RNA, 13 nt, Human
uaaaaugagaaau

SEQ ID NO: 3361317 - RNA, 16 nt, Human
uaaaagaugcaaugua

SEQ ID NO: 3361318 - RNA, 13 nt, Human
uaaaagaucgcag

SEQ ID NO: 3361319 - RNA, 20 nt, Human
uaaaagggacugagaaauuu

SEQ ID NO: 3361320 - RNA, 19 nt, Human
uaaaagggacugagaaauu

SEQ ID NO: 3361321 - RNA, 17 nt, Human
uaaaagggacugagaaa

SEQ ID NO: 3361322 - RNA, 14 nt, Human
uaaggcaaucaugg

SEQ ID NO: 3361323 - RNA, 15 nt, Human
uaaggcaaucauggu

SEQ ID NO: 3361324 - RNA, 15 nt, Human
uaagcaugcacaaau

SEQ ID NO: 3361325 - RNA, 13 nt, Human
uaagaucucagug

SEQ ID NO: 3361326 - RNA, 19 nt, Human
uaagaucucagugguuaag

SEQ ID NO: 3361327 - RNA, 19 nt, Human
uaaugauaaguaaaugcua

SEQ ID NO: 3361328 - RNA, 14 nt, Human
uaauauauuuccau

SEQ ID NO: 3361329 - RNA, 19 nt, Human
uaauaaauauuuuugccau

SEQ ID NO: 3361330 - RNA, 19 nt, Human
uaauucuuugaccuguugg

SEQ ID NO: 3361331 - RNA, 23 nt, Human
uaauuaaauuuugaguucuacau

SEQ ID NO: 3361332 - RNA, 13 nt, Human
uaauuuuaagaaa

SEQ ID NO: 3361333 - RNA, 18 nt, Human
uggggcaggggccggggg

SEQ ID NO: 3361334 - RNA, 16 nt, Human
uggggcaggggccggg

SEQ ID NO: 3361335 - RNA, 19 nt, Human
ugggguggggggggugcug

SEQ ID NO: 3361336 - RNA, 22 nt, Human
ugggguggggggggugcugggc

SEQ ID NO: 3361337 - RNA, 21 nt, Human
ugggguggggggggugcuggg

SEQ ID NO: 3361338 - RNA, 18 nt, Human
ugcuucuaguucugccag

SEQ ID NO: 3361339 - RNA, 19 nt, Human
ugcuucuaguucugccagg

SEQ ID NO: 3361340 - RNA, 20 nt, Human
ugcuucuaguucugccagga

SEQ ID NO: 3361341 - RNA, 14 nt, Human
ugcuuuccaaagcc

SEQ ID NO: 3361342 - RNA, 21 nt, Human
uggaagugugggucugugugu

SEQ ID NO: 3361343 - RNA, 20 nt, Human
uggaagugugggucugugug

SEQ ID NO: 3361344 - RNA, 23 nt, Human
uggaagugugggucugugugugu

SEQ ID NO: 3361345 - RNA, 15 nt, Human
uggaauuauuuuaaa

SEQ ID NO: 3361346 - RNA, 17 nt, Human
uggaauuauuuuaaaag

SEQ ID NO: 3361347 - RNA, 13 nt, Human
uggagauguuuag

SEQ ID NO: 3361348 - RNA, 23 nt, Human
ugcuagguuaauuccaauuauau

SEQ ID NO: 3361349 - RNA, 16 nt, Human
ugcuagguuaauucca

SEQ ID NO: 3361350 - RNA, 14 nt, Human
ugcucaggagcccu

SEQ ID NO: 3361351 - RNA, 17 nt, Human
ugcaggaaauggcugug

SEQ ID NO: 3361352 - RNA, 14 nt, Human
ugucacgccagacu

SEQ ID NO: 3361353 - RNA, 17 nt, Human
uguagcacugacagauu

SEQ ID NO: 3361354 - RNA, 22 nt, Human
uguagcacugacagauuuccau

SEQ ID NO: 3361355 - RNA, 16 nt, Human
uguagcacugacagau

SEQ ID NO: 3361356 - RNA, 20 nt, Human
uguaaaaugugaagugaaug

SEQ ID NO: 3361357 - RNA, 15 nt, Human
uguaaauuuauguga

SEQ ID NO: 3361358 - RNA, 16 nt, Human
uguaaauuuaugugau

SEQ ID NO: 3361359 - RNA, 16 nt, Human
ugugggggucugugug

SEQ ID NO: 3361360 - RNA, 14 nt, Human
ugugggucugugug

SEQ ID NO: 3361361 - RNA, 16 nt, Human
ugugggucugugugug

SEQ ID NO: 3361362 - RNA, 21 nt, Human
uguggaaaagccaagaggcug

SEQ ID NO: 3361363 - RNA, 23 nt, Human
uguggaaaagccaagaggcugca

SEQ ID NO: 3361364 - RNA, 19 nt, Human
uguggaaaagccaagaggc

SEQ ID NO: 3361365 - RNA, 14 nt, Human
ugugaaguuuacau

SEQ ID NO: 3361366 - RNA, 20 nt, Human
ugugaaguuuacauuguaaa

SEQ ID NO: 3361367 - RNA, 13 nt, Human
ugugaaacauguu

SEQ ID NO: 3361368 - RNA, 14 nt, Human
ugucuuuuuucuaa

SEQ ID NO: 3361369 - RNA, 16 nt, Human
ugucuggcugcagagc

SEQ ID NO: 3361370 - RNA, 17 nt, Human
ugucuggcugcagagca

SEQ ID NO: 3361371 - RNA, 14 nt, Human
ugucuggcugcaga

SEQ ID NO: 3361372 - RNA, 16 nt, Human
ugugaaucauuuuacc

SEQ ID NO: 3361373 - RNA, 18 nt, Human
ugugaggggcucucucau

SEQ ID NO: 3361374 - RNA, 14 nt, Human
ugugcaagagaggg

SEQ ID NO: 3361375 - RNA, 23 nt, Human
uguguaugugggggucugugugu

SEQ ID NO: 3361376 - RNA, 14 nt, Human
uguguauguggggg

SEQ ID NO: 3361377 - RNA, 13 nt, Human
uguguaugugggg

SEQ ID NO: 3361378 - RNA, 11 nt, Human
uguguguaugu

SEQ ID NO: 3361379 - RNA, 15 nt, Human
uguguuuaugugugu

SEQ ID NO: 3361380 - RNA, 13 nt, Human
uguguuuaugugu

SEQ ID NO: 3361381 - RNA, 22 nt, Human
uguguuuaggaacuacugagga

SEQ ID NO: 3361382 - RNA, 14 nt, Human
uguguugugugugg

SEQ ID NO: 3361383 - RNA, 23 nt, Human
uguguugugugugggagugugua

SEQ ID NO: 3361384 - RNA, 13 nt, Human
uguguugugaaug

SEQ ID NO: 3361385 - RNA, 14 nt, Human
uguuuacagaggac

SEQ ID NO: 3361386 - RNA, 21 nt, Human
uguuuacagaggacaguauuu

SEQ ID NO: 3361387 - RNA, 12 nt, Human
uguucuauagcu

SEQ ID NO: 3361388 - RNA, 15 nt, Human
uuacagaggacagua

SEQ ID NO: 3361389 - RNA, 14 nt, Human
uuacauuuccuaaa

SEQ ID NO: 3361390 - RNA, 22 nt, Human
uuaaugucaauucuugccaaau

SEQ ID NO: 3361391 - RNA, 14 nt, Human
uuaaagacuuuuau

SEQ ID NO: 3361392 - RNA, 12 nt, Human
uguuuuaaaaaa

SEQ ID NO: 3361393 - RNA, 18 nt, Human
uguuuuaaaaugagaaau

SEQ ID NO: 3361394 - RNA, 23 nt, Human
uguuuuaaaaugagaaaucuaaa

SEQ ID NO: 3361395 - RNA, 17 nt, Human
uuggguggggggcuuca

SEQ ID NO: 3361396 - RNA, 19 nt, Human
uuggguggggggcuucaua

SEQ ID NO: 3361397 - RNA, 20 nt, Human
uuggguggggggcuucauac

SEQ ID NO: 3361398 - RNA, 21 nt, Human
uuggguggggggcuucauaca

SEQ ID NO: 3361399 - RNA, 22 nt, Human
uuggguggggggcuucauacac

SEQ ID NO: 3361400 - RNA, 14 nt, Human
uugguaaaccuuuu

SEQ ID NO: 3361401 - RNA, 12 nt, Human
uugguaaaccuu

SEQ ID NO: 3361402 - RNA, 23 nt, Human
uuggcaaacucuccaccacacgu

SEQ ID NO: 3361403 - RNA, 16 nt, Human
uuguaaaggaauuuaa

SEQ ID NO: 3361404 - RNA, 18 nt, Human
uuguaaauaaaggaacca

SEQ ID NO: 3361405 - RNA, 14 nt, Human
uuguauucagaguu

SEQ ID NO: 3361406 - RNA, 14 nt, Human
uuguauuacaaauc

SEQ ID NO: 3361407 - RNA, 16 nt, Human
uuggcaaacucuccac

SEQ ID NO: 3361408 - RNA, 20 nt, Human
uuggcaaacucuccaccaca

SEQ ID NO: 3361409 - RNA, 15 nt, Human
uuggauucugagagc

SEQ ID NO: 3361410 - RNA, 17 nt, Human
uuggauucugagagcug

SEQ ID NO: 3361411 - RNA, 21 nt, Human
uugaaucucauaauuuauaca

SEQ ID NO: 3361412 - RNA, 15 nt, Human
uugaaucucauaauu

SEQ ID NO: 3361413 - RNA, 15 nt, Human
uugaacugagcuugg

SEQ ID NO: 3361414 - RNA, 16 nt, Human
uugaacugagcuugga

SEQ ID NO: 3361415 - RNA, 15 nt, Human
uugaaaaaugcaugu

SEQ ID NO: 3361416 - RNA, 14 nt, Human
uucugagcauuuaa

SEQ ID NO: 3361417 - RNA, 18 nt, Human
uugaauguaugcuucaua

SEQ ID NO: 3361418 - RNA, 14 nt, Human
uugcauagaauaaa

SEQ ID NO: 3361419 - RNA, 21 nt, Human
uuccauccuagucacuaccuu

SEQ ID NO: 3361420 - RNA, 12 nt, Human
uuccagccugcc

SEQ ID NO: 3361421 - RNA, 14 nt, Human
uuccagccugccac

SEQ ID NO: 3361422 - RNA, 17 nt, Human
uucaucugacuaugaca

SEQ ID NO: 3361423 - RNA, 15 nt, Human
uucaucuaggauuuu

SEQ ID NO: 3361424 - RNA, 18 nt, Human
uucacucuuggagccugc

SEQ ID NO: 3361425 - RNA, 19 nt, Human
uucacucuuggagccugca

SEQ ID NO: 3361426 - RNA, 14 nt, Human
uucacucuuggagc

SEQ ID NO: 3361427 - RNA, 23 nt, Human
uucaaauuguaagcaugcacaaa

SEQ ID NO: 3361428 - RNA, 17 nt, Human
uuccuucugugaaagua

SEQ ID NO: 3361429 - RNA, 15 nt, Human
uuccuagccaccgcc

SEQ ID NO: 3361430 - RNA, 21 nt, Human
uuccuagccaccgccuccuac

SEQ ID NO: 3361431 - RNA, 14 nt, Human
uuccuagccaccgc

SEQ ID NO: 3361432 - RNA, 22 nt, Human
uuccuagccaccgccuccuaca

SEQ ID NO: 3361433 - RNA, 20 nt, Human
uuccuagguauaauucacau

SEQ ID NO: 3361434 - RNA, 20 nt, Human
uuuuaugauacuugaaaauu

SEQ ID NO: 3361435 - RNA, 16 nt, Human
uuuuaugauacuugaa

SEQ ID NO: 3361436 - RNA, 14 nt, Human
uuuuacuguacaga

SEQ ID NO: 3361437 - RNA, 15 nt, Human
uuuuaaaaugagaaa

SEQ ID NO: 3361438 - RNA, 22 nt, Human
uuuuaaaaugagaaaucuaaaa

SEQ ID NO: 3361439 - RNA, 15 nt, Human
uuuucagaaaauauu

SEQ ID NO: 3361440 - RNA, 13 nt, Human
uuuucacauaucu

SEQ ID NO: 3361441 - RNA, 16 nt, Human
uuuucagaaaauauua

SEQ ID NO: 3361442 - RNA, 23 nt, Human
uuuggaacaagaugguucuagca

SEQ ID NO: 3361443 - RNA, 23 nt, Human
uuugcauaacguauaaaagccug

SEQ ID NO: 3361444 - RNA, 19 nt, Human
uuugcauaacguauaaaag

SEQ ID NO: 3361445 - RNA, 22 nt, Human
uuucuuacugucuuuuuucuaa

SEQ ID NO: 3361446 - RNA, 16 nt, Human
uuugagguggaagagg

SEQ ID NO: 3361447 - RNA, 13 nt, Human
uuuguucauacau

SEQ ID NO: 3361448 - RNA, 16 nt, Human
uuuguucauacauauu

SEQ ID NO: 3361449 - RNA, 15 nt, Human
uuuacauuguaaaua

SEQ ID NO: 3361450 - RNA, 13 nt, Human
uuuacauuguaaa

SEQ ID NO: 3361451 - RNA, 19 nt, Human
uuuagaagaagugugucac

SEQ ID NO: 3361452 - RNA, 17 nt, Human
uuuagaagaaguguguc

SEQ ID NO: 3361453 - RNA, 22 nt, Human
uuuaugauacuugaaaauuaac

SEQ ID NO: 3361454 - RNA, 21 nt, Human
uuucuaacaaaaaaauauauu

SEQ ID NO: 3361455 - RNA, 14 nt, Human
uuuccaaaauaauu

SEQ ID NO: 3361456 - RNA, 15 nt, Human
uuucagcagcugcag

SEQ ID NO: 3361457 - RNA, 20 nt, Human
uuuuuuauacaggaugauga

SEQ ID NO: 3361458 - RNA, 13 nt, Human
uuuugaaaaacug

SEQ ID NO: 3361459 - RNA, 13 nt, Human
cccaacaccucuu

SEQ ID NO: 3361460 - RNA, 13 nt, Human
ccaucagccucca

SEQ ID NO: 3361461 - RNA, 22 nt, Human
cccaaaccaccagaagcccaga

SEQ ID NO: 3361462 - RNA, 17 nt, Human
cccaaaccaccagaagc

SEQ ID NO: 3361463 - RNA, 18 nt, Human
cccaaaccaccagaagcc

SEQ ID NO: 3361464 - RNA, 20 nt, Human
ccagugaauucuugaaggaa

SEQ ID NO: 3361465 - RNA, 16 nt, Human
ccagugaauucuugaa

SEQ ID NO: 3361466 - RNA, 19 nt, Human
ccaggcuuuuuuaucaugu

SEQ ID NO: 3361467 - RNA, 23 nt, Human
ccagcuggggccaggcugggucg

SEQ ID NO: 3361468 - RNA, 22 nt, Human
ccagcuggggccaggcuggguc

SEQ ID NO: 3361469 - RNA, 21 nt, Human
ccagcuggggccaggcugggu

SEQ ID NO: 3361470 - RNA, 20 nt, Human
ccagcuggggccaggcuggg

SEQ ID NO: 3361471 - RNA, 19 nt, Human
ccagcuggggccaggcugg

SEQ ID NO: 3361472 - RNA, 18 nt, Human
ccagcuggggccaggcug

SEQ ID NO: 3361473 - RNA, 17 nt, Human
ccagcuggggccaggcu

SEQ ID NO: 3361474 - RNA, 21 nt, Human
ccacgucagcugggacacccc

SEQ ID NO: 3361475 - RNA, 14 nt, Human
ccacgguguucugu

SEQ ID NO: 3361476 - RNA, 14 nt, Human
ccagaagcccagaa

SEQ ID NO: 3361477 - RNA, 12 nt, Human
ccagaagcccag

SEQ ID NO: 3361478 - RNA, 13 nt, Human
ccagaagcccaga

SEQ ID NO: 3361479 - RNA, 16 nt, Human
ccacacccucacugcu

SEQ ID NO: 3361480 - RNA, 20 nt, Human
ccacacagacuugggcaggg

SEQ ID NO: 3361481 - RNA, 22 nt, Human
ccacacguaaugaaacuuggau

SEQ ID NO: 3361482 - RNA, 14 nt, Human
ccaacacugccagc

SEQ ID NO: 3361483 - RNA, 15 nt, Human
ccaacacugccagca

SEQ ID NO: 3361484 - RNA, 16 nt, Human
ccaacacugccagcau

SEQ ID NO: 3361485 - RNA, 13 nt, Human
ccaacacugccag

SEQ ID NO: 3361486 - RNA, 16 nt, Human
ccaaaggcucucuccu

SEQ ID NO: 3361487 - RNA, 17 nt, Human
ccaaagcgaauuuuaaa

SEQ ID NO: 3361488 - RNA, 14 nt, Human
ccaaagccaaugug

SEQ ID NO: 3361489 - RNA, 16 nt, Human
ccaagaggcugcagcc

SEQ ID NO: 3361490 - RNA, 14 nt, Human
ccaagaggcugcag

SEQ ID NO: 3361491 - RNA, 15 nt, Human
ccaagaggcugcagc

SEQ ID NO: 3361492 - RNA, 19 nt, Human
ccaagccuuggcucuaccc

SEQ ID NO: 3361493 - RNA, 19 nt, Human
ccaagccuggucagcccaa

SEQ ID NO: 3361494 - RNA, 20 nt, Human
ccaagccuggucagcccaaa

SEQ ID NO: 3361495 - RNA, 16 nt, Human
ccaaacaggcucagag

SEQ ID NO: 3361496 - RNA, 15 nt, Human
cauuuccuaaauaua

SEQ ID NO: 3361497 - RNA, 19 nt, Human
cauugucccugaagagaag

SEQ ID NO: 3361498 - RNA, 23 nt, Human
cauuguauucagaguugaugguu

SEQ ID NO: 3361499 - RNA, 20 nt, Human
cauuguacgaagaguauuuu

SEQ ID NO: 3361500 - RNA, 22 nt, Human
ccgacuuuuguuuaccagagaa

SEQ ID NO: 3361501 - RNA, 23 nt, Human
ccucuccacucaugugacucuuu

SEQ ID NO: 3361502 - RNA, 14 nt, Human
ccuccucugcccgg

SEQ ID NO: 3361503 - RNA, 15 nt, Human
ccuccucugcccggg

SEQ ID NO: 3361504 - RNA, 17 nt, Human
ccuccugggaaugaagc

SEQ ID NO: 3361505 - RNA, 23 nt, Human
ccugaagcuaucguaaaauuaag

SEQ ID NO: 3361506 - RNA, 22 nt, Human
ccugaagcuaucguaaaauuaa

SEQ ID NO: 3361507 - RNA, 20 nt, Human
ccugaagcuaucguaaaauu

SEQ ID NO: 3361508 - RNA, 19 nt, Human
ccugaggcagguccccaga

SEQ ID NO: 3361509 - RNA, 18 nt, Human
ccugaggcagguccccag

SEQ ID NO: 3361510 - RNA, 15 nt, Human
ccugaggcagguccc

SEQ ID NO: 3361511 - RNA, 19 nt, Human
cgucagcugggacaccccg

SEQ ID NO: 3361512 - RNA, 22 nt, Human
cguauaaaagccuguuuaagag

SEQ ID NO: 3361513 - RNA, 21 nt, Human
cguauaaaagccuguuuaaga

SEQ ID NO: 3361514 - RNA, 17 nt, Human
cguauaaaagccuguuu

SEQ ID NO: 3361515 - RNA, 16 nt, Human
cguauaaaagccuguu

SEQ ID NO: 3361516 - RNA, 13 nt, Human
cguuuucaaaauu

SEQ ID NO: 3361517 - RNA, 22 nt, Human
cggcugggaggagggcaggcau

SEQ ID NO: 3361518 - RNA, 18 nt, Human
cggcugggaggagggcag

SEQ ID NO: 3361519 - RNA, 23 nt, Human
cggcugggaggagggcaggcauc

SEQ ID NO: 3361520 - RNA, 16 nt, Human
cgggagcucaggaacc

SEQ ID NO: 3361521 - RNA, 21 nt, Human
cgauugcaggagucccugcca

SEQ ID NO: 3361522 - RNA, 23 nt, Human
cgauugcaggagucccugccauc

SEQ ID NO: 3361523 - RNA, 14 nt, Human
ccuuugacaaaggu

SEQ ID NO: 3361524 - RNA, 15 nt, Human
ccuggaccagccucu

SEQ ID NO: 3361525 - RNA, 16 nt, Human
ccuggaccagccucuc

SEQ ID NO: 3361526 - RNA, 14 nt, Human
ccuggaccagccuc

SEQ ID NO: 3361527 - RNA, 20 nt, Human
ccuggacugugugcucagga

SEQ ID NO: 3361528 - RNA, 17 nt, Human
ccuggacugugugcuca

SEQ ID NO: 3361529 - RNA, 21 nt, Human
ccugggaggcucuggagccca

SEQ ID NO: 3361530 - RNA, 13 nt, Human
ccugggaggcucu

SEQ ID NO: 3361531 - RNA, 12 nt, Human
ccuggcggggug

SEQ ID NO: 3361532 - RNA, 20 nt, Human
ccugcuuuuuauggccugug

SEQ ID NO: 3361533 - RNA, 22 nt, Human
ccugugagcuaggaauuguguu

SEQ ID NO: 3361534 - RNA, 23 nt, Human
ccuugacaaagucaagccacaug

SEQ ID NO: 3361535 - RNA, 21 nt, Human
ccuugacaaagucaagccaca

SEQ ID NO: 3361536 - RNA, 16 nt, Human
cugccaggagacaggu

SEQ ID NO: 3361537 - RNA, 11 nt, Human
cugccaggaga

SEQ ID NO: 3361538 - RNA, 20 nt, Human
cugccagcauuucccuuccu

SEQ ID NO: 3361539 - RNA, 13 nt, Human
cugccuauuuuaa

SEQ ID NO: 3361540 - RNA, 14 nt, Human
cugccucucugcag

SEQ ID NO: 3361541 - RNA, 13 nt, Human
cugccucucugca

SEQ ID NO: 3361542 - RNA, 12 nt, Human
cugccucucugc

SEQ ID NO: 3361543 - RNA, 12 nt, Human
cugcagagcugc

SEQ ID NO: 3361544 - RNA, 21 nt, Human
cugcagagcugcgggcugggu

SEQ ID NO: 3361545 - RNA, 21 nt, Human
cugcagagcagugggccuggc

SEQ ID NO: 3361546 - RNA, 23 nt, Human
cugcagagcagugggccuggcca

SEQ ID NO: 3361547 - RNA, 18 nt, Human
cugcagagcagugggccu

SEQ ID NO: 3361548 - RNA, 16 nt, Human
cugcagccaggccacu

SEQ ID NO: 3361549 - RNA, 17 nt, Human
cugcagccaggccacug

SEQ ID NO: 3361550 - RNA, 22 nt, Human
cugcagccaggccacuggcccc

SEQ ID NO: 3361551 - RNA, 23 nt, Human
cugcagccaggccacuggccccu

SEQ ID NO: 3361552 - RNA, 15 nt, Human
cugcagccaggccac

SEQ ID NO: 3361553 - RNA, 18 nt, Human
cugcaauuucauaugcug

SEQ ID NO: 3361554 - RNA, 20 nt, Human
cugcaauuucauaugcugua

SEQ ID NO: 3361555 - RNA, 20 nt, Human
cugauccagcccugaguucc

SEQ ID NO: 3361556 - RNA, 12 nt, Human
cuggaccagccu

SEQ ID NO: 3361557 - RNA, 21 nt, Human
cuggagcccacuguacuugcu

SEQ ID NO: 3361558 - RNA, 20 nt, Human
cuggagcccacuguacuugc

SEQ ID NO: 3361559 - RNA, 17 nt, Human
cuggagcccacuguacu

SEQ ID NO: 3361560 - RNA, 16 nt, Human
cuggagcccacuguac

SEQ ID NO: 3361561 - RNA, 15 nt, Human
cuggagcccacugua

SEQ ID NO: 3361562 - RNA, 13 nt, Human
cuggagcccacug

SEQ ID NO: 3361563 - RNA, 23 nt, Human
cuggaauaauccuaaacauauga

SEQ ID NO: 3361564 - RNA, 21 nt, Human
cuggaagugcuaauuuugaaa

SEQ ID NO: 3361565 - RNA, 15 nt, Human
cugcuuuccaaagcc

SEQ ID NO: 3361566 - RNA, 17 nt, Human
cugcuuuccaaagccaa

SEQ ID NO: 3361567 - RNA, 14 nt, Human
cuggcacagccugg

SEQ ID NO: 3361568 - RNA, 17 nt, Human
cuggauuauauuaugaa

SEQ ID NO: 3361569 - RNA, 22 nt, Human
cugggaggcucuggagcccacu

SEQ ID NO: 3361570 - RNA, 16 nt, Human
cugggaggcucuggag

SEQ ID NO: 3361571 - RNA, 15 nt, Human
cugggaggcucugga

SEQ ID NO: 3361572 - RNA, 10 nt, Human
cugggccccu

SEQ ID NO: 3361573 - RNA, 12 nt, Human
cugggccccugc

SEQ ID NO: 3361574 - RNA, 17 nt, Human
cugggccccugccucuc

SEQ ID NO: 3361575 - RNA, 16 nt, Human
cugggccccugccucu

SEQ ID NO: 3361576 - RNA, 22 nt, Human
cuccuuaaggcucuuuuguaag

SEQ ID NO: 3361577 - RNA, 13 nt, Human
cuccuuaaggcuc

SEQ ID NO: 3361578 - RNA, 17 nt, Human
cucaucuccccaucauu

SEQ ID NO: 3361579 - RNA, 21 nt, Human
cucaucuagguaaauuacagu

SEQ ID NO: 3361580 - RNA, 17 nt, Human
cucauuccagaggaagg

SEQ ID NO: 3361581 - RNA, 15 nt, Human
cucauuccagaggaa

SEQ ID NO: 3361582 - RNA, 20 nt, Human
cucagugucuggcugcagag

SEQ ID NO: 3361583 - RNA, 21 nt, Human
cucauaaaaagccugcaauuu

SEQ ID NO: 3361584 - RNA, 21 nt, Human
cucagugucuggcugcagagc

SEQ ID NO: 3361585 - RNA, 22 nt, Human
cucagugucuggcugcagagca

SEQ ID NO: 3361586 - RNA, 22 nt, Human
cucauaauuuauacaggucaua

SEQ ID NO: 3361587 - RNA, 13 nt, Human
cucauaauuuaua

SEQ ID NO: 3361588 - RNA, 15 nt, Human
cucauaauuuauaca

SEQ ID NO: 3361589 - RNA, 17 nt, Human
cuccauugguguugaca

SEQ ID NO: 3361590 - RNA, 21 nt, Human
cuccacucuccucuuccaggc

SEQ ID NO: 3361591 - RNA, 23 nt, Human
cucugcaggucccuaauaaagcu

SEQ ID NO: 3361592 - RNA, 22 nt, Human
cucugcaggucccuaauaaagc

SEQ ID NO: 3361593 - RNA, 14 nt, Human
cucuggaauuugaa

SEQ ID NO: 3361594 - RNA, 12 nt, Human
cucuggagccca

SEQ ID NO: 3361595 - RNA, 22 nt, Human
cucucugcaggucccuaauaaa

SEQ ID NO: 3361596 - RNA, 19 nt, Human
cucucugcaggucccuaau

SEQ ID NO: 3361597 - RNA, 17 nt, Human
cucucugcaggucccua

SEQ ID NO: 3361598 - RNA, 16 nt, Human
cucucugcaggucccu

SEQ ID NO: 3361599 - RNA, 14 nt, Human
cucucugcaggucc

SEQ ID NO: 3361600 - RNA, 13 nt, Human
cucucugcagguc

SEQ ID NO: 3361601 - RNA, 12 nt, Human
cucucugcaggu

SEQ ID NO: 3361602 - RNA, 21 nt, Human
cugaagagaagggcagggcug

SEQ ID NO: 3361603 - RNA, 12 nt, Human
cugaauuauuuu

SEQ ID NO: 3361604 - RNA, 15 nt, Human
cucuggagcccacug

SEQ ID NO: 3361605 - RNA, 15 nt, Human
cucuuggagccugca

SEQ ID NO: 3361606 - RNA, 22 nt, Human
cucuuggagccugcagagcugc

SEQ ID NO: 3361607 - RNA, 19 nt, Human
cucuugaacugagcuugga

SEQ ID NO: 3361608 - RNA, 16 nt, Human
cucuugaacugagcuu

SEQ ID NO: 3361609 - RNA, 17 nt, Human
cucuugaacugagcuug

SEQ ID NO: 3361610 - RNA, 14 nt, Human
cuuccuuccucucc

SEQ ID NO: 3361611 - RNA, 15 nt, Human
cuuccaagagccuga

SEQ ID NO: 3361612 - RNA, 14 nt, Human
cuuccaagagccug

SEQ ID NO: 3361613 - RNA, 13 nt, Human
cuucccuuucugc

SEQ ID NO: 3361614 - RNA, 14 nt, Human
cuuauaauuuaaaa

SEQ ID NO: 3361615 - RNA, 13 nt, Human
cuuauaauuuaaa

SEQ ID NO: 3361616 - RNA, 15 nt, Human
cuuaugauugcagau

SEQ ID NO: 3361617 - RNA, 11 nt, Human
cuuaacuauuc

SEQ ID NO: 3361618 - RNA, 18 nt, Human
cuguuuugaaucucauaa

SEQ ID NO: 3361619 - RNA, 13 nt, Human
cuguuuacagugu

SEQ ID NO: 3361620 - RNA, 15 nt, Human
cuguuuacaguguuc

SEQ ID NO: 3361621 - RNA, 17 nt, Human
cuugccaaauauaaaua

SEQ ID NO: 3361622 - RNA, 20 nt, Human
cuugcuugauuguauggugg

SEQ ID NO: 3361623 - RNA, 18 nt, Human
cuugcucuugaugccugg

SEQ ID NO: 3361624 - RNA, 17 nt, Human
cuugcucuugaugccug

SEQ ID NO: 3361625 - RNA, 19 nt, Human
cuugcucuugaugccuggc

SEQ ID NO: 3361626 - RNA, 17 nt, Human
cuuguacuuuauuuucu

SEQ ID NO: 3361627 - RNA, 15 nt, Human
cuuggaagcuucugg

SEQ ID NO: 3361628 - RNA, 17 nt, Human
cuuugacaaagguaaau

SEQ ID NO: 3361629 - RNA, 14 nt, Human
cuuucugucucucu

SEQ ID NO: 3361630 - RNA, 19 nt, Human
cuuugacaaagguaaauca

SEQ ID NO: 3361631 - RNA, 22 nt, Human
cuuugcauaacguauaaaagcc

SEQ ID NO: 3361632 - RNA, 13 nt, Human
gaagcguuguccu

SEQ ID NO: 3361633 - RNA, 19 nt, Human
gaagcguuguccucagccc

SEQ ID NO: 3361634 - RNA, 20 nt, Human
gaagcguuguccucagcccc

SEQ ID NO: 3361635 - RNA, 17 nt, Human
gaauauuugaauguaug

SEQ ID NO: 3361636 - RNA, 23 nt, Human
gaauucuugaaggaaaaugauac

SEQ ID NO: 3361637 - RNA, 23 nt, Human
gaauuguguuuauaauuuuaaau

SEQ ID NO: 3361638 - RNA, 15 nt, Human
gaauuguguuuauaa

SEQ ID NO: 3361639 - RNA, 21 nt, Human
gaauguaugcuucauacaggg

SEQ ID NO: 3361640 - RNA, 16 nt, Human
gaauguaugcuucaua

SEQ ID NO: 3361641 - RNA, 18 nt, Human
gaauguaugcuucauaca

SEQ ID NO: 3361642 - RNA, 18 nt, Human
gaacagauaaucagugug

SEQ ID NO: 3361643 - RNA, 21 nt, Human
gaacagcggcuggacuuggag

SEQ ID NO: 3361644 - RNA, 17 nt, Human
gaaauuuauaaacuuuu

SEQ ID NO: 3361645 - RNA, 16 nt, Human
gaaauuuauaaacuuu

SEQ ID NO: 3361646 - RNA, 16 nt, Human
gaaauuguauuacaaa

SEQ ID NO: 3361647 - RNA, 14 nt, Human
gaacuacugaggau

SEQ ID NO: 3361648 - RNA, 12 nt, Human
gaagagggcugc

SEQ ID NO: 3361649 - RNA, 15 nt, Human
gaagauguuucaaaa

SEQ ID NO: 3361650 - RNA, 17 nt, Human
gaagagaagggcagggc

SEQ ID NO: 3361651 - RNA, 20 nt, Human
gaagacugucagcuuccaaa

SEQ ID NO: 3361652 - RNA, 21 nt, Human
gaacucaucuagguaaauuac

SEQ ID NO: 3361653 - RNA, 20 nt, Human
gaacucaucuagguaaauua

SEQ ID NO: 3361654 - RNA, 12 nt, Human
gacccccuggag

SEQ ID NO: 3361655 - RNA, 17 nt, Human
gacauaaaaacaacuuu

SEQ ID NO: 3361656 - RNA, 11 nt, Human
gacugagaaau

SEQ ID NO: 3361657 - RNA, 13 nt, Human
gacugagaaauuu

SEQ ID NO: 3361658 - RNA, 18 nt, Human
gacuaaccccaccacacc

SEQ ID NO: 3361659 - RNA, 16 nt, Human
gaccuuccaagagccu

SEQ ID NO: 3361660 - RNA, 17 nt, Human
gaccuuccaagagccug

SEQ ID NO: 3361661 - RNA, 18 nt, Human
gaccuuccaagagccuga

SEQ ID NO: 3361662 - RNA, 18 nt, Human
gacuucccacggcuccuc

SEQ ID NO: 3361663 - RNA, 21 nt, Human
gaguguguaauuuaaaauugu

SEQ ID NO: 3361664 - RNA, 22 nt, Human
gaguguguaauuuaaaauugug

SEQ ID NO: 3361665 - RNA, 11 nt, Human
gaguucuacau

SEQ ID NO: 3361666 - RNA, 16 nt, Human
gauaaguucauacauu

SEQ ID NO: 3361667 - RNA, 16 nt, Human
gauugggaauccgccc

SEQ ID NO: 3361668 - RNA, 22 nt, Human
gcaacuuuguauaaaagggacu

SEQ ID NO: 3361669 - RNA, 12 nt, Human
gcaaaugugaau

SEQ ID NO: 3361670 - RNA, 20 nt, Human
gcaaacuuuauuuuguguuu

SEQ ID NO: 3361671 - RNA, 18 nt, Human
gcaaacuuuauuuugugu

SEQ ID NO: 3361672 - RNA, 15 nt, Human
gcaggagggaggugc

SEQ ID NO: 3361673 - RNA, 11 nt, Human
gcaggaggaag

SEQ ID NO: 3361674 - RNA, 21 nt, Human
gcaggaguuucguuuucaaaa

SEQ ID NO: 3361675 - RNA, 20 nt, Human
gcaggaguuucguuuucaaa

SEQ ID NO: 3361676 - RNA, 18 nt, Human
gcagauggaaugcugugu

SEQ ID NO: 3361677 - RNA, 19 nt, Human
gcagauuuugcccuugaca

SEQ ID NO: 3361678 - RNA, 12 nt, Human
gcacagccuggc

SEQ ID NO: 3361679 - RNA, 19 nt, Human
gcacagccuggcuguggcc

SEQ ID NO: 3361680 - RNA, 19 nt, Human
gcacaugccuguaguccca

SEQ ID NO: 3361681 - RNA, 23 nt, Human
gcauauuauuuuauguugcauag

SEQ ID NO: 3361682 - RNA, 18 nt, Human
gcauauuauuuuauguug

SEQ ID NO: 3361683 - RNA, 23 nt, Human
gcagguccccagacuccaccaag

SEQ ID NO: 3361684 - RNA, 12 nt, Human
gcaggucccuaa

SEQ ID NO: 3361685 - RNA, 14 nt, Human
gcagguccccagac

SEQ ID NO: 3361686 - RNA, 11 nt, Human
gcaggucccua

SEQ ID NO: 3361687 - RNA, 10 nt, Human
gcaggucccu

SEQ ID NO: 3361688 - RNA, 17 nt, Human
gcauuuuacuguacaga

SEQ ID NO: 3361689 - RNA, 16 nt, Human
gcauuuuacuguacag

SEQ ID NO: 3361690 - RNA, 17 nt, Human
gcaugaauuugugaagg

SEQ ID NO: 3361691 - RNA, 15 nt, Human
gcaugaauuugugaa

SEQ ID NO: 3361692 - RNA, 17 nt, Human
gccuaaccugccgagag

SEQ ID NO: 3361693 - RNA, 17 nt, Human
gccuauuuuaauaaaca

SEQ ID NO: 3361694 - RNA, 19 nt, Human
gccgggagccugacccuca

SEQ ID NO: 3361695 - RNA, 13 nt, Human
gccgggagccuga

SEQ ID NO: 3361696 - RNA, 14 nt, Human
gccgggagccugac

SEQ ID NO: 3361697 - RNA, 21 nt, Human
gccgagaguccaucagccucc

SEQ ID NO: 3361698 - RNA, 14 nt, Human
gccucucugcaggu

SEQ ID NO: 3361699 - RNA, 10 nt, Human
gccucucugc

SEQ ID NO: 3361700 - RNA, 17 nt, Human
gccucucugcagguccc

SEQ ID NO: 3361701 - RNA, 16 nt, Human
gccucucugcaggucc

SEQ ID NO: 3361702 - RNA, 23 nt, Human
gccucucugcaggucccuaauaa

SEQ ID NO: 3361703 - RNA, 20 nt, Human
gccugcagagcugcgggcug

SEQ ID NO: 3361704 - RNA, 15 nt, Human
gccugcagagcugcg

SEQ ID NO: 3361705 - RNA, 14 nt, Human
gcuaagaauauuug

SEQ ID NO: 3361706 - RNA, 21 nt, Human
gccagacuucccacggcuccu

SEQ ID NO: 3361707 - RNA, 22 nt, Human
gccacucaggcccaaagccucg

SEQ ID NO: 3361708 - RNA, 14 nt, Human
gccacucaggccca

SEQ ID NO: 3361709 - RNA, 13 nt, Human
gccccgcguggaa

SEQ ID NO: 3361710 - RNA, 20 nt, Human
gccccugagaucucugcagg

SEQ ID NO: 3361711 - RNA, 22 nt, Human
gcccaucugggggccucuucug

SEQ ID NO: 3361712 - RNA, 17 nt, Human
ggaacucgugucuggca

SEQ ID NO: 3361713 - RNA, 15 nt, Human
ggaaccgaggcaggg

SEQ ID NO: 3361714 - RNA, 16 nt, Human
ggaaccgaggcaggga

SEQ ID NO: 3361715 - RNA, 20 nt, Human
ggaaccgaggcagggaagga

SEQ ID NO: 3361716 - RNA, 19 nt, Human
gcuucuaguucugccagga

SEQ ID NO: 3361717 - RNA, 20 nt, Human
gcuucuaguucugccaggag

SEQ ID NO: 3361718 - RNA, 21 nt, Human
gcuucuaguucugccaggaga

SEQ ID NO: 3361719 - RNA, 17 nt, Human
gcuucuaguucugccag

SEQ ID NO: 3361720 - RNA, 18 nt, Human
gcuucuaguucugccagg

SEQ ID NO: 3361721 - RNA, 19 nt, Human
gcuucuggugaccuuccaa

SEQ ID NO: 3361722 - RNA, 16 nt, Human
ggaaaaaauaacaaug

SEQ ID NO: 3361723 - RNA, 20 nt, Human
ggaaaaaauaacaaugaaag

SEQ ID NO: 3361724 - RNA, 14 nt, Human
gcuuuaucaaaggg

SEQ ID NO: 3361725 - RNA, 17 nt, Human
gcugggaggagggcagg

SEQ ID NO: 3361726 - RNA, 19 nt, Human
gcuggggccaggcuggguc

SEQ ID NO: 3361727 - RNA, 16 nt, Human
gcuggggccaggcugg

SEQ ID NO: 3361728 - RNA, 15 nt, Human
gcugccuuuggacuu

SEQ ID NO: 3361729 - RNA, 20 nt, Human
gcugccuuuggacuuguccc

SEQ ID NO: 3361730 - RNA, 23 nt, Human
gcuagcagaaaucuagaagacug

SEQ ID NO: 3361731 - RNA, 23 nt, Human
gcugggacaccccgacuuuuguu

SEQ ID NO: 3361732 - RNA, 13 nt, Human
gcuggaucuguga

SEQ ID NO: 3361733 - RNA, 17 nt, Human
ggaucccaugagcuccu

SEQ ID NO: 3361734 - RNA, 20 nt, Human
ggaucccaugagcuccuuaa

SEQ ID NO: 3361735 - RNA, 14 nt, Human
ggcagguccccaga

SEQ ID NO: 3361736 - RNA, 19 nt, Human
ggcagguccccagacucca

SEQ ID NO: 3361737 - RNA, 20 nt, Human
ggcagucugagagaggccau

SEQ ID NO: 3361738 - RNA, 22 nt, Human
ggccaggcugggucgcccugga

SEQ ID NO: 3361739 - RNA, 18 nt, Human
ggccaggcugggucgccc

SEQ ID NO: 3361740 - RNA, 17 nt, Human
ggccccugccagacccc

SEQ ID NO: 3361741 - RNA, 19 nt, Human
ggccccugccagacccccu

SEQ ID NO: 3361742 - RNA, 17 nt, Human
ggccccugagaucucug

SEQ ID NO: 3361743 - RNA, 21 nt, Human
ggccccugagaucucugcagg

SEQ ID NO: 3361744 - RNA, 17 nt, Human
ggaaggaucccaugagc

SEQ ID NO: 3361745 - RNA, 12 nt, Human
ggagcccuggga

SEQ ID NO: 3361746 - RNA, 14 nt, Human
ggaggagggcaggc

SEQ ID NO: 3361747 - RNA, 15 nt, Human
ggaggagggcaggca

SEQ ID NO: 3361748 - RNA, 20 nt, Human
ggaggagggcaggcaucggg

SEQ ID NO: 3361749 - RNA, 16 nt, Human
ggagccgggagccuga

SEQ ID NO: 3361750 - RNA, 13 nt, Human
ggagggcaggcau

SEQ ID NO: 3361751 - RNA, 12 nt, Human
ggagggauuugg

SEQ ID NO: 3361752 - RNA, 13 nt, Human
ggauagaugugug

SEQ ID NO: 3361753 - RNA, 14 nt, Human
ggauagaugugugg

SEQ ID NO: 3361754 - RNA, 15 nt, Human
ggauagaugugugga

SEQ ID NO: 3361755 - RNA, 15 nt, Human
gggggagagggcugc

SEQ ID NO: 3361756 - RNA, 18 nt, Human
ggggugcugggccccugc

SEQ ID NO: 3361757 - RNA, 20 nt, Human
gggguggggggggugcuggg

SEQ ID NO: 3361758 - RNA, 16 nt, Human
gggccugggcaggagg

SEQ ID NO: 3361759 - RNA, 17 nt, Human
gggccugggcaggaggg

SEQ ID NO: 3361760 - RNA, 15 nt, Human
ggggaaaagagauga

SEQ ID NO: 3361761 - RNA, 15 nt, Human
ggggcgcggcuggga

SEQ ID NO: 3361762 - RNA, 16 nt, Human
ggggcgcggcugggag

SEQ ID NO: 3361763 - RNA, 19 nt, Human
ggggcagucugagagaggc

SEQ ID NO: 3361764 - RNA, 18 nt, Human
ggggcagucugagagagg

SEQ ID NO: 3361765 - RNA, 15 nt, Human
ggggcagucugagag

SEQ ID NO: 3361766 - RNA, 18 nt, Human
gguagaucacgagaucaa

SEQ ID NO: 3361767 - RNA, 17 nt, Human
gggugcugggccccugc

SEQ ID NO: 3361768 - RNA, 20 nt, Human
gggucuugguuccagccugc

SEQ ID NO: 3361769 - RNA, 15 nt, Human
ggugguggcucggga

SEQ ID NO: 3361770 - RNA, 22 nt, Human
ggugguucacucuuggagccug

SEQ ID NO: 3361771 - RNA, 23 nt, Human
ggugguucacucuuggagccugc

SEQ ID NO: 3361772 - RNA, 21 nt, Human
gguguccugcaccggggccug

SEQ ID NO: 3361773 - RNA, 17 nt, Human
gguguuuuaaaaaaucu

SEQ ID NO: 3361774 - RNA, 19 nt, Human
gguucacucuuggagccug

SEQ ID NO: 3361775 - RNA, 20 nt, Human
gguucacucuuggagccugc

SEQ ID NO: 3361776 - RNA, 21 nt, Human
gguucacucuuggagccugca

SEQ ID NO: 3361777 - RNA, 23 nt, Human
gguucacucuuggagccugcaga

SEQ ID NO: 3361778 - RNA, 19 nt, Human
ggugaccuuccaagagccu

SEQ ID NO: 3361779 - RNA, 20 nt, Human
ggugaccuuccaagagccug

SEQ ID NO: 3361780 - RNA, 21 nt, Human
ggugaccuuccaagagccuga

SEQ ID NO: 3361781 - RNA, 15 nt, Human
gggaaggaucccaug

SEQ ID NO: 3361782 - RNA, 20 nt, Human
gggaccccuggugguucacu

SEQ ID NO: 3361783 - RNA, 22 nt, Human
ggcuugaguuuaaauuguaaua

SEQ ID NO: 3361784 - RNA, 20 nt, Human
ggccccugccagacccccug

SEQ ID NO: 3361785 - RNA, 14 nt, Human
ggcucuggagccca

SEQ ID NO: 3361786 - RNA, 13 nt, Human
ggcucuggagccc

SEQ ID NO: 3361787 - RNA, 22 nt, Human
ggcugcagccaggccacuggcc

SEQ ID NO: 3361788 - RNA, 16 nt, Human
ggcugcagccaggcca

SEQ ID NO: 3361789 - RNA, 15 nt, Human
ggcugcuuuccaaag

SEQ ID NO: 3361790 - RNA, 20 nt, Human
gggcagucugagagaggcca

SEQ ID NO: 3361791 - RNA, 21 nt, Human
gggcagucugagagaggccau

SEQ ID NO: 3361792 - RNA, 13 nt, Human
gggccugggcagg

SEQ ID NO: 3361793 - RNA, 15 nt, Human
gggccugggcaggag

SEQ ID NO: 3361794 - RNA, 12 nt, Human
gggccugggcag

SEQ ID NO: 3361795 - RNA, 22 nt, Human
gggccccugccucucugcaggu

SEQ ID NO: 3361796 - RNA, 13 nt, Human
gggccccugccag

SEQ ID NO: 3361797 - RNA, 15 nt, Human
gggccccugccucuc

SEQ ID NO: 3361798 - RNA, 13 nt, Human
gggccccugccuc

SEQ ID NO: 3361799 - RNA, 21 nt, Human
gggccccugccucucugcagg

SEQ ID NO: 3361800 - RNA, 19 nt, Human
gggccccugccucucugca

SEQ ID NO: 3361801 - RNA, 18 nt, Human
gggccccugccucucugc

SEQ ID NO: 3361802 - RNA, 17 nt, Human
gggccccugccucucug

SEQ ID NO: 3361803 - RNA, 18 nt, Human
gggcagucugagagaggc

SEQ ID NO: 3361804 - RNA, 19 nt, Human
gggcagucugagagaggcc

SEQ ID NO: 3361805 - RNA, 17 nt, Human
gggcagucugagagagg

SEQ ID NO: 3361806 - RNA, 23 nt, Human
gggaggugcuucuaguucugcca

SEQ ID NO: 3361807 - RNA, 13 nt, Human
gggacugagaaau

SEQ ID NO: 3361808 - RNA, 16 nt, Human
gggaguuuaggguggg

SEQ ID NO: 3361809 - RNA, 11 nt, Human
gggagugugua

SEQ ID NO: 3361810 - RNA, 13 nt, Human
gggauagaugugu

SEQ ID NO: 3361811 - RNA, 14 nt, Human
gggauagaugugug

SEQ ID NO: 3361812 - RNA, 13 nt, Human
uuuuuucuuacug

SEQ ID NO: 3361813 - RNA, 14 nt, Zaire Ebola virus [ZEBOV]
uucgggccagcagc

SEQ ID NO: 3361814 - RNA, 22 nt, Zaire Ebola virus [ZEBOV]
ccggagaagagagugccagcag

SEQ ID NO: 3361815 - RNA, 16 nt, Zaire Ebola virus [ZEBOV]
ucaaacaagagauucc

SEQ ID NO: 3361816 - RNA, 21 nt, Zaire Ebola virus [ZEBOV]
aacuugacaucucugaggcaa

SEQ ID NO: 3361817 - RNA, 17 nt, Zaire Ebola virus [ZEBOV]
uaguauccugauacuug

SEQ ID NO: 3361818 - RNA, 16 nt, Zaire Ebola virus [ZEBOV]
acccuuccggaccagg

SEQ ID NO: 3361819 - RNA, 18 nt, Zaire Ebola virus [ZEBOV]
aaugauaaacuugaugaa

SEQ ID NO: 3361820 - RNA, 13 nt, Zaire Ebola virus [ZEBOV]
agauuauucauga

SEQ ID NO: 3361821 - RNA, 14 nt, Zaire Ebola virus [ZEBOV]
auuugagucuuaau

SEQ ID NO: 3361822 - RNA, 15 nt, Zaire Ebola virus [ZEBOV]
aaugguuaauuguaa

SEQ ID NO: 3361823 - RNA, 16 nt, Zaire Ebola virus [ZEBOV]
cacugacuuccuggac

SEQ ID NO: 3361824 - RNA, 22 nt, Zaire Ebola virus [ZEBOV]
auccugauacuugcaaagguug

SEQ ID NO: 3361825 - RNA, 13 nt, Zaire Ebola virus [ZEBOV]
aaggauugauuga

SEQ ID NO: 3361826 - RNA, 14 nt, Zaire Ebola virus [ZEBOV]
auauauuacuaacu

SEQ ID NO: 3361827 - RNA, 15 nt, Zaire Ebola virus [ZEBOV]
gaucucuuaaaauau

SEQ ID NO: 3361828 - RNA, 16 nt, Zaire Ebola virus [ZEBOV]
cuggcaacaacaacac

SEQ ID NO: 3361829 - RNA, 21 nt, Zaire Ebola virus [ZEBOV]
aguauuucaugacuuacuaau

SEQ ID NO: 3361830 - RNA, 14 nt, Zaire Ebola virus [ZEBOV]
aaugauaaacuuga

SEQ ID NO: 3361831 - RNA, 13 nt, Zaire Ebola virus [ZEBOV]
uuucaauccucaa

SEQ ID NO: 3361832 - RNA, 24 nt, Zaire Ebola virus [ZEBOV]
uaauacacccguguauaaacuuga

SEQ ID NO: 3361833 - RNA, 14 nt, Zaire Ebola virus [ZEBOV]
cgagcaagagcacu

SEQ ID NO: 3361834 - RNA, 19 nt, Zaire Ebola virus [ZEBOV]
aacugaagaccacaaaauc

SEQ ID NO: 3361835 - RNA, 14 nt, Zaire Ebola virus [ZEBOV]
uaaaacccuuccgg

SEQ ID NO: 3361836 - RNA, 24 nt, Zaire Ebola virus [ZEBOV]
gaugauucaaccgacaaauagcua

SEQ ID NO: 3361837 - RNA, 13 nt, Zaire Ebola virus [ZEBOV]
ugacuaaaacacu

SEQ ID NO: 3361838 - RNA, 22 nt, Zaire Ebola virus [ZEBOV]
aauacucauauuucuugauaau

SEQ ID NO: 3361839 - RNA, 22 nt, Zaire Ebola virus [ZEBOV]
ucaaggaagggaagcugcagug

SEQ ID NO: 3361840 - RNA, 17 nt, Zaire Ebola virus [ZEBOV]
ucacaguuaaucauaaa

SEQ ID NO: 3361841 - RNA, 15 nt, Zaire Ebola virus [ZEBOV]
aacaucauagaauug

SEQ ID NO: 3361842 - RNA, 22 nt, Zaire Ebola virus [ZEBOV]
acucuacaggagguagcaacga

SEQ ID NO: 3361843 - RNA, 13 nt, Zaire Ebola virus [ZEBOV]
cuuuuugcccuua

SEQ ID NO: 3361844 - RNA, 14 nt, Zaire Ebola virus [ZEBOV]
acccuaacagugau

SEQ ID NO: 3361845 - RNA, 16 nt, Zaire Ebola virus [ZEBOV]
auuuuugaugucuaag

SEQ ID NO: 3361846 - RNA, 19 nt, Zaire Ebola virus [ZEBOV]
auaaacuugaugaagauua

SEQ ID NO: 3361847 - RNA, 15 nt, Zaire Ebola virus [ZEBOV]
aucaaugaaaccagg

SEQ ID NO: 3361848 - RNA, 19 nt, Zaire Ebola virus [ZEBOV]
caauccaaguacagacauu

SEQ ID NO: 3361849 - RNA, 15 nt, Zaire Ebola virus [ZEBOV]
auuaacauacagauu

SEQ ID NO: 3361850 - RNA, 17 nt, Zaire Ebola virus [ZEBOV]
gcaggacugaucacagg

SEQ ID NO: 3361851 - RNA, 16 nt, Zaire Ebola virus [ZEBOV]
uuuucaaaguucaauu

SEQ ID NO: 3361852 - RNA, 15 nt, Zaire Ebola virus [ZEBOV]
cggacaacagcaccc

SEQ ID NO: 3361853 - RNA, 15 nt, Zaire Ebola virus [ZEBOV]
aguacuauaaucacu

SEQ ID NO: 3361854 - RNA, 18 nt, Zaire Ebola virus [ZEBOV]
ccauauuucgggccagca

SEQ ID NO: 3361855 - RNA, 20 nt, Zaire Ebola virus [ZEBOV]
caaauaauguuuuacucuac

SEQ ID NO: 3361856 - RNA, 18 nt, Zaire Ebola virus [ZEBOV]
uugagacagcuggccaac

SEQ ID NO: 3361857 - RNA, 20 nt, Zaire Ebola virus [ZEBOV]
agcuaggcuuaauuaccaau

SEQ ID NO: 3361858 - RNA, 22 nt, Zaire Ebola virus [ZEBOV]
gcgagaccgcuggcaacaacaa

SEQ ID NO: 3361859 - RNA, 23 nt, Zaire Ebola virus [ZEBOV]
cauaaacaagguuugacaucaau

SEQ ID NO: 3361860 - RNA, 21 nt, Zaire Ebola virus [ZEBOV]
aaacuuauucaguacuauaau

SEQ ID NO: 3361861 - RNA, 23 nt, Zaire Ebola virus [ZEBOV]
aaaaucgggacccauuucuaggu

SEQ ID NO: 3361862 - RNA, 18 nt, Zaire Ebola virus [ZEBOV]
cuucauggaaaagcucag

SEQ ID NO: 3361863 - RNA, 12 nt, Zaire Ebola virus [ZEBOV]
gucaaugcucaa

SEQ ID NO: 3361864 - RNA, 22 nt, Zaire Ebola virus [ZEBOV]
gcugcagcgauggggcggcaca

SEQ ID NO: 3361865 - RNA, 14 nt, Zaire Ebola virus [ZEBOV]
agauauauaagcau

SEQ ID NO: 3361866 - RNA, 21 nt, Zaire Ebola virus [ZEBOV]
cccaaaagcagagaacaccaa

SEQ ID NO: 3361867 - RNA, 14 nt, Zaire Ebola virus [ZEBOV]
ucaaaucaaugaaa

SEQ ID NO: 3361868 - RNA, 19 nt, Zaire Ebola virus [ZEBOV]
aguucaauuugagucuuaa

SEQ ID NO: 3361869 - RNA, 21 nt, Zaire Ebola virus [ZEBOV]
gaccaagauaaaauuguucau

SEQ ID NO: 3361870 - RNA, 17 nt, Zaire Ebola virus [ZEBOV]
cagacaacgacagcaca

SEQ ID NO: 3361871 - RNA, 23 nt, Zaire Ebola virus [ZEBOV]
ccggagaagagagugccagcagc

SEQ ID NO: 3361872 - RNA, 13 nt, Zaire Ebola virus [ZEBOV]
agacagcuggcca

SEQ ID NO: 3361873 - RNA, 18 nt, Zaire Ebola virus [ZEBOV]
agagcacugacuuccugg

SEQ ID NO: 3361874 - RNA, 16 nt, Zaire Ebola virus [ZEBOV]
aucgaaccacaugauu

SEQ ID NO: 3361875 - RNA, 19 nt, Zaire Ebola virus [ZEBOV]
cucuucaacuguuccugag

SEQ ID NO: 3361876 - RNA, 12 nt, Zaire Ebola virus [ZEBOV]
aagguugguuau

SEQ ID NO: 3361877 - RNA, 17 nt, Zaire Ebola virus [ZEBOV]
caaaagugaugaagauu

SEQ ID NO: 3361878 - RNA, 16 nt, Zaire Ebola virus [ZEBOV]
cgacagcacagccucc

SEQ ID NO: 3361879 - RNA, 21 nt, Zaire Ebola virus [ZEBOV]
acaacagcacccauaauacac

SEQ ID NO: 3361880 - RNA, 12 nt, Zaire Ebola virus [ZEBOV]
guuaaucuuucu

SEQ ID NO: 3361881 - RNA, 20 nt, Zaire Ebola virus [ZEBOV]
cacgagcaagagcacugacu

SEQ ID NO: 3361882 - RNA, 18 nt, Zaire Ebola virus [ZEBOV]
caacccuugccacaaucu

SEQ ID NO: 3361883 - RNA, 17 nt, Zaire Ebola virus [ZEBOV]
gauaccggagaagagag

SEQ ID NO: 3361884 - RNA, 15 nt, Zaire Ebola virus [ZEBOV]
acgacagcacagccu

SEQ ID NO: 3361885 - RNA, 18 nt, Zaire Ebola virus [ZEBOV]
acaaguccccaaaaccac

SEQ ID NO: 3361886 - RNA, 16 nt, Zaire Ebola virus [ZEBOV]
gaccagggggacaaug

SEQ ID NO: 3361887 - RNA, 23 nt, Zaire Ebola virus [ZEBOV]
acaacccuaacagugaucaaaga

SEQ ID NO: 3361888 - RNA, 18 nt, Zaire Ebola virus [ZEBOV]
aagagagugccagcagcg

SEQ ID NO: 3361889 - RNA, 19 nt, Zaire Ebola virus [ZEBOV]
agucaaggaagggaagcug

SEQ ID NO: 3361890 - RNA, 15 nt, Zaire Ebola virus [ZEBOV]
cagacaacgacagca

SEQ ID NO: 3361891 - RNA, 21 nt, Zaire Ebola virus [ZEBOV]
cguccauuagaggagacacuu

SEQ ID NO: 3361892 - RNA, 16 nt, Zaire Ebola virus [ZEBOV]
ccccgccaccacaaca

SEQ ID NO: 3361893 - RNA, 18 nt, Zaire Ebola virus [ZEBOV]
cacaaccaaaccaggucc

SEQ ID NO: 3361894 - RNA, 20 nt, Zaire Ebola virus [ZEBOV]
gcaugauugcccuaauauau

SEQ ID NO: 3361895 - RNA, 16 nt, Zaire Ebola virus [ZEBOV]
ucacaaccaaaccagg

SEQ ID NO: 3361896 - RNA, 20 nt, Zaire Ebola virus [ZEBOV]
gguccggacaacagcaccca

SEQ ID NO: 3361897 - RNA, 14 nt, Zaire Ebola virus [ZEBOV]
cauuaaugauacac

SEQ ID NO: 3361898 - RNA, 20 nt, Zaire Ebola virus [ZEBOV]
aaauguaauaggagcuauau

SEQ ID NO: 3361899 - RNA, 22 nt, Zaire Ebola virus [ZEBOV]
aaugauaauauaauacacugga

SEQ ID NO: 3361900 - RNA, 19 nt, Zaire Ebola virus [ZEBOV]
guccccaaucccucacaac

SEQ ID NO: 3361901 - RNA, 11 nt, Zaire Ebola virus [ZEBOV]
aaaaccaggac

SEQ ID NO: 3361902 - RNA, 15 nt, Zaire Ebola virus [ZEBOV]
auuuuaucaccagaa

SEQ ID NO: 3361903 - RNA, 20 nt, Zaire Ebola virus [ZEBOV]
gacacccuuacaaaaaccag

SEQ ID NO: 3361904 - RNA, 22 nt, Zaire Ebola virus [ZEBOV]
aaaaaccaggacucagaauccc

SEQ ID NO: 3361905 - RNA, 16 nt, Zaire Ebola virus [ZEBOV]
gaagagguaugauaca

SEQ ID NO: 3361906 - RNA, 19 nt, Zaire Ebola virus [ZEBOV]
gauucuuguacacaaauaa

SEQ ID NO: 3361907 - RNA, 16 nt, Zaire Ebola virus [ZEBOV]
uugagucuuaaugcaa

SEQ ID NO: 3361908 - RNA, 22 nt, Zaire Ebola virus [ZEBOV]
cauuacuggacuacucaggaug

SEQ ID NO: 3361909 - RNA, 11 nt, Zaire Ebola virus [ZEBOV]
uauaauacacu

SEQ ID NO: 3361910 - RNA, 21 nt, Zaire Ebola virus [ZEBOV]
gaggcgaauaauagcagaggc

SEQ ID NO: 3361911 - RNA, 19 nt, Zaire Ebola virus [ZEBOV]
ggacccccaaaagcagaga

SEQ ID NO: 3361912 - RNA, 12 nt, Zaire Ebola virus [ZEBOV]
auaaaacccuuc

SEQ ID NO: 3361913 - RNA, 16 nt, Zaire Ebola virus [ZEBOV]
aagugauucuuguaca

SEQ ID NO: 3361914 - RNA, 20 nt, Zaire Ebola virus [ZEBOV]
acugaagaccacaaaaucau

SEQ ID NO: 3361915 - RNA, 20 nt, Zaire Ebola virus [ZEBOV]
uuuaaccacagauaaauccu

SEQ ID NO: 3361916 - RNA, 14 nt, Zaire Ebola virus [ZEBOV]
uuacaccauugucu

SEQ ID NO: 3361917 - RNA, 21 nt, Zaire Ebola virus [ZEBOV]
cagcuggccaacgagacgacu

SEQ ID NO: 3361918 - RNA, 19 nt, Zaire Ebola virus [ZEBOV]
acaaaagacucauaauaua

SEQ ID NO: 3361919 - RNA, 20 nt, Zaire Ebola virus [ZEBOV]
accccgccaccacaacaagu

SEQ ID NO: 3361920 - RNA, 16 nt, Zaire Ebola virus [ZEBOV]
uaacagacaaaauuga

SEQ ID NO: 3361921 - RNA, 18 nt, Zaire Ebola virus [ZEBOV]
guacagacauugcccuuc

SEQ ID NO: 3361922 - RNA, 14 nt, Zaire Ebola virus [ZEBOV]
cuguauaugcaaau

SEQ ID NO: 3361923 - RNA, 15 nt, Zaire Ebola virus [ZEBOV]
cacccauaauacacc

SEQ ID NO: 3361924 - RNA, 21 nt, Zaire Ebola virus [ZEBOV]
uuguaacucaauauucuaacu

SEQ ID NO: 3361925 - RNA, 14 nt, Zaire Ebola virus [ZEBOV]
auaauauaauacac

SEQ ID NO: 3361926 - RNA, 18 nt, Zaire Ebola virus [ZEBOV]
aucauagaauugcuuuau

SEQ ID NO: 3361927 - RNA, 17 nt, Zaire Ebola virus [ZEBOV]
cacaaccaaaccagguc

SEQ ID NO: 3361928 - RNA, 22 nt, Zaire Ebola virus [ZEBOV]
agaauugcuuuauuauaugaau

SEQ ID NO: 3361929 - RNA, 20 nt, Zaire Ebola virus [ZEBOV]
caggaugaaggugcugcaau

SEQ ID NO: 3361930 - RNA, 14 nt, Zaire Ebola virus [ZEBOV]
acagcacagccucc

SEQ ID NO: 3361931 - RNA, 16 nt, Zaire Ebola virus [ZEBOV]
gacaaaugauaauaua

SEQ ID NO: 3361932 - RNA, 16 nt, Zaire Ebola virus [ZEBOV]
aagagguaugauacaa

SEQ ID NO: 3361933 - RNA, 15 nt, Zaire Ebola virus [ZEBOV]
cacaugccacauucu

SEQ ID NO: 3361934 - RNA, 22 nt, Zaire Ebola virus [ZEBOV]
acuaaaggugcuuuacaccauu

SEQ ID NO: 3361935 - RNA, 21 nt, Zaire Ebola virus [ZEBOV]
gcucagccucaaaucaaugaa

SEQ ID NO: 3361936 - RNA, 14 nt, Zaire Ebola virus [ZEBOV]
ccucugccacgacc

SEQ ID NO: 3361937 - RNA, 20 nt, Zaire Ebola virus [ZEBOV]
ugguuauuaacauacagauu

SEQ ID NO: 3361938 - RNA, 16 nt, Zaire Ebola virus [ZEBOV]
cucaaaucaaugaaac

SEQ ID NO: 3361939 - RNA, 20 nt, Zaire Ebola virus [ZEBOV]
gaaaauuccucugcaauggu

SEQ ID NO: 3361940 - RNA, 21 nt, Zaire Ebola virus [ZEBOV]
gaauugcuuuauuauaugaau

SEQ ID NO: 3361941 - RNA, 17 nt, Zaire Ebola virus [ZEBOV]
ccagggaccaacacaac

SEQ ID NO: 3361942 - RNA, 23 nt, Zaire Ebola virus [ZEBOV]
caaacggagccaaaaacaucagu

SEQ ID NO: 3361943 - RNA, 14 nt, Zaire Ebola virus [ZEBOV]
agcgauuuaucuaa

SEQ ID NO: 3361944 - RNA, 14 nt, Zaire Ebola virus [ZEBOV]
ucaaccgacaaaua

SEQ ID NO: 3361945 - RNA, 14 nt, Zaire Ebola virus [ZEBOV]
auaaacuugacauc

SEQ ID NO: 3361946 - RNA, 13 nt, Zaire Ebola virus [ZEBOV]
aaagguugguuau

SEQ ID NO: 3361947 - RNA, 21 nt, Zaire Ebola virus [ZEBOV]
uauaugcugacucaauaguua

SEQ ID NO: 3361948 - RNA, 18 nt, Zaire Ebola virus [ZEBOV]
aaucuuucucauugcaca

SEQ ID NO: 3361949 - RNA, 19 nt, Zaire Ebola virus [ZEBOV]
gcgaauaauagcagaggcu

SEQ ID NO: 3361950 - RNA, 22 nt, Zaire Ebola virus [ZEBOV]
uauuaaguaacccaaaccaaaa

SEQ ID NO: 3361951 - RNA, 15 nt, Zaire Ebola virus [ZEBOV]
cauacagauuauaaa

SEQ ID NO: 3361952 - RNA, 16 nt, Zaire Ebola virus [ZEBOV]
auuauaugaauaagca

SEQ ID NO: 3361953 - RNA, 17 nt, Zaire Ebola virus [ZEBOV]
uuauccucaaauugccu

SEQ ID NO: 3361954 - RNA, 16 nt, Zaire Ebola virus [ZEBOV]
aaagguugguuauuaa

SEQ ID NO: 3361955 - RNA, 15 nt, Zaire Ebola virus [ZEBOV]
uuuaucaccagaaau

SEQ ID NO: 3361956 - RNA, 19 nt, Zaire Ebola virus [ZEBOV]
gaccagggggacaaugaca

SEQ ID NO: 3361957 - RNA, 23 nt, Zaire Ebola virus [ZEBOV]
uugcuggagucgcaggacugauc

SEQ ID NO: 3361958 - RNA, 13 nt, Zaire Ebola virus [ZEBOV]
cggagccaaaaac

SEQ ID NO: 3361959 - RNA, 18 nt, Zaire Ebola virus [ZEBOV]
ucuucaacuguuccugag

SEQ ID NO: 3361960 - RNA, 19 nt, Zaire Ebola virus [ZEBOV]
ccauauuucgggccagcag

SEQ ID NO: 3361961 - RNA, 15 nt, Zaire Ebola virus [ZEBOV]
aucuaacaacccuug

SEQ ID NO: 3361962 - RNA, 12 nt, Zaire Ebola virus [ZEBOV]
agcucagccuca

SEQ ID NO: 3361963 - RNA, 14 nt, Zaire Ebola virus [ZEBOV]
aucuauuuaguaau

SEQ ID NO: 3361964 - RNA, 19 nt, Zaire Ebola virus [ZEBOV]
ggacuacucaggaugaagg

SEQ ID NO: 3361965 - RNA, 23 nt, Zaire Ebola virus [ZEBOV]
acaauugguggacaggauggaga

SEQ ID NO: 3361966 - RNA, 15 nt, Zaire Ebola virus [ZEBOV]
auucuguauaugcaa

SEQ ID NO: 3361967 - RNA, 15 nt, Zaire Ebola virus [ZEBOV]
gacuacucaggauga

SEQ ID NO: 3361968 - RNA, 15 nt, Zaire Ebola virus [ZEBOV]
acacucccucugcca

SEQ ID NO: 3361969 - RNA, 14 nt, Zaire Ebola virus [ZEBOV]
gggaagcugcagug

SEQ ID NO: 3361970 - RNA, 19 nt, Zaire Ebola virus [ZEBOV]
caggacucagaaucccuca

SEQ ID NO: 3361971 - RNA, 18 nt, Zaire Ebola virus [ZEBOV]
gccagcagccgagggaau

SEQ ID NO: 3361972 - RNA, 22 nt, Zaire Ebola virus [ZEBOV]
ucacaguuaaucauaaacaagg

SEQ ID NO: 3361973 - RNA, 14 nt, Zaire Ebola virus [ZEBOV]
aauccucacuguaa

SEQ ID NO: 3361974 - RNA, 14 nt, Zaire Ebola virus [ZEBOV]
uguuuuuaaaggau

SEQ ID NO: 3361975 - RNA, 18 nt, Zaire Ebola virus [ZEBOV]
gacaggauggagacaaug

SEQ ID NO: 3361976 - RNA, 21 nt, Zaire Ebola virus [ZEBOV]
ccaaaccagguccggacaaca

SEQ ID NO: 3361977 - RNA, 22 nt, Zaire Ebola virus [ZEBOV]
caaagguugguuauuaacauac

SEQ ID NO: 3361978 - RNA, 22 nt, Zaire Ebola virus [ZEBOV]
acaaauaauccuacuauaauca

SEQ ID NO: 3361979 - RNA, 19 nt, Zaire Ebola virus [ZEBOV]
acaauacuccguauaccua

SEQ ID NO: 3361980 - RNA, 22 nt, Zaire Ebola virus [ZEBOV]
cgacccagggaccaacacaaca

SEQ ID NO: 3361981 - RNA, 14 nt, Zaire Ebola virus [ZEBOV]
caaaagugaugaag

SEQ ID NO: 3361982 - RNA, 15 nt, Zaire Ebola virus [ZEBOV]
cuaauuuacauuacu

SEQ ID NO: 3361983 - RNA, 12 nt, Zaire Ebola virus [ZEBOV]
aauuugucuuuu

SEQ ID NO: 3361984 - RNA, 19 nt, Zaire Ebola virus [ZEBOV]
accacaugauuggaccaag

SEQ ID NO: 3361985 - RNA, 16 nt, Zaire Ebola virus [ZEBOV]
acacucaucaccaaga

SEQ ID NO: 3361986 - RNA, 16 nt, Zaire Ebola virus [ZEBOV]
caccacaacaaguccc

SEQ ID NO: 3361987 - RNA, 20 nt, Zaire Ebola virus [ZEBOV]
gcuuuauucuguauaugcaa

SEQ ID NO: 3361988 - RNA, 21 nt, Zaire Ebola virus [ZEBOV]
agcauaauaaauaaauacuca

SEQ ID NO: 3361989 - RNA, 18 nt, Zaire Ebola virus [ZEBOV]
aacucauauaugcugacu

SEQ ID NO: 3361990 - RNA, 17 nt, Zaire Ebola virus [ZEBOV]
ugcuuacaucugaggau

SEQ ID NO: 3361991 - RNA, 22 nt, Zaire Ebola virus [ZEBOV]
caaugguucaagugcacaguca

SEQ ID NO: 3361992 - RNA, 13 nt, Zaire Ebola virus [ZEBOV]
auaaacuugacau

SEQ ID NO: 3361993 - RNA, 13 nt, Zaire Ebola virus [ZEBOV]
gcuaaugcacaau

SEQ ID NO: 3361994 - RNA, 20 nt, Zaire Ebola virus [ZEBOV]
aacauuagauaaguagauua

SEQ ID NO: 3361995 - RNA, 14 nt, Zaire Ebola virus [ZEBOV]
aaucaagaugguuu

SEQ ID NO: 3361996 - RNA, 20 nt, Zaire Ebola virus [ZEBOV]
aacgaaaacaggaagaauuu

SEQ ID NO: 3361997 - RNA, 22 nt, Zaire Ebola virus [ZEBOV]
cacaaaaucauggcuucagaaa

SEQ ID NO: 3361998 - RNA, 12 nt, Zaire Ebola virus [ZEBOV]
acuugcaaaggu

SEQ ID NO: 3361999 - RNA, 21 nt, Zaire Ebola virus [ZEBOV]
ucacauguguuagguuucaca

SEQ ID NO: 3362000 - RNA, 14 nt, Zaire Ebola virus [ZEBOV]
acagauaaauccuc

SEQ ID NO: 3362001 - RNA, 13 nt, Zaire Ebola virus [ZEBOV]
agcaagagcacug

SEQ ID NO: 3362002 - RNA, 19 nt, Zaire Ebola virus [ZEBOV]
ugccagcagcgggaagcua

SEQ ID NO: 3362003 - RNA, 15 nt, Zaire Ebola virus [ZEBOV]
gaaagaucauaacua

SEQ ID NO: 3362004 - RNA, 15 nt, Zaire Ebola virus [ZEBOV]
gaaugauaaacuuga

SEQ ID NO: 3362005 - RNA, 13 nt, Zaire Ebola virus [ZEBOV]
ucaaugaaaccag

SEQ ID NO: 3362006 - RNA, 23 nt, Zaire Ebola virus [ZEBOV]
aaaauaaguauuucaugacuuac

SEQ ID NO: 3362007 - RNA, 19 nt, Zaire Ebola virus [ZEBOV]
cucacaguuaaucauaaac

SEQ ID NO: 3362008 - RNA, 21 nt, Zaire Ebola virus [ZEBOV]
cuguggguugagacagcuggc

SEQ ID NO: 3362009 - RNA, 17 nt, Zaire Ebola virus [ZEBOV]
uucauaaucagauauau

SEQ ID NO: 3362010 - RNA, 22 nt, Zaire Ebola virus [ZEBOV]
acacaacaacugaagaccacaa

SEQ ID NO: 3362011 - RNA, 12 nt, Zaire Ebola virus [ZEBOV]
aaucuaagauua

SEQ ID NO: 3362012 - RNA, 16 nt, Zaire Ebola virus [ZEBOV]
aaacaagguuugacau

SEQ ID NO: 3362013 - RNA, 20 nt, Zaire Ebola virus [ZEBOV]
acaauccaaguacagacauu

SEQ ID NO: 3362014 - RNA, 19 nt, Zaire Ebola virus [ZEBOV]
ccgacccagggaccaacac

SEQ ID NO: 3362015 - RNA, 13 nt, Zaire Ebola virus [ZEBOV]
cagacauugcccu

SEQ ID NO: 3362016 - RNA, 23 nt, Zaire Ebola virus [ZEBOV]
aauauaugaagagguaugauaca

SEQ ID NO: 3362017 - RNA, 15 nt, Zaire Ebola virus [ZEBOV]
acaaguccccaaaac

SEQ ID NO: 3362018 - RNA, 14 nt, Zaire Ebola virus [ZEBOV]
aaaaucauggcuuc

SEQ ID NO: 3362019 - RNA, 20 nt, Zaire Ebola virus [ZEBOV]
acucaauaguuaucuugaca

SEQ ID NO: 3362020 - RNA, 23 nt, Zaire Ebola virus [ZEBOV]
augauucaaccgacaaauagcua

SEQ ID NO: 3362021 - RNA, 15 nt, Zaire Ebola virus [ZEBOV]
gagucgcaggacuga

SEQ ID NO: 3362022 - RNA, 18 nt, Zaire Ebola virus [ZEBOV]
aaucaauacggugauuca

SEQ ID NO: 3362023 - RNA, 14 nt, Zaire Ebola virus [ZEBOV]
cuuccggaccaggg

SEQ ID NO: 3362024 - RNA, 15 nt, Zaire Ebola virus [ZEBOV]
acaaaauugaucaga

SEQ ID NO: 3362025 - RNA, 22 nt, Zaire Ebola virus [ZEBOV]
aacuuaacaaaagacucauaau

SEQ ID NO: 3362026 - RNA, 18 nt, Zaire Ebola virus [ZEBOV]
gaagggaagcugcagugu

SEQ ID NO: 3362027 - RNA, 21 nt, Zaire Ebola virus [ZEBOV]
caggcguuauaauugcaguua

SEQ ID NO: 3362028 - RNA, 18 nt, Zaire Ebola virus [ZEBOV]
ucaaaucaaugaaaccag

SEQ ID NO: 3362029 - RNA, 23 nt, Zaire Ebola virus [ZEBOV]
cuucauggaaaagcucagccuca

SEQ ID NO: 3362030 - RNA, 18 nt, Zaire Ebola virus [ZEBOV]
auacucguaauuaacauu

SEQ ID NO: 3362031 - RNA, 15 nt, Zaire Ebola virus [ZEBOV]
uuucaaaguucaauu

SEQ ID NO: 3362032 - RNA, 15 nt, Zaire Ebola virus [ZEBOV]
acgcaccuuuucaau

SEQ ID NO: 3362033 - RNA, 15 nt, Zaire Ebola virus [ZEBOV]
uaguauccugauacu

SEQ ID NO: 3362034 - RNA, 21 nt, Zaire Ebola virus [ZEBOV]
auccaguuuuauagaaucuuc

SEQ ID NO: 3362035 - RNA, 19 nt, Zaire Ebola virus [ZEBOV]
auaaacaagguuugacauc

SEQ ID NO: 3362036 - RNA, 18 nt, Zaire Ebola virus [ZEBOV]
auggaaaagcucagccuc

SEQ ID NO: 3362037 - RNA, 21 nt, Zaire Ebola virus [ZEBOV]
aagguugguuauuaacauaca

SEQ ID NO: 3362038 - RNA, 13 nt, Zaire Ebola virus [ZEBOV]
uugcacaaaguga

SEQ ID NO: 3362039 - RNA, 18 nt, Zaire Ebola virus [ZEBOV]
aauugcaguuaucgcuuu

SEQ ID NO: 3362040 - RNA, 21 nt, Zaire Ebola virus [ZEBOV]
acucaauaguuaucuugacau

SEQ ID NO: 3362041 - RNA, 19 nt, Zaire Ebola virus [ZEBOV]
agcacagccuccgacacuc

SEQ ID NO: 3362042 - RNA, 16 nt, Zaire Ebola virus [ZEBOV]
uauuaacauacagauu

SEQ ID NO: 3362043 - RNA, 18 nt, Zaire Ebola virus [ZEBOV]
gacauugcccuucuaauu

SEQ ID NO: 3362044 - RNA, 14 nt, Zaire Ebola virus [ZEBOV]
ucuuaaugcaaaua

SEQ ID NO: 3362045 - RNA, 18 nt, Zaire Ebola virus [ZEBOV]
auagugauaacaucuauu

SEQ ID NO: 3362046 - RNA, 21 nt, Zaire Ebola virus [ZEBOV]
aggcugacuaaaacacuauau

SEQ ID NO: 3362047 - RNA, 16 nt, Zaire Ebola virus [ZEBOV]
ugcccuucuaauuaag

SEQ ID NO: 3362048 - RNA, 14 nt, Zaire Ebola virus [ZEBOV]
ucaaugaaaccagg

SEQ ID NO: 3362049 - RNA, 15 nt, Zaire Ebola virus [ZEBOV]
cauagaauugcuuua

SEQ ID NO: 3362050 - RNA, 16 nt, Zaire Ebola virus [ZEBOV]
ccccaaaaccacagcg

SEQ ID NO: 3362051 - RNA, 21 nt, Zaire Ebola virus [ZEBOV]
cacaaagugauucuuguacac

SEQ ID NO: 3362052 - RNA, 18 nt, Zaire Ebola virus [ZEBOV]
guuuaaccacagauaaau

SEQ ID NO: 3362053 - RNA, 14 nt, Zaire Ebola virus [ZEBOV]
agauugcuucaugg

SEQ ID NO: 3362054 - RNA, 18 nt, Zaire Ebola virus [ZEBOV]
ugcugacucaauaguuau

SEQ ID NO: 3362055 - RNA, 17 nt, Zaire Ebola virus [ZEBOV]
uucugggaccggacugc

SEQ ID NO: 3362056 - RNA, 20 nt, Zaire Ebola virus [ZEBOV]
cauaguauccugauacuugc

SEQ ID NO: 3362057 - RNA, 17 nt, Zaire Ebola virus [ZEBOV]
acaacgacagcacagcc

SEQ ID NO: 3362058 - RNA, 20 nt, Zaire Ebola virus [ZEBOV]
ugauacaacccuaacaguga

SEQ ID NO: 3362059 - RNA, 21 nt, Zaire Ebola virus [ZEBOV]
gcgaacuucuuccgacccagg

SEQ ID NO: 3362060 - RNA, 16 nt, Zaire Ebola virus [ZEBOV]
acaacaucaccgcaga

SEQ ID NO: 3362061 - RNA, 21 nt, Zaire Ebola virus [ZEBOV]
ucuuccgacccagggaccaac

SEQ ID NO: 3362062 - RNA, 20 nt, Zaire Ebola virus [ZEBOV]
cacaacaacugaagaccaca

SEQ ID NO: 3362063 - RNA, 17 nt, Zaire Ebola virus [ZEBOV]
auucuaacuagcgauuu

SEQ ID NO: 3362064 - RNA, 13 nt, Zaire Ebola virus [ZEBOV]
agaguugucuuuc

SEQ ID NO: 3362065 - RNA, 13 nt, Zaire Ebola virus [ZEBOV]
auaauuguaacuc

SEQ ID NO: 3362066 - RNA, 18 nt, Zaire Ebola virus [ZEBOV]
auaaacaagguuugacau

SEQ ID NO: 3362067 - RNA, 17 nt, Zaire Ebola virus [ZEBOV]
cucuugcacaaagugau

SEQ ID NO: 3362068 - RNA, 15 nt, Zaire Ebola virus [ZEBOV]
caacugaagaccaca

SEQ ID NO: 3362069 - RNA, 22 nt, Zaire Ebola virus [ZEBOV]
uuuacacgaucguuuuauaauu

SEQ ID NO: 3362070 - RNA, 14 nt, Zaire Ebola virus [ZEBOV]
ucauaacuaauaac

SEQ ID NO: 3362071 - RNA, 20 nt, Zaire Ebola virus [ZEBOV]
ucaaacggagccaaaaacau

SEQ ID NO: 3362072 - RNA, 15 nt, Zaire Ebola virus [ZEBOV]
augcuuuuauaacuu

SEQ ID NO: 3362073 - RNA, 22 nt, Zaire Ebola virus [ZEBOV]
cuucagaaaauuccucugcaau

SEQ ID NO: 3362074 - RNA, 14 nt, Zaire Ebola virus [ZEBOV]
acgagacgacucaa

SEQ ID NO: 3362075 - RNA, 16 nt, Zaire Ebola virus [ZEBOV]
aaaauugaucagauua

SEQ ID NO: 3362076 - RNA, 20 nt, Zaire Ebola virus [ZEBOV]
acauuaugcuuuuauaacuu

SEQ ID NO: 3362077 - RNA, 21 nt, Zaire Ebola virus [ZEBOV]
cucagggauagugauaacauc

SEQ ID NO: 3362078 - RNA, 16 nt, Zaire Ebola virus [ZEBOV]
agacaaaauugaucag

SEQ ID NO: 3362079 - RNA, 22 nt, Zaire Ebola virus [ZEBOV]
uuuaucuaaauuaaauuacauu

SEQ ID NO: 3362080 - RNA, 12 nt, Zaire Ebola virus [ZEBOV]
aucucugcuuuc

SEQ ID NO: 3362081 - RNA, 15 nt, Zaire Ebola virus [ZEBOV]
caaaaccacagcgag

SEQ ID NO: 3362082 - RNA, 19 nt, Zaire Ebola virus [ZEBOV]
aauuugagucuuaaugcaa

SEQ ID NO: 3362083 - RNA, 19 nt, Zaire Ebola virus [ZEBOV]
uuauuaacauacagauuau

SEQ ID NO: 3362084 - RNA, 13 nt, Zaire Ebola virus [ZEBOV]
auacuugcaaagg

SEQ ID NO: 3362085 - RNA, 13 nt, Zaire Ebola virus [ZEBOV]
gaagcugcagugu

SEQ ID NO: 3362086 - RNA, 17 nt, Zaire Ebola virus [ZEBOV]
aagagagugccagcagc

SEQ ID NO: 3362087 - RNA, 20 nt, Zaire Ebola virus [ZEBOV]
uaguauccugauacuugcaa

SEQ ID NO: 3362088 - RNA, 14 nt, Zaire Ebola virus [ZEBOV]
uccugagagccaca

SEQ ID NO: 3362089 - RNA, 21 nt, Zaire Ebola virus [ZEBOV]
cagacaacgacagcacagccu

SEQ ID NO: 3362090 - RNA, 16 nt, Zaire Ebola virus [ZEBOV]
ugcauaguauccugau

SEQ ID NO: 3362091 - RNA, 17 nt, Zaire Ebola virus [ZEBOV]
uuguucacaauccaagu

SEQ ID NO: 3362092 - RNA, 16 nt, Zaire Ebola virus [ZEBOV]
aacugcugaacuauag

SEQ ID NO: 3362093 - RNA, 18 nt, Zaire Ebola virus [ZEBOV]
agaacaccaacacgagca

SEQ ID NO: 3362094 - RNA, 22 nt, Zaire Ebola virus [ZEBOV]
auaguauccugauacuugcaaa

SEQ ID NO: 3362095 - RNA, 17 nt, Zaire Ebola virus [ZEBOV]
gacaacgacagcacagc

SEQ ID NO: 3362096 - RNA, 14 nt, Zaire Ebola virus [ZEBOV]
cucaauaguuaucu

SEQ ID NO: 3362097 - RNA, 14 nt, Zaire Ebola virus [ZEBOV]
aaauguagaacuua

SEQ ID NO: 3362098 - RNA, 16 nt, Zaire Ebola virus [ZEBOV]
cauaacagacaaaauu

SEQ ID NO: 3362099 - RNA, 23 nt, Zaire Ebola virus [ZEBOV]
cuucuuccgacccagggaccaac

SEQ ID NO: 3362100 - RNA, 16 nt, Zaire Ebola virus [ZEBOV]
ucaaguugaacaacau

SEQ ID NO: 3362101 - RNA, 14 nt, Zaire Ebola virus [ZEBOV]
acaacgacagcaca

SEQ ID NO: 3362102 - RNA, 20 nt, Zaire Ebola virus [ZEBOV]
uaaccacagauaaauccuca

SEQ ID NO: 3362103 - RNA, 14 nt, Zaire Ebola virus [ZEBOV]
uagccaaugugauu

SEQ ID NO: 3362104 - RNA, 20 nt, Zaire Ebola virus [ZEBOV]
aaucucguaucgcucguaau

SEQ ID NO: 3362105 - RNA, 17 nt, Zaire Ebola virus [ZEBOV]
ugcauaguauccugaua

SEQ ID NO: 3362106 - RNA, 19 nt, Zaire Ebola virus [ZEBOV]
acguuacauuaaugauaca

SEQ ID NO: 3362107 - RNA, 21 nt, Zaire Ebola virus [ZEBOV]
accauauuucgggccagcagc

SEQ ID NO: 3362108 - RNA, 21 nt, Zaire Ebola virus [ZEBOV]
ucagaaaauuccucugcaaug

SEQ ID NO: 3362109 - RNA, 21 nt, Zaire Ebola virus [ZEBOV]
uuaacauacagauuauaaaaa

SEQ ID NO: 3362110 - RNA, 17 nt, Zaire Ebola virus [ZEBOV]
aucucugcuuucauaau

SEQ ID NO: 3362111 - RNA, 22 nt, Zaire Ebola virus [ZEBOV]
aucauaaacaagguuugacauc

SEQ ID NO: 3362112 - RNA, 19 nt, Zaire Ebola virus [ZEBOV]
augcaacccuaauuuacau

SEQ ID NO: 3362113 - RNA, 13 nt, Zaire Ebola virus [ZEBOV]
agauauauaagca

SEQ ID NO: 3362114 - RNA, 17 nt, Zaire Ebola virus [ZEBOV]
cacaaucuccacgaguc

SEQ ID NO: 3362115 - RNA, 14 nt, Zaire Ebola virus [ZEBOV]
auagaaucuucuca

SEQ ID NO: 3362116 - RNA, 13 nt, Zaire Ebola virus [ZEBOV]
gaacaacaucacc

SEQ ID NO: 3362117 - RNA, 17 nt, Zaire Ebola virus [ZEBOV]
auuagaggagacacuuu

SEQ ID NO: 3362118 - RNA, 19 nt, Zaire Ebola virus [ZEBOV]
gacaaaauugaucagauua

SEQ ID NO: 3362119 - RNA, 15 nt, Zaire Ebola virus [ZEBOV]
gagcaagagcacuga

SEQ ID NO: 3362120 - RNA, 15 nt, Zaire Ebola virus [ZEBOV]
gccagcagcgggaag

SEQ ID NO: 3362121 - RNA, 17 nt, Zaire Ebola virus [ZEBOV]
accgcagccggaccccc

SEQ ID NO: 3362122 - RNA, 22 nt, Zaire Ebola virus [ZEBOV]
gacaucucugaggcaacucaag

SEQ ID NO: 3362123 - RNA, 18 nt, Zaire Ebola virus [ZEBOV]
uucacagauucuauauau

SEQ ID NO: 3362124 - RNA, 22 nt, Zaire Ebola virus [ZEBOV]
caacacgagcaagagcacugac

SEQ ID NO: 3362125 - RNA, 15 nt, Zaire Ebola virus [ZEBOV]
caaauaauguuuuac

SEQ ID NO: 3362126 - RNA, 12 nt, Zaire Ebola virus [ZEBOV]
uccuggaccccg

SEQ ID NO: 3362127 - RNA, 23 nt, Zaire Ebola virus [ZEBOV]
ccucugccacgaccgcagccgga

SEQ ID NO: 3362128 - RNA, 21 nt, Zaire Ebola virus [ZEBOV]
aucaaacggagccaaaaacau

SEQ ID NO: 3362129 - RNA, 14 nt, Zaire Ebola virus [ZEBOV]
aagagauuccaaga

SEQ ID NO: 3362130 - RNA, 12 nt, Zaire Ebola virus [ZEBOV]
aauagcagaggc

SEQ ID NO: 3362131 - RNA, 18 nt, Zaire Ebola virus [ZEBOV]
ccaagaacauaacagaca

SEQ ID NO: 3362132 - RNA, 19 nt, Zaire Ebola virus [ZEBOV]
agcuuaaaauauaaaugua

SEQ ID NO: 3362133 - RNA, 14 nt, Zaire Ebola virus [ZEBOV]
aguuaucuugacau

SEQ ID NO: 3362134 - RNA, 12 nt, Zaire Ebola virus [ZEBOV]
caaugaaaccag

SEQ ID NO: 3362135 - RNA, 18 nt, Zaire Ebola virus [ZEBOV]
ugcugcaaucggacuggc

SEQ ID NO: 3362136 - RNA, 17 nt, Zaire Ebola virus [ZEBOV]
ugagucuuaaugcaaau

SEQ ID NO: 3362137 - RNA, 21 nt, Zaire Ebola virus [ZEBOV]
aacaucaccgcagaacagaca

SEQ ID NO: 3362138 - RNA, 18 nt, Zaire Ebola virus [ZEBOV]
caaucggacuggccugga

SEQ ID NO: 3362139 - RNA, 17 nt, Zaire Ebola virus [ZEBOV]
aacucuauacucguaau

SEQ ID NO: 3362140 - RNA, 23 nt, Zaire Ebola virus [ZEBOV]
cuugcaaagguugguuauuaaca

SEQ ID NO: 3362141 - RNA, 14 nt, Zaire Ebola virus [ZEBOV]
ucacuguaagccag

SEQ ID NO: 3362142 - RNA, 16 nt, Zaire Ebola virus [ZEBOV]
caaucccucacaacca

SEQ ID NO: 3362143 - RNA, 15 nt, Zaire Ebola virus [ZEBOV]
gaacucgaagagaag

SEQ ID NO: 3362144 - RNA, 23 nt, Zaire Ebola virus [ZEBOV]
aucgcuuuauucuguauaugcaa

SEQ ID NO: 3362145 - RNA, 17 nt, Zaire Ebola virus [ZEBOV]
uccugauacuugcaaag

SEQ ID NO: 3362146 - RNA, 17 nt, Zaire Ebola virus [ZEBOV]
cuaacucauauaugcug

SEQ ID NO: 3362147 - RNA, 21 nt, Zaire Ebola virus [ZEBOV]
agguuucacagauucuauaua

SEQ ID NO: 3362148 - RNA, 10 nt, Zaire Ebola virus [ZEBOV]
cuucagauug

SEQ ID NO: 3362149 - RNA, 18 nt, Zaire Ebola virus [ZEBOV]
ucauaacuaauaacauua

SEQ ID NO: 3362150 - RNA, 15 nt, Zaire Ebola virus [ZEBOV]
cugauacuugcaaag

SEQ ID NO: 3362151 - RNA, 23 nt, Zaire Ebola virus [ZEBOV]
caaaaacaucaguggucagaguc

SEQ ID NO: 3362152 - RNA, 19 nt, Zaire Ebola virus [ZEBOV]
uauaacuuaccuacuagcc

SEQ ID NO: 3362153 - RNA, 19 nt, Zaire Ebola virus [ZEBOV]
cauauuucgggccagcagc

SEQ ID NO: 3362154 - RNA, 18 nt, Zaire Ebola virus [ZEBOV]
acccaaaccaaaagugau

SEQ ID NO: 3362155 - RNA, 15 nt, Zaire Ebola virus [ZEBOV]
aacuuauucaguacu

SEQ ID NO: 3362156 - RNA, 22 nt, Zaire Ebola virus [ZEBOV]
aaaugcaacccuaauuuacauu

SEQ ID NO: 3362157 - RNA, 23 nt, Zaire Ebola virus [ZEBOV]
ucucugcuuucauaaucagauau

SEQ ID NO: 3362158 - RNA, 16 nt, Zaire Ebola virus [ZEBOV]
gguuauuaacauacag

SEQ ID NO: 3362159 - RNA, 16 nt, Zaire Ebola virus [ZEBOV]
auccugauacuugcaa

SEQ ID NO: 3362160 - RNA, 21 nt, Zaire Ebola virus [ZEBOV]
cgcaucuaacaacccuugcca

SEQ ID NO: 3362161 - RNA, 18 nt, Zaire Ebola virus [ZEBOV]
aacaaugggaugauucaa

SEQ ID NO: 3362162 - RNA, 14 nt, Zaire Ebola virus [ZEBOV]
acaaccaaaccagg

SEQ ID NO: 3362163 - RNA, 14 nt, Zaire Ebola virus [ZEBOV]
ccggacaacagcac

SEQ ID NO: 3362164 - RNA, 18 nt, Zaire Ebola virus [ZEBOV]
guugguuauuaacauaca

SEQ ID NO: 3362165 - RNA, 15 nt, Zaire Ebola virus [ZEBOV]
ucacaaccaaaccag

SEQ ID NO: 3362166 - RNA, 17 nt, Zaire Ebola virus [ZEBOV]
aauuaauaagaugugca

SEQ ID NO: 3362167 - RNA, 16 nt, Zaire Ebola virus [ZEBOV]
guauaaacuugacauc

SEQ ID NO: 3362168 - RNA, 16 nt, Zaire Ebola virus [ZEBOV]
acaugauuggaccaag

SEQ ID NO: 3362169 - RNA, 17 nt, Zaire Ebola virus [ZEBOV]
auucuuauuuuugaauu

SEQ ID NO: 3362170 - RNA, 19 nt, Zaire Ebola virus [ZEBOV]
agauuacuugacaaaugau

SEQ ID NO: 3362171 - RNA, 18 nt, Zaire Ebola virus [ZEBOV]
agcauaauaaauaaauac

SEQ ID NO: 3362172 - RNA, 13 nt, Zaire Ebola virus [ZEBOV]
caacgacagcaca

SEQ ID NO: 3362173 - RNA, 12 nt, Zaire Ebola virus [ZEBOV]
uuauuacuagcc

SEQ ID NO: 3362174 - RNA, 21 nt, Zaire Ebola virus [ZEBOV]
uaagauuacuugacaaaugau

SEQ ID NO: 3362175 - RNA, 16 nt, Zaire Ebola virus [ZEBOV]
auugucuuuuuucucu

SEQ ID NO: 3362176 - RNA, 22 nt, Zaire Ebola virus [ZEBOV]
accauauuucgggccagcagcc

SEQ ID NO: 3362177 - RNA, 13 nt, Zaire Ebola virus [ZEBOV]
ugauuggaccaag

SEQ ID NO: 3362178 - RNA, 14 nt, Zaire Ebola virus [ZEBOV]
ugaauuuaaagcua

SEQ ID NO: 3362179 - RNA, 15 nt, Zaire Ebola virus [ZEBOV]
auaauuguaacucaa

SEQ ID NO: 3362180 - RNA, 17 nt, Zaire Ebola virus [ZEBOV]
agccauaauuguaacuc

SEQ ID NO: 3362181 - RNA, 20 nt, Zaire Ebola virus [ZEBOV]
caagauaccggagaagagag

SEQ ID NO: 3362182 - RNA, 17 nt, Zaire Ebola virus [ZEBOV]
ucuccuaaauguagaac

SEQ ID NO: 3362183 - RNA, 15 nt, Zaire Ebola virus [ZEBOV]
ucagccucaaaucaa

SEQ ID NO: 3362184 - RNA, 17 nt, Zaire Ebola virus [ZEBOV]
guccccaaaaccacagc

SEQ ID NO: 3362185 - RNA, 15 nt, Zaire Ebola virus [ZEBOV]
gaacagacaacgaca

SEQ ID NO: 3362186 - RNA, 22 nt, Zaire Ebola virus [ZEBOV]
uuggauuggaaauguggagaaa

SEQ ID NO: 3362187 - RNA, 16 nt, Zaire Ebola virus [ZEBOV]
aagaacauaacagaca

SEQ ID NO: 3362188 - RNA, 21 nt, Zaire Ebola virus [ZEBOV]
guauccugauacuugcaaagg

SEQ ID NO: 3362189 - RNA, 14 nt, Zaire Ebola virus [ZEBOV]
cuuccgacccaggg

SEQ ID NO: 3362190 - RNA, 16 nt, Zaire Ebola virus [ZEBOV]
cuuaauuaccaauacu

SEQ ID NO: 3362191 - RNA, 16 nt, Zaire Ebola virus [ZEBOV]
uuucauaaucagauau

SEQ ID NO: 3362192 - RNA, 17 nt, Zaire Ebola virus [ZEBOV]
ucuauuuaguaauccgu

SEQ ID NO: 3362193 - RNA, 19 nt, Zaire Ebola virus [ZEBOV]
gcuucauggaaaagcucag

SEQ ID NO: 3362194 - RNA, 19 nt, Zaire Ebola virus [ZEBOV]
auacucauauuucuugaua

SEQ ID NO: 3362195 - RNA, 22 nt, Zaire Ebola virus [ZEBOV]
cacauucugggaccggacugcu

SEQ ID NO: 3362196 - RNA, 14 nt, Zaire Ebola virus [ZEBOV]
aguuauagccauaa

SEQ ID NO: 3362197 - RNA, 13 nt, Zaire Ebola virus [ZEBOV]
cucagccucaaau

SEQ ID NO: 3362198 - RNA, 15 nt, Zaire Ebola virus [ZEBOV]
cacagcgagaccgcu

SEQ ID NO: 3362199 - RNA, 13 nt, Zaire Ebola virus [ZEBOV]
agcucagccucaa

SEQ ID NO: 3362200 - RNA, 15 nt, Zaire Ebola virus [ZEBOV]
gucaaggaagggaag

SEQ ID NO: 3362201 - RNA, 17 nt, Zaire Ebola virus [ZEBOV]
aggcguuauaauugcag

SEQ ID NO: 3362202 - RNA, 21 nt, Zaire Ebola virus [ZEBOV]
auuuuaucaccagaaauccua

SEQ ID NO: 3362203 - RNA, 15 nt, Zaire Ebola virus [ZEBOV]
acucaagcucuucaa

SEQ ID NO: 3362204 - RNA, 15 nt, Zaire Ebola virus [ZEBOV]
acaucucugcuuuca

SEQ ID NO: 3362205 - RNA, 13 nt, Zaire Ebola virus [ZEBOV]
cacaaucaagaug

SEQ ID NO: 3362206 - RNA, 23 nt, Zaire Ebola virus [ZEBOV]
auauaaccugccaagcauaccuc

SEQ ID NO: 3362207 - RNA, 19 nt, Zaire Ebola virus [ZEBOV]
aggauuuaauuauauggau

SEQ ID NO: 3362208 - RNA, 21 nt, Zaire Ebola virus [ZEBOV]
guccccaaucccucacaacca

SEQ ID NO: 3362209 - RNA, 20 nt, Zaire Ebola virus [ZEBOV]
ugauucuuauuuuugaauuu

SEQ ID NO: 3362210 - RNA, 15 nt, Zaire Ebola virus [ZEBOV]
cgcagccggaccccc

SEQ ID NO: 3362211 - RNA, 18 nt, Zaire Ebola virus [ZEBOV]
cagccggacccccaaaag

SEQ ID NO: 3362212 - RNA, 16 nt, Zaire Ebola virus [ZEBOV]
cacgagcaagagcacu

SEQ ID NO: 3362213 - RNA, 15 nt, Zaire Ebola virus [ZEBOV]
uggagacaauggaua

SEQ ID NO: 3362214 - RNA, 12 nt, Zaire Ebola virus [ZEBOV]
acagacaaaauu

SEQ ID NO: 3362215 - RNA, 13 nt, Zaire Ebola virus [ZEBOV]
agugccagcagcg

SEQ ID NO: 3362216 - RNA, 22 nt, Zaire Ebola virus [ZEBOV]
agacaacgacagcacagccucc

SEQ ID NO: 3362217 - RNA, 21 nt, Zaire Ebola virus [ZEBOV]
gcuuuacaccauugucuuuuu

SEQ ID NO: 3362218 - RNA, 16 nt, Zaire Ebola virus [ZEBOV]
acaugccacauucugg

SEQ ID NO: 3362219 - RNA, 18 nt, Zaire Ebola virus [ZEBOV]
uuuaucaccagaaauccu

SEQ ID NO: 3362220 - RNA, 13 nt, Zaire Ebola virus [ZEBOV]
uuauucaugauuu

SEQ ID NO: 3362221 - RNA, 15 nt, Zaire Ebola virus [ZEBOV]
gcacagucaaggaag

SEQ ID NO: 3362222 - RNA, 20 nt, Zaire Ebola virus [ZEBOV]
ccucugccacgaccgcagcc

SEQ ID NO: 3362223 - RNA, 20 nt, Zaire Ebola virus [ZEBOV]
uguaucgaaccacaugauug

SEQ ID NO: 3362224 - RNA, 15 nt, Zaire Ebola virus [ZEBOV]
gaauuauuaucacaa

SEQ ID NO: 3362225 - RNA, 20 nt, Zaire Ebola virus [ZEBOV]
gacaucucugcuuucauaau

SEQ ID NO: 3362226 - RNA, 22 nt, Zaire Ebola virus [ZEBOV]
agugaagaguugucuuucacag

SEQ ID NO: 3362227 - RNA, 19 nt, Zaire Ebola virus [ZEBOV]
acauuaaugauacacuugu

SEQ ID NO: 3362228 - RNA, 22 nt, Zaire Ebola virus [ZEBOV]
cacaacaaguccccaaaaccac

SEQ ID NO: 3362229 - RNA, 21 nt, Zaire Ebola virus [ZEBOV]
caacaaguccccaaaaccaca

SEQ ID NO: 3362230 - RNA, 19 nt, Zaire Ebola virus [ZEBOV]
caauacuccguauaccuau

SEQ ID NO: 3362231 - RNA, 23 nt, Zaire Ebola virus [ZEBOV]
ggagucgcaggacugaucacagg

SEQ ID NO: 3362232 - RNA, 21 nt, Zaire Ebola virus [ZEBOV]
agcauuuuaucaccagaaauc

SEQ ID NO: 3362233 - RNA, 18 nt, Zaire Ebola virus [ZEBOV]
guaagccagcuuccaagu

SEQ ID NO: 3362234 - RNA, 19 nt, Zaire Ebola virus [ZEBOV]
agcucuucaacuguuccug

SEQ ID NO: 3362235 - RNA, 22 nt, Barmah Forest virus
aaaacuaaauaaaaauuuagaa

SEQ ID NO: 3362236 - RNA, 14 nt, Barmah Forest virus
aaaagucaagauga

SEQ ID NO: 3362237 - RNA, 14 nt, Barmah Forest virus
aaaccaaaaaagac

SEQ ID NO: 3362238 - RNA, 16 nt, Barmah Forest virus
aacauaccgaucagua

SEQ ID NO: 3362239 - RNA, 17 nt, Barmah Forest virus
aacauggaggucaagau

SEQ ID NO: 3362240 - RNA, 19 nt, Barmah Forest virus
aacguaugcguaacugcau

SEQ ID NO: 3362241 - RNA, 16 nt, Barmah Forest virus
aagaaaccaacccaaa

SEQ ID NO: 3362242 - RNA, 15 nt, Barmah Forest virus
aagcaccgauccaaa

SEQ ID NO: 3362243 - RNA, 23 nt, Barmah Forest virus
aagguacugcuacgaacaaaauc

SEQ ID NO: 3362244 - RNA, 22 nt, Barmah Forest virus
aaguauuaugaauuacuugacu

SEQ ID NO: 3362245 - RNA, 19 nt, Barmah Forest virus
aaucagacgcauccaaguu

SEQ ID NO: 3362246 - RNA, 22 nt, Barmah Forest virus
aauucaugcaccaaaguuggau

SEQ ID NO: 3362247 - RNA, 12 nt, Barmah Forest virus
aauugacauuca

SEQ ID NO: 3362248 - RNA, 12 nt, Barmah Forest virus
acaaaagagaaa

SEQ ID NO: 3362249 - RNA, 13 nt, Barmah Forest virus
acaacagcaccau

SEQ ID NO: 3362250 - RNA, 13 nt, Barmah Forest virus
acacaaaaaugaa

SEQ ID NO: 3362251 - RNA, 19 nt, Barmah Forest virus
acacagaugagagaacuac

SEQ ID NO: 3362252 - RNA, 11 nt, Barmah Forest virus
acagcaccaug

SEQ ID NO: 3362253 - RNA, 19 nt, Barmah Forest virus
accaacccaaaagaagaag

SEQ ID NO: 3362254 - RNA, 23 nt, Barmah Forest virus
accaugcuguuacgaaaaagacc

SEQ ID NO: 3362255 - RNA, 15 nt, Barmah Forest virus
accccaaguauuaug

SEQ ID NO: 3362256 - RNA, 13 nt, Barmah Forest virus
accuggagacagu

SEQ ID NO: 3362257 - RNA, 13 nt, Barmah Forest virus
accuuacaaaaug

SEQ ID NO: 3362258 - RNA, 22 nt, Barmah Forest virus
acgaugaaggauucugugcagg

SEQ ID NO: 3362259 - RNA, 14 nt, Barmah Forest virus
acgauggagaccag

SEQ ID NO: 3362260 - RNA, 16 nt, Barmah Forest virus
acgcagccaaacacaa

SEQ ID NO: 3362261 - RNA, 23 nt, Barmah Forest virus
acggcguacugaagauccaagug

SEQ ID NO: 3362262 - RNA, 23 nt, Barmah Forest virus
acgggcucuggcaaaccuggaga

SEQ ID NO: 3362263 - RNA, 19 nt, Barmah Forest virus
agaaaucuagcaaguauga

SEQ ID NO: 3362264 - RNA, 16 nt, Barmah Forest virus
agaagcccaagaagac

SEQ ID NO: 3362265 - RNA, 21 nt, Barmah Forest virus
agacgauggagaccagcacca

SEQ ID NO: 3362266 - RNA, 13 nt, Barmah Forest virus
agagagaccaaag

SEQ ID NO: 3362267 - RNA, 18 nt, Barmah Forest virus
agagcacagaagaagccc

SEQ ID NO: 3362268 - RNA, 14 nt, Barmah Forest virus
agauagaugugcca

SEQ ID NO: 3362269 - RNA, 15 nt, Barmah Forest virus
agaugacaacauaau

SEQ ID NO: 3362270 - RNA, 22 nt, Barmah Forest virus
agaugacaacauaauccauggu

SEQ ID NO: 3362271 - RNA, 20 nt, Barmah Forest virus
agauuacaaugcauguaccg

SEQ ID NO: 3362272 - RNA, 16 nt, Barmah Forest virus
agcaccaguccagaga

SEQ ID NO: 3362273 - RNA, 12 nt, Barmah Forest virus
agcaccauguga

SEQ ID NO: 3362274 - RNA, 14 nt, Barmah Forest virus
agcucuacaaccca

SEQ ID NO: 3362275 - RNA, 23 nt, Barmah Forest virus
agcugucuggacagauccuccuu

SEQ ID NO: 3362276 - RNA, 15 nt, Barmah Forest virus
aggacauuacaacug

SEQ ID NO: 3362277 - RNA, 23 nt, Barmah Forest virus
agguacugcuacgaacaaaauca

SEQ ID NO: 3362278 - RNA, 21 nt, Barmah Forest virus
aguaacaaaaaucaaaaacua

SEQ ID NO: 3362279 - RNA, 20 nt, Barmah Forest virus
agucacuucauauaaaauua

SEQ ID NO: 3362280 - RNA, 13 nt, Barmah Forest virus
aguccccagcacc

SEQ ID NO: 3362281 - RNA, 14 nt, Barmah Forest virus
aguccccagcaccc

SEQ ID NO: 3362282 - RNA, 21 nt, Barmah Forest virus
aguguauuacauaugcagugg

SEQ ID NO: 3362283 - RNA, 13 nt, Barmah Forest virus
aguucaaagggcc

SEQ ID NO: 3362284 - RNA, 22 nt, Barmah Forest virus
auaaccaccgaaaaugucacca

SEQ ID NO: 3362285 - RNA, 12 nt, Barmah Forest virus
auacggccaccu

SEQ ID NO: 3362286 - RNA, 20 nt, Barmah Forest virus
auagccucuuuugacaaaag

SEQ ID NO: 3362287 - RNA, 22 nt, Barmah Forest virus
auaguauuacaggaauuaguau

SEQ ID NO: 3362288 - RNA, 17 nt, Barmah Forest virus
auauaaccccugaauag

SEQ ID NO: 3362289 - RNA, 17 nt, Barmah Forest virus
auaugaaagcagagauc

SEQ ID NO: 3362290 - RNA, 16 nt, Barmah Forest virus
auaugaagagagaugu

SEQ ID NO: 3362291 - RNA, 17 nt, Barmah Forest virus
auccguuuuacaaaauu

SEQ ID NO: 3362292 - RNA, 18 nt, Barmah Forest virus
auccuauugcuguagaaa

SEQ ID NO: 3362293 - RNA, 21 nt, Barmah Forest virus
aucuacgaaccggcaaaacua

SEQ ID NO: 3362294 - RNA, 14 nt, Barmah Forest virus
aucucaacuccaac

SEQ ID NO: 3362295 - RNA, 17 nt, Barmah Forest virus
augacaacauaauccau

SEQ ID NO: 3362296 - RNA, 24 nt, Barmah Forest virus
augagagaacuaccaacauaugau

SEQ ID NO: 3362297 - RNA, 22 nt, Barmah Forest virus
augccguacaccauucucccac

SEQ ID NO: 3362298 - RNA, 23 nt, Barmah Forest virus
augguauaauaucagacaaauug

SEQ ID NO: 3362299 - RNA, 20 nt, Barmah Forest virus
augucacacagaugagagaa

SEQ ID NO: 3362300 - RNA, 12 nt, Barmah Forest virus
augucuggggaa

SEQ ID NO: 3362301 - RNA, 14 nt, Barmah Forest virus
auuaguauagucau

SEQ ID NO: 3362302 - RNA, 17 nt, Barmah Forest virus
auucccugcaaaacuua

SEQ ID NO: 3362303 - RNA, 23 nt, Barmah Forest virus
caaaaccaaaaaagacccagaag

SEQ ID NO: 3362304 - RNA, 14 nt, Barmah Forest virus
caaaccuggagaca

SEQ ID NO: 3362305 - RNA, 21 nt, Barmah Forest virus
caaauuuggagcuaugaugaa

SEQ ID NO: 3362306 - RNA, 15 nt, Barmah Forest virus
caaccaccagcgccu

SEQ ID NO: 3362307 - RNA, 20 nt, Barmah Forest virus
caagaugauuccauggcacu

SEQ ID NO: 3362308 - RNA, 24 nt, Barmah Forest virus
caagcuagguaagccauugccacu

SEQ ID NO: 3362309 - RNA, 14 nt, Barmah Forest virus
caaguugaaaggac

SEQ ID NO: 3362310 - RNA, 19 nt, Barmah Forest virus
cacccaugagcaagacaau

SEQ ID NO: 3362311 - RNA, 21 nt, Barmah Forest virus
cacccuauguaccccacccuc

SEQ ID NO: 3362312 - RNA, 16 nt, Barmah Forest virus
cacgccguaggagagg

SEQ ID NO: 3362313 - RNA, 22 nt, Barmah Forest virus
cacucauacuuggacccacaga

SEQ ID NO: 3362314 - RNA, 16 nt, Barmah Forest virus
cacucaucagaacuag

SEQ ID NO: 3362315 - RNA, 12 nt, Barmah Forest virus
cacugcccacaa

SEQ ID NO: 3362316 - RNA, 14 nt, Barmah Forest virus
cacuugcccacagg

SEQ ID NO: 3362317 - RNA, 19 nt, Barmah Forest virus
cagacaaauugauggcaga

SEQ ID NO: 3362318 - RNA, 23 nt, Barmah Forest virus
cagggccacucaccauacuugug

SEQ ID NO: 3362319 - RNA, 13 nt, Barmah Forest virus
caguccagagaua

SEQ ID NO: 3362320 - RNA, 23 nt, Barmah Forest virus
cauaccccaaccccaaccaccag

SEQ ID NO: 3362321 - RNA, 17 nt, Barmah Forest virus
cauagucucacauuacu

SEQ ID NO: 3362322 - RNA, 17 nt, Barmah Forest virus
cauaguuaguguagaaa

SEQ ID NO: 3362323 - RNA, 12 nt, Barmah Forest virus
cauaugcagugg

SEQ ID NO: 3362324 - RNA, 16 nt, Barmah Forest virus
cauauuaccccugaau

SEQ ID NO: 3362325 - RNA, 21 nt, Barmah Forest virus
cauccaaguucacccaugaga

SEQ ID NO: 3362326 - RNA, 20 nt, Barmah Forest virus
caugcgaggcugaccaugcc

SEQ ID NO: 3362327 - RNA, 15 nt, Barmah Forest virus
caugugcaccaugcu

SEQ ID NO: 3362328 - RNA, 15 nt, Barmah Forest virus
cauuacaugaugaag

SEQ ID NO: 3362329 - RNA, 19 nt, Barmah Forest virus
cauucaagaaaucuagcaa

SEQ ID NO: 3362330 - RNA, 21 nt, Barmah Forest virus
ccaaaagaaacuguaauguca

SEQ ID NO: 3362331 - RNA, 20 nt, Barmah Forest virus
ccaaaguuggauaaaaccaa

SEQ ID NO: 3362332 - RNA, 19 nt, Barmah Forest virus
ccaagaugaagacagaaga

SEQ ID NO: 3362333 - RNA, 17 nt, Barmah Forest virus
ccaagggcuagugucca

SEQ ID NO: 3362334 - RNA, 18 nt, Barmah Forest virus
ccaaguucacccaugaga

SEQ ID NO: 3362335 - RNA, 21 nt, Barmah Forest virus
ccaaguucacccaugagaaac

SEQ ID NO: 3362336 - RNA, 15 nt, Barmah Forest virus
ccauauuaccccuga

SEQ ID NO: 3362337 - RNA, 17 nt, Barmah Forest virus
ccccaaccccaaccacc

SEQ ID NO: 3362338 - RNA, 15 nt, Barmah Forest virus
ccgaagagagaccaa

SEQ ID NO: 3362339 - RNA, 18 nt, Barmah Forest virus
ccuaagauugcugucuga

SEQ ID NO: 3362340 - RNA, 17 nt, Barmah Forest virus
ccucagaggucugucua

SEQ ID NO: 3362341 - RNA, 16 nt, Barmah Forest virus
ccugggaguagaccaa

SEQ ID NO: 3362342 - RNA, 19 nt, Barmah Forest virus
ccuucagaaacauaagagg

SEQ ID NO: 3362343 - RNA, 23 nt, Barmah Forest virus
cgaaguuacggaggugaaaggaa

SEQ ID NO: 3362344 - RNA, 13 nt, Barmah Forest virus
cgacaauccagaa

SEQ ID NO: 3362345 - RNA, 14 nt, Barmah Forest virus
cgaccaugggccau

SEQ ID NO: 3362346 - RNA, 15 nt, Barmah Forest virus
cgauggagaccagca

SEQ ID NO: 3362347 - RNA, 22 nt, Barmah Forest virus
cggaggugaaaggaaagaucca

SEQ ID NO: 3362348 - RNA, 22 nt, Barmah Forest virus
cgguaccgucaccauuccaaaa

SEQ ID NO: 3362349 - RNA, 14 nt, Barmah Forest virus
cuacagcagagauc

SEQ ID NO: 3362350 - RNA, 15 nt, Barmah Forest virus
cuauuuuugacaaua

SEQ ID NO: 3362351 - RNA, 13 nt, Barmah Forest virus
cucccaucagaca

SEQ ID NO: 3362352 - RNA, 12 nt, Barmah Forest virus
cucggaaaggau

SEQ ID NO: 3362353 - RNA, 13 nt, Barmah Forest virus
cucuuuugacaaa

SEQ ID NO: 3362354 - RNA, 22 nt, Barmah Forest virus
cuuccacccuauguaccccacc

SEQ ID NO: 3362355 - RNA, 16 nt, Barmah Forest virus
gaaaauaugaaagcag

SEQ ID NO: 3362356 - RNA, 15 nt, Barmah Forest virus
gaaaccaacccaaaa

SEQ ID NO: 3362357 - RNA, 17 nt, Barmah Forest virus
gaaacuguaaugucaca

SEQ ID NO: 3362358 - RNA, 21 nt, Barmah Forest virus
gaacucuacggagauguagga

SEQ ID NO: 3362359 - RNA, 20 nt, Barmah Forest virus
gaagaccguuaugccgucca

SEQ ID NO: 3362360 - RNA, 23 nt, Barmah Forest virus
gaagacgugcauuacaugaugaa

SEQ ID NO: 3362361 - RNA, 14 nt, Barmah Forest virus
gaagauccaagugu

SEQ ID NO: 3362362 - RNA, 23 nt, Barmah Forest virus
gaagauccaaguguccaugcaga

SEQ ID NO: 3362363 - RNA, 14 nt, Barmah Forest virus
gaagccuaagaaac

SEQ ID NO: 3362364 - RNA, 16 nt, Barmah Forest virus
gacaauccagaacuag

SEQ ID NO: 3362365 - RNA, 20 nt, Barmah Forest virus
gacagacuuaacgagagaag

SEQ ID NO: 3362366 - RNA, 13 nt, Barmah Forest virus
gacccagaagccu

SEQ ID NO: 3362367 - RNA, 23 nt, Barmah Forest virus
gacccgcauaacaccugaagaau

SEQ ID NO: 3362368 - RNA, 21 nt, Barmah Forest virus
gacgauggccaagaugaagac

SEQ ID NO: 3362369 - RNA, 13 nt, Barmah Forest virus
gagcacagaagaa

SEQ ID NO: 3362370 - RNA, 23 nt, Barmah Forest virus
gagcuaugaugaagucuggaaug

SEQ ID NO: 3362371 - RNA, 13 nt, Barmah Forest virus
gaggaccugggag

SEQ ID NO: 3362372 - RNA, 23 nt, Barmah Forest virus
gauaucuuaaggagcaaguacca

SEQ ID NO: 3362373 - RNA, 12 nt, Barmah Forest virus
gauaugaagaga

SEQ ID NO: 3362374 - RNA, 13 nt, Barmah Forest virus
gauucugcagugc

SEQ ID NO: 3362375 - RNA, 14 nt, Barmah Forest virus
gcaaacaaaagcag

SEQ ID NO: 3362376 - RNA, 16 nt, Barmah Forest virus
gcaagugacauacaga

SEQ ID NO: 3362377 - RNA, 22 nt, Barmah Forest virus
gcaaugaaaaguccccagcacc

SEQ ID NO: 3362378 - RNA, 17 nt, Barmah Forest virus
gcacagaagaagcccaa

SEQ ID NO: 3362379 - RNA, 15 nt, Barmah Forest virus
gcacgucuggaguga

SEQ ID NO: 3362380 - RNA, 15 nt, Barmah Forest virus
gcacgugugcaguca

SEQ ID NO: 3362381 - RNA, 22 nt, Barmah Forest virus
gcacuauguguccuccagaacu

SEQ ID NO: 3362382 - RNA, 17 nt, Barmah Forest virus
gcagacccacugaagag

SEQ ID NO: 3362383 - RNA, 18 nt, Barmah Forest virus
gccagacguaugggauga

SEQ ID NO: 3362384 - RNA, 18 nt, Barmah Forest virus
ggagacaguccagccaga

SEQ ID NO: 3362385 - RNA, 13 nt, Barmah Forest virus
ggcacaagacccg

SEQ ID NO: 3362386 - RNA, 19 nt, Barmah Forest virus
ggcaccauggggcagugca

SEQ ID NO: 3362387 - RNA, 19 nt, Barmah Forest virus
ggccaagaugaagacagaa

SEQ ID NO: 3362388 - RNA, 18 nt, Barmah Forest virus
ggccaccaaaagaaacug

SEQ ID NO: 3362389 - RNA, 22 nt, Barmah Forest virus
ggcgcacuagcucuacaaccca

SEQ ID NO: 3362390 - RNA, 14 nt, Barmah Forest virus
ggcguacugaagau

SEQ ID NO: 3362391 - RNA, 16 nt, Barmah Forest virus
gggaaacaacaacccg

SEQ ID NO: 3362392 - RNA, 13 nt, Barmah Forest virus
ggugcaaaugaag

SEQ ID NO: 3362393 - RNA, 13 nt, Barmah Forest virus
guaaaagaaggua

SEQ ID NO: 3362394 - RNA, 13 nt, Barmah Forest virus
guacaacucccaa

SEQ ID NO: 3362395 - RNA, 19 nt, Barmah Forest virus
guagccauagugcugggag

SEQ ID NO: 3362396 - RNA, 22 nt, Barmah Forest virus
gucauaguuaguguagaaauag

SEQ ID NO: 3362397 - RNA, 19 nt, Barmah Forest virus
guccacucaucagaacuag

SEQ ID NO: 3362398 - RNA, 16 nt, Barmah Forest virus
gugugaagccaucgaa

SEQ ID NO: 3362399 - RNA, 23 nt, Barmah Forest virus
guuaugccguccacucaucagaa

SEQ ID NO: 3362400 - RNA, 18 nt, Barmah Forest virus
guucacacaaaaaugaag

SEQ ID NO: 3362401 - RNA, 21 nt, Barmah Forest virus
guucccgugugaugcaccacc

SEQ ID NO: 3362402 - RNA, 14 nt, Barmah Forest virus
uaacugcaugaaga

SEQ ID NO: 3362403 - RNA, 15 nt, Barmah Forest virus
uaaguauguaguauu

SEQ ID NO: 3362404 - RNA, 15 nt, Barmah Forest virus
uacaacuggcaccau

SEQ ID NO: 3362405 - RNA, 17 nt, Barmah Forest virus
uaccaaucuagaaaagu

SEQ ID NO: 3362406 - RNA, 17 nt, Barmah Forest virus
uacggaggugaaaggaa

SEQ ID NO: 3362407 - RNA, 17 nt, Barmah Forest virus
uagccgaacucuacgga

SEQ ID NO: 3362408 - RNA, 20 nt, Barmah Forest virus
uagucucacauuacuaugac

SEQ ID NO: 3362409 - RNA, 19 nt, Barmah Forest virus
uauaaccccugaauaguaa

SEQ ID NO: 3362410 - RNA, 22 nt, Barmah Forest virus
uaugcaguggauaacacagugu

SEQ ID NO: 3362411 - RNA, 14 nt, Barmah Forest virus
uauggugacccgca

SEQ ID NO: 3362412 - RNA, 10 nt, Barmah Forest virus
ucagggccac

SEQ ID NO: 3362413 - RNA, 19 nt, Barmah Forest virus
ucauacuuggacccacaga

SEQ ID NO: 3362414 - RNA, 18 nt, Barmah Forest virus
ucauaguuaguguagaaa

SEQ ID NO: 3362415 - RNA, 23 nt, Barmah Forest virus
uccacgccguaggagaggaccau

SEQ ID NO: 3362416 - RNA, 17 nt, Barmah Forest virus
ucccaucagacagacuu

SEQ ID NO: 3362417 - RNA, 18 nt, Barmah Forest virus
ucccaucagacagacuua

SEQ ID NO: 3362418 - RNA, 12 nt, Barmah Forest virus
uccccagcaccc

SEQ ID NO: 3362419 - RNA, 21 nt, Barmah Forest virus
ucuacgaaccggcaaaacuag

SEQ ID NO: 3362420 - RNA, 20 nt, Barmah Forest virus
ucugaagcaaacaaaagcag

SEQ ID NO: 3362421 - RNA, 18 nt, Barmah Forest virus
ucugaccacuacuaccac

SEQ ID NO: 3362422 - RNA, 21 nt, Barmah Forest virus
ugaacuguagccgaacucuac

SEQ ID NO: 3362423 - RNA, 18 nt, Barmah Forest virus
ugagagaacuaccaacau

SEQ ID NO: 3362424 - RNA, 17 nt, Barmah Forest virus
ugaugucuaugccaaca

SEQ ID NO: 3362425 - RNA, 20 nt, Barmah Forest virus
ugcuuucauaggagaugaca

SEQ ID NO: 3362426 - RNA, 22 nt, Barmah Forest virus
uggcagauagaugugccaccug

SEQ ID NO: 3362427 - RNA, 17 nt, Barmah Forest virus
  misc_feature (3)..(3): n is a, c, g or u
ugnauauaacagcacua

SEQ ID NO: 3362428 - RNA, 14 nt, Barmah Forest virus
uguuaacagcacug

SEQ ID NO: 3362429 - RNA, 13 nt, Barmah Forest virus
uuacgaaaaagac

SEQ ID NO: 3362430 - RNA, 19 nt, Barmah Forest virus
uuauaagauuaguuuguua

SEQ ID NO: 3362431 - RNA, 17 nt, Barmah Forest virus
uucacacaaaaaugaag

SEQ ID NO: 3362432 - RNA, 23 nt, Barmah Forest virus
uucacgguagauaugaagagaga

SEQ ID NO: 3362433 - RNA, 20 nt, Barmah Forest virus
uucugcagugcuaaauguag

SEQ ID NO: 3362434 - RNA, 21 nt, Barmah Forest virus
uugccacgcaggccuacgagc

SEQ ID NO: 3362435 - RNA, 13 nt, Barmah Forest virus
uuguuguaguauc

SEQ ID NO: 3362436 - RNA, 18 nt, Barmah Forest virus
uuuuaaauugaacuguag

SEQ ID NO: 3362437 - RNA, 14 nt, Barmah Forest virus
aaagauccaugugc

SEQ ID NO: 3362438 - RNA, 15 nt, Barmah Forest virus
aaagucaauccagua

SEQ ID NO: 3362439 - RNA, 14 nt, Barmah Forest virus
aaaguucauacuug

SEQ ID NO: 3362440 - RNA, 21 nt, Barmah Forest virus
aaauuuagaaaaacuuaauau

SEQ ID NO: 3362441 - RNA, 19 nt, Barmah Forest virus
gaaaccaacccaaaagaag

SEQ ID NO: 3362442 - RNA, 16 nt, Barmah Forest virus
gaaagcagagaucgua

SEQ ID NO: 3362443 - RNA, 22 nt, Barmah Forest virus
gaaccaagcacaccgaagagag

SEQ ID NO: 3362444 - RNA, 22 nt, Barmah Forest virus
gaacuucgugguccaagugugu

SEQ ID NO: 3362445 - RNA, 22 nt, Barmah Forest virus
gaagcccaagaagacaccacca

SEQ ID NO: 3362446 - RNA, 18 nt, Barmah Forest virus
gacaaaagucaagaugau

SEQ ID NO: 3362447 - RNA, 17 nt, Barmah Forest virus
gacaaauugauggcaga

SEQ ID NO: 3362448 - RNA, 23 nt, Barmah Forest virus
gacgcauaccuagauaugguaga

SEQ ID NO: 3362449 - RNA, 12 nt, Barmah Forest virus
gagagaagagau

SEQ ID NO: 3362450 - RNA, 20 nt, Barmah Forest virus
gaguggucggcggccgcacu

SEQ ID NO: 3362451 - RNA, 20 nt, Barmah Forest virus
gauacauaccccaaccccaa

SEQ ID NO: 3362452 - RNA, 18 nt, Barmah Forest virus
gaucgacaauccagaacu

SEQ ID NO: 3362453 - RNA, 18 nt, Barmah Forest virus
gaugagguguacaaugaa

SEQ ID NO: 3362454 - RNA, 15 nt, Barmah Forest virus
gcacagaagaagccc

SEQ ID NO: 3362455 - RNA, 14 nt, Barmah Forest virus
gcagacccacugaa

SEQ ID NO: 3362456 - RNA, 21 nt, Barmah Forest virus
gcagagccacuagccacugcc

SEQ ID NO: 3362457 - RNA, 21 nt, Barmah Forest virus
gcagucagcguagcaccugaa

SEQ ID NO: 3362458 - RNA, 14 nt, Barmah Forest virus
gcauaacaccugaa

SEQ ID NO: 3362459 - RNA, 22 nt, Barmah Forest virus
gcauccaaguucacccaugaga

SEQ ID NO: 3362460 - RNA, 17 nt, Barmah Forest virus
gcccaagaagacaccac

SEQ ID NO: 3362461 - RNA, 18 nt, Barmah Forest virus
gcccaagaagacaccacc

SEQ ID NO: 3362462 - RNA, 20 nt, Barmah Forest virus
gcccagguuuauuggcaaug

SEQ ID NO: 3362463 - RNA, 22 nt, Barmah Forest virus
gccgaacucuacggagauguag

SEQ ID NO: 3362464 - RNA, 22 nt, Barmah Forest virus
  misc_feature (10)..(10): n is a, c, g or u
gccgcacugnauauaacagcac

SEQ ID NO: 3362465 - RNA, 14 nt, Barmah Forest virus
gccgguaugcauga

SEQ ID NO: 3362466 - RNA, 19 nt, Barmah Forest virus
gccucggaaaggauccgag

SEQ ID NO: 3362467 - RNA, 10 nt, Barmah Forest virus
gcggaggcgc

SEQ ID NO: 3362468 - RNA, 16 nt, Barmah Forest virus
gcggaggcgcugagug

SEQ ID NO: 3362469 - RNA, 18 nt, Barmah Forest virus
gcguacugaagauccaag

SEQ ID NO: 3362470 - RNA, 16 nt, Barmah Forest virus
gcuaguguccaauaca

SEQ ID NO: 3362471 - RNA, 23 nt, Barmah Forest virus
ggaggcugaacgcucuacccuaa

SEQ ID NO: 3362472 - RNA, 16 nt, Barmah Forest virus
ggauguccccauccaa

SEQ ID NO: 3362473 - RNA, 23 nt, Barmah Forest virus
ggcagguucggagacauccaaag

SEQ ID NO: 3362474 - RNA, 16 nt, Barmah Forest virus
ggcauccgaacucuac

SEQ ID NO: 3362475 - RNA, 20 nt, Barmah Forest virus
ggccauauuaccccugaaua

SEQ ID NO: 3362476 - RNA, 20 nt, Barmah Forest virus
gguaagugugccauccacag

SEQ ID NO: 3362477 - RNA, 23 nt, Barmah Forest virus
gguagacgauggagaccagcacc

SEQ ID NO: 3362478 - RNA, 14 nt, Barmah Forest virus
gguagauaugaaga

SEQ ID NO: 3362479 - RNA, 14 nt, Barmah Forest virus
ggucaccuggaaua

SEQ ID NO: 3362480 - RNA, 20 nt, Barmah Forest virus
guaagccauugccacuugac

SEQ ID NO: 3362481 - RNA, 18 nt, Barmah Forest virus
guaagugugccauccaca

SEQ ID NO: 3362482 - RNA, 22 nt, Barmah Forest virus
guacccuuacuggaccaucaca

SEQ ID NO: 3362483 - RNA, 18 nt, Barmah Forest virus
guauccacaacagcacca

SEQ ID NO: 3362484 - RNA, 18 nt, Barmah Forest virus
guaugcguaacugcauga

SEQ ID NO: 3362485 - RNA, 20 nt, Barmah Forest virus
guauuggcagcggccaccaa

SEQ ID NO: 3362486 - RNA, 16 nt, Barmah Forest virus
gugccaccuggaugaa

SEQ ID NO: 3362487 - RNA, 22 nt, Barmah Forest virus
gugcucgguguucacaggcgug

SEQ ID NO: 3362488 - RNA, 19 nt, Barmah Forest virus
guggcaguacaacucccaa

SEQ ID NO: 3362489 - RNA, 21 nt, Barmah Forest virus
guguuugucaacggagacagu

SEQ ID NO: 3362490 - RNA, 19 nt, Barmah Forest virus
guuggaauacggccaccuu

SEQ ID NO: 3362491 - RNA, 15 nt, Barmah Forest virus
uaacagguacagccu

SEQ ID NO: 3362492 - RNA, 16 nt, Barmah Forest virus
uaacugcaugaagauc

SEQ ID NO: 3362493 - RNA, 22 nt, Barmah Forest virus
uaacugcaugaagaucgagaau

SEQ ID NO: 3362494 - RNA, 16 nt, Barmah Forest virus
uaagaaaccaacccaa

SEQ ID NO: 3362495 - RNA, 12 nt, Barmah Forest virus
uaccaaaugaaa

SEQ ID NO: 3362496 - RNA, 17 nt, Barmah Forest virus
uacgacuaugggcacag

SEQ ID NO: 3362497 - RNA, 14 nt, Barmah Forest virus
uacucccaucagac

SEQ ID NO: 3362498 - RNA, 15 nt, Barmah Forest virus
uagaaaaacuuaaua

SEQ ID NO: 3362499 - RNA, 18 nt, Barmah Forest virus
uaguucaaagggccauau

SEQ ID NO: 3362500 - RNA, 19 nt, Barmah Forest virus
uauaguauuacaggaauua

SEQ ID NO: 3362501 - RNA, 14 nt, Barmah Forest virus
uaugaaagcagaga

SEQ ID NO: 3362502 - RNA, 16 nt, Barmah Forest virus
uauguaugauaguaua

SEQ ID NO: 3362503 - RNA, 15 nt, Barmah Forest virus
ucacuaagcaccgau

SEQ ID NO: 3362504 - RNA, 19 nt, Barmah Forest virus
ucauaggagaugacaacau

SEQ ID NO: 3362505 - RNA, 14 nt, Barmah Forest virus
ucauaguuagugua

SEQ ID NO: 3362506 - RNA, 15 nt, Barmah Forest virus
ucauauaaaauuacu

SEQ ID NO: 3362507 - RNA, 17 nt, Barmah Forest virus
uccccucauuaguucag

SEQ ID NO: 3362508 - RNA, 14 nt, Barmah Forest virus
uccuaccuguggac

SEQ ID NO: 3362509 - RNA, 19 nt, Barmah Forest virus
uccuauggacaaauucacg

SEQ ID NO: 3362510 - RNA, 15 nt, Barmah Forest virus
ucgcagacccacuga

SEQ ID NO: 3362511 - RNA, 18 nt, Barmah Forest virus
ucgccaaguugaaaggac

SEQ ID NO: 3362512 - RNA, 21 nt, Barmah Forest virus
ucugcagugcuaaauguagag

SEQ ID NO: 3362513 - RNA, 19 nt, Barmah Forest virus
ugcagucagcguagcaccu

SEQ ID NO: 3362514 - RNA, 13 nt, Barmah Forest virus
ugccauccacagc

SEQ ID NO: 3362515 - RNA, 17 nt, Barmah Forest virus
ugcguagcuuuccaaaa

SEQ ID NO: 3362516 - RNA, 15 nt, Barmah Forest virus
ugcuacgaacaaaau

SEQ ID NO: 3362517 - RNA, 23 nt, Barmah Forest virus
ugcuuagugggggauaaagucau

SEQ ID NO: 3362518 - RNA, 22 nt, Barmah Forest virus
uggauauugcggacgcgcacuu

SEQ ID NO: 3362519 - RNA, 13 nt, Barmah Forest virus
uggaucagagagc

SEQ ID NO: 3362520 - RNA, 18 nt, Barmah Forest virus
uggcaccauggggcagug

SEQ ID NO: 3362521 - RNA, 14 nt, Barmah Forest virus
uggggaaacaacaa

SEQ ID NO: 3362522 - RNA, 15 nt, Barmah Forest virus
uguaaguauguagua

SEQ ID NO: 3362523 - RNA, 15 nt, Barmah Forest virus
uguaguaguaaguau

SEQ ID NO: 3362524 - RNA, 13 nt, Barmah Forest virus
uguccgcagagga

SEQ ID NO: 3362525 - RNA, 13 nt, Barmah Forest virus
uuaccccugaaua

SEQ ID NO: 3362526 - RNA, 13 nt, Barmah Forest virus
uucaaagggccau

SEQ ID NO: 3362527 - RNA, 22 nt, Barmah Forest virus
uuccauccaucucuacuacagc

SEQ ID NO: 3362528 - RNA, 20 nt, Barmah Forest virus
uuuguuauguaaguauguag

SEQ ID NO: 3362529 - RNA, 13 nt, Barmah Forest virus
aaagagcacagaa

SEQ ID NO: 3362530 - RNA, 18 nt, Barmah Forest virus
aaaucuagcaaguaugau

SEQ ID NO: 3362531 - RNA, 17 nt, Barmah Forest virus
aacaacccgguacgacu

SEQ ID NO: 3362532 - RNA, 14 nt, Barmah Forest virus
aaccaaaaaagacc

SEQ ID NO: 3362533 - RNA, 12 nt, Barmah Forest virus
aagacaauccaa

SEQ ID NO: 3362534 - RNA, 15 nt, Barmah Forest virus
aagagagaccaaagg

SEQ ID NO: 3362535 - RNA, 18 nt, Barmah Forest virus
aaggagcaaguaccaaau

SEQ ID NO: 3362536 - RNA, 12 nt, Barmah Forest virus
aagggccauaua

SEQ ID NO: 3362537 - RNA, 22 nt, Barmah Forest virus
aagguacugcuacgaacaaaau

SEQ ID NO: 3362538 - RNA, 16 nt, Barmah Forest virus
aagucaugaaaccagc

SEQ ID NO: 3362539 - RNA, 19 nt, Barmah Forest virus
aauaaaaauuuagaaaaac

SEQ ID NO: 3362540 - RNA, 18 nt, Barmah Forest virus
aauaucagacaaauugau

SEQ ID NO: 3362541 - RNA, 14 nt, Barmah Forest virus
aaugugcucaagug

SEQ ID NO: 3362542 - RNA, 20 nt, Barmah Forest virus
aauuuuuaaauugaacugua

SEQ ID NO: 3362543 - RNA, 22 nt, Barmah Forest virus
acaaaauugcacggcagaaugu

SEQ ID NO: 3362544 - RNA, 21 nt, Barmah Forest virus
acacagagugugugaagccau

SEQ ID NO: 3362545 - RNA, 21 nt, Barmah Forest virus
acaccauucucccacaagccc

SEQ ID NO: 3362546 - RNA, 14 nt, Barmah Forest virus
acagcaccauguga

SEQ ID NO: 3362547 - RNA, 21 nt, Barmah Forest virus
acauaugcaguggauaacaca

SEQ ID NO: 3362548 - RNA, 20 nt, Barmah Forest virus
acauuacaacuggcaccaug

SEQ ID NO: 3362549 - RNA, 19 nt, Barmah Forest virus
acccugcagggacccuaag

SEQ ID NO: 3362550 - RNA, 16 nt, Barmah Forest virus
accgaagagagaccaa

SEQ ID NO: 3362551 - RNA, 20 nt, Barmah Forest virus
acguaugggaugaguacagg

SEQ ID NO: 3362552 - RNA, 16 nt, Barmah Forest virus
acgucgccaaguugaa

SEQ ID NO: 3362553 - RNA, 12 nt, Barmah Forest virus
acucccaucaga

SEQ ID NO: 3362554 - RNA, 16 nt, Barmah Forest virus
acuggaaaaaagagaa

SEQ ID NO: 3362555 - RNA, 21 nt, Barmah Forest virus
acuguaaaagaagguacugcu

SEQ ID NO: 3362556 - RNA, 13 nt, Barmah Forest virus
agaccagcaccag

SEQ ID NO: 3362557 - RNA, 19 nt, Barmah Forest virus
agaccaucaaguacaaaug

SEQ ID NO: 3362558 - RNA, 12 nt, Barmah Forest virus
agacccugcagg

SEQ ID NO: 3362559 - RNA, 20 nt, Barmah Forest virus
agacgauggagaccagcacc

SEQ ID NO: 3362560 - RNA, 16 nt, Barmah Forest virus
agagcuugcaaugcau

SEQ ID NO: 3362561 - RNA, 13 nt, Barmah Forest virus
agauccaugugcc

SEQ ID NO: 3362562 - RNA, 23 nt, Barmah Forest virus
agaucgguauagcuaaaagcaau

SEQ ID NO: 3362563 - RNA, 14 nt, Barmah Forest virus
agauuacaaugcau

SEQ ID NO: 3362564 - RNA, 14 nt, Barmah Forest virus
aggauguccaggaa

SEQ ID NO: 3362565 - RNA, 20 nt, Barmah Forest virus
agggauaauccgauuugcau

SEQ ID NO: 3362566 - RNA, 20 nt, Barmah Forest virus
agggccauauaaccccugaa

SEQ ID NO: 3362567 - RNA, 20 nt, Barmah Forest virus
agggccauauuaccccugaa

SEQ ID NO: 3362568 - RNA, 23 nt, Barmah Forest virus
aguaccauugaaucgaaacgccc

SEQ ID NO: 3362569 - RNA, 15 nt, Barmah Forest virus
aguucaaagggccau

SEQ ID NO: 3362570 - RNA, 22 nt, Barmah Forest virus
auaaccugauaccacuacacca

SEQ ID NO: 3362571 - RNA, 13 nt, Barmah Forest virus
auaguaguucaaa

SEQ ID NO: 3362572 - RNA, 18 nt, Barmah Forest virus
auaguuggaauacggcca

SEQ ID NO: 3362573 - RNA, 17 nt, Barmah Forest virus
aucacuaagcaccgauc

SEQ ID NO: 3362574 - RNA, 19 nt, Barmah Forest virus
augcuguuacgaaaaagac

SEQ ID NO: 3362575 - RNA, 13 nt, Barmah Forest virus
augguaaguguga

SEQ ID NO: 3362576 - RNA, 17 nt, Barmah Forest virus
auugauggcagauagau

SEQ ID NO: 3362577 - RNA, 14 nt, Barmah Forest virus
auuuagaaaaacuu

SEQ ID NO: 3362578 - RNA, 18 nt, Barmah Forest virus
auuugaagcuuaaaagac

SEQ ID NO: 3362579 - RNA, 16 nt, Barmah Forest virus
auuugauagaggcugc

SEQ ID NO: 3362580 - RNA, 18 nt, Barmah Forest virus
caaagacgaagaccauca

SEQ ID NO: 3362581 - RNA, 22 nt, Barmah Forest virus
caaauuuggagcuaugaugaag

SEQ ID NO: 3362582 - RNA, 21 nt, Barmah Forest virus
caacauaugauucugcagugc

SEQ ID NO: 3362583 - RNA, 17 nt, Barmah Forest virus
caagcacaccgaagaga

SEQ ID NO: 3362584 - RNA, 16 nt, Barmah Forest virus
caaguacaaaugcacu

SEQ ID NO: 3362585 - RNA, 13 nt, Barmah Forest virus
caaguugaaagga

SEQ ID NO: 3362586 - RNA, 22 nt, Barmah Forest virus
cacaaaaaugaagcggacuaua

SEQ ID NO: 3362587 - RNA, 18 nt, Barmah Forest virus
cacagaagaagcccaaga

SEQ ID NO: 3362588 - RNA, 22 nt, Barmah Forest virus
cagaacuaguuuuauuggcacu

SEQ ID NO: 3362589 - RNA, 18 nt, Barmah Forest virus
cagacugggggaagugga

SEQ ID NO: 3362590 - RNA, 21 nt, Barmah Forest virus
cagacuuaacgagagaagaga

SEQ ID NO: 3362591 - RNA, 17 nt, Barmah Forest virus
cagaggucugucuagug

SEQ ID NO: 3362592 - RNA, 14 nt, Barmah Forest virus
cagagugugugaag

SEQ ID NO: 3362593 - RNA, 23 nt, Barmah Forest virus
cagcaucgcuuaaggcacaagua

SEQ ID NO: 3362594 - RNA, 12 nt, Barmah Forest virus
cagcggccacca

SEQ ID NO: 3362595 - RNA, 15 nt, Barmah Forest virus
cagucagaugaguga

SEQ ID NO: 3362596 - RNA, 20 nt, Barmah Forest virus
cagugcaauuuagcaauggu

SEQ ID NO: 3362597 - RNA, 14 nt, Barmah Forest virus
caugagaaaccaga

SEQ ID NO: 3362598 - RNA, 14 nt, Barmah Forest virus
cauuccaaaacacc

SEQ ID NO: 3362599 - RNA, 19 nt, Barmah Forest virus
ccaaaagaagaaguccaaa

SEQ ID NO: 3362600 - RNA, 19 nt, Barmah Forest virus
ccaaaguguauuacauaug

SEQ ID NO: 3362601 - RNA, 17 nt, Barmah Forest virus
ccaagaagacaccacca

SEQ ID NO: 3362602 - RNA, 14 nt, Barmah Forest virus
ccaagaugaagaca

SEQ ID NO: 3362603 - RNA, 21 nt, Barmah Forest virus
ccagcaccaguccagagauac

SEQ ID NO: 3362604 - RNA, 16 nt, Barmah Forest virus
ccaucaaguacaaaug

SEQ ID NO: 3362605 - RNA, 20 nt, Barmah Forest virus
ccaugguauaauaucagaca

SEQ ID NO: 3362606 - RNA, 21 nt, Barmah Forest virus
ccgaacucuacggagauguag

SEQ ID NO: 3362607 - RNA, 20 nt, Barmah Forest virus
ccgucugaagcaaacaaaag

SEQ ID NO: 3362608 - RNA, 20 nt, Barmah Forest virus
ccugaagaaucaguggagug

SEQ ID NO: 3362609 - RNA, 22 nt, Barmah Forest virus
ccugcaaaacuuacucccauca

SEQ ID NO: 3362610 - RNA, 19 nt, Barmah Forest virus
cgagagaagagauuacaau

SEQ ID NO: 3362611 - RNA, 19 nt, Barmah Forest virus
cgagcauuuccuacacauc

SEQ ID NO: 3362612 - RNA, 23 nt, Barmah Forest virus
cgagucuaggcuugcuaauagug

SEQ ID NO: 3362613 - RNA, 19 nt, Barmah Forest virus
cgauggagaccagcaccag

SEQ ID NO: 3362614 - RNA, 14 nt, Barmah Forest virus
cguaacugcaugaa

SEQ ID NO: 3362615 - RNA, 23 nt, Barmah Forest virus
cgucugaagcaaacaaaagcagg

SEQ ID NO: 3362616 - RNA, 18 nt, Barmah Forest virus
cgugugaugcaccaccau

SEQ ID NO: 3362617 - RNA, 15 nt, Barmah Forest virus
cuaagaacuugaagu

SEQ ID NO: 3362618 - RNA, 12 nt, Barmah Forest virus
cuacagcagaga

SEQ ID NO: 3362619 - RNA, 16 nt, Barmah Forest virus
cuaugccguacaccau

SEQ ID NO: 3362620 - RNA, 15 nt, Barmah Forest virus
cucuacggagaugua

SEQ ID NO: 3362621 - RNA, 11 nt, Barmah Forest virus
cugaagaucca

SEQ ID NO: 3362622 - RNA, 22 nt, Barmah Forest virus
cuggaccaucacaguacuagcg

SEQ ID NO: 3362623 - RNA, 14 nt, Barmah Forest virus
cugggcaccgagca

SEQ ID NO: 3362624 - RNA, 20 nt, Barmah Forest virus
cuuaaggagcaaguaccaaa

SEQ ID NO: 3362625 - RNA, 12 nt, Barmah Forest virus
cuuggacccaca

SEQ ID NO: 3362626 - RNA, 23 nt, Barmah Forest virus
cuuggcccgcugccgacccggca

SEQ ID NO: 3362627 - RNA, 13 nt, Barmah Forest virus
cuuguuugcaaaa

SEQ ID NO: 3362628 - RNA, 18 nt, Barmah Forest virus
cuuguuugcaaaaacaca

SEQ ID NO: 3362629 - RNA, 15 nt, Barmah Forest virus
cuuuccaaaaacaca

SEQ ID NO: 3362630 - RNA, 18 nt, Barmah Forest virus
gaacucuacggagaugua

SEQ ID NO: 3362631 - RNA, 19 nt, Barmah Forest virus
gaacuguagccgaacucua

SEQ ID NO: 3362632 - RNA, 13 nt, Barmah Forest virus
gaagagagauguc

SEQ ID NO: 3362633 - RNA, 16 nt, Barmah Forest virus
gaaggauucugugcag

SEQ ID NO: 3362634 - RNA, 20 nt, Barmah Forest virus
gaaggcgugugaagugcagu

SEQ ID NO: 3362635 - RNA, 23 nt, Barmah Forest virus
gaauaguaacaaaagagaaaaac

SEQ ID NO: 3362636 - RNA, 15 nt, Barmah Forest virus
gacauucaagaaauc

SEQ ID NO: 3362637 - RNA, 20 nt, Barmah Forest virus
gaccagguuacgcaggccuc

SEQ ID NO: 3362638 - RNA, 21 nt, Barmah Forest virus
gacgugcauuacaugaugaag

SEQ ID NO: 3362639 - RNA, 16 nt, Barmah Forest virus
gagacuguaaaagaag

SEQ ID NO: 3362640 - RNA, 16 nt, Barmah Forest virus
gagcacgucuggagug

SEQ ID NO: 3362641 - RNA, 17 nt, Barmah Forest virus
gagcacgucuggaguga

SEQ ID NO: 3362642 - RNA, 14 nt, Barmah Forest virus
gagcuaugaugaag

SEQ ID NO: 3362643 - RNA, 12 nt, Barmah Forest virus
gaggugaaagga

SEQ ID NO: 3362644 - RNA, 17 nt, Barmah Forest virus
cugucuggacagauccu

SEQ ID NO: 3362645 - RNA, 13 nt, Barmah Forest virus
gaaaaaagagaag

SEQ ID NO: 3362646 - RNA, 20 nt, Barmah Forest virus
gaaaacagucagaugaguga

SEQ ID NO: 3362647 - RNA, 12 nt, Barmah Forest virus
gaaaaugucacc

SEQ ID NO: 3362648 - RNA, 17 nt, Barmah Forest virus
gaugcaccaccaugugc

SEQ ID NO: 3362649 - RNA, 13 nt, Barmah Forest virus
gaugugccaccug

SEQ ID NO: 3362650 - RNA, 14 nt, Barmah Forest virus
gcacaccgaagaga

SEQ ID NO: 3362651 - RNA, 14 nt, Barmah Forest virus
gcaccgagcaucca

SEQ ID NO: 3362652 - RNA, 21 nt, Barmah Forest virus
gcaccugaaccgcaagugaca

SEQ ID NO: 3362653 - RNA, 17 nt, Barmah Forest virus
gcaggccuacgagcacu

SEQ ID NO: 3362654 - RNA, 13 nt, Barmah Forest virus
gcaguccugcacu

SEQ ID NO: 3362655 - RNA, 21 nt, Barmah Forest virus
gcaugaaaucagacgcaucca

SEQ ID NO: 3362656 - RNA, 15 nt, Barmah Forest virus
gcauuacaugaugaa

SEQ ID NO: 3362657 - RNA, 14 nt, Barmah Forest virus
gccaaguugaaagg

SEQ ID NO: 3362658 - RNA, 14 nt, Barmah Forest virus
gccacgcaggccua

SEQ ID NO: 3362659 - RNA, 13 nt, Barmah Forest virus
gcccaagaagaca

SEQ ID NO: 3362660 - RNA, 12 nt, Barmah Forest virus
gcccggacagcc

SEQ ID NO: 3362661 - RNA, 12 nt, Barmah Forest virus
gccgaaccccag

SEQ ID NO: 3362662 - RNA, 21 nt, Barmah Forest virus
gccgaacucuacggagaugua

SEQ ID NO: 3362663 - RNA, 23 nt, Barmah Forest virus
gcggaucacuugccaugguaagu

SEQ ID NO: 3362664 - RNA, 11 nt, Barmah Forest virus
gcuaaauguag

SEQ ID NO: 3362665 - RNA, 14 nt, Barmah Forest virus
gcucuacaacccaa

SEQ ID NO: 3362666 - RNA, 12 nt, Barmah Forest virus
ggagacauccaa

SEQ ID NO: 3362667 - RNA, 15 nt, Barmah Forest virus
ggcauccgaacucua

SEQ ID NO: 3362668 - RNA, 21 nt, Barmah Forest virus
gguacgacuaugggcacagaa

SEQ ID NO: 3362669 - RNA, 16 nt, Barmah Forest virus
guaacugcaugaagau

SEQ ID NO: 3362670 - RNA, 13 nt, Barmah Forest virus
guacaaaugcacu

SEQ ID NO: 3362671 - RNA, 15 nt, Barmah Forest virus
guagauaugaagaga

SEQ ID NO: 3362672 - RNA, 19 nt, Barmah Forest virus
guagggcugcgacacagag

SEQ ID NO: 3362673 - RNA, 22 nt, Barmah Forest virus
gucaacggagacaguccagcca

SEQ ID NO: 3362674 - RNA, 15 nt, Barmah Forest virus
gugccaaaacagcug

SEQ ID NO: 3362675 - RNA, 23 nt, Barmah Forest virus
gugcgguaccgucaccauuccaa

SEQ ID NO: 3362676 - RNA, 14 nt, Barmah Forest virus
guucaaagggccau

SEQ ID NO: 3362677 - RNA, 23 nt, Barmah Forest virus
guuggggcagaaggcguggagua

SEQ ID NO: 3362678 - RNA, 15 nt, Barmah Forest virus
uaacaccugaagaau

SEQ ID NO: 3362679 - RNA, 13 nt, Barmah Forest virus
uaaccccugaaua

SEQ ID NO: 3362680 - RNA, 20 nt, Barmah Forest virus
uaagauuaguuuguuaugua

SEQ ID NO: 3362681 - RNA, 13 nt, Barmah Forest virus
uaaguauguagua

SEQ ID NO: 3362682 - RNA, 16 nt, Barmah Forest virus
uaccccugaauaguaa

SEQ ID NO: 3362683 - RNA, 19 nt, Barmah Forest virus
uaccgucaccauuccaaaa

SEQ ID NO: 3362684 - RNA, 14 nt, Barmah Forest virus
uagaaaaaauucau

SEQ ID NO: 3362685 - RNA, 21 nt, Barmah Forest virus
uaggcauccgaacucuacgga

SEQ ID NO: 3362686 - RNA, 16 nt, Barmah Forest virus
uauaaccccugaauag

SEQ ID NO: 3362687 - RNA, 19 nt, Barmah Forest virus
uauaguauuauaggaauua

SEQ ID NO: 3362688 - RNA, 15 nt, Barmah Forest virus
uaucagaucccaaaa

SEQ ID NO: 3362689 - RNA, 17 nt, Barmah Forest virus
ucaaguacaaaugcacu

SEQ ID NO: 3362690 - RNA, 22 nt, Barmah Forest virus
ucaagugccgguaugcaugaaa

SEQ ID NO: 3362691 - RNA, 22 nt, Barmah Forest virus
ucagggccacucaccauacuug

SEQ ID NO: 3362692 - RNA, 14 nt, Barmah Forest virus
ucaugcgaggcuga

SEQ ID NO: 3362693 - RNA, 15 nt, Barmah Forest virus
ugaagccaucgaaga

SEQ ID NO: 3362694 - RNA, 15 nt, Barmah Forest virus
ugaagcuuaaaagac

SEQ ID NO: 3362695 - RNA, 19 nt, Barmah Forest virus
ugacauacagacuggggga

SEQ ID NO: 3362696 - RNA, 13 nt, Barmah Forest virus
ugaugcaccacca

SEQ ID NO: 3362697 - RNA, 12 nt, Barmah Forest virus
ugauuaagucag

SEQ ID NO: 3362698 - RNA, 18 nt, Barmah Forest virus
ugcaaaacuuacucccau

SEQ ID NO: 3362699 - RNA, 20 nt, Barmah Forest virus
ugcaccaccaugugcaccau

SEQ ID NO: 3362700 - RNA, 21 nt, Barmah Forest virus
ugcugggaggugcaaaugaag

SEQ ID NO: 3362701 - RNA, 11 nt, Barmah Forest virus
ugguccaagug

SEQ ID NO: 3362702 - RNA, 15 nt, Barmah Forest virus
uguaguauuaaguau

SEQ ID NO: 3362703 - RNA, 13 nt, Barmah Forest virus
uuaguauagucau

SEQ ID NO: 3362704 - RNA, 21 nt, Barmah Forest virus
gacacggguccaggccaccua

SEQ ID NO: 3362705 - RNA, 19 nt, Barmah Forest virus
gacagcacgugugcaguca

SEQ ID NO: 3362706 - RNA, 18 nt, Barmah Forest virus
gaccacuacuaccacccc

SEQ ID NO: 3362707 - RNA, 15 nt, Barmah Forest virus
gacccaaagacgaag

SEQ ID NO: 3362708 - RNA, 15 nt, Barmah Forest virus
gacccacugaagaga

SEQ ID NO: 3362709 - RNA, 23 nt, Barmah Forest virus
gacgauggccaagaugaagacag

SEQ ID NO: 3362710 - RNA, 13 nt, Barmah Forest virus
gagaccagcacca

SEQ ID NO: 3362711 - RNA, 14 nt, Barmah Forest virus
gagagaagagauua

SEQ ID NO: 3362712 - RNA, 14 nt, Barmah Forest virus
gaugagagaacuac

SEQ ID NO: 3362713 - RNA, 14 nt, Barmah Forest virus
gcaaaccuggagac

SEQ ID NO: 3362714 - RNA, 23 nt, Barmah Forest virus
gcaaugaaaaguccccagcaccc

SEQ ID NO: 3362715 - RNA, 17 nt, Barmah Forest virus
gcacccaccgggcacaa

SEQ ID NO: 3362716 - RNA, 15 nt, Barmah Forest virus
gcacugcccacaagg

SEQ ID NO: 3362717 - RNA, 20 nt, Barmah Forest virus
gcagaucgguauagcuaaaa

SEQ ID NO: 3362718 - RNA, 12 nt, Barmah Forest virus
gccaccaaaaga

SEQ ID NO: 3362719 - RNA, 15 nt, Barmah Forest virus
gccaccaaaagaaac

SEQ ID NO: 3362720 - RNA, 13 nt, Barmah Forest virus
gcccacaaggaag

SEQ ID NO: 3362721 - RNA, 22 nt, Barmah Forest virus
gcccagguuuauuggcaaugaa

SEQ ID NO: 3362722 - RNA, 19 nt, Barmah Forest virus
gccuaagaaaccaacccaa

SEQ ID NO: 3362723 - RNA, 22 nt, Barmah Forest virus
gccuaagaaaccaacccaaaag

SEQ ID NO: 3362724 - RNA, 19 nt, Barmah Forest virus
gcucuggcaaaccuggaga

SEQ ID NO: 3362725 - RNA, 21 nt, Barmah Forest virus
ggagaccagcaccaguccaga

SEQ ID NO: 3362726 - RNA, 18 nt, Barmah Forest virus
ggccaccuacagcagaga

SEQ ID NO: 3362727 - RNA, 18 nt, Barmah Forest virus
ggccauauaaccccugaa

SEQ ID NO: 3362728 - RNA, 20 nt, Barmah Forest virus
ggccauauaaccccugaaua

SEQ ID NO: 3362729 - RNA, 18 nt, Barmah Forest virus
ggccauauuaccccugaa

SEQ ID NO: 3362730 - RNA, 17 nt, Barmah Forest virus
gggaugaguacagggau

SEQ ID NO: 3362731 - RNA, 13 nt, Barmah Forest virus
gggcccggacagc

SEQ ID NO: 3362732 - RNA, 15 nt, Barmah Forest virus
guaacugcaugaaga

SEQ ID NO: 3362733 - RNA, 23 nt, Barmah Forest virus
guccaggccaccuacagcagaga

SEQ ID NO: 3362734 - RNA, 17 nt, Barmah Forest virus
gucuaauuuguuuuuua

SEQ ID NO: 3362735 - RNA, 18 nt, Barmah Forest virus
gugacaccgccccaaagu

SEQ ID NO: 3362736 - RNA, 15 nt, Barmah Forest virus
guguccuccagaacu

SEQ ID NO: 3362737 - RNA, 17 nt, Barmah Forest virus
guuacgaaaaagacccu

SEQ ID NO: 3362738 - RNA, 14 nt, Barmah Forest virus
uaacaccugaagaa

SEQ ID NO: 3362739 - RNA, 23 nt, Barmah Forest virus
uaaugucacacagaugagagaac

SEQ ID NO: 3362740 - RNA, 23 nt, Barmah Forest virus
uacacccuaucaauuagcaccag

SEQ ID NO: 3362741 - RNA, 19 nt, Barmah Forest virus
uaccucugcggaauucacc

SEQ ID NO: 3362742 - RNA, 12 nt, Barmah Forest virus
uacggccaccuu

SEQ ID NO: 3362743 - RNA, 22 nt, Barmah Forest virus
uagacccaaagacgaagaccau

SEQ ID NO: 3362744 - RNA, 22 nt, Barmah Forest virus
uagcaaguaugaucuagaaugu

SEQ ID NO: 3362745 - RNA, 15 nt, Barmah Forest virus
uauaaccccugaaua

SEQ ID NO: 3362746 - RNA, 16 nt, Barmah Forest virus
uauuaccccugaauag

SEQ ID NO: 3362747 - RNA, 19 nt, Barmah Forest virus
uauuaccccugaauaguaa

SEQ ID NO: 3362748 - RNA, 21 nt, Barmah Forest virus
ucaaaguucauacuugggccg

SEQ ID NO: 3362749 - RNA, 17 nt, Barmah Forest virus
ucaacuccaacagcuug

SEQ ID NO: 3362750 - RNA, 16 nt, Barmah Forest virus
ucauuagacccaaaga

SEQ ID NO: 3362751 - RNA, 19 nt, Barmah Forest virus
uccaauacagguaagucgu

SEQ ID NO: 3362752 - RNA, 15 nt, Barmah Forest virus
uccacaacagcacca

SEQ ID NO: 3362753 - RNA, 13 nt, Barmah Forest virus
uccaggccaccua

SEQ ID NO: 3362754 - RNA, 21 nt, Barmah Forest virus
ucccucugaccgacagcacgu

SEQ ID NO: 3362755 - RNA, 15 nt, Barmah Forest virus
uccguuuuacaaaau

SEQ ID NO: 3362756 - RNA, 16 nt, Barmah Forest virus
ucuagugccaaaacag

SEQ ID NO: 3362757 - RNA, 17 nt, Barmah Forest virus
ucugucuagugccaaaa

SEQ ID NO: 3362758 - RNA, 15 nt, Barmah Forest virus
ugaagacagaagacg

SEQ ID NO: 3362759 - RNA, 12 nt, Barmah Forest virus
ugaagugaaaac

SEQ ID NO: 3362760 - RNA, 14 nt, Barmah Forest virus
ugacauucaagaaa

SEQ ID NO: 3362761 - RNA, 22 nt, Barmah Forest virus
ugacgauggccaagaugaagac

SEQ ID NO: 3362762 - RNA, 16 nt, Barmah Forest virus
ugagcaagacaaucca

SEQ ID NO: 3362763 - RNA, 13 nt, Barmah Forest virus
ugcaaaaacacau

SEQ ID NO: 3362764 - RNA, 23 nt, Barmah Forest virus
ugcaugaaaucagacgcauccaa

SEQ ID NO: 3362765 - RNA, 17 nt, Barmah Forest virus
ugccaaaacagcuguua

SEQ ID NO: 3362766 - RNA, 12 nt, Barmah Forest virus
uggaaaaaagag

SEQ ID NO: 3362767 - RNA, 16 nt, Barmah Forest virus
uggacggacuggggga

SEQ ID NO: 3362768 - RNA, 18 nt, Barmah Forest virus
uggaguacaggaggcuga

SEQ ID NO: 3362769 - RNA, 16 nt, Barmah Forest virus
ugucacacagaugaga

SEQ ID NO: 3362770 - RNA, 24 nt, Barmah Forest virus
uuguuauguaaguauguaguagua

SEQ ID NO: 3362771 - RNA, 14 nt, Barmah Forest virus
uuuuaaauugaacu

SEQ ID NO: 3362772 - RNA, 16 nt, Barmah Forest virus
aacaaaagagaaaaac

SEQ ID NO: 3362773 - RNA, 20 nt, Barmah Forest virus
aaccgcaagugacauacaga

SEQ ID NO: 3362774 - RNA, 17 nt, Barmah Forest virus
aaccuaaugaauuugau

SEQ ID NO: 3362775 - RNA, 16 nt, Barmah Forest virus
aagcuagguaagccau

SEQ ID NO: 3362776 - RNA, 17 nt, Barmah Forest virus
aaggauucugugcagga

SEQ ID NO: 3362777 - RNA, 13 nt, Barmah Forest virus
aagggccauauua

SEQ ID NO: 3362778 - RNA, 23 nt, Barmah Forest virus
aaguguauccacaacagcaccau

SEQ ID NO: 3362779 - RNA, 22 nt, Barmah Forest virus
aaguguauuacauaugcagugg

SEQ ID NO: 3362780 - RNA, 12 nt, Barmah Forest virus
aauaguaacaaa

SEQ ID NO: 3362781 - RNA, 14 nt, Barmah Forest virus
acacagaugagaga

SEQ ID NO: 3362782 - RNA, 18 nt, Barmah Forest virus
acaccauucucccacaag

SEQ ID NO: 3362783 - RNA, 12 nt, Barmah Forest virus
acagucaagaau

SEQ ID NO: 3362784 - RNA, 16 nt, Barmah Forest virus
acagucagaugaguga

SEQ ID NO: 3362785 - RNA, 21 nt, Barmah Forest virus
accaaaguuggauaaaaccaa

SEQ ID NO: 3362786 - RNA, 15 nt, Barmah Forest virus
accaugugcaccaug

SEQ ID NO: 3362787 - RNA, 21 nt, Barmah Forest virus
accgacagcacgugugcaguc

SEQ ID NO: 3362788 - RNA, 20 nt, Barmah Forest virus
acgaaccggcaaaacuagaa

SEQ ID NO: 3362789 - RNA, 20 nt, Barmah Forest virus
acucauacuuggacccacag

SEQ ID NO: 3362790 - RNA, 19 nt, Barmah Forest virus
acuuccacccuauguaccc

SEQ ID NO: 3362791 - RNA, 15 nt, Barmah Forest virus
acuucuguggaggau

SEQ ID NO: 3362792 - RNA, 15 nt, Barmah Forest virus
agaaacaaaaaagag

SEQ ID NO: 3362793 - RNA, 14 nt, Barmah Forest virus
agaaauaguucaaa

SEQ ID NO: 3362794 - RNA, 18 nt, Barmah Forest virus
agaacuaccaacauauga

SEQ ID NO: 3362795 - RNA, 13 nt, Barmah Forest virus
agaaugacugcau

SEQ ID NO: 3362796 - RNA, 17 nt, Barmah Forest virus
agacccacugaagagau

SEQ ID NO: 3362797 - RNA, 19 nt, Barmah Forest virus
agacccgaauucccugcaa

SEQ ID NO: 3362798 - RNA, 21 nt, Barmah Forest virus
agagaacuaccaacauaugau

SEQ ID NO: 3362799 - RNA, 16 nt, Barmah Forest virus
agagauuacaaugcau

SEQ ID NO: 3362800 - RNA, 15 nt, Barmah Forest virus
agagcacagaagaag

SEQ ID NO: 3362801 - RNA, 17 nt, Barmah Forest virus
agagcucaucgagcagc

SEQ ID NO: 3362802 - RNA, 22 nt, Barmah Forest virus
agcaccaguccagagauacaua

SEQ ID NO: 3362803 - RNA, 13 nt, Barmah Forest virus
aggauucugugca

SEQ ID NO: 3362804 - RNA, 15 nt, Barmah Forest virus
agggccacucaccau

SEQ ID NO: 3362805 - RNA, 18 nt, Barmah Forest virus
agggccauauaaccccug

SEQ ID NO: 3362806 - RNA, 18 nt, Barmah Forest virus
aggggcccggacagcccu

SEQ ID NO: 3362807 - RNA, 21 nt, Barmah Forest virus
aguagaacuguuaacagcacu

SEQ ID NO: 3362808 - RNA, 12 nt, Barmah Forest virus
aguagaccaaaa

SEQ ID NO: 3362809 - RNA, 14 nt, Barmah Forest virus
aguauaguauuaua

SEQ ID NO: 3362810 - RNA, 22 nt, Barmah Forest virus
agugacauacagacugggggaa

SEQ ID NO: 3362811 - RNA, 18 nt, Barmah Forest virus
auaaaauuacugaugaau

SEQ ID NO: 3362812 - RNA, 19 nt, Barmah Forest virus
auaagguagguaagugugc

SEQ ID NO: 3362813 - RNA, 18 nt, Barmah Forest virus
auaauaucagacaaauug

SEQ ID NO: 3362814 - RNA, 19 nt, Barmah Forest virus
auacgacgcauaccuagau

SEQ ID NO: 3362815 - RNA, 16 nt, Barmah Forest virus
auauaaaauuacugau

SEQ ID NO: 3362816 - RNA, 12 nt, Barmah Forest virus
auccaaagcugc

SEQ ID NO: 3362817 - RNA, 19 nt, Barmah Forest virus
auccaaguguccaugcaga

SEQ ID NO: 3362818 - RNA, 22 nt, Barmah Forest virus
aucgacaauccagaacuagcca

SEQ ID NO: 3362819 - RNA, 13 nt, Barmah Forest virus
augaugaagugaa

SEQ ID NO: 3362820 - RNA, 17 nt, Barmah Forest virus
augcaccaccaugugca

SEQ ID NO: 3362821 - RNA, 12 nt, Barmah Forest virus
auuacaaugcau

SEQ ID NO: 3362822 - RNA, 15 nt, Barmah Forest virus
auuauauuaccugca

SEQ ID NO: 3362823 - RNA, 15 nt, Barmah Forest virus
auucaugcaccaaag

SEQ ID NO: 3362824 - RNA, 22 nt, Barmah Forest virus
auuguucaagcuagguaagcca

SEQ ID NO: 3362825 - RNA, 12 nt, Barmah Forest virus
caaaauugcacg

SEQ ID NO: 3362826 - RNA, 23 nt, Barmah Forest virus
caaauuuggagcuaugaugaagu

SEQ ID NO: 3362827 - RNA, 13 nt, Barmah Forest virus
caagugacauaca

SEQ ID NO: 3362828 - RNA, 23 nt, Barmah Forest virus
caauccaaguuggggcagaaggc

SEQ ID NO: 3362829 - RNA, 22 nt, Barmah Forest virus
caaugaaaaguccccagcaccc

SEQ ID NO: 3362830 - RNA, 23 nt, Barmah Forest virus
cacacagaugagagaacuaccaa

SEQ ID NO: 3362831 - RNA, 11 nt, Barmah Forest virus
cacagaagaag

SEQ ID NO: 3362832 - RNA, 23 nt, Barmah Forest virus
cacagagugugugaagccaucga

SEQ ID NO: 3362833 - RNA, 17 nt, Barmah Forest virus
caccaccucagggccac

SEQ ID NO: 3362834 - RNA, 22 nt, Barmah Forest virus
cacccaugagaaaccagaagga

SEQ ID NO: 3362835 - RNA, 13 nt, Barmah Forest virus
caccuuacaaaau

SEQ ID NO: 3362836 - RNA, 23 nt, Barmah Forest virus
cacgaucgacaauccagaacuag

SEQ ID NO: 3362837 - RNA, 21 nt, Barmah Forest virus
cacgguagauaugaagagaga

SEQ ID NO: 3362838 - RNA, 15 nt, Barmah Forest virus
cacucaccauacuug

SEQ ID NO: 3362839 - RNA, 15 nt, Barmah Forest virus
cacugcccacaagga

SEQ ID NO: 3362840 - RNA, 20 nt, Barmah Forest virus
cagaacuagccaaauugaca

SEQ ID NO: 3362841 - RNA, 15 nt, Barmah Forest virus
cagcucaugugaagg

SEQ ID NO: 3362842 - RNA, 18 nt, Barmah Forest virus
cagucagcguagcaccug

SEQ ID NO: 3362843 - RNA, 20 nt, Barmah Forest virus
cauagucucacauuacuaug

SEQ ID NO: 3362844 - RNA, 14 nt, Barmah Forest virus
cauauaaccccuga

SEQ ID NO: 3362845 - RNA, 17 nt, Barmah Forest virus
caucacaguacuagcga

SEQ ID NO: 3362846 - RNA, 22 nt, Barmah Forest virus
cauccaucucuacuacagcuug

SEQ ID NO: 3362847 - RNA, 17 nt, Barmah Forest virus
ccaaaagaagaagucca

SEQ ID NO: 3362848 - RNA, 17 nt, Barmah Forest virus
ccaaguguccaugcaga

SEQ ID NO: 3362849 - RNA, 15 nt, Barmah Forest virus
ccaauggaguacagg

SEQ ID NO: 3362850 - RNA, 13 nt, Barmah Forest virus
ccaccaaaaccaa

SEQ ID NO: 3362851 - RNA, 23 nt, Barmah Forest virus
ccaccaaaaccaaaaaagaccca

SEQ ID NO: 3362852 - RNA, 15 nt, Barmah Forest virus
ccagaacuagccaaa

SEQ ID NO: 3362853 - RNA, 17 nt, Barmah Forest virus
ccauauuaccccugaau

SEQ ID NO: 3362854 - RNA, 14 nt, Barmah Forest virus
cccaaaagaagaag

SEQ ID NO: 3362855 - RNA, 17 nt, Barmah Forest virus
ccccugaauaguaacaa

SEQ ID NO: 3362856 - RNA, 14 nt, Barmah Forest virus
ccccugugagcauc

SEQ ID NO: 3362857 - RNA, 18 nt, Barmah Forest virus
cccucugaccgacagcac

SEQ ID NO: 3362858 - RNA, 17 nt, Barmah Forest virus
ccggcuucaggcaaugu

SEQ ID NO: 3362859 - RNA, 20 nt, Barmah Forest virus
ccguuuauguggggaggcgc

SEQ ID NO: 3362860 - RNA, 13 nt, Barmah Forest virus
ccguuuuacaaaa

SEQ ID NO: 3362861 - RNA, 13 nt, Barmah Forest virus
ccucggaaaggau

SEQ ID NO: 3362862 - RNA, 19 nt, Barmah Forest virus
cgaaaacagucagaugagu

SEQ ID NO: 3362863 - RNA, 18 nt, Barmah Forest virus
cgaacucuacggagaugu

SEQ ID NO: 3362864 - RNA, 10 nt, Barmah Forest virus
cgaagagaga

SEQ ID NO: 3362865 - RNA, 14 nt, Barmah Forest virus
cggaggugaaagga

SEQ ID NO: 3362866 - RNA, 14 nt, Barmah Forest virus
cgguagauaugaag

SEQ ID NO: 3362867 - RNA, 19 nt, Barmah Forest virus
cgguagauaugaagagaga

SEQ ID NO: 3362868 - RNA, 15 nt, Barmah Forest virus
cguagcuuuccaaaa

SEQ ID NO: 3362869 - RNA, 15 nt, Barmah Forest virus
cguccacucaucaga

SEQ ID NO: 3362870 - RNA, 17 nt, Barmah Forest virus
cuaucaauuagcaccag

SEQ ID NO: 3362871 - RNA, 21 nt, Barmah Forest virus
cuaugguagacgauggagacc

SEQ ID NO: 3362872 - RNA, 22 nt, Barmah Forest virus
cucaagugccgguaugcaugaa

SEQ ID NO: 3362873 - RNA, 19 nt, Barmah Forest virus
cuccuuuugaucacaaggu

SEQ ID NO: 3362874 - RNA, 19 nt, Barmah Forest virus
cugaagauccaagugucca

SEQ ID NO: 3362875 - RNA, 21 nt, Barmah Forest virus
cugaauaguaacaaaagagaa

SEQ ID NO: 3362876 - RNA, 17 nt, Barmah Forest virus
cugggggaaguggaguu

SEQ ID NO: 3362877 - RNA, 21 nt, Barmah Forest virus
cuguuagagcuugcaaugcau

SEQ ID NO: 3362878 - RNA, 17 nt, Barmah Forest virus
cuugacucgacgaugca

SEQ ID NO: 3362879 - RNA, 16 nt, Barmah Forest virus
gaaacauaagagggaa

SEQ ID NO: 3362880 - RNA, 21 nt, Barmah Forest virus
gaaaccaacccaaaagaagaa

SEQ ID NO: 3362881 - RNA, 13 nt, Barmah Forest virus
gaaaccagaagga

SEQ ID NO: 3362882 - RNA, 21 nt, Barmah Forest virus
gaagccuaagaaaccaaccca

SEQ ID NO: 3362883 - RNA, 18 nt, Barmah Forest virus
gaaggauucugugcagga

SEQ ID NO: 3362884 - RNA, 16 nt, Barmah Forest virus
gacaccaccaccaaaa

SEQ ID NO: 3362885 - RNA, 13 nt, Barmah Forest virus
aaacaaaaaagag

SEQ ID NO: 3362886 - RNA, 23 nt, Barmah Forest virus
aaacuguaaugucacacagauga

SEQ ID NO: 3362887 - RNA, 17 nt, Barmah Forest virus
cgguagauaugaagaga

SEQ ID NO: 3362888 - RNA, 17 nt, Barmah Forest virus
cuacaacccaagcagaa

SEQ ID NO: 3362889 - RNA, 14 nt, Barmah Forest virus
aaaauuacugauga

SEQ ID NO: 3362890 - RNA, 18 nt, Barmah Forest virus
aaacaccuuacaaaaugu

SEQ ID NO: 3362891 - RNA, 22 nt, Barmah Forest virus
aaacuaaauaaaaauuuagaaa

SEQ ID NO: 3362892 - RNA, 18 nt, Barmah Forest virus
aaaggaaagauccaugug

SEQ ID NO: 3362893 - RNA, 23 nt, Barmah Forest virus
aacuaguuuuauuggcacugacu

SEQ ID NO: 3362894 - RNA, 15 nt, Barmah Forest virus
aagacaauccaaguu

SEQ ID NO: 3362895 - RNA, 23 nt, Barmah Forest virus
aagacaccaccaccaaaaccaaa

SEQ ID NO: 3362896 - RNA, 17 nt, Barmah Forest virus
aagagauuacaaugcau

SEQ ID NO: 3362897 - RNA, 19 nt, Barmah Forest virus
aagcacggugaccaugugu

SEQ ID NO: 3362898 - RNA, 12 nt, Barmah Forest virus
aaggacauuaca

SEQ ID NO: 3362899 - RNA, 20 nt, Barmah Forest virus
aaggcgugugaagugcaguc

SEQ ID NO: 3362900 - RNA, 16 nt, Barmah Forest virus
aaguaugaucuagaau

SEQ ID NO: 3362901 - RNA, 14 nt, Barmah Forest virus
aagugaaaaccugg

SEQ ID NO: 3362902 - RNA, 12 nt, Barmah Forest virus
aaguugaaagga

SEQ ID NO: 3362903 - RNA, 17 nt, Barmah Forest virus
aauuuagaaaaacuuaa

SEQ ID NO: 3362904 - RNA, 19 nt, Barmah Forest virus
acaccugaagaaucagugg

SEQ ID NO: 3362905 - RNA, 18 nt, Barmah Forest virus
acagcacgugugcaguca

SEQ ID NO: 3362906 - RNA, 22 nt, Barmah Forest virus
acagcacuauguguccuccaga

SEQ ID NO: 3362907 - RNA, 18 nt, Barmah Forest virus
accaaaaccaaaaaagac

SEQ ID NO: 3362908 - RNA, 15 nt, Barmah Forest virus
accaacccaaaagaa

SEQ ID NO: 3362909 - RNA, 14 nt, Barmah Forest virus
accauggggcagug

SEQ ID NO: 3362910 - RNA, 17 nt, Barmah Forest virus
acccuuacuggaccauc

SEQ ID NO: 3362911 - RNA, 21 nt, Barmah Forest virus
accugaagaaucaguggagug

SEQ ID NO: 3362912 - RNA, 17 nt, Barmah Forest virus
acgaucgacaauccaga

SEQ ID NO: 3362913 - RNA, 21 nt, Barmah Forest virus
acuccaacagcuuguggcugc

SEQ ID NO: 3362914 - RNA, 17 nt, Barmah Forest virus
acucccaauacgugccc

SEQ ID NO: 3362915 - RNA, 21 nt, Barmah Forest virus
acucuacggagauguaggcau

SEQ ID NO: 3362916 - RNA, 23 nt, Barmah Forest virus
acugcaugaagaucgagaaugac

SEQ ID NO: 3362917 - RNA, 20 nt, Barmah Forest virus
acugcuacgaacaaaaucac

SEQ ID NO: 3362918 - RNA, 17 nt, Barmah Forest virus
acuucauauaaaauuac

SEQ ID NO: 3362919 - RNA, 13 nt, Barmah Forest virus
acuugcccacagg

SEQ ID NO: 3362920 - RNA, 20 nt, Barmah Forest virus
agaaaccaacccaaaagaag

SEQ ID NO: 3362921 - RNA, 15 nt, Barmah Forest virus
agaagcccaagaaga

SEQ ID NO: 3362922 - RNA, 21 nt, Barmah Forest virus
agauccaaguguccaugcaga

SEQ ID NO: 3362923 - RNA, 15 nt, Barmah Forest virus
agcuaaaagcaauac

SEQ ID NO: 3362924 - RNA, 18 nt, Barmah Forest virus
agcuaauuuuccaucagu

SEQ ID NO: 3362925 - RNA, 22 nt, Barmah Forest virus
agcucaugugaagggcacgauc

SEQ ID NO: 3362926 - RNA, 14 nt, Barmah Forest virus
agcuugcaaugcau

SEQ ID NO: 3362927 - RNA, 13 nt, Barmah Forest virus
aggaaauaugcgu

SEQ ID NO: 3362928 - RNA, 18 nt, Barmah Forest virus
aggugcaaaugaaggggc

SEQ ID NO: 3362929 - RNA, 21 nt, Barmah Forest virus
aguaacaaaagagaaaaacac

SEQ ID NO: 3362930 - RNA, 14 nt, Barmah Forest virus
aguacaacucccaa

SEQ ID NO: 3362931 - RNA, 15 nt, Barmah Forest virus
aguacaggaggcuga

SEQ ID NO: 3362932 - RNA, 18 nt, Barmah Forest virus
aguauccauuguaguaug

SEQ ID NO: 3362933 - RNA, 12 nt, Barmah Forest virus
agucaaguugaa

SEQ ID NO: 3362934 - RNA, 23 nt, Barmah Forest virus
agucacgcccggaaccaagcaca

SEQ ID NO: 3362935 - RNA, 18 nt, Barmah Forest virus
agucaugaaaccagcuca

SEQ ID NO: 3362936 - RNA, 18 nt, Barmah Forest virus
aguguauuacauaugcag

SEQ ID NO: 3362937 - RNA, 12 nt, Barmah Forest virus
aguguuggagga

SEQ ID NO: 3362938 - RNA, 14 nt, Barmah Forest virus
aguucaaagggcca

SEQ ID NO: 3362939 - RNA, 22 nt, Barmah Forest virus
aguugaaaggaccgaaagcugc

SEQ ID NO: 3362940 - RNA, 17 nt, Barmah Forest virus
auaaccaccgaaaaugu

SEQ ID NO: 3362941 - RNA, 13 nt, Barmah Forest virus
auaaccccugaau

SEQ ID NO: 3362942 - RNA, 13 nt, Barmah Forest virus
auaugaaagcaga

SEQ ID NO: 3362943 - RNA, 17 nt, Barmah Forest virus
auauuaccccugaauag

SEQ ID NO: 3362944 - RNA, 18 nt, Barmah Forest virus
auccguuuuacaaaauug

SEQ ID NO: 3362945 - RNA, 12 nt, Barmah Forest virus
augcaccaaagu

SEQ ID NO: 3362946 - RNA, 23 nt, Barmah Forest virus
auuaccccugaauaguaacaaaa

SEQ ID NO: 3362947 - RNA, 23 nt, Barmah Forest virus
auuccaaaacaccuuacaaaaug

SEQ ID NO: 3362948 - RNA, 20 nt, Barmah Forest virus
caaaauugcacggcagaaug

SEQ ID NO: 3362949 - RNA, 11 nt, Barmah Forest virus
caaagggccau

SEQ ID NO: 3362950 - RNA, 22 nt, Barmah Forest virus
caaaugaaaccgucugaagcaa

SEQ ID NO: 3362951 - RNA, 12 nt, Barmah Forest virus
caacagcaccau

SEQ ID NO: 3362952 - RNA, 17 nt, Barmah Forest virus
caacuagugaccucaga

SEQ ID NO: 3362953 - RNA, 17 nt, Barmah Forest virus
caagaagacaccaccac

SEQ ID NO: 3362954 - RNA, 23 nt, Barmah Forest virus
caagacaauccaaguuggggcag

SEQ ID NO: 3362955 - RNA, 19 nt, Barmah Forest virus
caauccagaacuagccaaa

SEQ ID NO: 3362956 - RNA, 18 nt, Barmah Forest virus
caauggaguacaggaggc

SEQ ID NO: 3362957 - RNA, 22 nt, Barmah Forest virus
caaugguuggcacacaccaccu

SEQ ID NO: 3362958 - RNA, 13 nt, Barmah Forest virus
cacaacagcacca

SEQ ID NO: 3362959 - RNA, 15 nt, Barmah Forest virus
cacacagaugagaga

SEQ ID NO: 3362960 - RNA, 17 nt, Barmah Forest virus
cacagagugugugaagc

SEQ ID NO: 3362961 - RNA, 20 nt, Barmah Forest virus
cacaguacuagcgagucuag

SEQ ID NO: 3362962 - RNA, 19 nt, Barmah Forest virus
cacaguguggcaguacaac

SEQ ID NO: 3362963 - RNA, 13 nt, Barmah Forest virus
caccgaagagaga

SEQ ID NO: 3362964 - RNA, 20 nt, Barmah Forest virus
caccgaagagagaccaaagg

SEQ ID NO: 3362965 - RNA, 22 nt, Barmah Forest virus
cagacacggguccaggccaccu

SEQ ID NO: 3362966 - RNA, 17 nt, Barmah Forest virus
cagacccacugaagaga

SEQ ID NO: 3362967 - RNA, 22 nt, Barmah Forest virus
cagaugagagaacuaccaacau

SEQ ID NO: 3362968 - RNA, 21 nt, Barmah Forest virus
cagcacccaccgggcacaaga

SEQ ID NO: 3362969 - RNA, 17 nt, Barmah Forest virus
cagcacgugugcaguca

SEQ ID NO: 3362970 - RNA, 21 nt, Barmah Forest virus
cagcccuauccguggucaccu

SEQ ID NO: 3362971 - RNA, 15 nt, Barmah Forest virus
cagcuuggcaauggu

SEQ ID NO: 3362972 - RNA, 18 nt, Barmah Forest virus
caggaaauaugcgugcaa

SEQ ID NO: 3362973 - RNA, 17 nt, Barmah Forest virus
cagucagcguagcaccu

SEQ ID NO: 3362974 - RNA, 21 nt, Barmah Forest virus
cauaagagggaaaccaauaca

SEQ ID NO: 3362975 - RNA, 13 nt, Barmah Forest virus
caucaaguacaaa

SEQ ID NO: 3362976 - RNA, 17 nt, Barmah Forest virus
caugagaaaccagaagg

SEQ ID NO: 3362977 - RNA, 13 nt, Barmah Forest virus
caugagcaagaca

SEQ ID NO: 3362978 - RNA, 21 nt, Barmah Forest virus
ccaagcacaccgaagagagac

SEQ ID NO: 3362979 - RNA, 17 nt, Barmah Forest virus
ccaagcagaaacaaaaa

SEQ ID NO: 3362980 - RNA, 20 nt, Barmah Forest virus
ccacaaggaaggagaccuaa

SEQ ID NO: 3362981 - RNA, 17 nt, Barmah Forest virus
ccagcaccaguccagag

SEQ ID NO: 3362982 - RNA, 17 nt, Barmah Forest virus
ccauauaaccccugaau

SEQ ID NO: 3362983 - RNA, 13 nt, Barmah Forest virus
cccacugaagaga

SEQ ID NO: 3362984 - RNA, 11 nt, Barmah Forest virus
cccagaagccu

SEQ ID NO: 3362985 - RNA, 15 nt, Barmah Forest virus
cccagcacccaccgg

SEQ ID NO: 3362986 - RNA, 14 nt, Barmah Forest virus
cccaucagacagac

SEQ ID NO: 3362987 - RNA, 17 nt, Barmah Forest virus
cccaugagcaagacaau

SEQ ID NO: 3362988 - RNA, 13 nt, Barmah Forest virus
ccccagcacccac

SEQ ID NO: 3362989 - RNA, 12 nt, Barmah Forest virus
ccgaaaauguca

SEQ ID NO: 3362990 - RNA, 22 nt, Barmah Forest virus
ccgaaguuacggaggugaaagg

SEQ ID NO: 3362991 - RNA, 15 nt, Barmah Forest virus
ccuuacaaaauguau

SEQ ID NO: 3362992 - RNA, 22 nt, Barmah Forest virus
ccuucagaaacauaagagggaa

SEQ ID NO: 3362993 - RNA, 20 nt, Barmah Forest virus
cgaagaccaucaaguacaaa

SEQ ID NO: 3362994 - RNA, 14 nt, Barmah Forest virus
cgaucgacaaucca

SEQ ID NO: 3362995 - RNA, 18 nt, Barmah Forest virus
cgauggagaccagcacca

SEQ ID NO: 3362996 - RNA, 15 nt, Barmah Forest virus
cgcacuucacaagga

SEQ ID NO: 3362997 - RNA, 15 nt, Barmah Forest virus
cguaacugcaugaag

SEQ ID NO: 3362998 - RNA, 13 nt, Barmah Forest virus
cuacucugucuaa

SEQ ID NO: 3362999 - RNA, 15 nt, Barmah Forest virus
cuauugcuguagaaa

SEQ ID NO: 3363000 - RNA, 14 nt, Barmah Forest virus
cugaagcaaacaaa

SEQ ID NO: 3363001 - RNA, 15 nt, Barmah Forest virus
cugcauucggggaaa

SEQ ID NO: 3363002 - RNA, 22 nt, Colorado tick fever virus
acugcuugcuuaaaggugugaa

SEQ ID NO: 3363003 - RNA, 14 nt, Colorado tick fever virus
agcaucauucuccc

SEQ ID NO: 3363004 - RNA, 19 nt, Colorado tick fever virus
agcuucagcggcugcggcu

SEQ ID NO: 3363005 - RNA, 14 nt, Colorado tick fever virus
aggaccucgccggc

SEQ ID NO: 3363006 - RNA, 15 nt, Colorado tick fever virus
aggaugcugaucucc

SEQ ID NO: 3363007 - RNA, 19 nt, Colorado tick fever virus
aggaugcugaucucccuug

SEQ ID NO: 3363008 - RNA, 23 nt, Colorado tick fever virus
aggaugcugaucucccuugcagu

SEQ ID NO: 3363009 - RNA, 17 nt, Colorado tick fever virus
aggguagucgcugagga

SEQ ID NO: 3363010 - RNA, 19 nt, Colorado tick fever virus
aggguagucgcugaggacc

SEQ ID NO: 3363011 - RNA, 14 nt, Colorado tick fever virus
agggugcauucuug

SEQ ID NO: 3363012 - RNA, 14 nt, Colorado tick fever virus
aguccaaacuccaa

SEQ ID NO: 3363013 - RNA, 22 nt, Colorado tick fever virus
cugacgcagggguucagucugu

SEQ ID NO: 3363014 - RNA, 19 nt, Colorado tick fever virus
cugaggaccucgccggcuu

SEQ ID NO: 3363015 - RNA, 15 nt, Colorado tick fever virus
cugaucucccuugca

SEQ ID NO: 3363016 - RNA, 18 nt, Colorado tick fever virus
cugcauaguauccacaug

SEQ ID NO: 3363017 - RNA, 20 nt, Colorado tick fever virus
cugcggcuuaccaggcgggc

SEQ ID NO: 3363018 - RNA, 22 nt, Colorado tick fever virus
cugugcacacgauugagcacaa

SEQ ID NO: 3363019 - RNA, 19 nt, Colorado tick fever virus
cuguguucggaugcaugca

SEQ ID NO: 3363020 - RNA, 15 nt, Colorado tick fever virus
cuugaugugaagaca

SEQ ID NO: 3363021 - RNA, 21 nt, Colorado tick fever virus
cuugaugugaagacaaugcag

SEQ ID NO: 3363022 - RNA, 16 nt, Colorado tick fever virus
gaacgacgcgagugag

SEQ ID NO: 3363023 - RNA, 20 nt, Colorado tick fever virus
gaacggggcuaaggccugga

SEQ ID NO: 3363024 - RNA, 14 nt, Colorado tick fever virus
gaaguaugauugag

SEQ ID NO: 3363025 - RNA, 13 nt, Colorado tick fever virus
gaauccuugcagu

SEQ ID NO: 3363026 - RNA, 14 nt, Colorado tick fever virus
gaauccuugcaguc

SEQ ID NO: 3363027 - RNA, 14 nt, Colorado tick fever virus
gacgcagggguuca

SEQ ID NO: 3363028 - RNA, 12 nt, Colorado tick fever virus
gacgggcagggu

SEQ ID NO: 3363029 - RNA, 18 nt, Colorado tick fever virus
gacugcuugcuuaaaggu

SEQ ID NO: 3363030 - RNA, 15 nt, Colorado tick fever virus
gagagugcaggcuuu

SEQ ID NO: 3363031 - RNA, 13 nt, Colorado tick fever virus
gagguacuggcag

SEQ ID NO: 3363032 - RNA, 17 nt, Colorado tick fever virus
gagguacuggcagaugg

SEQ ID NO: 3363033 - RNA, 18 nt, Colorado tick fever virus
gaugcugaucucccuugc

SEQ ID NO: 3363034 - RNA, 20 nt, Colorado tick fever virus
gauuggugaccggugcagga

SEQ ID NO: 3363035 - RNA, 13 nt, Colorado tick fever virus
gcacggggaauuu

SEQ ID NO: 3363036 - RNA, 20 nt, Colorado tick fever virus
gcaggaugcugaucucccuu

SEQ ID NO: 3363037 - RNA, 13 nt, Colorado tick fever virus
gcagggguucagu

SEQ ID NO: 3363038 - RNA, 20 nt, Colorado tick fever virus
gcagggguucagucuguguu

SEQ ID NO: 3363039 - RNA, 22 nt, Colorado tick fever virus
gcaggguagucgcugaggaccu

SEQ ID NO: 3363040 - RNA, 12 nt, Colorado tick fever virus
gcgaguugcagu

SEQ ID NO: 3363041 - RNA, 16 nt, Colorado tick fever virus
gcgcacggggaauuug

SEQ ID NO: 3363042 - RNA, 16 nt, Colorado tick fever virus
gcgggcuuuuugcgug

SEQ ID NO: 3363043 - RNA, 21 nt, Colorado tick fever virus
gcugaccagacguaugaggcu

SEQ ID NO: 3363044 - RNA, 19 nt, Colorado tick fever virus
gcugaucucccuugcaguc

SEQ ID NO: 3363045 - RNA, 15 nt, Colorado tick fever virus
ggaauccuugcaguc

SEQ ID NO: 3363046 - RNA, 13 nt, Colorado tick fever virus
ggaauuugcaguc

SEQ ID NO: 3363047 - RNA, 21 nt, Colorado tick fever virus
ggauauuuucuaagacugcuu

SEQ ID NO: 3363048 - RNA, 15 nt, Colorado tick fever virus
ggcgcgugagcaggu

SEQ ID NO: 3363049 - RNA, 15 nt, Colorado tick fever virus
gggcugcgcagugug

SEQ ID NO: 3363050 - RNA, 21 nt, Colorado tick fever virus
ggugcauucuugaugugaaga

SEQ ID NO: 3363051 - RNA, 15 nt, Colorado tick fever virus
gguggaggcugcuca

SEQ ID NO: 3363052 - RNA, 13 nt, Colorado tick fever virus
gguggcugugcac

SEQ ID NO: 3363053 - RNA, 14 nt, Colorado tick fever virus
gguuguugcaggcu

SEQ ID NO: 3363054 - RNA, 20 nt, Colorado tick fever virus
guagugaaugggcuggagaa

SEQ ID NO: 3363055 - RNA, 13 nt, Colorado tick fever virus
guaugaggcucuu

SEQ ID NO: 3363056 - RNA, 19 nt, Colorado tick fever virus
gugaggagggcagauggca

SEQ ID NO: 3363057 - RNA, 19 nt, Colorado tick fever virus
gugcacacgauugagcaca

SEQ ID NO: 3363058 - RNA, 20 nt, Colorado tick fever virus
gugcaggcuuucgugaagga

SEQ ID NO: 3363059 - RNA, 20 nt, Colorado tick fever virus
gugcuuuuuaugggugucug

SEQ ID NO: 3363060 - RNA, 22 nt, Colorado tick fever virus
guggaugaguggggcugcgcag

SEQ ID NO: 3363061 - RNA, 21 nt, Colorado tick fever virus
gugggagugcucaagugauug

SEQ ID NO: 3363062 - RNA, 19 nt, Colorado tick fever virus
uaaggccuggauacaaaug

SEQ ID NO: 3363063 - RNA, 14 nt, Colorado tick fever virus
uacacaauugcagu

SEQ ID NO: 3363064 - RNA, 15 nt, Colorado tick fever virus
uagaacgguugcagu

SEQ ID NO: 3363065 - RNA, 13 nt, Colorado tick fever virus
uagucgcugagga

SEQ ID NO: 3363066 - RNA, 14 nt, Colorado tick fever virus
uagucgcugaggac

SEQ ID NO: 3363067 - RNA, 17 nt, Colorado tick fever virus
uaugugccagaggaggu

SEQ ID NO: 3363068 - RNA, 19 nt, Colorado tick fever virus
ucaauugucgguguaaucu

SEQ ID NO: 3363069 - RNA, 15 nt, Colorado tick fever virus
ucagucuguguucgg

SEQ ID NO: 3363070 - RNA, 20 nt, Colorado tick fever virus
ucauucccagggugcauucu

SEQ ID NO: 3363071 - RNA, 21 nt, Colorado tick fever virus
uccuagcaucauucucccggg

SEQ ID NO: 3363072 - RNA, 14 nt, Colorado tick fever virus
ucgagagugcaggc

SEQ ID NO: 3363073 - RNA, 17 nt, Colorado tick fever virus
ucgagagugcaggcuuu

SEQ ID NO: 3363074 - RNA, 17 nt, Colorado tick fever virus
ucuccaucgcuuugcag

SEQ ID NO: 3363075 - RNA, 17 nt, Colorado tick fever virus
ucuccgcgaguugcagu

SEQ ID NO: 3363076 - RNA, 19 nt, Colorado tick fever virus
ucugacgcagggguucagu

SEQ ID NO: 3363077 - RNA, 12 nt, Colorado tick fever virus
ucuucaauuugu

SEQ ID NO: 3363078 - RNA, 17 nt, Colorado tick fever virus
ugaccggugcaggaugc

SEQ ID NO: 3363079 - RNA, 20 nt, Colorado tick fever virus
ugaugugaagacaaugcagu

SEQ ID NO: 3363080 - RNA, 13 nt, Colorado tick fever virus
ugaugugacacac

SEQ ID NO: 3363081 - RNA, 17 nt, Colorado tick fever virus
uggagaaccaucccuac

SEQ ID NO: 3363082 - RNA, 18 nt, Colorado tick fever virus
uggggcugcgcagugugu

SEQ ID NO: 3363083 - RNA, 20 nt, Colorado tick fever virus
uggguagaacgguugcaguc

SEQ ID NO: 3363084 - RNA, 17 nt, Colorado tick fever virus
uggugaccggugcagga

SEQ ID NO: 3363085 - RNA, 11 nt, Colorado tick fever virus
ugucugaauac

SEQ ID NO: 3363086 - RNA, 17 nt, Colorado tick fever virus
ugugaagacaaugcagu

SEQ ID NO: 3363087 - RNA, 18 nt, Colorado tick fever virus
uguucggaugcaugcagu

SEQ ID NO: 3363088 - RNA, 21 nt, Colorado tick fever virus
uguuggcgugcgcgacgcauc

SEQ ID NO: 3363089 - RNA, 11 nt, Colorado tick fever virus
uucagcagcag

SEQ ID NO: 3363090 - RNA, 14 nt, Colorado tick fever virus
uucccagggugcau

SEQ ID NO: 3363091 - RNA, 17 nt, Colorado tick fever virus
uucggaugcaugcaguc

SEQ ID NO: 3363092 - RNA, 23 nt, Colorado tick fever virus
uucuaagacugcuugcuuaaagg

SEQ ID NO: 3363093 - RNA, 18 nt, Colorado tick fever virus
uucuugaugugaagacaa

SEQ ID NO: 3363094 - RNA, 22 nt, Colorado tick fever virus
uugacacagucugucaaagacg

SEQ ID NO: 3363095 - RNA, 20 nt, Colorado tick fever virus
uugggucacuauggggcuga

SEQ ID NO: 3363096 - RNA, 15 nt, Colorado tick fever virus
uuguuaacaaugagu

SEQ ID NO: 3363097 - RNA, 14 nt, Colorado tick fever virus
uuguugcaggcuuu

SEQ ID NO: 3363098 - RNA, 23 nt, Colorado tick fever virus
auugagagcggagccuuuaaggu

SEQ ID NO: 3363099 - RNA, 22 nt, Colorado tick fever virus
auuggauauuuucuaagacugc

SEQ ID NO: 3363100 - RNA, 11 nt, Colorado tick fever virus
caauugcaguc

SEQ ID NO: 3363101 - RNA, 21 nt, Colorado tick fever virus
cacgccauacacaauugcagu

SEQ ID NO: 3363102 - RNA, 19 nt, Colorado tick fever virus
cagaggagguuguugcagg

SEQ ID NO: 3363103 - RNA, 23 nt, Colorado tick fever virus
caggaugcugaucucccuugcag

SEQ ID NO: 3363104 - RNA, 22 nt, Colorado tick fever virus
caggguagucgcugaggaccuc

SEQ ID NO: 3363105 - RNA, 13 nt, Colorado tick fever virus
cauccgugcucgu

SEQ ID NO: 3363106 - RNA, 15 nt, Colorado tick fever virus
caucgcuuugcaguc

SEQ ID NO: 3363107 - RNA, 14 nt, Colorado tick fever virus
cauucccagggugc

SEQ ID NO: 3363108 - RNA, 11 nt, Colorado tick fever virus
ccaaacuccaa

SEQ ID NO: 3363109 - RNA, 13 nt, Colorado tick fever virus
cccaauggugucu

SEQ ID NO: 3363110 - RNA, 12 nt, Colorado tick fever virus
ccgcgaguugca

SEQ ID NO: 3363111 - RNA, 16 nt, Colorado tick fever virus
ccgggacggguaauug

SEQ ID NO: 3363112 - RNA, 15 nt, Colorado tick fever virus
ccggugcaggaugcu

SEQ ID NO: 3363113 - RNA, 17 nt, Colorado tick fever virus
cgccggcuuacggaaug

SEQ ID NO: 3363114 - RNA, 13 nt, Colorado tick fever virus
cggagggugaggu

SEQ ID NO: 3363115 - RNA, 16 nt, Colorado tick fever virus
cggggaauuugcaguc

SEQ ID NO: 3363116 - RNA, 22 nt, Colorado tick fever virus
cguagucuccgcgaguugcagu

SEQ ID NO: 3363117 - RNA, 14 nt, Colorado tick fever virus
cgugacgggcaggg

SEQ ID NO: 3363118 - RNA, 18 nt, Colorado tick fever virus
cguugacacagucuguca

SEQ ID NO: 3363119 - RNA, 19 nt, Colorado tick fever virus
cuagcaucauucucccggg

SEQ ID NO: 3363120 - RNA, 16 nt, Colorado tick fever virus
cucaguuaggcggugc

SEQ ID NO: 3363121 - RNA, 18 nt, Colorado tick fever virus
cucauauagggaauccuu

SEQ ID NO: 3363122 - RNA, 18 nt, Colorado tick fever virus
cuccaucgcuuugcaguc

SEQ ID NO: 3363123 - RNA, 13 nt, Colorado tick fever virus
cucccuugcaguc

SEQ ID NO: 3363124 - RNA, 17 nt, Colorado tick fever virus
cuccgcgaguugcaguc

SEQ ID NO: 3363125 - RNA, 23 nt, Colorado tick fever virus
cugagcucuccaucgcuuugcag

SEQ ID NO: 3363126 - RNA, 18 nt, Colorado tick fever virus
cugaucucccuugcaguc

SEQ ID NO: 3363127 - RNA, 21 nt, Colorado tick fever virus
cugucaaagacggcugcuggc

SEQ ID NO: 3363128 - RNA, 17 nt, Colorado tick fever virus
cuguguucggaugcaug

SEQ ID NO: 3363129 - RNA, 13 nt, Colorado tick fever virus
cuugaugugaaga

SEQ ID NO: 3363130 - RNA, 14 nt, Colorado tick fever virus
cuuuggugaaggau

SEQ ID NO: 3363131 - RNA, 17 nt, Colorado tick fever virus
gaacgacgcgagugagg

SEQ ID NO: 3363132 - RNA, 17 nt, Colorado tick fever virus
gaccagacguaugaggc

SEQ ID NO: 3363133 - RNA, 18 nt, Colorado tick fever virus
gaccuaagauaugcucag

SEQ ID NO: 3363134 - RNA, 19 nt, Colorado tick fever virus
gacugcuugcuuaaaggug

SEQ ID NO: 3363135 - RNA, 11 nt, Colorado tick fever virus
gagagugcagg

SEQ ID NO: 3363136 - RNA, 16 nt, Colorado tick fever virus
gaguggggcugcgcag

SEQ ID NO: 3363137 - RNA, 20 nt, Colorado tick fever virus
gaguggggcugcgcagugug

SEQ ID NO: 3363138 - RNA, 11 nt, Colorado tick fever virus
gauaugcucag

SEQ ID NO: 3363139 - RNA, 24 nt, Colorado tick fever virus
gauauuuucuaagacugcuugcuu

SEQ ID NO: 3363140 - RNA, 19 nt, Colorado tick fever virus
gcaccacgccauacacaau

SEQ ID NO: 3363141 - RNA, 23 nt, Colorado tick fever virus
gcaggaugcugaucucccuugca

SEQ ID NO: 3363142 - RNA, 21 nt, Colorado tick fever virus
gcaggcuuuaagcgagugcgg

SEQ ID NO: 3363143 - RNA, 21 nt, Colorado tick fever virus
gcaggcuuucgugaaggagcu

SEQ ID NO: 3363144 - RNA, 18 nt, Colorado tick fever virus
gcaggguagucgcugagg

SEQ ID NO: 3363145 - RNA, 21 nt, Colorado tick fever virus
gcaucuccguuaacugagagc

SEQ ID NO: 3363146 - RNA, 23 nt, Colorado tick fever virus
gcccugucgggaaaaaucggugg

SEQ ID NO: 3363147 - RNA, 21 nt, Colorado tick fever virus
gccggcuuacggaaugaugac

SEQ ID NO: 3363148 - RNA, 18 nt, Colorado tick fever virus
gcucaagugauuguugug

SEQ ID NO: 3363149 - RNA, 20 nt, Colorado tick fever virus
gcugaccagacguaugaggc

SEQ ID NO: 3363150 - RNA, 13 nt, Colorado tick fever virus
gcuuaaaggugug

SEQ ID NO: 3363151 - RNA, 19 nt, Colorado tick fever virus
gcuuuuuaugggugucuga

SEQ ID NO: 3363152 - RNA, 17 nt, Colorado tick fever virus
ggacggguaauugcagu

SEQ ID NO: 3363153 - RNA, 13 nt, Colorado tick fever virus
ggagggcagaugg

SEQ ID NO: 3363154 - RNA, 13 nt, Colorado tick fever virus
ggaugcaugcagu

SEQ ID NO: 3363155 - RNA, 23 nt, Colorado tick fever virus
ggaugcugaucucccuugcaguc

SEQ ID NO: 3363156 - RNA, 21 nt, Colorado tick fever virus
ggauuggugaccggugcagga

SEQ ID NO: 3363157 - RNA, 22 nt, Colorado tick fever virus
ggcaggguagucgcugaggacc

SEQ ID NO: 3363158 - RNA, 17 nt, Colorado tick fever virus
ggcgggcuuuuugcgug

SEQ ID NO: 3363159 - RNA, 14 nt, Colorado tick fever virus
gggaauuugcaguc

SEQ ID NO: 3363160 - RNA, 19 nt, Colorado tick fever virus
gggacggguaauugcaguc

SEQ ID NO: 3363161 - RNA, 15 nt, Colorado tick fever virus
ggggaauuugcaguc

SEQ ID NO: 3363162 - RNA, 22 nt, Colorado tick fever virus
ggggguauugauguuggcgugc

SEQ ID NO: 3363163 - RNA, 20 nt, Colorado tick fever virus
gggguauugauguuggcgug

SEQ ID NO: 3363164 - RNA, 17 nt, Colorado tick fever virus
gggguucagucuguguu

SEQ ID NO: 3363165 - RNA, 16 nt, Colorado tick fever virus
gggucacuauggggcu

SEQ ID NO: 3363166 - RNA, 16 nt, Colorado tick fever virus
gggugagguacuggca

SEQ ID NO: 3363167 - RNA, 17 nt, Colorado tick fever virus
ggugaccggugcaggau

SEQ ID NO: 3363168 - RNA, 23 nt, Colorado tick fever virus
ggugcaggaugcugaucucccuu

SEQ ID NO: 3363169 - RNA, 14 nt, Colorado tick fever virus
gguggaggcugcuc

SEQ ID NO: 3363170 - RNA, 15 nt, Colorado tick fever virus
gguucagucuguguu

SEQ ID NO: 3363171 - RNA, 22 nt, Colorado tick fever virus
guaugugacauucauucccagg

SEQ ID NO: 3363172 - RNA, 16 nt, Colorado tick fever virus
gucuuuggaugauggg

SEQ ID NO: 3363173 - RNA, 18 nt, Colorado tick fever virus
gugacauucauucccagg

SEQ ID NO: 3363174 - RNA, 15 nt, Colorado tick fever virus
gugaccggugcagga

SEQ ID NO: 3363175 - RNA, 20 nt, Colorado tick fever virus
gugcaccacgccauacacaa

SEQ ID NO: 3363176 - RNA, 14 nt, Colorado tick fever virus
gugcaggaugcuga

SEQ ID NO: 3363177 - RNA, 22 nt, Colorado tick fever virus
gugggauuggugaccggugcag

SEQ ID NO: 3363178 - RNA, 16 nt, Colorado tick fever virus
guggggcugcgcagug

SEQ ID NO: 3363179 - RNA, 15 nt, Colorado tick fever virus
uacacaauugcaguc

SEQ ID NO: 3363180 - RNA, 23 nt, Colorado tick fever virus
ucagcggcugcggcuuaccaggc

SEQ ID NO: 3363181 - RNA, 15 nt, Colorado tick fever virus
uccuagcaucauucu

SEQ ID NO: 3363182 - RNA, 13 nt, Colorado tick fever virus
ucggagggugagg

SEQ ID NO: 3363183 - RNA, 14 nt, Colorado tick fever virus
ucggaugcaugcag

SEQ ID NO: 3363184 - RNA, 22 nt, Colorado tick fever virus
ucugacgcagggguucagucug

SEQ ID NO: 3363185 - RNA, 15 nt, Colorado tick fever virus
ucuguuuggauguca

SEQ ID NO: 3363186 - RNA, 20 nt, Colorado tick fever virus
ugaaaauggcguaguaguga

SEQ ID NO: 3363187 - RNA, 16 nt, Colorado tick fever virus
ugaaugggcuggagaa

SEQ ID NO: 3363188 - RNA, 13 nt, Colorado tick fever virus
ugacgagugggua

SEQ ID NO: 3363189 - RNA, 18 nt, Colorado tick fever virus
ugaggagggcagauggca

SEQ ID NO: 3363190 - RNA, 19 nt, Colorado tick fever virus
ugaguggggcugcgcagug

SEQ ID NO: 3363191 - RNA, 20 nt, Colorado tick fever virus
agugacccuggagccgugcc

SEQ ID NO: 3363192 - RNA, 20 nt, Colorado tick fever virus
aguggggcugcgcagugugu

SEQ ID NO: 3363193 - RNA, 18 nt, Colorado tick fever virus
auauagggaauccuugca

SEQ ID NO: 3363194 - RNA, 19 nt, Colorado tick fever virus
auauagggaauccuugcag

SEQ ID NO: 3363195 - RNA, 21 nt, Colorado tick fever virus
auauagggaauccuugcaguc

SEQ ID NO: 3363196 - RNA, 22 nt, Colorado tick fever virus
auauuuucuaagacugcuugcu

SEQ ID NO: 3363197 - RNA, 11 nt, Colorado tick fever virus
aucuucaauuu

SEQ ID NO: 3363198 - RNA, 18 nt, Colorado tick fever virus
augacguccuagcaucau

SEQ ID NO: 3363199 - RNA, 21 nt, Colorado tick fever virus
augaugacguccuagcaucau

SEQ ID NO: 3363200 - RNA, 22 nt, Colorado tick fever virus
augcaaguggucgaccacgagu

SEQ ID NO: 3363201 - RNA, 13 nt, Colorado tick fever virus
auggggcugacca

SEQ ID NO: 3363202 - RNA, 23 nt, Colorado tick fever virus
auggguugagguggcugugcaca

SEQ ID NO: 3363203 - RNA, 17 nt, Colorado tick fever virus
augugaagacaaugcag

SEQ ID NO: 3363204 - RNA, 18 nt, Colorado tick fever virus
augugacauucauuccca

SEQ ID NO: 3363205 - RNA, 22 nt, Colorado tick fever virus
augugacauucauucccagggu

SEQ ID NO: 3363206 - RNA, 23 nt, Colorado tick fever virus
auguucauccgugcucgugaagu

SEQ ID NO: 3363207 - RNA, 23 nt, Colorado tick fever virus
auuggugaccggugcaggaugcu

SEQ ID NO: 3363208 - RNA, 14 nt, Colorado tick fever virus
auuuucuaagacug

SEQ ID NO: 3363209 - RNA, 18 nt, Colorado tick fever virus
caauugucgguguaaucu

SEQ ID NO: 3363210 - RNA, 21 nt, Colorado tick fever virus
caccacgccauacacaauugc

SEQ ID NO: 3363211 - RNA, 19 nt, Colorado tick fever virus
cagguggaggcugcucagu

SEQ ID NO: 3363212 - RNA, 16 nt, Colorado tick fever virus
cauauagggaauccuu

SEQ ID NO: 3363213 - RNA, 22 nt, Colorado tick fever virus
cauauagggaauccuugcaguc

SEQ ID NO: 3363214 - RNA, 17 nt, Colorado tick fever virus
caucguuguugaugcug

SEQ ID NO: 3363215 - RNA, 14 nt, Colorado tick fever virus
cauucauucccagg

SEQ ID NO: 3363216 - RNA, 12 nt, Colorado tick fever virus
cccagggugcau

SEQ ID NO: 3363217 - RNA, 14 nt, Colorado tick fever virus
cccgggacggguaa

SEQ ID NO: 3363218 - RNA, 18 nt, Colorado tick fever virus
ccggcuuacggaaugaug

SEQ ID NO: 3363219 - RNA, 19 nt, Colorado tick fever virus
cgauugagagcggagccuu

SEQ ID NO: 3363220 - RNA, 21 nt, Colorado tick fever virus
cgcagggguucagucuguguu

SEQ ID NO: 3363221 - RNA, 20 nt, Colorado tick fever virus
cgccuuuggugaaggaugca

SEQ ID NO: 3363222 - RNA, 22 nt, Colorado tick fever virus
cgcgcacggggaauuugcaguc

SEQ ID NO: 3363223 - RNA, 24 nt, Colorado tick fever virus
cgcguagucuccgcgaguugcagu

SEQ ID NO: 3363224 - RNA, 14 nt, Colorado tick fever virus
cggaugcaugcagu

SEQ ID NO: 3363225 - RNA, 23 nt, Colorado tick fever virus
cguagucuccgcgaguugcaguc

SEQ ID NO: 3363226 - RNA, 17 nt, Colorado tick fever virus
cuaagacugcuugcuua

SEQ ID NO: 3363227 - RNA, 16 nt, Colorado tick fever virus
cuaagauaugcucagu

SEQ ID NO: 3363228 - RNA, 13 nt, Colorado tick fever virus
cuaaggccuggau

SEQ ID NO: 3363229 - RNA, 19 nt, Colorado tick fever virus
cuacccccaauggugucua

SEQ ID NO: 3363230 - RNA, 21 nt, Colorado tick fever virus
cucaaugcucguaauccucag

SEQ ID NO: 3363231 - RNA, 23 nt, Colorado tick fever virus
cucccgggacggguaauugcagu

SEQ ID NO: 3363232 - RNA, 13 nt, Colorado tick fever virus
cucguaauccuca

SEQ ID NO: 3363233 - RNA, 20 nt, Colorado tick fever virus
cucuucgcgucaguuccaug

SEQ ID NO: 3363234 - RNA, 20 nt, Colorado tick fever virus
cuugaugugaagacaaugca

SEQ ID NO: 3363235 - RNA, 18 nt, Colorado tick fever virus
cuugcuuaaaggugugaa

SEQ ID NO: 3363236 - RNA, 23 nt, Colorado tick fever virus
gaaguaugauugagucuaugggg

SEQ ID NO: 3363237 - RNA, 19 nt, Colorado tick fever virus
gacauucauucccagggug

SEQ ID NO: 3363238 - RNA, 23 nt, Colorado tick fever virus
gaccucgccggcuuacggaauga

SEQ ID NO: 3363239 - RNA, 12 nt, Colorado tick fever virus
gacggcugcugg

SEQ ID NO: 3363240 - RNA, 17 nt, Colorado tick fever virus
gacggguaauugcaguc

SEQ ID NO: 3363241 - RNA, 22 nt, Colorado tick fever virus
gacguccuagcaucauucuccc

SEQ ID NO: 3363242 - RNA, 17 nt, Colorado tick fever virus
gaggagguuguugcagg

SEQ ID NO: 3363243 - RNA, 21 nt, Colorado tick fever virus
gaggagguuguugcaggcuuu

SEQ ID NO: 3363244 - RNA, 23 nt, Colorado tick fever virus
gauauuuucuaagacugcuugcu

SEQ ID NO: 3363245 - RNA, 19 nt, Colorado tick fever virus
gcacgcuugauuaccaggg

SEQ ID NO: 3363246 - RNA, 20 nt, Colorado tick fever virus
gcacgcuugauuaccagggu

SEQ ID NO: 3363247 - RNA, 19 nt, Colorado tick fever virus
gcagugugugacgaguggg

SEQ ID NO: 3363248 - RNA, 14 nt, Colorado tick fever virus
gcaucauucucccg

SEQ ID NO: 3363249 - RNA, 16 nt, Colorado tick fever virus
gcaucauucucccggg

SEQ ID NO: 3363250 - RNA, 19 nt, Colorado tick fever virus
gccauacacaauugcaguc

SEQ ID NO: 3363251 - RNA, 20 nt, Colorado tick fever virus
gccuggauacaaaugcagug

SEQ ID NO: 3363252 - RNA, 13 nt, Colorado tick fever virus
gcgaguugcaguc

SEQ ID NO: 3363253 - RNA, 21 nt, Colorado tick fever virus
gcgcacggggaauuugcaguc

SEQ ID NO: 3363254 - RNA, 22 nt, Colorado tick fever virus
gcggagccuuuaagguguagug

SEQ ID NO: 3363255 - RNA, 14 nt, Colorado tick fever virus
gcugaucucccuug

SEQ ID NO: 3363256 - RNA, 16 nt, Colorado tick fever virus
gcugcgcaguguguga

SEQ ID NO: 3363257 - RNA, 17 nt, Colorado tick fever virus
gcuuacggaaugaugac

SEQ ID NO: 3363258 - RNA, 20 nt, Colorado tick fever virus
gcuugcuuaaaggugugaaa

SEQ ID NO: 3363259 - RNA, 15 nt, Colorado tick fever virus
ggagguuguugcagg

SEQ ID NO: 3363260 - RNA, 17 nt, Colorado tick fever virus
ggauauuuucuaagacu

SEQ ID NO: 3363261 - RNA, 18 nt, Colorado tick fever virus
ggccuggauacaaaugca

SEQ ID NO: 3363262 - RNA, 14 nt, Colorado tick fever virus
ggcuauggugucuu

SEQ ID NO: 3363263 - RNA, 13 nt, Colorado tick fever virus
ggcugcgcagugu

SEQ ID NO: 3363264 - RNA, 20 nt, Colorado tick fever virus
gggaaaaaucggugggagug

SEQ ID NO: 3363265 - RNA, 16 nt, Colorado tick fever virus
gggaauccuugcaguc

SEQ ID NO: 3363266 - RNA, 22 nt, Colorado tick fever virus
gggauuggugaccggugcagga

SEQ ID NO: 3363267 - RNA, 16 nt, Colorado tick fever virus
ggggcugcgcagugug

SEQ ID NO: 3363268 - RNA, 12 nt, Colorado tick fever virus
ggguaauugcag

SEQ ID NO: 3363269 - RNA, 19 nt, Colorado tick fever virus
ggguagaacgguugcaguc

SEQ ID NO: 3363270 - RNA, 18 nt, Colorado tick fever virus
gguagaacgguugcaguc

SEQ ID NO: 3363271 - RNA, 19 nt, Colorado tick fever virus
ggugaccggugcaggaugc

SEQ ID NO: 3363272 - RNA, 15 nt, Colorado tick fever virus
ggugcaggaugcuga

SEQ ID NO: 3363273 - RNA, 14 nt, Colorado tick fever virus
guacuggcagaugg

SEQ ID NO: 3363274 - RNA, 17 nt, Colorado tick fever virus
guagucgcugaggaccu

SEQ ID NO: 3363275 - RNA, 19 nt, Colorado tick fever virus
gucaaagacggcugcuggc

SEQ ID NO: 3363276 - RNA, 16 nt, Colorado tick fever virus
gucgcugaggaccucg

SEQ ID NO: 3363277 - RNA, 18 nt, Colorado tick fever virus
gucuccgcgaguugcagu

SEQ ID NO: 3363278 - RNA, 16 nt, Colorado tick fever virus
gugaccggugcaggau

SEQ ID NO: 3363279 - RNA, 17 nt, Colorado tick fever virus
gugaccggugcaggaug

SEQ ID NO: 3363280 - RNA, 20 nt, Colorado tick fever virus
gugcauucuugaugugaaga

SEQ ID NO: 3363281 - RNA, 15 nt, Colorado tick fever virus
cgggcuuuuugcgug

SEQ ID NO: 3363282 - RNA, 15 nt, Colorado tick fever virus
cggggcuaaggccug

SEQ ID NO: 3363283 - RNA, 15 nt, Colorado tick fever virus
cggguaauugcaguc

SEQ ID NO: 3363284 - RNA, 18 nt, Colorado tick fever virus
cggugggagugcucaagu

SEQ ID NO: 3363285 - RNA, 23 nt, Colorado tick fever virus
cguggaugaguggggcugcgcag

SEQ ID NO: 3363286 - RNA, 11 nt, Colorado tick fever virus
cuaagacugcu

SEQ ID NO: 3363287 - RNA, 13 nt, Colorado tick fever virus
cuagcaucauucu

SEQ ID NO: 3363288 - RNA, 18 nt, Colorado tick fever virus
cucggagggugagguacu

SEQ ID NO: 3363289 - RNA, 22 nt, Colorado tick fever virus
cucgugaagucggcuggcgcaa

SEQ ID NO: 3363290 - RNA, 21 nt, Colorado tick fever virus
cugagagcgggguuguuuauc

SEQ ID NO: 3363291 - RNA, 17 nt, Colorado tick fever virus
cugcuugcuuaaaggug

SEQ ID NO: 3363292 - RNA, 14 nt, Colorado tick fever virus
gaagacaaugcagu

SEQ ID NO: 3363293 - RNA, 23 nt, Colorado tick fever virus
gaccuacccccaauggugucuau

SEQ ID NO: 3363294 - RNA, 14 nt, Colorado tick fever virus
gacggguaauugca

SEQ ID NO: 3363295 - RNA, 16 nt, Colorado tick fever virus
gacguccuagcaucau

SEQ ID NO: 3363296 - RNA, 23 nt, Colorado tick fever virus
gagcucuccaucgcuuugcaguc

SEQ ID NO: 3363297 - RNA, 14 nt, Colorado tick fever virus
gaggagggcagaug

SEQ ID NO: 3363298 - RNA, 16 nt, Colorado tick fever virus
gagguacuggcagaug

SEQ ID NO: 3363299 - RNA, 16 nt, Colorado tick fever virus
gaucucccuugcaguc

SEQ ID NO: 3363300 - RNA, 15 nt, Colorado tick fever virus
gcaggaugcugaucu

SEQ ID NO: 3363301 - RNA, 19 nt, Colorado tick fever virus
gcaucuucaauuuguuaac

SEQ ID NO: 3363302 - RNA, 15 nt, Colorado tick fever virus
gcgagugcgggagcu

SEQ ID NO: 3363303 - RNA, 16 nt, Colorado tick fever virus
gcugaggaccucgccg

SEQ ID NO: 3363304 - RNA, 17 nt, Colorado tick fever virus
gcugaucucccuugcag

SEQ ID NO: 3363305 - RNA, 21 nt, Colorado tick fever virus
gcugugcacacgauugagcac

SEQ ID NO: 3363306 - RNA, 16 nt, Colorado tick fever virus
gcuugcuuaaaggugu

SEQ ID NO: 3363307 - RNA, 17 nt, Colorado tick fever virus
ggacaucguuguugaug

SEQ ID NO: 3363308 - RNA, 21 nt, Colorado tick fever virus
ggagcuucagcggcugcggcu

SEQ ID NO: 3363309 - RNA, 14 nt, Colorado tick fever virus
ggaugcaugcaguc

SEQ ID NO: 3363310 - RNA, 16 nt, Colorado tick fever virus
ggaugcugaucucccu

SEQ ID NO: 3363311 - RNA, 18 nt, Colorado tick fever virus
gggauuggugaccggugc

SEQ ID NO: 3363312 - RNA, 18 nt, Colorado tick fever virus
gggcgaaacuacuccauu

SEQ ID NO: 3363313 - RNA, 14 nt, Colorado tick fever virus
ggguaauugcaguc

SEQ ID NO: 3363314 - RNA, 17 nt, Colorado tick fever virus
ggguugagguggcugug

SEQ ID NO: 3363315 - RNA, 17 nt, Colorado tick fever virus
ggugggauuggugaccg

SEQ ID NO: 3363316 - RNA, 18 nt, Colorado tick fever virus
gguugagguggcugugca

SEQ ID NO: 3363317 - RNA, 12 nt, Colorado tick fever virus
guacuggcagau

SEQ ID NO: 3363318 - RNA, 22 nt, Colorado tick fever virus
guagucuccgcgaguugcaguc

SEQ ID NO: 3363319 - RNA, 12 nt, Colorado tick fever virus
gucacuaugggg

SEQ ID NO: 3363320 - RNA, 19 nt, Colorado tick fever virus
gucgcugaggaccucgccg

SEQ ID NO: 3363321 - RNA, 22 nt, Colorado tick fever virus
gugaaaaucaauugucggugua

SEQ ID NO: 3363322 - RNA, 21 nt, Colorado tick fever virus
gugacauucauucccagggug

SEQ ID NO: 3363323 - RNA, 14 nt, Colorado tick fever virus
gugaccggugcagg

SEQ ID NO: 3363324 - RNA, 15 nt, Colorado tick fever virus
gugacgggcagggua

SEQ ID NO: 3363325 - RNA, 21 nt, Colorado tick fever virus
gugacgggcaggguagucgcu

SEQ ID NO: 3363326 - RNA, 14 nt, Colorado tick fever virus
gugcauucuugaug

SEQ ID NO: 3363327 - RNA, 20 nt, Colorado tick fever virus
guggaugaguggggcugcgc

SEQ ID NO: 3363328 - RNA, 18 nt, Colorado tick fever virus
gugucuuaugugccagag

SEQ ID NO: 3363329 - RNA, 16 nt, Colorado tick fever virus
guguucggaugcaugc

SEQ ID NO: 3363330 - RNA, 23 nt, Colorado tick fever virus
guguuggccuggugagcuguacc

SEQ ID NO: 3363331 - RNA, 17 nt, Colorado tick fever virus
guuggccuggugagcug

SEQ ID NO: 3363332 - RNA, 16 nt, Colorado tick fever virus
uaagacugcuugcuua

SEQ ID NO: 3363333 - RNA, 14 nt, Colorado tick fever virus
uaaucugacgcagg

SEQ ID NO: 3363334 - RNA, 14 nt, Colorado tick fever virus
uagaaguaugauug

SEQ ID NO: 3363335 - RNA, 15 nt, Colorado tick fever virus
uauccacaugaugug

SEQ ID NO: 3363336 - RNA, 17 nt, Colorado tick fever virus
ucaaagacggcugcugg

SEQ ID NO: 3363337 - RNA, 21 nt, Colorado tick fever virus
ucaaagacggcugcuggcugu

SEQ ID NO: 3363338 - RNA, 17 nt, Colorado tick fever virus
ucaauugucgguguaau

SEQ ID NO: 3363339 - RNA, 22 nt, Colorado tick fever virus
ucauucccagggugcauucuug

SEQ ID NO: 3363340 - RNA, 15 nt, Colorado tick fever virus
uccaucgcuuugcag

SEQ ID NO: 3363341 - RNA, 22 nt, Colorado tick fever virus
ucccgggacggguaauugcagu

SEQ ID NO: 3363342 - RNA, 23 nt, Colorado tick fever virus
ucccgggacggguaauugcaguc

SEQ ID NO: 3363343 - RNA, 18 nt, Colorado tick fever virus
uccgccuuuggugaagga

SEQ ID NO: 3363344 - RNA, 11 nt, Colorado tick fever virus
uccuugcaguc

SEQ ID NO: 3363345 - RNA, 19 nt, Colorado tick fever virus
ucuaagacugcuugcuuaa

SEQ ID NO: 3363346 - RNA, 20 nt, Colorado tick fever virus
ugaacggggcuaaggccugg

SEQ ID NO: 3363347 - RNA, 23 nt, Colorado tick fever virus
ugacacacccucauauagggaau

SEQ ID NO: 3363348 - RNA, 16 nt, Colorado tick fever virus
ugacauucauucccag

SEQ ID NO: 3363349 - RNA, 17 nt, Colorado tick fever virus
ugacauucauucccagg

SEQ ID NO: 3363350 - RNA, 13 nt, Colorado tick fever virus
ugagaguugcagu

SEQ ID NO: 3363351 - RNA, 21 nt, Colorado tick fever virus
ugcauucuugaugugaagaca

SEQ ID NO: 3363352 - RNA, 20 nt, Colorado tick fever virus
ugcugaucucccuugcaguc

SEQ ID NO: 3363353 - RNA, 16 nt, Colorado tick fever virus
uggauacaaaugcagu

SEQ ID NO: 3363354 - RNA, 16 nt, Colorado tick fever virus
uggugaccggugcagg

SEQ ID NO: 3363355 - RNA, 15 nt, Colorado tick fever virus
uguguaucauuuuga

SEQ ID NO: 3363356 - RNA, 22 nt, Colorado tick fever virus
uguguaucauuuugauccuacc

SEQ ID NO: 3363357 - RNA, 20 nt, Colorado tick fever virus
uguguucggaugcaugcagu

SEQ ID NO: 3363358 - RNA, 18 nt, Colorado tick fever virus
uuaaaggugugaaaauca

SEQ ID NO: 3363359 - RNA, 20 nt, Colorado tick fever virus
uucauucccagggugcauuc

SEQ ID NO: 3363360 - RNA, 17 nt, Colorado tick fever virus
uucccagggugcauucu

SEQ ID NO: 3363361 - RNA, 14 nt, Colorado tick fever virus
uucggaugcaugca

SEQ ID NO: 3363362 - RNA, 16 nt, Colorado tick fever virus
uucuugaugugaagac

SEQ ID NO: 3363363 - RNA, 21 nt, Colorado tick fever virus
uugaugugaagacaaugcagu

SEQ ID NO: 3363364 - RNA, 22 nt, Colorado tick fever virus
ucuugaugugaagacaaugcag

SEQ ID NO: 3363365 - RNA, 23 nt, Colorado tick fever virus
ucuugaugugaagacaaugcagu

SEQ ID NO: 3363366 - RNA, 22 nt, Colorado tick fever virus
ugaccggugcaggaugcugauc

SEQ ID NO: 3363367 - RNA, 23 nt, Colorado tick fever virus
ugacgggcaggguagucgcugag

SEQ ID NO: 3363368 - RNA, 13 nt, Colorado tick fever virus
ugaggaccucgcc

SEQ ID NO: 3363369 - RNA, 14 nt, Colorado tick fever virus
ugaguggggcugcg

SEQ ID NO: 3363370 - RNA, 16 nt, Colorado tick fever virus
ugaguugaaggucggg

SEQ ID NO: 3363371 - RNA, 14 nt, Colorado tick fever virus
ugaucucccuugca

SEQ ID NO: 3363372 - RNA, 16 nt, Colorado tick fever virus
ugaucucccuugcagu

SEQ ID NO: 3363373 - RNA, 16 nt, Colorado tick fever virus
ugaugacguccuagca

SEQ ID NO: 3363374 - RNA, 12 nt, Colorado tick fever virus
ugaugugaagac

SEQ ID NO: 3363375 - RNA, 23 nt, Colorado tick fever virus
ugcaaguggucgaccacgaguga

SEQ ID NO: 3363376 - RNA, 21 nt, Colorado tick fever virus
ugccagaggagguuguugcag

SEQ ID NO: 3363377 - RNA, 13 nt, Colorado tick fever virus
ugccgcaucuuca

SEQ ID NO: 3363378 - RNA, 15 nt, Colorado tick fever virus
ugcuuaaagguguga

SEQ ID NO: 3363379 - RNA, 22 nt, Colorado tick fever virus
uggaugaguggggcugcgcagu

SEQ ID NO: 3363380 - RNA, 22 nt, Colorado tick fever virus
ugggauuggugaccggugcagg

SEQ ID NO: 3363381 - RNA, 19 nt, Colorado tick fever virus
uggugaccggugcaggaug

SEQ ID NO: 3363382 - RNA, 19 nt, Colorado tick fever virus
uuaaaggugugaaaaucaa

SEQ ID NO: 3363383 - RNA, 16 nt, Colorado tick fever virus
uucggaugcaugcagu

SEQ ID NO: 3363384 - RNA, 17 nt, Colorado tick fever virus
uugcuuaaaggugugaa

SEQ ID NO: 3363385 - RNA, 18 nt, Colorado tick fever virus
uugcuuaaaggugugaaa

SEQ ID NO: 3363386 - RNA, 12 nt, Colorado tick fever virus
aaggagcuucag

SEQ ID NO: 3363387 - RNA, 23 nt, Colorado tick fever virus
acacgauugagcacaaaauccau

SEQ ID NO: 3363388 - RNA, 12 nt, Colorado tick fever virus
acauucauuccc

SEQ ID NO: 3363389 - RNA, 20 nt, Colorado tick fever virus
accggugcaggaugcugauc

SEQ ID NO: 3363390 - RNA, 18 nt, Colorado tick fever virus
acgcagggguucagucug

SEQ ID NO: 3363391 - RNA, 16 nt, Colorado tick fever virus
acggggaauuugcagu

SEQ ID NO: 3363392 - RNA, 15 nt, Colorado tick fever virus
agaacgguugcaguc

SEQ ID NO: 3363393 - RNA, 18 nt, Colorado tick fever virus
agcaucauucucccggga

SEQ ID NO: 3363394 - RNA, 20 nt, Colorado tick fever virus
agcgagugcgggagcuugag

SEQ ID NO: 3363395 - RNA, 16 nt, Colorado tick fever virus
aggagguuguugcagg

SEQ ID NO: 3363396 - RNA, 15 nt, Colorado tick fever virus
agggaauccuugcag

SEQ ID NO: 3363397 - RNA, 18 nt, Colorado tick fever virus
agggugagguacuggcag

SEQ ID NO: 3363398 - RNA, 24 nt, Colorado tick fever virus
auaguauccacaugaugugacaca

SEQ ID NO: 3363399 - RNA, 16 nt, Colorado tick fever virus
aucagguggaggcugc

SEQ ID NO: 3363400 - RNA, 14 nt, Colorado tick fever virus
aucucccuugcagu

SEQ ID NO: 3363401 - RNA, 14 nt, Colorado tick fever virus
augacguccuagca

SEQ ID NO: 3363402 - RNA, 19 nt, Colorado tick fever virus
augcgugacgggcagggua

SEQ ID NO: 3363403 - RNA, 14 nt, Colorado tick fever virus
augggcuggagaac

SEQ ID NO: 3363404 - RNA, 13 nt, Colorado tick fever virus
augugaagacaau

SEQ ID NO: 3363405 - RNA, 14 nt, Colorado tick fever virus
auucauucccaggg

SEQ ID NO: 3363406 - RNA, 18 nt, Colorado tick fever virus
auucauucccagggugca

SEQ ID NO: 3363407 - RNA, 17 nt, Colorado tick fever virus
auucccagggugcauuc

SEQ ID NO: 3363408 - RNA, 15 nt, Colorado tick fever virus
auucuugaugugaag

SEQ ID NO: 3363409 - RNA, 22 nt, Colorado tick fever virus
auuggugaccggugcaggaugc

SEQ ID NO: 3363410 - RNA, 19 nt, Colorado tick fever virus
auuuucuaagacugcuugc

SEQ ID NO: 3363411 - RNA, 15 nt, Colorado tick fever virus
cacgagugacugaug

SEQ ID NO: 3363412 - RNA, 15 nt, Colorado tick fever virus
cacggggaauuugca

SEQ ID NO: 3363413 - RNA, 20 nt, Colorado tick fever virus
cagcagaggcgcgugagcag

SEQ ID NO: 3363414 - RNA, 12 nt, Colorado tick fever virus
cagggguucagu

SEQ ID NO: 3363415 - RNA, 15 nt, Colorado tick fever virus
caggguagucgcuga

SEQ ID NO: 3363416 - RNA, 15 nt, Colorado tick fever virus
cagggugcauucuug

SEQ ID NO: 3363417 - RNA, 14 nt, Colorado tick fever virus
cagguggaggcugc

SEQ ID NO: 3363418 - RNA, 22 nt, Colorado tick fever virus
caguauuacguugacacagucu

SEQ ID NO: 3363419 - RNA, 18 nt, Colorado tick fever virus
cauucccagggugcauuc

SEQ ID NO: 3363420 - RNA, 17 nt, Colorado tick fever virus
ccacaugaugugacaca

SEQ ID NO: 3363421 - RNA, 13 nt, Colorado tick fever virus
ccacgccauacac

SEQ ID NO: 3363422 - RNA, 18 nt, Colorado tick fever virus
auagggaauccuugcagu

SEQ ID NO: 3363423 - RNA, 13 nt, Colorado tick fever virus
aucgcuuugcagu

SEQ ID NO: 3363424 - RNA, 20 nt, Colorado tick fever virus
aucggugggagugcucaagu

SEQ ID NO: 3363425 - RNA, 18 nt, Colorado tick fever virus
aucugacgcagggguuca

SEQ ID NO: 3363426 - RNA, 13 nt, Colorado tick fever virus
augacguccuagc

SEQ ID NO: 3363427 - RNA, 17 nt, Colorado tick fever virus
augaugacguccuagca

SEQ ID NO: 3363428 - RNA, 20 nt, Colorado tick fever virus
augaugacguccuagcauca

SEQ ID NO: 3363429 - RNA, 13 nt, Colorado tick fever virus
gugccagaggagg

SEQ ID NO: 3363430 - RNA, 13 nt, Colorado tick fever virus
gugggagugcuca

SEQ ID NO: 3363431 - RNA, 16 nt, Colorado tick fever virus
uagaacgguugcaguc

SEQ ID NO: 3363432 - RNA, 18 nt, Colorado tick fever virus
ucaauuuguuaacaauga

SEQ ID NO: 3363433 - RNA, 15 nt, Colorado tick fever virus
ucagcagcagaggcg

SEQ ID NO: 3363434 - RNA, 15 nt, Colorado tick fever virus
ucagguggaggcugc

SEQ ID NO: 3363435 - RNA, 18 nt, Colorado tick fever virus
ucagguggaggcugcuca

SEQ ID NO: 3363436 - RNA, 15 nt, Colorado tick fever virus
ucauucccagggugc

SEQ ID NO: 3363437 - RNA, 13 nt, Colorado tick fever virus
ucauucucccggg

SEQ ID NO: 3363438 - RNA, 18 nt, Colorado tick fever virus
ucauucucccgggacggg

SEQ ID NO: 3363439 - RNA, 13 nt, Colorado tick fever virus
uccauuggcgcaa

SEQ ID NO: 3363440 - RNA, 14 nt, Colorado tick fever virus
uccgcgaguugcag

SEQ ID NO: 3363441 - RNA, 14 nt, Colorado tick fever virus
ucuaagacugcuug

SEQ ID NO: 3363442 - RNA, 16 nt, Colorado tick fever virus
ucuccgcgaguugcag

SEQ ID NO: 3363443 - RNA, 23 nt, Colorado tick fever virus
ucucgcgcacggggaauuugcag

SEQ ID NO: 3363444 - RNA, 18 nt, Colorado tick fever virus
ucuuaugugccagaggag

SEQ ID NO: 3363445 - RNA, 21 nt, Colorado tick fever virus
aagcgagugcgggagcuugag

SEQ ID NO: 3363446 - RNA, 15 nt, Colorado tick fever virus
aaguaugauugaguc

SEQ ID NO: 3363447 - RNA, 20 nt, Colorado tick fever virus
aaugaugacguccuagcauc

SEQ ID NO: 3363448 - RNA, 14 nt, Colorado tick fever virus
acacaauugcaguc

SEQ ID NO: 3363449 - RNA, 10 nt, Colorado tick fever virus
accggugcag

SEQ ID NO: 3363450 - RNA, 11 nt, Colorado tick fever virus
accggugcagg

SEQ ID NO: 3363451 - RNA, 15 nt, Colorado tick fever virus
accggugcaggaugc

SEQ ID NO: 3363452 - RNA, 11 nt, Colorado tick fever virus
acgggcagggu

SEQ ID NO: 3363453 - RNA, 16 nt, Colorado tick fever virus
acggguaauugcaguc

SEQ ID NO: 3363454 - RNA, 15 nt, Colorado tick fever virus
acugagagcgggguu

SEQ ID NO: 3363455 - RNA, 18 nt, Colorado tick fever virus
acugcuugcuuaaaggug

SEQ ID NO: 3363456 - RNA, 14 nt, Colorado tick fever virus
agaacgguugcagu

SEQ ID NO: 3363457 - RNA, 13 nt, Colorado tick fever virus
agaggcgcgugag

SEQ ID NO: 3363458 - RNA, 21 nt, Colorado tick fever virus
agcggcugcggcuuaccaggc

SEQ ID NO: 3363459 - RNA, 20 nt, Colorado tick fever virus
agcgggguuguuuaucaggu

SEQ ID NO: 3363460 - RNA, 14 nt, Colorado tick fever virus
aggcgcgugagcag

SEQ ID NO: 3363461 - RNA, 22 nt, Colorado tick fever virus
aggcuuuaagcgagugcgggag

SEQ ID NO: 3363462 - RNA, 17 nt, Colorado tick fever virus
aggcuuucgugaaggag

SEQ ID NO: 3363463 - RNA, 17 nt, Colorado tick fever virus
agggaauccuugcaguc

SEQ ID NO: 3363464 - RNA, 23 nt, Colorado tick fever virus
agggugcauucuugaugugaaga

SEQ ID NO: 3363465 - RNA, 19 nt, Colorado tick fever virus
agucuguguucggaugcau

SEQ ID NO: 3363466 - RNA, 14 nt, Colorado tick fever virus
augagaguugcagu

SEQ ID NO: 3363467 - RNA, 19 nt, Colorado tick fever virus
augcugaucucccuugcag

SEQ ID NO: 3363468 - RNA, 18 nt, Colorado tick fever virus
auucagcagcagaggcgc

SEQ ID NO: 3363469 - RNA, 17 nt, Colorado tick fever virus
auugagagcggagccuu

SEQ ID NO: 3363470 - RNA, 21 nt, Colorado tick fever virus
auuggugaccggugcaggaug

SEQ ID NO: 3363471 - RNA, 17 nt, Colorado tick fever virus
auuuguuaacaaugagu

SEQ ID NO: 3363472 - RNA, 23 nt, Colorado tick fever virus
auuuucuaagacugcuugcuuaa

SEQ ID NO: 3363473 - RNA, 18 nt, Colorado tick fever virus
caaagacggcugcuggcu

SEQ ID NO: 3363474 - RNA, 14 nt, Colorado tick fever virus
cacgauugagcaca

SEQ ID NO: 3363475 - RNA, 22 nt, Colorado tick fever virus
cacgauugagcacaaaauccau

SEQ ID NO: 3363476 - RNA, 19 nt, Colorado tick fever virus
caggaugcugaucucccuu

SEQ ID NO: 3363477 - RNA, 19 nt, Colorado tick fever virus
caggcgggcuuuuugcgug

SEQ ID NO: 3363478 - RNA, 14 nt, Colorado tick fever virus
cagggugcauucuu

SEQ ID NO: 3363479 - RNA, 15 nt, Colorado tick fever virus
cauacacaauugcag

SEQ ID NO: 3363480 - RNA, 17 nt, Colorado tick fever virus
cauacacaauugcaguc

SEQ ID NO: 3363481 - RNA, 16 nt, Colorado tick fever virus
caucauucucccggga

SEQ ID NO: 3363482 - RNA, 23 nt, Colorado tick fever virus
ccaaacuccaaagguugcugccu

SEQ ID NO: 3363483 - RNA, 21 nt, Colorado tick fever virus
ccaauggugucuaugguuaua

SEQ ID NO: 3363484 - RNA, 18 nt, Colorado tick fever virus
ccagacguaugaggcucu

SEQ ID NO: 3363485 - RNA, 14 nt, Colorado tick fever virus
ccagaggagguugu

SEQ ID NO: 3363486 - RNA, 13 nt, Colorado tick fever virus
ccagggugcauuc

SEQ ID NO: 3363487 - RNA, 17 nt, Colorado tick fever virus
cccgggacggguaauug

SEQ ID NO: 3363488 - RNA, 16 nt, Colorado tick fever virus
ccggcuuacggaauga

SEQ ID NO: 3363489 - RNA, 20 nt, Colorado tick fever virus
ccggugcaggaugcugaucu

SEQ ID NO: 3363490 - RNA, 21 nt, Colorado tick fever virus
ccucgccggcuuacggaauga

SEQ ID NO: 3363491 - RNA, 18 nt, Colorado tick fever virus
ccuggauacaaaugcagu

SEQ ID NO: 3363492 - RNA, 12 nt, Colorado tick fever virus
cgaguugcaguc

SEQ ID NO: 3363493 - RNA, 14 nt, Colorado tick fever virus
cgcagggguucagu

SEQ ID NO: 3363494 - RNA, 18 nt, Colorado tick fever virus
cgcagggguucagucugu

SEQ ID NO: 3363495 - RNA, 21 nt, Colorado tick fever virus
cgcagugugugacgagugggu

SEQ ID NO: 3363496 - RNA, 22 nt, Colorado tick fever virus
ccacgccauacacaauugcagu

SEQ ID NO: 3363497 - RNA, 24 nt, Colorado tick fever virus
cccucauauagggaauccuugcag

SEQ ID NO: 3363498 - RNA, 12 nt, Colorado tick fever virus
cgcaucuucaau

SEQ ID NO: 3363499 - RNA, 19 nt, Colorado tick fever virus
cgccauacacaauugcagu

SEQ ID NO: 3363500 - RNA, 18 nt, Colorado tick fever virus
cgccggcuuacggaauga

SEQ ID NO: 3363501 - RNA, 13 nt, Colorado tick fever virus
cgcugaggaccuc

SEQ ID NO: 3363502 - RNA, 12 nt, Colorado tick fever virus
cggaugcaugca

SEQ ID NO: 3363503 - RNA, 16 nt, Colorado tick fever virus
cggcugcuggcugucc

SEQ ID NO: 3363504 - RNA, 23 nt, Colorado tick fever virus
cgggcaggguagucgcugaggac

SEQ ID NO: 3363505 - RNA, 15 nt, Colorado tick fever virus
aaaggugugaaaauc

SEQ ID NO: 3363506 - RNA, 19 nt, Colorado tick fever virus
aaaggugugaaaaucaauu

SEQ ID NO: 3363507 - RNA, 19 nt, Colorado tick fever virus
aaggugugaaaaucaauug

SEQ ID NO: 3363508 - RNA, 18 nt, Colorado tick fever virus
aaguaugauugagucuau

SEQ ID NO: 3363509 - RNA, 12 nt, Colorado tick fever virus
aauggugucuau

SEQ ID NO: 3363510 - RNA, 17 nt, Colorado tick fever virus
aauuuguuaacaaugag

SEQ ID NO: 3363511 - RNA, 12 nt, Colorado tick fever virus
acaauugcaguc

SEQ ID NO: 3363512 - RNA, 15 nt, Colorado tick fever virus
acacagucugucaaa

SEQ ID NO: 3363513 - RNA, 18 nt, Colorado tick fever virus
acaucgagagugcaggcu

SEQ ID NO: 3363514 - RNA, 16 nt, Colorado tick fever virus
acauucauucccaggg

SEQ ID NO: 3363515 - RNA, 13 nt, Colorado tick fever virus
accaggcgggcuu

SEQ ID NO: 3363516 - RNA, 19 nt, Colorado tick fever virus
acgcagggguucagucugu

SEQ ID NO: 3363517 - RNA, 21 nt, Colorado tick fever virus
acgccauacacaauugcaguc

SEQ ID NO: 3363518 - RNA, 13 nt, Colorado tick fever virus
acggguaauugca

SEQ ID NO: 3363519 - RNA, 15 nt, Colorado tick fever virus
acggguaauugcagu

SEQ ID NO: 3363520 - RNA, 12 nt, Colorado tick fever virus
aagacugcuugc

SEQ ID NO: 3363521 - RNA, 18 nt, Colorado tick fever virus
aaugaugacguccuagca

SEQ ID NO: 3363522 - RNA, 16 nt, Colorado tick fever virus
accggugcaggaugcu

SEQ ID NO: 3363523 - RNA, 13 nt, Colorado tick fever virus
acggaaugaugac

SEQ ID NO: 3363524 - RNA, 17 nt, Colorado tick fever virus
acggggaauuugcaguc

SEQ ID NO: 3363525 - RNA, 14 nt, Colorado tick fever virus
acugcuugcuuaaa

SEQ ID NO: 3363526 - RNA, 13 nt, Colorado tick fever virus
agacggcugcugg

SEQ ID NO: 3363527 - RNA, 19 nt, Colorado tick fever virus
agacugcuugcuuaaaggu

SEQ ID NO: 3363528 - RNA, 24 nt, Colorado tick fever virus
agagcgggguuguuuaucaggugg

SEQ ID NO: 3363529 - RNA, 20 nt, Colorado tick fever virus
agcagaggcgcgugagcagg

SEQ ID NO: 3363530 - RNA, 16 nt, Colorado tick fever virus
agcucuccaucgcuuu

SEQ ID NO: 3363531 - RNA, 18 nt, Colorado tick fever virus
aggcgggcuuuuugcgug

SEQ ID NO: 3363532 - RNA, 22 nt, Colorado tick fever virus
agggugcauucuugaugugaag

SEQ ID NO: 3363533 - RNA, 16 nt, Colorado tick fever virus
agguggaggcugcuca

SEQ ID NO: 3363534 - RNA, 17 nt, Colorado tick fever virus
agguggaggcugcucag

SEQ ID NO: 3363535 - RNA, 17 nt, Colorado tick fever virus
aggugugaaaaucaauu

SEQ ID NO: 3363536 - RNA, 11 nt, Colorado tick fever virus
agugaggaggg

SEQ ID NO: 3363537 - RNA, 20 nt, Colorado tick fever virus
agugcaggcuuucgugaagg

SEQ ID NO: 3363538 - RNA, 22 nt, Colorado tick fever virus
aguuaggcggugcuuuuacgau

SEQ ID NO: 3363539 - RNA, 12 nt, Colorado tick fever virus
cggaaugaugac

SEQ ID NO: 3363540 - RNA, 19 nt, Colorado tick fever virus
cgggacggguaauugcagu

SEQ ID NO: 3363541 - RNA, 20 nt, Colorado tick fever virus
cgggacggguaauugcaguc

SEQ ID NO: 3363542 - RNA, 15 nt, Colorado tick fever virus
cggggaauuugcagu

SEQ ID NO: 3363543 - RNA, 18 nt, Colorado tick fever virus
cgguguaaucugacgcag

SEQ ID NO: 3363544 - RNA, 20 nt, Colorado tick fever virus
cuagcaucauucucccggga

SEQ ID NO: 3363545 - RNA, 14 nt, Colorado tick fever virus
ugaugaaaauggcg

SEQ ID NO: 3363546 - RNA, 11 nt, Colorado tick fever virus
ugaugugaaga

SEQ ID NO: 3363547 - RNA, 19 nt, Colorado tick fever virus
ugaugugaagacaaugcag

SEQ ID NO: 3363548 - RNA, 23 nt, Colorado tick fever virus
ugcaggaugcugaucucccuugc

SEQ ID NO: 3363549 - RNA, 15 nt, Colorado tick fever virus
ugcucguaauccuca

SEQ ID NO: 3363550 - RNA, 14 nt, Colorado tick fever virus
ugcugccugaauug

SEQ ID NO: 3363551 - RNA, 17 nt, Colorado tick fever virus
uggaugaguggggcugc

SEQ ID NO: 3363552 - RNA, 20 nt, Colorado tick fever virus
uggauucggaaaaacauauu

SEQ ID NO: 3363553 - RNA, 15 nt, Colorado tick fever virus
ugggcuggagaacca

SEQ ID NO: 3363554 - RNA, 17 nt, Colorado tick fever virus
uggggcugcgcagugug

SEQ ID NO: 3363555 - RNA, 17 nt, Colorado tick fever virus
uggugaaggaugcaagu

SEQ ID NO: 3363556 - RNA, 21 nt, Colorado tick fever virus
ugucgguguaaucugacgcag

SEQ ID NO: 3363557 - RNA, 18 nt, Colorado tick fever virus
ugugaaaaucaauugucg

SEQ ID NO: 3363558 - RNA, 15 nt, Colorado tick fever virus
uucuaagacugcuug

SEQ ID NO: 3363559 - RNA, 14 nt, Colorado tick fever virus
uugaugugaagaca

SEQ ID NO: 3363560 - RNA, 22 nt, Colorado tick fever virus
uugaugugaagacaaugcaguc

SEQ ID NO: 3363561 - RNA, 23 nt, Colorado tick fever virus
uugcuuaaaggugugaaaaucaa

SEQ ID NO: 3363562 - RNA, 17 nt, Dobrava virus
aaauaacuccuucauua

SEQ ID NO: 3363563 - RNA, 15 nt, Dobrava virus
acaacuacuaccuca

SEQ ID NO: 3363564 - RNA, 13 nt, Dobrava virus
acuacuaccucau

SEQ ID NO: 3363565 - RNA, 23 nt, Dobrava virus
auauauggauguagauuucauuu

SEQ ID NO: 3363566 - RNA, 17 nt, Dobrava virus
auauuuauuuucauuuu

SEQ ID NO: 3363567 - RNA, 19 nt, Dobrava virus
auuuucauuuuccggagca

SEQ ID NO: 3363568 - RNA, 14 nt, Dobrava virus
cauugauuugcuuc

SEQ ID NO: 3363569 - RNA, 12 nt, Dobrava virus
cauuuuccggag

SEQ ID NO: 3363570 - RNA, 14 nt, Dobrava virus
cuaccucaacaacu

SEQ ID NO: 3363571 - RNA, 12 nt, Dobrava virus
cuacuaccucau

SEQ ID NO: 3363572 - RNA, 18 nt, Dobrava virus
cuacugauuggugaaugu

SEQ ID NO: 3363573 - RNA, 22 nt, Dobrava virus
cuuaagugacuuuuuucuguau

SEQ ID NO: 3363574 - RNA, 23 nt, Dobrava virus
guuuauauuuauuuucauuuucc

SEQ ID NO: 3363575 - RNA, 22 nt, Dobrava virus
uacuacugauuggugaauguau

SEQ ID NO: 3363576 - RNA, 21 nt, Dobrava virus
ucauuugaucuguacuaacau

SEQ ID NO: 3363577 - RNA, 18 nt, Dobrava virus
uuucauuugaucuguacu

SEQ ID NO: 3363578 - RNA, 17 nt, Dobrava virus
uuuguugcauuauccca

SEQ ID NO: 3363579 - RNA, 21 nt, Dobrava virus
uuucuguauauauggauguag

SEQ ID NO: 3363580 - RNA, 16 nt, Dobrava virus
uuuucauuuuccggag

SEQ ID NO: 3363581 - RNA, 19 nt, Dobrava virus
cauuaucccaugcuuuaug

SEQ ID NO: 3363582 - RNA, 19 nt, Dobrava virus
cauuugaucuguacuaaca

SEQ ID NO: 3363583 - RNA, 13 nt, Dobrava virus
cuaccuaccucaa

SEQ ID NO: 3363584 - RNA, 22 nt, Dobrava virus
cuaccucaacaacuacuaccuc

SEQ ID NO: 3363585 - RNA, 17 nt, Dobrava virus
cugauuggugaauguau

SEQ ID NO: 3363586 - RNA, 20 nt, Dobrava virus
cuggaauuauuauacuacug

SEQ ID NO: 3363587 - RNA, 18 nt, Dobrava virus
cuuauuuccuucuuuucc

SEQ ID NO: 3363588 - RNA, 15 nt, Dobrava virus
cuuucuuuacuaaca

SEQ ID NO: 3363589 - RNA, 21 nt, Dobrava virus
cuuucuuuacuaacaacaacu

SEQ ID NO: 3363590 - RNA, 16 nt, Dobrava virus
gaauguauuugcacua

SEQ ID NO: 3363591 - RNA, 20 nt, Dobrava virus
guuaucuaaaaaaaauaacu

SEQ ID NO: 3363592 - RNA, 21 nt, Dobrava virus
uacugauuggugaauguauuu

SEQ ID NO: 3363593 - RNA, 12 nt, Dobrava virus
uccggagcauac

SEQ ID NO: 3363594 - RNA, 20 nt, Dobrava virus
ucuugcggagcauacuacua

SEQ ID NO: 3363595 - RNA, 20 nt, Dobrava virus
ucuuuagggagucuacuacu

SEQ ID NO: 3363596 - RNA, 21 nt, Dobrava virus
ucuuuagggagucuacuacua

SEQ ID NO: 3363597 - RNA, 20 nt, Dobrava virus
aacuacuaccucauugauuu

SEQ ID NO: 3363598 - RNA, 12 nt, Dobrava virus
acuauaaaccuu

SEQ ID NO: 3363599 - RNA, 23 nt, Dobrava virus
agcuuguccuuguauauagcuuu

SEQ ID NO: 3363600 - RNA, 20 nt, Dobrava virus
auaucaguuuaaacuucugu

SEQ ID NO: 3363601 - RNA, 21 nt, Dobrava virus
aucuaaaaaaaauaacuccuu

SEQ ID NO: 3363602 - RNA, 18 nt, Dobrava virus
auuaacuuuuuacauuua

SEQ ID NO: 3363603 - RNA, 16 nt, Dobrava virus
caguuuaaacuucugu

SEQ ID NO: 3363604 - RNA, 17 nt, Dobrava virus
cauugauuugcuuccug

SEQ ID NO: 3363605 - RNA, 18 nt, Dobrava virus
cauuuaucaaccuaguua

SEQ ID NO: 3363606 - RNA, 11 nt, Dobrava virus
cggagcauacu

SEQ ID NO: 3363607 - RNA, 13 nt, Dobrava virus
cuaacaucuuauu

SEQ ID NO: 3363608 - RNA, 17 nt, Dobrava virus
cuaacaucuuauuuccu

SEQ ID NO: 3363609 - RNA, 12 nt, Dobrava virus
accuaccucaaa

SEQ ID NO: 3363610 - RNA, 11 nt, Dobrava virus
acuaccucaac

SEQ ID NO: 3363611 - RNA, 13 nt, Dobrava virus
acuaccucaacaa

SEQ ID NO: 3363612 - RNA, 15 nt, Dobrava virus
auauaucaguuuaaa

SEQ ID NO: 3363613 - RNA, 18 nt, Dobrava virus
aucccaugcuuuauguaa

SEQ ID NO: 3363614 - RNA, 21 nt, Dobrava virus
aucuguacuaacaucuuauuu

SEQ ID NO: 3363615 - RNA, 14 nt, Dobrava virus
caacuaccuaccuc

SEQ ID NO: 3363616 - RNA, 15 nt, Dobrava virus
caucuuauuuccuuc

SEQ ID NO: 3363617 - RNA, 18 nt, Dobrava virus
cuuaagugacuuuuuucu

SEQ ID NO: 3363618 - RNA, 18 nt, Dobrava virus
gaauuauuauacuacuga

SEQ ID NO: 3363619 - RNA, 22 nt, Dobrava virus
ggaauuauuauacuacugauug

SEQ ID NO: 3363620 - RNA, 18 nt, Dobrava virus
guuuauauuuauuuucau

SEQ ID NO: 3363621 - RNA, 21 nt, Dobrava virus
uagcuuucaacaaugcaauuu

SEQ ID NO: 3363622 - RNA, 23 nt, Dobrava virus
ucauugauuugcuuccugaaugu

SEQ ID NO: 3363623 - RNA, 19 nt, Dobrava virus
uuaaacuucuguacuuauu

SEQ ID NO: 3363624 - RNA, 23 nt, Dobrava virus
uuuacauuuaucaaccuaguuau

SEQ ID NO: 3363625 - RNA, 16 nt, Dobrava virus
aacaucuuauuuccuu

SEQ ID NO: 3363626 - RNA, 16 nt, Dobrava virus
acaacuaccuaccuca

SEQ ID NO: 3363627 - RNA, 19 nt, Dobrava virus
acaacuaccuaccucaaaa

SEQ ID NO: 3363628 - RNA, 14 nt, Dobrava virus
acuaccuaccucaa

SEQ ID NO: 3363629 - RNA, 16 nt, Dobrava virus
auauuuauuuucauuu

SEQ ID NO: 3363630 - RNA, 17 nt, Dobrava virus
auuacuauaaaccuuag

SEQ ID NO: 3363631 - RNA, 14 nt, Dobrava virus
auuuucauuuuccg

SEQ ID NO: 3363632 - RNA, 22 nt, Dobrava virus
cugauuggugaauguauuugca

SEQ ID NO: 3363633 - RNA, 12 nt, Dobrava virus
cuuucaacaaug

SEQ ID NO: 3363634 - RNA, 22 nt, Dobrava virus
gcugcauuaacugcuuggacug

SEQ ID NO: 3363635 - RNA, 14 nt, Dobrava virus
guacuuauuaacuu

SEQ ID NO: 3363636 - RNA, 14 nt, Dobrava virus
guauauagcuuuca

SEQ ID NO: 3363637 - RNA, 16 nt, Dobrava virus
uauagcuuucaacaau

SEQ ID NO: 3363638 - RNA, 23 nt, Dobrava virus
uauagcuuucaacaaugcaauuu

SEQ ID NO: 3363639 - RNA, 15 nt, Dobrava virus
uauuucuauaucuug

SEQ ID NO: 3363640 - RNA, 22 nt, Dobrava virus
ucauuuuccggagcauacuacu

SEQ ID NO: 3363641 - RNA, 16 nt, Dobrava virus
ugacuuuuuucuguau

SEQ ID NO: 3363642 - RNA, 21 nt, Dobrava virus
ugauuugcuuccugaaugucu

SEQ ID NO: 3363643 - RNA, 21 nt, Dobrava virus
uucauuuuccggagcauacua

SEQ ID NO: 3363644 - RNA, 14 nt, Dobrava virus
uuuauguaauccca

SEQ ID NO: 3363645 - RNA, 19 nt, Dobrava virus
uuuccggagcauacuacua

SEQ ID NO: 3363646 - RNA, 15 nt, Dobrava virus
uuuccuuucuuuacu

SEQ ID NO: 3363647 - RNA, 12 nt, Eastern equine encephalitis virus
ccuuucacccag

SEQ ID NO: 3363648 - RNA, 13 nt, Eastern equine encephalitis virus
cgaaggauccagg

SEQ ID NO: 3363649 - RNA, 13 nt, Eastern equine encephalitis virus
cgaccuugcugac

SEQ ID NO: 3363650 - RNA, 21 nt, Eastern equine encephalitis virus
cgagccuaugaucagcugcuc

SEQ ID NO: 3363651 - RNA, 13 nt, Eastern equine encephalitis virus
cgauaacaaggug

SEQ ID NO: 3363652 - RNA, 18 nt, Eastern equine encephalitis virus
cgcauccagacaucagcu

SEQ ID NO: 3363653 - RNA, 22 nt, Eastern equine encephalitis virus
cgccaagccuaagccugcgcag

SEQ ID NO: 3363654 - RNA, 23 nt, Eastern equine encephalitis virus
cgccacgugguugaacauggaag

SEQ ID NO: 3363655 - RNA, 22 nt, Eastern equine encephalitis virus
cgccuccuauaaacacuacagg

SEQ ID NO: 3363656 - RNA, 13 nt, Eastern equine encephalitis virus
cggaagagugcuc

SEQ ID NO: 3363657 - RNA, 23 nt, Eastern equine encephalitis virus
cggcucuaucaguggugacaugg

SEQ ID NO: 3363658 - RNA, 16 nt, Eastern equine encephalitis virus
cgugcagaccaaggac

SEQ ID NO: 3363659 - RNA, 12 nt, Eastern equine encephalitis virus
cuaaacacuaaa

SEQ ID NO: 3363660 - RNA, 12 nt, Eastern equine encephalitis virus
cuaacccuccag

SEQ ID NO: 3363661 - RNA, 16 nt, Eastern equine encephalitis virus
cuacaacgaccccagg

SEQ ID NO: 3363662 - RNA, 20 nt, Eastern equine encephalitis virus
cucaucauagguccacuguc

SEQ ID NO: 3363663 - RNA, 13 nt, Eastern equine encephalitis virus
cuccacugcaaac

SEQ ID NO: 3363664 - RNA, 18 nt, Eastern equine encephalitis virus
cuccaguacaccagugac

SEQ ID NO: 3363665 - RNA, 19 nt, Eastern equine encephalitis virus
cuccaguacaccagugaca

SEQ ID NO: 3363666 - RNA, 24 nt, Eastern equine encephalitis virus
cuccaguacaccagugacaagccu

SEQ ID NO: 3363667 - RNA, 19 nt, Eastern equine encephalitis virus
cucuccuuagcauccacag

SEQ ID NO: 3363668 - RNA, 22 nt, Eastern equine encephalitis virus
cucuccuuagcauccacagugc

SEQ ID NO: 3363669 - RNA, 16 nt, Eastern equine encephalitis virus
cucuggaagacugccu

SEQ ID NO: 3363670 - RNA, 16 nt, Eastern equine encephalitis virus
cugaagaaagaccaaa

SEQ ID NO: 3363671 - RNA, 15 nt, Eastern equine encephalitis virus
cugacuaucaguguc

SEQ ID NO: 3363672 - RNA, 23 nt, Eastern equine encephalitis virus
cugagauacgaucagcagugcca

SEQ ID NO: 3363673 - RNA, 17 nt, Eastern equine encephalitis virus
cugauugacaacaaaaa

SEQ ID NO: 3363674 - RNA, 22 nt, Eastern equine encephalitis virus
cugcauuaagccgacgagggca

SEQ ID NO: 3363675 - RNA, 23 nt, Eastern equine encephalitis virus
cugcuguuuagauacugccaccu

SEQ ID NO: 3363676 - RNA, 16 nt, Eastern equine encephalitis virus
cuggagaucugcagau

SEQ ID NO: 3363677 - RNA, 22 nt, Eastern equine encephalitis virus
cuggagcguuccguccaugaga

SEQ ID NO: 3363678 - RNA, 22 nt, Eastern equine encephalitis virus
cuggaguacaucaccugcaagu

SEQ ID NO: 3363679 - RNA, 13 nt, Eastern equine encephalitis virus
cuggcaccagagc

SEQ ID NO: 3363680 - RNA, 15 nt, Eastern equine encephalitis virus
cuguguggcuaucau

SEQ ID NO: 3363681 - RNA, 23 nt, Eastern equine encephalitis virus
cuguucaggcaauggugaacaua

SEQ ID NO: 3363682 - RNA, 14 nt, Eastern equine encephalitis virus
cuuaccaacaggca

SEQ ID NO: 3363683 - RNA, 17 nt, Eastern equine encephalitis virus
cuuaccugauugacaac

SEQ ID NO: 3363684 - RNA, 20 nt, Eastern equine encephalitis virus
cuuccacuggacgaugacca

SEQ ID NO: 3363685 - RNA, 13 nt, Eastern equine encephalitis virus
cuucuccacugca

SEQ ID NO: 3363686 - RNA, 11 nt, Eastern equine encephalitis virus
cuugccacugu

SEQ ID NO: 3363687 - RNA, 17 nt, Eastern equine encephalitis virus
cuuuccaaagaagcaca

SEQ ID NO: 3363688 - RNA, 19 nt, Eastern equine encephalitis virus
gaaaagggacaaaggggca

SEQ ID NO: 3363689 - RNA, 17 nt, Eastern equine encephalitis virus
gaaccaaaaagggguua

SEQ ID NO: 3363690 - RNA, 14 nt, Eastern equine encephalitis virus
gaacggacagguga

SEQ ID NO: 3363691 - RNA, 19 nt, Eastern equine encephalitis virus
gaaggcagaauagacaaug

SEQ ID NO: 3363692 - RNA, 18 nt, Eastern equine encephalitis virus
gaaggccagcauauauga

SEQ ID NO: 3363693 - RNA, 12 nt, Eastern equine encephalitis virus
gaaugguuacgc

SEQ ID NO: 3363694 - RNA, 16 nt, Eastern equine encephalitis virus
gacaagggcaccugca

SEQ ID NO: 3363695 - RNA, 14 nt, Eastern equine encephalitis virus
gacaugucugcaga

SEQ ID NO: 3363696 - RNA, 16 nt, Eastern equine encephalitis virus
gaccaccaccaccugc

SEQ ID NO: 3363697 - RNA, 19 nt, Eastern equine encephalitis virus
gacgaguguucaaaccgcu

SEQ ID NO: 3363698 - RNA, 23 nt, Eastern equine encephalitis virus
gacggcucuaucaguggugacau

SEQ ID NO: 3363699 - RNA, 23 nt, Eastern equine encephalitis virus
gacuauacaaccaccugcacgga

SEQ ID NO: 3363700 - RNA, 16 nt, Eastern equine encephalitis virus
gaguacaucaccugca

SEQ ID NO: 3363701 - RNA, 18 nt, Eastern equine encephalitis virus
gauacaccagagggguca

SEQ ID NO: 3363702 - RNA, 13 nt, Eastern equine encephalitis virus
gaucgacaaccug

SEQ ID NO: 3363703 - RNA, 14 nt, Eastern equine encephalitis virus
gaucgacaaccugc

SEQ ID NO: 3363704 - RNA, 19 nt, Eastern equine encephalitis virus
gaugugccacaaugcauga

SEQ ID NO: 3363705 - RNA, 23 nt, Eastern equine encephalitis virus
gcaagaagccugcgccaagccua

SEQ ID NO: 3363706 - RNA, 20 nt, Eastern equine encephalitis virus
gcacacaccuuucacccagg

SEQ ID NO: 3363707 - RNA, 19 nt, Eastern equine encephalitis virus
gcagaaaauugugcagugg

SEQ ID NO: 3363708 - RNA, 17 nt, Eastern equine encephalitis virus
gcagaaccgcaaccagu

SEQ ID NO: 3363709 - RNA, 21 nt, Eastern equine encephalitis virus
gcagaaccgcaaccaguugaa

SEQ ID NO: 3363710 - RNA, 22 nt, Eastern equine encephalitis virus
gcaggagucauccgcauccaga

SEQ ID NO: 3363711 - RNA, 21 nt, Eastern equine encephalitis virus
gcagugaugccgaacaaggug

SEQ ID NO: 3363712 - RNA, 18 nt, Eastern equine encephalitis virus
gcagugcauaaggcugcu

SEQ ID NO: 3363713 - RNA, 17 nt, Eastern equine encephalitis virus
gcaguguauaaggcugu

SEQ ID NO: 3363714 - RNA, 19 nt, Eastern equine encephalitis virus
gcauaaugcugucuuuuau

SEQ ID NO: 3363715 - RNA, 22 nt, Eastern equine encephalitis virus
gcaucgccacgcuggcaccaga

SEQ ID NO: 3363716 - RNA, 17 nt, Eastern equine encephalitis virus
gccaagccuaagccugc

SEQ ID NO: 3363717 - RNA, 21 nt, Eastern equine encephalitis virus
gccagcuauaacauaacggau

SEQ ID NO: 3363718 - RNA, 18 nt, Eastern equine encephalitis virus
gccgacgagggcagauga

SEQ ID NO: 3363719 - RNA, 23 nt, Eastern equine encephalitis virus
gccgcuccgugcagaaaauugug

SEQ ID NO: 3363720 - RNA, 16 nt, Eastern equine encephalitis virus
gccuaucuugacaugg

SEQ ID NO: 3363721 - RNA, 17 nt, Eastern equine encephalitis virus
gccuugggcgccgcagc

SEQ ID NO: 3363722 - RNA, 15 nt, Eastern equine encephalitis virus
gcgucuacugcaggg

SEQ ID NO: 3363723 - RNA, 15 nt, Eastern equine encephalitis virus
gcuauuacauccugg

SEQ ID NO: 3363724 - RNA, 11 nt, Eastern equine encephalitis virus
gcucugcauga

SEQ ID NO: 3363725 - RNA, 21 nt, Eastern equine encephalitis virus
gcugcuuauuuugcugugggc

SEQ ID NO: 3363726 - RNA, 15 nt, Eastern equine encephalitis virus
gcuggcaccagagcc

SEQ ID NO: 3363727 - RNA, 23 nt, Eastern equine encephalitis virus
gcuguuaugaaaagaauccacac

SEQ ID NO: 3363728 - RNA, 20 nt, Eastern equine encephalitis virus
ggacaaaacauacugaagaa

SEQ ID NO: 3363729 - RNA, 21 nt, Eastern equine encephalitis virus
ggacaaaacauacugaagaaa

SEQ ID NO: 3363730 - RNA, 20 nt, Eastern equine encephalitis virus
ggacccaaagcagcugcccu

SEQ ID NO: 3363731 - RNA, 19 nt, Eastern equine encephalitis virus
ggaccgcccgccaaacgca

SEQ ID NO: 3363732 - RNA, 14 nt, Eastern equine encephalitis virus
ggaguauaccuggg

SEQ ID NO: 3363733 - RNA, 16 nt, Eastern equine encephalitis virus
ggauggccgcacgaag

SEQ ID NO: 3363734 - RNA, 15 nt, Eastern equine encephalitis virus
ggcaccggcaaagca

SEQ ID NO: 3363735 - RNA, 14 nt, Eastern equine encephalitis virus
ggccaccacuugca

SEQ ID NO: 3363736 - RNA, 22 nt, Eastern equine encephalitis virus
ggccgccaucaagcugaagaag

SEQ ID NO: 3363737 - RNA, 20 nt, Eastern equine encephalitis virus
ggcgcagagcucugcaugau

SEQ ID NO: 3363738 - RNA, 16 nt, Eastern equine encephalitis virus
gggaacauaacaucug

SEQ ID NO: 3363739 - RNA, 12 nt, Eastern equine encephalitis virus
gggaauccacau

SEQ ID NO: 3363740 - RNA, 14 nt, Eastern equine encephalitis virus
gggacaagggcacc

SEQ ID NO: 3363741 - RNA, 14 nt, Eastern equine encephalitis virus
gggcagugcauaau

SEQ ID NO: 3363742 - RNA, 17 nt, Eastern equine encephalitis virus
aucuugucaaccacaua

SEQ ID NO: 3363743 - RNA, 16 nt, Eastern equine encephalitis virus
augaacggcaaaacgc

SEQ ID NO: 3363744 - RNA, 19 nt, Eastern equine encephalitis virus
augaucagcugcucgaugc

SEQ ID NO: 3363745 - RNA, 14 nt, Eastern equine encephalitis virus
augcaugaaaucag

SEQ ID NO: 3363746 - RNA, 14 nt, Eastern equine encephalitis virus
augccgaacaaggu

SEQ ID NO: 3363747 - RNA, 22 nt, Eastern equine encephalitis virus
augcuaucauugcagaacacuu

SEQ ID NO: 3363748 - RNA, 17 nt, Eastern equine encephalitis virus
auguauucaaguacugc

SEQ ID NO: 3363749 - RNA, 12 nt, Eastern equine encephalitis virus
auuacauccugg

SEQ ID NO: 3363750 - RNA, 13 nt, Eastern equine encephalitis virus
auucaaguacugc

SEQ ID NO: 3363751 - RNA, 19 nt, Eastern equine encephalitis virus
auuccacuucuccacugca

SEQ ID NO: 3363752 - RNA, 16 nt, Eastern equine encephalitis virus
auuuaauacacacuuu

SEQ ID NO: 3363753 - RNA, 16 nt, Eastern equine encephalitis virus
caaacaccaacuugaa

SEQ ID NO: 3363754 - RNA, 18 nt, Eastern equine encephalitis virus
caacaaaaaaugggugua

SEQ ID NO: 3363755 - RNA, 16 nt, Eastern equine encephalitis virus
caaccuaguacugcaa

SEQ ID NO: 3363756 - RNA, 12 nt, Eastern equine encephalitis virus
caaccugcaugu

SEQ ID NO: 3363757 - RNA, 18 nt, Eastern equine encephalitis virus
caacgaccccaggcuggu

SEQ ID NO: 3363758 - RNA, 15 nt, Eastern equine encephalitis virus
caagagucaggagaa

SEQ ID NO: 3363759 - RNA, 20 nt, Eastern equine encephalitis virus
caagauguacuagcagcagc

SEQ ID NO: 3363760 - RNA, 14 nt, Eastern equine encephalitis virus
caagccuaagccug

SEQ ID NO: 3363761 - RNA, 14 nt, Eastern equine encephalitis virus
caagggcaccugca

SEQ ID NO: 3363762 - RNA, 20 nt, Eastern equine encephalitis virus
caagucccaauacuccuggc

SEQ ID NO: 3363763 - RNA, 22 nt, Eastern equine encephalitis virus
caagugcugaauuaccugugga

SEQ ID NO: 3363764 - RNA, 12 nt, Eastern equine encephalitis virus
caaucuuugcau

SEQ ID NO: 3363765 - RNA, 13 nt, Eastern equine encephalitis virus
uuacaggaacugc

SEQ ID NO: 3363766 - RNA, 12 nt, Eastern equine encephalitis virus
uuacgacagccg

SEQ ID NO: 3363767 - RNA, 12 nt, Eastern equine encephalitis virus
uuacuaaacacu

SEQ ID NO: 3363768 - RNA, 23 nt, Eastern equine encephalitis virus
uuacuaaacacuaaauucacccu

SEQ ID NO: 3363769 - RNA, 22 nt, Eastern equine encephalitis virus
uuccaaucauguugaacggaca

SEQ ID NO: 3363770 - RNA, 16 nt, Eastern equine encephalitis virus
uuccaucaacuaaccu

SEQ ID NO: 3363771 - RNA, 15 nt, Eastern equine encephalitis virus
uuccaucgcuaaccu

SEQ ID NO: 3363772 - RNA, 17 nt, Eastern equine encephalitis virus
uugcaaccuaguacugc

SEQ ID NO: 3363773 - RNA, 21 nt, Eastern equine encephalitis virus
uuggacacucauuucacccag

SEQ ID NO: 3363774 - RNA, 22 nt, Eastern equine encephalitis virus
uugucaaccacauaacacuaua

SEQ ID NO: 3363775 - RNA, 16 nt, Eastern equine encephalitis virus
aaaacgcagaaaucaa

SEQ ID NO: 3363776 - RNA, 15 nt, Eastern equine encephalitis virus
aaaagggguuacagu

SEQ ID NO: 3363777 - RNA, 22 nt, Eastern equine encephalitis virus
aaaguuugcaaccuaguacugc

SEQ ID NO: 3363778 - RNA, 12 nt, Eastern equine encephalitis virus
aacaucugugca

SEQ ID NO: 3363779 - RNA, 17 nt, Eastern equine encephalitis virus
aacauggaguugaauua

SEQ ID NO: 3363780 - RNA, 15 nt, Eastern equine encephalitis virus
aacgaugaguacugg

SEQ ID NO: 3363781 - RNA, 21 nt, Eastern equine encephalitis virus
aacuguccaauucauucucca

SEQ ID NO: 3363782 - RNA, 13 nt, Eastern equine encephalitis virus
aagcgaccaccac

SEQ ID NO: 3363783 - RNA, 14 nt, Eastern equine encephalitis virus
aagcugcaggucug

SEQ ID NO: 3363784 - RNA, 15 nt, Eastern equine encephalitis virus
aagcuguugcagaag

SEQ ID NO: 3363785 - RNA, 22 nt, Eastern equine encephalitis virus
aaggcugucuuacuaaacacua

SEQ ID NO: 3363786 - RNA, 16 nt, Eastern equine encephalitis virus
aaugagggaacuucca

SEQ ID NO: 3363787 - RNA, 19 nt, Eastern equine encephalitis virus
aaugauucuugaagaccua

SEQ ID NO: 3363788 - RNA, 14 nt, Eastern equine encephalitis virus
aaugcuaggagaac

SEQ ID NO: 3363789 - RNA, 18 nt, Eastern equine encephalitis virus
acaccuuucacccaggcg

SEQ ID NO: 3363790 - RNA, 17 nt, Eastern equine encephalitis virus
acacuacguugagaugc

SEQ ID NO: 3363791 - RNA, 16 nt, Eastern equine encephalitis virus
acagauacccauuaac

SEQ ID NO: 3363792 - RNA, 18 nt, Eastern equine encephalitis virus
acagcgaauguguaugaa

SEQ ID NO: 3363793 - RNA, 14 nt, Eastern equine encephalitis virus
acauaacacuauag

SEQ ID NO: 3363794 - RNA, 14 nt, Eastern equine encephalitis virus
acauacugaagaaa

SEQ ID NO: 3363795 - RNA, 14 nt, Eastern equine encephalitis virus
accagagccucuag

SEQ ID NO: 3363796 - RNA, 16 nt, Eastern equine encephalitis virus
acccaaagcagcugcc

SEQ ID NO: 3363797 - RNA, 19 nt, Eastern equine encephalitis virus
acccuccaguacaccagug

SEQ ID NO: 3363798 - RNA, 15 nt, Eastern equine encephalitis virus
acccugcaugccaug

SEQ ID NO: 3363799 - RNA, 13 nt, Eastern equine encephalitis virus
accugcaugugcg

SEQ ID NO: 3363800 - RNA, 17 nt, Eastern equine encephalitis virus
accuggaguacaucacc

SEQ ID NO: 3363801 - RNA, 16 nt, Eastern equine encephalitis virus
acgaucagcagugcca

SEQ ID NO: 3363802 - RNA, 16 nt, Eastern equine encephalitis virus
acgcuuaucccacuug

SEQ ID NO: 3363803 - RNA, 18 nt, Eastern equine encephalitis virus
acgggccuaaccgccaua

SEQ ID NO: 3363804 - RNA, 17 nt, Eastern equine encephalitis virus
acuaucagugucaggug

SEQ ID NO: 3363805 - RNA, 16 nt, Eastern equine encephalitis virus
acugaaaacacccaga

SEQ ID NO: 3363806 - RNA, 18 nt, Eastern equine encephalitis virus
agaaauaccgucacccac

SEQ ID NO: 3363807 - RNA, 18 nt, Eastern equine encephalitis virus
agaagcuguugcagaaga

SEQ ID NO: 3363808 - RNA, 20 nt, Eastern equine encephalitis virus
agaauuggcaucacugaaga

SEQ ID NO: 3363809 - RNA, 20 nt, Eastern equine encephalitis virus
agagcuggugaaagcaguug

SEQ ID NO: 3363810 - RNA, 22 nt, Eastern equine encephalitis virus
agagugcucuauugaccacgca

SEQ ID NO: 3363811 - RNA, 16 nt, Eastern equine encephalitis virus
agccuaugaucagcug

SEQ ID NO: 3363812 - RNA, 22 nt, Eastern equine encephalitis virus
agccugcgcaggaaaaagaagc

SEQ ID NO: 3363813 - RNA, 14 nt, Eastern equine encephalitis virus
agcgaccaccacca

SEQ ID NO: 3363814 - RNA, 20 nt, Eastern equine encephalitis virus
agcgaccaccaccaccugcc

SEQ ID NO: 3363815 - RNA, 14 nt, Eastern equine encephalitis virus
agcggaucauuuac

SEQ ID NO: 3363816 - RNA, 16 nt, Eastern equine encephalitis virus
agcgugcagaccaagg

SEQ ID NO: 3363817 - RNA, 20 nt, Eastern equine encephalitis virus
agcguugaccacauuagcau

SEQ ID NO: 3363818 - RNA, 12 nt, Eastern equine encephalitis virus
agcucugcauga

SEQ ID NO: 3363819 - RNA, 15 nt, Eastern equine encephalitis virus
agcucugcaugauga

SEQ ID NO: 3363820 - RNA, 20 nt, Eastern equine encephalitis virus
cuauguucggucugaagacg

SEQ ID NO: 3363821 - RNA, 17 nt, Eastern equine encephalitis virus
cuccuuagcauccacag

SEQ ID NO: 3363822 - RNA, 14 nt, Eastern equine encephalitis virus
cugacuuugaaaca

SEQ ID NO: 3363823 - RNA, 21 nt, Eastern equine encephalitis virus
cugagauacgaucagcagugc

SEQ ID NO: 3363824 - RNA, 14 nt, Eastern equine encephalitis virus
cugauugacaacaa

SEQ ID NO: 3363825 - RNA, 15 nt, Eastern equine encephalitis virus
cuggcaccagagccu

SEQ ID NO: 3363826 - RNA, 13 nt, Eastern equine encephalitis virus
cuggguggaguca

SEQ ID NO: 3363827 - RNA, 18 nt, Eastern equine encephalitis virus
cuguacaguaugagaaca

SEQ ID NO: 3363828 - RNA, 18 nt, Eastern equine encephalitis virus
cugucaauuucacaguca

SEQ ID NO: 3363829 - RNA, 18 nt, Eastern equine encephalitis virus
cugucuuacuaaacacua

SEQ ID NO: 3363830 - RNA, 20 nt, Eastern equine encephalitis virus
cuuacagccauugcaugaga

SEQ ID NO: 3363831 - RNA, 21 nt, Eastern equine encephalitis virus
cuucaacguagaguguuucaa

SEQ ID NO: 3363832 - RNA, 24 nt, Eastern equine encephalitis virus
cuugcugagagcggaucauuuaca

SEQ ID NO: 3363833 - RNA, 15 nt, Eastern equine encephalitis virus
cuuuccaaagaagca

SEQ ID NO: 3363834 - RNA, 20 nt, Eastern equine encephalitis virus
gaaaacgcauaacuuacagc

SEQ ID NO: 3363835 - RNA, 16 nt, Eastern equine encephalitis virus
auggaaccaaaaaggg

SEQ ID NO: 3363836 - RNA, 23 nt, Eastern equine encephalitis virus
auggaaccaaaaagggguuacag

SEQ ID NO: 3363837 - RNA, 17 nt, Eastern equine encephalitis virus
augggagcgucagcugg

SEQ ID NO: 3363838 - RNA, 16 nt, Eastern equine encephalitis virus
auguacuagcagcagc

SEQ ID NO: 3363839 - RNA, 19 nt, Eastern equine encephalitis virus
auuaccacauuauaacacu

SEQ ID NO: 3363840 - RNA, 15 nt, Eastern equine encephalitis virus
auucgauaacaaggu

SEQ ID NO: 3363841 - RNA, 17 nt, Eastern equine encephalitis virus
auucgauaacaaggugg

SEQ ID NO: 3363842 - RNA, 15 nt, Eastern equine encephalitis virus
auucuccaucaggug

SEQ ID NO: 3363843 - RNA, 14 nt, Eastern equine encephalitis virus
auuuacaaaaucau

SEQ ID NO: 3363844 - RNA, 17 nt, Eastern equine encephalitis virus
caaacgcaagaagccug

SEQ ID NO: 3363845 - RNA, 13 nt, Eastern equine encephalitis virus
caacaacugucaa

SEQ ID NO: 3363846 - RNA, 12 nt, Eastern equine encephalitis virus
caaccaccugca

SEQ ID NO: 3363847 - RNA, 17 nt, Eastern equine encephalitis virus
caacgaccccaggcugg

SEQ ID NO: 3363848 - RNA, 21 nt, Eastern equine encephalitis virus
ugcacggaugucaaacaaugc

SEQ ID NO: 3363849 - RNA, 12 nt, Eastern equine encephalitis virus
ugcagcucaaau

SEQ ID NO: 3363850 - RNA, 16 nt, Eastern equine encephalitis virus
ugcaucgccacgcugg

SEQ ID NO: 3363851 - RNA, 22 nt, Eastern equine encephalitis virus
ugccuguuaaggccaagugcau

SEQ ID NO: 3363852 - RNA, 22 nt, Eastern equine encephalitis virus
uggaacagaauuacgacagccg

SEQ ID NO: 3363853 - RNA, 19 nt, Eastern equine encephalitis virus
uggagccgcuccgugcaga

SEQ ID NO: 3363854 - RNA, 18 nt, Eastern equine encephalitis virus
uggaguacaucaccugca

SEQ ID NO: 3363855 - RNA, 16 nt, Eastern equine encephalitis virus
uggugacauggaacca

SEQ ID NO: 3363856 - RNA, 15 nt, Eastern equine encephalitis virus
ugguugcccuaguuc

SEQ ID NO: 3363857 - RNA, 17 nt, Eastern equine encephalitis virus
uguacuagcagcagcca

SEQ ID NO: 3363858 - RNA, 19 nt, Eastern equine encephalitis virus
ugucugcggcgccuugggc

SEQ ID NO: 3363859 - RNA, 15 nt, Eastern equine encephalitis virus
uguuacucaaaugag

SEQ ID NO: 3363860 - RNA, 16 nt, Eastern equine encephalitis virus
uuaucccacuugcagc

SEQ ID NO: 3363861 - RNA, 12 nt, Eastern equine encephalitis virus
uucaaguacugc

SEQ ID NO: 3363862 - RNA, 19 nt, Eastern equine encephalitis virus
uucccaccguagccagcua

SEQ ID NO: 3363863 - RNA, 16 nt, Eastern equine encephalitis virus
uuuaauacacacuuua

SEQ ID NO: 3363864 - RNA, 17 nt, Eastern equine encephalitis virus
ggugacgguggugcaua

SEQ ID NO: 3363865 - RNA, 14 nt, Eastern equine encephalitis virus
gguggacggagcau

SEQ ID NO: 3363866 - RNA, 16 nt, Eastern equine encephalitis virus
guacaacucuggaaga

SEQ ID NO: 3363867 - RNA, 12 nt, Eastern equine encephalitis virus
guacgagaggga

SEQ ID NO: 3363868 - RNA, 16 nt, Eastern equine encephalitis virus
guacuagcagcagcca

SEQ ID NO: 3363869 - RNA, 19 nt, Eastern equine encephalitis virus
gucaaagauacaccagagg

SEQ ID NO: 3363870 - RNA, 22 nt, Eastern equine encephalitis virus
gucggcgauauccgccacugcg

SEQ ID NO: 3363871 - RNA, 20 nt, Eastern equine encephalitis virus
gugcacuuaccaacaggcac

SEQ ID NO: 3363872 - RNA, 17 nt, Eastern equine encephalitis virus
gugcuagagacagacau

SEQ ID NO: 3363873 - RNA, 18 nt, Eastern equine encephalitis virus
guucgauugcccuggagc

SEQ ID NO: 3363874 - RNA, 19 nt, Eastern equine encephalitis virus
guuggaguauaccugggga

SEQ ID NO: 3363875 - RNA, 17 nt, Eastern equine encephalitis virus
uaaauucacccuaguuc

SEQ ID NO: 3363876 - RNA, 15 nt, Eastern equine encephalitis virus
uaauuuuucuuuuau

SEQ ID NO: 3363877 - RNA, 21 nt, Eastern equine encephalitis virus
uacagucaaagauacaccaga

SEQ ID NO: 3363878 - RNA, 16 nt, Eastern equine encephalitis virus
uaccgucacccaccug

SEQ ID NO: 3363879 - RNA, 17 nt, Eastern equine encephalitis virus
uaccgucacccaccuga

SEQ ID NO: 3363880 - RNA, 21 nt, Eastern equine encephalitis virus
uaccuauccugcucccaugua

SEQ ID NO: 3363881 - RNA, 20 nt, Eastern equine encephalitis virus
uaccuccaaaccccauccug

SEQ ID NO: 3363882 - RNA, 14 nt, Eastern equine encephalitis virus
uagagaacaugaag

SEQ ID NO: 3363883 - RNA, 23 nt, Eastern equine encephalitis virus
uagagagaaauaccgucacccac

SEQ ID NO: 3363884 - RNA, 23 nt, Eastern equine encephalitis virus
uagauacugccaccuuuugccca

SEQ ID NO: 3363885 - RNA, 22 nt, Eastern equine encephalitis virus
uagcuauagaagaagucagagg

SEQ ID NO: 3363886 - RNA, 12 nt, Eastern equine encephalitis virus
aaagcagcugcc

SEQ ID NO: 3363887 - RNA, 14 nt, Eastern equine encephalitis virus
aacacacagcagug

SEQ ID NO: 3363888 - RNA, 13 nt, Eastern equine encephalitis virus
aacauacugaaga

SEQ ID NO: 3363889 - RNA, 14 nt, Eastern equine encephalitis virus
aacgaccccaggcu

SEQ ID NO: 3363890 - RNA, 13 nt, Eastern equine encephalitis virus
aacuucaugugcc

SEQ ID NO: 3363891 - RNA, 12 nt, Eastern equine encephalitis virus
aagcugaagaag

SEQ ID NO: 3363892 - RNA, 21 nt, Eastern equine encephalitis virus
aaggagcuuuccaaagaagca

SEQ ID NO: 3363893 - RNA, 20 nt, Eastern equine encephalitis virus
aaguaauuuaauacacacuu

SEQ ID NO: 3363894 - RNA, 22 nt, Eastern equine encephalitis virus
aaucacgcacaucaaccagcaa

SEQ ID NO: 3363895 - RNA, 21 nt, Eastern equine encephalitis virus
aaucagauacccuccaguaca

SEQ ID NO: 3363896 - RNA, 18 nt, Eastern equine encephalitis virus
aauccaguaaagcaggaa

SEQ ID NO: 3363897 - RNA, 22 nt, Eastern equine encephalitis virus
aauuguccuggguggagucaac

SEQ ID NO: 3363898 - RNA, 13 nt, Eastern equine encephalitis virus
aauuuuucuuuua

SEQ ID NO: 3363899 - RNA, 21 nt, Eastern equine encephalitis virus
acaccaacuugaagcuacaac

SEQ ID NO: 3363900 - RNA, 20 nt, Eastern equine encephalitis virus
acaccagaggggucagagcc

SEQ ID NO: 3363901 - RNA, 16 nt, Eastern equine encephalitis virus
acaccuuucacccagg

SEQ ID NO: 3363902 - RNA, 14 nt, Eastern equine encephalitis virus
acaucaaccagcaa

SEQ ID NO: 3363903 - RNA, 13 nt, Eastern equine encephalitis virus
acauccauccugc

SEQ ID NO: 3363904 - RNA, 14 nt, Eastern equine encephalitis virus
accaccaccaccug

SEQ ID NO: 3363905 - RNA, 12 nt, Eastern equine encephalitis virus
accacccugcau

SEQ ID NO: 3363906 - RNA, 16 nt, Eastern equine encephalitis virus
accacccugcaugcca

SEQ ID NO: 3363907 - RNA, 19 nt, Eastern equine encephalitis virus
accauggagcuguacagua

SEQ ID NO: 3363908 - RNA, 20 nt, Eastern equine encephalitis virus
accauguuggaacagaauua

SEQ ID NO: 3363909 - RNA, 23 nt, Eastern equine encephalitis virus
accgauucaaaacacgcuccaag

SEQ ID NO: 3363910 - RNA, 13 nt, Eastern equine encephalitis virus
accuaacccucca

SEQ ID NO: 3363911 - RNA, 16 nt, Eastern equine encephalitis virus
accuccaaaccccauc

SEQ ID NO: 3363912 - RNA, 14 nt, Eastern equine encephalitis virus
accuuucacccagg

SEQ ID NO: 3363913 - RNA, 16 nt, Eastern equine encephalitis virus
acgaaggauccaggac

SEQ ID NO: 3363914 - RNA, 14 nt, Eastern equine encephalitis virus
acgagggcagauga

SEQ ID NO: 3363915 - RNA, 19 nt, Eastern equine encephalitis virus
acgcaagaagccugcgcca

SEQ ID NO: 3363916 - RNA, 14 nt, Eastern equine encephalitis virus
acgcuggcaccaga

SEQ ID NO: 3363917 - RNA, 17 nt, Eastern equine encephalitis virus
acgucacucuugcugag

SEQ ID NO: 3363918 - RNA, 15 nt, Eastern equine encephalitis virus
acuaagggcagugca

SEQ ID NO: 3363919 - RNA, 15 nt, Eastern equine encephalitis virus
acuacaggcagcgca

SEQ ID NO: 3363920 - RNA, 16 nt, Eastern equine encephalitis virus
acucgcaaucuuugca

SEQ ID NO: 3363921 - RNA, 20 nt, Eastern equine encephalitis virus
acugcaaacauccauccugc

SEQ ID NO: 3363922 - RNA, 18 nt, Eastern equine encephalitis virus
acuggacgaugaccaaga

SEQ ID NO: 3363923 - RNA, 14 nt, Eastern equine encephalitis virus
acuuugcugcauua

SEQ ID NO: 3363924 - RNA, 12 nt, Eastern equine encephalitis virus
agaacaugaagg

SEQ ID NO: 3363925 - RNA, 15 nt, Eastern equine encephalitis virus
agaagcgaccaccac

SEQ ID NO: 3363926 - RNA, 14 nt, Eastern equine encephalitis virus
agaaugacgucacu

SEQ ID NO: 3363927 - RNA, 14 nt, Eastern equine encephalitis virus
agacaaacccgaua

SEQ ID NO: 3363928 - RNA, 15 nt, Eastern equine encephalitis virus
agaccuaggaguuga

SEQ ID NO: 3363929 - RNA, 23 nt, Eastern equine encephalitis virus
agcaggcucuuuuggagaccugc

SEQ ID NO: 3363930 - RNA, 16 nt, Eastern equine encephalitis virus
agcauccacagugcca

SEQ ID NO: 3363931 - RNA, 23 nt, Eastern equine encephalitis virus
agccgcuuccacuggacgaugac

SEQ ID NO: 3363932 - RNA, 20 nt, Eastern equine encephalitis virus
agcgacuauacaaccaccug

SEQ ID NO: 3363933 - RNA, 17 nt, Eastern equine encephalitis virus
agcgcucggaagagugc

SEQ ID NO: 3363934 - RNA, 23 nt, Eastern equine encephalitis virus
agcgcuuauuguaugcaugcgca

SEQ ID NO: 3363935 - RNA, 14 nt, Eastern equine encephalitis virus
agcggcgcccaagu

SEQ ID NO: 3363936 - RNA, 20 nt, Eastern equine encephalitis virus
agcgucagcuggagaucugc

SEQ ID NO: 3363937 - RNA, 18 nt, Eastern equine encephalitis virus
agcguuccguccaugaga

SEQ ID NO: 3363938 - RNA, 12 nt, Eastern equine encephalitis virus
agcuauggugac

SEQ ID NO: 3363939 - RNA, 14 nt, Eastern equine encephalitis virus
aggaccgcccgcca

SEQ ID NO: 3363940 - RNA, 14 nt, Eastern equine encephalitis virus
aggagaaccaggag

SEQ ID NO: 3363941 - RNA, 19 nt, Eastern equine encephalitis virus
aggcacuguucaggcaaug

SEQ ID NO: 3363942 - RNA, 22 nt, Eastern equine encephalitis virus
aggcucuuuuggagaccugcaa

SEQ ID NO: 3363943 - RNA, 16 nt, Eastern equine encephalitis virus
agggaacuuccagugu

SEQ ID NO: 3363944 - RNA, 19 nt, Eastern equine encephalitis virus
agggacccaaagcagcugc

SEQ ID NO: 3363945 - RNA, 24 nt, Eastern equine encephalitis virus
agggcagaugacaccuugcaagug

SEQ ID NO: 3363946 - RNA, 19 nt, Eastern equine encephalitis virus
agguagaauucaggccagu

SEQ ID NO: 3363947 - RNA, 16 nt, Eastern equine encephalitis virus
aggugauacaggcagc

SEQ ID NO: 3363948 - RNA, 13 nt, Eastern equine encephalitis virus
agguguugcaguu

SEQ ID NO: 3363949 - RNA, 19 nt, Eastern equine encephalitis virus
aguguuggauucagcugcc

SEQ ID NO: 3363950 - RNA, 19 nt, Eastern equine encephalitis virus
aguucggggcaaugaugaa

SEQ ID NO: 3363951 - RNA, 14 nt, Eastern equine encephalitis virus
aguugaucaggcau

SEQ ID NO: 3363952 - RNA, 18 nt, Eastern equine encephalitis virus
auaacacuauaggcagug

SEQ ID NO: 3363953 - RNA, 23 nt, Eastern equine encephalitis virus
auaacgccgccgaugcagugcau

SEQ ID NO: 3363954 - RNA, 14 nt, Eastern equine encephalitis virus
auaagguagaauuc

SEQ ID NO: 3363955 - RNA, 23 nt, Eastern equine encephalitis virus
auacagcugguuaauaccaggau

SEQ ID NO: 3363956 - RNA, 18 nt, Eastern equine encephalitis virus
auagacaaugagcaacug

SEQ ID NO: 3363957 - RNA, 20 nt, Eastern equine encephalitis virus
auauacaauuacacuacagg

SEQ ID NO: 3363958 - RNA, 15 nt, Eastern equine encephalitis virus
auccgcauccagaca

SEQ ID NO: 3363959 - RNA, 19 nt, Eastern equine encephalitis virus
gagccauggucgcuugcca

SEQ ID NO: 3363960 - RNA, 17 nt, Eastern equine encephalitis virus
gagccuaugaucagcug

SEQ ID NO: 3363961 - RNA, 18 nt, Eastern equine encephalitis virus
gagcucugcaugaugaag

SEQ ID NO: 3363962 - RNA, 14 nt, Eastern equine encephalitis virus
gaguacaucaccug

SEQ ID NO: 3363963 - RNA, 15 nt, Eastern equine encephalitis virus
gaguaugaugccuau

SEQ ID NO: 3363964 - RNA, 20 nt, Eastern equine encephalitis virus
gagucaacgaaggauccagg

SEQ ID NO: 3363965 - RNA, 16 nt, Eastern equine encephalitis virus
gagucauccgcaucca

SEQ ID NO: 3363966 - RNA, 16 nt, Eastern equine encephalitis virus
gauauccgccacugcg

SEQ ID NO: 3363967 - RNA, 22 nt, Eastern equine encephalitis virus
gaucaaccacccugcaugccau

SEQ ID NO: 3363968 - RNA, 19 nt, Eastern equine encephalitis virus
gaucgcuagccgcgugcuc

SEQ ID NO: 3363969 - RNA, 18 nt, Eastern equine encephalitis virus
gaugucaaacaaugcagg

SEQ ID NO: 3363970 - RNA, 18 nt, Eastern equine encephalitis virus
gcaaccguuacacccaca

SEQ ID NO: 3363971 - RNA, 16 nt, Eastern equine encephalitis virus
gcaaucuuugcauaac

SEQ ID NO: 3363972 - RNA, 15 nt, Eastern equine encephalitis virus
gcaccuguguggcua

SEQ ID NO: 3363973 - RNA, 23 nt, Eastern equine encephalitis virus
gcaggucugcacuagugcaguua

SEQ ID NO: 3363974 - RNA, 13 nt, Eastern equine encephalitis virus
gcaguguauaagg

SEQ ID NO: 3363975 - RNA, 19 nt, Eastern equine encephalitis virus
gcauagucggugcgacagc

SEQ ID NO: 3363976 - RNA, 15 nt, Eastern equine encephalitis virus
gcaucacugaagagc

SEQ ID NO: 3363977 - RNA, 12 nt, Eastern equine encephalitis virus
gcaugccaugcu

SEQ ID NO: 3363978 - RNA, 16 nt, Eastern equine encephalitis virus
gccacaaugcaugaaa

SEQ ID NO: 3363979 - RNA, 19 nt, Eastern equine encephalitis virus
gccacaaugcaugaaauca

SEQ ID NO: 3363980 - RNA, 17 nt, Eastern equine encephalitis virus
gccgacccccugaagag

SEQ ID NO: 3363981 - RNA, 18 nt, Eastern equine encephalitis virus
gccgagccuaugaucagc

SEQ ID NO: 3363982 - RNA, 23 nt, Eastern equine encephalitis virus
gccucgaucucgagcgugagaag

SEQ ID NO: 3363983 - RNA, 19 nt, Eastern equine encephalitis virus
gccuucuccaguagugaaa

SEQ ID NO: 3363984 - RNA, 17 nt, Eastern equine encephalitis virus
gcgaaaauaggagaugc

SEQ ID NO: 3363985 - RNA, 15 nt, Eastern equine encephalitis virus
gcgaccaccaccacc

SEQ ID NO: 3363986 - RNA, 20 nt, Eastern equine encephalitis virus
gcgacuauacaaccaccugc

SEQ ID NO: 3363987 - RNA, 17 nt, Eastern equine encephalitis virus
gcuacaacgaccccagg

SEQ ID NO: 3363988 - RNA, 19 nt, Eastern equine encephalitis virus
gcuacgaggugaacuacgu

SEQ ID NO: 3363989 - RNA, 13 nt, Eastern equine encephalitis virus
gcucuaucagugg

SEQ ID NO: 3363990 - RNA, 18 nt, Eastern equine encephalitis virus
gcugaagaaggccagcau

SEQ ID NO: 3363991 - RNA, 13 nt, Eastern equine encephalitis virus
gcuuuuaagcugc

SEQ ID NO: 3363992 - RNA, 18 nt, Eastern equine encephalitis virus
ggaaagggugacagcggg

SEQ ID NO: 3363993 - RNA, 17 nt, Eastern equine encephalitis virus
ggacaagggcaccugca

SEQ ID NO: 3363994 - RNA, 14 nt, Eastern equine encephalitis virus
ggacacgguuacag

SEQ ID NO: 3363995 - RNA, 21 nt, Eastern equine encephalitis virus
ggacggcucuaucagugguga

SEQ ID NO: 3363996 - RNA, 18 nt, Eastern equine encephalitis virus
ggaguacaucaccugcaa

SEQ ID NO: 3363997 - RNA, 19 nt, Eastern equine encephalitis virus
ggcaucacugaagagcugg

SEQ ID NO: 3363998 - RNA, 19 nt, Eastern equine encephalitis virus
ggcggcccuuuaggccacc

SEQ ID NO: 3363999 - RNA, 20 nt, Eastern equine encephalitis virus
ggcuaguugccgaccacucu

SEQ ID NO: 3364000 - RNA, 20 nt, Eastern equine encephalitis virus
ggcucaagagucaggagaag

SEQ ID NO: 3364001 - RNA, 18 nt, Eastern equine encephalitis virus
gggaaaccauccaccaaa

SEQ ID NO: 3364002 - RNA, 12 nt, Eastern equine encephalitis virus
gggacaaaacau

SEQ ID NO: 3364003 - RNA, 18 nt, Eastern equine encephalitis virus
gggaugcgcacgcaggag

SEQ ID NO: 3364004 - RNA, 17 nt, Eastern equine encephalitis virus
gggaugucaaggucaca

SEQ ID NO: 3364005 - RNA, 12 nt, Eastern equine encephalitis virus
gggcaccugcaa

SEQ ID NO: 3364006 - RNA, 14 nt, Eastern equine encephalitis virus
gggccuaaccgcca

SEQ ID NO: 3364007 - RNA, 16 nt, Eastern equine encephalitis virus
ggugauacaggcagcu

SEQ ID NO: 3364008 - RNA, 14 nt, Eastern equine encephalitis virus
guacaucaccugca

SEQ ID NO: 3364009 - RNA, 14 nt, Eastern equine encephalitis virus
guacuagcagcagc

SEQ ID NO: 3364010 - RNA, 19 nt, Eastern equine encephalitis virus
guauucaaguacugcaagc

SEQ ID NO: 3364011 - RNA, 17 nt, Eastern equine encephalitis virus
gucaauaucaugaucgc

SEQ ID NO: 3364012 - RNA, 18 nt, Eastern equine encephalitis virus
gucacauccguguggcuc

SEQ ID NO: 3364013 - RNA, 15 nt, Eastern equine encephalitis virus
gucagauaaaacguu

SEQ ID NO: 3364014 - RNA, 12 nt, Eastern equine encephalitis virus
gucagcuggaga

SEQ ID NO: 3364015 - RNA, 21 nt, Eastern equine encephalitis virus
gugcagaaaauugugcagugg

SEQ ID NO: 3364016 - RNA, 14 nt, Eastern equine encephalitis virus
gugcaguuaccugc

SEQ ID NO: 3364017 - RNA, 15 nt, Eastern equine encephalitis virus
gugcauaaugcugcu

SEQ ID NO: 3364018 - RNA, 15 nt, Eastern equine encephalitis virus
gugcgcagguugaac

SEQ ID NO: 3364019 - RNA, 12 nt, Eastern equine encephalitis virus
gugcguccuggc

SEQ ID NO: 3364020 - RNA, 23 nt, Eastern equine encephalitis virus
guggacgaguguucaaaccgcug

SEQ ID NO: 3364021 - RNA, 17 nt, Eastern equine encephalitis virus
guggcuccuuugcagga

SEQ ID NO: 3364022 - RNA, 19 nt, Eastern equine encephalitis virus
guguggcuccuuugcagga

SEQ ID NO: 3364023 - RNA, 22 nt, Eastern equine encephalitis virus
guuaaggccaagugcaucgcca

SEQ ID NO: 3364024 - RNA, 16 nt, Eastern equine encephalitis virus
guugccuacaaaucca

SEQ ID NO: 3364025 - RNA, 17 nt, Eastern equine encephalitis virus
uaaugauucuugaagac

SEQ ID NO: 3364026 - RNA, 20 nt, Eastern equine encephalitis virus
uaaugcuaggagaaccagga

SEQ ID NO: 3364027 - RNA, 12 nt, Eastern equine encephalitis virus
uacaauuacacu

SEQ ID NO: 3364028 - RNA, 21 nt, Eastern equine encephalitis virus
gcagugguugcccuaguucug

SEQ ID NO: 3364029 - RNA, 13 nt, Eastern equine encephalitis virus
gcauaaggcugcu

SEQ ID NO: 3364030 - RNA, 15 nt, Eastern equine encephalitis virus
gcauccacagugcca

SEQ ID NO: 3364031 - RNA, 13 nt, Eastern equine encephalitis virus
gcaucgccacgcu

SEQ ID NO: 3364032 - RNA, 23 nt, Eastern equine encephalitis virus
gcaugaaaucagauacccuccag

SEQ ID NO: 3364033 - RNA, 19 nt, Eastern equine encephalitis virus
gccaagaaacaaaaacgua

SEQ ID NO: 3364034 - RNA, 22 nt, Eastern equine encephalitis virus
gccgagccuaugaucagcugcu

SEQ ID NO: 3364035 - RNA, 15 nt, Eastern equine encephalitis virus
gccgaugcagugcau

SEQ ID NO: 3364036 - RNA, 17 nt, Eastern equine encephalitis virus
gccgccgaugcagugca

SEQ ID NO: 3364037 - RNA, 12 nt, Eastern equine encephalitis virus
gccgcugugaaa

SEQ ID NO: 3364038 - RNA, 15 nt, Eastern equine encephalitis virus
gccuacaaauccagu

SEQ ID NO: 3364039 - RNA, 22 nt, Eastern equine encephalitis virus
gcgaccaacaacugucaauuuc

SEQ ID NO: 3364040 - RNA, 21 nt, Eastern equine encephalitis virus
gcggugcuagagacagacaua

SEQ ID NO: 3364041 - RNA, 21 nt, Eastern equine encephalitis virus
gcucaaauugaggaccugaga

SEQ ID NO: 3364042 - RNA, 21 nt, Eastern equine encephalitis virus
gcugcacguagaaggcagaau

SEQ ID NO: 3364043 - RNA, 17 nt, Eastern equine encephalitis virus
ggacccaaagcagcugc

SEQ ID NO: 3364044 - RNA, 14 nt, Eastern equine encephalitis virus
ggagcgucagcugg

SEQ ID NO: 3364045 - RNA, 21 nt, Eastern equine encephalitis virus
ggagcuguacaguaugagaac

SEQ ID NO: 3364046 - RNA, 14 nt, Eastern equine encephalitis virus
ggaguugaucaggc

SEQ ID NO: 3364047 - RNA, 16 nt, Eastern equine encephalitis virus
ggaugcgcacgcagga

SEQ ID NO: 3364048 - RNA, 21 nt, Eastern equine encephalitis virus
ggcaguguauaaggcugucuu

SEQ ID NO: 3364049 - RNA, 15 nt, Eastern equine encephalitis virus
ggcaucacugaagag

SEQ ID NO: 3364050 - RNA, 19 nt, Eastern equine encephalitis virus
ggcgauauccgccacugcg

SEQ ID NO: 3364051 - RNA, 17 nt, Eastern equine encephalitis virus
ggcuauuacauccuggc

SEQ ID NO: 3364052 - RNA, 20 nt, Eastern equine encephalitis virus
ggcugcuauauuaccacauu

SEQ ID NO: 3364053 - RNA, 20 nt, Eastern equine encephalitis virus
guaugcaugcgcaugcugcg

SEQ ID NO: 3364054 - RNA, 22 nt, Eastern equine encephalitis virus
guauguagagcgcucggaagag

SEQ ID NO: 3364055 - RNA, 13 nt, Eastern equine encephalitis virus
gucaccggagaag

SEQ ID NO: 3364056 - RNA, 20 nt, Eastern equine encephalitis virus
gucgccgacccccugaagag

SEQ ID NO: 3364057 - RNA, 12 nt, Eastern equine encephalitis virus
gugacaagccuc

SEQ ID NO: 3364058 - RNA, 17 nt, Eastern equine encephalitis virus
gugauacaggcagcuga

SEQ ID NO: 3364059 - RNA, 23 nt, Eastern equine encephalitis virus
gugcacacaccuuucacccaggc

SEQ ID NO: 3364060 - RNA, 16 nt, Eastern equine encephalitis virus
gugcaguuaccugcaa

SEQ ID NO: 3364061 - RNA, 22 nt, Eastern equine encephalitis virus
gugccuguuaaggccaagugca

SEQ ID NO: 3364062 - RNA, 19 nt, Eastern equine encephalitis virus
gugcgcagguugaacgcug

SEQ ID NO: 3364063 - RNA, 18 nt, Eastern equine encephalitis virus
gugguauacaucgagagc

SEQ ID NO: 3364064 - RNA, 18 nt, Eastern equine encephalitis virus
guuacacccacaagcgug

SEQ ID NO: 3364065 - RNA, 23 nt, Eastern equine encephalitis virus
guuacaucugacgcacugauggc

SEQ ID NO: 3364066 - RNA, 15 nt, Eastern equine encephalitis virus
guucggucugaagac

SEQ ID NO: 3364067 - RNA, 20 nt, Eastern equine encephalitis virus
uaaacacauaagaggucacc

SEQ ID NO: 3364068 - RNA, 23 nt, Eastern equine encephalitis virus
uaaagggacccaaagcagcugcc

SEQ ID NO: 3364069 - RNA, 20 nt, Eastern equine encephalitis virus
uaaaguagagaacaugaagg

SEQ ID NO: 3364070 - RNA, 14 nt, Eastern equine encephalitis virus
uacaaccaccugca

SEQ ID NO: 3364071 - RNA, 22 nt, Eastern equine encephalitis virus
uacacacuuuauaaucaggcau

SEQ ID NO: 3364072 - RNA, 14 nt, Eastern equine encephalitis virus
uacaggcagcgcau

SEQ ID NO: 3364073 - RNA, 13 nt, Eastern equine encephalitis virus
uacaucaccugca

SEQ ID NO: 3364074 - RNA, 18 nt, Eastern equine encephalitis virus
uacauuccacuucuccac

SEQ ID NO: 3364075 - RNA, 15 nt, Eastern equine encephalitis virus
uacgcggcaaugcaa

SEQ ID NO: 3364076 - RNA, 23 nt, Eastern equine encephalitis virus
uacugcaagagaauuuucccacc

SEQ ID NO: 3364077 - RNA, 15 nt, Eastern equine encephalitis virus
uauacaaccaccugc

SEQ ID NO: 3364078 - RNA, 20 nt, Eastern equine encephalitis virus
ucaaauugaggaccugagac

SEQ ID NO: 3364079 - RNA, 16 nt, Eastern equine encephalitis virus
ucaaccacccugcaug

SEQ ID NO: 3364080 - RNA, 20 nt, Eastern equine encephalitis virus
ucaagcugaagaaggccagc

SEQ ID NO: 3364081 - RNA, 17 nt, Eastern equine encephalitis virus
ucacagucaccggagaa

SEQ ID NO: 3364082 - RNA, 20 nt, Eastern equine encephalitis virus
ucacccuaguucgauguacu

SEQ ID NO: 3364083 - RNA, 18 nt, Eastern equine encephalitis virus
ucacgacgggccuaaccg

SEQ ID NO: 3364084 - RNA, 15 nt, Eastern equine encephalitis virus
ucauucuccaucagg

SEQ ID NO: 3364085 - RNA, 12 nt, Eastern equine encephalitis virus
ucauuucaccca

SEQ ID NO: 3364086 - RNA, 17 nt, Eastern equine encephalitis virus
uccaaaccccauccuga

SEQ ID NO: 3364087 - RNA, 23 nt, Eastern equine encephalitis virus
uccaagauguacuagcagcagcc

SEQ ID NO: 3364088 - RNA, 15 nt, Eastern equine encephalitis virus
uccaaucauguugaa

SEQ ID NO: 3364089 - RNA, 14 nt, Eastern equine encephalitis virus
uccaguacaccagu

SEQ ID NO: 3364090 - RNA, 21 nt, Eastern equine encephalitis virus
uccuggcucaaugcccaccag

SEQ ID NO: 3364091 - RNA, 18 nt, Eastern equine encephalitis virus
ugaaagcaguugaaucac

SEQ ID NO: 3364092 - RNA, 21 nt, Eastern equine encephalitis virus
ugaagcuacaacgaccccagg

SEQ ID NO: 3364093 - RNA, 15 nt, Eastern equine encephalitis virus
ugacgaccaggucac

SEQ ID NO: 3364094 - RNA, 19 nt, Eastern equine encephalitis virus
ugagaacaauagguucacc

SEQ ID NO: 3364095 - RNA, 18 nt, Eastern equine encephalitis virus
ugaugugccacaaugcau

SEQ ID NO: 3364096 - RNA, 20 nt, Eastern equine encephalitis virus
ugauugcccuaacugugggc

SEQ ID NO: 3364097 - RNA, 18 nt, Eastern equine encephalitis virus
ugcacccguucaccuaca

SEQ ID NO: 3364098 - RNA, 14 nt, Eastern equine encephalitis virus
ugcaggggauaggc

SEQ ID NO: 3364099 - RNA, 17 nt, Eastern equine encephalitis virus
ugcaguuaccugcaaag

SEQ ID NO: 3364100 - RNA, 14 nt, Eastern equine encephalitis virus
ugccacucaaugua

SEQ ID NO: 3364101 - RNA, 21 nt, Eastern equine encephalitis virus
ugccaucaccgauucaaaaca

SEQ ID NO: 3364102 - RNA, 15 nt, Eastern equine encephalitis virus
ugcugacgaccaggu

SEQ ID NO: 3364103 - RNA, 13 nt, Eastern equine encephalitis virus
uggaagacugccu

SEQ ID NO: 3364104 - RNA, 20 nt, Eastern equine encephalitis virus
uggaguugaauuaccaugca

SEQ ID NO: 3364105 - RNA, 20 nt, Eastern equine encephalitis virus
uggcggcccuuuaggccacc

SEQ ID NO: 3364106 - RNA, 12 nt, Eastern equine encephalitis virus
uuaauaccagga

SEQ ID NO: 3364107 - RNA, 20 nt, Eastern equine encephalitis virus
aaaaagggguuacagucaaa

SEQ ID NO: 3364108 - RNA, 17 nt, Eastern equine encephalitis virus
aaaagugccuucuccag

SEQ ID NO: 3364109 - RNA, 14 nt, Eastern equine encephalitis virus
aaaccccauccuga

SEQ ID NO: 3364110 - RNA, 23 nt, Eastern equine encephalitis virus
aaacuguccaauucauucuccau

SEQ ID NO: 3364111 - RNA, 17 nt, Eastern equine encephalitis virus
gaaauacuacugcaagu

SEQ ID NO: 3364112 - RNA, 14 nt, Eastern equine encephalitis virus
gaacaugaaggcaa

SEQ ID NO: 3364113 - RNA, 17 nt, Eastern equine encephalitis virus
gaagaagucagagggga

SEQ ID NO: 3364114 - RNA, 18 nt, Eastern equine encephalitis virus
gaagacggauggaguuga

SEQ ID NO: 3364115 - RNA, 13 nt, Eastern equine encephalitis virus
gaagagcugguga

SEQ ID NO: 3364116 - RNA, 21 nt, Eastern equine encephalitis virus
gaagcuguugcagaagaaacu

SEQ ID NO: 3364117 - RNA, 13 nt, Eastern equine encephalitis virus
gaagucagagggg

SEQ ID NO: 3364118 - RNA, 21 nt, Eastern equine encephalitis virus
gaauuggcaucacugaagagc

SEQ ID NO: 3364119 - RNA, 20 nt, Eastern equine encephalitis virus
gacaacaaagguagagucgu

SEQ ID NO: 3364120 - RNA, 22 nt, Eastern equine encephalitis virus
gacaacaucgugaaagggguua

SEQ ID NO: 3364121 - RNA, 14 nt, Eastern equine encephalitis virus
gacacgguuacagu

SEQ ID NO: 3364122 - RNA, 23 nt, Eastern equine encephalitis virus
gacacgguuacaguuggguuuca

SEQ ID NO: 3364123 - RNA, 19 nt, Eastern equine encephalitis virus
gacagucucagaccuggaa

SEQ ID NO: 3364124 - RNA, 14 nt, Eastern equine encephalitis virus
gacccaaagcagcu

SEQ ID NO: 3364125 - RNA, 20 nt, Eastern equine encephalitis virus
gacgcacugauggcagagcg

SEQ ID NO: 3364126 - RNA, 19 nt, Eastern equine encephalitis virus
gacuauacaaccaccugca

SEQ ID NO: 3364127 - RNA, 18 nt, Eastern equine encephalitis virus
gacugccucgaggagagg

SEQ ID NO: 3364128 - RNA, 12 nt, Eastern equine encephalitis virus
gagcgugagaag

SEQ ID NO: 3364129 - RNA, 18 nt, Eastern equine encephalitis virus
gagggaacuaccagcagc

SEQ ID NO: 3364130 - RNA, 22 nt, Eastern equine encephalitis virus
gagucgccgacccccugaagag

SEQ ID NO: 3364131 - RNA, 12 nt, Eastern equine encephalitis virus
gauacagcuggu

SEQ ID NO: 3364132 - RNA, 22 nt, Eastern equine encephalitis virus
gauacagcugguuaauaccagg

SEQ ID NO: 3364133 - RNA, 14 nt, Eastern equine encephalitis virus
gaucagcagugcca

SEQ ID NO: 3364134 - RNA, 16 nt, Eastern equine encephalitis virus
gaucgacaaccugcau

SEQ ID NO: 3364135 - RNA, 13 nt, Eastern equine encephalitis virus
gaugcagugcaua

SEQ ID NO: 3364136 - RNA, 18 nt, Eastern equine encephalitis virus
gaugccuaucuugacaug

SEQ ID NO: 3364137 - RNA, 22 nt, Eastern equine encephalitis virus
gcaacuuuaaacacauaagagg

SEQ ID NO: 3364138 - RNA, 21 nt, Eastern equine encephalitis virus
gcaccauggagcuguacagua

SEQ ID NO: 3364139 - RNA, 16 nt, Eastern equine encephalitis virus
gcaccuaacccuccag

SEQ ID NO: 3364140 - RNA, 18 nt, Eastern equine encephalitis virus
gcacgaagugguagucua

SEQ ID NO: 3364141 - RNA, 23 nt, Eastern equine encephalitis virus
gcacugauggcagagcggugcgc

SEQ ID NO: 3364142 - RNA, 21 nt, Eastern equine encephalitis virus
gcagcgacuauacaaccaccu

SEQ ID NO: 3364143 - RNA, 23 nt, Eastern equine encephalitis virus
gcagcucaaauugaggaccugag

SEQ ID NO: 3364144 - RNA, 15 nt, Eastern equine encephalitis virus
gcauccagacaucag

SEQ ID NO: 3364145 - RNA, 16 nt, Eastern equine encephalitis virus
gcaugcugcgcugcuu

SEQ ID NO: 3364146 - RNA, 17 nt, Eastern equine encephalitis virus
gccaaacgcaagaagcc

SEQ ID NO: 3364147 - RNA, 20 nt, Eastern equine encephalitis virus
gccaaacgcaagaagccugc

SEQ ID NO: 3364148 - RNA, 15 nt, Eastern equine encephalitis virus
gccaccacuugcagc

SEQ ID NO: 3364149 - RNA, 18 nt, Eastern equine encephalitis virus
gccaccacuugcagcuca

SEQ ID NO: 3364150 - RNA, 18 nt, Eastern equine encephalitis virus
gccaccuuuugcccagcu

SEQ ID NO: 3364151 - RNA, 19 nt, Eastern equine encephalitis virus
gccacgcuggcaccagagc

SEQ ID NO: 3364152 - RNA, 15 nt, Eastern equine encephalitis virus
gccacgugguugaac

SEQ ID NO: 3364153 - RNA, 16 nt, Eastern equine encephalitis virus
gccacugucaugugcg

SEQ ID NO: 3364154 - RNA, 16 nt, Eastern equine encephalitis virus
gccaucaagcugaaga

SEQ ID NO: 3364155 - RNA, 18 nt, Eastern equine encephalitis virus
gccaucaagcugaagaag

SEQ ID NO: 3364156 - RNA, 21 nt, Eastern equine encephalitis virus
gccauggucgcuugccacugu

SEQ ID NO: 3364157 - RNA, 13 nt, Eastern equine encephalitis virus
gcccaagugaaau

SEQ ID NO: 3364158 - RNA, 15 nt, Eastern equine encephalitis virus
gcccuaacugugggc

SEQ ID NO: 3364159 - RNA, 16 nt, Eastern equine encephalitis virus
gccgccgaugcagugc

SEQ ID NO: 3364160 - RNA, 19 nt, Eastern equine encephalitis virus
gccuauggcgccgauuaac

SEQ ID NO: 3364161 - RNA, 17 nt, Eastern equine encephalitis virus
gccuccgauuucggugg

SEQ ID NO: 3364162 - RNA, 17 nt, Eastern equine encephalitis virus
gccuccuauaaacacua

SEQ ID NO: 3364163 - RNA, 18 nt, Eastern equine encephalitis virus
gccugagauacgaucagc

SEQ ID NO: 3364164 - RNA, 14 nt, Eastern equine encephalitis virus
gccugcgcaggaaa

SEQ ID NO: 3364165 - RNA, 23 nt, Eastern equine encephalitis virus
gccuucuccaguagugaaaugcu

SEQ ID NO: 3364166 - RNA, 19 nt, Eastern equine encephalitis virus
gcgaccaccaccaccugcc

SEQ ID NO: 3364167 - RNA, 22 nt, Eastern equine encephalitis virus
gcgacuauacaaccaccugcac

SEQ ID NO: 3364168 - RNA, 22 nt, Eastern equine encephalitis virus
gcggugcuagagacagacauag

SEQ ID NO: 3364169 - RNA, 21 nt, Eastern equine encephalitis virus
gcguuacuuugcugcauuaag

SEQ ID NO: 3364170 - RNA, 21 nt, Eastern equine encephalitis virus
gcuaggagaaccaggagagau

SEQ ID NO: 3364171 - RNA, 19 nt, Eastern equine encephalitis virus
gcucaagagucaggagaag

SEQ ID NO: 3364172 - RNA, 20 nt, Eastern equine encephalitis virus
gcucuuuuggagaccugcaa

SEQ ID NO: 3364173 - RNA, 14 nt, Eastern equine encephalitis virus
gcuggagaucugca

SEQ ID NO: 3364174 - RNA, 18 nt, Eastern equine encephalitis virus
gcuuaucccacuugcagc

SEQ ID NO: 3364175 - RNA, 19 nt, Eastern equine encephalitis virus
ggacacucauuucacccag

SEQ ID NO: 3364176 - RNA, 14 nt, Eastern equine encephalitis virus
ggagaaccaggaga

SEQ ID NO: 3364177 - RNA, 16 nt, Eastern equine encephalitis virus
ggaggagccuacugcu

SEQ ID NO: 3364178 - RNA, 23 nt, Eastern equine encephalitis virus
ggagucauccgcauccagacauc

SEQ ID NO: 3364179 - RNA, 20 nt, Eastern equine encephalitis virus
ggaguugaauuaccaugcaa

SEQ ID NO: 3364180 - RNA, 23 nt, Eastern equine encephalitis virus
ggaguugauuuggccuacaugag

SEQ ID NO: 3364181 - RNA, 16 nt, Eastern equine encephalitis virus
ggcaaagcaggcucuu

SEQ ID NO: 3364182 - RNA, 19 nt, Eastern equine encephalitis virus
ggcagaugacaccuugcaa

SEQ ID NO: 3364183 - RNA, 22 nt, Eastern equine encephalitis virus
ggcauagucggugcgacagccc

SEQ ID NO: 3364184 - RNA, 15 nt, Eastern equine encephalitis virus
ggcgcagagcucugc

SEQ ID NO: 3364185 - RNA, 23 nt, Eastern equine encephalitis virus
ggggcuuauugcuacagcagugg

SEQ ID NO: 3364186 - RNA, 17 nt, Eastern equine encephalitis virus
gguucaugggcaugaag

SEQ ID NO: 3364187 - RNA, 17 nt, Eastern equine encephalitis virus
guacaucaccugcaagu

SEQ ID NO: 3364188 - RNA, 14 nt, Eastern equine encephalitis virus
guagaaggcagaau

SEQ ID NO: 3364189 - RNA, 13 nt, Eastern equine encephalitis virus
caagccuccuggc

SEQ ID NO: 3364190 - RNA, 15 nt, Eastern equine encephalitis virus
caagccuccuggcuu

SEQ ID NO: 3364191 - RNA, 12 nt, Eastern equine encephalitis virus
caagcgugcaga

SEQ ID NO: 3364192 - RNA, 19 nt, Eastern equine encephalitis virus
caaguauaagacaaaagug

SEQ ID NO: 3364193 - RNA, 18 nt, Eastern equine encephalitis virus
caauuacacuacagguaa

SEQ ID NO: 3364194 - RNA, 13 nt, Eastern equine encephalitis virus
cacaaugcaugaa

SEQ ID NO: 3364195 - RNA, 13 nt, Eastern equine encephalitis virus
caccaccaccugc

SEQ ID NO: 3364196 - RNA, 17 nt, Eastern equine encephalitis virus
caccacuugcagcucaa

SEQ ID NO: 3364197 - RNA, 13 nt, Eastern equine encephalitis virus
cacccugcaugcc

SEQ ID NO: 3364198 - RNA, 18 nt, Eastern equine encephalitis virus
caccggcaaagcaggcuc

SEQ ID NO: 3364199 - RNA, 21 nt, Eastern equine encephalitis virus
caccugccaagaaacaaaaac

SEQ ID NO: 3364200 - RNA, 18 nt, Eastern equine encephalitis virus
caccuuucacccaggcgc

SEQ ID NO: 3364201 - RNA, 24 nt, Eastern equine encephalitis virus
cacggcuauuacauccuggcucaa

SEQ ID NO: 3364202 - RNA, 23 nt, Eastern equine encephalitis virus
cacgugguugaacauggaaguga

SEQ ID NO: 3364203 - RNA, 20 nt, Eastern equine encephalitis virus
cacuaaauucacccuaguuc

SEQ ID NO: 3364204 - RNA, 20 nt, Eastern equine encephalitis virus
cacuagugcaguuaccugca

SEQ ID NO: 3364205 - RNA, 17 nt, Eastern equine encephalitis virus
cacugaaaacacccaga

SEQ ID NO: 3364206 - RNA, 19 nt, Eastern equine encephalitis virus
cagaaaauugugcaguggg

SEQ ID NO: 3364207 - RNA, 15 nt, Eastern equine encephalitis virus
cagagcggugcgcca

SEQ ID NO: 3364208 - RNA, 17 nt, Eastern equine encephalitis virus
cagaggggucagagcca

SEQ ID NO: 3364209 - RNA, 19 nt, Eastern equine encephalitis virus
cagaggggucagagccaug

SEQ ID NO: 3364210 - RNA, 15 nt, Eastern equine encephalitis virus
cagauacccuccagu

SEQ ID NO: 3364211 - RNA, 20 nt, Eastern equine encephalitis virus
cagaugacaccuugcaagug

SEQ ID NO: 3364212 - RNA, 23 nt, Eastern equine encephalitis virus
cagcagcgacuauacaaccaccu

SEQ ID NO: 3364213 - RNA, 20 nt, Eastern equine encephalitis virus
caggagaagggaauccacau

SEQ ID NO: 3364214 - RNA, 15 nt, Eastern equine encephalitis virus
caggcacuguucagg

SEQ ID NO: 3364215 - RNA, 22 nt, Eastern equine encephalitis virus
caggcagcugauccacuugcaa

SEQ ID NO: 3364216 - RNA, 23 nt, Eastern equine encephalitis virus
caggcucuuuuggagaccugcaa

SEQ ID NO: 3364217 - RNA, 15 nt, Eastern equine encephalitis virus
cagguguugcaguua

SEQ ID NO: 3364218 - RNA, 16 nt, Eastern equine encephalitis virus
cagugcauaaggcugc

SEQ ID NO: 3364219 - RNA, 18 nt, Eastern equine encephalitis virus
cagugcauaaugcugcuc

SEQ ID NO: 3364220 - RNA, 19 nt, Eastern equine encephalitis virus
caguggugacauggaacca

SEQ ID NO: 3364221 - RNA, 19 nt, Eastern equine encephalitis virus
cauaacacuauaggcagug

SEQ ID NO: 3364222 - RNA, 19 nt, Eastern equine encephalitis virus
cauaacgccgccgaugcag

SEQ ID NO: 3364223 - RNA, 22 nt, Eastern equine encephalitis virus
cauaacgccgccgaugcagugc

SEQ ID NO: 3364224 - RNA, 21 nt, Eastern equine encephalitis virus
cauaaugcugcuccuaaguaa

SEQ ID NO: 3364225 - RNA, 15 nt, Eastern equine encephalitis virus
caucaagcugaagaa

SEQ ID NO: 3364226 - RNA, 15 nt, Eastern equine encephalitis virus
caucagguguugcag

SEQ ID NO: 3364227 - RNA, 14 nt, Eastern equine encephalitis virus
cauccacagugcca

SEQ ID NO: 3364228 - RNA, 15 nt, Eastern equine encephalitis virus
cauccagacaucagc

SEQ ID NO: 3364229 - RNA, 14 nt, Eastern equine encephalitis virus
caugucugcagaag

SEQ ID NO: 3364230 - RNA, 15 nt, Eastern equine encephalitis virus
caugucugcagaaga

SEQ ID NO: 3364231 - RNA, 15 nt, Eastern equine encephalitis virus
ccaaagaagcacagu

SEQ ID NO: 3364232 - RNA, 16 nt, Eastern equine encephalitis virus
ccaagccuaagccugc

SEQ ID NO: 3364233 - RNA, 21 nt, Eastern equine encephalitis virus
ccacaagcgugcagaccaagg

SEQ ID NO: 3364234 - RNA, 16 nt, Eastern equine encephalitis virus
ccacacuuuguuugac

SEQ ID NO: 3364235 - RNA, 12 nt, Eastern equine encephalitis virus
ccaccaccugcc

SEQ ID NO: 3364236 - RNA, 18 nt, Eastern equine encephalitis virus
ccaccacuugcagcucaa

SEQ ID NO: 3364237 - RNA, 20 nt, Eastern equine encephalitis virus
ccacgcuggcaccagagccu

SEQ ID NO: 3364238 - RNA, 18 nt, Eastern equine encephalitis virus
ccagaggggucagagcca

SEQ ID NO: 3364239 - RNA, 22 nt, Eastern equine encephalitis virus
ccaggacggcucuaucaguggu

SEQ ID NO: 3364240 - RNA, 20 nt, Eastern equine encephalitis virus
ccaggggacacgguuacagu

SEQ ID NO: 3364241 - RNA, 21 nt, Eastern equine encephalitis virus
ccaguguuggauucagcugcc

SEQ ID NO: 3364242 - RNA, 20 nt, Eastern equine encephalitis virus
ccaugugaucaaccacccug

SEQ ID NO: 3364243 - RNA, 20 nt, Eastern equine encephalitis virus
ccauucgauaacaagguggu

SEQ ID NO: 3364244 - RNA, 14 nt, Eastern equine encephalitis virus
cccauucauguggg

SEQ ID NO: 3364245 - RNA, 15 nt, Eastern equine encephalitis virus
ccguauauugcugau

SEQ ID NO: 3364246 - RNA, 19 nt, Eastern equine encephalitis virus
ccuauggcgccgauuaacc

SEQ ID NO: 3364247 - RNA, 14 nt, Eastern equine encephalitis virus
ccuccagcaggacc

SEQ ID NO: 3364248 - RNA, 13 nt, Eastern equine encephalitis virus
ccugcaacaaaaa

SEQ ID NO: 3364249 - RNA, 20 nt, Eastern equine encephalitis virus
ccuggaguacaucaccugca

SEQ ID NO: 3364250 - RNA, 13 nt, Eastern equine encephalitis virus
cgacaaccugcau

SEQ ID NO: 3364251 - RNA, 17 nt, Eastern equine encephalitis virus
cgagacgggacaagggc

SEQ ID NO: 3364252 - RNA, 19 nt, Eastern equine encephalitis virus
cgagccuaugaucagcugc

SEQ ID NO: 3364253 - RNA, 15 nt, Eastern equine encephalitis virus
cgaucagcagugcca

SEQ ID NO: 3364254 - RNA, 23 nt, Eastern equine encephalitis virus
cgauuucggugguauagccaccg

SEQ ID NO: 3364255 - RNA, 15 nt, Eastern equine encephalitis virus
cgcaccucagccccu

SEQ ID NO: 3364256 - RNA, 14 nt, Eastern equine encephalitis virus
cgcacugauggcag

SEQ ID NO: 3364257 - RNA, 23 nt, Eastern equine encephalitis virus
cgcauauacaauuacacuacagg

SEQ ID NO: 3364258 - RNA, 15 nt, Eastern equine encephalitis virus
cgccgaugcagugca

SEQ ID NO: 3364259 - RNA, 19 nt, Eastern equine encephalitis virus
cgggacaagggcaccugca

SEQ ID NO: 3364260 - RNA, 17 nt, Eastern equine encephalitis virus
cgugcagaccaaggaca

SEQ ID NO: 3364261 - RNA, 14 nt, Eastern equine encephalitis virus
cuaaauaucagaga

SEQ ID NO: 3364262 - RNA, 13 nt, Eastern equine encephalitis virus
cuacaagacaaac

SEQ ID NO: 3364263 - RNA, 13 nt, Eastern equine encephalitis virus
cuacagcaguggu

SEQ ID NO: 3364264 - RNA, 22 nt, Eastern equine encephalitis virus
cuaccagcagcgacuauacaac

SEQ ID NO: 3364265 - RNA, 16 nt, Eastern equine encephalitis virus
cuauaaacacuacagg

SEQ ID NO: 3364266 - RNA, 21 nt, Eastern equine encephalitis virus
cuauagaagaagucagagggg

SEQ ID NO: 3364267 - RNA, 14 nt, Eastern equine encephalitis virus
cuaucaucaugguc

SEQ ID NO: 3364268 - RNA, 16 nt, Eastern equine encephalitis virus
cuaucauugcagaaca

SEQ ID NO: 3364269 - RNA, 16 nt, Eastern equine encephalitis virus
cuaugaucagcugcuc

SEQ ID NO: 3364270 - RNA, 14 nt, Eastern equine encephalitis virus
agcuggagaucugc

SEQ ID NO: 3364271 - RNA, 20 nt, Eastern equine encephalitis virus
aggaaaacuucaugugcccu

SEQ ID NO: 3364272 - RNA, 20 nt, Eastern equine encephalitis virus
aggagucauccgcauccaga

SEQ ID NO: 3364273 - RNA, 17 nt, Eastern equine encephalitis virus
aggcguauguagagcgc

SEQ ID NO: 3364274 - RNA, 21 nt, Eastern equine encephalitis virus
aggcugcuauauuaccacauu

SEQ ID NO: 3364275 - RNA, 21 nt, Eastern equine encephalitis virus
aggggaugcgcacgcaggagu

SEQ ID NO: 3364276 - RNA, 14 nt, Eastern equine encephalitis virus
agguguugcaguua

SEQ ID NO: 3364277 - RNA, 15 nt, Eastern equine encephalitis virus
agguguuuacccauu

SEQ ID NO: 3364278 - RNA, 16 nt, Eastern equine encephalitis virus
aguacaucaccugcaa

SEQ ID NO: 3364279 - RNA, 17 nt, Eastern equine encephalitis virus
aguagagaacaugaagg

SEQ ID NO: 3364280 - RNA, 23 nt, Eastern equine encephalitis virus
aguauaccuggggaaaccaucca

SEQ ID NO: 3364281 - RNA, 21 nt, Eastern equine encephalitis virus
aguaugggcucaagagucagg

SEQ ID NO: 3364282 - RNA, 21 nt, Eastern equine encephalitis virus
agucucguaaaguagagaaca

SEQ ID NO: 3364283 - RNA, 13 nt, Eastern equine encephalitis virus
agugaaaugcugc

SEQ ID NO: 3364284 - RNA, 17 nt, Eastern equine encephalitis virus
agugcauaaugcugcuc

SEQ ID NO: 3364285 - RNA, 18 nt, Eastern equine encephalitis virus
agugcaucgccacgcugg

SEQ ID NO: 3364286 - RNA, 21 nt, Eastern equine encephalitis virus
aguugagcacaaacaccgcac

SEQ ID NO: 3364287 - RNA, 20 nt, Eastern equine encephalitis virus
aguugauuuggccuacauga

SEQ ID NO: 3364288 - RNA, 16 nt, Eastern equine encephalitis virus
auacgaucagcagugc

SEQ ID NO: 3364289 - RNA, 18 nt, Eastern equine encephalitis virus
cacacaggcacuguucag

SEQ ID NO: 3364290 - RNA, 15 nt, Eastern equine encephalitis virus
cacagcagugaugcc

SEQ ID NO: 3364291 - RNA, 21 nt, Eastern equine encephalitis virus
cacaggcacuguucaggcaau

SEQ ID NO: 3364292 - RNA, 13 nt, Eastern equine encephalitis virus
cacagugccaagg

SEQ ID NO: 3364293 - RNA, 11 nt, Eastern equine encephalitis virus
caccaccugcc

SEQ ID NO: 3364294 - RNA, 13 nt, Eastern equine encephalitis virus
caccaccugccaa

SEQ ID NO: 3364295 - RNA, 20 nt, Eastern equine encephalitis virus
caccagaggggucagagcca

SEQ ID NO: 3364296 - RNA, 21 nt, Eastern equine encephalitis virus
cacccacaagcgugcagacca

SEQ ID NO: 3364297 - RNA, 17 nt, Eastern equine encephalitis virus
cacccaccugaacaugg

SEQ ID NO: 3364298 - RNA, 13 nt, Eastern equine encephalitis virus
cacgcaaaagcuu

SEQ ID NO: 3364299 - RNA, 22 nt, Eastern equine encephalitis virus
cacuaaauucacccuaguucga

SEQ ID NO: 3364300 - RNA, 16 nt, Eastern equine encephalitis virus
cagagcucugcaugau

SEQ ID NO: 3364301 - RNA, 15 nt, Eastern equine encephalitis virus
cagccauugcaugag

SEQ ID NO: 3364302 - RNA, 17 nt, Eastern equine encephalitis virus
cagcgaauguguaugaa

SEQ ID NO: 3364303 - RNA, 19 nt, Eastern equine encephalitis virus
cagcuggagaucugcagau

SEQ ID NO: 3364304 - RNA, 13 nt, Eastern equine encephalitis virus
caggccagugggu

SEQ ID NO: 3364305 - RNA, 22 nt, Eastern equine encephalitis virus
caggccaguggguagagagaaa

SEQ ID NO: 3364306 - RNA, 20 nt, Eastern equine encephalitis virus
caggcucuuuuggagaccug

SEQ ID NO: 3364307 - RNA, 19 nt, Eastern equine encephalitis virus
caggcugguaucgugcaca

SEQ ID NO: 3364308 - RNA, 17 nt, Eastern equine encephalitis virus
caguguauaaggcuguc

SEQ ID NO: 3364309 - RNA, 18 nt, Eastern equine encephalitis virus
cauaagaggucaccccau

SEQ ID NO: 3364310 - RNA, 24 nt, Eastern equine encephalitis virus
cauaaugcugucuuuuauaucaau

SEQ ID NO: 3364311 - RNA, 21 nt, Eastern equine encephalitis virus
cauaauugccgcauauacaau

SEQ ID NO: 3364312 - RNA, 18 nt, Eastern equine encephalitis virus
cauaucucucugcagaac

SEQ ID NO: 3364313 - RNA, 18 nt, Eastern equine encephalitis virus
caucagguguugcaguua

SEQ ID NO: 3364314 - RNA, 14 nt, Eastern equine encephalitis virus
ccaaagaagcacag

SEQ ID NO: 3364315 - RNA, 14 nt, Eastern equine encephalitis virus
ccaagaaacaaaaa

SEQ ID NO: 3364316 - RNA, 14 nt, Eastern equine encephalitis virus
ccacaagcgugcag

SEQ ID NO: 3364317 - RNA, 18 nt, Eastern equine encephalitis virus
ccacaagcgugcagacca

SEQ ID NO: 3364318 - RNA, 14 nt, Eastern equine encephalitis virus
ccaccaccaccugc

SEQ ID NO: 3364319 - RNA, 15 nt, Eastern equine encephalitis virus
ccaccguagccagcu

SEQ ID NO: 3364320 - RNA, 22 nt, Eastern equine encephalitis virus
ccauaagguagaauucaggcca

SEQ ID NO: 3364321 - RNA, 21 nt, Eastern equine encephalitis virus
ccauggucgcuugccacuguc

SEQ ID NO: 3364322 - RNA, 16 nt, Eastern equine encephalitis virus
ccauguuggaacagaa

SEQ ID NO: 3364323 - RNA, 23 nt, Eastern equine encephalitis virus
cccauguauucaaguacugcaag

SEQ ID NO: 3364324 - RNA, 23 nt, Eastern equine encephalitis virus
cccgccaaacgcaagaagccugc

SEQ ID NO: 3364325 - RNA, 20 nt, Eastern equine encephalitis virus
cccguauauugcugauugcc

SEQ ID NO: 3364326 - RNA, 19 nt, Eastern equine encephalitis virus
ccgaccuugcugacgacca

SEQ ID NO: 3364327 - RNA, 12 nt, Eastern equine encephalitis virus
ccggcaaagcag

SEQ ID NO: 3364328 - RNA, 11 nt, Eastern equine encephalitis virus
ccgucacccac

SEQ ID NO: 3364329 - RNA, 17 nt, Eastern equine encephalitis virus
ccuauaaacacuacagg

SEQ ID NO: 3364330 - RNA, 14 nt, Eastern equine encephalitis virus
ccucgugucgcacc

SEQ ID NO: 3364331 - RNA, 14 nt, Eastern equine encephalitis virus
ccugcuguuuagau

SEQ ID NO: 3364332 - RNA, 16 nt, Eastern equine encephalitis virus
ccuggguggagucaac

SEQ ID NO: 3364333 - RNA, 15 nt, Eastern equine encephalitis virus
ccuuagcauccacag

SEQ ID NO: 3364334 - RNA, 20 nt, Eastern equine encephalitis virus
cgacuauacaaccaccugca

SEQ ID NO: 3364335 - RNA, 21 nt, Eastern equine encephalitis virus
cgacuauacaaccaccugcac

SEQ ID NO: 3364336 - RNA, 17 nt, Eastern equine encephalitis virus
cgauugcccuggagccg

SEQ ID NO: 3364337 - RNA, 20 nt, Eastern equine encephalitis virus
cgauugcccuggagccgcuc

SEQ ID NO: 3364338 - RNA, 16 nt, Eastern equine encephalitis virus
cgcaaucuuugcauaa

SEQ ID NO: 3364339 - RNA, 14 nt, Eastern equine encephalitis virus
cgcccaagugaaau

SEQ ID NO: 3364340 - RNA, 20 nt, Eastern equine encephalitis virus
cgcggugcuagagacagaca

SEQ ID NO: 3364341 - RNA, 21 nt, Eastern equine encephalitis virus
cgcugcuuauuuugcuguggg

SEQ ID NO: 3364342 - RNA, 19 nt, Eastern equine encephalitis virus
cgcuuauuguaugcaugcg

SEQ ID NO: 3364343 - RNA, 16 nt, Eastern equine encephalitis virus
cgucacucuugcugag

SEQ ID NO: 3364344 - RNA, 18 nt, Eastern equine encephalitis virus
cguguggcuccuuugcag

SEQ ID NO: 3364345 - RNA, 12 nt, Eastern equine encephalitis virus
cuaaccuggagu

SEQ ID NO: 3364346 - RNA, 20 nt, Eastern equine encephalitis virus
cuaaccuggaguacaucacc

SEQ ID NO: 3364347 - RNA, 16 nt, Eastern equine encephalitis virus
cuacugcaagugccca

SEQ ID NO: 3364348 - RNA, 15 nt, Eastern equine encephalitis virus
cuagcagcagccacg

SEQ ID NO: 3364349 - RNA, 21 nt, Eastern equine encephalitis virus
cuauaaacacuacaggcagcg

SEQ ID NO: 3364350 - RNA, 14 nt, Eastern equine encephalitis virus
cuauucuugacaac

SEQ ID NO: 3364351 - RNA, 15 nt, Eastern equine encephalitis virus
cucaccauguuggaa

SEQ ID NO: 3364352 - RNA, 22 nt, Eastern equine encephalitis virus
cuccuaaguaauuuaauacaca

SEQ ID NO: 3364353 - RNA, 14 nt, Eastern equine encephalitis virus
cuccuauaaacacu

SEQ ID NO: 3364354 - RNA, 11 nt, Eastern equine encephalitis virus
cucugcaugau

SEQ ID NO: 3364355 - RNA, 20 nt, Eastern equine encephalitis virus
cugaagguaaucggagcagg

SEQ ID NO: 3364356 - RNA, 21 nt, Eastern equine encephalitis virus
cugacgcacugauggcagagc

SEQ ID NO: 3364357 - RNA, 16 nt, Eastern equine encephalitis virus
cugcaaguauaagaca

SEQ ID NO: 3364358 - RNA, 19 nt, Eastern equine encephalitis virus
cugcacuagugcaguuacc

SEQ ID NO: 3364359 - RNA, 20 nt, Eastern equine encephalitis virus
cugcuaccgaauauccacac

SEQ ID NO: 3364360 - RNA, 17 nt, Eastern equine encephalitis virus
cgcagagcucugcauga

SEQ ID NO: 3364361 - RNA, 20 nt, Eastern equine encephalitis virus
cgcagagcucugcaugauga

SEQ ID NO: 3364362 - RNA, 21 nt, Eastern equine encephalitis virus
cgcuggcaccagagccucuag

SEQ ID NO: 3364363 - RNA, 17 nt, Eastern equine encephalitis virus
cggcucuaucaguggug

SEQ ID NO: 3364364 - RNA, 18 nt, Eastern equine encephalitis virus
cgggacaagggcaccugc

SEQ ID NO: 3364365 - RNA, 14 nt, Eastern equine encephalitis virus
cggugcgacagccc

SEQ ID NO: 3364366 - RNA, 14 nt, Eastern equine encephalitis virus
cguauauugcugau

SEQ ID NO: 3364367 - RNA, 22 nt, Eastern equine encephalitis virus
cgucacccaccugaacauggag

SEQ ID NO: 3364368 - RNA, 21 nt, Eastern equine encephalitis virus
cgugagaagcuguugcagaag

SEQ ID NO: 3364369 - RNA, 15 nt, Eastern equine encephalitis virus
cgugcagaccaagga

SEQ ID NO: 3364370 - RNA, 13 nt, Eastern equine encephalitis virus
cuaagggcagugc

SEQ ID NO: 3364371 - RNA, 15 nt, Eastern equine encephalitis virus
cuagagucagauaaa

SEQ ID NO: 3364372 - RNA, 16 nt, Eastern equine encephalitis virus
cuaggagaaccaggag

SEQ ID NO: 3364373 - RNA, 17 nt, Eastern equine encephalitis virus
cuauacaaccaccugca

SEQ ID NO: 3364374 - RNA, 15 nt, Eastern equine encephalitis virus
cuaucauugcagaac

SEQ ID NO: 3364375 - RNA, 16 nt, Eastern equine encephalitis virus
cuauucuugacaacaa

SEQ ID NO: 3364376 - RNA, 16 nt, Eastern equine encephalitis virus
cucaaugcccaccagg

SEQ ID NO: 3364377 - RNA, 19 nt, Eastern equine encephalitis virus
cucaaugcccaccagggga

SEQ ID NO: 3364378 - RNA, 13 nt, Eastern equine encephalitis virus
cucagaccuggaa

SEQ ID NO: 3364379 - RNA, 15 nt, Eastern equine encephalitis virus
cuccaguagugaaau

SEQ ID NO: 3364380 - RNA, 23 nt, Eastern equine encephalitis virus
cucgacaauggauugagcgacca

SEQ ID NO: 3364381 - RNA, 20 nt, Eastern equine encephalitis virus
cucuggaagacugccucgag

SEQ ID NO: 3364382 - RNA, 20 nt, Eastern equine encephalitis virus
cugaaaacacccagaugagc

SEQ ID NO: 3364383 - RNA, 12 nt, Eastern equine encephalitis virus
cugcaaguauaa

SEQ ID NO: 3364384 - RNA, 14 nt, Eastern equine encephalitis virus
cuggcaccauggag

SEQ ID NO: 3364385 - RNA, 12 nt, Eastern equine encephalitis virus
cuggggaaacca

SEQ ID NO: 3364386 - RNA, 19 nt, Eastern equine encephalitis virus
cugucaugugcguccuggc

SEQ ID NO: 3364387 - RNA, 20 nt, Eastern equine encephalitis virus
cuucugcgacacugaaaaca

SEQ ID NO: 3364388 - RNA, 13 nt, Eastern equine encephalitis virus
cuugccacuguca

SEQ ID NO: 3364389 - RNA, 21 nt, Eastern equine encephalitis virus
cuuuuggagaccugcaaucac

SEQ ID NO: 3364390 - RNA, 15 nt, Eastern equine encephalitis virus
gaaagggguuacauc

SEQ ID NO: 3364391 - RNA, 16 nt, Eastern equine encephalitis virus
gaauuacgacagccga

SEQ ID NO: 3364392 - RNA, 17 nt, Eastern equine encephalitis virus
gaauucaggccaguggg

SEQ ID NO: 3364393 - RNA, 17 nt, Eastern equine encephalitis virus
gacaacaucgugaaagg

SEQ ID NO: 3364394 - RNA, 16 nt, Eastern equine encephalitis virus
gacaaugagcaacugg

SEQ ID NO: 3364395 - RNA, 19 nt, Eastern equine encephalitis virus
gacacugaaaacacccaga

SEQ ID NO: 3364396 - RNA, 15 nt, Eastern equine encephalitis virus
gacaggcgcagagcu

SEQ ID NO: 3364397 - RNA, 12 nt, Eastern equine encephalitis virus
gacgcggugcua

SEQ ID NO: 3364398 - RNA, 20 nt, Eastern equine encephalitis virus
gagaaauaccgucacccacc

SEQ ID NO: 3364399 - RNA, 14 nt, Eastern equine encephalitis virus
gaggggucagagcc

SEQ ID NO: 3364400 - RNA, 21 nt, Eastern equine encephalitis virus
gaucaaccacccugcaugcca

SEQ ID NO: 3364401 - RNA, 20 nt, Eastern equine encephalitis virus
gauccuaauccgccuaggcg

SEQ ID NO: 3364402 - RNA, 17 nt, Eastern equine encephalitis virus
gcaaaacgcagaaauca

SEQ ID NO: 3364403 - RNA, 15 nt, Eastern equine encephalitis virus
gcacguagaaggcag

SEQ ID NO: 3364404 - RNA, 17 nt, Eastern equine encephalitis virus
aaacacauaagagguca

SEQ ID NO: 3364405 - RNA, 22 nt, Eastern equine encephalitis virus
aaacaccgacagucucagaccu

SEQ ID NO: 3364406 - RNA, 18 nt, Eastern equine encephalitis virus
aaacacuaaauucacccu

SEQ ID NO: 3364407 - RNA, 17 nt, Eastern equine encephalitis virus
aaacacuacaggcagcg

SEQ ID NO: 3364408 - RNA, 18 nt, Eastern equine encephalitis virus
aaacguuuccaaucaugu

SEQ ID NO: 3364409 - RNA, 15 nt, Eastern equine encephalitis virus
aaaguacacacaggc

SEQ ID NO: 3364410 - RNA, 20 nt, Eastern equine encephalitis virus
aaaguucaggugauacaggc

SEQ ID NO: 3364411 - RNA, 15 nt, Eastern equine encephalitis virus
aacauacugaagaaa

SEQ ID NO: 3364412 - RNA, 14 nt, Eastern equine encephalitis virus
aaccacauaacacu

SEQ ID NO: 3364413 - RNA, 12 nt, Eastern equine encephalitis virus
aacccuccagca

SEQ ID NO: 3364414 - RNA, 15 nt, Eastern equine encephalitis virus
aaccuaaaccaggca

SEQ ID NO: 3364415 - RNA, 13 nt, Eastern equine encephalitis virus
aacggacagguga

SEQ ID NO: 3364416 - RNA, 13 nt, Eastern equine encephalitis virus
aagaaacaaaaac

SEQ ID NO: 3364417 - RNA, 19 nt, Eastern equine encephalitis virus
aagaauccacacgaaacac

SEQ ID NO: 3364418 - RNA, 20 nt, Eastern equine encephalitis virus
aagaucgacaaccugcaugu

SEQ ID NO: 3364419 - RNA, 13 nt, Eastern equine encephalitis virus
aagggcaccugca

SEQ ID NO: 3364420 - RNA, 19 nt, Eastern equine encephalitis virus
aauaucacguuuccaugug

SEQ ID NO: 3364421 - RNA, 19 nt, Eastern equine encephalitis virus
aaugagggaacuuccagug

SEQ ID NO: 3364422 - RNA, 19 nt, Eastern equine encephalitis virus
aaugcuaggagaaccagga

SEQ ID NO: 3364423 - RNA, 22 nt, Eastern equine encephalitis virus
aauugccgcauauacaauuaca

SEQ ID NO: 3364424 - RNA, 21 nt, Eastern equine encephalitis virus
acaagcgugcagaccaaggac

SEQ ID NO: 3364425 - RNA, 13 nt, Eastern equine encephalitis virus
acaaugcaugaaa

SEQ ID NO: 3364426 - RNA, 16 nt, Eastern equine encephalitis virus
acaauuacacuacagg

SEQ ID NO: 3364427 - RNA, 21 nt, Eastern equine encephalitis virus
acacgaaacacucaccauguu

SEQ ID NO: 3364428 - RNA, 14 nt, Eastern equine encephalitis virus
acacuacguugaga

SEQ ID NO: 3364429 - RNA, 21 nt, Eastern equine encephalitis virus
acaggcgcagagcucugcaug

SEQ ID NO: 3364430 - RNA, 17 nt, Eastern equine encephalitis virus
accaccaccaccugcca

SEQ ID NO: 3364431 - RNA, 16 nt, Eastern equine encephalitis virus
aacacgcuccaagaug

SEQ ID NO: 3364432 - RNA, 14 nt, Eastern equine encephalitis virus
aacauaacaucugu

SEQ ID NO: 3364433 - RNA, 23 nt, Eastern equine encephalitis virus
aacucaucauagguccacuguca

SEQ ID NO: 3364434 - RNA, 13 nt, Eastern equine encephalitis virus
aagagucaggaga

SEQ ID NO: 3364435 - RNA, 23 nt, Eastern equine encephalitis virus
aagcaucccuauaucuauagaua

SEQ ID NO: 3364436 - RNA, 16 nt, Eastern equine encephalitis virus
aagcugaagaaggcca

SEQ ID NO: 3364437 - RNA, 16 nt, Eastern equine encephalitis virus
aauacuacugcaagug

SEQ ID NO: 3364438 - RNA, 16 nt, Eastern equine encephalitis virus
aaugcugucuuuuaua

SEQ ID NO: 3364439 - RNA, 13 nt, Eastern equine encephalitis virus
acaaccugcaugu

SEQ ID NO: 3364440 - RNA, 18 nt, Eastern equine encephalitis virus
acaacgagcaccuaaccc

SEQ ID NO: 3364441 - RNA, 19 nt, Eastern equine encephalitis virus
acaagcgugcagaccaagg

SEQ ID NO: 3364442 - RNA, 23 nt, Eastern equine encephalitis virus
acaccagugacaagccuccuggc

SEQ ID NO: 3364443 - RNA, 17 nt, Eastern equine encephalitis virus
acacgaaacacucacca

SEQ ID NO: 3364444 - RNA, 17 nt, Eastern equine encephalitis virus
acacuaagggcagugca

SEQ ID NO: 3364445 - RNA, 20 nt, Eastern equine encephalitis virus
acacucuuuaucaauacugu

SEQ ID NO: 3364446 - RNA, 21 nt, Eastern equine encephalitis virus
acagcugguuaauaccaggau

SEQ ID NO: 3364447 - RNA, 22 nt, Eastern equine encephalitis virus
acaggcagcgcauaaugcuguc

SEQ ID NO: 3364448 - RNA, 22 nt, Eastern equine encephalitis virus
acaggcgcagagcucugcauga

SEQ ID NO: 3364449 - RNA, 21 nt, Eastern equine encephalitis virus
acauuccacuucuccacugca

SEQ ID NO: 3364450 - RNA, 16 nt, Eastern equine encephalitis virus
accacauuauaacacu

SEQ ID NO: 3364451 - RNA, 20 nt, Eastern equine encephalitis virus
accacggcuauuacauccug

SEQ ID NO: 3364452 - RNA, 22 nt, Eastern equine encephalitis virus
accagaggggucagagccaugg

SEQ ID NO: 3364453 - RNA, 16 nt, Eastern equine encephalitis virus
acccgaccuugcugac

SEQ ID NO: 3364454 - RNA, 16 nt, Eastern equine encephalitis virus
accgaaagaccacauc

SEQ ID NO: 3364455 - RNA, 16 nt, Eastern equine encephalitis virus
accuaguacugcaaga

SEQ ID NO: 3364456 - RNA, 16 nt, Eastern equine encephalitis virus
acuauacaaccaccug

SEQ ID NO: 3364457 - RNA, 16 nt, Eastern equine encephalitis virus
acugcaagcaacagcu

SEQ ID NO: 3364458 - RNA, 20 nt, Eastern equine encephalitis virus
acuguucaggcaauggugaa

SEQ ID NO: 3364459 - RNA, 21 nt, Eastern equine encephalitis virus
acuuacagccauugcaugaga

SEQ ID NO: 3364460 - RNA, 16 nt, Eastern equine encephalitis virus
agaccuauucuugaca

SEQ ID NO: 3364461 - RNA, 23 nt, Eastern equine encephalitis virus
agacgcuuaucccacuugcagcg

SEQ ID NO: 3364462 - RNA, 23 nt, Eastern equine encephalitis virus
agagauuuggacacucauuucac

SEQ ID NO: 3364463 - RNA, 13 nt, Eastern equine encephalitis virus
agaggggaugcgc

SEQ ID NO: 3364464 - RNA, 16 nt, Eastern equine encephalitis virus
agauacgaucagcagu

SEQ ID NO: 3364465 - RNA, 17 nt, Eastern equine encephalitis virus
agauacgaucagcagug

SEQ ID NO: 3364466 - RNA, 13 nt, Eastern equine encephalitis virus
agcaacgaucugu

SEQ ID NO: 3364467 - RNA, 17 nt, Eastern equine encephalitis virus
agcaacuggccgccauc

SEQ ID NO: 3364468 - RNA, 17 nt, Eastern equine encephalitis virus
agcgcauaaugcugucu

SEQ ID NO: 3364469 - RNA, 20 nt, Eastern equine encephalitis virus
agcuauguucggucugaaga

SEQ ID NO: 3364470 - RNA, 17 nt, Eastern equine encephalitis virus
agcuguacaguaugaga

SEQ ID NO: 3364471 - RNA, 17 nt, Eastern equine encephalitis virus
aggcagcgcauaaugcu

SEQ ID NO: 3364472 - RNA, 18 nt, Eastern equine encephalitis virus
aggccaagugcaucgcca

SEQ ID NO: 3364473 - RNA, 19 nt, Eastern equine encephalitis virus
aggcucuuuuggagaccug

SEQ ID NO: 3364474 - RNA, 18 nt, Eastern equine encephalitis virus
agggacccaaagcagcug

SEQ ID NO: 3364475 - RNA, 12 nt, Eastern equine encephalitis virus
agggcagugcau

SEQ ID NO: 3364476 - RNA, 18 nt, Eastern equine encephalitis virus
agggcagugcauaaugcu

SEQ ID NO: 3364477 - RNA, 17 nt, Eastern equine encephalitis virus
agguugugcauuaguau

SEQ ID NO: 3364478 - RNA, 16 nt, Eastern equine encephalitis virus
agugacaagccuccug

SEQ ID NO: 3364479 - RNA, 12 nt, Eastern equine encephalitis virus
agugcauaaggc

SEQ ID NO: 3364480 - RNA, 15 nt, Eastern equine encephalitis virus
agugcauaaggcugc

SEQ ID NO: 3364481 - RNA, 23 nt, Eastern equine encephalitis virus
aguggccgucaaaguuugcaacc

SEQ ID NO: 3364482 - RNA, 17 nt, Eastern equine encephalitis virus
aguguauaaggcugucu

SEQ ID NO: 3364483 - RNA, 22 nt, Eastern equine encephalitis virus
aguugauuuggccuacaugagu

SEQ ID NO: 3364484 - RNA, 16 nt, Eastern equine encephalitis virus
auaacauaacggauga

SEQ ID NO: 3364485 - RNA, 22 nt, Eastern equine encephalitis virus
auaacuggcaccauggagcugu

SEQ ID NO: 3364486 - RNA, 21 nt, Eastern equine encephalitis virus
auacaccagaggggucagagc

SEQ ID NO: 3364487 - RNA, 14 nt, Eastern equine encephalitis virus
auacaggcagcuga

SEQ ID NO: 3364488 - RNA, 12 nt, Eastern equine encephalitis virus
auagacauuaac

SEQ ID NO: 3364489 - RNA, 23 nt, Eastern equine encephalitis virus
aucaaaacuuuuucuggaugcag

SEQ ID NO: 3364490 - RNA, 13 nt, Eastern equine encephalitis virus
aucaucgaugcag

SEQ ID NO: 3364491 - RNA, 22 nt, Eastern equine encephalitis virus
auccauccugcuuuuaagcugc

SEQ ID NO: 3364492 - RNA, 14 nt, Eastern equine encephalitis virus
augaaggcaaucac

SEQ ID NO: 3364493 - RNA, 13 nt, Eastern equine encephalitis virus
augaucagcugcu

SEQ ID NO: 3364494 - RNA, 16 nt, Eastern equine encephalitis virus
augauucuugaagacc

SEQ ID NO: 3364495 - RNA, 19 nt, Eastern equine encephalitis virus
augcaaccguuacacccac

SEQ ID NO: 3364496 - RNA, 16 nt, Eastern equine encephalitis virus
augccgaacaaggugg

SEQ ID NO: 3364497 - RNA, 16 nt, Eastern equine encephalitis virus
augcuguuaugaaaag

SEQ ID NO: 3364498 - RNA, 17 nt, Eastern equine encephalitis virus
guagagaacaugaaggc

SEQ ID NO: 3364499 - RNA, 17 nt, Eastern equine encephalitis virus
guagagcgcucggaaga

SEQ ID NO: 3364500 - RNA, 14 nt, Eastern equine encephalitis virus
guaugaugccuauc

SEQ ID NO: 3364501 - RNA, 13 nt, Eastern equine encephalitis virus
gucaauggugaaa

SEQ ID NO: 3364502 - RNA, 13 nt, Eastern equine encephalitis virus
gucacccaccuga

SEQ ID NO: 3364503 - RNA, 15 nt, Eastern equine encephalitis virus
gucacuaaucaucac

SEQ ID NO: 3364504 - RNA, 16 nt, Eastern equine encephalitis virus
gucgcaauuguccugg

SEQ ID NO: 3364505 - RNA, 20 nt, Eastern equine encephalitis virus
gucucguaaaguagagaaca

SEQ ID NO: 3364506 - RNA, 13 nt, Eastern equine encephalitis virus
gugaaaugcugcg

SEQ ID NO: 3364507 - RNA, 23 nt, Eastern equine encephalitis virus
gugcugcuaccgaauauccacac

SEQ ID NO: 3364508 - RNA, 16 nt, Eastern equine encephalitis virus
guguucaaaccgcugc

SEQ ID NO: 3364509 - RNA, 20 nt, Eastern equine encephalitis virus
guugaccacuucccccugcg

SEQ ID NO: 3364510 - RNA, 16 nt, Eastern equine encephalitis virus
guugucaauaucauga

SEQ ID NO: 3364511 - RNA, 21 nt, Eastern equine encephalitis virus
guuuccaugugaucaaccacc

SEQ ID NO: 3364512 - RNA, 12 nt, Eastern equine encephalitis virus
uaaaccuaaacc

SEQ ID NO: 3364513 - RNA, 19 nt, Eastern equine encephalitis virus
uacaacucuggaagacugc

SEQ ID NO: 3364514 - RNA, 21 nt, Eastern equine encephalitis virus
uacaauuacacuacagguaau

SEQ ID NO: 3364515 - RNA, 17 nt, Eastern equine encephalitis virus
uaccacauuauaacacu

SEQ ID NO: 3364516 - RNA, 22 nt, Eastern equine encephalitis virus
uaccagaauaucugaaacaccg

SEQ ID NO: 3364517 - RNA, 17 nt, Eastern equine encephalitis virus
uacgacuuuccugagua

SEQ ID NO: 3364518 - RNA, 22 nt, Eastern equine encephalitis virus
uacuaaacacuaaauucacccu

SEQ ID NO: 3364519 - RNA, 22 nt, Eastern equine encephalitis virus
uagagagaaauaccgucaccca

SEQ ID NO: 3364520 - RNA, 23 nt, Eastern equine encephalitis virus
uagguccacugucaucugcgugg

SEQ ID NO: 3364521 - RNA, 17 nt, Eastern equine encephalitis virus
uaucagagauguuccca

SEQ ID NO: 3364522 - RNA, 22 nt, Eastern equine encephalitis virus
uauggugaugugccacaaugca

SEQ ID NO: 3364523 - RNA, 13 nt, Eastern equine encephalitis virus
uauuacuacaaca

SEQ ID NO: 3364524 - RNA, 14 nt, Eastern equine encephalitis virus
ucaagcugaagaag

SEQ ID NO: 3364525 - RNA, 19 nt, Eastern equine encephalitis virus
ucaauaaagaucgacaacc

SEQ ID NO: 3364526 - RNA, 22 nt, Eastern equine encephalitis virus
ucagcuauguucggucugaaga

SEQ ID NO: 3364527 - RNA, 16 nt, Eastern equine encephalitis virus
ucaucagcagaagugg

SEQ ID NO: 3364528 - RNA, 19 nt, Eastern equine encephalitis virus
ucccgcgaaaauaggagau

SEQ ID NO: 3364529 - RNA, 15 nt, Eastern equine encephalitis virus
uccgccacugcgugg

SEQ ID NO: 3364530 - RNA, 14 nt, Eastern equine encephalitis virus
uccuauaaacacua

SEQ ID NO: 3364531 - RNA, 17 nt, Eastern equine encephalitis virus
uccugcucccauguauu

SEQ ID NO: 3364532 - RNA, 15 nt, Eastern equine encephalitis virus
uccuuagcauccaca

SEQ ID NO: 3364533 - RNA, 22 nt, Eastern equine encephalitis virus
ucgaggagagggcgacacuuuu

SEQ ID NO: 3364534 - RNA, 12 nt, Eastern equine encephalitis virus
ucgcuugccacu

SEQ ID NO: 3364535 - RNA, 20 nt, Eastern equine encephalitis virus
ugaacauggaagugaagauc

SEQ ID NO: 3364536 - RNA, 15 nt, Eastern equine encephalitis virus
ugcaagcaacagcuu

SEQ ID NO: 3364537 - RNA, 19 nt, Eastern equine encephalitis virus
ugcacacaccuuucaccca

SEQ ID NO: 3364538 - RNA, 22 nt, Eastern equine encephalitis virus
ugcaggucugcacuagugcagu

SEQ ID NO: 3364539 - RNA, 14 nt, Eastern equine encephalitis virus
ugcaguuaccugca

SEQ ID NO: 3364540 - RNA, 14 nt, Eastern equine encephalitis virus
ugcauaaugcugcu

SEQ ID NO: 3364541 - RNA, 15 nt, Eastern equine encephalitis virus
ugcaugugcgcaccu

SEQ ID NO: 3364542 - RNA, 16 nt, Eastern equine encephalitis virus
ugccacaaugcaugaa

SEQ ID NO: 3364543 - RNA, 13 nt, Eastern equine encephalitis virus
ugcgcaugcugcg

SEQ ID NO: 3364544 - RNA, 16 nt, Eastern equine encephalitis virus
ugcuaggagaaccagg

SEQ ID NO: 3364545 - RNA, 15 nt, Eastern equine encephalitis virus
uggaaagggugacag

SEQ ID NO: 3364546 - RNA, 17 nt, Eastern equine encephalitis virus
uggcaucacugaagagc

SEQ ID NO: 3364547 - RNA, 20 nt, Eastern equine encephalitis virus
ugugccuguuaaggccaagu

SEQ ID NO: 3364548 - RNA, 23 nt, Eastern equine encephalitis virus
uuauaacacuaagggcagugcau

SEQ ID NO: 3364549 - RNA, 24 nt, Eastern equine encephalitis virus
uuaucaauacuguugucaauauca

SEQ ID NO: 3364550 - RNA, 16 nt, Eastern equine encephalitis virus
uuauuuugcugugggc

SEQ ID NO: 3364551 - RNA, 15 nt, Eastern equine encephalitis virus
uucacccaguauaag

SEQ ID NO: 3364552 - RNA, 16 nt, Eastern equine encephalitis virus
uucaugugcccuuugu

SEQ ID NO: 3364553 - RNA, 14 nt, Eastern equine encephalitis virus
uucgauaacaaggu

SEQ ID NO: 3364554 - RNA, 18 nt, Eastern equine encephalitis virus
uugaaacaacgagcaccu

SEQ ID NO: 3364555 - RNA, 24 nt, Eastern equine encephalitis virus
uugacaugguggacggagcauccu

SEQ ID NO: 3364556 - RNA, 22 nt, Eastern equine encephalitis virus
uugcagcucaaauugaggaccu

SEQ ID NO: 3364557 - RNA, 19 nt, Eastern equine encephalitis virus
uugcauaaccccguauaaa

SEQ ID NO: 3364558 - RNA, 23 nt, Eastern equine encephalitis virus
uuuaauacacacuuuauaaucag

SEQ ID NO: 3364559 - RNA, 21 nt, Eastern equine encephalitis virus
uuuggacacucauuucaccca

SEQ ID NO: 3364560 - RNA, 14 nt, Eastern equine encephalitis virus
uacaguaugagaac

SEQ ID NO: 3364561 - RNA, 22 nt, Eastern equine encephalitis virus
uaccagcagcgacuauacaacc

SEQ ID NO: 3364562 - RNA, 21 nt, Eastern equine encephalitis virus
uaccaggauaauuccaucaac

SEQ ID NO: 3364563 - RNA, 14 nt, Eastern equine encephalitis virus
uaccgucacccacc

SEQ ID NO: 3364564 - RNA, 11 nt, Eastern equine encephalitis virus
uaccugcaaag

SEQ ID NO: 3364565 - RNA, 16 nt, Eastern equine encephalitis virus
uaccugcaaaggagau

SEQ ID NO: 3364566 - RNA, 13 nt, Eastern equine encephalitis virus
uagagagaaauac

SEQ ID NO: 3364567 - RNA, 14 nt, Eastern equine encephalitis virus
uaguaucuaaccua

SEQ ID NO: 3364568 - RNA, 16 nt, Eastern equine encephalitis virus
uauaaucaggcauaau

SEQ ID NO: 3364569 - RNA, 16 nt, Eastern equine encephalitis virus
uauacaaccaccugca

SEQ ID NO: 3364570 - RNA, 21 nt, Eastern equine encephalitis virus
uauaccgccuccuauaaacac

SEQ ID NO: 3364571 - RNA, 21 nt, Eastern equine encephalitis virus
uauaccuggggaaaccaucca

SEQ ID NO: 3364572 - RNA, 21 nt, Eastern equine encephalitis virus
uauuacauccuggcucaaugc

SEQ ID NO: 3364573 - RNA, 13 nt, Eastern equine encephalitis virus
ucaagcugaagaa

SEQ ID NO: 3364574 - RNA, 20 nt, Eastern equine encephalitis virus
ucauuucacccaguauaagc

SEQ ID NO: 3364575 - RNA, 12 nt, Eastern equine encephalitis virus
uccacacuuugu

SEQ ID NO: 3364576 - RNA, 14 nt, Eastern equine encephalitis virus
uccaguagugaaau

SEQ ID NO: 3364577 - RNA, 15 nt, Eastern equine encephalitis virus
uccaucgcuaaccug

SEQ ID NO: 3364578 - RNA, 12 nt, Eastern equine encephalitis virus
uccgcauccaga

SEQ ID NO: 3364579 - RNA, 16 nt, Eastern equine encephalitis virus
ucgacaaccugcaugu

SEQ ID NO: 3364580 - RNA, 15 nt, Eastern equine encephalitis virus
ugaaagggguuacau

SEQ ID NO: 3364581 - RNA, 12 nt, Eastern equine encephalitis virus
ugaaaugcugcg

SEQ ID NO: 3364582 - RNA, 20 nt, Eastern equine encephalitis virus
ugaccaagacgucgacaggc

SEQ ID NO: 3364583 - RNA, 19 nt, Eastern equine encephalitis virus
ugagaagcuguugcagaag

SEQ ID NO: 3364584 - RNA, 20 nt, Eastern equine encephalitis virus
ugaugcuaucauugcagaac

SEQ ID NO: 3364585 - RNA, 18 nt, Eastern equine encephalitis virus
ugcaaccguuacacccac

SEQ ID NO: 3364586 - RNA, 21 nt, Eastern equine encephalitis virus
ugcacacaccuuucacccagg

SEQ ID NO: 3364587 - RNA, 19 nt, Eastern equine encephalitis virus
auaucacguuuccauguga

SEQ ID NO: 3364588 - RNA, 21 nt, Eastern equine encephalitis virus
aucaacuaaccuggaguacau

SEQ ID NO: 3364589 - RNA, 21 nt, Eastern equine encephalitis virus
aucacgcacaucaaccagcaa

SEQ ID NO: 3364590 - RNA, 13 nt, Eastern equine encephalitis virus
aucagcauuuauc

SEQ ID NO: 3364591 - RNA, 20 nt, Eastern equine encephalitis virus
aucgucgauuauccagcaca

SEQ ID NO: 3364592 - RNA, 12 nt, Eastern equine encephalitis virus
augagcaacugg

SEQ ID NO: 3364593 - RNA, 20 nt, Eastern equine encephalitis virus
augcuaggagaaccaggaga

SEQ ID NO: 3364594 - RNA, 22 nt, Eastern equine encephalitis virus
auggaccuuaaacgggauguca

SEQ ID NO: 3364595 - RNA, 12 nt, Eastern equine encephalitis virus
auugugcagugg

SEQ ID NO: 3364596 - RNA, 17 nt, Eastern equine encephalitis virus
caaagauacaccagagg

SEQ ID NO: 3364597 - RNA, 13 nt, Eastern equine encephalitis virus
caaccaccugcac

SEQ ID NO: 3364598 - RNA, 21 nt, Eastern equine encephalitis virus
caacgaucuguacgcaaacac

SEQ ID NO: 3364599 - RNA, 16 nt, Eastern equine encephalitis virus
caacucuggaagacug

SEQ ID NO: 3364600 - RNA, 20 nt, Eastern equine encephalitis virus
caagcugaagaaggccagca

SEQ ID NO: 3364601 - RNA, 20 nt, Eastern equine encephalitis virus
cacaagcgugcagaccaagg

SEQ ID NO: 3364602 - RNA, 18 nt, Eastern equine encephalitis virus
cacacagcagugaugccg

SEQ ID NO: 3364603 - RNA, 19 nt, Eastern equine encephalitis virus
cacacuuuguuugacaugu

SEQ ID NO: 3364604 - RNA, 18 nt, Eastern equine encephalitis virus
cacagugccaaggugaaa

SEQ ID NO: 3364605 - RNA, 17 nt, Eastern equine encephalitis virus
cacauuagcaucuucag

SEQ ID NO: 3364606 - RNA, 15 nt, Eastern equine encephalitis virus
caccaccaccugcca

SEQ ID NO: 3364607 - RNA, 14 nt, Eastern equine encephalitis virus
caccagagggguca

SEQ ID NO: 3364608 - RNA, 12 nt, Eastern equine encephalitis virus
caccucagcccc

SEQ ID NO: 3364609 - RNA, 16 nt, Eastern equine encephalitis virus
caccugcaacaaaaau

SEQ ID NO: 3364610 - RNA, 17 nt, Eastern equine encephalitis virus
caccugcaaguauaaga

SEQ ID NO: 3364611 - RNA, 16 nt, Eastern equine encephalitis virus
cacguagaaggcagaa

SEQ ID NO: 3364612 - RNA, 14 nt, Eastern equine encephalitis virus
cacuagugcaguua

SEQ ID NO: 3364613 - RNA, 14 nt, Eastern equine encephalitis virus
cacucaauguaccu

SEQ ID NO: 3364614 - RNA, 17 nt, Eastern equine encephalitis virus
cacucaauguaccucca

SEQ ID NO: 3364615 - RNA, 15 nt, Eastern equine encephalitis virus
cacuucuccacugca

SEQ ID NO: 3364616 - RNA, 18 nt, Eastern equine encephalitis virus
cacuuggaagugaugcaa

SEQ ID NO: 3364617 - RNA, 21 nt, Eastern equine encephalitis virus
cagacgcuuaucccacuugca

SEQ ID NO: 3364618 - RNA, 19 nt, Eastern equine encephalitis virus
cagcugguuaauaccagga

SEQ ID NO: 3364619 - RNA, 21 nt, Eastern equine encephalitis virus
cagcuucucaucagcagaagu

SEQ ID NO: 3364620 - RNA, 19 nt, Eastern equine encephalitis virus
caggaaaaagaagcgacca

SEQ ID NO: 3364621 - RNA, 15 nt, Eastern equine encephalitis virus
caggcaauggugaac

SEQ ID NO: 3364622 - RNA, 12 nt, Eastern equine encephalitis virus
caggcgcagagc

SEQ ID NO: 3364623 - RNA, 21 nt, Eastern equine encephalitis virus
caggucugcacuagugcaguu

SEQ ID NO: 3364624 - RNA, 16 nt, Eastern equine encephalitis virus
caguagugaaaugcug

SEQ ID NO: 3364625 - RNA, 23 nt, Eastern equine encephalitis virus
cagucaaagauacaccagagggg

SEQ ID NO: 3364626 - RNA, 14 nt, Eastern equine encephalitis virus
cagucucagaccug

SEQ ID NO: 3364627 - RNA, 18 nt, Eastern equine encephalitis virus
cagucucagaccuggaau

SEQ ID NO: 3364628 - RNA, 18 nt, Eastern equine encephalitis virus
cagugcauaaggcugcua

SEQ ID NO: 3364629 - RNA, 14 nt, Eastern equine encephalitis virus
caucaacuaaccug

SEQ ID NO: 3364630 - RNA, 11 nt, Eastern equine encephalitis virus
caucaccugca

SEQ ID NO: 3364631 - RNA, 16 nt, Eastern equine encephalitis virus
cauccgagacgggaca

SEQ ID NO: 3364632 - RNA, 20 nt, Eastern equine encephalitis virus
cauccugacuaucaguguca

SEQ ID NO: 3364633 - RNA, 20 nt, Eastern equine encephalitis virus
cauccuggcucaaugcccac

SEQ ID NO: 3364634 - RNA, 17 nt, Eastern equine encephalitis virus
caucuugucaaccacau

SEQ ID NO: 3364635 - RNA, 21 nt, Eastern equine encephalitis virus
caugaaaucagauacccucca

SEQ ID NO: 3364636 - RNA, 18 nt, Eastern equine encephalitis virus
caugugaucaaccacccu

SEQ ID NO: 3364637 - RNA, 15 nt, Eastern equine encephalitis virus
cauuauaacacuaag

SEQ ID NO: 3364638 - RNA, 11 nt, Eastern equine encephalitis virus
cauugcagaac

SEQ ID NO: 3364639 - RNA, 22 nt, Eastern equine encephalitis virus
ccaaaaagggguuacagucaaa

SEQ ID NO: 3364640 - RNA, 14 nt, Eastern equine encephalitis virus
ccaacaacugucaa

SEQ ID NO: 3364641 - RNA, 23 nt, Eastern equine encephalitis virus
ccaagauguacuagcagcagcca

SEQ ID NO: 3364642 - RNA, 23 nt, Eastern equine encephalitis virus
ccacauaacacuauaggcagugu

SEQ ID NO: 3364643 - RNA, 15 nt, Eastern equine encephalitis virus
ccaccugccaagaaa

SEQ ID NO: 3364644 - RNA, 20 nt, Eastern equine encephalitis virus
ccacggcuauuacauccugg

SEQ ID NO: 3364645 - RNA, 12 nt, Eastern equine encephalitis virus
ccacugcguggu

SEQ ID NO: 3364646 - RNA, 17 nt, Eastern equine encephalitis virus
ccaguauaagcuggcac

SEQ ID NO: 3364647 - RNA, 20 nt, Eastern equine encephalitis virus
ccaguguuggauucagcugc

SEQ ID NO: 3364648 - RNA, 14 nt, Eastern equine encephalitis virus
ccauccaccaaaaa

SEQ ID NO: 3364649 - RNA, 23 nt, Eastern equine encephalitis virus
cccaagugaaauacuacugcaag

SEQ ID NO: 3364650 - RNA, 14 nt, Eastern equine encephalitis virus
cccgaacgcucaag

SEQ ID NO: 3364651 - RNA, 15 nt, Eastern equine encephalitis virus
cccugcaugccaugc

SEQ ID NO: 3364652 - RNA, 22 nt, Eastern equine encephalitis virus
cccuggagccgcuccgugcaga

SEQ ID NO: 3364653 - RNA, 20 nt, Eastern equine encephalitis virus
ccgagccuaugaucagcugc

SEQ ID NO: 3364654 - RNA, 17 nt, Eastern equine encephalitis virus
ccuacagauacagcugg

SEQ ID NO: 3364655 - RNA, 23 nt, Eastern equine encephalitis virus
ccuaugaucagcugcucgaugcc

SEQ ID NO: 3364656 - RNA, 21 nt, Eastern equine encephalitis virus
ccucuaguugagcacaaacac

SEQ ID NO: 3364657 - RNA, 18 nt, Eastern equine encephalitis virus
ccugaagagacuguuuaa

SEQ ID NO: 3364658 - RNA, 16 nt, Eastern equine encephalitis virus
ccugcaugugcgcacc

SEQ ID NO: 3364659 - RNA, 19 nt, Eastern equine encephalitis virus
ccuuagcauccacagugcc

SEQ ID NO: 3364660 - RNA, 20 nt, Eastern equine encephalitis virus
ccuuagcauccacagugcca

SEQ ID NO: 3364661 - RNA, 19 nt, Eastern equine encephalitis virus
cuggaagacugccucgagg

SEQ ID NO: 3364662 - RNA, 20 nt, Eastern equine encephalitis virus
cuggaguacaucaccugcaa

SEQ ID NO: 3364663 - RNA, 12 nt, Eastern equine encephalitis virus
cuggcucaaugc

SEQ ID NO: 3364664 - RNA, 22 nt, Eastern equine encephalitis virus
cuguuaugaaaagaauccacac

SEQ ID NO: 3364665 - RNA, 19 nt, Eastern equine encephalitis virus
cuuacagccauugcaugag

SEQ ID NO: 3364666 - RNA, 23 nt, Eastern equine encephalitis virus
cuuaccugauugacaacaaaaaa

SEQ ID NO: 3364667 - RNA, 18 nt, Eastern equine encephalitis virus
cuugucaaccacauaaca

SEQ ID NO: 3364668 - RNA, 21 nt, Eastern equine encephalitis virus
cuugucaaccacauaacacua

SEQ ID NO: 3364669 - RNA, 16 nt, Eastern equine encephalitis virus
gaaaauugugcagugg

SEQ ID NO: 3364670 - RNA, 13 nt, Eastern equine encephalitis virus
gaaagggugacag

SEQ ID NO: 3364671 - RNA, 14 nt, Eastern equine encephalitis virus
gaaagggugacagc

SEQ ID NO: 3364672 - RNA, 17 nt, Eastern equine encephalitis virus
gaagcuagagucagaua

SEQ ID NO: 3364673 - RNA, 20 nt, Eastern equine encephalitis virus
gacaaaacauacugaagaaa

SEQ ID NO: 3364674 - RNA, 14 nt, Eastern equine encephalitis virus
gacaaccugcaugu

SEQ ID NO: 3364675 - RNA, 19 nt, Eastern equine encephalitis virus
gacacuacguugagaugca

SEQ ID NO: 3364676 - RNA, 19 nt, Eastern equine encephalitis virus
gacacucauuucacccagu

SEQ ID NO: 3364677 - RNA, 15 nt, Eastern equine encephalitis virus
gacagccgagccuau

SEQ ID NO: 3364678 - RNA, 17 nt, Eastern equine encephalitis virus
gaccaccaccaccugcc

SEQ ID NO: 3364679 - RNA, 17 nt, Eastern equine encephalitis virus
gacccaaagcagcugcc

SEQ ID NO: 3364680 - RNA, 16 nt, Eastern equine encephalitis virus
gaccugagacguucca

SEQ ID NO: 3364681 - RNA, 19 nt, Eastern equine encephalitis virus
gaccuugcugacgaccagg

SEQ ID NO: 3364682 - RNA, 17 nt, Eastern equine encephalitis virus
gacggcucuaucagugg

SEQ ID NO: 3364683 - RNA, 22 nt, Eastern equine encephalitis virus
gacggcucuaucaguggugaca

SEQ ID NO: 3364684 - RNA, 22 nt, Eastern equine encephalitis virus
gacuauacaaccaccugcacgg

SEQ ID NO: 3364685 - RNA, 15 nt, Eastern equine encephalitis virus
gagaaccaggagaga

SEQ ID NO: 3364686 - RNA, 19 nt, Eastern equine encephalitis virus
uauaagacaaaagugccuu

SEQ ID NO: 3364687 - RNA, 13 nt, Eastern equine encephalitis virus
uauccgccacugc

SEQ ID NO: 3364688 - RNA, 14 nt, Eastern equine encephalitis virus
uaugaucagcugcu

SEQ ID NO: 3364689 - RNA, 16 nt, Eastern equine encephalitis virus
ucaaagauacaccaga

SEQ ID NO: 3364690 - RNA, 16 nt, Eastern equine encephalitis virus
ucaaccacauaacacu

SEQ ID NO: 3364691 - RNA, 17 nt, Eastern equine encephalitis virus
ucaaccacccugcaugc

SEQ ID NO: 3364692 - RNA, 12 nt, Eastern equine encephalitis virus
ucaagcugaaga

SEQ ID NO: 3364693 - RNA, 19 nt, Eastern equine encephalitis virus
ucagcauuuaucguucugg

SEQ ID NO: 3364694 - RNA, 14 nt, Eastern equine encephalitis virus
ucagcuauguucgg

SEQ ID NO: 3364695 - RNA, 22 nt, Eastern equine encephalitis virus
uccaguguuggauucagcugcc

SEQ ID NO: 3364696 - RNA, 21 nt, Eastern equine encephalitis virus
ucgacaaccugcaugugcgca

SEQ ID NO: 3364697 - RNA, 17 nt, Eastern equine encephalitis virus
ucgagagcuugugcgca

SEQ ID NO: 3364698 - RNA, 19 nt, Eastern equine encephalitis virus
ucugaaacaccgacagucu

SEQ ID NO: 3364699 - RNA, 18 nt, Eastern equine encephalitis virus
ucugcgacacugaaaaca

SEQ ID NO: 3364700 - RNA, 22 nt, Eastern equine encephalitis virus
ucuugucaaccacauaacacua

SEQ ID NO: 3364701 - RNA, 13 nt, Eastern equine encephalitis virus
ugaaaacacccag

SEQ ID NO: 3364702 - RNA, 14 nt, Eastern equine encephalitis virus
ugaaaacacccaga

SEQ ID NO: 3364703 - RNA, 17 nt, Eastern equine encephalitis virus
ugaaacaccgacagucu

SEQ ID NO: 3364704 - RNA, 23 nt, Eastern equine encephalitis virus
ugagcaacuggccgccaucaagc

SEQ ID NO: 3364705 - RNA, 16 nt, Eastern equine encephalitis virus
ugaugccgaacaaggu

SEQ ID NO: 3364706 - RNA, 22 nt, Eastern equine encephalitis virus
ugaugugccacaaugcaugaaa

SEQ ID NO: 3364707 - RNA, 17 nt, Eastern equine encephalitis virus
ugcaaccguuacaccca

SEQ ID NO: 3364708 - RNA, 13 nt, Eastern equine encephalitis virus
ugcaaguauaaga

SEQ ID NO: 3364709 - RNA, 14 nt, Eastern equine encephalitis virus
ugcacaguugccca

SEQ ID NO: 3364710 - RNA, 18 nt, Eastern equine encephalitis virus
ugcauaaccccguauaaa

SEQ ID NO: 3364711 - RNA, 14 nt, Eastern equine encephalitis virus
ugcaugccaugcug

SEQ ID NO: 3364712 - RNA, 20 nt, Eastern equine encephalitis virus
ugccacaaugcaugaaauca

SEQ ID NO: 3364713 - RNA, 21 nt, Eastern equine encephalitis virus
uggacacucauuucacccagu

SEQ ID NO: 3364714 - RNA, 20 nt, Eastern equine encephalitis virus
uggagcuguacaguaugaga

SEQ ID NO: 3364715 - RNA, 19 nt, Eastern equine encephalitis virus
uggcaucacugaagagcug

SEQ ID NO: 3364716 - RNA, 19 nt, Eastern equine encephalitis virus
uggcucaaugcccaccagg

SEQ ID NO: 3364717 - RNA, 12 nt, Eastern equine encephalitis virus
uguaagccaccg

SEQ ID NO: 3364718 - RNA, 19 nt, Eastern equine encephalitis virus
uguaaugcuaggagaacca

SEQ ID NO: 3364719 - RNA, 17 nt, Eastern equine encephalitis virus
uucaggugauacaggca

SEQ ID NO: 3364720 - RNA, 23 nt, Eastern equine encephalitis virus
uuccaguguuggauucagcugcc

SEQ ID NO: 3364721 - RNA, 13 nt, Eastern equine encephalitis virus
uugacaacaaagg

SEQ ID NO: 3364722 - RNA, 20 nt, Eastern equine encephalitis virus
uugcaauguuacucaaauga

SEQ ID NO: 3364723 - RNA, 17 nt, Eastern equine encephalitis virus
caaaaagggguuacagu

SEQ ID NO: 3364724 - RNA, 19 nt, Eastern equine encephalitis virus
caaagauacaccagagggg

SEQ ID NO: 3364725 - RNA, 16 nt, Eastern equine encephalitis virus
caaauccaacucgaca

SEQ ID NO: 3364726 - RNA, 21 nt, Eastern equine encephalitis virus
caaccaccugcacggauguca

SEQ ID NO: 3364727 - RNA, 15 nt, Eastern equine encephalitis virus
caacuaaccuggagu

SEQ ID NO: 3364728 - RNA, 22 nt, Eastern equine encephalitis virus
caauaaagaucgacaaccugca

SEQ ID NO: 3364729 - RNA, 21 nt, Eastern equine encephalitis virus
caauguaccuccaaaccccau

SEQ ID NO: 3364730 - RNA, 18 nt, Eastern equine encephalitis virus
caauucauucuccaucag

SEQ ID NO: 3364731 - RNA, 12 nt, Eastern equine encephalitis virus
cacaaugcauga

SEQ ID NO: 3364732 - RNA, 17 nt, Eastern equine encephalitis virus
cacagcguugaccacau

SEQ ID NO: 3364733 - RNA, 14 nt, Eastern equine encephalitis virus
cacaguugcccaua

SEQ ID NO: 3364734 - RNA, 15 nt, Eastern equine encephalitis virus
caccgcacccugauu

SEQ ID NO: 3364735 - RNA, 15 nt, Eastern equine encephalitis virus
cacguuggaacagaa

SEQ ID NO: 3364736 - RNA, 17 nt, Eastern equine encephalitis virus
cacuaagggcagugcau

SEQ ID NO: 3364737 - RNA, 21 nt, Eastern equine encephalitis virus
cacuacguugagaugcaucaa

SEQ ID NO: 3364738 - RNA, 15 nt, Eastern equine encephalitis virus
cacucuugcugagag

SEQ ID NO: 3364739 - RNA, 15 nt, Eastern equine encephalitis virus
cacuguucaggcaau

SEQ ID NO: 3364740 - RNA, 20 nt, Eastern equine encephalitis virus
cagaaaauugugcaguggga

SEQ ID NO: 3364741 - RNA, 19 nt, Eastern equine encephalitis virus
cagaaguggccgucaaagu

SEQ ID NO: 3364742 - RNA, 16 nt, Eastern equine encephalitis virus
cagaauuacgacagcc

SEQ ID NO: 3364743 - RNA, 14 nt, Eastern equine encephalitis virus
cagcacaacauacu

SEQ ID NO: 3364744 - RNA, 20 nt, Eastern equine encephalitis virus
cagcugguuaauaccaggau

SEQ ID NO: 3364745 - RNA, 20 nt, Eastern equine encephalitis virus
cagggcuuaccugauugaca

SEQ ID NO: 3364746 - RNA, 20 nt, Eastern equine encephalitis virus
caggucugcacuagugcagu

SEQ ID NO: 3364747 - RNA, 14 nt, Eastern equine encephalitis virus
cagguguugcaguu

SEQ ID NO: 3364748 - RNA, 15 nt, Eastern equine encephalitis virus
caguaaagcaggaaa

SEQ ID NO: 3364749 - RNA, 18 nt, Eastern equine encephalitis virus
cagugguugcccuaguuc

SEQ ID NO: 3364750 - RNA, 13 nt, Eastern equine encephalitis virus
caguuaccugcaa

SEQ ID NO: 3364751 - RNA, 21 nt, Eastern equine encephalitis virus
cauaagguagaauucaggcca

SEQ ID NO: 3364752 - RNA, 21 nt, Eastern equine encephalitis virus
cauagucggugcgacagcccu

SEQ ID NO: 3364753 - RNA, 19 nt, Eastern equine encephalitis virus
caucauagguccacuguca

SEQ ID NO: 3364754 - RNA, 22 nt, Eastern equine encephalitis virus
cauccugcuuuuaagcugcagg

SEQ ID NO: 3364755 - RNA, 21 nt, Eastern equine encephalitis virus
caucugacgcacugauggcag

SEQ ID NO: 3364756 - RNA, 22 nt, Eastern equine encephalitis virus
cauggaguugaauuaccaugca

SEQ ID NO: 3364757 - RNA, 23 nt, Eastern equine encephalitis virus
cauggucgcuugccacugucaug

SEQ ID NO: 3364758 - RNA, 21 nt, Eastern equine encephalitis virus
caugugaucaaccacccugca

SEQ ID NO: 3364759 - RNA, 20 nt, Eastern equine encephalitis virus
cauuccacuucuccacugca

SEQ ID NO: 3364760 - RNA, 22 nt, Eastern equine encephalitis virus
ccacaucgucgauuauccagca

SEQ ID NO: 3364761 - RNA, 14 nt, Eastern equine encephalitis virus
ccaccaccugccaa

SEQ ID NO: 3364762 - RNA, 13 nt, Eastern equine encephalitis virus
ccaccacuugcag

SEQ ID NO: 3364763 - RNA, 13 nt, Eastern equine encephalitis virus
ccacccugcaugc

SEQ ID NO: 3364764 - RNA, 19 nt, Eastern equine encephalitis virus
ccacugucaucugcguggu

SEQ ID NO: 3364765 - RNA, 15 nt, Eastern equine encephalitis virus
ccaggucacuuggaa

SEQ ID NO: 3364766 - RNA, 19 nt, Eastern equine encephalitis virus
ccaggucacuuggaaguga

SEQ ID NO: 3364767 - RNA, 17 nt, Eastern equine encephalitis virus
ccauggagcuguacagu

SEQ ID NO: 3364768 - RNA, 10 nt, Eastern equine encephalitis virus
cccugcaugc

SEQ ID NO: 3364769 - RNA, 15 nt, Eastern equine encephalitis virus
ccuaugaucagcugc

SEQ ID NO: 3364770 - RNA, 19 nt, Eastern equine encephalitis virus
ccuccaguacaccagugac

SEQ ID NO: 3364771 - RNA, 15 nt, Eastern equine encephalitis virus
ccugcacggauguca

SEQ ID NO: 3364772 - RNA, 12 nt, Eastern equine encephalitis virus
cgacgacaacau

SEQ ID NO: 3364773 - RNA, 17 nt, Eastern equine encephalitis virus
cgaucagcagugccauc

SEQ ID NO: 3364774 - RNA, 21 nt, Eastern equine encephalitis virus
cgaucucgagcgugagaagcu

SEQ ID NO: 3364775 - RNA, 13 nt, Eastern equine encephalitis virus
accaccaccugcc

SEQ ID NO: 3364776 - RNA, 14 nt, Eastern equine encephalitis virus
accacccugcaugc

SEQ ID NO: 3364777 - RNA, 17 nt, Eastern equine encephalitis virus
acccacaagcgugcaga

SEQ ID NO: 3364778 - RNA, 22 nt, Eastern equine encephalitis virus
acccaccugaacauggaguuga

SEQ ID NO: 3364779 - RNA, 19 nt, Eastern equine encephalitis virus
acccguucaccuacagaua

SEQ ID NO: 3364780 - RNA, 14 nt, Eastern equine encephalitis virus
acccuccagcagga

SEQ ID NO: 3364781 - RNA, 14 nt, Eastern equine encephalitis virus
acccugauuuuaca

SEQ ID NO: 3364782 - RNA, 13 nt, Eastern equine encephalitis virus
acccugcaugcca

SEQ ID NO: 3364783 - RNA, 21 nt, Eastern equine encephalitis virus
accgauucaaaacacgcucca

SEQ ID NO: 3364784 - RNA, 15 nt, Eastern equine encephalitis virus
accuaguacugcaag

SEQ ID NO: 3364785 - RNA, 20 nt, Eastern equine encephalitis virus
accuccaaaccccauccuga

SEQ ID NO: 3364786 - RNA, 17 nt, Eastern equine encephalitis virus
accuugaguauggugau

SEQ ID NO: 3364787 - RNA, 14 nt, Eastern equine encephalitis virus
acgaugaguacugg

SEQ ID NO: 3364788 - RNA, 19 nt, Eastern equine encephalitis virus
acgccgccgaugcagugca

SEQ ID NO: 3364789 - RNA, 21 nt, Eastern equine encephalitis virus
acguuggaacagaauuggcau

SEQ ID NO: 3364790 - RNA, 23 nt, Eastern equine encephalitis virus
acuaaacacuaaauucacccuag

SEQ ID NO: 3364791 - RNA, 17 nt, Eastern equine encephalitis virus
acuaagggcagugcaua

SEQ ID NO: 3364792 - RNA, 23 nt, Eastern equine encephalitis virus
acuaucagugucagguguuuaca

SEQ ID NO: 3364793 - RNA, 16 nt, Eastern equine encephalitis virus
acucauuucacccagu

SEQ ID NO: 3364794 - RNA, 19 nt, Eastern equine encephalitis virus
acuuacagccauugcauga

SEQ ID NO: 3364795 - RNA, 15 nt, Eastern equine encephalitis virus
acuuuguuugacaug

SEQ ID NO: 3364796 - RNA, 23 nt, Eastern equine encephalitis virus
agaagcgaccaccaccaccugcc

SEQ ID NO: 3364797 - RNA, 14 nt, Eastern equine encephalitis virus
agacaucagcuaug

SEQ ID NO: 3364798 - RNA, 16 nt, Eastern equine encephalitis virus
agacggauggaguuga

SEQ ID NO: 3364799 - RNA, 14 nt, Eastern equine encephalitis virus
agagcucugcauga

SEQ ID NO: 3364800 - RNA, 18 nt, Eastern equine encephalitis virus
agagggaacuaccagcag

SEQ ID NO: 3364801 - RNA, 22 nt, Eastern equine encephalitis virus
agagucgccgacccccugaaga

SEQ ID NO: 3364802 - RNA, 13 nt, Eastern equine encephalitis virus
agaucaucgaugc

SEQ ID NO: 3364803 - RNA, 22 nt, Eastern equine encephalitis virus
agauguuuacgucaauggugaa

SEQ ID NO: 3364804 - RNA, 21 nt, Eastern equine encephalitis virus
agcaacuuuaaacacauaaga

SEQ ID NO: 3364805 - RNA, 16 nt, Eastern equine encephalitis virus
agcaccuaacccucca

SEQ ID NO: 3364806 - RNA, 12 nt, Eastern equine encephalitis virus
agcauauaugac

SEQ ID NO: 3364807 - RNA, 18 nt, Eastern equine encephalitis virus
agccauggucgcuugcca

SEQ ID NO: 3364808 - RNA, 15 nt, Eastern equine encephalitis virus
agccauugcaugaga

SEQ ID NO: 3364809 - RNA, 18 nt, Eastern equine encephalitis virus
agccuaugaucagcugcu

SEQ ID NO: 3364810 - RNA, 13 nt, Eastern equine encephalitis virus
agcgaccaacaac

SEQ ID NO: 3364811 - RNA, 16 nt, Eastern equine encephalitis virus
agcucugcaugaugaa

SEQ ID NO: 3364812 - RNA, 20 nt, Eastern equine encephalitis virus
agcugguuaauaccaggaua

SEQ ID NO: 3364813 - RNA, 14 nt, Eastern equine encephalitis virus
aggaaaaagaagcg

SEQ ID NO: 3364814 - RNA, 16 nt, Eastern equine encephalitis virus
aggagucauccgcauc

SEQ ID NO: 3364815 - RNA, 17 nt, Eastern equine encephalitis virus
aggaguugaucaggcau

SEQ ID NO: 3364816 - RNA, 19 nt, Eastern equine encephalitis virus
aggcaaacgacagcgaaug

SEQ ID NO: 3364817 - RNA, 12 nt, Eastern equine encephalitis virus
aggcacccgauu

SEQ ID NO: 3364818 - RNA, 20 nt, Eastern equine encephalitis virus
aggcagaauagacaaugagc

SEQ ID NO: 3364819 - RNA, 13 nt, Eastern equine encephalitis virus
aggcgcagagcuc

SEQ ID NO: 3364820 - RNA, 18 nt, Eastern equine encephalitis virus
agggaacuaccagcagcg

SEQ ID NO: 3364821 - RNA, 14 nt, Eastern equine encephalitis virus
aggggucagagcca

SEQ ID NO: 3364822 - RNA, 23 nt, Eastern equine encephalitis virus
agguagaauucaggccagugggu

SEQ ID NO: 3364823 - RNA, 15 nt, Eastern equine encephalitis virus
aggugauacaggcag

SEQ ID NO: 3364824 - RNA, 19 nt, Eastern equine encephalitis virus
agucauccgcauccagaca

SEQ ID NO: 3364825 - RNA, 17 nt, Eastern equine encephalitis virus
agugcaguuaccugcaa

SEQ ID NO: 3364826 - RNA, 15 nt, Eastern equine encephalitis virus
agugcauaaugcugc

SEQ ID NO: 3364827 - RNA, 19 nt, Eastern equine encephalitis virus
agugcauaaugcugcuccu

SEQ ID NO: 3364828 - RNA, 20 nt, Eastern equine encephalitis virus
aguuugcaaccuaguacugc

SEQ ID NO: 3364829 - RNA, 15 nt, Eastern equine encephalitis virus
auacccuccaguaca

SEQ ID NO: 3364830 - RNA, 18 nt, Eastern equine encephalitis virus
auaggcaguguauaaggc

SEQ ID NO: 3364831 - RNA, 14 nt, Eastern equine encephalitis virus
auagguccacuguc

SEQ ID NO: 3364832 - RNA, 23 nt, Eastern equine encephalitis virus
auauaccgccuccuauaaacacu

SEQ ID NO: 3364833 - RNA, 18 nt, Eastern equine encephalitis virus
aucaccgauucaaaacac

SEQ ID NO: 3364834 - RNA, 13 nt, Eastern equine encephalitis virus
aucucucugcaga

SEQ ID NO: 3364835 - RNA, 18 nt, Eastern equine encephalitis virus
aucugcgugguccccauu

SEQ ID NO: 3364836 - RNA, 18 nt, Eastern equine encephalitis virus
augcacccguucaccuac

SEQ ID NO: 3364837 - RNA, 21 nt, Eastern equine encephalitis virus
auggcgccgauuaacccgaug

SEQ ID NO: 3364838 - RNA, 16 nt, Eastern equine encephalitis virus
augucaaacaaugcag

SEQ ID NO: 3364839 - RNA, 20 nt, Eastern equine encephalitis virus
augucaaacaaugcagggcu

SEQ ID NO: 3364840 - RNA, 13 nt, Eastern equine encephalitis virus
auuguaugcaugc

SEQ ID NO: 3364841 - RNA, 21 nt, Eastern equine encephalitis virus
auuucacccaguauaagcugg

SEQ ID NO: 3364842 - RNA, 13 nt, Hepatitis A virus
aaacaaauuuucu

SEQ ID NO: 3364843 - RNA, 13 nt, Hepatitis A virus
aauuucugagguu

SEQ ID NO: 3364844 - RNA, 14 nt, Hepatitis A virus
acaaauuuucuuaa

SEQ ID NO: 3364845 - RNA, 21 nt, Hepatitis A virus
uaaacaaauuuucuuaaaauu

SEQ ID NO: 3364846 - RNA, 17 nt, Hepatitis A virus
uauuucuuuuaucagua

SEQ ID NO: 3364847 - RNA, 13 nt, Hepatitis A virus
ucuuaaaauuucu

SEQ ID NO: 3364848 - RNA, 13 nt, Hepatitis A virus
uuuuaucaguaaa

SEQ ID NO: 3364849 - RNA, 21 nt, Hepatitis A virus
aauuucugagguuuguuuauu

SEQ ID NO: 3364850 - RNA, 21 nt, Hepatitis A virus
auuuucuuaaaauuucugagg

SEQ ID NO: 3364851 - RNA, 15 nt, Hepatitis A virus
cuuaaaauuucugag

SEQ ID NO: 3364852 - RNA, 23 nt, Hepatitis A virus
guuuauuucuuuuaucaguaaau

SEQ ID NO: 3364853 - RNA, 18 nt, Hepatitis A virus
uucugagguuuguuuauu

SEQ ID NO: 3364854 - RNA, 12 nt, Hepatitis A virus
uuuucuuaaaau

SEQ ID NO: 3364855 - RNA, 20 nt, Hepatitis A virus
aauuuucuuaaaauuucuga

SEQ ID NO: 3364856 - RNA, 22 nt, Hepatitis A virus
acaaauuuucuuaaaauuucug

SEQ ID NO: 3364857 - RNA, 18 nt, Hepatitis A virus
auuucuuuuaucaguaaa

SEQ ID NO: 3364858 - RNA, 23 nt, Hepatitis A virus
caaauuuucuuaaaauuucugag

SEQ ID NO: 3364859 - RNA, 16 nt, Hepatitis A virus
cugagguuuguuuauu

SEQ ID NO: 3364860 - RNA, 19 nt, Hepatitis A virus
cuuaaaauuucugagguuu

SEQ ID NO: 3364861 - RNA, 14 nt, Hepatitis A virus
cuuuuaucaguaaa

SEQ ID NO: 3364862 - RNA, 15 nt, Hepatitis A virus
cuuuuaucaguaaau

SEQ ID NO: 3364863 - RNA, 15 nt, Hepatitis A virus
guuuauuucuuuuau

SEQ ID NO: 3364864 - RNA, 15 nt, Hepatitis A virus
uguuuauuucuuuua

SEQ ID NO: 3364865 - RNA, 13 nt, Hepatitis A virus
uuaaaauuucuga

SEQ ID NO: 3364866 - RNA, 17 nt, Hepatitis A virus
uucuuaaaauuucugag

SEQ ID NO: 3364867 - RNA, 15 nt, Hepatitis A virus
ucuuaaaauuucuga

SEQ ID NO: 3364868 - RNA, 20 nt, Hepatitis A virus
uguuuaaacaaauuuucuua

SEQ ID NO: 3364869 - RNA, 22 nt, Hepatitis A virus
uguuuaaacaaauuuucuuaaa

SEQ ID NO: 3364870 - RNA, 24 nt, Hepatitis A virus
uguuuaaacaaauuuucuuaaaau

SEQ ID NO: 3364871 - RNA, 20 nt, Hepatitis A virus
uuuaaacaaauuuucuuaaa

SEQ ID NO: 3364872 - RNA, 21 nt, Hepatitis A virus
uuuucuuaaaauuucugaggu

SEQ ID NO: 3364873 - RNA, 14 nt, Hepatitis B virus
aaccguauuauccu

SEQ ID NO: 3364874 - RNA, 18 nt, Hepatitis B virus
aacuaggcauuauuuaca

SEQ ID NO: 3364875 - RNA, 19 nt, Hepatitis B virus
aagaauuuggagcuucugu

SEQ ID NO: 3364876 - RNA, 14 nt, Hepatitis B virus
aauccucugggauu

SEQ ID NO: 3364877 - RNA, 13 nt, Hepatitis B virus
acaaggccuuucu

SEQ ID NO: 3364878 - RNA, 18 nt, Hepatitis B virus
acaccgccucugcucugu

SEQ ID NO: 3364879 - RNA, 11 nt, Hepatitis B virus
acauucauuua

SEQ ID NO: 3364880 - RNA, 17 nt, Hepatitis B virus
accaaacguuggggcua

SEQ ID NO: 3364881 - RNA, 17 nt, Hepatitis B virus
accauauucuugggaac

SEQ ID NO: 3364882 - RNA, 19 nt, Hepatitis B virus
accccaccacacggaggcc

SEQ ID NO: 3364883 - RNA, 16 nt, Hepatitis B virus
acccugcguucggagc

SEQ ID NO: 3364884 - RNA, 23 nt, Hepatitis B virus
accucuaagagacagucauccuc

SEQ ID NO: 3364885 - RNA, 17 nt, Hepatitis B virus
acucucuuuuuugccuu

SEQ ID NO: 3364886 - RNA, 14 nt, Hepatitis B virus
acuucaaaacuagg

SEQ ID NO: 3364887 - RNA, 12 nt, Hepatitis B virus
agcaaugucaac

SEQ ID NO: 3364888 - RNA, 11 nt, Hepatitis B virus
agcugugccuu

SEQ ID NO: 3364889 - RNA, 16 nt, Hepatitis B virus
aucacuggccagaggc

SEQ ID NO: 3364890 - RNA, 22 nt, Hepatitis B virus
auccugauuggaaaacucccuc

SEQ ID NO: 3364891 - RNA, 23 nt, Hepatitis B virus
aucuaagcaggcuuucacuuucu

SEQ ID NO: 3364892 - RNA, 23 nt, Hepatitis B virus
aucuccucgacaccgccucugcu

SEQ ID NO: 3364893 - RNA, 18 nt, Hepatitis B virus
auuggaaaguaugucaaa

SEQ ID NO: 3364894 - RNA, 17 nt, Hepatitis B virus
auugugggucuuuuggg

SEQ ID NO: 3364895 - RNA, 13 nt, Hepatitis B virus
caacacugccagc

SEQ ID NO: 3364896 - RNA, 16 nt, Hepatitis B virus
caacucaguuguccuc

SEQ ID NO: 3364897 - RNA, 17 nt, Hepatitis B virus
aaaacucccuccuuucc

SEQ ID NO: 3364898 - RNA, 14 nt, Hepatitis B virus
aaccgacaacucag

SEQ ID NO: 3364899 - RNA, 13 nt, Hepatitis B virus
aacguuggggcua

SEQ ID NO: 3364900 - RNA, 23 nt, Hepatitis B virus
aaucuuucuguucccaauccucu

SEQ ID NO: 3364901 - RNA, 15 nt, Hepatitis B virus
aauuggucuguucac

SEQ ID NO: 3364902 - RNA, 16 nt, Hepatitis B virus
acaauaucuaaaccuu

SEQ ID NO: 3364903 - RNA, 12 nt, Hepatitis B virus
acaauguggcua

SEQ ID NO: 3364904 - RNA, 13 nt, Hepatitis B virus
accaaucggcagu

SEQ ID NO: 3364905 - RNA, 21 nt, Hepatitis B virus
accucgacaaggcauggggac

SEQ ID NO: 3364906 - RNA, 17 nt, Hepatitis B virus
acuaggcauuauuuaca

SEQ ID NO: 3364907 - RNA, 15 nt, Hepatitis B virus
acucccuccuuuccu

SEQ ID NO: 3364908 - RNA, 19 nt, Hepatitis B virus
acucucuuuuuugccuucu

SEQ ID NO: 3364909 - RNA, 22 nt, Hepatitis B virus
acuguaccugucuuuaauccug

SEQ ID NO: 3364910 - RNA, 21 nt, Hepatitis B virus
agaggacucuuggacucucag

SEQ ID NO: 3364911 - RNA, 19 nt, Hepatitis B virus
agccuccaagcugugccuu

SEQ ID NO: 3364912 - RNA, 15 nt, Hepatitis B virus
aggccaugcagugga

SEQ ID NO: 3364913 - RNA, 14 nt, Hepatitis B virus
aggcuggcauucua

SEQ ID NO: 3364914 - RNA, 14 nt, Hepatitis B virus
aggcugugcugcca

SEQ ID NO: 3364915 - RNA, 21 nt, Hepatitis B virus
aucuuucuguucccaauccuc

SEQ ID NO: 3364916 - RNA, 20 nt, Hepatitis B virus
auggcugcuaggcugugcug

SEQ ID NO: 3364917 - RNA, 15 nt, Hepatitis B virus
auguccuacuguuca

SEQ ID NO: 3364918 - RNA, 20 nt, Hepatitis B virus
caaaacuaggcauuauuuac

SEQ ID NO: 3364919 - RNA, 12 nt, Hepatitis B virus
caaaucagguag

SEQ ID NO: 3364920 - RNA, 23 nt, Hepatitis B virus
caacaauaugugggcccucugac

SEQ ID NO: 3364921 - RNA, 15 nt, Hepatitis B virus
caaccccaacaagga

SEQ ID NO: 3364922 - RNA, 23 nt, Hepatitis B virus
caacggucaggucucugccaagu

SEQ ID NO: 3364923 - RNA, 16 nt, Hepatitis B virus
caacucaaacaaucca

SEQ ID NO: 3364924 - RNA, 16 nt, Hepatitis B virus
caacuuacaaggccuu

SEQ ID NO: 3364925 - RNA, 15 nt, Hepatitis B virus
caagccuccaagcug

SEQ ID NO: 3364926 - RNA, 20 nt, Hepatitis B virus
caccaaucggcagucaggaa

SEQ ID NO: 3364927 - RNA, 18 nt, Hepatitis B virus
caccagcaccaugcaacu

SEQ ID NO: 3364928 - RNA, 17 nt, Hepatitis B virus
cacggggcgcaccucuc

SEQ ID NO: 3364929 - RNA, 13 nt, Hepatitis B virus
cacuuucucgcca

SEQ ID NO: 3364930 - RNA, 14 nt, Hepatitis B virus
caggaagacagccu

SEQ ID NO: 3364931 - RNA, 17 nt, Hepatitis B virus
caggcaagcuauucugu

SEQ ID NO: 3364932 - RNA, 19 nt, Hepatitis B virus
cauauugacaacacugcca

SEQ ID NO: 3364933 - RNA, 16 nt, Hepatitis B virus
cauuaaaccguauuau

SEQ ID NO: 3364934 - RNA, 18 nt, Hepatitis B virus
ccaaaccucgacaaggca

SEQ ID NO: 3364935 - RNA, 14 nt, Hepatitis B virus
ccaagcugugccuu

SEQ ID NO: 3364936 - RNA, 20 nt, Hepatitis B virus
ccaugcaacuuuuuccccuc

SEQ ID NO: 3364937 - RNA, 13 nt, Hepatitis B virus
cccaauccucugg

SEQ ID NO: 3364938 - RNA, 14 nt, Hepatitis B virus
cccaauccucuggg

SEQ ID NO: 3364939 - RNA, 15 nt, Hepatitis B virus
cccuucuucaucugc

SEQ ID NO: 3364940 - RNA, 21 nt, Hepatitis B virus
ccgucugugccuucucaucug

SEQ ID NO: 3364941 - RNA, 17 nt, Hepatitis B virus
ccucugacaguuaauga

SEQ ID NO: 3364942 - RNA, 20 nt, Hepatitis B virus
ccugaauaugcaguuaauca

SEQ ID NO: 3364943 - RNA, 18 nt, Hepatitis B virus
ccugucuuuaauccugau

SEQ ID NO: 3364944 - RNA, 21 nt, Hepatitis B virus
ccuuggguggcuuuggggcau

SEQ ID NO: 3364945 - RNA, 18 nt, Hepatitis B virus
cgaccacggggcgcaccu

SEQ ID NO: 3364946 - RNA, 22 nt, Hepatitis B virus
cgaccacggggcgcaccucucu

SEQ ID NO: 3364947 - RNA, 14 nt, Hepatitis B virus
cgcuucaccucugc

SEQ ID NO: 3364948 - RNA, 23 nt, Hepatitis B virus
cggcaacggucaggucucugcca

SEQ ID NO: 3364949 - RNA, 19 nt, Hepatitis B virus
cggggccguuugggccucu

SEQ ID NO: 3364950 - RNA, 14 nt, Hepatitis B virus
cguauuauccugaa

SEQ ID NO: 3364951 - RNA, 14 nt, Hepatitis B virus
cgucugugccuucu

SEQ ID NO: 3364952 - RNA, 21 nt, Hepatitis B virus
cuacucccaucucuccaccuc

SEQ ID NO: 3364953 - RNA, 15 nt, Hepatitis B virus
caccuccuccugccu

SEQ ID NO: 3364954 - RNA, 23 nt, Hepatitis B virus
caccuccuuuccauggcugcuag

SEQ ID NO: 3364955 - RNA, 19 nt, Hepatitis B virus
cacuucgcuucaccucugc

SEQ ID NO: 3364956 - RNA, 23 nt, Hepatitis B virus
cagcgccucauuuugugggucac

SEQ ID NO: 3364957 - RNA, 17 nt, Hepatitis B virus
cagucauccucaggcca

SEQ ID NO: 3364958 - RNA, 13 nt, Hepatitis B virus
cauccucaggcca

SEQ ID NO: 3364959 - RNA, 13 nt, Hepatitis B virus
caucucauguuca

SEQ ID NO: 3364960 - RNA, 13 nt, Hepatitis B virus
caucucuccaccu

SEQ ID NO: 3364961 - RNA, 20 nt, Hepatitis B virus
cauuuacaggaggacauuau

SEQ ID NO: 3364962 - RNA, 15 nt, Hepatitis B virus
ccagcaccaugcaac

SEQ ID NO: 3364963 - RNA, 14 nt, Hepatitis B virus
cccgucugugccuu

SEQ ID NO: 3364964 - RNA, 21 nt, Hepatitis B virus
cccugcguucggagccaacuc

SEQ ID NO: 3364965 - RNA, 13 nt, Hepatitis B virus
ccugccuccacca

SEQ ID NO: 3364966 - RNA, 23 nt, Hepatitis B virus
ccugcuagguucuauccuaaccu

SEQ ID NO: 3364967 - RNA, 15 nt, Hepatitis B virus
ccuucuucaucugcc

SEQ ID NO: 3364968 - RNA, 12 nt, Hepatitis B virus
cgcuucaccucu

SEQ ID NO: 3364969 - RNA, 21 nt, Hepatitis B virus
cggucuccccgucugugccuu

SEQ ID NO: 3364970 - RNA, 13 nt, Hepatitis B virus
cuacuguaccugu

SEQ ID NO: 3364971 - RNA, 13 nt, Hepatitis B virus
cuagguucuaucc

SEQ ID NO: 3364972 - RNA, 20 nt, Hepatitis B virus
cuccaccaaucggcagucag

SEQ ID NO: 3364973 - RNA, 19 nt, Hepatitis B virus
cuccccgucugugccuucu

SEQ ID NO: 3364974 - RNA, 21 nt, Hepatitis B virus
cuccggaacauuguucaccuc

SEQ ID NO: 3364975 - RNA, 15 nt, Hepatitis B virus
cucucuuuuuugccu

SEQ ID NO: 3364976 - RNA, 14 nt, Hepatitis B virus
ccaucucuccaccu

SEQ ID NO: 3364977 - RNA, 12 nt, Hepatitis B virus
ccaugcagugga

SEQ ID NO: 3364978 - RNA, 14 nt, Hepatitis B virus
ccccuucuucaucu

SEQ ID NO: 3364979 - RNA, 16 nt, Hepatitis B virus
ccccuucuucaucugc

SEQ ID NO: 3364980 - RNA, 23 nt, Hepatitis B virus
cccgucugugccuucucaucugc

SEQ ID NO: 3364981 - RNA, 20 nt, Hepatitis B virus
ccggaacauuguucaccuca

SEQ ID NO: 3364982 - RNA, 12 nt, Hepatitis B virus
ccuacuguucaa

SEQ ID NO: 3364983 - RNA, 16 nt, Hepatitis B virus
ccuccuuuccucacau

SEQ ID NO: 3364984 - RNA, 17 nt, Hepatitis B virus
ccucgacaaggcauggg

SEQ ID NO: 3364985 - RNA, 16 nt, Hepatitis B virus
ccugaauaugcaguua

SEQ ID NO: 3364986 - RNA, 14 nt, Hepatitis B virus
ccuucucaucugcc

SEQ ID NO: 3364987 - RNA, 15 nt, Hepatitis B virus
cuaaucaucucaugu

SEQ ID NO: 3364988 - RNA, 15 nt, Hepatitis B virus
cucagcaaugucaac

SEQ ID NO: 3364989 - RNA, 18 nt, Hepatitis B virus
cucccaucucuccaccuc

SEQ ID NO: 3364990 - RNA, 16 nt, Hepatitis B virus
cuccccgucugugccu

SEQ ID NO: 3364991 - RNA, 22 nt, Hepatitis B virus
cuccucgacaccgccucugcuc

SEQ ID NO: 3364992 - RNA, 17 nt, Hepatitis B virus
cucuaccguccccuucu

SEQ ID NO: 3364993 - RNA, 13 nt, Hepatitis B virus
cucuccaccucua

SEQ ID NO: 3364994 - RNA, 15 nt, Hepatitis B virus
cugccagcagcaccu

SEQ ID NO: 3364995 - RNA, 18 nt, Hepatitis B virus
cugcguucggagccaacu

SEQ ID NO: 3364996 - RNA, 23 nt, Hepatitis B virus
cuguggaguuacucucuuuuuug

SEQ ID NO: 3364997 - RNA, 16 nt, Hepatitis B virus
cuguucccaauccucu

SEQ ID NO: 3364998 - RNA, 14 nt, Hepatitis B virus
cuucucaucugccg

SEQ ID NO: 3364999 - RNA, 20 nt, Hepatitis B virus
cuugcccaaggucuuacaca

SEQ ID NO: 3365000 - RNA, 19 nt, Hepatitis B virus
cuuugcugccccuuuuaca

SEQ ID NO: 3365001 - RNA, 17 nt, Hepatitis B virus
gaaccuuuguggcuccu

SEQ ID NO: 3365002 - RNA, 13 nt, Hepatitis B virus
gagcccucaggcu

SEQ ID NO: 3365003 - RNA, 14 nt, Hepatitis B virus
gagcuucuguggag

SEQ ID NO: 3365004 - RNA, 21 nt, Hepatitis B virus
gcaacggucaggucucugcca

SEQ ID NO: 3365005 - RNA, 21 nt, Hepatitis B virus
gcaacuuuuuccccucugccu

SEQ ID NO: 3365006 - RNA, 14 nt, Hepatitis B virus
gccaacuggauccu

SEQ ID NO: 3365007 - RNA, 14 nt, Hepatitis B virus
gccuccaagcugug

SEQ ID NO: 3365008 - RNA, 13 nt, Hepatitis B virus
gccucugcucugu

SEQ ID NO: 3365009 - RNA, 13 nt, Hepatitis B virus
cuccaccucuaag

SEQ ID NO: 3365010 - RNA, 13 nt, Hepatitis B virus
cuccuccugccuc

SEQ ID NO: 3365011 - RNA, 20 nt, Hepatitis B virus
cuccucgacaccgccucugc

SEQ ID NO: 3365012 - RNA, 15 nt, Hepatitis B virus
cugggauucuuuccc

SEQ ID NO: 3365013 - RNA, 16 nt, Hepatitis B virus
cuguucaccagcacca

SEQ ID NO: 3365014 - RNA, 20 nt, Hepatitis B virus
cuucuguggaguuacucucu

SEQ ID NO: 3365015 - RNA, 17 nt, Hepatitis B virus
cuuggacaaaggcauua

SEQ ID NO: 3365016 - RNA, 18 nt, Hepatitis B virus
cuuggacaaaggcauuaa

SEQ ID NO: 3365017 - RNA, 18 nt, Hepatitis B virus
cuuucuguucccaauccu

SEQ ID NO: 3365018 - RNA, 20 nt, Hepatitis B virus
cuuuguacuaggaggcugua

SEQ ID NO: 3365019 - RNA, 20 nt, Hepatitis B virus
gaacauuguucaccucacca

SEQ ID NO: 3365020 - RNA, 15 nt, Hepatitis B virus
gacaacacugccagc

SEQ ID NO: 3365021 - RNA, 16 nt, Hepatitis B virus
gagcccucaggcucag

SEQ ID NO: 3365022 - RNA, 16 nt, Hepatitis B virus
gagcuacagcauggga

SEQ ID NO: 3365023 - RNA, 13 nt, Hepatitis B virus
gaucacuggccag

SEQ ID NO: 3365024 - RNA, 22 nt, Hepatitis B virus
gcaccuccuccugccuccacca

SEQ ID NO: 3365025 - RNA, 22 nt, Hepatitis B virus
gcaggcuuucacuuucucgcca

SEQ ID NO: 3365026 - RNA, 15 nt, Hepatitis B virus
gcaugggagguuggu

SEQ ID NO: 3365027 - RNA, 18 nt, Hepatitis B virus
gccagaggcaaaucaggu

SEQ ID NO: 3365028 - RNA, 17 nt, Hepatitis B virus
gcccucaggcucagggc

SEQ ID NO: 3365029 - RNA, 15 nt, Hepatitis B virus
gccuaaucaucucau

SEQ ID NO: 3365030 - RNA, 17 nt, Hepatitis B virus
gccuccaagcugugccu

SEQ ID NO: 3365031 - RNA, 21 nt, Hepatitis B virus
gcggucuccccgucugugccu

SEQ ID NO: 3365032 - RNA, 16 nt, Hepatitis B virus
gcugcuaggcugugcu

SEQ ID NO: 3365033 - RNA, 12 nt, Hepatitis B virus
gcugugcugcca

SEQ ID NO: 3365034 - RNA, 20 nt, Hepatitis B virus
ggcauaaauuggucuguuca

SEQ ID NO: 3365035 - RNA, 14 nt, Hepatitis B virus
ggccaugcagugga

SEQ ID NO: 3365036 - RNA, 16 nt, Hepatitis B virus
ggcugcuaggcugugc

SEQ ID NO: 3365037 - RNA, 14 nt, Hepatitis B virus
ggugggaaacuuua

SEQ ID NO: 3365038 - RNA, 13 nt, Hepatitis B virus
gucugugccuucu

SEQ ID NO: 3365039 - RNA, 18 nt, Hepatitis B virus
guggaaggcuggcauucu

SEQ ID NO: 3365040 - RNA, 15 nt, Hepatitis B virus
guggcuccucugccg

SEQ ID NO: 3365041 - RNA, 14 nt, Hepatitis B virus
guuggucuuccaaa

SEQ ID NO: 3365042 - RNA, 14 nt, Hepatitis B virus
uacaaaaacucaag

SEQ ID NO: 3365043 - RNA, 14 nt, Hepatitis B virus
uacaaggccuuucu

SEQ ID NO: 3365044 - RNA, 22 nt, Hepatitis B virus
uacauacucuguggaaggcugg

SEQ ID NO: 3365045 - RNA, 21 nt, Hepatitis B virus
uacuaggaggcuguaggcaua

SEQ ID NO: 3365046 - RNA, 17 nt, Hepatitis B virus
uacugcggaacuccuag

SEQ ID NO: 3365047 - RNA, 18 nt, Hepatitis B virus
uaugucaaagaauugugg

SEQ ID NO: 3365048 - RNA, 16 nt, Hepatitis B virus
ucaaaacuaggcauua

SEQ ID NO: 3365049 - RNA, 19 nt, Hepatitis B virus
ucaacaauaugugggcccu

SEQ ID NO: 3365050 - RNA, 22 nt, Hepatitis B virus
ucacuggccagaggcaaaucag

SEQ ID NO: 3365051 - RNA, 17 nt, Hepatitis B virus
uccccuucuucaucugc

SEQ ID NO: 3365052 - RNA, 18 nt, Hepatitis B virus
uccucaggccaugcagug

SEQ ID NO: 3365053 - RNA, 19 nt, Hepatitis B virus
ucggggccguuugggccuc

SEQ ID NO: 3365054 - RNA, 17 nt, Hepatitis B virus
ucucuuuuuugccuucu

SEQ ID NO: 3365055 - RNA, 19 nt, Hepatitis B virus
ucucuuuuuugccuucuga

SEQ ID NO: 3365056 - RNA, 22 nt, Hepatitis B virus
ucuuccaaaccucgacaaggca

SEQ ID NO: 3365057 - RNA, 22 nt, Hepatitis B virus
ugccugcuagguucuauccuaa

SEQ ID NO: 3365058 - RNA, 15 nt, Hepatitis B virus
ugccuucucaucugc

SEQ ID NO: 3365059 - RNA, 13 nt, Hepatitis B virus
uggacucucagca

SEQ ID NO: 3365060 - RNA, 17 nt, Hepatitis B virus
uggccagaggcaaauca

SEQ ID NO: 3365061 - RNA, 19 nt, Hepatitis B virus
uguucauguccuacuguuc

SEQ ID NO: 3365062 - RNA, 15 nt, Hepatitis B virus
uuaaucauuacuuca

SEQ ID NO: 3365063 - RNA, 16 nt, Hepatitis B virus
uuacauacucugugga

SEQ ID NO: 3365064 - RNA, 21 nt, Hepatitis B virus
uuacuucaaaacuaggcauua

SEQ ID NO: 3365065 - RNA, 19 nt, Hepatitis B virus
uuauccugaauaugcaguu

SEQ ID NO: 3365066 - RNA, 13 nt, Hepatitis B virus
uuccccucugccu

SEQ ID NO: 3365067 - RNA, 13 nt, Hepatitis B virus
uucgagaucuccu

SEQ ID NO: 3365068 - RNA, 15 nt, Hepatitis B virus
uucgagaucuccucg

SEQ ID NO: 3365069 - RNA, 14 nt, Hepatitis B virus
uuuuccccucugcc

SEQ ID NO: 3365070 - RNA, 21 nt, Hepatitis B virus
caacuuuuuccccucugccua

SEQ ID NO: 3365071 - RNA, 13 nt, Hepatitis B virus
caagagcuacagc

SEQ ID NO: 3365072 - RNA, 14 nt, Hepatitis B virus
caagagcuacagca

SEQ ID NO: 3365073 - RNA, 15 nt, Hepatitis B virus
caagagcuacagcau

SEQ ID NO: 3365074 - RNA, 14 nt, Hepatitis B virus
cacaagaggacucu

SEQ ID NO: 3365075 - RNA, 15 nt, Hepatitis B virus
caccagcaccaugca

SEQ ID NO: 3365076 - RNA, 21 nt, Hepatitis B virus
caccaggucuugcccaagguc

SEQ ID NO: 3365077 - RNA, 19 nt, Hepatitis B virus
cacugccagcagcaccucc

SEQ ID NO: 3365078 - RNA, 18 nt, Hepatitis B virus
caggucuugcccaagguc

SEQ ID NO: 3365079 - RNA, 19 nt, Hepatitis B virus
cauccucaggccaugcagu

SEQ ID NO: 3365080 - RNA, 18 nt, Hepatitis B virus
ccagcagcaccuccuccu

SEQ ID NO: 3365081 - RNA, 15 nt, Hepatitis B virus
cccaucucuccaccu

SEQ ID NO: 3365082 - RNA, 11 nt, Hepatitis B virus
cccucaggcuc

SEQ ID NO: 3365083 - RNA, 12 nt, Hepatitis B virus
cccucaggcuca

SEQ ID NO: 3365084 - RNA, 13 nt, Hepatitis B virus
ccgccucugcucu

SEQ ID NO: 3365085 - RNA, 19 nt, Hepatitis B virus
ccguccccuucuucaucug

SEQ ID NO: 3365086 - RNA, 20 nt, Hepatitis B virus
ccgucucggggccguuuggg

SEQ ID NO: 3365087 - RNA, 12 nt, Hepatitis B virus
ccgucugugccu

SEQ ID NO: 3365088 - RNA, 20 nt, Hepatitis B virus
ccgucugugccuucucaucu

SEQ ID NO: 3365089 - RNA, 17 nt, Hepatitis B virus
ccucaccauacagcacu

SEQ ID NO: 3365090 - RNA, 20 nt, Hepatitis B virus
ccuccaccaaucggcaguca

SEQ ID NO: 3365091 - RNA, 19 nt, Hepatitis B virus
ccuccuuuccauggcugcu

SEQ ID NO: 3365092 - RNA, 14 nt, Hepatitis B virus
ccucugggauucuu

SEQ ID NO: 3365093 - RNA, 19 nt, Hepatitis B virus
ccuuuguggcuccucugcc

SEQ ID NO: 3365094 - RNA, 16 nt, Hepatitis B virus
cuacuguucaagccuc

SEQ ID NO: 3365095 - RNA, 13 nt, Hepatitis B virus
cuaggcugugcug

SEQ ID NO: 3365096 - RNA, 16 nt, Hepatitis B virus
cuaggcugugcugcca

SEQ ID NO: 3365097 - RNA, 19 nt, Hepatitis B virus
cuaggcugugcugccaacu

SEQ ID NO: 3365098 - RNA, 15 nt, Hepatitis B virus
cucacauucauuuac

SEQ ID NO: 3365099 - RNA, 17 nt, Hepatitis B virus
cucaggccaugcagugg

SEQ ID NO: 3365100 - RNA, 15 nt, Hepatitis B virus
cucaggcucagggca

SEQ ID NO: 3365101 - RNA, 15 nt, Hepatitis B virus
cuccaagcugugccu

SEQ ID NO: 3365102 - RNA, 17 nt, Hepatitis B virus
cuccucgacaccgccuc

SEQ ID NO: 3365103 - RNA, 22 nt, Hepatitis B virus
cuccucugccgauccauacugc

SEQ ID NO: 3365104 - RNA, 20 nt, Hepatitis B virus
cucggaaauacaccuccuuu

SEQ ID NO: 3365105 - RNA, 18 nt, Hepatitis B virus
cucucuuuuuugccuucu

SEQ ID NO: 3365106 - RNA, 15 nt, Hepatitis B virus
cucuuggacucucag

SEQ ID NO: 3365107 - RNA, 17 nt, Hepatitis B virus
cucuuggacucucagca

SEQ ID NO: 3365108 - RNA, 16 nt, Hepatitis B virus
cugccccuuuuacaca

SEQ ID NO: 3365109 - RNA, 18 nt, Hepatitis B virus
cugugccuucucaucugc

SEQ ID NO: 3365110 - RNA, 18 nt, Hepatitis B virus
cuguggaguuacucucuu

SEQ ID NO: 3365111 - RNA, 17 nt, Hepatitis B virus
cuucgcuucaccucugc

SEQ ID NO: 3365112 - RNA, 18 nt, Hepatitis B virus
cuugcccaaggucuuaca

SEQ ID NO: 3365113 - RNA, 18 nt, Hepatitis B virus
cuuggccauaggccaucg

SEQ ID NO: 3365114 - RNA, 12 nt, Hepatitis B virus
cuuuaauccuga

SEQ ID NO: 3365115 - RNA, 15 nt, Hepatitis B virus
cuuuacugggcuuua

SEQ ID NO: 3365116 - RNA, 19 nt, Hepatitis B virus
cuuuugggcuuugcugccc

SEQ ID NO: 3365117 - RNA, 16 nt, Hepatitis B virus
gaacauuguucaccuc

SEQ ID NO: 3365118 - RNA, 18 nt, Hepatitis B virus
gaacauuguucaccucac

SEQ ID NO: 3365119 - RNA, 15 nt, Hepatitis B virus
gaaccuuuguggcuc

SEQ ID NO: 3365120 - RNA, 14 nt, Hepatitis B virus
gacaacacugccag

SEQ ID NO: 3365121 - RNA, 18 nt, Hepatitis B virus
gacagucauccucaggcc

SEQ ID NO: 3365122 - RNA, 14 nt, Hepatitis B virus
gagcccucaggcuc

SEQ ID NO: 3365123 - RNA, 13 nt, Hepatitis B virus
gaggcaaaucagg

SEQ ID NO: 3365124 - RNA, 23 nt, Hepatitis B virus
gaggccuuuugggguggagcccu

SEQ ID NO: 3365125 - RNA, 23 nt, Hepatitis B virus
gcacuucgcuucaccucugcacg

SEQ ID NO: 3365126 - RNA, 16 nt, Hepatitis B virus
gccuccaagcugugcc

SEQ ID NO: 3365127 - RNA, 14 nt, Hepatitis B virus
gcuucaccucugca

SEQ ID NO: 3365128 - RNA, 19 nt, Hepatitis B virus
ggacuucaaccccaacaag

SEQ ID NO: 3365129 - RNA, 19 nt, Hepatitis B virus
ggagauuagguuaaagguc

SEQ ID NO: 3365130 - RNA, 11 nt, Hepatitis B virus
ggagcuucugu

SEQ ID NO: 3365131 - RNA, 18 nt, Hepatitis B virus
ggucuccccgucugugcc

SEQ ID NO: 3365132 - RNA, 23 nt, Hepatitis B virus
gguucuauccuaaccuuaccaaa

SEQ ID NO: 3365133 - RNA, 16 nt, Hepatitis B virus
gucauccucaggccau

SEQ ID NO: 3365134 - RNA, 19 nt, Hepatitis B virus
gucuccccgucugugccuu

SEQ ID NO: 3365135 - RNA, 11 nt, Hepatitis B virus
gucugugccuu

SEQ ID NO: 3365136 - RNA, 22 nt, Hepatitis B virus
guucaagccuccaagcugugcc

SEQ ID NO: 3365137 - RNA, 19 nt, Hepatitis B virus
uauaaagaauuuggagcuu

SEQ ID NO: 3365138 - RNA, 22 nt, Hepatitis B virus
ucaacaauaugugggcccucug

SEQ ID NO: 3365139 - RNA, 15 nt, Hepatitis B virus
uccaggguucacccc

SEQ ID NO: 3365140 - RNA, 15 nt, Hepatitis B virus
ucccaauccucuggg

SEQ ID NO: 3365141 - RNA, 19 nt, Hepatitis B virus
uccucgacaccgccucugc

SEQ ID NO: 3365142 - RNA, 18 nt, Hepatitis B virus
ucuccccgucugugccuu

SEQ ID NO: 3365143 - RNA, 19 nt, Hepatitis B virus
ucuguaucgggaggccuua

SEQ ID NO: 3365144 - RNA, 12 nt, Hepatitis B virus
ucuuggacucuc

SEQ ID NO: 3365145 - RNA, 14 nt, Hepatitis B virus
ucuuggacucucag

SEQ ID NO: 3365146 - RNA, 14 nt, Hepatitis B virus
ucuuuaauccugau

SEQ ID NO: 3365147 - RNA, 17 nt, Hepatitis B virus
ucuuuccuucuauucga

SEQ ID NO: 3365148 - RNA, 22 nt, Hepatitis B virus
ugcaacuuuuuccccucugccu

SEQ ID NO: 3365149 - RNA, 18 nt, Hepatitis B virus
ugcuaggcugugcugcca

SEQ ID NO: 3365150 - RNA, 21 nt, Hepatitis B virus
uggaaccuuuguggcuccucu

SEQ ID NO: 3365151 - RNA, 17 nt, Hepatitis B virus
uggcuuuggggcaugga

SEQ ID NO: 3365152 - RNA, 15 nt, Hepatitis B virus
uguggcuccucugcc

SEQ ID NO: 3365153 - RNA, 14 nt, Hepatitis B virus
uuguggcuccucug

SEQ ID NO: 3365154 - RNA, 15 nt, Hepatitis B virus
uuguucaccucacca

SEQ ID NO: 3365155 - RNA, 20 nt, Hepatitis B virus
uuuacaggaggacauuauua

SEQ ID NO: 3365156 - RNA, 16 nt, Hepatitis B virus
cucuuggacucucagc

SEQ ID NO: 3365157 - RNA, 23 nt, Hepatitis B virus
cugccuaaucaucucauguucau

SEQ ID NO: 3365158 - RNA, 12 nt, Hepatitis B virus
cugccuccacca

SEQ ID NO: 3365159 - RNA, 15 nt, Hepatitis B virus
cugccuugaugccuu

SEQ ID NO: 3365160 - RNA, 15 nt, Hepatitis B virus
cugcguucggagcca

SEQ ID NO: 3365161 - RNA, 22 nt, Hepatitis B virus
cugcucuguaucgggaggccuu

SEQ ID NO: 3365162 - RNA, 21 nt, Hepatitis B virus
cugggaggaguugggggagga

SEQ ID NO: 3365163 - RNA, 22 nt, Hepatitis B virus
cuguaccugucuuuaauccuga

SEQ ID NO: 3365164 - RNA, 15 nt, Hepatitis B virus
cuguggaaggcuggc

SEQ ID NO: 3365165 - RNA, 12 nt, Hepatitis B virus
cuucaucugccg

SEQ ID NO: 3365166 - RNA, 22 nt, Hepatitis B virus
cuuggguggcuuuggggcaugg

SEQ ID NO: 3365167 - RNA, 19 nt, Hepatitis B virus
cuuucuguucccaauccuc

SEQ ID NO: 3365168 - RNA, 17 nt, Hepatitis B virus
cuuuugggguggagccc

SEQ ID NO: 3365169 - RNA, 15 nt, Hepatitis B virus
gacaaggcaugggga

SEQ ID NO: 3365170 - RNA, 16 nt, Hepatitis B virus
gaccgaccuugaggca

SEQ ID NO: 3365171 - RNA, 18 nt, Hepatitis B virus
gacucauaaggugggaaa

SEQ ID NO: 3365172 - RNA, 22 nt, Hepatitis B virus
gagacagucauccucaggccau

SEQ ID NO: 3365173 - RNA, 21 nt, Hepatitis B virus
gagccaacucaaacaauccag

SEQ ID NO: 3365174 - RNA, 23 nt, Hepatitis B virus
gcaacccccacggguuggggcuu

SEQ ID NO: 3365175 - RNA, 15 nt, Hepatitis B virus
gcagucaggaagaca

SEQ ID NO: 3365176 - RNA, 13 nt, Hepatitis B virus
gccaacucaaaca

SEQ ID NO: 3365177 - RNA, 13 nt, Hepatitis B virus
gcugugcugccaa

SEQ ID NO: 3365178 - RNA, 18 nt, Hepatitis B virus
ggacucuuggacucucag

SEQ ID NO: 3365179 - RNA, 22 nt, Hepatitis B virus
ggucuuuugggcuuugcugccc

SEQ ID NO: 3365180 - RNA, 15 nt, Hepatitis B virus
gguggcuuuggggca

SEQ ID NO: 3365181 - RNA, 11 nt, Hepatitis B virus
gguuggggcuu

SEQ ID NO: 3365182 - RNA, 18 nt, Hepatitis B virus
gucaaagaauuguggguc

SEQ ID NO: 3365183 - RNA, 13 nt, Hepatitis B virus
gucaacaauaugu

SEQ ID NO: 3365184 - RNA, 13 nt, Hepatitis B virus
gucauccucaggc

SEQ ID NO: 3365185 - RNA, 14 nt, Hepatitis B virus
guccuacuguucaa

SEQ ID NO: 3365186 - RNA, 19 nt, Hepatitis B virus
guccuacuguucaagccuc

SEQ ID NO: 3365187 - RNA, 22 nt, Hepatitis B virus
guucccaauccucugggauucu

SEQ ID NO: 3365188 - RNA, 14 nt, Hepatitis B virus
uagagucuccggaa

SEQ ID NO: 3365189 - RNA, 17 nt, Hepatitis B virus
uauccugaauaugcagu

SEQ ID NO: 3365190 - RNA, 16 nt, Hepatitis B virus
ucaccaguuggacccu

SEQ ID NO: 3365191 - RNA, 15 nt, Hepatitis B virus
ucaggcucagggcau

SEQ ID NO: 3365192 - RNA, 22 nt, Hepatitis B virus
uccaaaccucgacaaggcaugg

SEQ ID NO: 3365193 - RNA, 21 nt, Hepatitis B virus
uccagauugggacuucaaccc

SEQ ID NO: 3365194 - RNA, 17 nt, Hepatitis B virus
ucccaucucuccaccuc

SEQ ID NO: 3365195 - RNA, 12 nt, Hepatitis B virus
uccccucugccu

SEQ ID NO: 3365196 - RNA, 17 nt, Hepatitis B virus
uccucaggccaugcagu

SEQ ID NO: 3365197 - RNA, 14 nt, Hepatitis B virus
uccugccuccacca

SEQ ID NO: 3365198 - RNA, 12 nt, Hepatitis B virus
ucgggaggccuu

SEQ ID NO: 3365199 - RNA, 22 nt, Hepatitis B virus
ucuaagcaggcuuucacuuucu

SEQ ID NO: 3365200 - RNA, 21 nt, Hepatitis B virus
ucucuccaccucuaagagaca

SEQ ID NO: 3365201 - RNA, 13 nt, Hepatitis B virus
ucugacuucuuuc

SEQ ID NO: 3365202 - RNA, 22 nt, Hepatitis B virus
ucuguucaccagcaccaugcaa

SEQ ID NO: 3365203 - RNA, 13 nt, Hepatitis B virus
ucuucaucugccg

SEQ ID NO: 3365204 - RNA, 15 nt, Hepatitis B virus
uggacaaaggcauua

SEQ ID NO: 3365205 - RNA, 22 nt, Hepatitis B virus
uggacccugcguucggagccaa

SEQ ID NO: 3365206 - RNA, 12 nt, Hepatitis B virus
uggagcccucag

SEQ ID NO: 3365207 - RNA, 18 nt, Hepatitis B virus
uggagcccucaggcucag

SEQ ID NO: 3365208 - RNA, 23 nt, Hepatitis B virus
uggagcccucaggcucagggcau

SEQ ID NO: 3365209 - RNA, 13 nt, Hepatitis B virus
ugggguggagccc

SEQ ID NO: 3365210 - RNA, 21 nt, Hepatitis B virus
uguucauguccuacuguucaa

SEQ ID NO: 3365211 - RNA, 17 nt, Hepatitis B virus
uuaaucauuacuucaaa

SEQ ID NO: 3365212 - RNA, 12 nt, Hepatitis B virus
uuccccucugcc

SEQ ID NO: 3365213 - RNA, 17 nt, Hepatitis B virus
uugaggcauacuucaaa

SEQ ID NO: 3365214 - RNA, 14 nt, Hepatitis B virus
uugggacuucaacc

SEQ ID NO: 3365215 - RNA, 12 nt, Hepatitis B virus
uuuccccucugc

SEQ ID NO: 3365216 - RNA, 17 nt, Hepatitis B virus
uuugggcuuugcugccc

SEQ ID NO: 3365217 - RNA, 17 nt, Hepatitis B virus
aaacuaggcauuauuua

SEQ ID NO: 3365218 - RNA, 17 nt, Hepatitis B virus
aaacuuuacugggcuuu

SEQ ID NO: 3365219 - RNA, 20 nt, Hepatitis B virus
aacaagagcuacagcauggg

SEQ ID NO: 3365220 - RNA, 14 nt, Hepatitis B virus
aacggucaggucuc

SEQ ID NO: 3365221 - RNA, 17 nt, Hepatitis B virus
aauauuugcccuuggac

SEQ ID NO: 3365222 - RNA, 19 nt, Hepatitis B virus
acaauccagauugggacuu

SEQ ID NO: 3365223 - RNA, 13 nt, Hepatitis B virus
acauucauuuaca

SEQ ID NO: 3365224 - RNA, 14 nt, Hepatitis B virus
accaaauauuugcc

SEQ ID NO: 3365225 - RNA, 16 nt, Hepatitis B virus
accauacagcacucag

SEQ ID NO: 3365226 - RNA, 12 nt, Hepatitis B virus
accugucuuuaa

SEQ ID NO: 3365227 - RNA, 16 nt, Hepatitis B virus
acgcccaccaggucuu

SEQ ID NO: 3365228 - RNA, 18 nt, Hepatitis B virus
acucauaaggugggaaac

SEQ ID NO: 3365229 - RNA, 12 nt, Hepatitis B virus
acucuguggaag

SEQ ID NO: 3365230 - RNA, 12 nt, Hepatitis B virus
acucuuggacuc

SEQ ID NO: 3365231 - RNA, 15 nt, Hepatitis B virus
acucuuggacucuca

SEQ ID NO: 3365232 - RNA, 21 nt, Hepatitis B virus
acuggccagaggcaaaucagg

SEQ ID NO: 3365233 - RNA, 18 nt, Hepatitis B virus
agcaccuccuccugccuc

SEQ ID NO: 3365234 - RNA, 15 nt, Hepatitis B virus
agcagcaccuccucc

SEQ ID NO: 3365235 - RNA, 15 nt, Hepatitis B virus
agcauuugguccagg

SEQ ID NO: 3365236 - RNA, 18 nt, Hepatitis B virus
agccuccaagcugugccu

SEQ ID NO: 3365237 - RNA, 21 nt, Hepatitis B virus
aggaagacagccuacucccau

SEQ ID NO: 3365238 - RNA, 12 nt, Hepatitis B virus
aggucucugcca

SEQ ID NO: 3365239 - RNA, 23 nt, Hepatitis B virus
aucaccaguuggacccugcguuc

SEQ ID NO: 3365240 - RNA, 15 nt, Hepatitis B virus
auccuaaccuuacca

SEQ ID NO: 3365241 - RNA, 16 nt, Hepatitis B virus
auccugaauaugcagu

SEQ ID NO: 3365242 - RNA, 23 nt, Hepatitis B virus
augcaacuuuuuccccucugccu

SEQ ID NO: 3365243 - RNA, 17 nt, Hepatitis B virus
auguggcuauccugccu

SEQ ID NO: 3365244 - RNA, 16 nt, Hepatitis B virus
auugacaacacugcca

SEQ ID NO: 3365245 - RNA, 19 nt, Hepatitis B virus
auuggaaaacucccuccuu

SEQ ID NO: 3365246 - RNA, 13 nt, Hepatitis B virus
auuuacaggagga

SEQ ID NO: 3365247 - RNA, 22 nt, Hepatitis B virus
caaggaucacuggccagaggca

SEQ ID NO: 3365248 - RNA, 14 nt, Hepatitis B virus
caccauacagcacu

SEQ ID NO: 3365249 - RNA, 16 nt, Hepatitis B virus
caccccaccacacgga

SEQ ID NO: 3365250 - RNA, 13 nt, Hepatitis B virus
caccgccucugcu

SEQ ID NO: 3365251 - RNA, 16 nt, Hepatitis B virus
caccgccucugcucug

SEQ ID NO: 3365252 - RNA, 16 nt, Hepatitis B virus
gcuacagcaugggagg

SEQ ID NO: 3365253 - RNA, 12 nt, Hepatitis B virus
gcuuugcugccc

SEQ ID NO: 3365254 - RNA, 12 nt, Hepatitis B virus
ggacucuuggac

SEQ ID NO: 3365255 - RNA, 21 nt, Hepatitis B virus
ggcauaaauuggucuguucac

SEQ ID NO: 3365256 - RNA, 21 nt, Hepatitis B virus
ggcauauugacaacacugcca

SEQ ID NO: 3365257 - RNA, 14 nt, Hepatitis B virus
ggcccucugacagu

SEQ ID NO: 3365258 - RNA, 21 nt, Hepatitis B virus
ggucuuccaaaccucgacaag

SEQ ID NO: 3365259 - RNA, 16 nt, Hepatitis B virus
guacuaggaggcugua

SEQ ID NO: 3365260 - RNA, 15 nt, Hepatitis B virus
gucaggucucugcca

SEQ ID NO: 3365261 - RNA, 18 nt, Hepatitis B virus
gugccuucucaucugccg

SEQ ID NO: 3365262 - RNA, 16 nt, Hepatitis B virus
uaaccuuaccaaauau

SEQ ID NO: 3365263 - RNA, 21 nt, Hepatitis B virus
uaccaaauauuugcccuugga

SEQ ID NO: 3365264 - RNA, 22 nt, Hepatitis B virus
ucaagccuccaagcugugccuu

SEQ ID NO: 3365265 - RNA, 14 nt, Hepatitis B virus
ucaggucucugcca

SEQ ID NO: 3365266 - RNA, 14 nt, Hepatitis B virus
ucauccucaggcca

SEQ ID NO: 3365267 - RNA, 19 nt, Hepatitis B virus
uccagauugggacuucaac

SEQ ID NO: 3365268 - RNA, 16 nt, Hepatitis B virus
ucccaucucuccaccu

SEQ ID NO: 3365269 - RNA, 20 nt, Hepatitis B virus
uccucgacaccgccucugcu

SEQ ID NO: 3365270 - RNA, 13 nt, Hepatitis B virus
ucgacaaggcaug

SEQ ID NO: 3365271 - RNA, 20 nt, Hepatitis B virus
ucggaaauacaccuccuuuc

SEQ ID NO: 3365272 - RNA, 23 nt, Hepatitis B virus
ucuuggacucucagcaaugucaa

SEQ ID NO: 3365273 - RNA, 23 nt, Hepatitis B virus
ugcacuucgcuucaccucugcac

SEQ ID NO: 3365274 - RNA, 15 nt, Hepatitis B virus
ugccagcagcaccuc

SEQ ID NO: 3365275 - RNA, 17 nt, Hepatitis B virus
ugccuucucaucugccg

SEQ ID NO: 3365276 - RNA, 15 nt, Hepatitis B virus
ugcggaacuccuagc

SEQ ID NO: 3365277 - RNA, 14 nt, Hepatitis B virus
uggacucucagcaa

SEQ ID NO: 3365278 - RNA, 18 nt, Hepatitis B virus
ugggagguuggucuucca

SEQ ID NO: 3365279 - RNA, 12 nt, Hepatitis B virus
uggucuguucac

SEQ ID NO: 3365280 - RNA, 21 nt, Hepatitis B virus
uguaccugucuuuaauccuga

SEQ ID NO: 3365281 - RNA, 15 nt, Hepatitis B virus
uguccuacuguucaa

SEQ ID NO: 3365282 - RNA, 16 nt, Hepatitis B virus
ugugggcccucugaca

SEQ ID NO: 3365283 - RNA, 14 nt, Hepatitis B virus
uucaaagacuguuu

SEQ ID NO: 3365284 - RNA, 13 nt, Hepatitis B virus
uucuuuccuucua

SEQ ID NO: 3365285 - RNA, 15 nt, Hepatitis B virus
uuggacaaaggcauu

SEQ ID NO: 3365286 - RNA, 16 nt, Hepatitis B virus
uuggacaaaggcauua

SEQ ID NO: 3365287 - RNA, 17 nt, Hepatitis B virus
uuguggcuccucugccg

SEQ ID NO: 3365288 - RNA, 17 nt, Hepatitis B virus
aaacuacacgcagcgcc

SEQ ID NO: 3365289 - RNA, 19 nt, Hepatitis B virus
aagaauugugggucuuuug

SEQ ID NO: 3365290 - RNA, 19 nt, Hepatitis B virus
aauaugugggcccucugac

SEQ ID NO: 3365291 - RNA, 17 nt, Hepatitis B virus
acaacacugccagcagc

SEQ ID NO: 3365292 - RNA, 22 nt, Hepatitis B virus
acauacucuguggaaggcuggc

SEQ ID NO: 3365293 - RNA, 23 nt, Hepatitis B virus
accccaacaaggaucacuggcca

SEQ ID NO: 3365294 - RNA, 24 nt, Hepatitis B virus
acccguauaaagaauuuggagcuu

SEQ ID NO: 3365295 - RNA, 18 nt, Hepatitis B virus
acccugcguucggagcca

SEQ ID NO: 3365296 - RNA, 18 nt, Hepatitis B virus
accucgacaaggcauggg

SEQ ID NO: 3365297 - RNA, 13 nt, Hepatitis B virus
accucucuuuacg

SEQ ID NO: 3365298 - RNA, 23 nt, Hepatitis B virus
acgcggucuccccgucugugccu

SEQ ID NO: 3365299 - RNA, 20 nt, Hepatitis B virus
acucaggcaagcuauucugu

SEQ ID NO: 3365300 - RNA, 18 nt, Hepatitis B virus
acucuguggaaggcuggc

SEQ ID NO: 3365301 - RNA, 19 nt, Hepatitis B virus
acuucaaaacuaggcauua

SEQ ID NO: 3365302 - RNA, 16 nt, Hepatitis B virus
agcaugggagguuggu

SEQ ID NO: 3365303 - RNA, 16 nt, Hepatitis B virus
agcccucaggcucagg

SEQ ID NO: 3365304 - RNA, 24 nt, Hepatitis B virus
aggagauuaaaauuaauuaugccu

SEQ ID NO: 3365305 - RNA, 19 nt, Hepatitis B virus
agguuggucuuccaaaccu

SEQ ID NO: 3365306 - RNA, 15 nt, Hepatitis B virus
aguuacucucuuuuu

SEQ ID NO: 3365307 - RNA, 20 nt, Hepatitis B virus
auaugcaguuaaucauuacu

SEQ ID NO: 3365308 - RNA, 17 nt, Hepatitis B virus
aucacuggccagaggca

SEQ ID NO: 3365309 - RNA, 13 nt, Hepatitis B virus
auccucaggccau

SEQ ID NO: 3365310 - RNA, 15 nt, Hepatitis B virus
auuuacauacucugu

SEQ ID NO: 3365311 - RNA, 14 nt, Hepatitis B virus
caacacugccagca

SEQ ID NO: 3365312 - RNA, 13 nt, Hepatitis B virus
caacuuuuucccc

SEQ ID NO: 3365313 - RNA, 16 nt, Hepatitis B virus
caaggaucacuggcca

SEQ ID NO: 3365314 - RNA, 23 nt, Hepatitis B virus
caauaugugggcccucugacagu

SEQ ID NO: 3365315 - RNA, 15 nt, Hepatitis B virus
caccgccucugcucu

SEQ ID NO: 3365316 - RNA, 18 nt, Hepatitis B virus
cacuucgcuucaccucug

SEQ ID NO: 3365317 - RNA, 12 nt, Hepatitis B virus
cauccucaggcc

SEQ ID NO: 3365318 - RNA, 12 nt, Hepatitis B virus
cauggcugcuag

SEQ ID NO: 3365319 - RNA, 18 nt, Hepatitis B virus
cauggcugcuaggcugug

SEQ ID NO: 3365320 - RNA, 21 nt, Hepatitis B virus
cauuguucaccucaccauaca

SEQ ID NO: 3365321 - RNA, 23 nt, Hepatitis B virus
ccaccacacggaggccuuuuggg

SEQ ID NO: 3365322 - RNA, 18 nt, Hepatitis C virus
acugcagagagugcugau

SEQ ID NO: 3365323 - RNA, 17 nt, Hepatitis C virus
agagugcugauacuggc

SEQ ID NO: 3365324 - RNA, 19 nt, Hepatitis C virus
agucacggcuagcugugaa

SEQ ID NO: 3365325 - RNA, 22 nt, Hepatitis C virus
cagagagugcugauacuggccu

SEQ ID NO: 3365326 - RNA, 19 nt, Hepatitis C virus
caugacugcagagagugcu

SEQ ID NO: 3365327 - RNA, 21 nt, Hepatitis C virus
cuucuuuaaugguggcuccau

SEQ ID NO: 3365328 - RNA, 13 nt, Hepatitis C virus
cuuuccuucuuuu

SEQ ID NO: 3365329 - RNA, 18 nt, Hepatitis C virus
cuuucuuuuccuuccuuc

SEQ ID NO: 3365330 - RNA, 21 nt, Hepatitis C virus
gagagugcugauacuggccuc

SEQ ID NO: 3365331 - RNA, 13 nt, Hepatitis C virus
gccucucugcaga

SEQ ID NO: 3365332 - RNA, 20 nt, Hepatitis C virus
gccucuuaggccauuuccug

SEQ ID NO: 3365333 - RNA, 16 nt, Hepatitis C virus
gugcugauacuggccu

SEQ ID NO: 3365334 - RNA, 19 nt, Hepatitis C virus
gugcugauacuggccucuc

SEQ ID NO: 3365335 - RNA, 18 nt, Hepatitis C virus
aacacuccggccucuuag

SEQ ID NO: 3365336 - RNA, 19 nt, Hepatitis C virus
acuggccucucugcagauc

SEQ ID NO: 3365337 - RNA, 19 nt, Hepatitis C virus
agagugcugauacuggccu

SEQ ID NO: 3365338 - RNA, 13 nt, Hepatitis C virus
auacuggccucuc

SEQ ID NO: 3365339 - RNA, 20 nt, Hepatitis C virus
cugcagagagugcugauacu

SEQ ID NO: 3365340 - RNA, 20 nt, Hepatitis C virus
cugugaaagguccgugagcc

SEQ ID NO: 3365341 - RNA, 23 nt, Hepatitis C virus
cugugaaagguccgugagccgca

SEQ ID NO: 3365342 - RNA, 14 nt, Hepatitis C virus
aaacacuccggccu

SEQ ID NO: 3365343 - RNA, 15 nt, Hepatitis C virus
acggcuagcugugaa

SEQ ID NO: 3365344 - RNA, 23 nt, Hepatitis C virus
agccgcaugacugcagagagugc

SEQ ID NO: 3365345 - RNA, 14 nt, Hepatitis C virus
cacuccggccucuu

SEQ ID NO: 3365346 - RNA, 13 nt, Hepatitis C virus
caugacugcagag

SEQ ID NO: 3365347 - RNA, 15 nt, Hepatitis C virus
ccuuccuucuuuaau

SEQ ID NO: 3365348 - RNA, 18 nt, Hepatitis C virus
ccuucuuuaaugguggcu

SEQ ID NO: 3365349 - RNA, 12 nt, Hepatitis C virus
cuuuuccuuccu

SEQ ID NO: 3365350 - RNA, 12 nt, Hepatitis C virus
ggcuagcuguga

SEQ ID NO: 3365351 - RNA, 23 nt, Hepatitis C virus
ugagccgcaugacugcagagagu

SEQ ID NO: 3365352 - RNA, 12 nt, Hepatitis C virus
aggccauuuccu

SEQ ID NO: 3365353 - RNA, 13 nt, Hepatitis C virus
ccucucugcagau

SEQ ID NO: 3365354 - RNA, 13 nt, Hepatitis C virus
ccuuccuucuuua

SEQ ID NO: 3365355 - RNA, 12 nt, Hepatitis C virus
cggcuagcugug

SEQ ID NO: 3365356 - RNA, 16 nt, Hepatitis C virus
cuggccucucugcaga

SEQ ID NO: 3365357 - RNA, 16 nt, Hepatitis C virus
gagccgcaugacugca

SEQ ID NO: 3365358 - RNA, 12 nt, Hepatitis C virus
gccauuuccugu

SEQ ID NO: 3365359 - RNA, 22 nt, Hepatitis C virus
gcugugaaagguccgugagccg

SEQ ID NO: 3365360 - RNA, 22 nt, Hepatitis C virus
uccuucuuuaaugguggcucca

SEQ ID NO: 3365361 - RNA, 16 nt, Hepatitis C virus
ugagccgcaugacugc

SEQ ID NO: 3365362 - RNA, 11 nt, Hepatitis C virus
ugguggcucca

SEQ ID NO: 3365363 - RNA, 20 nt, Hepatitis C virus
uuaggccauuuccuguuuuu

SEQ ID NO: 3365364 - RNA, 22 nt, Hepatitis C virus
gagagugcugauacuggccucu

SEQ ID NO: 3365365 - RNA, 19 nt, Hepatitis C virus
gauacuggccucucugcag

SEQ ID NO: 3365366 - RNA, 23 nt, Hepatitis C virus
gcagagagugcugauacuggccu

SEQ ID NO: 3365367 - RNA, 23 nt, Hepatitis C virus
gcccuagucacggcuagcuguga

SEQ ID NO: 3365368 - RNA, 13 nt, Hepatitis C virus
gccgcaugacugc

SEQ ID NO: 3365369 - RNA, 14 nt, Hepatitis C virus
gcuccaucuuagcc

SEQ ID NO: 3365370 - RNA, 15 nt, Hepatitis C virus
gcuccaucuuagccc

SEQ ID NO: 3365371 - RNA, 22 nt, Hepatitis C virus
gcugauacuggccucucugcag

SEQ ID NO: 3365372 - RNA, 19 nt, Hepatitis C virus
guaaacacuccggccucuu

SEQ ID NO: 3365373 - RNA, 19 nt, Hepatitis C virus
ugaaagguccgugagccgc

SEQ ID NO: 3365374 - RNA, 15 nt, Hepatitis C virus
uuaaugguggcucca

SEQ ID NO: 3365375 - RNA, 15 nt, Hepatitis D virus
accccucucgggcgc

SEQ ID NO: 3365376 - RNA, 13 nt, Hepatitis D virus
acucaccccucuc

SEQ ID NO: 3365377 - RNA, 22 nt, Hepatitis D virus
agccucacucguccccucucgg

SEQ ID NO: 3365378 - RNA, 14 nt, Hepatitis D virus
agggguccucugga

SEQ ID NO: 3365379 - RNA, 21 nt, Hepatitis D virus
aucgcuauggucuacucccuc

SEQ ID NO: 3365380 - RNA, 13 nt, Hepatitis D virus
auuucucuguucu

SEQ ID NO: 3365381 - RNA, 13 nt, Hepatitis D virus
caccuucccucuu

SEQ ID NO: 3365382 - RNA, 20 nt, Hepatitis D virus
cagccgacccucccuccucu

SEQ ID NO: 3365383 - RNA, 17 nt, Hepatitis D virus
cauggcaucuccaccuc

SEQ ID NO: 3365384 - RNA, 20 nt, Hepatitis D virus
cauuccugggcgacccuugg

SEQ ID NO: 3365385 - RNA, 13 nt, Hepatitis D virus
cccaacuccuagc

SEQ ID NO: 3365386 - RNA, 14 nt, Hepatitis D virus
cccagccggcgcca

SEQ ID NO: 3365387 - RNA, 18 nt, Hepatitis D virus
cccgccauuccugggcga

SEQ ID NO: 3365388 - RNA, 21 nt, Hepatitis D virus
cccucucgcgaugcgcucucu

SEQ ID NO: 3365389 - RNA, 21 nt, Hepatitis D virus
ccgacucaccccucucgggcg

SEQ ID NO: 3365390 - RNA, 19 nt, Hepatitis D virus
ccgaggggacgguccccuc

SEQ ID NO: 3365391 - RNA, 15 nt, Hepatitis D virus
ccguguggcuuccuc

SEQ ID NO: 3365392 - RNA, 22 nt, Hepatitis D virus
ccugcuagccccgcugcucucu

SEQ ID NO: 3365393 - RNA, 12 nt, Hepatitis D virus
ccuucucuucca

SEQ ID NO: 3365394 - RNA, 12 nt, Hepatitis D virus
cgaccugggcau

SEQ ID NO: 3365395 - RNA, 16 nt, Hepatitis D virus
cgacucaccccucucg

SEQ ID NO: 3365396 - RNA, 14 nt, Hepatitis D virus
cgaugcgcucucug

SEQ ID NO: 3365397 - RNA, 15 nt, Hepatitis D virus
cgaugcgcucucugu

SEQ ID NO: 3365398 - RNA, 18 nt, Hepatitis D virus
cggaacacccaccugcua

SEQ ID NO: 3365399 - RNA, 16 nt, Hepatitis D virus
cgguccgaccugggca

SEQ ID NO: 3365400 - RNA, 22 nt, Hepatitis D virus
cuacuccguguggcuuccuccc

SEQ ID NO: 3365401 - RNA, 14 nt, Hepatitis D virus
cucaacccuucggg

SEQ ID NO: 3365402 - RNA, 13 nt, Hepatitis D virus
cuccaccuccucg

SEQ ID NO: 3365403 - RNA, 15 nt, Hepatitis D virus
cuccaccuccucgcg

SEQ ID NO: 3365404 - RNA, 21 nt, Hepatitis D virus
cuuccaccuucccucuuuccc

SEQ ID NO: 3365405 - RNA, 14 nt, Hepatitis D virus
cuuccucccucugg

SEQ ID NO: 3365406 - RNA, 18 nt, Hepatitis D virus
cuuggccgccgggccccu

SEQ ID NO: 3365407 - RNA, 14 nt, Hepatitis D virus
gaacacccaccugc

SEQ ID NO: 3365408 - RNA, 15 nt, Hepatitis D virus
gaugcgcucucuguu

SEQ ID NO: 3365409 - RNA, 14 nt, Hepatitis D virus
gcaucuccaccucc

SEQ ID NO: 3365410 - RNA, 15 nt, Hepatitis D virus
gccgccgggccccuc

SEQ ID NO: 3365411 - RNA, 17 nt, Hepatitis D virus
gccgccgggccccucgg

SEQ ID NO: 3365412 - RNA, 20 nt, Hepatitis D virus
gccucacucguccccucucg

SEQ ID NO: 3365413 - RNA, 19 nt, Hepatitis D virus
gccuccuucucuuccaccu

SEQ ID NO: 3365414 - RNA, 23 nt, Hepatitis D virus
gcuaagggagagccacuuuucuc

SEQ ID NO: 3365415 - RNA, 21 nt, Hepatitis D virus
gcugaucuauccuccccgcga

SEQ ID NO: 3365416 - RNA, 21 nt, Hepatitis D virus
gcuucggucucccccaacucc

SEQ ID NO: 3365417 - RNA, 22 nt, Hepatitis D virus
gcuucggucucccccaacuccu

SEQ ID NO: 3365418 - RNA, 13 nt, Hepatitis D virus
gcuucuugcuuuc

SEQ ID NO: 3365419 - RNA, 17 nt, Hepatitis D virus
ggcuuccucccucuggg

SEQ ID NO: 3365420 - RNA, 22 nt, Hepatitis D virus
gggcgacccuuggggggaagga

SEQ ID NO: 3365421 - RNA, 20 nt, Hepatitis D virus
ggggaaauucauccgcuucu

SEQ ID NO: 3365422 - RNA, 14 nt, Hepatitis D virus
ggucuacucccucu

SEQ ID NO: 3365423 - RNA, 12 nt, Hepatitis D virus
gguuuccacucg

SEQ ID NO: 3365424 - RNA, 15 nt, Hepatitis D virus
guccuucuuuccucu

SEQ ID NO: 3365425 - RNA, 16 nt, Hepatitis D virus
guccuucuuuccucuu

SEQ ID NO: 3365426 - RNA, 19 nt, Hepatitis D virus
uacuccguguggcuuccuc

SEQ ID NO: 3365427 - RNA, 23 nt, Hepatitis D virus
ucccagccgacccucccuccucu

SEQ ID NO: 3365428 - RNA, 18 nt, Hepatitis D virus
ucccucuuuccccuuccu

SEQ ID NO: 3365429 - RNA, 20 nt, Hepatitis D virus
ucgcugaagggguccucugg

SEQ ID NO: 3365430 - RNA, 14 nt, Hepatitis D virus
ucguccccucucgg

SEQ ID NO: 3365431 - RNA, 14 nt, Hepatitis D virus
ucuccaccuccucg

SEQ ID NO: 3365432 - RNA, 19 nt, Hepatitis D virus
ucucgcgaugcgcucucug

SEQ ID NO: 3365433 - RNA, 15 nt, Hepatitis D virus
ucucuuccaccuucc

SEQ ID NO: 3365434 - RNA, 15 nt, Hepatitis D virus
uggcuuccucccucu

SEQ ID NO: 3365435 - RNA, 18 nt, Hepatitis D virus
ugggcauccgaaggagga

SEQ ID NO: 3365436 - RNA, 14 nt, Hepatitis D virus
ugggcgacccuugg

SEQ ID NO: 3365437 - RNA, 21 nt, Hepatitis D virus
uguggcuuccucccucugggg

SEQ ID NO: 3365438 - RNA, 21 nt, Hepatitis D virus
uucucucgcuucucucuggga

SEQ ID NO: 3365439 - RNA, 23 nt, Hepatitis D virus
ggagagccacuuuucucucgcuu

SEQ ID NO: 3365440 - RNA, 14 nt, Hepatitis D virus
gugauuucucuguu

SEQ ID NO: 3365441 - RNA, 13 nt, Hepatitis D virus
uccaccuucccuc

SEQ ID NO: 3365442 - RNA, 15 nt, Hepatitis D virus
ucucgcuucucucug

SEQ ID NO: 3365443 - RNA, 18 nt, Hepatitis D virus
ucuuugcuuuccuccucg

SEQ ID NO: 3365444 - RNA, 13 nt, Hepatitis D virus
ugcuuuccuccuc

SEQ ID NO: 3365445 - RNA, 14 nt, Hepatitis D virus
ugcuuuccuccucg

SEQ ID NO: 3365446 - RNA, 17 nt, Hepatitis D virus
uggcuaagggagagcca

SEQ ID NO: 3365447 - RNA, 21 nt, Hepatitis D virus
uucgcugaagggguccucugg

SEQ ID NO: 3365448 - RNA, 17 nt, Hepatitis D virus
uucucucugggaagcua

SEQ ID NO: 3365449 - RNA, 19 nt, Hepatitis D virus
cucucuuugcuuuccuccu

SEQ ID NO: 3365450 - RNA, 17 nt, Hepatitis D virus
cucuuuccccuuccuag

SEQ ID NO: 3365451 - RNA, 23 nt, Hepatitis D virus
cugcucucuuugcuuuccuccuc

SEQ ID NO: 3365452 - RNA, 15 nt, Hepatitis D virus
cuuccucccucuggg

SEQ ID NO: 3365453 - RNA, 13 nt, Hepatitis D virus
cuucuugcuuucu

SEQ ID NO: 3365454 - RNA, 17 nt, Hepatitis D virus
cuuugcuuuccuccucg

SEQ ID NO: 3365455 - RNA, 22 nt, Hepatitis D virus
gccagcgaggaggcugggacca

SEQ ID NO: 3365456 - RNA, 15 nt, Hepatitis D virus
gccgacccucccucc

SEQ ID NO: 3365457 - RNA, 20 nt, Hepatitis D virus
gccgacccucccuccucucc

SEQ ID NO: 3365458 - RNA, 13 nt, Hepatitis D virus
gccuccuucucuu

SEQ ID NO: 3365459 - RNA, 21 nt, Hepatitis D virus
gcuauggucuacucccucucg

SEQ ID NO: 3365460 - RNA, 15 nt, Hepatitis D virus
gcucucuuugcuuuc

SEQ ID NO: 3365461 - RNA, 12 nt, Hepatitis D virus
gguccucuggag

SEQ ID NO: 3365462 - RNA, 19 nt, Hepatitis D virus
ggucggcauggcaucucca

SEQ ID NO: 3365463 - RNA, 16 nt, Hepatitis D virus
guggcuuccucccucu

SEQ ID NO: 3365464 - RNA, 14 nt, Hepatitis D virus
uacucucaacccuu

SEQ ID NO: 3365465 - RNA, 17 nt, Hepatitis D virus
ucacucguccccucucg

SEQ ID NO: 3365466 - RNA, 16 nt, Hepatitis D virus
ucccagccgacccucc

SEQ ID NO: 3365467 - RNA, 15 nt, Hepatitis D virus
ucccauggcuccacu

SEQ ID NO: 3365468 - RNA, 21 nt, Hepatitis D virus
uccccgggauaagccucacuc

SEQ ID NO: 3365469 - RNA, 16 nt, Hepatitis D virus
uccuagcauccccucc

SEQ ID NO: 3365470 - RNA, 12 nt, Hepatitis D virus
uccucuggaggu

SEQ ID NO: 3365471 - RNA, 22 nt, Hepatitis D virus
ucuuuaccgacucaccccucuc

SEQ ID NO: 3365472 - RNA, 13 nt, Hepatitis D virus
ucuuuccccuucc

SEQ ID NO: 3365473 - RNA, 22 nt, Hepatitis D virus
ugcucucuuugcuuuccuccuc

SEQ ID NO: 3365474 - RNA, 14 nt, Hepatitis D virus
uggcaucuccaccu

SEQ ID NO: 3365475 - RNA, 17 nt, Hepatitis D virus
uggcuuccucccucugg

SEQ ID NO: 3365476 - RNA, 19 nt, Hepatitis D virus
uguggcuuccucccucugg

SEQ ID NO: 3365477 - RNA, 15 nt, Hepatitis D virus
aagggguccucugga

SEQ ID NO: 3365478 - RNA, 23 nt, Hepatitis D virus
aauucauccgcuucuugcuuucu

SEQ ID NO: 3365479 - RNA, 14 nt, Hepatitis D virus
acccuucgggccgg

SEQ ID NO: 3365480 - RNA, 17 nt, Hepatitis D virus
acuccguguggcuuccu

SEQ ID NO: 3365481 - RNA, 13 nt, Hepatitis D virus
agcauccccuccu

SEQ ID NO: 3365482 - RNA, 16 nt, Hepatitis D virus
agcggguuuccacucg

SEQ ID NO: 3365483 - RNA, 18 nt, Hepatitis D virus
aggcccgccuccuucucu

SEQ ID NO: 3365484 - RNA, 20 nt, Hepatitis D virus
aggggacgguccccucggaa

SEQ ID NO: 3365485 - RNA, 15 nt, Hepatitis D virus
agggguccucuggag

SEQ ID NO: 3365486 - RNA, 19 nt, Hepatitis D virus
auaaagcggguuuccacuc

SEQ ID NO: 3365487 - RNA, 20 nt, Hepatitis D virus
cccaccugcuagccccgcug

SEQ ID NO: 3365488 - RNA, 19 nt, Hepatitis D virus
cccagccgacccucccucc

SEQ ID NO: 3365489 - RNA, 20 nt, Hepatitis D virus
ccccucucgggcgcugaucu

SEQ ID NO: 3365490 - RNA, 22 nt, Hepatitis D virus
cccuccuaucgcuauggucuac

SEQ ID NO: 3365491 - RNA, 13 nt, Hepatitis D virus
cccucugggguac

SEQ ID NO: 3365492 - RNA, 18 nt, Hepatitis D virus
cccuucgggccggagugu

SEQ ID NO: 3365493 - RNA, 17 nt, Hepatitis D virus
ccgacccucccuccucu

SEQ ID NO: 3365494 - RNA, 16 nt, Hepatitis D virus
ccgccauuccugggcg

SEQ ID NO: 3365495 - RNA, 22 nt, Hepatitis D virus
ccgcugcucucuuugcuuuccu

SEQ ID NO: 3365496 - RNA, 16 nt, Hepatitis D virus
ccuagcauccccuccu

SEQ ID NO: 3365497 - RNA, 12 nt, Hepatitis D virus
ccucccucuggg

SEQ ID NO: 3365498 - RNA, 20 nt, Hepatitis D virus
ccucucgcgaugcgcucucu

SEQ ID NO: 3365499 - RNA, 22 nt, Hepatitis D virus
ccucucgcgaugcgcucucugu

SEQ ID NO: 3365500 - RNA, 23 nt, Hepatitis D virus
cgacccuuggggggaaggagcuu

SEQ ID NO: 3365501 - RNA, 15 nt, Hepatitis D virus
cgcuucggucucccc

SEQ ID NO: 3365502 - RNA, 18 nt, Hepatitis D virus
cggaauguugcccagccg

SEQ ID NO: 3365503 - RNA, 19 nt, Hepatitis D virus
cguccuucuuuccucuucg

SEQ ID NO: 3365504 - RNA, 21 nt, Hepatitis D virus
cgucucgcguccuucuuuccu

SEQ ID NO: 3365505 - RNA, 16 nt, Hepatitis D virus
cguguggcuuccuccc

SEQ ID NO: 3365506 - RNA, 19 nt, Hepatitis D virus
cuauggucuacucccucuc

SEQ ID NO: 3365507 - RNA, 14 nt, Hepatitis D virus
cucaccccucucgg

SEQ ID NO: 3365508 - RNA, 20 nt, Hepatitis D virus
cucucaacccuucgggccgg

SEQ ID NO: 3365509 - RNA, 13 nt, Hepatitis D virus
cucucgcuucucu

SEQ ID NO: 3365510 - RNA, 14 nt, Hepatitis D virus
cucucgcuucucuc

SEQ ID NO: 3365511 - RNA, 20 nt, Hepatitis D virus
cucucuuugcuuuccuccuc

SEQ ID NO: 3365512 - RNA, 23 nt, Hepatitis D virus
cucuucccagccgacccucccuc

SEQ ID NO: 3365513 - RNA, 15 nt, Hepatitis D virus
cugaucuauccuccc

SEQ ID NO: 3365514 - RNA, 23 nt, Hepatitis D virus
cuucgggucggcauggcaucucc

SEQ ID NO: 3365515 - RNA, 15 nt, Hepatitis D virus
cuugcuuucucuuuu

SEQ ID NO: 3365516 - RNA, 19 nt, Hepatitis D virus
aaucgggaggagcauccca

SEQ ID NO: 3365517 - RNA, 17 nt, Hepatitis D virus
accgacucaccccucuc

SEQ ID NO: 3365518 - RNA, 21 nt, Hepatitis D virus
accgaggggacgguccccucg

SEQ ID NO: 3365519 - RNA, 14 nt, Hepatitis D virus
acucaccccucucg

SEQ ID NO: 3365520 - RNA, 15 nt, Hepatitis D virus
acuccuagcaucccc

SEQ ID NO: 3365521 - RNA, 19 nt, Hepatitis D virus
agccgacccucccuccucu

SEQ ID NO: 3365522 - RNA, 21 nt, Hepatitis D virus
agccucacucguccccucucg

SEQ ID NO: 3365523 - RNA, 20 nt, Hepatitis D virus
aggcccgccuccuucucuuc

SEQ ID NO: 3365524 - RNA, 12 nt, Hepatitis D virus
aguguccuccaa

SEQ ID NO: 3365525 - RNA, 23 nt, Hepatitis D virus
auccgcuucuugcuuucucuuuu

SEQ ID NO: 3365526 - RNA, 21 nt, Hepatitis D virus
caccuccucgcgguccgaccu

SEQ ID NO: 3365527 - RNA, 15 nt, Hepatitis D virus
cacucguccccucuc

SEQ ID NO: 3365528 - RNA, 16 nt, Hepatitis D virus
cauggcaucuccaccu

SEQ ID NO: 3365529 - RNA, 19 nt, Hepatitis D virus
ccacuuuucucucgcuucu

SEQ ID NO: 3365530 - RNA, 22 nt, Hepatitis D virus
cccgccuccuucucuuccaccu

SEQ ID NO: 3365531 - RNA, 20 nt, Hepatitis D virus
cccucuuuccccuuccuaga

SEQ ID NO: 3365532 - RNA, 15 nt, Hepatitis D virus
ccgacccucccuccu

SEQ ID NO: 3365533 - RNA, 18 nt, Hepatitis D virus
ccgccuccuucucuucca

SEQ ID NO: 3365534 - RNA, 23 nt, Hepatitis D virus
ccgcugcucucuuugcuuuccuc

SEQ ID NO: 3365535 - RNA, 18 nt, Hepatitis D virus
ccguguggcuuccucccu

SEQ ID NO: 3365536 - RNA, 13 nt, Hepatitis D virus
acccucccuccuc

SEQ ID NO: 3365537 - RNA, 19 nt, Hepatitis D virus
acuccguguggcuuccucc

SEQ ID NO: 3365538 - RNA, 19 nt, Hepatitis D virus
agccucacucguccccucu

SEQ ID NO: 3365539 - RNA, 20 nt, Hepatitis D virus
agccucacucguccccucuc

SEQ ID NO: 3365540 - RNA, 20 nt, Hepatitis D virus
aucgggaggcccgccuccuu

SEQ ID NO: 3365541 - RNA, 15 nt, Hepatitis D virus
aucuccaccuccucg

SEQ ID NO: 3365542 - RNA, 11 nt, Hepatitis D virus
auuccugggcg

SEQ ID NO: 3365543 - RNA, 22 nt, Hepatitis D virus
caacuccuagcauccccuccua

SEQ ID NO: 3365544 - RNA, 13 nt, Hepatitis D virus
cacccaccugcua

SEQ ID NO: 3365545 - RNA, 20 nt, Hepatitis D virus
caccugcuagccccgcugcu

SEQ ID NO: 3365546 - RNA, 21 nt, Hepatitis D virus
cacucggauggcuaagggaga

SEQ ID NO: 3365547 - RNA, 18 nt, Hepatitis D virus
cagaguggggucccgcca

SEQ ID NO: 3365548 - RNA, 14 nt, Hepatitis D virus
cagguaagaaagga

SEQ ID NO: 3365549 - RNA, 14 nt, Hepatitis D virus
cauccgaaggagga

SEQ ID NO: 3365550 - RNA, 18 nt, Hepatitis D virus
cauggcaucuccaccucc

SEQ ID NO: 3365551 - RNA, 20 nt, Hepatitis D virus
ccaauguucaaagucacccc

SEQ ID NO: 3365552 - RNA, 18 nt, Hepatitis D virus
ccagccgacccucccucc

SEQ ID NO: 3365553 - RNA, 22 nt, Hepatitis D virus
cccaacuccuagcauccccucc

SEQ ID NO: 3365554 - RNA, 14 nt, Hepatitis D virus
cccgcugcucucuu

SEQ ID NO: 3365555 - RNA, 13 nt, Hepatitis D virus
cccucuuuccccu

SEQ ID NO: 3365556 - RNA, 23 nt, Hepatitis D virus
ccguguggcuuccucccucuggg

SEQ ID NO: 3365557 - RNA, 22 nt, Hepatitis D virus
ccugcagaguggggucccgcca

SEQ ID NO: 3365558 - RNA, 14 nt, Hepatitis D virus
cgcacguccacucg

SEQ ID NO: 3365559 - RNA, 12 nt, Hepatitis D virus
cgccgggccccu

SEQ ID NO: 3365560 - RNA, 20 nt, Hepatitis D virus
cgcugaagggguccucugga

SEQ ID NO: 3365561 - RNA, 13 nt, Hepatitis D virus
cgcuucucucugg

SEQ ID NO: 3365562 - RNA, 19 nt, Hepatitis D virus
cggaaucgggaggagcauc

SEQ ID NO: 3365563 - RNA, 13 nt, Hepatitis D virus
cgggagucugcua

SEQ ID NO: 3365564 - RNA, 21 nt, Hepatitis D virus
cguguggcuuccucccucugg

SEQ ID NO: 3365565 - RNA, 13 nt, Hepatitis D virus
cuacucccucucg

SEQ ID NO: 3365566 - RNA, 15 nt, Hepatitis D virus
cucaccccucucggg

SEQ ID NO: 3365567 - RNA, 19 nt, Hepatitis D virus
cucacucguccccucucgg

SEQ ID NO: 3365568 - RNA, 20 nt, Hepatitis D virus
cucacucguccccucucggg

SEQ ID NO: 3365569 - RNA, 20 nt, Hepatitis D virus
cuccaaacuuggccgccggg

SEQ ID NO: 3365570 - RNA, 21 nt, Hepatitis D virus
cuccguguggcuuccucccuc

SEQ ID NO: 3365571 - RNA, 23 nt, Hepatitis D virus
cuccguguggcuuccucccucug

SEQ ID NO: 3365572 - RNA, 23 nt, Hepatitis D virus
cuccucgcgguccgaccugggca

SEQ ID NO: 3365573 - RNA, 20 nt, Hepatitis D virus
cucgcgguccgaccugggca

SEQ ID NO: 3365574 - RNA, 11 nt, Hepatitis D virus
cucucuguucg

SEQ ID NO: 3365575 - RNA, 16 nt, Hepatitis D virus
cuuggccgccgggccc

SEQ ID NO: 3365576 - RNA, 11 nt, Hepatitis D virus
cuuugcuuucc

SEQ ID NO: 3365577 - RNA, 15 nt, Hepatitis D virus
cuuugcuuuccuccu

SEQ ID NO: 3365578 - RNA, 13 nt, Hepatitis D virus
gacccucccuccu

SEQ ID NO: 3365579 - RNA, 20 nt, Hepatitis D virus
gagccacuuuucucucgcuu

SEQ ID NO: 3365580 - RNA, 12 nt, Hepatitis D virus
gcccgccuccuu

SEQ ID NO: 3365581 - RNA, 17 nt, Hepatitis D virus
gcgaugcgcucucuguu

SEQ ID NO: 3365582 - RNA, 20 nt, Hepatitis D virus
gcguccuucuuuccucuucg

SEQ ID NO: 3365583 - RNA, 19 nt, Hepatitis D virus
gcuauggucuacucccucu

SEQ ID NO: 3365584 - RNA, 13 nt, Hepatitis D virus
gcugcucucuuug

SEQ ID NO: 3365585 - RNA, 15 nt, Hepatitis D virus
ggaggcccgccuccu

SEQ ID NO: 3365586 - RNA, 22 nt, Hepatitis D virus
gggaggcccgccuccuucucuu

SEQ ID NO: 3365587 - RNA, 12 nt, Hepatitis D virus
uacucccucucg

SEQ ID NO: 3365588 - RNA, 15 nt, Hepatitis D virus
ucgccauuaccgagg

SEQ ID NO: 3365589 - RNA, 15 nt, Hepatitis D virus
ucgggaggagcaucc

SEQ ID NO: 3365590 - RNA, 13 nt, Hepatitis D virus
ucucaacccuucg

SEQ ID NO: 3365591 - RNA, 13 nt, Hepatitis D virus
ucuccaccuccuc

SEQ ID NO: 3365592 - RNA, 15 nt, Hepatitis D virus
ugaagggguccucug

SEQ ID NO: 3365593 - RNA, 22 nt, Hepatitis D virus
ugcccagccggcgccagcgagg

SEQ ID NO: 3365594 - RNA, 22 nt, Hepatitis D virus
uggggacgauaagucgaguucc

SEQ ID NO: 3365595 - RNA, 23 nt, Hepatitis D virus
uuccccgggauaagccucacucg

SEQ ID NO: 3365596 - RNA, 14 nt, Hepatitis D virus
uucucuuccaccuu

SEQ ID NO: 3365597 - RNA, 22 nt, Hepatitis D virus
uuuaccgacucaccccucucgg

SEQ ID NO: 3365598 - RNA, 16 nt, Hepatitis D virus
uuugcuuuccuccucg

SEQ ID NO: 3365599 - RNA, 22 nt, Hepatitis D virus
ccguguggcuuccucccucugg

SEQ ID NO: 3365600 - RNA, 16 nt, Hepatitis D virus
ccucacucguccccuc

SEQ ID NO: 3365601 - RNA, 19 nt, Hepatitis D virus
ccugcagaguggggucccg

SEQ ID NO: 3365602 - RNA, 22 nt, Hepatitis D virus
ccuucucuuccaccuucccucu

SEQ ID NO: 3365603 - RNA, 15 nt, Hepatitis D virus
cgccauuccugggcg

SEQ ID NO: 3365604 - RNA, 17 nt, Hepatitis D virus
cgcguccuucuuuccuc

SEQ ID NO: 3365605 - RNA, 16 nt, Hepatitis D virus
cuagccccgcugcucu

SEQ ID NO: 3365606 - RNA, 21 nt, Hepatitis D virus
cuagccccgcugcucucuuug

SEQ ID NO: 3365607 - RNA, 15 nt, Hepatitis D virus
cucacucguccccuc

SEQ ID NO: 3365608 - RNA, 16 nt, Hepatitis D virus
cuccuagcauccccuc

SEQ ID NO: 3365609 - RNA, 18 nt, Hepatitis D virus
cuccuucucuuccaccuu

SEQ ID NO: 3365610 - RNA, 19 nt, Hepatitis D virus
cucgcgaugcgcucucugu

SEQ ID NO: 3365611 - RNA, 18 nt, Hepatitis D virus
cucgcguccuucuuuccu

SEQ ID NO: 3365612 - RNA, 21 nt, Hepatitis D virus
cucuggaggugauuucucugu

SEQ ID NO: 3365613 - RNA, 18 nt, Hepatitis D virus
cucuuugcuuuccuccuc

SEQ ID NO: 3365614 - RNA, 17 nt, Hepatitis D virus
cucuuuuuuccuucuug

SEQ ID NO: 3365615 - RNA, 18 nt, Hepatitis D virus
cugaagggguccucugga

SEQ ID NO: 3365616 - RNA, 14 nt, Hepatitis D virus
cuucucucugggaa

SEQ ID NO: 3365617 - RNA, 16 nt, Hepatitis D virus
cuuucucuuuuuuccu

SEQ ID NO: 3365618 - RNA, 19 nt, Hepatitis D virus
gaggacgcacguccacucg

SEQ ID NO: 3365619 - RNA, 16 nt, Hepatitis D virus
gccauuccugggcgac

SEQ ID NO: 3365620 - RNA, 18 nt, Hepatitis D virus
gccgccgggccccucgga

SEQ ID NO: 3365621 - RNA, 13 nt, Hepatitis D virus
gccgggccccucg

SEQ ID NO: 3365622 - RNA, 19 nt, Hepatitis D virus
gcugcucucuuugcuuucc

SEQ ID NO: 3365623 - RNA, 15 nt, Hepatitis D virus
gcuuccucccucugg

SEQ ID NO: 3365624 - RNA, 16 nt, Hepatitis D virus
gcuuccucccucuggg

SEQ ID NO: 3365625 - RNA, 20 nt, Hepatitis E virus
cccggucagccgucuggccg

SEQ ID NO: 3365626 - RNA, 14 nt, Hepatitis E virus
cccuucuuucuguu

SEQ ID NO: 3365627 - RNA, 18 nt, Hepatitis E virus
ccgaccacucggcuccgc

SEQ ID NO: 3365628 - RNA, 14 nt, Hepatitis E virus
ccgccgcugccuca

SEQ ID NO: 3365629 - RNA, 13 nt, Hepatitis E virus
ccgcgcucccuga

SEQ ID NO: 3365630 - RNA, 17 nt, Hepatitis E virus
ccggagugccgcccccu

SEQ ID NO: 3365631 - RNA, 20 nt, Hepatitis E virus
ccggcccaugacaccccgcc

SEQ ID NO: 3365632 - RNA, 13 nt, Hepatitis E virus
ccuuccccagccc

SEQ ID NO: 3365633 - RNA, 19 nt, Hepatitis E virus
cgagcuaaugaugugcuuu

SEQ ID NO: 3365634 - RNA, 14 nt, Hepatitis E virus
cgagcucaccacca

SEQ ID NO: 3365635 - RNA, 15 nt, Hepatitis E virus
cgccaccgcccgguc

SEQ ID NO: 3365636 - RNA, 22 nt, Hepatitis E virus
cgcccccuuggccuccagggcu

SEQ ID NO: 3365637 - RNA, 14 nt, Hepatitis E virus
cgccccgccgcugc

SEQ ID NO: 3365638 - RNA, 16 nt, Hepatitis E virus
cgcccggucagccguc

SEQ ID NO: 3365639 - RNA, 20 nt, Hepatitis E virus
cgcccggucagccgucuggc

SEQ ID NO: 3365640 - RNA, 17 nt, Hepatitis E virus
cgccgugggcggcgcag

SEQ ID NO: 3365641 - RNA, 15 nt, Hepatitis E virus
cgcuucuaccccucc

SEQ ID NO: 3365642 - RNA, 15 nt, Hepatitis E virus
gaccaccaccacccc

SEQ ID NO: 3365643 - RNA, 19 nt, Hepatitis E virus
gaccaggcccagcgccccg

SEQ ID NO: 3365644 - RNA, 13 nt, Hepatitis E virus
gacucugugaccu

SEQ ID NO: 3365645 - RNA, 17 nt, Hepatitis E virus
gagcuaaugaugugcuu

SEQ ID NO: 3365646 - RNA, 15 nt, Hepatitis E virus
gaggaggaggccacc

SEQ ID NO: 3365647 - RNA, 18 nt, Hepatitis E virus
gaggcagguacuacuaaa

SEQ ID NO: 3365648 - RNA, 15 nt, Hepatitis E virus
gaguaugaccagucc

SEQ ID NO: 3365649 - RNA, 21 nt, Hepatitis E virus
gcagaugggacugccgagcuc

SEQ ID NO: 3365650 - RNA, 23 nt, Hepatitis E virus
gcccaugacaccccgccagugcc

SEQ ID NO: 3365651 - RNA, 22 nt, Hepatitis E virus
gcccccgaugucaccgcugcgg

SEQ ID NO: 3365652 - RNA, 17 nt, Hepatitis E virus
gccccgucgucucagcc

SEQ ID NO: 3365653 - RNA, 17 nt, Hepatitis E virus
gcccgcgccaccgcccg

SEQ ID NO: 3365654 - RNA, 20 nt, Hepatitis E virus
gcccgcuucuaccccuccag

SEQ ID NO: 3365655 - RNA, 13 nt, Hepatitis E virus
gccuaugcugccc

SEQ ID NO: 3365656 - RNA, 20 nt, Hepatitis E virus
gcggucgcuccggcccauga

SEQ ID NO: 3365657 - RNA, 22 nt, Hepatitis E virus
gcuccgcgguaagcucuccuuu

SEQ ID NO: 3365658 - RNA, 17 nt, Hepatitis E virus
gcucgacuggaccaagg

SEQ ID NO: 3365659 - RNA, 17 nt, Hepatitis E virus
gcugauucucagcccuu

SEQ ID NO: 3365660 - RNA, 19 nt, Hepatitis E virus
gcugccgaguaugaccagu

SEQ ID NO: 3365661 - RNA, 17 nt, Hepatitis E virus
gcuggggccgcgccgcu

SEQ ID NO: 3365662 - RNA, 17 nt, Hepatitis E virus
gcuuauuucucauuucu

SEQ ID NO: 3365663 - RNA, 15 nt, Hepatitis E virus
ggccaccucuggucu

SEQ ID NO: 3365664 - RNA, 20 nt, Hepatitis E virus
ggcccaugacaccccgccag

SEQ ID NO: 3365665 - RNA, 21 nt, Hepatitis E virus
ggccgcgccgcuaaccgcggu

SEQ ID NO: 3365666 - RNA, 19 nt, Hepatitis E virus
ggcgcgcaggccguugccc

SEQ ID NO: 3365667 - RNA, 19 nt, Hepatitis E virus
ggucgcccccuuuccacca

SEQ ID NO: 3365668 - RNA, 21 nt, Hepatitis E virus
ggucgcuccggcccaugacac

SEQ ID NO: 3365669 - RNA, 13 nt, Hepatitis E virus
guccuccgagcua

SEQ ID NO: 3365670 - RNA, 20 nt, Hepatitis E virus
gucgcucgacuggaccaagg

SEQ ID NO: 3365671 - RNA, 19 nt, Hepatitis E virus
gucguagaccuaccacagc

SEQ ID NO: 3365672 - RNA, 19 nt, Hepatitis E virus
caccgcugcggccggggcu

SEQ ID NO: 3365673 - RNA, 18 nt, Hepatitis E virus
cagccccaucgcgccccu

SEQ ID NO: 3365674 - RNA, 20 nt, Hepatitis E virus
cagcggcgguuccggcggug

SEQ ID NO: 3365675 - RNA, 17 nt, Hepatitis E virus
caucggguugcuauuuc

SEQ ID NO: 3365676 - RNA, 19 nt, Hepatitis E virus
caucggguugcuauuucca

SEQ ID NO: 3365677 - RNA, 15 nt, Hepatitis E virus
caugucuucugcugc

SEQ ID NO: 3365678 - RNA, 13 nt, Hepatitis E virus
cauuucugcguuc

SEQ ID NO: 3365679 - RNA, 20 nt, Hepatitis E virus
ccacagaccaccaccacccc

SEQ ID NO: 3365680 - RNA, 13 nt, Hepatitis E virus
ccacuagccuggg

SEQ ID NO: 3365681 - RNA, 17 nt, Hepatitis E virus
ccagucuaugucucuga

SEQ ID NO: 3365682 - RNA, 13 nt, Hepatitis E virus
ccauggacuaccc

SEQ ID NO: 3365683 - RNA, 19 nt, Hepatitis E virus
ccccgguaauaccaacacg

SEQ ID NO: 3365684 - RNA, 17 nt, Hepatitis E virus
ccccuauauucauccaa

SEQ ID NO: 3365685 - RNA, 14 nt, Hepatitis E virus
ccccuucuuucugu

SEQ ID NO: 3365686 - RNA, 15 nt, Hepatitis E virus
ccccuuuccaccacc

SEQ ID NO: 3365687 - RNA, 19 nt, Hepatitis E virus
ccccuuuucuguccuccga

SEQ ID NO: 3365688 - RNA, 22 nt, Hepatitis E virus
cccgaugucaccgcugcggccg

SEQ ID NO: 3365689 - RNA, 14 nt, Hepatitis E virus
cccgcccgaccacu

SEQ ID NO: 3365690 - RNA, 22 nt, Hepatitis E virus
cccgcugguccccaacgcuguu

SEQ ID NO: 3365691 - RNA, 21 nt, Hepatitis E virus
cccgcuucuaccccuccagga

SEQ ID NO: 3365692 - RNA, 16 nt, Hepatitis E virus
cccggcauagccuccg

SEQ ID NO: 3365693 - RNA, 17 nt, Hepatitis E virus
acaucuguagagaaugc

SEQ ID NO: 3365694 - RNA, 19 nt, Hepatitis E virus
accaaccccuucgcccccg

SEQ ID NO: 3365695 - RNA, 22 nt, Hepatitis E virus
accaacugcucguugagaaugc

SEQ ID NO: 3365696 - RNA, 12 nt, Hepatitis E virus
accgcugccgag

SEQ ID NO: 3365697 - RNA, 15 nt, Hepatitis E virus
acgcuguugguggcu

SEQ ID NO: 3365698 - RNA, 17 nt, Hepatitis E virus
acgucguagaccuacca

SEQ ID NO: 3365699 - RNA, 15 nt, Hepatitis E virus
acucugugaccuugg

SEQ ID NO: 3365700 - RNA, 17 nt, Hepatitis E virus
acugcuagugaccaacu

SEQ ID NO: 3365701 - RNA, 12 nt, Hepatitis E virus
acuggaccaagg

SEQ ID NO: 3365702 - RNA, 24 nt, Hepatitis E virus
acuuacaccacuagccugggugcu

SEQ ID NO: 3365703 - RNA, 21 nt, Hepatitis E virus
aguaccggguuguucgugcua

SEQ ID NO: 3365704 - RNA, 17 nt, Hepatitis E virus
aucuccccuuaccucuu

SEQ ID NO: 3365705 - RNA, 20 nt, Hepatitis E virus
aucucguucuggccacagac

SEQ ID NO: 3365706 - RNA, 17 nt, Hepatitis E virus
augcccaguaccggguu

SEQ ID NO: 3365707 - RNA, 21 nt, Hepatitis E virus
augcugcccgcgccaccgccc

SEQ ID NO: 3365708 - RNA, 14 nt, Hepatitis E virus
augggacugccgag

SEQ ID NO: 3365709 - RNA, 12 nt, Hepatitis E virus
auguugacuccc

SEQ ID NO: 3365710 - RNA, 18 nt, Hepatitis E virus
auuucucauuucugcguu

SEQ ID NO: 3365711 - RNA, 14 nt, Hepatitis E virus
caccaccacggcug

SEQ ID NO: 3365712 - RNA, 14 nt, Hepatitis E virus
caccgcccggucag

SEQ ID NO: 3365713 - RNA, 12 nt, Hepatitis E virus
cacucugcgcua

SEQ ID NO: 3365714 - RNA, 20 nt, Hepatitis E virus
cacugcccgucaccgccuuc

SEQ ID NO: 3365715 - RNA, 15 nt, Hepatitis E virus
cagcgccccgccgcu

SEQ ID NO: 3365716 - RNA, 16 nt, Hepatitis E virus
cagcgccccgccgcug

SEQ ID NO: 3365717 - RNA, 23 nt, Hepatitis E virus
gugccccccuucuuucuguugcu

SEQ ID NO: 3365718 - RNA, 16 nt, Hepatitis E virus
uacaaacuugguucuu

SEQ ID NO: 3365719 - RNA, 21 nt, Hepatitis E virus
uacaccacuagccugggugcu

SEQ ID NO: 3365720 - RNA, 17 nt, Hepatitis E virus
uacgccgcuccucuuag

SEQ ID NO: 3365721 - RNA, 19 nt, Hepatitis E virus
uacggcucuucgaccggcc

SEQ ID NO: 3365722 - RNA, 23 nt, Hepatitis E virus
uacggcucuucgaccggcccagu

SEQ ID NO: 3365723 - RNA, 16 nt, Hepatitis E virus
uacuccagcacugccc

SEQ ID NO: 3365724 - RNA, 22 nt, Hepatitis E virus
uagaccuaccacagcuggggcc

SEQ ID NO: 3365725 - RNA, 13 nt, Hepatitis E virus
uagccccccacuc

SEQ ID NO: 3365726 - RNA, 15 nt, Hepatitis E virus
ucaccaccacggcug

SEQ ID NO: 3365727 - RNA, 20 nt, Hepatitis E virus
uccaucucguucuggccaca

SEQ ID NO: 3365728 - RNA, 12 nt, Hepatitis E virus
uccugccgcucc

SEQ ID NO: 3365729 - RNA, 14 nt, Hepatitis E virus
ucgaccggcccagu

SEQ ID NO: 3365730 - RNA, 14 nt, Hepatitis E virus
ucggcuccgcuugg

SEQ ID NO: 3365731 - RNA, 21 nt, Hepatitis E virus
ucguugagaaugccgcugggc

SEQ ID NO: 3365732 - RNA, 17 nt, Hepatitis E virus
ucuaauuaugcccagua

SEQ ID NO: 3365733 - RNA, 16 nt, Hepatitis E virus
ucuacugucgcugagc

SEQ ID NO: 3365734 - RNA, 22 nt, Hepatitis E virus
ucucgccccgucgucucagcca

SEQ ID NO: 3365735 - RNA, 12 nt, Hepatitis E virus
ucugcugcgccc

SEQ ID NO: 3365736 - RNA, 20 nt, Hepatitis E virus
ucuguagagaaugcucagca

SEQ ID NO: 3365737 - RNA, 19 nt, Hepatitis E virus
ucuguugcuuauuucucau

SEQ ID NO: 3365738 - RNA, 14 nt, Hepatitis E virus
ucuuccguggccac

SEQ ID NO: 3365739 - RNA, 12 nt, Hepatitis E virus
ugacaccccgcc

SEQ ID NO: 3365740 - RNA, 14 nt, Hepatitis E virus
ugaccaggcccagc

SEQ ID NO: 3365741 - RNA, 21 nt, Hepatitis E virus
ugaccuugguuaauguagcga

SEQ ID NO: 3365742 - RNA, 18 nt, Hepatitis E virus
ugacucugugaccuuggu

SEQ ID NO: 3365743 - RNA, 16 nt, Hepatitis E virus
ugcccaguaccggguu

SEQ ID NO: 3365744 - RNA, 14 nt, Hepatitis E virus
ugccuaugcugccc

SEQ ID NO: 3365745 - RNA, 17 nt, Hepatitis E virus
ugcuguuuuagcccccc

SEQ ID NO: 3365746 - RNA, 10 nt, Hepatitis E virus
uggcuacaga

SEQ ID NO: 3365747 - RNA, 15 nt, Hepatitis E virus
uggggugaccgggcu

SEQ ID NO: 3365748 - RNA, 23 nt, Hepatitis E virus
uggucgcccccuuuccaccaccc

SEQ ID NO: 3365749 - RNA, 18 nt, Hepatitis E virus
uguagagaaugcucagca

SEQ ID NO: 3365750 - RNA, 14 nt, Hepatitis E virus
uguugguggcuacg

SEQ ID NO: 3365751 - RNA, 12 nt, Hepatitis E virus
uuccccagcccc

SEQ ID NO: 3365752 - RNA, 18 nt, Hepatitis E virus
uucucauuucugcguucc

SEQ ID NO: 3365753 - RNA, 12 nt, Hepatitis E virus
uugcuauuucca

SEQ ID NO: 3365754 - RNA, 16 nt, Hepatitis E virus
uugcuuauuucucauu

SEQ ID NO: 3365755 - RNA, 20 nt, Hepatitis E virus
uuucuguugcuuauuucuca

SEQ ID NO: 3365756 - RNA, 20 nt, Hepatitis E virus
gcgccaccgcccggucagcc

SEQ ID NO: 3365757 - RNA, 21 nt, Hepatitis E virus
gcuaaccgcggucgcuccggc

SEQ ID NO: 3365758 - RNA, 18 nt, Hepatitis E virus
gcuaaugaugugcuuugg

SEQ ID NO: 3365759 - RNA, 16 nt, Hepatitis E virus
gcuacccgcuucauga

SEQ ID NO: 3365760 - RNA, 14 nt, Hepatitis E virus
gcuauuuccacuua

SEQ ID NO: 3365761 - RNA, 19 nt, Hepatitis E virus
gcuccgcuuggcgugacca

SEQ ID NO: 3365762 - RNA, 14 nt, Hepatitis E virus
gcuccggcccauga

SEQ ID NO: 3365763 - RNA, 20 nt, Hepatitis E virus
gcucgacuggaccaagguca

SEQ ID NO: 3365764 - RNA, 15 nt, Hepatitis E virus
gcucguugagaaugc

SEQ ID NO: 3365765 - RNA, 16 nt, Hepatitis E virus
gcugagcuucagcgcc

SEQ ID NO: 3365766 - RNA, 18 nt, Hepatitis E virus
gcuuggcgugaccaggcc

SEQ ID NO: 3365767 - RNA, 15 nt, Hepatitis E virus
gcuugugccccccuu

SEQ ID NO: 3365768 - RNA, 18 nt, Hepatitis E virus
ggacugccgagcucacca

SEQ ID NO: 3365769 - RNA, 20 nt, Hepatitis E virus
ggagugccgcccccuuggcc

SEQ ID NO: 3365770 - RNA, 18 nt, Hepatitis E virus
ggccacagaccaccacca

SEQ ID NO: 3365771 - RNA, 13 nt, Hepatitis E virus
ggcgagccgacug

SEQ ID NO: 3365772 - RNA, 13 nt, Hepatitis E virus
ggcugguggccag

SEQ ID NO: 3365773 - RNA, 16 nt, Hepatitis E virus
guagaccuaccacagc

SEQ ID NO: 3365774 - RNA, 21 nt, Hepatitis E virus
gucucccguuacuccagcacu

SEQ ID NO: 3365775 - RNA, 18 nt, Hepatitis E virus
gugaccaggcccagcgcc

SEQ ID NO: 3365776 - RNA, 19 nt, Hepatitis E virus
guuccgcaaccucaccccc

SEQ ID NO: 3365777 - RNA, 19 nt, Hepatitis E virus
uaaccuaucaacaucuccc

SEQ ID NO: 3365778 - RNA, 15 nt, Hepatitis E virus
uaccccuccaggacg

SEQ ID NO: 3365779 - RNA, 19 nt, Hepatitis E virus
uaccucuuccguggccacc

SEQ ID NO: 3365780 - RNA, 18 nt, Hepatitis E virus
uacgccgcuccucuuagc

SEQ ID NO: 3365781 - RNA, 17 nt, Hepatitis E virus
uagaccuaccacagcug

SEQ ID NO: 3365782 - RNA, 20 nt, Hepatitis E virus
ucagccgucuggccgccgcc

SEQ ID NO: 3365783 - RNA, 14 nt, Hepatitis E virus
uccgcgcucccuga

SEQ ID NO: 3365784 - RNA, 14 nt, Hepatitis E virus
uccucauguuucug

SEQ ID NO: 3365785 - RNA, 21 nt, Hepatitis E virus
ucgcucgacuggaccaagguc

SEQ ID NO: 3365786 - RNA, 15 nt, Hepatitis E virus
ucuaccccuccagga

SEQ ID NO: 3365787 - RNA, 21 nt, Hepatitis E virus
ucuccaucucguucuggccac

SEQ ID NO: 3365788 - RNA, 17 nt, Hepatitis E virus
ucucccguuacuccagc

SEQ ID NO: 3365789 - RNA, 19 nt, Hepatitis E virus
ucucccguuacuccagcac

SEQ ID NO: 3365790 - RNA, 15 nt, Hepatitis E virus
ucucugacucuguga

SEQ ID NO: 3365791 - RNA, 23 nt, Hepatitis E virus
ucugccuaugcugcccgcgccac

SEQ ID NO: 3365792 - RNA, 19 nt, Hepatitis E virus
ucugcugcgcccauggguu

SEQ ID NO: 3365793 - RNA, 19 nt, Hepatitis E virus
ucuggggugaccgggcuga

SEQ ID NO: 3365794 - RNA, 17 nt, Hepatitis E virus
ugaccaggcccagcgcc

SEQ ID NO: 3365795 - RNA, 12 nt, Hepatitis E virus
ugaccuugguua

SEQ ID NO: 3365796 - RNA, 21 nt, Hepatitis E virus
ugccccccuucuuucuguugc

SEQ ID NO: 3365797 - RNA, 23 nt, Hepatitis E virus
ugccgcccccuuggccuccaggg

SEQ ID NO: 3365798 - RNA, 18 nt, Hepatitis E virus
ugcugacacccugcuugg

SEQ ID NO: 3365799 - RNA, 20 nt, Hepatitis E virus
ugcuuauuucucauuucugc

SEQ ID NO: 3365800 - RNA, 17 nt, Hepatitis E virus
ugcuugugccccccuuc

SEQ ID NO: 3365801 - RNA, 15 nt, Hepatitis E virus
uggcgugaccaggcc

SEQ ID NO: 3365802 - RNA, 18 nt, Hepatitis E virus
uuccaccacccagcagua

SEQ ID NO: 3365803 - RNA, 15 nt, Hepatitis E virus
uuccgcgcucccuga

SEQ ID NO: 3365804 - RNA, 16 nt, Hepatitis E virus
uugcuguugcuccuca

SEQ ID NO: 3365805 - RNA, 17 nt, Hepatitis E virus
uuuacgccgcuccucuu

SEQ ID NO: 3365806 - RNA, 17 nt, Hepatitis E virus
cuguugcuuauuucuca

SEQ ID NO: 3365807 - RNA, 16 nt, Hepatitis E virus
cuucuaccccuccagg

SEQ ID NO: 3365808 - RNA, 14 nt, Hepatitis E virus
cuuggcgugaccag

SEQ ID NO: 3365809 - RNA, 16 nt, Hepatitis E virus
gaccaggcccagcgcc

SEQ ID NO: 3365810 - RNA, 14 nt, Hepatitis E virus
gaccaguccacuua

SEQ ID NO: 3365811 - RNA, 13 nt, Hepatitis E virus
gagcucaccacca

SEQ ID NO: 3365812 - RNA, 20 nt, Hepatitis E virus
gaguaugaccaguccacuua

SEQ ID NO: 3365813 - RNA, 14 nt, Hepatitis E virus
gccacagaccacca

SEQ ID NO: 3365814 - RNA, 16 nt, Hepatitis E virus
gccacagaccaccacc

SEQ ID NO: 3365815 - RNA, 12 nt, Hepatitis E virus
gccaccucuggu

SEQ ID NO: 3365816 - RNA, 15 nt, Hepatitis E virus
gcccggagugccgcc

SEQ ID NO: 3365817 - RNA, 16 nt, Hepatitis E virus
gcccucgggcuguugg

SEQ ID NO: 3365818 - RNA, 22 nt, Hepatitis E virus
gccuacacuaucguaaccaagg

SEQ ID NO: 3365819 - RNA, 18 nt, Hepatitis E virus
gcgaccggcgcgcaggcc

SEQ ID NO: 3365820 - RNA, 16 nt, Hepatitis E virus
gcgccccgccgcugcc

SEQ ID NO: 3365821 - RNA, 22 nt, Hepatitis E virus
gcuaaccgcggucgcuccggcc

SEQ ID NO: 3365822 - RNA, 19 nt, Hepatitis E virus
gcucuucgaccggcccagu

SEQ ID NO: 3365823 - RNA, 21 nt, Hepatitis E virus
gcuugugccccccuucuuucu

SEQ ID NO: 3365824 - RNA, 18 nt, Hepatitis E virus
gcuuucucucaccgcugc

SEQ ID NO: 3365825 - RNA, 19 nt, Hepatitis E virus
ggacuacccugcccgcgcc

SEQ ID NO: 3365826 - RNA, 19 nt, Hepatitis E virus
gggcuguuggacuuugccc

SEQ ID NO: 3365827 - RNA, 18 nt, Hepatitis E virus
ggguuguucgugcuacaa

SEQ ID NO: 3365828 - RNA, 23 nt, Hepatitis E virus
gguauugcaaucccgcaugacau

SEQ ID NO: 3365829 - RNA, 17 nt, Hepatitis E virus
gguugcuauuuccacuu

SEQ ID NO: 3365830 - RNA, 16 nt, Hepatitis E virus
gucagccgucuggccg

SEQ ID NO: 3365831 - RNA, 18 nt, Hepatitis E virus
gucagccgucuggccgcc

SEQ ID NO: 3365832 - RNA, 16 nt, Hepatitis E virus
guccugccgcuccgcg

SEQ ID NO: 3365833 - RNA, 17 nt, Hepatitis E virus
gucuuguuaugcuuugc

SEQ ID NO: 3365834 - RNA, 18 nt, Hepatitis E virus
gugccccccuucuuucug

SEQ ID NO: 3365835 - RNA, 14 nt, Hepatitis E virus
guugcuauuuccac

SEQ ID NO: 3365836 - RNA, 14 nt, Hepatitis E virus
uaacaccacugcua

SEQ ID NO: 3365837 - RNA, 17 nt, Hepatitis E virus
uaccauggacuacccug

SEQ ID NO: 3365838 - RNA, 14 nt, Hepatitis E virus
uacuccagcacugc

SEQ ID NO: 3365839 - RNA, 15 nt, Hepatitis E virus
uagcgcuuacccugu

SEQ ID NO: 3365840 - RNA, 12 nt, Hepatitis E virus
uaguccagcccg

SEQ ID NO: 3365841 - RNA, 14 nt, Hepatitis E virus
uauuucucauuucu

SEQ ID NO: 3365842 - RNA, 16 nt, Hepatitis E virus
uccgcgcucccugaaa

SEQ ID NO: 3365843 - RNA, 14 nt, Hepatitis E virus
uccugccgcuccgc

SEQ ID NO: 3365844 - RNA, 11 nt, Hepatitis E virus
ucgcccccuuu

SEQ ID NO: 3365845 - RNA, 20 nt, Hepatitis E virus
ucucccguuacuccagcacu

SEQ ID NO: 3365846 - RNA, 13 nt, Hepatitis E virus
ugauucucagccc

SEQ ID NO: 3365847 - RNA, 14 nt, Hepatitis E virus
ugcgcccauggguu

SEQ ID NO: 3365848 - RNA, 14 nt, Hepatitis E virus
ugcuccucauguuu

SEQ ID NO: 3365849 - RNA, 12 nt, Hepatitis E virus
ugcuugugcccc

SEQ ID NO: 3365850 - RNA, 15 nt, Hepatitis E virus
ugcuugugccccccu

SEQ ID NO: 3365851 - RNA, 17 nt, Hepatitis E virus
ugucgcugagcuucagc

SEQ ID NO: 3365852 - RNA, 15 nt, Hepatitis E virus
uucuuucuguugcuu

SEQ ID NO: 3365853 - RNA, 17 nt, Hepatitis E virus
uuuccaccacccagcag

SEQ ID NO: 3365854 - RNA, 15 nt, Hepatitis E virus
acugucgcugagcuu

SEQ ID NO: 3365855 - RNA, 20 nt, Hepatitis E virus
agaccuucuuuguccugccg

SEQ ID NO: 3365856 - RNA, 15 nt, Hepatitis E virus
agccccccacucugc

SEQ ID NO: 3365857 - RNA, 18 nt, Hepatitis E virus
agcgccccgccgcugccu

SEQ ID NO: 3365858 - RNA, 14 nt, Hepatitis E virus
agcuguucuacucu

SEQ ID NO: 3365859 - RNA, 12 nt, Hepatitis E virus
aggaggccaccu

SEQ ID NO: 3365860 - RNA, 19 nt, Hepatitis E virus
aguauucaaagaccuucuu

SEQ ID NO: 3365861 - RNA, 22 nt, Hepatitis E virus
agugccugauguugacucccgc

SEQ ID NO: 3365862 - RNA, 18 nt, Hepatitis E virus
auaccggugcccucgggc

SEQ ID NO: 3365863 - RNA, 15 nt, Hepatitis E virus
aucuguagagaaugc

SEQ ID NO: 3365864 - RNA, 15 nt, Hepatitis E virus
cacagaccaccacca

SEQ ID NO: 3365865 - RNA, 13 nt, Hepatitis E virus
caccaccacggcu

SEQ ID NO: 3365866 - RNA, 13 nt, Hepatitis E virus
caccacuagccug

SEQ ID NO: 3365867 - RNA, 14 nt, Hepatitis E virus
caccccgccagugc

SEQ ID NO: 3365868 - RNA, 21 nt, Hepatitis E virus
caccuuccccagccccaucgc

SEQ ID NO: 3365869 - RNA, 14 nt, Hepatitis E virus
cacucggcuccgcu

SEQ ID NO: 3365870 - RNA, 15 nt, Hepatitis E virus
cacucggcuccgcuu

SEQ ID NO: 3365871 - RNA, 16 nt, Hepatitis E virus
cacugcuagugaccaa

SEQ ID NO: 3365872 - RNA, 18 nt, Hepatitis E virus
cacuuacaccacuagccu

SEQ ID NO: 3365873 - RNA, 16 nt, Hepatitis E virus
cagaccaccaccaccc

SEQ ID NO: 3365874 - RNA, 14 nt, Hepatitis E virus
cagcacugcccguc

SEQ ID NO: 3365875 - RNA, 14 nt, Hepatitis E virus
cagggcugugcuuu

SEQ ID NO: 3365876 - RNA, 22 nt, Hepatitis E virus
caguauucaaagaccuucuuug

SEQ ID NO: 3365877 - RNA, 23 nt, Hepatitis E virus
ccacagcuggggccgcgccgcua

SEQ ID NO: 3365878 - RNA, 20 nt, Hepatitis E virus
ccacggcugcuacccgcuuc

SEQ ID NO: 3365879 - RNA, 12 nt, Hepatitis E virus
ccacuagccugg

SEQ ID NO: 3365880 - RNA, 19 nt, Hepatitis E virus
ccacucggcuccgcuuggc

SEQ ID NO: 3365881 - RNA, 18 nt, Hepatitis E virus
ccauggguucgcgaccau

SEQ ID NO: 3365882 - RNA, 20 nt, Hepatitis E virus
cccagccccaucgcgccccu

SEQ ID NO: 3365883 - RNA, 21 nt, Hepatitis E virus
cccagcgccccgccgcugccu

SEQ ID NO: 3365884 - RNA, 20 nt, Hepatitis E virus
cccaucgcgccccuuuucug

SEQ ID NO: 3365885 - RNA, 22 nt, Hepatitis E virus
ccccaucgcgccccuuuucugu

SEQ ID NO: 3365886 - RNA, 20 nt, Hepatitis E virus
cccccuuggccuccagggcu

SEQ ID NO: 3365887 - RNA, 15 nt, Hepatitis E virus
cccgucaccgccuuc

SEQ ID NO: 3365888 - RNA, 14 nt, Hepatitis E virus
cccuuggccuccag

SEQ ID NO: 3365889 - RNA, 16 nt, Hepatitis E virus
cccuuggccuccaggg

SEQ ID NO: 3365890 - RNA, 11 nt, Hepatitis E virus
ccgcccccuug

SEQ ID NO: 3365891 - RNA, 13 nt, Hepatitis E virus
ccgcgccaccgcc

SEQ ID NO: 3365892 - RNA, 16 nt, Hepatitis E virus
ccgcggucgcuccggc

SEQ ID NO: 3365893 - RNA, 18 nt, Hepatitis E virus
ccgcggucgcuccggccc

SEQ ID NO: 3365894 - RNA, 14 nt, Hepatitis E virus
ccuaccacagcugg

SEQ ID NO: 3365895 - RNA, 18 nt, Hepatitis E virus
ccuauuuugcuguugcuc

SEQ ID NO: 3365896 - RNA, 10 nt, Hepatitis E virus
ccuucuuucu

SEQ ID NO: 3365897 - RNA, 15 nt, Hepatitis E virus
cgaccaugcgcccuc

SEQ ID NO: 3365898 - RNA, 20 nt, Hepatitis E virus
cgaccaugcgcccucggccu

SEQ ID NO: 3365899 - RNA, 19 nt, Hepatitis E virus
cgcaugacaucgaccucgg

SEQ ID NO: 3365900 - RNA, 12 nt, Hepatitis E virus
cgcccccuuggc

SEQ ID NO: 3365901 - RNA, 22 nt, Hepatitis E virus
cgcugagcuucagcgccuuaag

SEQ ID NO: 3365902 - RNA, 18 nt, Hepatitis E virus
cggcgguuccggcggugg

SEQ ID NO: 3365903 - RNA, 14 nt, Hepatitis E virus
cggucgcucgacug

SEQ ID NO: 3365904 - RNA, 17 nt, Hepatitis E virus
cuaccacagcuggggcc

SEQ ID NO: 3365905 - RNA, 22 nt, Hepatitis E virus
cucauuucugcguuccgcgcuc

SEQ ID NO: 3365906 - RNA, 15 nt, Hepatitis E virus
cuccagggcugugcu

SEQ ID NO: 3365907 - RNA, 20 nt, Hepatitis E virus
cuccagggcugugcuuuuca

SEQ ID NO: 3365908 - RNA, 19 nt, Hepatitis E virus
cuccaucucguucuggcca

SEQ ID NO: 3365909 - RNA, 19 nt, Hepatitis E virus
cuccucuuagcccgcuucu

SEQ ID NO: 3365910 - RNA, 16 nt, Hepatitis E virus
cugccgagcucaccac

SEQ ID NO: 3365911 - RNA, 17 nt, Hepatitis E virus
cuggccacagaccacca

SEQ ID NO: 3365912 - RNA, 23 nt, Hepatitis E virus
cuggccgccgccgugggcggcgc

SEQ ID NO: 3365913 - RNA, 20 nt, Hepatitis E virus
cuucuaauuaugcccaguac

SEQ ID NO: 3365914 - RNA, 22 nt, Hepatitis E virus
cuugaguuccgcaaccucaccc

SEQ ID NO: 3365915 - RNA, 19 nt, Hepatitis E virus
cuugugccccccuucuuuc

SEQ ID NO: 3365916 - RNA, 20 nt, Hepatitis E virus
gaauucaauaaccucgacug

SEQ ID NO: 3365917 - RNA, 17 nt, Hepatitis E virus
gaccaaggucacacuug

SEQ ID NO: 3365918 - RNA, 14 nt, Hepatitis E virus
gaggccaccucugg

SEQ ID NO: 3365919 - RNA, 22 nt, Hepatitis E virus
gaguuauaguuuauuugcuugu

SEQ ID NO: 3365920 - RNA, 22 nt, Hepatitis E virus
gauaaccaacaugagcaggacc

SEQ ID NO: 3365921 - RNA, 13 nt, Hepatitis E virus
gauggucgccccc

SEQ ID NO: 3365922 - RNA, 14 nt, Hepatitis E virus
gccaccucuggucu

SEQ ID NO: 3365923 - RNA, 16 nt, Hepatitis E virus
gccagugccugauguu

SEQ ID NO: 3365924 - RNA, 16 nt, Hepatitis E virus
gcccagcgccccgccg

SEQ ID NO: 3365925 - RNA, 17 nt, Hepatitis E virus
gcccccuuuccaccacc

SEQ ID NO: 3365926 - RNA, 21 nt, Hepatitis E virus
gcccggcauagccuccgagca

SEQ ID NO: 3365927 - RNA, 19 nt, Hepatitis E virus
gccgagcucaccaccacgg

SEQ ID NO: 3365928 - RNA, 20 nt, Hepatitis E virus
gccgcccccuuggccuccag

SEQ ID NO: 3365929 - RNA, 16 nt, Hepatitis E virus
gccgucuggccgccgc

SEQ ID NO: 3365930 - RNA, 15 nt, Hepatitis E virus
gccuauuuugcuguu

SEQ ID NO: 3365931 - RNA, 18 nt, Hepatitis E virus
gccucacgucguagaccu

SEQ ID NO: 3365932 - RNA, 18 nt, Hepatitis E virus
gccuccagggcugugcuu

SEQ ID NO: 3365933 - RNA, 19 nt, Hepatitis E virus
gccugggugcuggccccgu

SEQ ID NO: 3365934 - RNA, 16 nt, Hepatitis E virus
cggcccaugacacccc

SEQ ID NO: 3365935 - RNA, 18 nt, Hepatitis E virus
cgggcugauucucagccc

SEQ ID NO: 3365936 - RNA, 14 nt, Hepatitis E virus
cgucgucucagcca

SEQ ID NO: 3365937 - RNA, 16 nt, Hepatitis E virus
cgucuggccgccgccg

SEQ ID NO: 3365938 - RNA, 15 nt, Hepatitis E virus
cuacagaagcuucua

SEQ ID NO: 3365939 - RNA, 14 nt, Hepatitis E virus
cuagcauugcuuga

SEQ ID NO: 3365940 - RNA, 18 nt, Hepatitis E virus
cuauuuccacuuacacca

SEQ ID NO: 3365941 - RNA, 21 nt, Hepatitis E virus
cuauuuugcuguugcuccuca

SEQ ID NO: 3365942 - RNA, 22 nt, Hepatitis E virus
cucauguuucugccuaugcugc

SEQ ID NO: 3365943 - RNA, 16 nt, Hepatitis E virus
cuccucuuagcccgcu

SEQ ID NO: 3365944 - RNA, 15 nt, Hepatitis E virus
cugccuaugcugccc

SEQ ID NO: 3365945 - RNA, 16 nt, Hepatitis E virus
cuuacaccacuagccu

SEQ ID NO: 3365946 - RNA, 11 nt, Hepatitis E virus
cuugugccccc

SEQ ID NO: 3365947 - RNA, 16 nt, Hepatitis E virus
cuugugccccccuucu

SEQ ID NO: 3365948 - RNA, 14 nt, Hepatitis E virus
cuuuucuguccucc

SEQ ID NO: 3365949 - RNA, 16 nt, Hepatitis E virus
gaaucucguguaguua

SEQ ID NO: 3365950 - RNA, 16 nt, Hepatitis E virus
gaccacucggcuccgc

SEQ ID NO: 3365951 - RNA, 15 nt, Hepatitis E virus
gacucccgcggcgcc

SEQ ID NO: 3365952 - RNA, 14 nt, Hepatitis E virus
gacucugugaccuu

SEQ ID NO: 3365953 - RNA, 19 nt, Hepatitis E virus
gaguaugaccaguccacuu

SEQ ID NO: 3365954 - RNA, 20 nt, Hepatitis E virus
gauggucgcccccuuuccac

SEQ ID NO: 3365955 - RNA, 12 nt, Hepatitis E virus
gauucucagccc

SEQ ID NO: 3365956 - RNA, 19 nt, Hepatitis E virus
gcccccuuuccaccaccca

SEQ ID NO: 3365957 - RNA, 22 nt, Hepatitis E virus
gccccgucucuauuuccgcggu

SEQ ID NO: 3365958 - RNA, 14 nt, Hepatitis E virus
gcccgucaccgccu

SEQ ID NO: 3365959 - RNA, 13 nt, Hepatitis E virus
gccgcuccgcggu

SEQ ID NO: 3365960 - RNA, 22 nt, Hepatitis E virus
gccucacgucguagaccuacca

SEQ ID NO: 3365961 - RNA, 19 nt, Hepatitis E virus
gccuccagggcugugcuuu

SEQ ID NO: 3365962 - RNA, 13 nt, Hepatitis E virus
gccugggugcugg

SEQ ID NO: 3365963 - RNA, 12 nt, Hepatitis E virus
gcgcccucggcc

SEQ ID NO: 3365964 - RNA, 23 nt, Hepatitis E virus
gcgggucucccguuacuccagca

SEQ ID NO: 3365965 - RNA, 17 nt, Hepatitis E virus
gcgugaccaggcccagc

SEQ ID NO: 3365966 - RNA, 19 nt, Hepatitis E virus
gcuacaauucgcuaccgcc

SEQ ID NO: 3365967 - RNA, 18 nt, Hepatitis E virus
gcucaccaccacggcugc

SEQ ID NO: 3365968 - RNA, 21 nt, Hepatitis E virus
gcuccucuuagcccgcuucua

SEQ ID NO: 3365969 - RNA, 18 nt, Hepatitis E virus
gcugcccgcgccaccgcc

SEQ ID NO: 3365970 - RNA, 13 nt, Hepatitis E virus
gcugcgcccaugg

SEQ ID NO: 3365971 - RNA, 16 nt, Hepatitis E virus
ggcccagcgccccgcc

SEQ ID NO: 3365972 - RNA, 17 nt, Hepatitis E virus
ggcccagcgccccgccg

SEQ ID NO: 3365973 - RNA, 19 nt, Hepatitis E virus
ggcccaugacaccccgcca

SEQ ID NO: 3365974 - RNA, 21 nt, Hepatitis E virus
ggcccaugacaccccgccagu

SEQ ID NO: 3365975 - RNA, 21 nt, Hepatitis E virus
ggcgcucuguugagaccuccg

SEQ ID NO: 3365976 - RNA, 18 nt, Hepatitis E virus
ggcggaggaggaggccac

SEQ ID NO: 3365977 - RNA, 19 nt, Hepatitis E virus
ggcggaggaggaggccacc

SEQ ID NO: 3365978 - RNA, 17 nt, Hepatitis E virus
ggcuacagaagcuucua

SEQ ID NO: 3365979 - RNA, 19 nt, Hepatitis E virus
ggguugcuauuuccacuua

SEQ ID NO: 3365980 - RNA, 18 nt, Hepatitis E virus
gguucgcgaccaugcgcc

SEQ ID NO: 3365981 - RNA, 23 nt, Hepatitis E virus
guaaaacucgggaguuauaguuu

SEQ ID NO: 3365982 - RNA, 17 nt, Hepatitis E virus
gucggcugguggccagc

SEQ ID NO: 3365983 - RNA, 18 nt, Hepatitis E virus
gugccgcccccuuggccu

SEQ ID NO: 3365984 - RNA, 18 nt, Hepatitis E virus
uacaccacuagccugggu

SEQ ID NO: 3365985 - RNA, 18 nt, Hepatitis E virus
uaccauggacuacccugc

SEQ ID NO: 3365986 - RNA, 14 nt, Hepatitis E virus
uacgccgcuccucu

SEQ ID NO: 3365987 - RNA, 17 nt, Hepatitis E virus
uaucaacaucuccccuu

SEQ ID NO: 3365988 - RNA, 15 nt, Hepatitis E virus
uaucguaaccaaggu

SEQ ID NO: 3365989 - RNA, 22 nt, Hepatitis E virus
ucacacuugauggucgcccccu

SEQ ID NO: 3365990 - RNA, 23 nt, Hepatitis E virus
ucacacuugauggucgcccccuu

SEQ ID NO: 3365991 - RNA, 10 nt, Hepatitis E virus
uccaccaccc

SEQ ID NO: 3365992 - RNA, 22 nt, Hepatitis E virus
uccagcccggcauagccuccga

SEQ ID NO: 3365993 - RNA, 14 nt, Hepatitis E virus
uccaucucguucug

SEQ ID NO: 3365994 - RNA, 16 nt, Hepatitis E virus
ucgacuggaccaaggu

SEQ ID NO: 3365995 - RNA, 12 nt, Hepatitis E virus
ucgucucagcca

SEQ ID NO: 3365996 - RNA, 17 nt, Hepatitis E virus
ucgucucagccaauggc

SEQ ID NO: 3365997 - RNA, 12 nt, Hepatitis E virus
ucguucuggcca

SEQ ID NO: 3365998 - RNA, 20 nt, Hepatitis E virus
ucugcccggagugccgcccc

SEQ ID NO: 3365999 - RNA, 23 nt, Hepatitis E virus
ucugcccggagugccgcccccuu

SEQ ID NO: 3366000 - RNA, 17 nt, Hepatitis E virus
ucugcguuccgcgcucc

SEQ ID NO: 3366001 - RNA, 18 nt, Hepatitis E virus
ucugcguuccgcgcuccc

SEQ ID NO: 3366002 - RNA, 20 nt, Hepatitis E virus
ugaccgggcugauucucagc

SEQ ID NO: 3366003 - RNA, 20 nt, Hepatitis E virus
ugcccggagugccgcccccu

SEQ ID NO: 3366004 - RNA, 14 nt, Hepatitis E virus
ugccgcccccuugg

SEQ ID NO: 3366005 - RNA, 18 nt, Hepatitis E virus
ugcggccggggcuggacc

SEQ ID NO: 3366006 - RNA, 15 nt, Hepatitis E virus
ugcuguugcuccuca

SEQ ID NO: 3366007 - RNA, 18 nt, Hepatitis E virus
ugcuguuuuagcccccca

SEQ ID NO: 3366008 - RNA, 13 nt, Hepatitis E virus
uggccagcuguuc

SEQ ID NO: 3366009 - RNA, 17 nt, Hepatitis E virus
uggcgagccgacuguua

SEQ ID NO: 3366010 - RNA, 18 nt, Hepatitis E virus
ugugccccccuucuuucu

SEQ ID NO: 3366011 - RNA, 16 nt, Hepatitis E virus
uucgaccggcccaguc

SEQ ID NO: 3366012 - RNA, 15 nt, Hepatitis E virus
uucuguugcuuauuu

SEQ ID NO: 3366013 - RNA, 15 nt, Hepatitis E virus
uugcuuauuucucau

SEQ ID NO: 3366014 - RNA, 22 nt, Hepatitis E virus
uugcuugugccccccuucuuuc

SEQ ID NO: 3366015 - RNA, 22 nt, Hepatitis E virus
uuuauuugcuugugccccccuu

SEQ ID NO: 3366016 - RNA, 18 nt, Hepatitis E virus
uuuccacuuacaccacua

SEQ ID NO: 3366017 - RNA, 12 nt, Hepatitis E virus
aacaccacugcu

SEQ ID NO: 3366018 - RNA, 21 nt, Hepatitis E virus
aauacucauauaauggcuaca

SEQ ID NO: 3366019 - RNA, 14 nt, Hepatitis E virus
acaauucgcuaccg

SEQ ID NO: 3366020 - RNA, 20 nt, Hepatitis E virus
acacccugcuuggcggucua

SEQ ID NO: 3366021 - RNA, 16 nt, Hepatitis E virus
accaccacggcugcua

SEQ ID NO: 3366022 - RNA, 20 nt, Hepatitis E virus
accgccuucgucgcggugca

SEQ ID NO: 3366023 - RNA, 23 nt, Hepatitis E virus
accucuauuuuacuaguacuaau

SEQ ID NO: 3366024 - RNA, 22 nt, Hepatitis E virus
accucuggucuuguuaugcuuu

SEQ ID NO: 3366025 - RNA, 12 nt, Hepatitis E virus
agcauugcuuga

SEQ ID NO: 3366026 - RNA, 13 nt, Hepatitis E virus
aggauaccaugga

SEQ ID NO: 3366027 - RNA, 13 nt, Hepatitis E virus
agugccgcccccu

SEQ ID NO: 3366028 - RNA, 11 nt, Hepatitis E virus
aucgcgccccu

SEQ ID NO: 3366029 - RNA, 14 nt, Hepatitis E virus
augacaccccgcca

SEQ ID NO: 3366030 - RNA, 19 nt, Hepatitis E virus
augacaccccgccagugcc

SEQ ID NO: 3366031 - RNA, 18 nt, Hepatitis E virus
augacaucgaccucgggg

SEQ ID NO: 3366032 - RNA, 13 nt, Hepatitis E virus
auggacuacccug

SEQ ID NO: 3366033 - RNA, 19 nt, Hepatitis E virus
auuucgucggcugguggcc

SEQ ID NO: 3366034 - RNA, 17 nt, Hepatitis E virus
auuuugcuguugcuccu

SEQ ID NO: 3366035 - RNA, 22 nt, Hepatitis E virus
caaccaaccccuucgcccccga

SEQ ID NO: 3366036 - RNA, 14 nt, Hepatitis E virus
caccacugcuagug

SEQ ID NO: 3366037 - RNA, 19 nt, Hepatitis E virus
caccuuccccagccccauc

SEQ ID NO: 3366038 - RNA, 21 nt, Hepatitis E virus
cagcacugcccgucaccgccu

SEQ ID NO: 3366039 - RNA, 19 nt, Hepatitis E virus
cagcccuucgcaauccccu

SEQ ID NO: 3366040 - RNA, 19 nt, Hepatitis E virus
cagccgucuggccgccgcc

SEQ ID NO: 3366041 - RNA, 19 nt, Hepatitis E virus
cagcuggggccgcgccgcu

SEQ ID NO: 3366042 - RNA, 21 nt, Hepatitis E virus
caggaccgaccgacaccuucc

SEQ ID NO: 3366043 - RNA, 23 nt, Hepatitis E virus
cauacuuucgaugacuucugccc

SEQ ID NO: 3366044 - RNA, 20 nt, Hepatitis E virus
caugaaggaccucuauuuua

SEQ ID NO: 3366045 - RNA, 16 nt, Hepatitis E virus
ccaaccaaccccuucg

SEQ ID NO: 3366046 - RNA, 14 nt, Hepatitis E virus
ccaagugagcgccu

SEQ ID NO: 3366047 - RNA, 14 nt, Hepatitis E virus
ccacuuacaccacu

SEQ ID NO: 3366048 - RNA, 22 nt, Hepatitis E virus
ccagcacugcccgucaccgccu

SEQ ID NO: 3366049 - RNA, 17 nt, Hepatitis E virus
cccaugacaccccgcca

SEQ ID NO: 3366050 - RNA, 14 nt, Hepatitis E virus
cccccacucugcgc

SEQ ID NO: 3366051 - RNA, 17 nt, Hepatitis E virus
ccccuucuuucuguugc

SEQ ID NO: 3366052 - RNA, 21 nt, Hepatitis E virus
cccgcaugacaucgaccucgg

SEQ ID NO: 3366053 - RNA, 22 nt, Hepatitis E virus
cccgcggcgccauccugcgccg

SEQ ID NO: 3366054 - RNA, 16 nt, Hepatitis E virus
cccgucgucucagcca

SEQ ID NO: 3366055 - RNA, 17 nt, Hepatitis E virus
cccuucuuucuguugcu

SEQ ID NO: 3366056 - RNA, 12 nt, Hepatitis E virus
cccuuuucuguc

SEQ ID NO: 3366057 - RNA, 17 nt, Hepatitis E virus
ccgcgguaagcucuccu

SEQ ID NO: 3366058 - RNA, 15 nt, Hepatitis E virus
ccgcggucgcuccgg

SEQ ID NO: 3366059 - RNA, 16 nt, Hepatitis E virus
ccggagugccgccccc

SEQ ID NO: 3366060 - RNA, 15 nt, Hepatitis E virus
ccgucgucucagcca

SEQ ID NO: 3366061 - RNA, 16 nt, Hepatitis E virus
ccucauguuucugccu

SEQ ID NO: 3366062 - RNA, 17 nt, Hepatitis E virus
ccucauguuucugccua

SEQ ID NO: 3366063 - RNA, 19 nt, Hepatitis E virus
ccucauguuucugccuaug

SEQ ID NO: 3366064 - RNA, 17 nt, Hepatitis E virus
ccuccagggcugugcuu

SEQ ID NO: 3366065 - RNA, 13 nt, Hepatitis E virus
ccugggugcuggc

SEQ ID NO: 3366066 - RNA, 21 nt, Hepatitis E virus
ccuuauaauuauaacaccacu

SEQ ID NO: 3366067 - RNA, 19 nt, Hepatitis E virus
cgaguaugaccaguccacu

SEQ ID NO: 3366068 - RNA, 15 nt, Hepatitis E virus
cgccaucuccaucuc

SEQ ID NO: 3366069 - RNA, 20 nt, Hepatitis E virus
cgcccccgaugucaccgcug

SEQ ID NO: 3366070 - RNA, 19 nt, Hepatitis E virus
cgcccccuuggccuccagg

SEQ ID NO: 3366071 - RNA, 14 nt, Hepatitis E virus
cgcuccucuuagcc

SEQ ID NO: 3366072 - RNA, 18 nt, Hepatitis E virus
cguauuuuaguccagccc

SEQ ID NO: 3366073 - RNA, 23 nt, Hepatitis E virus
cguucuggccacagaccaccacc

SEQ ID NO: 3366074 - RNA, 11 nt, Hepatitis E virus
cucagcaggau

SEQ ID NO: 3366075 - RNA, 14 nt, Hepatitis E virus
cuccagcacugccc

SEQ ID NO: 3366076 - RNA, 17 nt, Hepatitis E virus
cuccagcacugcccguc

SEQ ID NO: 3366077 - RNA, 22 nt, Hepatitis E virus
cuccagggcugugcuuuucagu

SEQ ID NO: 3366078 - RNA, 16 nt, Hepatitis E virus
cuccaucucguucugg

SEQ ID NO: 3366079 - RNA, 18 nt, Hepatitis E virus
cuccaucucguucuggcc

SEQ ID NO: 3366080 - RNA, 22 nt, Hepatitis E virus
cucggccuauuuugcuguugcu

SEQ ID NO: 3366081 - RNA, 20 nt, Hepatitis E virus
cugacucugugaccuugguu

SEQ ID NO: 3366082 - RNA, 21 nt, Hepatitis E virus
cugauguugacucccgcggcg

SEQ ID NO: 3366083 - RNA, 14 nt, Hepatitis E virus
cugauucucagccc

SEQ ID NO: 3366084 - RNA, 16 nt, Hepatitis E virus
cugcccgcgccaccgc

SEQ ID NO: 3366085 - RNA, 15 nt, Hepatitis E virus
cugcgcccauggguu

SEQ ID NO: 3366086 - RNA, 19 nt, Hepatitis E virus
cugcguuccgcgcucccug

SEQ ID NO: 3366087 - RNA, 15 nt, Hepatitis E virus
cuuagcccgcuucua

SEQ ID NO: 3366088 - RNA, 13 nt, Hepatitis E virus
cuuauuucucauu

SEQ ID NO: 3366089 - RNA, 14 nt, Hepatitis E virus
cuucugcugcgccc

SEQ ID NO: 3366090 - RNA, 16 nt, Hepatitis E virus
cuucuuucuguugcuu

SEQ ID NO: 3366091 - RNA, 16 nt, Hepatitis E virus
cuugauggucgccccc

SEQ ID NO: 3366092 - RNA, 16 nt, Hepatitis E virus
cuugcugacacccugc

SEQ ID NO: 3366093 - RNA, 20 nt, Hepatitis E virus
cuugcugacacccugcuugg

SEQ ID NO: 3366094 - RNA, 16 nt, Hepatitis E virus
cuuucucucaccgcug

SEQ ID NO: 3366095 - RNA, 21 nt, Hepatitis E virus
cuuucuguugcuuauuucuca

SEQ ID NO: 3366096 - RNA, 20 nt, Hepatitis E virus
gacaccuuccccagccccau

SEQ ID NO: 3366097 - RNA, 18 nt, Hepatitis E virus
cagcgccccgccgcugcc

SEQ ID NO: 3366098 - RNA, 16 nt, Hepatitis E virus
cagcuggggccgcgcc

SEQ ID NO: 3366099 - RNA, 20 nt, Hepatitis E virus
cagucuacugucgcugagcu

SEQ ID NO: 3366100 - RNA, 18 nt, Hepatitis E virus
cagucuaugucucugacu

SEQ ID NO: 3366101 - RNA, 18 nt, Hepatitis E virus
caugacaccccgccagug

SEQ ID NO: 3366102 - RNA, 21 nt, Hepatitis E virus
caugacaccccgccagugccu

SEQ ID NO: 3366103 - RNA, 12 nt, Hepatitis E virus
caugagcaggac

SEQ ID NO: 3366104 - RNA, 22 nt, Hepatitis E virus
caugcgcccucggccuauuuug

SEQ ID NO: 3366105 - RNA, 13 nt, Hepatitis E virus
ccaaccaaccccu

SEQ ID NO: 3366106 - RNA, 17 nt, Hepatitis E virus
ccaauggcgagccgacu

SEQ ID NO: 3366107 - RNA, 12 nt, Hepatitis E virus
ccacagaccacc

SEQ ID NO: 3366108 - RNA, 21 nt, Hepatitis E virus
ccaccgcccggucagccgucu

SEQ ID NO: 3366109 - RNA, 13 nt, Hepatitis E virus
ccagcacugcccg

SEQ ID NO: 3366110 - RNA, 13 nt, Hepatitis E virus
cccagcgccccgc

SEQ ID NO: 3366111 - RNA, 18 nt, Hepatitis E virus
cccagucuaugucucuga

SEQ ID NO: 3366112 - RNA, 19 nt, Hepatitis E virus
ccccgaugucaccgcugcg

SEQ ID NO: 3366113 - RNA, 13 nt, Hepatitis E virus
ccccgccgcugcc

SEQ ID NO: 3366114 - RNA, 14 nt, Hepatitis E virus
ccccgccgcugccu

SEQ ID NO: 3366115 - RNA, 17 nt, Hepatitis E virus
ccccuuggccuccaggg

SEQ ID NO: 3366116 - RNA, 17 nt, Hepatitis E virus
ccccuuuucuguccucc

SEQ ID NO: 3366117 - RNA, 13 nt, Hepatitis E virus
cccgccgcugccu

SEQ ID NO: 3366118 - RNA, 15 nt, Hepatitis E virus
cccgcugguccccaa

SEQ ID NO: 3366119 - RNA, 15 nt, Hepatitis E virus
ccgagcucaccacca

SEQ ID NO: 3366120 - RNA, 23 nt, Hepatitis E virus
ccgagcucaccaccacggcugcu

SEQ ID NO: 3366121 - RNA, 20 nt, Hepatitis E virus
ccgaguaugaccaguccacu

SEQ ID NO: 3366122 - RNA, 21 nt, Hepatitis E virus
ccgcuccucuuagcccgcuuc

SEQ ID NO: 3366123 - RNA, 19 nt, Hepatitis E virus
ccgggcugauucucagccc

SEQ ID NO: 3366124 - RNA, 16 nt, Hepatitis E virus
ccgucuggccgccgcc

SEQ ID NO: 3366125 - RNA, 16 nt, Hepatitis E virus
ccguuacuccagcacu

SEQ ID NO: 3366126 - RNA, 21 nt, Hepatitis E virus
ccuaucaacaucuccccuuac

SEQ ID NO: 3366127 - RNA, 18 nt, Hepatitis E virus
ccuaugcugcccgcgcca

SEQ ID NO: 3366128 - RNA, 14 nt, Hepatitis E virus
ccucguguucgcca

SEQ ID NO: 3366129 - RNA, 18 nt, Hepatitis E virus
ccuuuccaccacccagca

SEQ ID NO: 3366130 - RNA, 13 nt, Hepatitis E virus
cgaccaugcgccc

SEQ ID NO: 3366131 - RNA, 15 nt, Hepatitis E virus
cgagcucaccaccac

SEQ ID NO: 3366132 - RNA, 15 nt, Hepatitis E virus
cgaugacuucugccc

SEQ ID NO: 3366133 - RNA, 19 nt, Hepatitis E virus
cgcccccuuuccaccaccc

SEQ ID NO: 3366134 - RNA, 16 nt, Hepatitis E virus
cgcggcgccauccugc

SEQ ID NO: 3366135 - RNA, 12 nt, Hepatitis E virus
cgcucccugaaa

SEQ ID NO: 3366136 - RNA, 19 nt, Hepatitis E virus
cggaggaggaggccaccuc

SEQ ID NO: 3366137 - RNA, 20 nt, Hepatitis E virus
cggccuauuuugcuguugcu

SEQ ID NO: 3366138 - RNA, 17 nt, Hepatitis E virus
cggucagccgucuggcc

SEQ ID NO: 3366139 - RNA, 13 nt, Hepatitis E virus
cguagaccuacca

SEQ ID NO: 3366140 - RNA, 14 nt, Hepatitis E virus
cgucucuauuuccg

SEQ ID NO: 3366141 - RNA, 22 nt, Hepatitis E virus
cgugcuacaauucgcuaccgcc

SEQ ID NO: 3366142 - RNA, 20 nt, Hepatitis E virus
cguugagaaugccgcugggc

SEQ ID NO: 3366143 - RNA, 14 nt, Hepatitis E virus
cuaccccuccagga

SEQ ID NO: 3366144 - RNA, 23 nt, Hepatitis E virus
cuagccugggugcuggccccguc

SEQ ID NO: 3366145 - RNA, 12 nt, Hepatitis E virus
cucaccgcugcc

SEQ ID NO: 3366146 - RNA, 13 nt, Hepatitis E virus
cucucgccccguc

SEQ ID NO: 3366147 - RNA, 13 nt, Hepatitis E virus
cugauucucagcc

SEQ ID NO: 3366148 - RNA, 17 nt, Hepatitis E virus
cugcccggagugccgcc

SEQ ID NO: 3366149 - RNA, 18 nt, Hepatitis E virus
cugcguuccgcgcucccu

SEQ ID NO: 3366150 - RNA, 23 nt, Hepatitis E virus
cuggccacagaccaccaccaccc

SEQ ID NO: 3366151 - RNA, 15 nt, Hepatitis E virus
cugguggccagcugu

SEQ ID NO: 3366152 - RNA, 20 nt, Hepatitis E virus
cuguagagaaugcucagcag

SEQ ID NO: 3366153 - RNA, 14 nt, Hepatitis E virus
cuguccuccgagcu

SEQ ID NO: 3366154 - RNA, 14 nt, Hepatitis E virus
cugugcuuuucagu

SEQ ID NO: 3366155 - RNA, 18 nt, Hepatitis E virus
acaccacuagccugggug

SEQ ID NO: 3366156 - RNA, 18 nt, Hepatitis E virus
acagcuggggccgcgccg

SEQ ID NO: 3366157 - RNA, 15 nt, Hepatitis E virus
accacuagccugggu

SEQ ID NO: 3366158 - RNA, 18 nt, Hepatitis E virus
accaugcgcccucggccu

SEQ ID NO: 3366159 - RNA, 20 nt, Hepatitis E virus
accgcccggucagccgucug

SEQ ID NO: 3366160 - RNA, 19 nt, Hepatitis E virus
accgcugcggccggggcug

SEQ ID NO: 3366161 - RNA, 15 nt, Hepatitis E virus
accucgacugauguu

SEQ ID NO: 3366162 - RNA, 19 nt, Hepatitis E virus
accucuuccguggccaccg

SEQ ID NO: 3366163 - RNA, 13 nt, Hepatitis E virus
accuuccccagcc

SEQ ID NO: 3366164 - RNA, 14 nt, Hepatitis E virus
acucuuauacuaau

SEQ ID NO: 3366165 - RNA, 16 nt, Hepatitis E virus
acuuucgaugacuucu

SEQ ID NO: 3366166 - RNA, 15 nt, Hepatitis E virus
agccuccgagcaugu

SEQ ID NO: 3366167 - RNA, 20 nt, Hepatitis E virus
agcuucuaauuaugcccagu

SEQ ID NO: 3366168 - RNA, 18 nt, Hepatitis E virus
aggcccagcgccccgccg

SEQ ID NO: 3366169 - RNA, 14 nt, Hepatitis E virus
auaacaccacugcu

SEQ ID NO: 3366170 - RNA, 20 nt, Hepatitis E virus
auaccggugcccucgggcug

SEQ ID NO: 3366171 - RNA, 15 nt, Hepatitis E virus
auagcgcuuacccug

SEQ ID NO: 3366172 - RNA, 13 nt, Hepatitis E virus
auggucgcccccu

SEQ ID NO: 3366173 - RNA, 21 nt, Hepatitis E virus
auggucgcccccuuuccacca

SEQ ID NO: 3366174 - RNA, 18 nt, Hepatitis E virus
auuugcuugugccccccu

SEQ ID NO: 3366175 - RNA, 13 nt, Hepatitis E virus
cacagaccaccac

SEQ ID NO: 3366176 - RNA, 16 nt, Hepatitis E virus
caccacuagccugggu

SEQ ID NO: 3366177 - RNA, 10 nt, Hepatitis E virus
caccacugcu

SEQ ID NO: 3366178 - RNA, 22 nt, Hepatitis E virus
caccgccuucgucgcggugcag

SEQ ID NO: 3366179 - RNA, 11 nt, Hepatitis E virus
caccgcugccg

SEQ ID NO: 3366180 - RNA, 19 nt, Hepatitis E virus
aacaugucuucugcugcgc

SEQ ID NO: 3366181 - RNA, 13 nt, Hepatitis E virus
acaaacuugguuc

SEQ ID NO: 3366182 - RNA, 17 nt, Hepatitis E virus
acaccccgccagugccu

SEQ ID NO: 3366183 - RNA, 20 nt, Hepatitis E virus
accgggcugauucucagccc

SEQ ID NO: 3366184 - RNA, 17 nt, Hepatitis E virus
accucuuccguggccac

SEQ ID NO: 3366185 - RNA, 21 nt, Hepatitis E virus
acgucguagaccuaccacagc

SEQ ID NO: 3366186 - RNA, 15 nt, Hepatitis E virus
acuccagcacugccc

SEQ ID NO: 3366187 - RNA, 19 nt, Hepatitis E virus
acugccgagcucaccacca

SEQ ID NO: 3366188 - RNA, 23 nt, Human
agaaaacaggaaaaaaacuuuua

SEQ ID NO: 3366189 - RNA, 15 nt, Human
agaaaacaucacuga

SEQ ID NO: 3366190 - RNA, 12 nt, Human
agaaaacauugu

SEQ ID NO: 3366191 - RNA, 15 nt, Human
agaaaacauuguucc

SEQ ID NO: 3366192 - RNA, 19 nt, Human
agaaaacauuguuccagau

SEQ ID NO: 3366193 - RNA, 13 nt, Human
agaaaacauuuuu

SEQ ID NO: 3366194 - RNA, 13 nt, Human
agaaaacccaccc

SEQ ID NO: 3366195 - RNA, 16 nt, Human
agaaaacccuuuucua

SEQ ID NO: 3366196 - RNA, 21 nt, Human
agaaaacuccuuuagcaggug

SEQ ID NO: 3366197 - RNA, 14 nt, Human
agaaaacuucuuuu

SEQ ID NO: 3366198 - RNA, 19 nt, Human
agaaaacuuuaaaaaauau

SEQ ID NO: 3366199 - RNA, 11 nt, Human
agaaaagaaaa

SEQ ID NO: 3366200 - RNA, 13 nt, Human
agaaaagagagaa

SEQ ID NO: 3366201 - RNA, 17 nt, Human
agaaaagauaaagauga

SEQ ID NO: 3366202 - RNA, 20 nt, Human
agaaaagauacgacuuuauu

SEQ ID NO: 3366203 - RNA, 12 nt, Human
agaaaagaugca

SEQ ID NO: 3366204 - RNA, 15 nt, Human
agaaaagaugcacuu

SEQ ID NO: 3366205 - RNA, 19 nt, Human
agaaaagauguagauuuau

SEQ ID NO: 3366206 - RNA, 20 nt, Human
agaaaagauuuuaaucaagu

SEQ ID NO: 3366207 - RNA, 17 nt, Human
agaaaagcuaagagaag

SEQ ID NO: 3366208 - RNA, 21 nt, Human
agaaaagcuauaaaaugaaua

SEQ ID NO: 3366209 - RNA, 12 nt, Human
agaaaaggaaaa

SEQ ID NO: 3366210 - RNA, 17 nt, Human
agaaaaggaaaagaaaa

SEQ ID NO: 3366211 - RNA, 23 nt, Human
agaaaaguagacaaucauuguuu

SEQ ID NO: 3366212 - RNA, 12 nt, Human
agaaaaguauuu

SEQ ID NO: 3366213 - RNA, 15 nt, Human
agaaaaguauuuuga

SEQ ID NO: 3366214 - RNA, 21 nt, Human
agaaaaguugaauuuuacaug

SEQ ID NO: 3366215 - RNA, 22 nt, Human
agaaaauaaaauuaagaauguu

SEQ ID NO: 3366216 - RNA, 21 nt, Human
agaaaauaaagacaaccauau

SEQ ID NO: 3366217 - RNA, 17 nt, Human
agaaaauacaauaaacu

SEQ ID NO: 3366218 - RNA, 19 nt, Human
agaaaauagagaugagcuu

SEQ ID NO: 3366219 - RNA, 11 nt, Human
agaaaauauaa

SEQ ID NO: 3366220 - RNA, 14 nt, Human
agaaaauauacugu

SEQ ID NO: 3366221 - RNA, 16 nt, Human
agaaaauauacuguaa

SEQ ID NO: 3366222 - RNA, 17 nt, Human
agaaaauauacuguaaa

SEQ ID NO: 3366223 - RNA, 20 nt, Human
agaaaauauacuguaaagaa

SEQ ID NO: 3366224 - RNA, 14 nt, Human
agaaaauauaugua

SEQ ID NO: 3366225 - RNA, 16 nt, Human
agccuccucugucugc

SEQ ID NO: 3366226 - RNA, 18 nt, Human
agccuccucugucugccc

SEQ ID NO: 3366227 - RNA, 16 nt, Human
agccuccugaccugag

SEQ ID NO: 3366228 - RNA, 18 nt, Human
agccuccugaccugaggc

SEQ ID NO: 3366229 - RNA, 22 nt, Human
agccuccugaccugaggcuccu

SEQ ID NO: 3366230 - RNA, 16 nt, Human
agccucgaacuccugg

SEQ ID NO: 3366231 - RNA, 17 nt, Human
agccucgacacagagug

SEQ ID NO: 3366232 - RNA, 18 nt, Human
agccucgacacagagugg

SEQ ID NO: 3366233 - RNA, 19 nt, Human
agccucgcaacccgugcca

SEQ ID NO: 3366234 - RNA, 22 nt, Human
agccucgcaggccucccugcca

SEQ ID NO: 3366235 - RNA, 20 nt, Human
agccucgcccauccccuuga

SEQ ID NO: 3366236 - RNA, 18 nt, Human
agccucgccccuggcaga

SEQ ID NO: 3366237 - RNA, 19 nt, Human
agccucgccccuggcagag

SEQ ID NO: 3366238 - RNA, 20 nt, Human
agccucgccgucugugaauu

SEQ ID NO: 3366239 - RNA, 23 nt, Human
agccucgcucuguuacccagggu

SEQ ID NO: 3366240 - RNA, 17 nt, Human
agccucguuuugaugcc

SEQ ID NO: 3366241 - RNA, 19 nt, Human
agccucuagagcagacuac

SEQ ID NO: 3366242 - RNA, 22 nt, Human
agccucuagagcagacuacagc

SEQ ID NO: 3366243 - RNA, 23 nt, Human
agccucuagagcagacuacagcu

SEQ ID NO: 3366244 - RNA, 18 nt, Human
agccucuagggaccccuc

SEQ ID NO: 3366245 - RNA, 18 nt, Human
agccucucagugcccucc

SEQ ID NO: 3366246 - RNA, 20 nt, Human
agccucucagugcccuccag

SEQ ID NO: 3366247 - RNA, 20 nt, Human
agccucuccggcagaaggga

SEQ ID NO: 3366248 - RNA, 17 nt, Human
agccucucucccagucu

SEQ ID NO: 3366249 - RNA, 20 nt, Human
agccucucuuccuaucccau

SEQ ID NO: 3366250 - RNA, 23 nt, Human
agccucugaaaaccaauguucuc

SEQ ID NO: 3366251 - RNA, 19 nt, Human
agccucugaaguuggacag

SEQ ID NO: 3366252 - RNA, 12 nt, Human
agccucugaccc

SEQ ID NO: 3366253 - RNA, 15 nt, Human
agccucugaccccuc

SEQ ID NO: 3366254 - RNA, 18 nt, Human
agccucugaccccuccuc

SEQ ID NO: 3366255 - RNA, 19 nt, Human
agccucugaccccuccuca

SEQ ID NO: 3366256 - RNA, 22 nt, Human
agccucugcccaggcacugcua

SEQ ID NO: 3366257 - RNA, 18 nt, Human
agccucugcugccauggc

SEQ ID NO: 3366258 - RNA, 23 nt, Human
agccucuggcauuagaauuauuu

SEQ ID NO: 3366259 - RNA, 20 nt, Human
agccucuggcuagaggccag

SEQ ID NO: 3366260 - RNA, 13 nt, Human
agccucugggggg

SEQ ID NO: 3366261 - RNA, 21 nt, Human
agccucugggggguggccagg

SEQ ID NO: 3366262 - RNA, 17 nt, Human
agccucugucuggcaau

SEQ ID NO: 3366263 - RNA, 23 nt, Human
agccucugugucacuggcugccu

SEQ ID NO: 3366264 - RNA, 14 nt, Human
agccucuucugcca

SEQ ID NO: 3366265 - RNA, 12 nt, Human
agccucuuuccc

SEQ ID NO: 3366266 - RNA, 13 nt, Human
agccucuuucccu

SEQ ID NO: 3366267 - RNA, 22 nt, Human
agccugaaagaggaaugaagua

SEQ ID NO: 3366268 - RNA, 21 nt, Human
agccugaauuuuguugcuguu

SEQ ID NO: 3366269 - RNA, 14 nt, Human
agccugacagccag

SEQ ID NO: 3366270 - RNA, 19 nt, Human
agccugacagccagaacuc

SEQ ID NO: 3366271 - RNA, 22 nt, Human
agccugacaucaaaaaaggcag

SEQ ID NO: 3366272 - RNA, 19 nt, Human
agccugacccucaucuuuc

SEQ ID NO: 3366273 - RNA, 19 nt, Human
agccugaccuuccuuccug

SEQ ID NO: 3366274 - RNA, 17 nt, Human
agccugaggcugagacu

SEQ ID NO: 3366275 - RNA, 23 nt, Human
agccugagggaaaggccagcacu

SEQ ID NO: 3366276 - RNA, 19 nt, Human
agccugagucaccugcaga

SEQ ID NO: 3366277 - RNA, 19 nt, Human
agccugagucagggcccag

SEQ ID NO: 3366278 - RNA, 17 nt, Human
agccugaucucuuccug

SEQ ID NO: 3366279 - RNA, 23 nt, Human
agccugcacuugggggcucagca

SEQ ID NO: 3366280 - RNA, 15 nt, Human
agccugcagagcugc

SEQ ID NO: 3366281 - RNA, 20 nt, Human
agccugcaggaccucgugcc

SEQ ID NO: 3366282 - RNA, 14 nt, Human
agccugcaggaucu

SEQ ID NO: 3366283 - RNA, 18 nt, Human
agccugcaggugcugcug

SEQ ID NO: 3366284 - RNA, 12 nt, Human
agccugcccagc

SEQ ID NO: 3366285 - RNA, 14 nt, Human
agccugcccuuguc

SEQ ID NO: 3366286 - RNA, 17 nt, Human
agccugccgagcaaccg

SEQ ID NO: 3366287 - RNA, 14 nt, Human
agccugccuggcag

SEQ ID NO: 3366288 - RNA, 15 nt, Human
agccugccuugccca

SEQ ID NO: 3366289 - RNA, 14 nt, Human
agccugcgccugcu

SEQ ID NO: 3366290 - RNA, 19 nt, Human
agccugcguggcugacccc

SEQ ID NO: 3366291 - RNA, 21 nt, Human
agccugcguggcugacccccc

SEQ ID NO: 3366292 - RNA, 12 nt, Human
agccugcuagcu

SEQ ID NO: 3366293 - RNA, 22 nt, Human
agccugcuccagcuguucagcu

SEQ ID NO: 3366294 - RNA, 17 nt, Human
agccugcucccccaccc

SEQ ID NO: 3366295 - RNA, 19 nt, Human
agccugcucccccaccccc

SEQ ID NO: 3366296 - RNA, 22 nt, Human
agccugcuccuucccaggagug

SEQ ID NO: 3366297 - RNA, 12 nt, Human
agccugcugcau

SEQ ID NO: 3366298 - RNA, 20 nt, Human
agccugcugcccaggcugug

SEQ ID NO: 3366299 - RNA, 10 nt, Human
agccugcugg

SEQ ID NO: 3366300 - RNA, 21 nt, Human
agccugcuggucacagccucc

SEQ ID NO: 3366301 - RNA, 15 nt, Human
agccugcuucccacc

SEQ ID NO: 3366302 - RNA, 23 nt, Human
agccugcuucccaccucccugcc

SEQ ID NO: 3366303 - RNA, 14 nt, Human
agccuggacccugu

SEQ ID NO: 3366304 - RNA, 15 nt, Human
agccuggaccucuga

SEQ ID NO: 3366305 - RNA, 17 nt, Human
agccuggaccucugaca

SEQ ID NO: 3366306 - RNA, 19 nt, Human
agccuggaccucugacagc

SEQ ID NO: 3366307 - RNA, 13 nt, Human
agccuggagaagc

SEQ ID NO: 3366308 - RNA, 24 nt, Human
agccuggagacccaccccaccugc

SEQ ID NO: 3366309 - RNA, 17 nt, Human
agccuggagcccuggag

SEQ ID NO: 3366310 - RNA, 16 nt, Human
agccuggaugccaucc

SEQ ID NO: 3366311 - RNA, 20 nt, Human
agccuggcacagggcagugg

SEQ ID NO: 3366312 - RNA, 14 nt, Human
agccuggccaacau

SEQ ID NO: 3366313 - RNA, 21 nt, Human
agccuggccacgcagccagga

SEQ ID NO: 3366314 - RNA, 23 nt, Human
agccuggccacgcagccaggaca

SEQ ID NO: 3366315 - RNA, 13 nt, Human
agccuggccagac

SEQ ID NO: 3366316 - RNA, 22 nt, Human
agccuggccagacacaggcccu

SEQ ID NO: 3366317 - RNA, 17 nt, Human
agccuggccagccuaca

SEQ ID NO: 3366318 - RNA, 15 nt, Human
agccuggcccagcuc

SEQ ID NO: 3366319 - RNA, 11 nt, Human
agccuggccuc

SEQ ID NO: 3366320 - RNA, 14 nt, Human
agccuggccuccug

SEQ ID NO: 3366321 - RNA, 20 nt, Human
agccuggccuccugccucua

SEQ ID NO: 3366322 - RNA, 13 nt, Human
agccuggcuccaa

SEQ ID NO: 3366323 - RNA, 21 nt, Human
agccuggcuccaaacccucga

SEQ ID NO: 3366324 - RNA, 18 nt, Human
agccuggcucccaggaca

SEQ ID NO: 3366325 - RNA, 15 nt, Human
agccuggcuccccug

SEQ ID NO: 3366326 - RNA, 17 nt, Human
agccuggcuucaaauug

SEQ ID NO: 3366327 - RNA, 20 nt, Human
agccuggcuucuggagcccu

SEQ ID NO: 3366328 - RNA, 21 nt, Human
agccugggacaguuuaucaug

SEQ ID NO: 3366329 - RNA, 15 nt, Human
agccugggcaacaga

SEQ ID NO: 3366330 - RNA, 20 nt, Human
agccugggcaacagagcaag

SEQ ID NO: 3366331 - RNA, 17 nt, Human
agccugggcagcauagc

SEQ ID NO: 3366332 - RNA, 17 nt, Human
acuuuguauacuuuaaa

SEQ ID NO: 3366333 - RNA, 12 nt, Human
acuuuguauagu

SEQ ID NO: 3366334 - RNA, 14 nt, Human
acuuuguauaguua

SEQ ID NO: 3366335 - RNA, 21 nt, Human
acuuuguauaguuauguaaau

SEQ ID NO: 3366336 - RNA, 23 nt, Human
acuuuguauaguuauguaaauaa

SEQ ID NO: 3366337 - RNA, 19 nt, Human
acuuugucuaagaaacauu

SEQ ID NO: 3366338 - RNA, 14 nt, Human
acuuugucugaaaa

SEQ ID NO: 3366339 - RNA, 14 nt, Human
acuuugugaauaga

SEQ ID NO: 3366340 - RNA, 14 nt, Human
acuuugugcuacau

SEQ ID NO: 3366341 - RNA, 22 nt, Human
acuuuguggaccaauuauugau

SEQ ID NO: 3366342 - RNA, 16 nt, Human
acuuuguggaugucuu

SEQ ID NO: 3366343 - RNA, 14 nt, Human
acuuuguuaggcca

SEQ ID NO: 3366344 - RNA, 18 nt, Human
acuuuguuaggccaaaga

SEQ ID NO: 3366345 - RNA, 14 nt, Human
acuuuguucuggcu

SEQ ID NO: 3366346 - RNA, 21 nt, Human
agcccuguugugccacagagu

SEQ ID NO: 3366347 - RNA, 21 nt, Human
agcccuuaugcgguuaauuuu

SEQ ID NO: 3366348 - RNA, 22 nt, Human
agcccuuaugcgguuaauuuug

SEQ ID NO: 3366349 - RNA, 19 nt, Human
agcccuuccaugucgccuc

SEQ ID NO: 3366350 - RNA, 23 nt, Human
agcccuuccaugucgccucugca

SEQ ID NO: 3366351 - RNA, 15 nt, Human
agcccuuccucugcu

SEQ ID NO: 3366352 - RNA, 17 nt, Human
agcccuuccucugcucc

SEQ ID NO: 3366353 - RNA, 22 nt, Human
agcccuucggaggaccagggcu

SEQ ID NO: 3366354 - RNA, 23 nt, Human
agcccuucuccauggcccugcca

SEQ ID NO: 3366355 - RNA, 13 nt, Human
agcccuugaggga

SEQ ID NO: 3366356 - RNA, 14 nt, Human
agcccuugccuccc

SEQ ID NO: 3366357 - RNA, 21 nt, Human
agcccuuuacuugaccuccua

SEQ ID NO: 3366358 - RNA, 16 nt, Human
agcccuuucugugugc

SEQ ID NO: 3366359 - RNA, 17 nt, Human
agcccuuucugugugca

SEQ ID NO: 3366360 - RNA, 21 nt, Human
agcccuuugggaggcugaggc

SEQ ID NO: 3366361 - RNA, 23 nt, Human
agcccuuuuguugagccaggccu

SEQ ID NO: 3366362 - RNA, 14 nt, Human
agccgaagcccagg

SEQ ID NO: 3366363 - RNA, 14 nt, Human
agccgaccucagcc

SEQ ID NO: 3366364 - RNA, 15 nt, Human
agccgaccucagccu

SEQ ID NO: 3366365 - RNA, 17 nt, Human
agccgacuccacuuuca

SEQ ID NO: 3366366 - RNA, 16 nt, Human
agccgacucuggcccu

SEQ ID NO: 3366367 - RNA, 17 nt, Human
agccgacucuggcccug

SEQ ID NO: 3366368 - RNA, 21 nt, Human
agccgacucuggcccuggccc

SEQ ID NO: 3366369 - RNA, 13 nt, Human
agccgagagccug

SEQ ID NO: 3366370 - RNA, 19 nt, Human
agccgagaucacgccacug

SEQ ID NO: 3366371 - RNA, 20 nt, Human
agccgagauugcaccacugc

SEQ ID NO: 3366372 - RNA, 15 nt, Human
agccgagcaggaggc

SEQ ID NO: 3366373 - RNA, 18 nt, Human
agccgagccgggccuggg

SEQ ID NO: 3366374 - RNA, 21 nt, Human
agccgcaucuucuccaucugg

SEQ ID NO: 3366375 - RNA, 20 nt, Human
agccgccauugccaccagga

SEQ ID NO: 3366376 - RNA, 12 nt, Human
agccgcccaagg

SEQ ID NO: 3366377 - RNA, 17 nt, Human
agccgccuuaagcugau

SEQ ID NO: 3366378 - RNA, 17 nt, Human
agccgccuucacagcag

SEQ ID NO: 3366379 - RNA, 22 nt, Human
agccgcggugcccaaccacacu

SEQ ID NO: 3366380 - RNA, 21 nt, Human
agccgcuccugucugccagcc

SEQ ID NO: 3366381 - RNA, 22 nt, Human
agccgcuccugucugccagcca

SEQ ID NO: 3366382 - RNA, 13 nt, Human
agccgcucuccug

SEQ ID NO: 3366383 - RNA, 17 nt, Human
agccgcucuccugccac

SEQ ID NO: 3366384 - RNA, 15 nt, Human
agccgcugagcgagg

SEQ ID NO: 3366385 - RNA, 12 nt, Human
agccgcugcugg

SEQ ID NO: 3366386 - RNA, 22 nt, Human
agccgcuggggccaguuggucc

SEQ ID NO: 3366387 - RNA, 16 nt, Human
agccggcauggcuggg

SEQ ID NO: 3366388 - RNA, 14 nt, Human
agccgggccccugg

SEQ ID NO: 3366389 - RNA, 17 nt, Human
agccgggccccugggcu

SEQ ID NO: 3366390 - RNA, 18 nt, Human
agccgggccccugggcuu

SEQ ID NO: 3366391 - RNA, 14 nt, Human
agccgggccgcaga

SEQ ID NO: 3366392 - RNA, 13 nt, Human
agccgggccuggg

SEQ ID NO: 3366393 - RNA, 21 nt, Human
agccgggcgugguggugagug

SEQ ID NO: 3366394 - RNA, 20 nt, Human
agccggggugggguggcugc

SEQ ID NO: 3366395 - RNA, 24 nt, Human
agccggggugggguggcugcagcc

SEQ ID NO: 3366396 - RNA, 20 nt, Human
agccgggucugccucuucug

SEQ ID NO: 3366397 - RNA, 16 nt, Human
agccguaaaaacugaa

SEQ ID NO: 3366398 - RNA, 20 nt, Human
agccguaaaaacugaaguuc

SEQ ID NO: 3366399 - RNA, 13 nt, Human
agccguccuggcg

SEQ ID NO: 3366400 - RNA, 21 nt, Human
agccguggcuucccgcucagc

SEQ ID NO: 3366401 - RNA, 23 nt, Human
agccguggcuucccgcucagccc

SEQ ID NO: 3366402 - RNA, 23 nt, Human
agccguuuguuccccaagacauu

SEQ ID NO: 3366403 - RNA, 12 nt, Human
agccuaaagauu

SEQ ID NO: 3366404 - RNA, 12 nt, Human
agccuaagggau

SEQ ID NO: 3366405 - RNA, 16 nt, Human
agccuaagggauccug

SEQ ID NO: 3366406 - RNA, 21 nt, Human
agccuaagggauccugccugc

SEQ ID NO: 3366407 - RNA, 16 nt, Human
agccuaccugcucucc

SEQ ID NO: 3366408 - RNA, 13 nt, Human
agccuacucuccu

SEQ ID NO: 3366409 - RNA, 18 nt, Human
agccuagacccuccuccu

SEQ ID NO: 3366410 - RNA, 15 nt, Human
agccuagagugaggg

SEQ ID NO: 3366411 - RNA, 18 nt, Human
agccuagccgaccucagc

SEQ ID NO: 3366412 - RNA, 20 nt, Human
agccuagccgaccucagccu

SEQ ID NO: 3366413 - RNA, 21 nt, Human
agccuagccgaccucagccuu

SEQ ID NO: 3366414 - RNA, 15 nt, Human
agccuaggaccacuc

SEQ ID NO: 3366415 - RNA, 23 nt, Human
agccuaggaccacucagccccua

SEQ ID NO: 3366416 - RNA, 12 nt, Human
agccuaggccag

SEQ ID NO: 3366417 - RNA, 17 nt, Human
agccuaggccuaguccu

SEQ ID NO: 3366418 - RNA, 19 nt, Human
agccuaggccuaguccugc

SEQ ID NO: 3366419 - RNA, 23 nt, Human
agccuaggggucagggaccaagg

SEQ ID NO: 3366420 - RNA, 15 nt, Human
agccuaggugacaga

SEQ ID NO: 3366421 - RNA, 20 nt, Human
agccuagugaaggcuucucu

SEQ ID NO: 3366422 - RNA, 15 nt, Human
agccuaguggcuugu

SEQ ID NO: 3366423 - RNA, 23 nt, Human
agccuaguucauccaauccucac

SEQ ID NO: 3366424 - RNA, 14 nt, Human
agccuauauuuaca

SEQ ID NO: 3366425 - RNA, 18 nt, Human
agccuauauuuacaguga

SEQ ID NO: 3366426 - RNA, 19 nt, Human
agccuauggcagaaaaaau

SEQ ID NO: 3366427 - RNA, 22 nt, Human
agccuauguggauuuuuuccua

SEQ ID NO: 3366428 - RNA, 16 nt, Human
agccuauguugugguc

SEQ ID NO: 3366429 - RNA, 15 nt, Human
agccuauuguaaaua

SEQ ID NO: 3366430 - RNA, 20 nt, Human
agccuauuuaccugcaggcu

SEQ ID NO: 3366431 - RNA, 21 nt, Human
agccuauuuaccugcaggcug

SEQ ID NO: 3366432 - RNA, 20 nt, Human
agccucaaaacaaaggccua

SEQ ID NO: 3366433 - RNA, 21 nt, Human
agccucaaauccaggacccug

SEQ ID NO: 3366434 - RNA, 15 nt, Human
agccucaaccuccug

SEQ ID NO: 3366435 - RNA, 19 nt, Human
agccucaauaagccuuguc

SEQ ID NO: 3366436 - RNA, 15 nt, Human
agccucaauuucuga

SEQ ID NO: 3366437 - RNA, 15 nt, Human
agccucacagaagaa

SEQ ID NO: 3366438 - RNA, 14 nt, Human
agccucacagcagu

SEQ ID NO: 3366439 - RNA, 22 nt, Human
agccucacagcagugagacugg

SEQ ID NO: 3366440 - RNA, 17 nt, Human
agccucacaguccuuac

SEQ ID NO: 3366441 - RNA, 20 nt, Human
agccucacccggugaccucu

SEQ ID NO: 3366442 - RNA, 21 nt, Human
agccucacgcuccuuucugau

SEQ ID NO: 3366443 - RNA, 13 nt, Human
agccucacugaua

SEQ ID NO: 3366444 - RNA, 17 nt, Human
agccucacuugaaugug

SEQ ID NO: 3366445 - RNA, 22 nt, Human
agccucacuugaaugugucacu

SEQ ID NO: 3366446 - RNA, 23 nt, Human
agccucacuuuuaaugaacaaau

SEQ ID NO: 3366447 - RNA, 20 nt, Human
agccucagagacaucagccc

SEQ ID NO: 3366448 - RNA, 17 nt, Human
agccucagauuccuucc

SEQ ID NO: 3366449 - RNA, 13 nt, Human
agccucagcaucc

SEQ ID NO: 3366450 - RNA, 14 nt, Human
agccucagcauccu

SEQ ID NO: 3366451 - RNA, 19 nt, Human
agccucagcauccuggcac

SEQ ID NO: 3366452 - RNA, 20 nt, Human
agccucagcauccuggcacc

SEQ ID NO: 3366453 - RNA, 19 nt, Human
agccucagcgcggcccucc

SEQ ID NO: 3366454 - RNA, 23 nt, Human
agccucagcucucaguugcagcc

SEQ ID NO: 3366455 - RNA, 13 nt, Human
agccucaggacug

SEQ ID NO: 3366456 - RNA, 17 nt, Human
agccucaggacugggag

SEQ ID NO: 3366457 - RNA, 18 nt, Human
agccucaguccuccccuc

SEQ ID NO: 3366458 - RNA, 20 nt, Human
agccucauaguuauuaucca

SEQ ID NO: 3366459 - RNA, 16 nt, Human
agccucauauuuaaag

SEQ ID NO: 3366460 - RNA, 20 nt, Human
agccucauauuuaaagacag

SEQ ID NO: 3366461 - RNA, 17 nt, Human
agccucaucaucagagc

SEQ ID NO: 3366462 - RNA, 20 nt, Human
agccucauccgaggcagggu

SEQ ID NO: 3366463 - RNA, 23 nt, Human
agccuccacuuuggaucaggaaa

SEQ ID NO: 3366464 - RNA, 15 nt, Human
agccuccagccucug

SEQ ID NO: 3366465 - RNA, 17 nt, Human
agccuccagcugccccg

SEQ ID NO: 3366466 - RNA, 17 nt, Human
agccuccaugcugccuc

SEQ ID NO: 3366467 - RNA, 20 nt, Human
agccuccauuuaguucuuug

SEQ ID NO: 3366468 - RNA, 13 nt, Human
agccucccaaagu

SEQ ID NO: 3366469 - RNA, 14 nt, Human
agccucccaaagug

SEQ ID NO: 3366470 - RNA, 17 nt, Human
agccucccaaagugcug

SEQ ID NO: 3366471 - RNA, 19 nt, Human
agccucccaaagugcuggg

SEQ ID NO: 3366472 - RNA, 21 nt, Human
agccucccaaggagaacaaau

SEQ ID NO: 3366473 - RNA, 17 nt, Human
agccucccaaguagcug

SEQ ID NO: 3366474 - RNA, 17 nt, Human
agccuccccugccaggg

SEQ ID NO: 3366475 - RNA, 19 nt, Human
agccuccccugccagggca

SEQ ID NO: 3366476 - RNA, 17 nt, Human
agcuaucgaacuucaca

SEQ ID NO: 3366477 - RNA, 17 nt, Human
agcuaucguaaaauuaa

SEQ ID NO: 3366478 - RNA, 15 nt, Human
agcuaucuaaaguuu

SEQ ID NO: 3366479 - RNA, 16 nt, Human
agcuaucuaaaguuug

SEQ ID NO: 3366480 - RNA, 17 nt, Human
agcuaucucucagugaa

SEQ ID NO: 3366481 - RNA, 24 nt, Human
agcuaucuggucaaccuccuggac

SEQ ID NO: 3366482 - RNA, 17 nt, Human
agcuaucuucauguaaa

SEQ ID NO: 3366483 - RNA, 21 nt, Human
agcuaugaagagcuagagaaa

SEQ ID NO: 3366484 - RNA, 16 nt, Human
agcuaugacuuaacau

SEQ ID NO: 3366485 - RNA, 20 nt, Human
agcuaugcuguaucugugcu

SEQ ID NO: 3366486 - RNA, 17 nt, Human
agcuaugggagccccag

SEQ ID NO: 3366487 - RNA, 20 nt, Human
agcuauguuauauugaaaaa

SEQ ID NO: 3366488 - RNA, 20 nt, Human
agcuauuacugucugguuuu

SEQ ID NO: 3366489 - RNA, 14 nt, Human
agcuauuccuuucc

SEQ ID NO: 3366490 - RNA, 16 nt, Human
agcuauuccuuucccu

SEQ ID NO: 3366491 - RNA, 18 nt, Human
agcuauuccuuucccuuc

SEQ ID NO: 3366492 - RNA, 15 nt, Human
agcuauuuaaagcau

SEQ ID NO: 3366493 - RNA, 15 nt, Human
agcuauuuaugggcc

SEQ ID NO: 3366494 - RNA, 22 nt, Human
agcuauuuaugggccccuggca

SEQ ID NO: 3366495 - RNA, 13 nt, Human
agcuauuucaucu

SEQ ID NO: 3366496 - RNA, 17 nt, Human
agcuauuucaucuauuu

SEQ ID NO: 3366497 - RNA, 20 nt, Human
agcuauuugauguaauacuu

SEQ ID NO: 3366498 - RNA, 12 nt, Human
agcuauuuucca

SEQ ID NO: 3366499 - RNA, 19 nt, Human
agcacuggcucucuccagg

SEQ ID NO: 3366500 - RNA, 20 nt, Human
agcacuggcucucuccagga

SEQ ID NO: 3366501 - RNA, 20 nt, Human
agcacugggaucacaggugu

SEQ ID NO: 3366502 - RNA, 17 nt, Human
agcacuggguugacuuu

SEQ ID NO: 3366503 - RNA, 13 nt, Human
agcacugucccuu

SEQ ID NO: 3366504 - RNA, 14 nt, Human
agcacugucucagu

SEQ ID NO: 3366505 - RNA, 14 nt, Human
agcacugugcuaau

SEQ ID NO: 3366506 - RNA, 14 nt, Human
agcacugugcucag

SEQ ID NO: 3366507 - RNA, 16 nt, Human
agcacuguuccagccu

SEQ ID NO: 3366508 - RNA, 21 nt, Human
agcacuguugauguaucugag

SEQ ID NO: 3366509 - RNA, 13 nt, Human
agcacuuaagaga

SEQ ID NO: 3366510 - RNA, 15 nt, Human
agcacuuaagagaau

SEQ ID NO: 3366511 - RNA, 18 nt, Human
agcacuuaagagaauauu

SEQ ID NO: 3366512 - RNA, 16 nt, Human
agcacuuccaaaauuc

SEQ ID NO: 3366513 - RNA, 19 nt, Human
agcacuuccuugccagucu

SEQ ID NO: 3366514 - RNA, 13 nt, Human
agcacuugcugua

SEQ ID NO: 3366515 - RNA, 18 nt, Human
agcacuuggacucuugcu

SEQ ID NO: 3366516 - RNA, 20 nt, Human
agcacuuggacucuugcucu

SEQ ID NO: 3366517 - RNA, 15 nt, Human
agcacuuggcccuuc

SEQ ID NO: 3366518 - RNA, 22 nt, Human
agcacuugucucauuuuaaugu

SEQ ID NO: 3366519 - RNA, 14 nt, Human
agcacuuuagaaua

SEQ ID NO: 3366520 - RNA, 22 nt, Human
agcacuuucauugccagugucu

SEQ ID NO: 3366521 - RNA, 22 nt, Human
agcacuuucuacaaugugaacu

SEQ ID NO: 3366522 - RNA, 12 nt, Human
agcacuuuggga

SEQ ID NO: 3366523 - RNA, 14 nt, Human
agcacuuugggagg

SEQ ID NO: 3366524 - RNA, 15 nt, Human
agcacuuugggaggc

SEQ ID NO: 3366525 - RNA, 19 nt, Human
agcacuuugggaggccaag

SEQ ID NO: 3366526 - RNA, 21 nt, Human
agcacuuugggaggccaaggu

SEQ ID NO: 3366527 - RNA, 16 nt, Human
agcacuuugggaggcu

SEQ ID NO: 3366528 - RNA, 22 nt, Human
agcacuuugggaggcugaggcg

SEQ ID NO: 3366529 - RNA, 22 nt, Human
agcacuuugggaggcugaggug

SEQ ID NO: 3366530 - RNA, 15 nt, Human
agcagaaaacccuug

SEQ ID NO: 3366531 - RNA, 15 nt, Human
agcagaaagugccuu

SEQ ID NO: 3366532 - RNA, 20 nt, Human
agcagaaagugccuuucagg

SEQ ID NO: 3366533 - RNA, 21 nt, Human
agcagaaagugccuuucagga

SEQ ID NO: 3366534 - RNA, 23 nt, Human
agcagaaagugccuuucaggauc

SEQ ID NO: 3366535 - RNA, 12 nt, Human
agcagaaaugcc

SEQ ID NO: 3366536 - RNA, 13 nt, Human
agcagaaaugccu

SEQ ID NO: 3366537 - RNA, 16 nt, Human
agcagaaauucuguuu

SEQ ID NO: 3366538 - RNA, 20 nt, Human
agcagaaauucuguuuuuaa

SEQ ID NO: 3366539 - RNA, 21 nt, Human
agcagaaauucuguuuuuaaa

SEQ ID NO: 3366540 - RNA, 20 nt, Human
agcagaacagaucuuuuacu

SEQ ID NO: 3366541 - RNA, 21 nt, Human
agcagaacggagccccaggcc

SEQ ID NO: 3366542 - RNA, 18 nt, Human
agcagaaggauuuuuuaa

SEQ ID NO: 3366543 - RNA, 23 nt, Human
agcagaaggggagauggacgaca

SEQ ID NO: 3366544 - RNA, 11 nt, Human
agcagaauaaa

SEQ ID NO: 3366545 - RNA, 13 nt, Human
agcagaauaaagc

SEQ ID NO: 3366546 - RNA, 17 nt, Human
agcagaauaaagcaauu

SEQ ID NO: 3366547 - RNA, 18 nt, Human
agcagaauaaagcaauuu

SEQ ID NO: 3366548 - RNA, 21 nt, Human
agcagaauaaagcaauuuucc

SEQ ID NO: 3366549 - RNA, 19 nt, Human
agcagaaucaaaaugaccu

SEQ ID NO: 3366550 - RNA, 21 nt, Human
agcagaauggugaucacucca

SEQ ID NO: 3366551 - RNA, 16 nt, Human
agcagaauucauucau

SEQ ID NO: 3366552 - RNA, 13 nt, Human
agcagaauuggaa

SEQ ID NO: 3366553 - RNA, 14 nt, Human
agcagaauuggaaa

SEQ ID NO: 3366554 - RNA, 14 nt, Human
agcagacagagcca

SEQ ID NO: 3366555 - RNA, 12 nt, Human
agcagacauugu

SEQ ID NO: 3366556 - RNA, 11 nt, Human
agcagacauuu

SEQ ID NO: 3366557 - RNA, 13 nt, Human
agcagacuacagc

SEQ ID NO: 3366558 - RNA, 17 nt, Human
agcagacuacagcuggg

SEQ ID NO: 3366559 - RNA, 22 nt, Human
agcagacuacagcuggggugca

SEQ ID NO: 3366560 - RNA, 16 nt, Human
agcagacugaucagga

SEQ ID NO: 3366561 - RNA, 15 nt, Human
agcagagaccauccc

SEQ ID NO: 3366562 - RNA, 16 nt, Human
agcagagaccaucccu

SEQ ID NO: 3366563 - RNA, 20 nt, Human
agcagagcaagucugcaggu

SEQ ID NO: 3366564 - RNA, 18 nt, Human
agcagagcuagguggaaa

SEQ ID NO: 3366565 - RNA, 19 nt, Human
agcagagcugauggagaag

SEQ ID NO: 3366566 - RNA, 21 nt, Human
agcagagcugauggagaagga

SEQ ID NO: 3366567 - RNA, 16 nt, Human
agcagagcuuccucag

SEQ ID NO: 3366568 - RNA, 17 nt, Human
agcagaggaaggagagg

SEQ ID NO: 3366569 - RNA, 18 nt, Human
agcagaggaccagggccu

SEQ ID NO: 3366570 - RNA, 19 nt, Human
agcagaggaggggccgcug

SEQ ID NO: 3366571 - RNA, 21 nt, Human
agcagaggaggggccgcugcc

SEQ ID NO: 3366572 - RNA, 22 nt, Human
agcagaggaggggccgcugcca

SEQ ID NO: 3366573 - RNA, 18 nt, Human
agcagagggacuuuguau

SEQ ID NO: 3366574 - RNA, 10 nt, Human
agcagagugc

SEQ ID NO: 3366575 - RNA, 17 nt, Human
agcagagugcacagcug

SEQ ID NO: 3366576 - RNA, 13 nt, Human
agcagagugcuuu

SEQ ID NO: 3366577 - RNA, 15 nt, Human
agcagaguuuucauu

SEQ ID NO: 3366578 - RNA, 22 nt, Human
agcagauacauaugagugugga

SEQ ID NO: 3366579 - RNA, 18 nt, Human
agcagauaccucacccug

SEQ ID NO: 3366580 - RNA, 17 nt, Human
agcagaugaccccuccc

SEQ ID NO: 3366581 - RNA, 18 nt, Human
agcagaugcagagagcca

SEQ ID NO: 3366582 - RNA, 21 nt, Human
agcagauggaaugcuguguua

SEQ ID NO: 3366583 - RNA, 19 nt, Human
agcagaugguuuccacauu

SEQ ID NO: 3366584 - RNA, 19 nt, Human
agcagauuauucacugauu

SEQ ID NO: 3366585 - RNA, 24 nt, Human
agcagauucagaaaugaggccaug

SEQ ID NO: 3366586 - RNA, 18 nt, Human
agcagauuggaaggagac

SEQ ID NO: 3366587 - RNA, 23 nt, Human
agcagauuggaaggagacacaga

SEQ ID NO: 3366588 - RNA, 22 nt, Human
agcagauuguuuccucuuccaa

SEQ ID NO: 3366589 - RNA, 15 nt, Human
agcagcaaaaauaua

SEQ ID NO: 3366590 - RNA, 16 nt, Human
agcagcaaaaauauaa

SEQ ID NO: 3366591 - RNA, 15 nt, Human
agcagcaaauuuuca

SEQ ID NO: 3366592 - RNA, 20 nt, Human
agcagcaagaaaaaaaaaug

SEQ ID NO: 3366593 - RNA, 21 nt, Human
agcagcaagaaaaaaaaaugc

SEQ ID NO: 3366594 - RNA, 14 nt, Human
agcagcaaggucuu

SEQ ID NO: 3366595 - RNA, 13 nt, Human
agcagcaccuccu

SEQ ID NO: 3366596 - RNA, 17 nt, Human
agcagcaccuccucagc

SEQ ID NO: 3366597 - RNA, 16 nt, Human
agcagcaccugcccua

SEQ ID NO: 3366598 - RNA, 15 nt, Human
agcagcacuuauaaa

SEQ ID NO: 3366599 - RNA, 18 nt, Human
agcagcacuuauaaauca

SEQ ID NO: 3366600 - RNA, 12 nt, Human
agcagcagcccu

SEQ ID NO: 3366601 - RNA, 19 nt, Human
agcagcagccuuuaaugca

SEQ ID NO: 3366602 - RNA, 18 nt, Human
agcagcaggaggggggag

SEQ ID NO: 3366603 - RNA, 21 nt, Human
agcagcaggaggggggaggga

SEQ ID NO: 3366604 - RNA, 16 nt, Human
agcagcagggagggcu

SEQ ID NO: 3366605 - RNA, 20 nt, Human
agcagcagguagccugcugg

SEQ ID NO: 3366606 - RNA, 12 nt, Human
agcagcagguga

SEQ ID NO: 3366607 - RNA, 16 nt, Human
agcagcagugaaaaca

SEQ ID NO: 3366608 - RNA, 11 nt, Human
agcagcaucuc

SEQ ID NO: 3366609 - RNA, 19 nt, Human
agcagcaucucuaccuucu

SEQ ID NO: 3366610 - RNA, 18 nt, Human
agcagcaucugcuaauaa

SEQ ID NO: 3366611 - RNA, 21 nt, Human
agcagccaagcuccuugggag

SEQ ID NO: 3366612 - RNA, 11 nt, Human
agcagccacau

SEQ ID NO: 3366613 - RNA, 12 nt, Human
agcagccagcca

SEQ ID NO: 3366614 - RNA, 13 nt, Human
agcagccagcccu

SEQ ID NO: 3366615 - RNA, 16 nt, Human
agcagccagcccugcc

SEQ ID NO: 3366616 - RNA, 17 nt, Human
agcagccagcccugccu

SEQ ID NO: 3366617 - RNA, 21 nt, Human
agcagccagcccugccuggag

SEQ ID NO: 3366618 - RNA, 23 nt, Human
agcagccagcccugccuggagga

SEQ ID NO: 3366619 - RNA, 19 nt, Human
acuuaccuaaacagauaua

SEQ ID NO: 3366620 - RNA, 15 nt, Human
acuuaccuagugaaa

SEQ ID NO: 3366621 - RNA, 20 nt, Human
acuuaccugaguugaagagg

SEQ ID NO: 3366622 - RNA, 19 nt, Human
acuuaccuucaauaaagua

SEQ ID NO: 3366623 - RNA, 14 nt, Human
acuuacucuaagau

SEQ ID NO: 3366624 - RNA, 22 nt, Human
acuuacuguacaugaaaacaca

SEQ ID NO: 3366625 - RNA, 22 nt, Human
acuuacuuacccucaccuguca

SEQ ID NO: 3366626 - RNA, 13 nt, Human
acuuacuugcuua

SEQ ID NO: 3366627 - RNA, 16 nt, Human
acuuacuugcuuauuu

SEQ ID NO: 3366628 - RNA, 21 nt, Human
acuuagaaaaccagcucagca

SEQ ID NO: 3366629 - RNA, 17 nt, Human
acuuagaauaaaauugu

SEQ ID NO: 3366630 - RNA, 22 nt, Human
acuuagaauaaaauuguaaaau

SEQ ID NO: 3366631 - RNA, 21 nt, Human
acuuagaaucccuguguuaau

SEQ ID NO: 3366632 - RNA, 22 nt, Human
acuuagaaucccuguguuaauu

SEQ ID NO: 3366633 - RNA, 12 nt, Human
acuuagaggaaa

SEQ ID NO: 3366634 - RNA, 21 nt, Human
acuuagaggaaauaagaaaaa

SEQ ID NO: 3366635 - RNA, 21 nt, Human
acuuagaguuucuguuugauu

SEQ ID NO: 3366636 - RNA, 22 nt, Human
acuuagaguuucuguuugauuc

SEQ ID NO: 3366637 - RNA, 15 nt, Human
acuuagauuuuacau

SEQ ID NO: 3366638 - RNA, 18 nt, Human
acuuagauuuuacaugaa

SEQ ID NO: 3366639 - RNA, 21 nt, Human
acuuagauuuuacaugaagua

SEQ ID NO: 3366640 - RNA, 17 nt, Human
acuuagcaaaaaguggg

SEQ ID NO: 3366641 - RNA, 19 nt, Human
acuuagcaucuaauuucaa

SEQ ID NO: 3366642 - RNA, 17 nt, Human
acuuagcaugcacaaag

SEQ ID NO: 3366643 - RNA, 22 nt, Human
acuuagcauuuucugcaucucc

SEQ ID NO: 3366644 - RNA, 17 nt, Human
acuuagcgaacccuuua

SEQ ID NO: 3366645 - RNA, 19 nt, Human
acuuagcuggagaugucuc

SEQ ID NO: 3366646 - RNA, 16 nt, Human
acuuagcuuaucaauu

SEQ ID NO: 3366647 - RNA, 21 nt, Human
acuuagcuugaaggaucuguu

SEQ ID NO: 3366648 - RNA, 23 nt, Human
acuuaggaagguggccuuccugc

SEQ ID NO: 3366649 - RNA, 18 nt, Human
acuuaggcaugcacagcu

SEQ ID NO: 3366650 - RNA, 21 nt, Human
acuuaggcaugcacagcugua

SEQ ID NO: 3366651 - RNA, 23 nt, Human
acuuagggcaccagggguuucuc

SEQ ID NO: 3366652 - RNA, 16 nt, Human
acuuaguacaaaguuu

SEQ ID NO: 3366653 - RNA, 19 nt, Human
acuuaguauugcaaaguca

SEQ ID NO: 3366654 - RNA, 13 nt, Human
acuuaguuuugca

SEQ ID NO: 3366655 - RNA, 22 nt, Human
acuuauaagguguuuucugugu

SEQ ID NO: 3366656 - RNA, 15 nt, Human
acuuauagauugaaa

SEQ ID NO: 3366657 - RNA, 21 nt, Human
acuuauagccucugucuggca

SEQ ID NO: 3366658 - RNA, 17 nt, Human
acuuauaguacaugaua

SEQ ID NO: 3366659 - RNA, 13 nt, Human
acuuauauugaag

SEQ ID NO: 3366660 - RNA, 17 nt, Human
acuuauauuguaagaaa

SEQ ID NO: 3366661 - RNA, 23 nt, Human
acuuauauuuucguaugaaaaug

SEQ ID NO: 3366662 - RNA, 19 nt, Human
acuuauauuuuuaauaaaa

SEQ ID NO: 3366663 - RNA, 16 nt, Human
acuuaucucucugugc

SEQ ID NO: 3366664 - RNA, 17 nt, Human
acuuaucuuacaaagug

SEQ ID NO: 3366665 - RNA, 13 nt, Human
acuuaugauuuca

SEQ ID NO: 3366666 - RNA, 19 nt, Human
acuuauguagauauuuggc

SEQ ID NO: 3366667 - RNA, 20 nt, Human
acuuauguagauauuuggcu

SEQ ID NO: 3366668 - RNA, 21 nt, Human
acuuauguagauauuuggcuu

SEQ ID NO: 3366669 - RNA, 21 nt, Human
acuuauuaacaauuaggcaga

SEQ ID NO: 3366670 - RNA, 13 nt, Human
acuuauucaaaga

SEQ ID NO: 3366671 - RNA, 16 nt, Human
acuuauucucaagaag

SEQ ID NO: 3366672 - RNA, 19 nt, Human
acuuauugcugauuuuaau

SEQ ID NO: 3366673 - RNA, 14 nt, Human
acuuauugcuuuga

SEQ ID NO: 3366674 - RNA, 16 nt, Human
acuuauugcuuugaaa

SEQ ID NO: 3366675 - RNA, 20 nt, Human
acuuauuggaacucugcuug

SEQ ID NO: 3366676 - RNA, 21 nt, Human
acuuauuguggauaacaaaga

SEQ ID NO: 3366677 - RNA, 15 nt, Human
acuuauuuaaacucu

SEQ ID NO: 3366678 - RNA, 16 nt, Human
acuuauuucacuuuag

SEQ ID NO: 3366679 - RNA, 15 nt, Human
acuuauuucuucaaa

SEQ ID NO: 3366680 - RNA, 11 nt, Human
acuuauuugag

SEQ ID NO: 3366681 - RNA, 15 nt, Human
acuuauuuucucugu

SEQ ID NO: 3366682 - RNA, 17 nt, Human
acuuauuuuuuucugau

SEQ ID NO: 3366683 - RNA, 16 nt, Human
acuucaaaaacuguca

SEQ ID NO: 3366684 - RNA, 18 nt, Human
acuucaaauccuugaaga

SEQ ID NO: 3366685 - RNA, 19 nt, Human
acuucaagcauggcuauuu

SEQ ID NO: 3366686 - RNA, 23 nt, Human
acuucaaggugacagaaggacca

SEQ ID NO: 3366687 - RNA, 22 nt, Human
acuucaagugcaugcucucugc

SEQ ID NO: 3366688 - RNA, 19 nt, Human
acuucaauaauuguccaug

SEQ ID NO: 3366689 - RNA, 22 nt, Human
acuucaaugggcucuuccaaca

SEQ ID NO: 3366690 - RNA, 14 nt, Human
acuucacacugcaa

SEQ ID NO: 3366691 - RNA, 15 nt, Human
acuucacacugcaag

SEQ ID NO: 3366692 - RNA, 19 nt, Human
acuucacacugcaagagcc

SEQ ID NO: 3366693 - RNA, 20 nt, Human
acuucacagagugugcugga

SEQ ID NO: 3366694 - RNA, 22 nt, Human
acuucacagagugugcuggagg

SEQ ID NO: 3366695 - RNA, 15 nt, Human
acuucacugaaagac

SEQ ID NO: 3366696 - RNA, 23 nt, Human
acuucacugucaggaagaaauca

SEQ ID NO: 3366697 - RNA, 19 nt, Human
acuucacugugcuguuguu

SEQ ID NO: 3366698 - RNA, 22 nt, Human
acuucacugugcuguuguuaug

SEQ ID NO: 3366699 - RNA, 12 nt, Human
acuucagaaaga

SEQ ID NO: 3366700 - RNA, 16 nt, Human
acuucagaaagacuug

SEQ ID NO: 3366701 - RNA, 12 nt, Human
acuucagacaua

SEQ ID NO: 3366702 - RNA, 18 nt, Human
acuucagaugggaggaaa

SEQ ID NO: 3366703 - RNA, 19 nt, Human
acuucagcaagagagaacc

SEQ ID NO: 3366704 - RNA, 21 nt, Human
acuucagcaagagagaaccua

SEQ ID NO: 3366705 - RNA, 11 nt, Human
acuucagcacc

SEQ ID NO: 3366706 - RNA, 19 nt, Human
acuucagcgguuuauauaa

SEQ ID NO: 3366707 - RNA, 17 nt, Human
acuucaggccaacaagg

SEQ ID NO: 3366708 - RNA, 18 nt, Human
acuucaggcucuucuccu

SEQ ID NO: 3366709 - RNA, 18 nt, Human
acuucaggcuugauaaua

SEQ ID NO: 3366710 - RNA, 18 nt, Human
acuucagggcagauuuua

SEQ ID NO: 3366711 - RNA, 19 nt, Human
acuucagggcagauuuuag

SEQ ID NO: 3366712 - RNA, 19 nt, Human
acuucagggcagggcucug

SEQ ID NO: 3366713 - RNA, 20 nt, Human
acuucagggcagggcucuga

SEQ ID NO: 3366714 - RNA, 21 nt, Human
acuucagggcagggcucugau

SEQ ID NO: 3366715 - RNA, 22 nt, Human
acuucaggguucuccucucccc

SEQ ID NO: 3366716 - RNA, 16 nt, Human
acuucaguccugggag

SEQ ID NO: 3366717 - RNA, 18 nt, Human
acuucauauaugaggacu

SEQ ID NO: 3366718 - RNA, 14 nt, Human
acuucauauugcug

SEQ ID NO: 3366719 - RNA, 24 nt, Human
acuucauauugcugagagaaauau

SEQ ID NO: 3366720 - RNA, 16 nt, Human
acuucaucccucuggg

SEQ ID NO: 3366721 - RNA, 16 nt, Human
acuucaucuggcugcc

SEQ ID NO: 3366722 - RNA, 20 nt, Human
acuucaucuuccccaagugc

SEQ ID NO: 3366723 - RNA, 15 nt, Human
acuucaucuucucag

SEQ ID NO: 3366724 - RNA, 16 nt, Human
acuucaucuucucagc

SEQ ID NO: 3366725 - RNA, 20 nt, Human
acuucauggaauggacaucc

SEQ ID NO: 3366726 - RNA, 14 nt, Human
acuucauucuugaa

SEQ ID NO: 3366727 - RNA, 14 nt, Human
acuucauugaaaau

SEQ ID NO: 3366728 - RNA, 13 nt, Human
acuucauuucaga

SEQ ID NO: 3366729 - RNA, 11 nt, Human
agagucuagau

SEQ ID NO: 3366730 - RNA, 17 nt, Human
agagucuagauucaaag

SEQ ID NO: 3366731 - RNA, 21 nt, Human
agagucuagauucaaagguuc

SEQ ID NO: 3366732 - RNA, 17 nt, Human
agagucuagcacucauu

SEQ ID NO: 3366733 - RNA, 18 nt, Human
agagucuauuuacggaac

SEQ ID NO: 3366734 - RNA, 17 nt, Human
agagucucccagggagc

SEQ ID NO: 3366735 - RNA, 13 nt, Human
agagucugaacag

SEQ ID NO: 3366736 - RNA, 13 nt, Human
agagucuggcccu

SEQ ID NO: 3366737 - RNA, 21 nt, Human
agagucuggggaccagcuugg

SEQ ID NO: 3366738 - RNA, 12 nt, Human
agagucugucuc

SEQ ID NO: 3366739 - RNA, 22 nt, Human
agagucuuuguaaguaaacugc

SEQ ID NO: 3366740 - RNA, 16 nt, Human
agagugaaaauugucu

SEQ ID NO: 3366741 - RNA, 22 nt, Human
agagugaacaaauuuacagaga

SEQ ID NO: 3366742 - RNA, 16 nt, Human
agagugaauucccuca

SEQ ID NO: 3366743 - RNA, 18 nt, Human
agagugacuccaagaaca

SEQ ID NO: 3366744 - RNA, 16 nt, Human
agagugacucuccagg

SEQ ID NO: 3366745 - RNA, 13 nt, Human
agagugagagaca

SEQ ID NO: 3366746 - RNA, 20 nt, Human
agagugauagucuuuugcuu

SEQ ID NO: 3366747 - RNA, 15 nt, Human
agagugauugcagcu

SEQ ID NO: 3366748 - RNA, 22 nt, Human
agagugcaacaguagcauagga

SEQ ID NO: 3366749 - RNA, 14 nt, Human
agagugcacagcug

SEQ ID NO: 3366750 - RNA, 16 nt, Human
agagugcacagcuguc

SEQ ID NO: 3366751 - RNA, 13 nt, Human
agagugccccacc

SEQ ID NO: 3366752 - RNA, 16 nt, Human
agagugccccaccugc

SEQ ID NO: 3366753 - RNA, 16 nt, Human
agaguggaauaagaca

SEQ ID NO: 3366754 - RNA, 19 nt, Human
agaguggccccaccuggcc

SEQ ID NO: 3366755 - RNA, 22 nt, Human
agaguggccuggccaggagcuc

SEQ ID NO: 3366756 - RNA, 12 nt, Human
agaguggcuccu

SEQ ID NO: 3366757 - RNA, 19 nt, Human
agaguggcuccucccggug

SEQ ID NO: 3366758 - RNA, 23 nt, Human
agaguggcuccucccggugccca

SEQ ID NO: 3366759 - RNA, 22 nt, Human
agagugggggagagcaggcugg

SEQ ID NO: 3366760 - RNA, 14 nt, Human
agaguguagaagca

SEQ ID NO: 3366761 - RNA, 18 nt, Human
agaguguagaucagagca

SEQ ID NO: 3366762 - RNA, 20 nt, Human
agaguguaguuuacagaaaa

SEQ ID NO: 3366763 - RNA, 14 nt, Human
agagugugaccaaa

SEQ ID NO: 3366764 - RNA, 15 nt, Human
agaguguggaggcug

SEQ ID NO: 3366765 - RNA, 19 nt, Human
agagugugggaagggagag

SEQ ID NO: 3366766 - RNA, 20 nt, Human
agagugugggaagggagagc

SEQ ID NO: 3366767 - RNA, 16 nt, Human
agaguuaagaagaaaa

SEQ ID NO: 3366768 - RNA, 14 nt, Human
agaguuaagaagcu

SEQ ID NO: 3366769 - RNA, 18 nt, Human
agaguuaagaagcuguug

SEQ ID NO: 3366770 - RNA, 12 nt, Human
agaguuaagaau

SEQ ID NO: 3366771 - RNA, 14 nt, Human
agaguuaagaaugu

SEQ ID NO: 3366772 - RNA, 20 nt, Human
agaguuaauauauagaaggg

SEQ ID NO: 3366773 - RNA, 11 nt, Human
agaguuacagu

SEQ ID NO: 3366774 - RNA, 15 nt, Human
agaguuacaguucug

SEQ ID NO: 3366775 - RNA, 22 nt, Human
agaguuacaguucugugguuuc

SEQ ID NO: 3366776 - RNA, 13 nt, Human
agaguuacuugau

SEQ ID NO: 3366777 - RNA, 14 nt, Human
agaguuacuugaua

SEQ ID NO: 3366778 - RNA, 17 nt, Human
agaguuacuugauaagg

SEQ ID NO: 3366779 - RNA, 12 nt, Human
agaguuagacug

SEQ ID NO: 3366780 - RNA, 15 nt, Human
agaguuagacuguug

SEQ ID NO: 3366781 - RNA, 16 nt, Human
agaguuagguuuaaca

SEQ ID NO: 3366782 - RNA, 15 nt, Human
agaguucaagaaaua

SEQ ID NO: 3366783 - RNA, 17 nt, Human
agaguucaauggcugcu

SEQ ID NO: 3366784 - RNA, 16 nt, Human
agaguucacuauaaau

SEQ ID NO: 3366785 - RNA, 16 nt, Human
agaguucagggaagau

SEQ ID NO: 3366786 - RNA, 19 nt, Human
agaguuccccaugcagaca

SEQ ID NO: 3366787 - RNA, 22 nt, Human
agaguuccugcggagugaagag

SEQ ID NO: 3366788 - RNA, 14 nt, Human
agaguucugcucua

SEQ ID NO: 3366789 - RNA, 22 nt, Human
agaguucuuuuugaaguauuua

SEQ ID NO: 3366790 - RNA, 13 nt, Human
agaguugaagaca

SEQ ID NO: 3366791 - RNA, 20 nt, Human
agaguugauacuacaguuug

SEQ ID NO: 3366792 - RNA, 22 nt, Human
agaguugauacuacaguuuguu

SEQ ID NO: 3366793 - RNA, 18 nt, Human
agaguugccccgucucug

SEQ ID NO: 3366794 - RNA, 21 nt, Human
agaguugcugagagggcucga

SEQ ID NO: 3366795 - RNA, 17 nt, Human
agaguuggcaugacucu

SEQ ID NO: 3366796 - RNA, 19 nt, Human
agaguugggugucuccuua

SEQ ID NO: 3366797 - RNA, 22 nt, Human
agaguugggugucuccuuaagc

SEQ ID NO: 3366798 - RNA, 15 nt, Human
agaguuguaaauaua

SEQ ID NO: 3366799 - RNA, 16 nt, Human
agaguuguaaauauau

SEQ ID NO: 3366800 - RNA, 20 nt, Human
agaguuguaaauauauaaau

SEQ ID NO: 3366801 - RNA, 22 nt, Human
agaguuguaaauauauaaauau

SEQ ID NO: 3366802 - RNA, 20 nt, Human
agaguugugacaacuuccug

SEQ ID NO: 3366803 - RNA, 16 nt, Human
agaguugugcacgcag

SEQ ID NO: 3366804 - RNA, 14 nt, Human
agaguuguguuguu

SEQ ID NO: 3366805 - RNA, 17 nt, Human
agaguuguguuguucuu

SEQ ID NO: 3366806 - RNA, 18 nt, Human
agaguuguguuguucuuu

SEQ ID NO: 3366807 - RNA, 21 nt, Human
agaguuguguuguucuuuucc

SEQ ID NO: 3366808 - RNA, 14 nt, Human
agaguuuaaaauca

SEQ ID NO: 3366809 - RNA, 17 nt, Human
agaguuuagcuggaaaa

SEQ ID NO: 3366810 - RNA, 16 nt, Human
agaguuuaguuguagc

SEQ ID NO: 3366811 - RNA, 17 nt, Human
agaguuucuuuacauug

SEQ ID NO: 3366812 - RNA, 20 nt, Human
agaguuugaugaggcccucc

SEQ ID NO: 3366813 - RNA, 16 nt, Human
agaguuuguguguugu

SEQ ID NO: 3366814 - RNA, 18 nt, Human
agaguuuguguguugucu

SEQ ID NO: 3366815 - RNA, 23 nt, Human
agaguuuuauagccuggacugcu

SEQ ID NO: 3366816 - RNA, 13 nt, Human
agaguuuugucuu

SEQ ID NO: 3366817 - RNA, 12 nt, Human
agauaaaaagau

SEQ ID NO: 3366818 - RNA, 19 nt, Human
agauaaaccuagauaaaga

SEQ ID NO: 3366819 - RNA, 20 nt, Human
agauaaacguggauguuacu

SEQ ID NO: 3366820 - RNA, 21 nt, Human
acuccagaccccuggcuuuuc

SEQ ID NO: 3366821 - RNA, 17 nt, Human
acuccagacucucugug

SEQ ID NO: 3366822 - RNA, 20 nt, Human
acuccagcaacuucuucucc

SEQ ID NO: 3366823 - RNA, 14 nt, Human
acuccagccagcgc

SEQ ID NO: 3366824 - RNA, 15 nt, Human
acuccagccagcgcc

SEQ ID NO: 3366825 - RNA, 18 nt, Human
acuccagccagcgccucc

SEQ ID NO: 3366826 - RNA, 20 nt, Human
acuccagccagcgccucccu

SEQ ID NO: 3366827 - RNA, 14 nt, Human
acuccagccugagc

SEQ ID NO: 3366828 - RNA, 19 nt, Human
acuccagccugagcaacag

SEQ ID NO: 3366829 - RNA, 14 nt, Human
acuccagccugggc

SEQ ID NO: 3366830 - RNA, 18 nt, Human
acuccagccugggcgaca

SEQ ID NO: 3366831 - RNA, 20 nt, Human
acuccagccugggugacaga

SEQ ID NO: 3366832 - RNA, 19 nt, Human
acuccaggaaggggcugga

SEQ ID NO: 3366833 - RNA, 22 nt, Human
acuccaggcagcagacacaugc

SEQ ID NO: 3366834 - RNA, 16 nt, Human
acuccaggcccaaggc

SEQ ID NO: 3366835 - RNA, 17 nt, Human
acuccaggcccaaggcu

SEQ ID NO: 3366836 - RNA, 21 nt, Human
acuccaggcccaaggcucccg

SEQ ID NO: 3366837 - RNA, 19 nt, Human
acuccagggacacacagcc

SEQ ID NO: 3366838 - RNA, 15 nt, Human
acuccaguacuggag

SEQ ID NO: 3366839 - RNA, 18 nt, Human
acuccaguggugaagaaa

SEQ ID NO: 3366840 - RNA, 19 nt, Human
acuccaucaguuagagcug

SEQ ID NO: 3366841 - RNA, 11 nt, Human
acuccaucucu

SEQ ID NO: 3366842 - RNA, 16 nt, Human
acuccaucucucaucc

SEQ ID NO: 3366843 - RNA, 20 nt, Human
acuccauguuggcuagccuc

SEQ ID NO: 3366844 - RNA, 12 nt, Human
acuccauuccca

SEQ ID NO: 3366845 - RNA, 12 nt, Human
acuccauugucg

SEQ ID NO: 3366846 - RNA, 19 nt, Human
acucccaaagagcugccua

SEQ ID NO: 3366847 - RNA, 13 nt, Human
acucccaagaaca

SEQ ID NO: 3366848 - RNA, 15 nt, Human
acucccaagcuggac

SEQ ID NO: 3366849 - RNA, 17 nt, Human
acucccacuucccugac

SEQ ID NO: 3366850 - RNA, 17 nt, Human
acucccagacacccacc

SEQ ID NO: 3366851 - RNA, 22 nt, Human
acucccaucugugaaaggaaag

SEQ ID NO: 3366852 - RNA, 14 nt, Human
acucccaugaagcc

SEQ ID NO: 3366853 - RNA, 22 nt, Human
acucccaugaagccuuuugaaa

SEQ ID NO: 3366854 - RNA, 22 nt, Human
acucccaugagggagaugccau

SEQ ID NO: 3366855 - RNA, 13 nt, Human
acucccauuccug

SEQ ID NO: 3366856 - RNA, 20 nt, Human
acucccauuccugaagaacc

SEQ ID NO: 3366857 - RNA, 16 nt, Human
acuccccaacccccaa

SEQ ID NO: 3366858 - RNA, 19 nt, Human
acuccccaaggaagagcca

SEQ ID NO: 3366859 - RNA, 20 nt, Human
acuccccacaucccaucguc

SEQ ID NO: 3366860 - RNA, 17 nt, Human
acuccccagccagccug

SEQ ID NO: 3366861 - RNA, 17 nt, Human
acuccccagccugggcc

SEQ ID NO: 3366862 - RNA, 13 nt, Human
acuccccaggcca

SEQ ID NO: 3366863 - RNA, 14 nt, Human
acucccccaggugg

SEQ ID NO: 3366864 - RNA, 12 nt, Human
acuccccugcac

SEQ ID NO: 3366865 - RNA, 17 nt, Human
acuccccuugagcugag

SEQ ID NO: 3366866 - RNA, 21 nt, Human
acucccgagacggcacugaga

SEQ ID NO: 3366867 - RNA, 15 nt, Human
acucccuccagcaca

SEQ ID NO: 3366868 - RNA, 15 nt, Human
acucccuccucaccu

SEQ ID NO: 3366869 - RNA, 19 nt, Human
acucccuccucaccucugg

SEQ ID NO: 3366870 - RNA, 15 nt, Human
acucccuucccauaa

SEQ ID NO: 3366871 - RNA, 23 nt, Human
acucccuucccaugacccaggcu

SEQ ID NO: 3366872 - RNA, 19 nt, Human
acucccuugcuggccccag

SEQ ID NO: 3366873 - RNA, 19 nt, Human
acucccuugguggcaagag

SEQ ID NO: 3366874 - RNA, 19 nt, Human
agauaccagguugaaagac

SEQ ID NO: 3366875 - RNA, 16 nt, Human
agauaccauacucauu

SEQ ID NO: 3366876 - RNA, 14 nt, Human
agauaccaucagca

SEQ ID NO: 3366877 - RNA, 22 nt, Human
agauacccuacgcuguccagaa

SEQ ID NO: 3366878 - RNA, 22 nt, Human
agauaccuaaaagagauuucaa

SEQ ID NO: 3366879 - RNA, 19 nt, Human
agauaccuuaucuuacaau

SEQ ID NO: 3366880 - RNA, 14 nt, Human
agauacgacuuuau

SEQ ID NO: 3366881 - RNA, 18 nt, Human
agauacucuuauuuuacu

SEQ ID NO: 3366882 - RNA, 13 nt, Human
agauacugaaaua

SEQ ID NO: 3366883 - RNA, 23 nt, Human
agauacugcuacuguaauuuuau

SEQ ID NO: 3366884 - RNA, 14 nt, Human
agauacugcugugu

SEQ ID NO: 3366885 - RNA, 13 nt, Human
agauacuggugga

SEQ ID NO: 3366886 - RNA, 15 nt, Human
agauacuguaucaug

SEQ ID NO: 3366887 - RNA, 12 nt, Human
agauacuuugua

SEQ ID NO: 3366888 - RNA, 13 nt, Human
agauacuuuguau

SEQ ID NO: 3366889 - RNA, 15 nt, Human
agauacuuuguauug

SEQ ID NO: 3366890 - RNA, 20 nt, Human
agauacuuuguauuguccua

SEQ ID NO: 3366891 - RNA, 20 nt, Human
agauacuuuuucuuuuguaa

SEQ ID NO: 3366892 - RNA, 22 nt, Human
agauacuuuuucuuuuguaagu

SEQ ID NO: 3366893 - RNA, 15 nt, Human
agauagaaagcauua

SEQ ID NO: 3366894 - RNA, 15 nt, Human
agauagaaauaaaua

SEQ ID NO: 3366895 - RNA, 14 nt, Human
agauagaagaaaaa

SEQ ID NO: 3366896 - RNA, 15 nt, Human
agauagaagaacugc

SEQ ID NO: 3366897 - RNA, 13 nt, Human
agauagaauuucc

SEQ ID NO: 3366898 - RNA, 16 nt, Human
agauagaauuuccaau

SEQ ID NO: 3366899 - RNA, 13 nt, Human
agauagaguaaaa

SEQ ID NO: 3366900 - RNA, 14 nt, Human
agauagauuuggaa

SEQ ID NO: 3366901 - RNA, 16 nt, Human
agauagcagccuggcu

SEQ ID NO: 3366902 - RNA, 23 nt, Human
agauagcagccuggcuccccugg

SEQ ID NO: 3366903 - RNA, 16 nt, Human
agauagcauugugaac

SEQ ID NO: 3366904 - RNA, 19 nt, Human
agauagcauugugaacuga

SEQ ID NO: 3366905 - RNA, 22 nt, Human
agauagcauugugaacugacag

SEQ ID NO: 3366906 - RNA, 17 nt, Human
agauagccuguggcccu

SEQ ID NO: 3366907 - RNA, 12 nt, Human
agauaggaccuu

SEQ ID NO: 3366908 - RNA, 17 nt, Human
agauaggaccuugggcc

SEQ ID NO: 3366909 - RNA, 18 nt, Human
agauaggaccuugggcca

SEQ ID NO: 3366910 - RNA, 18 nt, Human
agauaggccuucuuguga

SEQ ID NO: 3366911 - RNA, 13 nt, Human
agauaggcucugc

SEQ ID NO: 3366912 - RNA, 12 nt, Human
agauagggaaaa

SEQ ID NO: 3366913 - RNA, 22 nt, Human
agauagggaaaaggggcuccuu

SEQ ID NO: 3366914 - RNA, 22 nt, Human
agauagggcugggcaaggaaaa

SEQ ID NO: 3366915 - RNA, 21 nt, Human
agauaggucagugcaaauacu

SEQ ID NO: 3366916 - RNA, 14 nt, Human
agauaguaacugua

SEQ ID NO: 3366917 - RNA, 17 nt, Human
agauaguagcauacauu

SEQ ID NO: 3366918 - RNA, 20 nt, Human
agauaguccauaauguucug

SEQ ID NO: 3366919 - RNA, 23 nt, Human
agauaguccauaauguucugcua

SEQ ID NO: 3366920 - RNA, 19 nt, Human
agauaguguaacuugcuua

SEQ ID NO: 3366921 - RNA, 15 nt, Human
agauaguuacuauau

SEQ ID NO: 3366922 - RNA, 17 nt, Human
agauaguuuucauccau

SEQ ID NO: 3366923 - RNA, 15 nt, Human
agauauaaauggcug

SEQ ID NO: 3366924 - RNA, 20 nt, Human
agauauaacuauugcccagg

SEQ ID NO: 3366925 - RNA, 20 nt, Human
agauauaagugcuguauaaa

SEQ ID NO: 3366926 - RNA, 20 nt, Human
agauauacuuguuuuuguaa

SEQ ID NO: 3366927 - RNA, 21 nt, Human
agauauacuuguuuuuguaaa

SEQ ID NO: 3366928 - RNA, 15 nt, Human
agauauacuuugugg

SEQ ID NO: 3366929 - RNA, 15 nt, Human
agauauaucugaaaa

SEQ ID NO: 3366930 - RNA, 19 nt, Human
agauauaugcucugcaugu

SEQ ID NO: 3366931 - RNA, 20 nt, Human
agauauauuaaaaauauaaa

SEQ ID NO: 3366932 - RNA, 21 nt, Human
agauauauuaaaaauauaaaa

SEQ ID NO: 3366933 - RNA, 16 nt, Human
agauauauuuuucaca

SEQ ID NO: 3366934 - RNA, 17 nt, Human
agauauccacuuaccug

SEQ ID NO: 3366935 - RNA, 19 nt, Human
agauauccucugcuuaaaa

SEQ ID NO: 3366936 - RNA, 16 nt, Human
agauaucgacuuguuu

SEQ ID NO: 3366937 - RNA, 21 nt, Human
agauaucugagggaggaggcc

SEQ ID NO: 3366938 - RNA, 19 nt, Human
agauaucuuggacaaauca

SEQ ID NO: 3366939 - RNA, 21 nt, Human
agauaucuuggacaaaucaca

SEQ ID NO: 3366940 - RNA, 22 nt, Human
agauaucuuggacaaaucacau

SEQ ID NO: 3366941 - RNA, 13 nt, Human
agauaucuuuucu

SEQ ID NO: 3366942 - RNA, 17 nt, Human
agauaucuuuucuuuag

SEQ ID NO: 3366943 - RNA, 23 nt, Human
agauaucuuuucuuuagagaacu

SEQ ID NO: 3366944 - RNA, 15 nt, Human
agauaugaaagcuga

SEQ ID NO: 3366945 - RNA, 18 nt, Human
agauaugaacauauuguu

SEQ ID NO: 3366946 - RNA, 15 nt, Human
agauaugaguuguuu

SEQ ID NO: 3366947 - RNA, 16 nt, Human
agauaugauauguaaa

SEQ ID NO: 3366948 - RNA, 17 nt, Human
agauaugauauguaaac

SEQ ID NO: 3366949 - RNA, 17 nt, Human
agauaugggacauuuuu

SEQ ID NO: 3366950 - RNA, 18 nt, Human
agauauuaaugcccagac

SEQ ID NO: 3366951 - RNA, 15 nt, Human
agauauuaccaguuu

SEQ ID NO: 3366952 - RNA, 22 nt, Human
agauauuacuuuaucacuuuuu

SEQ ID NO: 3366953 - RNA, 20 nt, Human
agauauuauucaccauguaa

SEQ ID NO: 3366954 - RNA, 21 nt, Human
agauauuauucaccauguaaa

SEQ ID NO: 3366955 - RNA, 12 nt, Human
agauauucaagu

SEQ ID NO: 3366956 - RNA, 22 nt, Human
agauauugaggccaagaauauu

SEQ ID NO: 3366957 - RNA, 14 nt, Human
agauauuggacaaa

SEQ ID NO: 3366958 - RNA, 23 nt, Human
agauauuguucaaacaauaucau

SEQ ID NO: 3366959 - RNA, 14 nt, Human
agauauuuauauau

SEQ ID NO: 3366960 - RNA, 18 nt, Human
agauauuugcaguuuuuc

SEQ ID NO: 3366961 - RNA, 15 nt, Human
agauauuuuaaaaug

SEQ ID NO: 3366962 - RNA, 18 nt, Human
agauauuuuaaaaugaga

SEQ ID NO: 3366963 - RNA, 21 nt, Human
agauauuuucacaaugucagu

SEQ ID NO: 3366964 - RNA, 22 nt, Human
agauauuuugcuuugugauuuu

SEQ ID NO: 3366965 - RNA, 20 nt, Human
agauauuuuuaucuuuauau

SEQ ID NO: 3366966 - RNA, 12 nt, Human
agauauuuuuca

SEQ ID NO: 3366967 - RNA, 16 nt, Human
agauauuuuucaugau

SEQ ID NO: 3366968 - RNA, 14 nt, Human
agaucaaaauaaaa

SEQ ID NO: 3366969 - RNA, 16 nt, Human
agaucaaaauaaaaag

SEQ ID NO: 3366970 - RNA, 14 nt, Human
agaucaaauacuuu

SEQ ID NO: 3366971 - RNA, 14 nt, Human
agaucaaauaguug

SEQ ID NO: 3366972 - RNA, 19 nt, Human
agaucaaauaguugcauag

SEQ ID NO: 3366973 - RNA, 21 nt, Human
agaucaaccccuucgcuccug

SEQ ID NO: 3366974 - RNA, 17 nt, Human
agaucaacgccucacug

SEQ ID NO: 3366975 - RNA, 12 nt, Human
agaucaagcugu

SEQ ID NO: 3366976 - RNA, 14 nt, Human
agaucaagcuguga

SEQ ID NO: 3366977 - RNA, 16 nt, Human
agaucacauaacagaa

SEQ ID NO: 3366978 - RNA, 18 nt, Human
agaucacauaacagaaug

SEQ ID NO: 3366979 - RNA, 19 nt, Human
agaucacauaacagaaugc

SEQ ID NO: 3366980 - RNA, 16 nt, Human
agaucacgccacugca

SEQ ID NO: 3366981 - RNA, 23 nt, Human
acucgugucuggcacagccuggc

SEQ ID NO: 3366982 - RNA, 19 nt, Human
acucguuaauuuguagugu

SEQ ID NO: 3366983 - RNA, 12 nt, Human
acucuaaaaacu

SEQ ID NO: 3366984 - RNA, 14 nt, Human
acucuaaaagaucc

SEQ ID NO: 3366985 - RNA, 18 nt, Human
acucuaaaagguucaggg

SEQ ID NO: 3366986 - RNA, 15 nt, Human
acucuaaagaccaaa

SEQ ID NO: 3366987 - RNA, 16 nt, Human
acucuaaagaccaaac

SEQ ID NO: 3366988 - RNA, 14 nt, Human
acucuaaagcaaau

SEQ ID NO: 3366989 - RNA, 18 nt, Human
acucuaaagcaaauuuau

SEQ ID NO: 3366990 - RNA, 14 nt, Human
acucuaaagucugu

SEQ ID NO: 3366991 - RNA, 23 nt, Human
acucuaaauucuuuauuucuguc

SEQ ID NO: 3366992 - RNA, 14 nt, Human
acucuaacuguaua

SEQ ID NO: 3366993 - RNA, 15 nt, Human
acucuaacuguauau

SEQ ID NO: 3366994 - RNA, 15 nt, Human
acucuaagaaagaac

SEQ ID NO: 3366995 - RNA, 18 nt, Human
acucuaagucauguaugu

SEQ ID NO: 3366996 - RNA, 23 nt, Human
acucuaagucauguauguuucuc

SEQ ID NO: 3366997 - RNA, 16 nt, Human
acucuaaguguuugcu

SEQ ID NO: 3366998 - RNA, 23 nt, Human
acucuaaguuuuaggguacaugu

SEQ ID NO: 3366999 - RNA, 22 nt, Human
acucuaauucccauuuugcaaa

SEQ ID NO: 3367000 - RNA, 15 nt, Human
acucuacagaggcca

SEQ ID NO: 3367001 - RNA, 19 nt, Human
acucuacauaauuuagagu

SEQ ID NO: 3367002 - RNA, 13 nt, Human
acucuacccuccc

SEQ ID NO: 3367003 - RNA, 19 nt, Human
acucuacccucccaccccc

SEQ ID NO: 3367004 - RNA, 13 nt, Human
acucuacccucuu

SEQ ID NO: 3367005 - RNA, 21 nt, Human
acucuacccucuuagaaaaac

SEQ ID NO: 3367006 - RNA, 16 nt, Human
acucuaccugcacacu

SEQ ID NO: 3367007 - RNA, 19 nt, Human
acucuacuuaauccaaugg

SEQ ID NO: 3367008 - RNA, 21 nt, Human
acucuacuuaauccaaugggu

SEQ ID NO: 3367009 - RNA, 21 nt, Human
acucuacuuagcaugucccua

SEQ ID NO: 3367010 - RNA, 19 nt, Human
acucuagaaaacgcgaccu

SEQ ID NO: 3367011 - RNA, 23 nt, Human
acucuagaaaacgcgaccuuggc

SEQ ID NO: 3367012 - RNA, 17 nt, Human
acucuagacaagauauu

SEQ ID NO: 3367013 - RNA, 20 nt, Human
acucuagauuuuguuuugcu

SEQ ID NO: 3367014 - RNA, 18 nt, Human
acucuaggauguauauuu

SEQ ID NO: 3367015 - RNA, 16 nt, Human
acucuaguacugugaa

SEQ ID NO: 3367016 - RNA, 17 nt, Human
acucuaguacugugaau

SEQ ID NO: 3367017 - RNA, 17 nt, Human
acucuagucaaugacau

SEQ ID NO: 3367018 - RNA, 21 nt, Human
agcaagaggccguggcugcug

SEQ ID NO: 3367019 - RNA, 16 nt, Human
agcaagauaaacauua

SEQ ID NO: 3367020 - RNA, 17 nt, Human
agcaagauaaacauuau

SEQ ID NO: 3367021 - RNA, 16 nt, Human
agcaagcaacacagag

SEQ ID NO: 3367022 - RNA, 18 nt, Human
agcaagcaguagcauuug

SEQ ID NO: 3367023 - RNA, 21 nt, Human
agcaagcauucagaagaaaaa

SEQ ID NO: 3367024 - RNA, 22 nt, Human
agcaagcauucagaagaaaaag

SEQ ID NO: 3367025 - RNA, 20 nt, Human
agcaagcauuuauguuuauu

SEQ ID NO: 3367026 - RNA, 19 nt, Human
agcaagcccuacagagcug

SEQ ID NO: 3367027 - RNA, 15 nt, Human
agcaagcucccaagg

SEQ ID NO: 3367028 - RNA, 14 nt, Human
agcaagcuggccuc

SEQ ID NO: 3367029 - RNA, 15 nt, Human
agcaagcuggccucu

SEQ ID NO: 3367030 - RNA, 16 nt, Human
agcaagcuggccucua

SEQ ID NO: 3367031 - RNA, 22 nt, Human
acugaccugucaugccccccuc

SEQ ID NO: 3367032 - RNA, 20 nt, Human
acugaccuuguaaaagacag

SEQ ID NO: 3367033 - RNA, 16 nt, Human
acugacggacucauga

SEQ ID NO: 3367034 - RNA, 21 nt, Human
acugacuaucauaaaaucaaa

SEQ ID NO: 3367035 - RNA, 23 nt, Human
acugacuauucuugauguaaaau

SEQ ID NO: 3367036 - RNA, 21 nt, Human
acugacucuggaaaaggcaua

SEQ ID NO: 3367037 - RNA, 14 nt, Human
acugacucuuaaga

SEQ ID NO: 3367038 - RNA, 16 nt, Human
acugacucuuaagaag

SEQ ID NO: 3367039 - RNA, 12 nt, Human
acugacugaggc

SEQ ID NO: 3367040 - RNA, 15 nt, Human
acugacugaggcagu

SEQ ID NO: 3367041 - RNA, 21 nt, Human
acugacugaggcaguuugagg

SEQ ID NO: 3367042 - RNA, 21 nt, Human
acugacuggauucauucucau

SEQ ID NO: 3367043 - RNA, 13 nt, Human
acugacuucuaag

SEQ ID NO: 3367044 - RNA, 15 nt, Human
acugacuucuaagua

SEQ ID NO: 3367045 - RNA, 24 nt, Human
acugacuuguuugucuuccauucc

SEQ ID NO: 3367046 - RNA, 14 nt, Human
acugacuuuauccu

SEQ ID NO: 3367047 - RNA, 16 nt, Human
acugacuuugcuugcu

SEQ ID NO: 3367048 - RNA, 17 nt, Human
acugacuuugcuugcuu

SEQ ID NO: 3367049 - RNA, 23 nt, Human
acugacuuugcuugcuuugaagu

SEQ ID NO: 3367050 - RNA, 23 nt, Human
acugagaaaacgaaacugcucua

SEQ ID NO: 3367051 - RNA, 20 nt, Human
acugagaauguaagaacuac

SEQ ID NO: 3367052 - RNA, 18 nt, Human
acugagacagcccgggcu

SEQ ID NO: 3367053 - RNA, 15 nt, Human
acugagaccaaagaa

SEQ ID NO: 3367054 - RNA, 23 nt, Human
acugagaccaaggcuuucucuac

SEQ ID NO: 3367055 - RNA, 18 nt, Human
acugagagccuuuuugaa

SEQ ID NO: 3367056 - RNA, 17 nt, Human
acugagauuuugguauu

SEQ ID NO: 3367057 - RNA, 23 nt, Human
acugagcacuguuuucuagugua

SEQ ID NO: 3367058 - RNA, 14 nt, Human
acugagcagagucu

SEQ ID NO: 3367059 - RNA, 18 nt, Human
acugagcauagugguggg

SEQ ID NO: 3367060 - RNA, 20 nt, Human
acugagccagucccaggggc

SEQ ID NO: 3367061 - RNA, 13 nt, Human
acugagccccccc

SEQ ID NO: 3367062 - RNA, 18 nt, Human
acugagccccgcagaccu

SEQ ID NO: 3367063 - RNA, 16 nt, Human
acugagcuccaugugc

SEQ ID NO: 3367064 - RNA, 16 nt, Human
acugagcuccucuggg

SEQ ID NO: 3367065 - RNA, 21 nt, Human
acugagcuccucugggcagga

SEQ ID NO: 3367066 - RNA, 16 nt, Human
acugagcuucucugug

SEQ ID NO: 3367067 - RNA, 18 nt, Human
acugagcuucucugugaa

SEQ ID NO: 3367068 - RNA, 12 nt, Human
acugagcuugga

SEQ ID NO: 3367069 - RNA, 13 nt, Human
acugaggaagaac

SEQ ID NO: 3367070 - RNA, 15 nt, Human
acugaggaccagcca

SEQ ID NO: 3367071 - RNA, 14 nt, Human
acugaggaucagag

SEQ ID NO: 3367072 - RNA, 19 nt, Human
acugaggcagacagcagcu

SEQ ID NO: 3367073 - RNA, 14 nt, Human
acugaggcagggaa

SEQ ID NO: 3367074 - RNA, 20 nt, Human
acugaggcaguuugaggauu

SEQ ID NO: 3367075 - RNA, 13 nt, Human
acugaggccugag

SEQ ID NO: 3367076 - RNA, 19 nt, Human
acugaggccugagacccag

SEQ ID NO: 3367077 - RNA, 20 nt, Human
acugagggaccaacugggcc

SEQ ID NO: 3367078 - RNA, 22 nt, Human
acugaggggaggggagcauggg

SEQ ID NO: 3367079 - RNA, 19 nt, Human
acugagggggccuggaugc

SEQ ID NO: 3367080 - RNA, 24 nt, Human
acugagggugaguuggcuuaccug

SEQ ID NO: 3367081 - RNA, 21 nt, Human
acugagguucauggauuuucc

SEQ ID NO: 3367082 - RNA, 22 nt, Human
acugaguacguugugcauuugg

SEQ ID NO: 3367083 - RNA, 23 nt, Human
acugaguacguugugcauuuggu

SEQ ID NO: 3367084 - RNA, 12 nt, Human
acugagugacuc

SEQ ID NO: 3367085 - RNA, 14 nt, Human
acugagugggaagc

SEQ ID NO: 3367086 - RNA, 18 nt, Human
acugaguuacauugucau

SEQ ID NO: 3367087 - RNA, 19 nt, Human
acugaguuagaauguugaa

SEQ ID NO: 3367088 - RNA, 13 nt, Human
acugaguuuucca

SEQ ID NO: 3367089 - RNA, 13 nt, Human
acugauaaagaug

SEQ ID NO: 3367090 - RNA, 21 nt, Human
acugauaaagaugagugagca

SEQ ID NO: 3367091 - RNA, 16 nt, Human
acugauaguguccaaa

SEQ ID NO: 3367092 - RNA, 15 nt, Human
acugauauucagaau

SEQ ID NO: 3367093 - RNA, 16 nt, Human
acugauauucagaauu

SEQ ID NO: 3367094 - RNA, 13 nt, Human
acugaucucucgu

SEQ ID NO: 3367095 - RNA, 18 nt, Human
acugaugcugagauucuu

SEQ ID NO: 3367096 - RNA, 11 nt, Human
acugaugcugc

SEQ ID NO: 3367097 - RNA, 12 nt, Human
acugaugcuuuu

SEQ ID NO: 3367098 - RNA, 18 nt, Human
acugaugcuuuuagcuca

SEQ ID NO: 3367099 - RNA, 21 nt, Human
acugauggaauuuuuuuguac

SEQ ID NO: 3367100 - RNA, 23 nt, Human
acugauggaauuuuuuuguacga

SEQ ID NO: 3367101 - RNA, 23 nt, Human
acugaugggcaacccccagccug

SEQ ID NO: 3367102 - RNA, 12 nt, Human
acugaugugaaa

SEQ ID NO: 3367103 - RNA, 16 nt, Human
acugauguuaggcugg

SEQ ID NO: 3367104 - RNA, 18 nt, Human
acugauuaugucuuuuau

SEQ ID NO: 3367105 - RNA, 15 nt, Human
acugauuauuuucuu

SEQ ID NO: 3367106 - RNA, 14 nt, Human
acugauucaauuug

SEQ ID NO: 3367107 - RNA, 20 nt, Human
acugauucacaucucauuuu

SEQ ID NO: 3367108 - RNA, 13 nt, Human
acugauuguuuca

SEQ ID NO: 3367109 - RNA, 21 nt, Human
acugauuguuuuagagacuau

SEQ ID NO: 3367110 - RNA, 15 nt, Human
acugauuucagagug

SEQ ID NO: 3367111 - RNA, 17 nt, Human
acugauuuccccuuuug

SEQ ID NO: 3367112 - RNA, 21 nt, Human
acugauuuccccuuuugcauu

SEQ ID NO: 3367113 - RNA, 13 nt, Human
acugauuuccuuu

SEQ ID NO: 3367114 - RNA, 22 nt, Human
acugauuuuguuauuuuuauau

SEQ ID NO: 3367115 - RNA, 18 nt, Human
acugauuuuuuuuuccuu

SEQ ID NO: 3367116 - RNA, 20 nt, Human
acugauuuuuuuuuccuuca

SEQ ID NO: 3367117 - RNA, 21 nt, Human
acugauuuuuuuuuccuucag

SEQ ID NO: 3367118 - RNA, 23 nt, Human
acugauuuuuuuuuccuucagug

SEQ ID NO: 3367119 - RNA, 22 nt, Human
acugcaaaucaggcuuuuguuu

SEQ ID NO: 3367120 - RNA, 11 nt, Human
acugcaacagg

SEQ ID NO: 3367121 - RNA, 12 nt, Human
acugcaacagga

SEQ ID NO: 3367122 - RNA, 14 nt, Human
acugcaaccuccac

SEQ ID NO: 3367123 - RNA, 13 nt, Human
acugcaaccuccg

SEQ ID NO: 3367124 - RNA, 14 nt, Human
acugcaaccuccgc

SEQ ID NO: 3367125 - RNA, 16 nt, Human
acugcaaccuccgccu

SEQ ID NO: 3367126 - RNA, 16 nt, Human
acugcaaccucugccu

SEQ ID NO: 3367127 - RNA, 20 nt, Human
acugcaaccuucgccaccug

SEQ ID NO: 3367128 - RNA, 20 nt, Human
acugcaaccuuguuuauuaa

SEQ ID NO: 3367129 - RNA, 16 nt, Human
acugcaacuucugccu

SEQ ID NO: 3367130 - RNA, 20 nt, Human
acugcaacuuguaaaugugg

SEQ ID NO: 3367131 - RNA, 16 nt, Human
acugcaagaaaaugau

SEQ ID NO: 3367132 - RNA, 16 nt, Human
acugcaagagccuugg

SEQ ID NO: 3367133 - RNA, 20 nt, Human
acugcaagucacaaaggaau

SEQ ID NO: 3367134 - RNA, 20 nt, Human
acugcaagugagcaaaccug

SEQ ID NO: 3367135 - RNA, 19 nt, Human
acugcaauagagacuguag

SEQ ID NO: 3367136 - RNA, 15 nt, Human
acugcaaucauaugu

SEQ ID NO: 3367137 - RNA, 17 nt, Human
acugcacaugaagaaau

SEQ ID NO: 3367138 - RNA, 16 nt, Human
acugcacaugauuuca

SEQ ID NO: 3367139 - RNA, 17 nt, Human
acugcacaugauuucac

SEQ ID NO: 3367140 - RNA, 18 nt, Human
acugcacaugauuucaca

SEQ ID NO: 3367141 - RNA, 12 nt, Human
acugcacccagg

SEQ ID NO: 3367142 - RNA, 22 nt, Human
acugcacccccuccugcugcag

SEQ ID NO: 3367143 - RNA, 14 nt, Human
acugcaccgggcca

SEQ ID NO: 3367144 - RNA, 20 nt, Human
acugcacguggcuucugaug

SEQ ID NO: 3367145 - RNA, 14 nt, Human
acugcacguuuuca

SEQ ID NO: 3367146 - RNA, 17 nt, Human
acugcacuccagccugg

SEQ ID NO: 3367147 - RNA, 13 nt, Human
acugcagaagcaa

SEQ ID NO: 3367148 - RNA, 18 nt, Human
acugcagaccuguccucc

SEQ ID NO: 3367149 - RNA, 21 nt, Human
acugcagaccuguccuccugg

SEQ ID NO: 3367150 - RNA, 17 nt, Human
acugcagauugagaccu

SEQ ID NO: 3367151 - RNA, 19 nt, Human
acugcagcaaucuuugaaa

SEQ ID NO: 3367152 - RNA, 21 nt, Human
acugcagcaccuccaggccug

SEQ ID NO: 3367153 - RNA, 21 nt, Human
acugcagccucaaccuccugg

SEQ ID NO: 3367154 - RNA, 23 nt, Human
acugcagccucaaccuccugggc

SEQ ID NO: 3367155 - RNA, 22 nt, Human
acugcagccuccgcuucccugg

SEQ ID NO: 3367156 - RNA, 12 nt, Human
acugcaggcccu

SEQ ID NO: 3367157 - RNA, 14 nt, Human
acugcaggcccugg

SEQ ID NO: 3367158 - RNA, 15 nt, Human
acugcaggcccuggc

SEQ ID NO: 3367159 - RNA, 16 nt, Human
acugcaggcccuggcc

SEQ ID NO: 3367160 - RNA, 22 nt, Human
acugcaggcccuggccuccccu

SEQ ID NO: 3367161 - RNA, 12 nt, Human
acugcagggaca

SEQ ID NO: 3367162 - RNA, 16 nt, Human
agagauucauuuucua

SEQ ID NO: 3367163 - RNA, 18 nt, Human
agagauucauuuucuaga

SEQ ID NO: 3367164 - RNA, 12 nt, Human
agagauucugau

SEQ ID NO: 3367165 - RNA, 20 nt, Human
agagauucugugaucuuuua

SEQ ID NO: 3367166 - RNA, 23 nt, Human
agagauucugugaucuuuuaaag

SEQ ID NO: 3367167 - RNA, 20 nt, Human
agagauuggaaugggcagcu

SEQ ID NO: 3367168 - RNA, 17 nt, Human
agagauuggaucaagua

SEQ ID NO: 3367169 - RNA, 16 nt, Human
agagauugugguuuca

SEQ ID NO: 3367170 - RNA, 13 nt, Human
agagauuucucau

SEQ ID NO: 3367171 - RNA, 21 nt, Human
agagauuuuuuuuuaaagaag

SEQ ID NO: 3367172 - RNA, 20 nt, Human
agagcaaaauugauguguuu

SEQ ID NO: 3367173 - RNA, 17 nt, Human
agagcaaccucucacuc

SEQ ID NO: 3367174 - RNA, 14 nt, Human
agagcaacucugag

SEQ ID NO: 3367175 - RNA, 23 nt, Human
agagcaagacgcugugcugcccu

SEQ ID NO: 3367176 - RNA, 18 nt, Human
agagcaagacucugucua

SEQ ID NO: 3367177 - RNA, 13 nt, Human
agagcaagagagc

SEQ ID NO: 3367178 - RNA, 20 nt, Human
agagcaagagauaagucuuu

SEQ ID NO: 3367179 - RNA, 23 nt, Human
agagcaagauccugucuuuaagg

SEQ ID NO: 3367180 - RNA, 15 nt, Human
agagcaagcuuuuuu

SEQ ID NO: 3367181 - RNA, 21 nt, Human
agagcaaggaagguaaaaagu

SEQ ID NO: 3367182 - RNA, 21 nt, Human
agagcaaugcccguaaugcuu

SEQ ID NO: 3367183 - RNA, 17 nt, Human
agagcaaugguuguauu

SEQ ID NO: 3367184 - RNA, 15 nt, Human
agagcacaaacauuu

SEQ ID NO: 3367185 - RNA, 14 nt, Human
agagcacacuguag

SEQ ID NO: 3367186 - RNA, 11 nt, Human
agagcacagcc

SEQ ID NO: 3367187 - RNA, 13 nt, Human
agagcacagcccu

SEQ ID NO: 3367188 - RNA, 18 nt, Human
agagcaccuaguccagug

SEQ ID NO: 3367189 - RNA, 17 nt, Human
agagcaccugcugucug

SEQ ID NO: 3367190 - RNA, 21 nt, Human
agagcaccuuagacagucccu

SEQ ID NO: 3367191 - RNA, 22 nt, Human
agagcaccuuagacagucccug

SEQ ID NO: 3367192 - RNA, 20 nt, Human
agagcaccuuugcacaggau

SEQ ID NO: 3367193 - RNA, 21 nt, Human
agagcacuagguucaauuccc

SEQ ID NO: 3367194 - RNA, 13 nt, Human
agagcacugccac

SEQ ID NO: 3367195 - RNA, 16 nt, Human
agagcacugcuccagu

SEQ ID NO: 3367196 - RNA, 21 nt, Human
agagcacuggguugcagggga

SEQ ID NO: 3367197 - RNA, 14 nt, Human
agagcagaaauucu

SEQ ID NO: 3367198 - RNA, 15 nt, Human
agagcagaaauucug

SEQ ID NO: 3367199 - RNA, 20 nt, Human
agagcagaaauucuguuuuu

SEQ ID NO: 3367200 - RNA, 20 nt, Human
agagcagaacagaucuuuua

SEQ ID NO: 3367201 - RNA, 23 nt, Human
agagcagaacggagccccaggcc

SEQ ID NO: 3367202 - RNA, 12 nt, Human
agagcagaugca

SEQ ID NO: 3367203 - RNA, 18 nt, Human
agagcagaugcagagagc

SEQ ID NO: 3367204 - RNA, 19 nt, Human
agagcagaugcagagagcc

SEQ ID NO: 3367205 - RNA, 19 nt, Human
agagcagcaaggucuugcu

SEQ ID NO: 3367206 - RNA, 12 nt, Human
agagcagcaccu

SEQ ID NO: 3367207 - RNA, 19 nt, Human
agagcagccuguggcaucu

SEQ ID NO: 3367208 - RNA, 19 nt, Human
agagcagcuccuuccuagc

SEQ ID NO: 3367209 - RNA, 20 nt, Human
agagcagcuucugccacuuc

SEQ ID NO: 3367210 - RNA, 18 nt, Human
agagcagcuuuaaacuca

SEQ ID NO: 3367211 - RNA, 20 nt, Human
agagcaggaagcauucagag

SEQ ID NO: 3367212 - RNA, 23 nt, Human
agagcaggaagcauucagagagc

SEQ ID NO: 3367213 - RNA, 14 nt, Human
agagcaggaauggg

SEQ ID NO: 3367214 - RNA, 20 nt, Human
agagcaggacuccaggccca

SEQ ID NO: 3367215 - RNA, 19 nt, Human
agagcaggacugaugucuc

SEQ ID NO: 3367216 - RNA, 20 nt, Human
agagcaggaggccccuggcc

SEQ ID NO: 3367217 - RNA, 13 nt, Human
agagcaggcacau

SEQ ID NO: 3367218 - RNA, 20 nt, Human
aggagagucccagagcagga

SEQ ID NO: 3367219 - RNA, 21 nt, Human
aggagagucuugcagugauua

SEQ ID NO: 3367220 - RNA, 16 nt, Human
aggagaucagaaaaau

SEQ ID NO: 3367221 - RNA, 20 nt, Human
aggagaucgagaccauccug

SEQ ID NO: 3367222 - RNA, 16 nt, Human
aggagaugcuccuugg

SEQ ID NO: 3367223 - RNA, 17 nt, Human
aggagaugcuccuuggg

SEQ ID NO: 3367224 - RNA, 22 nt, Human
aggagauguaagagcuuuacaa

SEQ ID NO: 3367225 - RNA, 13 nt, Human
aggagauugagaa

SEQ ID NO: 3367226 - RNA, 19 nt, Human
aggagauugagaaggagag

SEQ ID NO: 3367227 - RNA, 14 nt, Human
aggagcaaagccug

SEQ ID NO: 3367228 - RNA, 18 nt, Human
aggagcaaauguuucugc

SEQ ID NO: 3367229 - RNA, 22 nt, Human
aggagcaaauguuucugcagua

SEQ ID NO: 3367230 - RNA, 17 nt, Human
aggagcacaggucccac

SEQ ID NO: 3367231 - RNA, 23 nt, Human
aggagcacggcucuguccccagc

SEQ ID NO: 3367232 - RNA, 15 nt, Human
aggagcacugaaagu

SEQ ID NO: 3367233 - RNA, 20 nt, Human
aggagcagcaggagggggga

SEQ ID NO: 3367234 - RNA, 12 nt, Human
aggagcagccac

SEQ ID NO: 3367235 - RNA, 18 nt, Human
aggagcauauguccuaga

SEQ ID NO: 3367236 - RNA, 14 nt, Human
aggagccaccaguu

SEQ ID NO: 3367237 - RNA, 14 nt, Human
aggagccagacaga

SEQ ID NO: 3367238 - RNA, 13 nt, Human
aggagccaggcaa

SEQ ID NO: 3367239 - RNA, 24 nt, Human
aggagcccacggcuaagaggcugc

SEQ ID NO: 3367240 - RNA, 20 nt, Human
aggagcccagcguccacucu

SEQ ID NO: 3367241 - RNA, 15 nt, Human
aggagcccaggccag

SEQ ID NO: 3367242 - RNA, 16 nt, Human
aggagcccaggccagg

SEQ ID NO: 3367243 - RNA, 17 nt, Human
aggagcccaggccagga

SEQ ID NO: 3367244 - RNA, 20 nt, Human
aggagcccaggccaggacuc

SEQ ID NO: 3367245 - RNA, 22 nt, Human
aggagcccaggccaggacucug

SEQ ID NO: 3367246 - RNA, 20 nt, Human
aggagcccauuuggagggcc

SEQ ID NO: 3367247 - RNA, 14 nt, Human
aggagccccagcua

SEQ ID NO: 3367248 - RNA, 12 nt, Human
aggagcccccac

SEQ ID NO: 3367249 - RNA, 19 nt, Human
aggagcccccacccuguuc

SEQ ID NO: 3367250 - RNA, 14 nt, Human
aggagcccugccuc

SEQ ID NO: 3367251 - RNA, 17 nt, Human
aggagcccugccucucc

SEQ ID NO: 3367252 - RNA, 16 nt, Human
aggagccuaggccagg

SEQ ID NO: 3367253 - RNA, 16 nt, Human
aggagccuccugcccu

SEQ ID NO: 3367254 - RNA, 14 nt, Human
aggagccugcuggu

SEQ ID NO: 3367255 - RNA, 12 nt, Human
aggagccugucc

SEQ ID NO: 3367256 - RNA, 12 nt, Human
aggagccuguga

SEQ ID NO: 3367257 - RNA, 17 nt, Human
aggagccugugaaccca

SEQ ID NO: 3367258 - RNA, 20 nt, Human
aggagccugugaacccagga

SEQ ID NO: 3367259 - RNA, 22 nt, Human
aggagccugugaacccaggaca

SEQ ID NO: 3367260 - RNA, 13 nt, Human
aggagcuaaggcu

SEQ ID NO: 3367261 - RNA, 15 nt, Human
aggagcuaaggcucu

SEQ ID NO: 3367262 - RNA, 17 nt, Human
aggagcuaaggcucuau

SEQ ID NO: 3367263 - RNA, 16 nt, Human
aggagcuaccugugug

SEQ ID NO: 3367264 - RNA, 22 nt, Human
aggagcuccauacacacgcugc

SEQ ID NO: 3367265 - RNA, 23 nt, Human
aggagcucuuaacuacaguggcu

SEQ ID NO: 3367266 - RNA, 14 nt, Human
aggagcugagaaua

SEQ ID NO: 3367267 - RNA, 16 nt, Human
aggagcugagaauaga

SEQ ID NO: 3367268 - RNA, 23 nt, Human
aggagcugagaauagaaggaaac

SEQ ID NO: 3367269 - RNA, 15 nt, Human
aggagcugagguuuc

SEQ ID NO: 3367270 - RNA, 21 nt, Human
aggagcugagguuucacccuu

SEQ ID NO: 3367271 - RNA, 14 nt, Human
aggagcugccugga

SEQ ID NO: 3367272 - RNA, 16 nt, Human
aggagcugccuggacc

SEQ ID NO: 3367273 - RNA, 13 nt, Human
aggagcugcuaua

SEQ ID NO: 3367274 - RNA, 12 nt, Human
aggagcugcugg

SEQ ID NO: 3367275 - RNA, 17 nt, Human
aggagcugggagccggg

SEQ ID NO: 3367276 - RNA, 16 nt, Human
aggagcugggaggaaa

SEQ ID NO: 3367277 - RNA, 20 nt, Human
aggagcugggcagaaggcca

SEQ ID NO: 3367278 - RNA, 21 nt, Human
aggagcuggggaucccucccc

SEQ ID NO: 3367279 - RNA, 19 nt, Human
aggagcugggggcagccug

SEQ ID NO: 3367280 - RNA, 16 nt, Human
aggagcuuccuguccu

SEQ ID NO: 3367281 - RNA, 22 nt, Human
aggagcuucugggguccccagg

SEQ ID NO: 3367282 - RNA, 22 nt, Human
aggagcuucuuguuuccuuguu

SEQ ID NO: 3367283 - RNA, 17 nt, Human
aggagcuuugacucagg

SEQ ID NO: 3367284 - RNA, 14 nt, Human
aggaggaaggcaag

SEQ ID NO: 3367285 - RNA, 17 nt, Human
aggaggaaggcaagagg

SEQ ID NO: 3367286 - RNA, 19 nt, Human
aggaggaaugcuggacugg

SEQ ID NO: 3367287 - RNA, 16 nt, Human
aggaggacccaggaca

SEQ ID NO: 3367288 - RNA, 18 nt, Human
aggaggacccaggacagg

SEQ ID NO: 3367289 - RNA, 15 nt, Human
aggaggagcaggggc

SEQ ID NO: 3367290 - RNA, 14 nt, Human
aggaggagccuguc

SEQ ID NO: 3367291 - RNA, 23 nt, Human
aggaggaggcaauugggauggcg

SEQ ID NO: 3367292 - RNA, 14 nt, Human
aggaggaugggcuc

SEQ ID NO: 3367293 - RNA, 17 nt, Human
aggaggaugucccuggg

SEQ ID NO: 3367294 - RNA, 21 nt, Human
aggaggauugcuugagcccag

SEQ ID NO: 3367295 - RNA, 23 nt, Human
aggaggauugcuugagcccagga

SEQ ID NO: 3367296 - RNA, 14 nt, Human
aggaggcagaaagc

SEQ ID NO: 3367297 - RNA, 22 nt, Human
aggaggcagaauaagaaaacaa

SEQ ID NO: 3367298 - RNA, 20 nt, Human
aggaggcagagguugcagug

SEQ ID NO: 3367299 - RNA, 17 nt, Human
aggaggcagcaggacug

SEQ ID NO: 3367300 - RNA, 14 nt, Human
aggaggccaccucu

SEQ ID NO: 3367301 - RNA, 15 nt, Human
aggaggccaccucuc

SEQ ID NO: 3367302 - RNA, 17 nt, Human
aggaggccaccucucca

SEQ ID NO: 3367303 - RNA, 18 nt, Human
aggaggccaccucuccaa

SEQ ID NO: 3367304 - RNA, 19 nt, Human
aggaggccaccucuccaag

SEQ ID NO: 3367305 - RNA, 22 nt, Human
aggaggccaccucuccaagggc

SEQ ID NO: 3367306 - RNA, 20 nt, Human
aggccgaggccaugugcaua

SEQ ID NO: 3367307 - RNA, 20 nt, Human
aggccgcagcuccauuuucu

SEQ ID NO: 3367308 - RNA, 18 nt, Human
aggccgcagcucuugccc

SEQ ID NO: 3367309 - RNA, 14 nt, Human
aggccgccccagcc

SEQ ID NO: 3367310 - RNA, 18 nt, Human
aggccgcuagaggccuga

SEQ ID NO: 3367311 - RNA, 21 nt, Human
aggccgcuagaggccugagga

SEQ ID NO: 3367312 - RNA, 20 nt, Human
aggccgcuguucacccacag

SEQ ID NO: 3367313 - RNA, 15 nt, Human
aggccggcagcccca

SEQ ID NO: 3367314 - RNA, 14 nt, Human
aggccggccagccu

SEQ ID NO: 3367315 - RNA, 19 nt, Human
aggccggcgagcccugugg

SEQ ID NO: 3367316 - RNA, 20 nt, Human
aggccggcgccuuccccucg

SEQ ID NO: 3367317 - RNA, 18 nt, Human
aggccgggaaaaagccca

SEQ ID NO: 3367318 - RNA, 16 nt, Human
aggccgggcagagcac

SEQ ID NO: 3367319 - RNA, 19 nt, Human
aggccgggcagagcacagc

SEQ ID NO: 3367320 - RNA, 20 nt, Human
aggccgggugcucagggcug

SEQ ID NO: 3367321 - RNA, 13 nt, Human
aggccguccuccc

SEQ ID NO: 3367322 - RNA, 21 nt, Human
aggccguccucccgggcccuc

SEQ ID NO: 3367323 - RNA, 17 nt, Human
aggccgugacgucuggg

SEQ ID NO: 3367324 - RNA, 12 nt, Human
aggccguggcug

SEQ ID NO: 3367325 - RNA, 20 nt, Human
aggccguggcugcccacaca

SEQ ID NO: 3367326 - RNA, 21 nt, Human
aggccguugcugacuuagaau

SEQ ID NO: 3367327 - RNA, 23 nt, Human
aggccguugcugacuuagaaucc

SEQ ID NO: 3367328 - RNA, 19 nt, Human
aggccuaauucuaugccug

SEQ ID NO: 3367329 - RNA, 19 nt, Human
aggccuaccccgcagacac

SEQ ID NO: 3367330 - RNA, 22 nt, Human
aggccuaccccgcagacaccuu

SEQ ID NO: 3367331 - RNA, 14 nt, Human
aggccuacuccugu

SEQ ID NO: 3367332 - RNA, 15 nt, Human
aggccuacuccuguc

SEQ ID NO: 3367333 - RNA, 16 nt, Human
aggccuagacucuguc

SEQ ID NO: 3367334 - RNA, 17 nt, Human
aggccuaggaggguccu

SEQ ID NO: 3367335 - RNA, 16 nt, Human
aggccuaggauucuaa

SEQ ID NO: 3367336 - RNA, 17 nt, Human
aggccuaggauucuaaa

SEQ ID NO: 3367337 - RNA, 16 nt, Human
aggccuauaaugaagc

SEQ ID NO: 3367338 - RNA, 15 nt, Human
aggccucaacuccuc

SEQ ID NO: 3367339 - RNA, 14 nt, Human
aggccucagccaga

SEQ ID NO: 3367340 - RNA, 15 nt, Human
aggccucagccagag

SEQ ID NO: 3367341 - RNA, 15 nt, Human
aggccucaggugcug

SEQ ID NO: 3367342 - RNA, 16 nt, Human
aggccucaguggacuu

SEQ ID NO: 3367343 - RNA, 14 nt, Human
aggccucccaaguu

SEQ ID NO: 3367344 - RNA, 12 nt, Human
aggccucccaca

SEQ ID NO: 3367345 - RNA, 13 nt, Human
aggccucccacag

SEQ ID NO: 3367346 - RNA, 14 nt, Human
aggccucccacagu

SEQ ID NO: 3367347 - RNA, 16 nt, Human
aggccucccucaaccc

SEQ ID NO: 3367348 - RNA, 16 nt, Human
aggccucccugccagu

SEQ ID NO: 3367349 - RNA, 12 nt, Human
aggccucccugu

SEQ ID NO: 3367350 - RNA, 13 nt, Human
aggccucccuguu

SEQ ID NO: 3367351 - RNA, 14 nt, Human
aggccucccuguuu

SEQ ID NO: 3367352 - RNA, 21 nt, Human
aggccuccuguggccugccag

SEQ ID NO: 3367353 - RNA, 13 nt, Human
aggccucgcagga

SEQ ID NO: 3367354 - RNA, 17 nt, Human
aggccucgcaggaagac

SEQ ID NO: 3367355 - RNA, 21 nt, Human
aggccucuccaguuugcaccu

SEQ ID NO: 3367356 - RNA, 23 nt, Human
aggccucuccaguuugcaccugu

SEQ ID NO: 3367357 - RNA, 24 nt, Human
aggccucuccaguuugcaccuguc

SEQ ID NO: 3367358 - RNA, 19 nt, Human
aggccucuccauuugcucu

SEQ ID NO: 3367359 - RNA, 21 nt, Human
aggccucuccauuugcucuuc

SEQ ID NO: 3367360 - RNA, 19 nt, Human
aggccucuggaaagcaaag

SEQ ID NO: 3367361 - RNA, 15 nt, Human
aggccucugugccgc

SEQ ID NO: 3367362 - RNA, 13 nt, Human
aggccucuguguc

SEQ ID NO: 3367363 - RNA, 14 nt, Human
aggccucugugucc

SEQ ID NO: 3367364 - RNA, 20 nt, Human
aggccucuguguccuucccu

SEQ ID NO: 3367365 - RNA, 22 nt, Human
aggccucuguguccuucccugc

SEQ ID NO: 3367366 - RNA, 24 nt, Human
aggccucuuggaccucugcucuga

SEQ ID NO: 3367367 - RNA, 23 nt, Human
aggccugaaagaggcugaggccu

SEQ ID NO: 3367368 - RNA, 22 nt, Human
aggccugaaucaugagccugcu

SEQ ID NO: 3367369 - RNA, 17 nt, Human
aggccugacuucugcug

SEQ ID NO: 3367370 - RNA, 17 nt, Human
aggccugagacccagga

SEQ ID NO: 3367371 - RNA, 19 nt, Human
aggccugagauuucaucug

SEQ ID NO: 3367372 - RNA, 21 nt, Human
aggccugagauuucaucugcu

SEQ ID NO: 3367373 - RNA, 22 nt, Human
aggccugagauuucaucugcuc

SEQ ID NO: 3367374 - RNA, 18 nt, Human
aggccugagcgcuccugc

SEQ ID NO: 3367375 - RNA, 19 nt, Human
aggccugagcgcuccugcc

SEQ ID NO: 3367376 - RNA, 22 nt, Human
aggccugagcgcuccugccgca

SEQ ID NO: 3367377 - RNA, 17 nt, Human
aggccugaggaugagcu

SEQ ID NO: 3367378 - RNA, 18 nt, Human
aggccugaggaugagcug

SEQ ID NO: 3367379 - RNA, 12 nt, Human
aggccugcacac

SEQ ID NO: 3367380 - RNA, 20 nt, Human
aggccugccuccagggcugg

SEQ ID NO: 3367381 - RNA, 21 nt, Human
aggccugcgacccugggggca

SEQ ID NO: 3367382 - RNA, 18 nt, Human
aggccugcucagggacug

SEQ ID NO: 3367383 - RNA, 19 nt, Human
aggccugcuuugucuccuc

SEQ ID NO: 3367384 - RNA, 23 nt, Human
aggccuggcacagugucugggcu

SEQ ID NO: 3367385 - RNA, 21 nt, Human
aggccuggccagaugcaccag

SEQ ID NO: 3367386 - RNA, 22 nt, Human
aggccuggccagaugcaccagc

SEQ ID NO: 3367387 - RNA, 13 nt, Human
aggccuggccagg

SEQ ID NO: 3367388 - RNA, 16 nt, Human
aggccuggccaggcac

SEQ ID NO: 3367389 - RNA, 16 nt, Human
aggccugggcugggaa

SEQ ID NO: 3367390 - RNA, 12 nt, Human
aggccuggggac

SEQ ID NO: 3367391 - RNA, 20 nt, Human
aggccugggggcugggcaga

SEQ ID NO: 3367392 - RNA, 23 nt, Human
aggccugggggcugggcagagga

SEQ ID NO: 3367393 - RNA, 17 nt, Human
aggccugggucuguguc

SEQ ID NO: 3367394 - RNA, 17 nt, Human
aggccugguguuucuug

SEQ ID NO: 3367395 - RNA, 17 nt, Human
aggccugucccuggcca

SEQ ID NO: 3367396 - RNA, 17 nt, Human
aggccugucugugaccu

SEQ ID NO: 3367397 - RNA, 22 nt, Human
aggccuguguagcugugaccug

SEQ ID NO: 3367398 - RNA, 24 nt, Human
aggccuguguagcugugaccugcu

SEQ ID NO: 3367399 - RNA, 21 nt, Human
aggccuguugcuuuuuuaugg

SEQ ID NO: 3367400 - RNA, 15 nt, Human
aggccuuccagcugc

SEQ ID NO: 3367401 - RNA, 16 nt, Human
aggccuuccagcugcu

SEQ ID NO: 3367402 - RNA, 13 nt, Human
aggccuucuccuc

SEQ ID NO: 3367403 - RNA, 22 nt, Human
aggccuucuccuccccacccgc

SEQ ID NO: 3367404 - RNA, 18 nt, Human
aggccuucucugaaggac

SEQ ID NO: 3367405 - RNA, 13 nt, Human
aggccuucuugug

SEQ ID NO: 3367406 - RNA, 19 nt, Human
aggccuugcggcuccucag

SEQ ID NO: 3367407 - RNA, 11 nt, Human
aggccuugcuc

SEQ ID NO: 3367408 - RNA, 14 nt, Human
aggccuugucccag

SEQ ID NO: 3367409 - RNA, 14 nt, Human
aggccuuuaaaauu

SEQ ID NO: 3367410 - RNA, 15 nt, Human
aggccuuucccuaag

SEQ ID NO: 3367411 - RNA, 17 nt, Human
aggccuuuuaacauuuu

SEQ ID NO: 3367412 - RNA, 18 nt, Human
aggccuuuuaacauuuug

SEQ ID NO: 3367413 - RNA, 16 nt, Human
aggccuuuuggaaugu

SEQ ID NO: 3367414 - RNA, 21 nt, Human
aggcgaaagaaaacucuauuu

SEQ ID NO: 3367415 - RNA, 15 nt, Human
aggcgaccaccgccc

SEQ ID NO: 3367416 - RNA, 13 nt, Human
agaguugagcucu

SEQ ID NO: 3367417 - RNA, 23 nt, Human
agaguugccccgucucuguucca

SEQ ID NO: 3367418 - RNA, 16 nt, Human
agaguugcugggagcu

SEQ ID NO: 3367419 - RNA, 13 nt, Human
agaguuggccaua

SEQ ID NO: 3367420 - RNA, 17 nt, Human
agaguuguaaauauaua

SEQ ID NO: 3367421 - RNA, 18 nt, Human
agaguuguaaauauauaa

SEQ ID NO: 3367422 - RNA, 19 nt, Human
agaguuguaaauauauaaa

SEQ ID NO: 3367423 - RNA, 16 nt, Human
agaguuguuacauuuu

SEQ ID NO: 3367424 - RNA, 17 nt, Human
agaguuguuacauuuuu

SEQ ID NO: 3367425 - RNA, 20 nt, Human
agaguuguuacauuuuuaag

SEQ ID NO: 3367426 - RNA, 22 nt, Human
agaguuuagcuguaacaguucu

SEQ ID NO: 3367427 - RNA, 20 nt, Human
agaguuucaguuuguuggaa

SEQ ID NO: 3367428 - RNA, 21 nt, Human
agaguuucaguuuguuggaaa

SEQ ID NO: 3367429 - RNA, 22 nt, Human
agaguuucuguuugauucuuuu

SEQ ID NO: 3367430 - RNA, 20 nt, Human
agaguuugagaccugaauag

SEQ ID NO: 3367431 - RNA, 18 nt, Human
agaguuugaugaggcccu

SEQ ID NO: 3367432 - RNA, 21 nt, Human
agaguuugccuuccuuucucc

SEQ ID NO: 3367433 - RNA, 13 nt, Human
agaguuugugugu

SEQ ID NO: 3367434 - RNA, 22 nt, Human
agaguuuguguguugucuugaa

SEQ ID NO: 3367435 - RNA, 14 nt, Human
agaguuuugucuug

SEQ ID NO: 3367436 - RNA, 16 nt, Human
agaguuuugucuugaa

SEQ ID NO: 3367437 - RNA, 19 nt, Human
agaguuuugucuugaaugu

SEQ ID NO: 3367438 - RNA, 14 nt, Human
agauaaaaagaugg

SEQ ID NO: 3367439 - RNA, 13 nt, Human
agauaaaaagugg

SEQ ID NO: 3367440 - RNA, 21 nt, Human
agauaaaaaguggaauuucuu

SEQ ID NO: 3367441 - RNA, 18 nt, Human
agauaaaagcugaaguua

SEQ ID NO: 3367442 - RNA, 12 nt, Human
agauaaacauua

SEQ ID NO: 3367443 - RNA, 19 nt, Human
agauaaacucagaaauuua

SEQ ID NO: 3367444 - RNA, 18 nt, Human
agauaaagaccagaaauu

SEQ ID NO: 3367445 - RNA, 14 nt, Human
agauaaagauuucu

SEQ ID NO: 3367446 - RNA, 13 nt, Human
agauaaagugguu

SEQ ID NO: 3367447 - RNA, 20 nt, Human
agauaaauauuugacuugca

SEQ ID NO: 3367448 - RNA, 12 nt, Human
agauaaaugugc

SEQ ID NO: 3367449 - RNA, 18 nt, Human
agauaacaagaucuuuca

SEQ ID NO: 3367450 - RNA, 17 nt, Human
aggcugggggagagccg

SEQ ID NO: 3367451 - RNA, 10 nt, Human
aggcuggguc

SEQ ID NO: 3367452 - RNA, 11 nt, Human
aggcugggugc

SEQ ID NO: 3367453 - RNA, 14 nt, Human
aggcuggguucuga

SEQ ID NO: 3367454 - RNA, 18 nt, Human
aggcuggguucugauccu

SEQ ID NO: 3367455 - RNA, 19 nt, Human
aggcugguacaacggaggc

SEQ ID NO: 3367456 - RNA, 17 nt, Human
aggcugguccuauggcc

SEQ ID NO: 3367457 - RNA, 20 nt, Human
aggcugguggagaacucugg

SEQ ID NO: 3367458 - RNA, 13 nt, Human
aggcugguggccc

SEQ ID NO: 3367459 - RNA, 14 nt, Human
aggcugguggccca

SEQ ID NO: 3367460 - RNA, 16 nt, Human
aggcugguggcccagg

SEQ ID NO: 3367461 - RNA, 14 nt, Human
aggcuggugggagg

SEQ ID NO: 3367462 - RNA, 17 nt, Human
aggcuggugggaggggc

SEQ ID NO: 3367463 - RNA, 18 nt, Human
aggcuguaucccaugagc

SEQ ID NO: 3367464 - RNA, 22 nt, Human
aggcuguaucccaugagccuca

SEQ ID NO: 3367465 - RNA, 24 nt, Human
aggcuguaucccaugagccucagc

SEQ ID NO: 3367466 - RNA, 20 nt, Human
aggcugucaguguuuggugc

SEQ ID NO: 3367467 - RNA, 15 nt, Human
aggcuguccuguaca

SEQ ID NO: 3367468 - RNA, 16 nt, Human
aggcuguccuguacau

SEQ ID NO: 3367469 - RNA, 21 nt, Human
aggcuguccuguacauugugg

SEQ ID NO: 3367470 - RNA, 15 nt, Human
aggcuguccuuaccc

SEQ ID NO: 3367471 - RNA, 19 nt, Human
aggcuguccuuacccaucu

SEQ ID NO: 3367472 - RNA, 22 nt, Human
aggcugucucagauaaauuaug

SEQ ID NO: 3367473 - RNA, 21 nt, Human
aggcugucuucucaggcucug

SEQ ID NO: 3367474 - RNA, 22 nt, Human
aggcugucuucucaggcucugc

SEQ ID NO: 3367475 - RNA, 20 nt, Human
aggcugugcucccugguucu

SEQ ID NO: 3367476 - RNA, 15 nt, Human
aggcugugcugcccu

SEQ ID NO: 3367477 - RNA, 21 nt, Human
aggcugugcugcccugaagaa

SEQ ID NO: 3367478 - RNA, 15 nt, Human
aggcuguggcuggug

SEQ ID NO: 3367479 - RNA, 17 nt, Human
aggcuguggcuggugag

SEQ ID NO: 3367480 - RNA, 21 nt, Human
aggcuguucugcacugaaaag

SEQ ID NO: 3367481 - RNA, 14 nt, Human
aggcuuaaacccau

SEQ ID NO: 3367482 - RNA, 14 nt, Human
aggcuuacacccac

SEQ ID NO: 3367483 - RNA, 14 nt, Human
aggcuuagacccuc

SEQ ID NO: 3367484 - RNA, 21 nt, Human
aggcuuagacccucaugcugc

SEQ ID NO: 3367485 - RNA, 19 nt, Human
aggcuuagcuuugcucugc

SEQ ID NO: 3367486 - RNA, 18 nt, Human
aggcuuagugauguaauu

SEQ ID NO: 3367487 - RNA, 14 nt, Human
aggcuuauauuugu

SEQ ID NO: 3367488 - RNA, 23 nt, Human
aggcuuccagagaguccucugga

SEQ ID NO: 3367489 - RNA, 21 nt, Human
aggcuuccugcguccuccuca

SEQ ID NO: 3367490 - RNA, 14 nt, Human
aggcuuccuucauu

SEQ ID NO: 3367491 - RNA, 16 nt, Human
aggcuuccuucauuuc

SEQ ID NO: 3367492 - RNA, 18 nt, Human
aggcuuccuucauuuccu

SEQ ID NO: 3367493 - RNA, 16 nt, Human
aggcuucuccgccagc

SEQ ID NO: 3367494 - RNA, 12 nt, Human
aggcuucucucu

SEQ ID NO: 3367495 - RNA, 13 nt, Human
aggcuucucucuc

SEQ ID NO: 3367496 - RNA, 16 nt, Human
aggcuucucucugugg

SEQ ID NO: 3367497 - RNA, 15 nt, Human
aggcuucugagcagc

SEQ ID NO: 3367498 - RNA, 14 nt, Human
aggcuucugcuggg

SEQ ID NO: 3367499 - RNA, 19 nt, Human
aggcuucugcuggggccug

SEQ ID NO: 3367500 - RNA, 23 nt, Human
aggcuucugguugaugccuguga

SEQ ID NO: 3367501 - RNA, 18 nt, Human
aggcuugcauaauaagcu

SEQ ID NO: 3367502 - RNA, 14 nt, Human
aggcuugcugagag

SEQ ID NO: 3367503 - RNA, 19 nt, Human
aggcuugguuccuucccaa

SEQ ID NO: 3367504 - RNA, 15 nt, Human
aggcuugucagagcu

SEQ ID NO: 3367505 - RNA, 21 nt, Human
aggcuuguuccaaugccacau

SEQ ID NO: 3367506 - RNA, 14 nt, Human
aggcuuguugugcu

SEQ ID NO: 3367507 - RNA, 15 nt, Human
aggcuuguugugcuu

SEQ ID NO: 3367508 - RNA, 22 nt, Human
aggcuuuaugauaauagauucu

SEQ ID NO: 3367509 - RNA, 23 nt, Human
aggcuuuaugauaauagauucuc

SEQ ID NO: 3367510 - RNA, 15 nt, Human
aggcuuucacuauuu

SEQ ID NO: 3367511 - RNA, 20 nt, Human
aggcuuucacuauuuccuuu

SEQ ID NO: 3367512 - RNA, 13 nt, Human
aggcuuucagcuu

SEQ ID NO: 3367513 - RNA, 22 nt, Human
aggcuuucccacuucccacccu

SEQ ID NO: 3367514 - RNA, 13 nt, Human
aggcuuugcccug

SEQ ID NO: 3367515 - RNA, 18 nt, Human
aggcuuugcccugcugcc

SEQ ID NO: 3367516 - RNA, 18 nt, Human
aggcuuugguaacugcgg

SEQ ID NO: 3367517 - RNA, 15 nt, Human
aggcuuuguguugua

SEQ ID NO: 3367518 - RNA, 17 nt, Human
aggcuuuuuuccagacu

SEQ ID NO: 3367519 - RNA, 16 nt, Human
agggaaaagcagcucu

SEQ ID NO: 3367520 - RNA, 18 nt, Human
agggaaaauaggcaggaa

SEQ ID NO: 3367521 - RNA, 11 nt, Human
agggaaaccuu

SEQ ID NO: 3367522 - RNA, 12 nt, Human
agggaaaccuuu

SEQ ID NO: 3367523 - RNA, 15 nt, Human
agggaaacgugcccu

SEQ ID NO: 3367524 - RNA, 15 nt, Human
agggaaacugccagc

SEQ ID NO: 3367525 - RNA, 15 nt, Human
agggaaacuucccgu

SEQ ID NO: 3367526 - RNA, 12 nt, Human
agggaaagaaaa

SEQ ID NO: 3367527 - RNA, 13 nt, Human
agggaaagaaaau

SEQ ID NO: 3367528 - RNA, 18 nt, Human
agggaaaggccagcacuc

SEQ ID NO: 3367529 - RNA, 22 nt, Human
agggaaauagaaaaacccugcc

SEQ ID NO: 3367530 - RNA, 13 nt, Human
agggaacagacag

SEQ ID NO: 3367531 - RNA, 14 nt, Human
agggaacagacagg

SEQ ID NO: 3367532 - RNA, 15 nt, Human
agggaacagacagga

SEQ ID NO: 3367533 - RNA, 17 nt, Human
agggaacagacaggaga

SEQ ID NO: 3367534 - RNA, 21 nt, Human
agggaacagacaggagaaaug

SEQ ID NO: 3367535 - RNA, 14 nt, Human
agggaacaggaaaa

SEQ ID NO: 3367536 - RNA, 14 nt, Human
agggaacagggcgg

SEQ ID NO: 3367537 - RNA, 22 nt, Human
agggaacccagcucuaauacau

SEQ ID NO: 3367538 - RNA, 19 nt, Human
agggaaccguuauuauaau

SEQ ID NO: 3367539 - RNA, 19 nt, Human
agggaacgggguccuucaa

SEQ ID NO: 3367540 - RNA, 16 nt, Human
agggaacuaggaaggc

SEQ ID NO: 3367541 - RNA, 13 nt, Human
agggaagaaacug

SEQ ID NO: 3367542 - RNA, 15 nt, Human
agggaagaaggagga

SEQ ID NO: 3367543 - RNA, 19 nt, Human
agggaagaauaaagagcug

SEQ ID NO: 3367544 - RNA, 13 nt, Human
agggaagagaaac

SEQ ID NO: 3367545 - RNA, 12 nt, Human
agggaagagcag

SEQ ID NO: 3367546 - RNA, 21 nt, Human
agggaagcuacagguuacaac

SEQ ID NO: 3367547 - RNA, 16 nt, Human
agggaagcuggccgag

SEQ ID NO: 3367548 - RNA, 17 nt, Human
agggaagcuggccugag

SEQ ID NO: 3367549 - RNA, 13 nt, Human
agggaaggacaga

SEQ ID NO: 3367550 - RNA, 14 nt, Human
agggaaggacagaa

SEQ ID NO: 3367551 - RNA, 17 nt, Human
agggaaggaggagccug

SEQ ID NO: 3367552 - RNA, 23 nt, Human
agggaaggaucccaugagcuccu

SEQ ID NO: 3367553 - RNA, 15 nt, Human
agggaaggcaggcag

SEQ ID NO: 3367554 - RNA, 16 nt, Human
agggaaggccaccugc

SEQ ID NO: 3367555 - RNA, 13 nt, Human
agggaaggccuga

SEQ ID NO: 3367556 - RNA, 14 nt, Human
agggaaggccugac

SEQ ID NO: 3367557 - RNA, 19 nt, Human
agggaaggcuggacuaggc

SEQ ID NO: 3367558 - RNA, 20 nt, Human
agggaagggagccaagggau

SEQ ID NO: 3367559 - RNA, 16 nt, Human
agggaagggccugcca

SEQ ID NO: 3367560 - RNA, 18 nt, Human
agggaagggccugccaca

SEQ ID NO: 3367561 - RNA, 13 nt, Human
agggaaggggaca

SEQ ID NO: 3367562 - RNA, 20 nt, Human
agggaaggggaggcagccgg

SEQ ID NO: 3367563 - RNA, 21 nt, Human
agggaaggggaggcagccggc

SEQ ID NO: 3367564 - RNA, 12 nt, Human
agggaagggugg

SEQ ID NO: 3367565 - RNA, 17 nt, Human
agggaaguaguuaucau

SEQ ID NO: 3367566 - RNA, 20 nt, Human
agggaaguaguuaucauguu

SEQ ID NO: 3367567 - RNA, 23 nt, Human
agggaaguugcuggaaagagcau

SEQ ID NO: 3367568 - RNA, 13 nt, Human
agggaaguuuugu

SEQ ID NO: 3367569 - RNA, 23 nt, Human
agggaauaaaauccuaagacaca

SEQ ID NO: 3367570 - RNA, 15 nt, Human
agggaauccaagccu

SEQ ID NO: 3367571 - RNA, 15 nt, Human
aaaaaaguuauauag

SEQ ID NO: 3367572 - RNA, 20 nt, Human
aaaaaaguugcagcuguuuu

SEQ ID NO: 3367573 - RNA, 10 nt, Human
aaaaaauaca

SEQ ID NO: 3367574 - RNA, 13 nt, Human
aaaaaauacuauu

SEQ ID NO: 3367575 - RNA, 9 nt, Human
aaaaaauag

SEQ ID NO: 3367576 - RNA, 13 nt, Human
aaaaaauauuuau

SEQ ID NO: 3367577 - RNA, 15 nt, Human
aaaaaauauuuuccu

SEQ ID NO: 3367578 - RNA, 12 nt, Human
aaaaaaucaucu

SEQ ID NO: 3367579 - RNA, 14 nt, Human
aaaaaaucaucuau

SEQ ID NO: 3367580 - RNA, 13 nt, Human
aaaaaaucuaucc

SEQ ID NO: 3367581 - RNA, 11 nt, Human
aaaaaaucuuc

SEQ ID NO: 3367582 - RNA, 19 nt, Human
aaaaaaugaaauguuuuaa

SEQ ID NO: 3367583 - RNA, 14 nt, Human
aaaaaaugcucaca

SEQ ID NO: 3367584 - RNA, 20 nt, Human
aaaaaaugcugaacauugca

SEQ ID NO: 3367585 - RNA, 16 nt, Human
aaaaaauguauaugca

SEQ ID NO: 3367586 - RNA, 11 nt, Human
aaaaaauguug

SEQ ID NO: 3367587 - RNA, 22 nt, Human
aaaaaauuagaaauuggcugga

SEQ ID NO: 3367588 - RNA, 13 nt, Human
aaaaaauuggcau

SEQ ID NO: 3367589 - RNA, 12 nt, Human
aaaaaauuuaag

SEQ ID NO: 3367590 - RNA, 12 nt, Human
aaaaacaaagag

SEQ ID NO: 3367591 - RNA, 21 nt, Human
aaaaacaaagagcguugaagu

SEQ ID NO: 3367592 - RNA, 12 nt, Human
aaaaacaaccaa

SEQ ID NO: 3367593 - RNA, 15 nt, Human
aaaaacaccuagcuu

SEQ ID NO: 3367594 - RNA, 14 nt, Human
aaaaacagaggcca

SEQ ID NO: 3367595 - RNA, 15 nt, Human
aaaaacagcauugcu

SEQ ID NO: 3367596 - RNA, 17 nt, Human
aaaaacagcauugcuuu

SEQ ID NO: 3367597 - RNA, 14 nt, Human
aggcgggcucaagg

SEQ ID NO: 3367598 - RNA, 22 nt, Human
aggcggugcggcagggaagagg

SEQ ID NO: 3367599 - RNA, 20 nt, Human
aggcgguggacuugaacuuu

SEQ ID NO: 3367600 - RNA, 14 nt, Human
aggcggugggcacc

SEQ ID NO: 3367601 - RNA, 19 nt, Human
aggcgucaacgugcauuuu

SEQ ID NO: 3367602 - RNA, 18 nt, Human
aggcgucuguauauuuug

SEQ ID NO: 3367603 - RNA, 15 nt, Human
aggcguugcuuucac

SEQ ID NO: 3367604 - RNA, 12 nt, Human
aggcuaaaaugu

SEQ ID NO: 3367605 - RNA, 14 nt, Human
aggcuaaaauguuu

SEQ ID NO: 3367606 - RNA, 18 nt, Human
aggcuaaagcccagagac

SEQ ID NO: 3367607 - RNA, 21 nt, Human
aggcuaaagcccagagacagc

SEQ ID NO: 3367608 - RNA, 18 nt, Human
aggcuaaggcguggagcu

SEQ ID NO: 3367609 - RNA, 13 nt, Human
aggcuaaguuggg

SEQ ID NO: 3367610 - RNA, 13 nt, Human
aggcuaaugucaa

SEQ ID NO: 3367611 - RNA, 12 nt, Human
aggcuaauuuuu

SEQ ID NO: 3367612 - RNA, 23 nt, Human
aggcuaauuuuuuuguauuuuag

SEQ ID NO: 3367613 - RNA, 22 nt, Human
aggcuacaauuuucucccagga

SEQ ID NO: 3367614 - RNA, 13 nt, Human
aggcuacacugac

SEQ ID NO: 3367615 - RNA, 18 nt, Human
aggcuacacugacacugg

SEQ ID NO: 3367616 - RNA, 14 nt, Human
aggcuacagagaag

SEQ ID NO: 3367617 - RNA, 17 nt, Human
aggcuacagagaagccu

SEQ ID NO: 3367618 - RNA, 23 nt, Human
aggcuaccaacuuguauccaggc

SEQ ID NO: 3367619 - RNA, 13 nt, Human
aggcuaccuuugu

SEQ ID NO: 3367620 - RNA, 18 nt, Human
aggcuacuagaauucugu

SEQ ID NO: 3367621 - RNA, 22 nt, Human
aggcuacuagaauucuguauug

SEQ ID NO: 3367622 - RNA, 23 nt, Human
aggcuacuguaaggcaaucaugg

SEQ ID NO: 3367623 - RNA, 17 nt, Human
aggcuacugucagcucc

SEQ ID NO: 3367624 - RNA, 19 nt, Human
aggcuagaaccuggcaagc

SEQ ID NO: 3367625 - RNA, 15 nt, Human
aggcuagaucaugaa

SEQ ID NO: 3367626 - RNA, 16 nt, Human
aggcuagcuggagccu

SEQ ID NO: 3367627 - RNA, 17 nt, Human
aggcuagcuucugcuuu

SEQ ID NO: 3367628 - RNA, 18 nt, Human
aggcuagcuucugcuuuu

SEQ ID NO: 3367629 - RNA, 22 nt, Human
aggcuaguccggacccaccuca

SEQ ID NO: 3367630 - RNA, 23 nt, Human
aggcuagugugguguuuccuggc

SEQ ID NO: 3367631 - RNA, 22 nt, Human
aggcuauggggauagaugugug

SEQ ID NO: 3367632 - RNA, 16 nt, Human
aggcuauguauaaaau

SEQ ID NO: 3367633 - RNA, 19 nt, Human
aggcuauguauaaaauaca

SEQ ID NO: 3367634 - RNA, 20 nt, Human
aggcuauguauaaaauacau

SEQ ID NO: 3367635 - RNA, 21 nt, Human
aggcuauguauaaaauacaua

SEQ ID NO: 3367636 - RNA, 14 nt, Human
aggcuaugugauua

SEQ ID NO: 3367637 - RNA, 17 nt, Human
aggcuauuuguaaaucu

SEQ ID NO: 3367638 - RNA, 14 nt, Human
aggcuauuuucuaa

SEQ ID NO: 3367639 - RNA, 18 nt, Human
aggcuauuuucuaaagac

SEQ ID NO: 3367640 - RNA, 19 nt, Human
aggcuauuuucuaaagacu

SEQ ID NO: 3367641 - RNA, 15 nt, Human
aggcucaacaauaaa

SEQ ID NO: 3367642 - RNA, 19 nt, Human
aggcucacccccuucucca

SEQ ID NO: 3367643 - RNA, 23 nt, Human
aggcucacccccuucuccaucca

SEQ ID NO: 3367644 - RNA, 13 nt, Human
aggcucacugcca

SEQ ID NO: 3367645 - RNA, 16 nt, Human
aggcucacugccaggc

SEQ ID NO: 3367646 - RNA, 17 nt, Human
aggcucacugccaggcc

SEQ ID NO: 3367647 - RNA, 21 nt, Human
aggcucagagaugugcaccca

SEQ ID NO: 3367648 - RNA, 24 nt, Human
aggcucagagaugugcacccaugg

SEQ ID NO: 3367649 - RNA, 14 nt, Human
aggcucaggcaggg

SEQ ID NO: 3367650 - RNA, 20 nt, Human
aggcucaggcaggggccucc

SEQ ID NO: 3367651 - RNA, 13 nt, Human
aggcucaggccau

SEQ ID NO: 3367652 - RNA, 10 nt, Human
aggcucaggu

SEQ ID NO: 3367653 - RNA, 17 nt, Human
aggcucagucucaggag

SEQ ID NO: 3367654 - RNA, 23 nt, Human
aggcucagucucaggagcauggg

SEQ ID NO: 3367655 - RNA, 22 nt, Human
aggcucauagggaagaccugcu

SEQ ID NO: 3367656 - RNA, 18 nt, Human
aggcuccaggagcagcca

SEQ ID NO: 3367657 - RNA, 15 nt, Human
aggcuccaggcagca

SEQ ID NO: 3367658 - RNA, 22 nt, Human
aggcucccuccccauggggcag

SEQ ID NO: 3367659 - RNA, 14 nt, Human
aggcuccugccacc

SEQ ID NO: 3367660 - RNA, 13 nt, Human
aggcuccugugcu

SEQ ID NO: 3367661 - RNA, 12 nt, Human
aggcuccuguua

SEQ ID NO: 3367662 - RNA, 16 nt, Human
aggcuccuguuuugca

SEQ ID NO: 3367663 - RNA, 22 nt, Human
aggcuccuuaggguuuucucuc

SEQ ID NO: 3367664 - RNA, 20 nt, Human
aggcuccuucaacaaggcuu

SEQ ID NO: 3367665 - RNA, 16 nt, Human
aggcuccuuccugucu

SEQ ID NO: 3367666 - RNA, 23 nt, Human
aggcuccuuccugucuuccugca

SEQ ID NO: 3367667 - RNA, 19 nt, Human
aggcuccuuuagcgcccag

SEQ ID NO: 3367668 - RNA, 22 nt, Human
aggcucgauuuuguaucugcag

SEQ ID NO: 3367669 - RNA, 24 nt, Human
aggcucgccuucccuccugcuuug

SEQ ID NO: 3367670 - RNA, 19 nt, Human
aggcucuaugagucuagau

SEQ ID NO: 3367671 - RNA, 23 nt, Human
aggcucuauuccaauaaacuaug

SEQ ID NO: 3367672 - RNA, 20 nt, Human
aggcucucaacaggggagag

SEQ ID NO: 3367673 - RNA, 14 nt, Human
aggcucucaggcca

SEQ ID NO: 3367674 - RNA, 15 nt, Human
aggcucucaggccag

SEQ ID NO: 3367675 - RNA, 19 nt, Human
aggcucucaggccagcugc

SEQ ID NO: 3367676 - RNA, 15 nt, Human
aggcucucugggcug

SEQ ID NO: 3367677 - RNA, 13 nt, Human
aggcucugagagu

SEQ ID NO: 3367678 - RNA, 16 nt, Human
aggcucugagagucua

SEQ ID NO: 3367679 - RNA, 13 nt, Human
aggcucugcacag

SEQ ID NO: 3367680 - RNA, 17 nt, Human
aggcucugcccugcccu

SEQ ID NO: 3367681 - RNA, 23 nt, Human
aggcucugcccugcccuagcucc

SEQ ID NO: 3367682 - RNA, 13 nt, Human
aggcucuggagcc

SEQ ID NO: 3367683 - RNA, 19 nt, Human
aggcucuggagcccacugu

SEQ ID NO: 3367684 - RNA, 15 nt, Human
aggcucugucuggaa

SEQ ID NO: 3367685 - RNA, 13 nt, Human
aggcucugugcug

SEQ ID NO: 3367686 - RNA, 17 nt, Human
aggcucugugcugaccc

SEQ ID NO: 3367687 - RNA, 18 nt, Human
aggcucugugcugacccu

SEQ ID NO: 3367688 - RNA, 22 nt, Human
aggcucuuagcagcuuccagau

SEQ ID NO: 3367689 - RNA, 18 nt, Human
aggcucuucuccccagag

SEQ ID NO: 3367690 - RNA, 13 nt, Human
aggcucuucuccu

SEQ ID NO: 3367691 - RNA, 20 nt, Human
aggcucuuucugggccaagu

SEQ ID NO: 3367692 - RNA, 17 nt, Human
aggcugaaagaggccaa

SEQ ID NO: 3367693 - RNA, 21 nt, Human
aggcugaacuuguuuucuggg

SEQ ID NO: 3367694 - RNA, 14 nt, Human
aggcugaccaagag

SEQ ID NO: 3367695 - RNA, 18 nt, Human
aggcugaccaagagagaa

SEQ ID NO: 3367696 - RNA, 22 nt, Human
aggcugaccaagagagaaagaa

SEQ ID NO: 3367697 - RNA, 21 nt, Human
aggcugaccacagcacagcca

SEQ ID NO: 3367698 - RNA, 13 nt, Human
aggcugagacagg

SEQ ID NO: 3367699 - RNA, 15 nt, Human
aggcugaggaaaggc

SEQ ID NO: 3367700 - RNA, 19 nt, Human
aggcugaggaaaggccagc

SEQ ID NO: 3367701 - RNA, 13 nt, Human
aggcugaggacuu

SEQ ID NO: 3367702 - RNA, 11 nt, Human
aggcugaggca

SEQ ID NO: 3367703 - RNA, 14 nt, Human
aggcugaggcagga

SEQ ID NO: 3367704 - RNA, 18 nt, Human
aggcugaggcaggagaau

SEQ ID NO: 3367705 - RNA, 13 nt, Human
aggcugaggccug

SEQ ID NO: 3367706 - RNA, 17 nt, Human
aggcugaggcuggcaca

SEQ ID NO: 3367707 - RNA, 22 nt, Human
aggcugaggggaggaucacugg

SEQ ID NO: 3367708 - RNA, 17 nt, Human
aggcugagugcaggccc

SEQ ID NO: 3367709 - RNA, 20 nt, Human
aggcugauaauuccaguggu

SEQ ID NO: 3367710 - RNA, 23 nt, Human
aggcugaugccaaguuguuugag

SEQ ID NO: 3367711 - RNA, 21 nt, Human
aggcugaugucaauuucugug

SEQ ID NO: 3367712 - RNA, 18 nt, Human
aggcugcagccaggccac

SEQ ID NO: 3367713 - RNA, 15 nt, Human
aggcugcagcuggac

SEQ ID NO: 3367714 - RNA, 17 nt, Human
aggcugcagugagccga

SEQ ID NO: 3367715 - RNA, 19 nt, Human
aggcugcagugagccgaga

SEQ ID NO: 3367716 - RNA, 15 nt, Human
aggcugcauagaagg

SEQ ID NO: 3367717 - RNA, 17 nt, Human
aggcugcauagaaggag

SEQ ID NO: 3367718 - RNA, 22 nt, Human
aggcugcauugaaaagagcuga

SEQ ID NO: 3367719 - RNA, 15 nt, Human
aggcugccagugccu

SEQ ID NO: 3367720 - RNA, 15 nt, Human
aggcugcccccggcc

SEQ ID NO: 3367721 - RNA, 22 nt, Human
aggcugcccccggcccccuggu

SEQ ID NO: 3367722 - RNA, 12 nt, Human
aggcugcccucc

SEQ ID NO: 3367723 - RNA, 22 nt, Human
aggcugcccuccugugcucagc

SEQ ID NO: 3367724 - RNA, 13 nt, Human
aggcugccuccca

SEQ ID NO: 3367725 - RNA, 14 nt, Human
aggcugccucccaa

SEQ ID NO: 3367726 - RNA, 12 nt, Human
aggcugccugag

SEQ ID NO: 3367727 - RNA, 22 nt, Human
agggaauccaagccuccacagc

SEQ ID NO: 3367728 - RNA, 16 nt, Human
agggaauccccgaagg

SEQ ID NO: 3367729 - RNA, 18 nt, Human
agggaaugaaccuggagg

SEQ ID NO: 3367730 - RNA, 15 nt, Human
agggaauucucuugg

SEQ ID NO: 3367731 - RNA, 18 nt, Human
agggaauugaggucugcu

SEQ ID NO: 3367732 - RNA, 16 nt, Human
agggaauuucuaucua

SEQ ID NO: 3367733 - RNA, 17 nt, Human
agggacaaaggagccug

SEQ ID NO: 3367734 - RNA, 19 nt, Human
agggacaaaggagccugug

SEQ ID NO: 3367735 - RNA, 20 nt, Human
agggacaccagccaggcucu

SEQ ID NO: 3367736 - RNA, 20 nt, Human
agggacagagacaccugcac

SEQ ID NO: 3367737 - RNA, 22 nt, Human
agggacagaggccccagccucc

SEQ ID NO: 3367738 - RNA, 12 nt, Human
agggacagaggg

SEQ ID NO: 3367739 - RNA, 22 nt, Human
agggacagaggggguggccucc

SEQ ID NO: 3367740 - RNA, 22 nt, Human
agggacagaugaaugccgugga

SEQ ID NO: 3367741 - RNA, 16 nt, Human
agggaggaguggaggu

SEQ ID NO: 3367742 - RNA, 13 nt, Human
agggaggcaagcc

SEQ ID NO: 3367743 - RNA, 14 nt, Human
agggaggcccagcg

SEQ ID NO: 3367744 - RNA, 19 nt, Human
agggagggcagagcuggug

SEQ ID NO: 3367745 - RNA, 17 nt, Human
agggagggcaguuuucu

SEQ ID NO: 3367746 - RNA, 14 nt, Human
agggagggcuccag

SEQ ID NO: 3367747 - RNA, 17 nt, Human
agggagggcuccagaca

SEQ ID NO: 3367748 - RNA, 15 nt, Human
agggagggcucugag

SEQ ID NO: 3367749 - RNA, 15 nt, Human
agggagggcugucau

SEQ ID NO: 3367750 - RNA, 21 nt, Human
agggaggggaaaagcauuuuu

SEQ ID NO: 3367751 - RNA, 17 nt, Human
agggaggggccggcccu

SEQ ID NO: 3367752 - RNA, 21 nt, Human
agggaggucacuggaaagggg

SEQ ID NO: 3367753 - RNA, 16 nt, Human
agggaggucaggcccu

SEQ ID NO: 3367754 - RNA, 22 nt, Human
agggagguguuuaaagagaggu

SEQ ID NO: 3367755 - RNA, 17 nt, Human
agggagguuugugagag

SEQ ID NO: 3367756 - RNA, 23 nt, Human
agggaguccgaaagggacuugga

SEQ ID NO: 3367757 - RNA, 20 nt, Human
agggagugacagaggcagcc

SEQ ID NO: 3367758 - RNA, 16 nt, Human
agggaguguacuccca

SEQ ID NO: 3367759 - RNA, 21 nt, Human
agggaguuaucuaaaagaaau

SEQ ID NO: 3367760 - RNA, 14 nt, Human
agggauacacugaa

SEQ ID NO: 3367761 - RNA, 16 nt, Human
agggauacccagugau

SEQ ID NO: 3367762 - RNA, 19 nt, Human
agggauagucaccuuuuaa

SEQ ID NO: 3367763 - RNA, 21 nt, Human
agggauagucaccuuuuaaau

SEQ ID NO: 3367764 - RNA, 22 nt, Human
agggauagucaccuuuuaaauc

SEQ ID NO: 3367765 - RNA, 22 nt, Human
agggaucaaccagcuaagaaaa

SEQ ID NO: 3367766 - RNA, 17 nt, Human
agggaucacagggcccc

SEQ ID NO: 3367767 - RNA, 16 nt, Human
agggaucccucaucug

SEQ ID NO: 3367768 - RNA, 18 nt, Human
agggaucuauacuugcuu

SEQ ID NO: 3367769 - RNA, 19 nt, Human
agggaucuauacuugcuuu

SEQ ID NO: 3367770 - RNA, 22 nt, Human
agggaucugguccuacccaucc

SEQ ID NO: 3367771 - RNA, 16 nt, Human
agggaugaauuguaaa

SEQ ID NO: 3367772 - RNA, 21 nt, Human
agggucuuuucaucugggaaa

SEQ ID NO: 3367773 - RNA, 15 nt, Human
agggugaaaauuauu

SEQ ID NO: 3367774 - RNA, 12 nt, Human
agggugagccca

SEQ ID NO: 3367775 - RNA, 13 nt, Human
agggugaggaugg

SEQ ID NO: 3367776 - RNA, 18 nt, Human
agggugaguccuccagaa

SEQ ID NO: 3367777 - RNA, 14 nt, Human
agggugaugccagg

SEQ ID NO: 3367778 - RNA, 14 nt, Human
agggugcagcccaa

SEQ ID NO: 3367779 - RNA, 24 nt, Human
agggugccguguccccugacaggg

SEQ ID NO: 3367780 - RNA, 23 nt, Human
agggugcuacguacaugugaggc

SEQ ID NO: 3367781 - RNA, 21 nt, Human
aggguggagacuaagcccugu

SEQ ID NO: 3367782 - RNA, 13 nt, Human
aggguggcagcaa

SEQ ID NO: 3367783 - RNA, 15 nt, Human
aggguggcaucccag

SEQ ID NO: 3367784 - RNA, 22 nt, Human
aggguggccacaccucuauccc

SEQ ID NO: 3367785 - RNA, 21 nt, Human
aggguggcuggguccagggga

SEQ ID NO: 3367786 - RNA, 17 nt, Human
agggugggauggaggag

SEQ ID NO: 3367787 - RNA, 18 nt, Human
agggugggauggaggaga

SEQ ID NO: 3367788 - RNA, 14 nt, Human
agggugggcuucag

SEQ ID NO: 3367789 - RNA, 22 nt, Human
agggugggcuuguggggccugg

SEQ ID NO: 3367790 - RNA, 23 nt, Human
agggugggcuuguggggccuggg

SEQ ID NO: 3367791 - RNA, 18 nt, Human
agggugggggccaccugc

SEQ ID NO: 3367792 - RNA, 19 nt, Human
agggugggggccaccugcc

SEQ ID NO: 3367793 - RNA, 22 nt, Human
agggugggggccaccugccugc

SEQ ID NO: 3367794 - RNA, 21 nt, Human
aggguggggggggggcgcggc

SEQ ID NO: 3367795 - RNA, 18 nt, Human
agggugggugcucagaau

SEQ ID NO: 3367796 - RNA, 14 nt, Human
aggguggugcuggg

SEQ ID NO: 3367797 - RNA, 16 nt, Human
aggguggugcugggac

SEQ ID NO: 3367798 - RNA, 17 nt, Human
aggguggugcugggacu

SEQ ID NO: 3367799 - RNA, 22 nt, Human
aggguguccggucccuguccca

SEQ ID NO: 3367800 - RNA, 21 nt, Human
aggguguugggauacugcagg

SEQ ID NO: 3367801 - RNA, 17 nt, Human
aggguuaagaaaagaga

SEQ ID NO: 3367802 - RNA, 18 nt, Human
aggguuacuaugcacaau

SEQ ID NO: 3367803 - RNA, 16 nt, Human
aggguuagggaggggu

SEQ ID NO: 3367804 - RNA, 13 nt, Human
aggguuauaauaa

SEQ ID NO: 3367805 - RNA, 16 nt, Human
aggguucagagacuca

SEQ ID NO: 3367806 - RNA, 15 nt, Human
aggguucccccagcc

SEQ ID NO: 3367807 - RNA, 18 nt, Human
aggguucccccagcccug

SEQ ID NO: 3367808 - RNA, 16 nt, Human
aggguucugccucucc

SEQ ID NO: 3367809 - RNA, 14 nt, Human
aggguucuggcugc

SEQ ID NO: 3367810 - RNA, 17 nt, Human
aggguugaccccagagg

SEQ ID NO: 3367811 - RNA, 18 nt, Human
aggguugauuaaggcagu

SEQ ID NO: 3367812 - RNA, 13 nt, Human
aggguuggccccu

SEQ ID NO: 3367813 - RNA, 14 nt, Human
aggguuggccccug

SEQ ID NO: 3367814 - RNA, 23 nt, Human
aggguuggccccugcccggcugc

SEQ ID NO: 3367815 - RNA, 18 nt, Human
aggguuggccugaguuag

SEQ ID NO: 3367816 - RNA, 19 nt, Human
aggguugggaaaauccaaa

SEQ ID NO: 3367817 - RNA, 15 nt, Human
aggguugggcccaga

SEQ ID NO: 3367818 - RNA, 13 nt, Human
aggguugggcugg

SEQ ID NO: 3367819 - RNA, 15 nt, Human
aggguuggggagggg

SEQ ID NO: 3367820 - RNA, 23 nt, Human
aggguuggguucaucugagcaag

SEQ ID NO: 3367821 - RNA, 19 nt, Human
aggguugugauuuugucug

SEQ ID NO: 3367822 - RNA, 22 nt, Human
aggguugugauuuugucugcuu

SEQ ID NO: 3367823 - RNA, 21 nt, Human
aggguuguuaauggugcaaau

SEQ ID NO: 3367824 - RNA, 21 nt, Human
aggguuuaauccccaguaaaa

SEQ ID NO: 3367825 - RNA, 15 nt, Human
aggguuucaccaugu

SEQ ID NO: 3367826 - RNA, 15 nt, Human
aggguuucauugucu

SEQ ID NO: 3367827 - RNA, 21 nt, Human
aggguuucccuacugaagccc

SEQ ID NO: 3367828 - RNA, 14 nt, Human
aggguuucucuauu

SEQ ID NO: 3367829 - RNA, 22 nt, Human
aggguuugaauuguuuucuuua

SEQ ID NO: 3367830 - RNA, 23 nt, Human
aggguuugaauuguuuucuuuaa

SEQ ID NO: 3367831 - RNA, 21 nt, Human
aggguuuggcugugucuaaac

SEQ ID NO: 3367832 - RNA, 23 nt, Human
aggguuuggcugugucuaaacug

SEQ ID NO: 3367833 - RNA, 17 nt, Human
aggguuuuaauguagau

SEQ ID NO: 3367834 - RNA, 14 nt, Human
aggguuuuccaaug

SEQ ID NO: 3367835 - RNA, 15 nt, Human
aggguuuuccacccu

SEQ ID NO: 3367836 - RNA, 23 nt, Human
aggguuuugccauguuggccagg

SEQ ID NO: 3367837 - RNA, 14 nt, Human
agguaaaacaaaac

SEQ ID NO: 3367838 - RNA, 22 nt, Human
agguaaaacaaaacaaaacaac

SEQ ID NO: 3367839 - RNA, 20 nt, Human
agguaaaagcaucacaugaa

SEQ ID NO: 3367840 - RNA, 15 nt, Human
agguaaaauguauuu

SEQ ID NO: 3367841 - RNA, 15 nt, Human
agguaaaauucuaaa

SEQ ID NO: 3367842 - RNA, 14 nt, Human
agguaacagaacag

SEQ ID NO: 3367843 - RNA, 18 nt, Human
agguaacagaacagcuuc

SEQ ID NO: 3367844 - RNA, 19 nt, Human
agguaacuaacugcauaca

SEQ ID NO: 3367845 - RNA, 21 nt, Human
agguaagcaggaggaggugcc

SEQ ID NO: 3367846 - RNA, 16 nt, Human
agguaaggugaaggug

SEQ ID NO: 3367847 - RNA, 13 nt, Human
agguaaguuuuuu

SEQ ID NO: 3367848 - RNA, 18 nt, Human
agguaaucaaugaauauu

SEQ ID NO: 3367849 - RNA, 17 nt, Human
agguaaucgaccugccu

SEQ ID NO: 3367850 - RNA, 21 nt, Human
agguaaucgaccugccucggc

SEQ ID NO: 3367851 - RNA, 13 nt, Human
agguaaugaggga

SEQ ID NO: 3367852 - RNA, 14 nt, Human
agguaauggcauga

SEQ ID NO: 3367853 - RNA, 19 nt, Human
agguaauuucuugugccuc

SEQ ID NO: 3367854 - RNA, 23 nt, Human
agguaauuuuuacccuaaugucu

SEQ ID NO: 3367855 - RNA, 16 nt, Human
agguacagagaaggaa

SEQ ID NO: 3367856 - RNA, 23 nt, Human
agguaccagcugcgcuugcuuuu

SEQ ID NO: 3367857 - RNA, 21 nt, Human
agguaccccuuucuggcucuc

SEQ ID NO: 3367858 - RNA, 16 nt, Human
agguaccgucuacauu

SEQ ID NO: 3367859 - RNA, 22 nt, Human
agguacgaaaagaggggaagag

SEQ ID NO: 3367860 - RNA, 19 nt, Human
agguacgaugacaguguuc

SEQ ID NO: 3367861 - RNA, 15 nt, Human
agguacgcacagaca

SEQ ID NO: 3367862 - RNA, 16 nt, Human
agguacgcacagacag

SEQ ID NO: 3367863 - RNA, 15 nt, Human
agguacuaaauaccu

SEQ ID NO: 3367864 - RNA, 16 nt, Human
agguacuagaaugcuu

SEQ ID NO: 3367865 - RNA, 22 nt, Human
agguacuguaugaucaaauguu

SEQ ID NO: 3367866 - RNA, 22 nt, Human
agguacugucaugggcuaggca

SEQ ID NO: 3367867 - RNA, 23 nt, Human
agguacuuucauauuuuaaacag

SEQ ID NO: 3367868 - RNA, 17 nt, Human
agguagaaaaaggguca

SEQ ID NO: 3367869 - RNA, 19 nt, Human
agguagaaauaucugaaaa

SEQ ID NO: 3367870 - RNA, 21 nt, Human
agguagaaugaccuuguaaug

SEQ ID NO: 3367871 - RNA, 19 nt, Human
agguagaauguaaagcuug

SEQ ID NO: 3367872 - RNA, 22 nt, Human
agguagaauuaucuaauuuaua

SEQ ID NO: 3367873 - RNA, 20 nt, Human
agguagacuuuuaugagaac

SEQ ID NO: 3367874 - RNA, 18 nt, Human
agguagagccacaaaaga

SEQ ID NO: 3367875 - RNA, 20 nt, Human
agguagaguuugaaggaggu

SEQ ID NO: 3367876 - RNA, 20 nt, Human
agguagauguucagauugcu

SEQ ID NO: 3367877 - RNA, 19 nt, Human
agguagcugccccuggcuc

SEQ ID NO: 3367878 - RNA, 18 nt, Human
agguagcuuaccugacac

SEQ ID NO: 3367879 - RNA, 19 nt, Human
agguagcuuaccugacaca

SEQ ID NO: 3367880 - RNA, 13 nt, Human
agguagcuucagc

SEQ ID NO: 3367881 - RNA, 23 nt, Human
agguaggccaagguguccuacag

SEQ ID NO: 3367882 - RNA, 12 nt, Human
agguaggguuua

SEQ ID NO: 3367883 - RNA, 15 nt, Human
agguauaauaaaauu

SEQ ID NO: 3367884 - RNA, 21 nt, Human
agcaaccgccucaaaaugugu

SEQ ID NO: 3367885 - RNA, 16 nt, Human
agcaaccguggcccuu

SEQ ID NO: 3367886 - RNA, 20 nt, Human
agcaaccuggguccaaauaa

SEQ ID NO: 3367887 - RNA, 21 nt, Human
agcaaccuggguccaaauaaa

SEQ ID NO: 3367888 - RNA, 20 nt, Human
agcaacgcuauuccagcugu

SEQ ID NO: 3367889 - RNA, 14 nt, Human
agcaacgcuuguag

SEQ ID NO: 3367890 - RNA, 17 nt, Human
agcaacgcuuguagaac

SEQ ID NO: 3367891 - RNA, 11 nt, Human
agcaacuauuc

SEQ ID NO: 3367892 - RNA, 16 nt, Human
agcaacucuugauuau

SEQ ID NO: 3367893 - RNA, 21 nt, Human
agcaacugaauaaauaccucu

SEQ ID NO: 3367894 - RNA, 22 nt, Human
agcaacugaauaaauaccucuu

SEQ ID NO: 3367895 - RNA, 17 nt, Human
agcaacugucuauuucu

SEQ ID NO: 3367896 - RNA, 20 nt, Human
agcaacugucuauuucugcu

SEQ ID NO: 3367897 - RNA, 17 nt, Human
agcaacuguuaugaaau

SEQ ID NO: 3367898 - RNA, 12 nt, Human
agcaacuugaac

SEQ ID NO: 3367899 - RNA, 21 nt, Human
agcaacuuguccuagcacaga

SEQ ID NO: 3367900 - RNA, 17 nt, Human
agcaacuuguucguggg

SEQ ID NO: 3367901 - RNA, 13 nt, Human
agcaacuuucuua

SEQ ID NO: 3367902 - RNA, 15 nt, Human
agcaacuuuugugua

SEQ ID NO: 3367903 - RNA, 20 nt, Human
agcaacuuuuguguaaugaa

SEQ ID NO: 3367904 - RNA, 18 nt, Human
agcaagaaaaaaaaaugc

SEQ ID NO: 3367905 - RNA, 15 nt, Human
agcaagaaagaaacc

SEQ ID NO: 3367906 - RNA, 21 nt, Human
agcaagacccuaaacauccau

SEQ ID NO: 3367907 - RNA, 21 nt, Human
agcaagacgcugugcugcccu

SEQ ID NO: 3367908 - RNA, 23 nt, Human
agcaagacgcugugcugcccugc

SEQ ID NO: 3367909 - RNA, 14 nt, Human
agcaagagagaacc

SEQ ID NO: 3367910 - RNA, 13 nt, Human
agcaagagcuggc

SEQ ID NO: 3367911 - RNA, 15 nt, Human
agcaagauaaacauu

SEQ ID NO: 3367912 - RNA, 15 nt, Human
agcaagcaagaggcc

SEQ ID NO: 3367913 - RNA, 20 nt, Human
agcaagcccuacagagcugu

SEQ ID NO: 3367914 - RNA, 12 nt, Human
agcaagcuggcc

SEQ ID NO: 3367915 - RNA, 13 nt, Human
agcaagcuggccu

SEQ ID NO: 3367916 - RNA, 16 nt, Human
agcaaggaagguaaaa

SEQ ID NO: 3367917 - RNA, 16 nt, Human
agcaaggaggcuggcu

SEQ ID NO: 3367918 - RNA, 22 nt, Human
agcaaggaggcuggcuggggcc

SEQ ID NO: 3367919 - RNA, 15 nt, Human
agcaaggaucuuuca

SEQ ID NO: 3367920 - RNA, 16 nt, Human
agcaaggcaccugcag

SEQ ID NO: 3367921 - RNA, 12 nt, Human
agcaaggccacc

SEQ ID NO: 3367922 - RNA, 14 nt, Human
agcaaggccaccuc

SEQ ID NO: 3367923 - RNA, 12 nt, Human
agcaaggcccga

SEQ ID NO: 3367924 - RNA, 14 nt, Human
agcaaggcccgagc

SEQ ID NO: 3367925 - RNA, 21 nt, Human
agcaaggcccgagcagcugag

SEQ ID NO: 3367926 - RNA, 17 nt, Human
agggaugaggugcuggg

SEQ ID NO: 3367927 - RNA, 16 nt, Human
agggaugaugccacac

SEQ ID NO: 3367928 - RNA, 19 nt, Human
agggaugauucaagccauu

SEQ ID NO: 3367929 - RNA, 19 nt, Human
agggaugcccuggaggugg

SEQ ID NO: 3367930 - RNA, 16 nt, Human
agggaugguguucaaa

SEQ ID NO: 3367931 - RNA, 23 nt, Human
agggaugugaauugccugcagag

SEQ ID NO: 3367932 - RNA, 22 nt, Human
agggauguggguuccacagacg

SEQ ID NO: 3367933 - RNA, 17 nt, Human
agggauuaaccucugca

SEQ ID NO: 3367934 - RNA, 14 nt, Human
agggauucaggcug

SEQ ID NO: 3367935 - RNA, 17 nt, Human
agggauuccccuaaccu

SEQ ID NO: 3367936 - RNA, 19 nt, Human
agggauuuuagucacacgu

SEQ ID NO: 3367937 - RNA, 17 nt, Human
agggauuuucagcccuc

SEQ ID NO: 3367938 - RNA, 23 nt, Human
agggcaaaauauucacugggcca

SEQ ID NO: 3367939 - RNA, 11 nt, Human
agggcaaagcc

SEQ ID NO: 3367940 - RNA, 13 nt, Human
agggcaaaucugc

SEQ ID NO: 3367941 - RNA, 18 nt, Human
agggcaaaugacaugcac

SEQ ID NO: 3367942 - RNA, 20 nt, Human
agggcaacaauaaaauagca

SEQ ID NO: 3367943 - RNA, 17 nt, Human
agggcaagcuccgcagg

SEQ ID NO: 3367944 - RNA, 19 nt, Human
agggcaagcuccgcaggac

SEQ ID NO: 3367945 - RNA, 20 nt, Human
agggcaagcuccgcaggacu

SEQ ID NO: 3367946 - RNA, 16 nt, Human
agggcaagggguuccc

SEQ ID NO: 3367947 - RNA, 20 nt, Human
agggcacaaguccuggaugu

SEQ ID NO: 3367948 - RNA, 21 nt, Human
agggcacaccgggcacucaga

SEQ ID NO: 3367949 - RNA, 19 nt, Human
agggcacagcaucuguagu

SEQ ID NO: 3367950 - RNA, 15 nt, Human
agggcacaggagcua

SEQ ID NO: 3367951 - RNA, 17 nt, Human
agggcacaggccaugga

SEQ ID NO: 3367952 - RNA, 13 nt, Human
agggcacagggcc

SEQ ID NO: 3367953 - RNA, 14 nt, Human
agggcacagggccu

SEQ ID NO: 3367954 - RNA, 15 nt, Human
agggcacagggccug

SEQ ID NO: 3367955 - RNA, 16 nt, Human
agggcacagggccugg

SEQ ID NO: 3367956 - RNA, 17 nt, Human
agggcacagggccuggc

SEQ ID NO: 3367957 - RNA, 18 nt, Human
agggcacagggccuggcc

SEQ ID NO: 3367958 - RNA, 20 nt, Human
agggcacagggccuggccca

SEQ ID NO: 3367959 - RNA, 20 nt, Human
agggcacauuccuugccugc

SEQ ID NO: 3367960 - RNA, 19 nt, Human
agggcaccagggguuucuc

SEQ ID NO: 3367961 - RNA, 21 nt, Human
agggcaccagggguuucucgc

SEQ ID NO: 3367962 - RNA, 13 nt, Human
agggcacugggcu

SEQ ID NO: 3367963 - RNA, 14 nt, Human
agggcacugguggc

SEQ ID NO: 3367964 - RNA, 17 nt, Human
agggcacugguggcccg

SEQ ID NO: 3367965 - RNA, 17 nt, Human
agggcacuucacagagu

SEQ ID NO: 3367966 - RNA, 20 nt, Human
agggcagaaagguucugccc

SEQ ID NO: 3367967 - RNA, 15 nt, Human
agggcagacuggggc

SEQ ID NO: 3367968 - RNA, 13 nt, Human
agggcagagcugg

SEQ ID NO: 3367969 - RNA, 17 nt, Human
agggcagagcuggugcg

SEQ ID NO: 3367970 - RNA, 16 nt, Human
agggcagcacacggcc

SEQ ID NO: 3367971 - RNA, 18 nt, Human
agggcagcagccagcccu

SEQ ID NO: 3367972 - RNA, 13 nt, Human
agggcagccaggg

SEQ ID NO: 3367973 - RNA, 19 nt, Human
agggcagccagggagagcc

SEQ ID NO: 3367974 - RNA, 15 nt, Human
agggcagccugccug

SEQ ID NO: 3367975 - RNA, 14 nt, Human
agggcagcgccagg

SEQ ID NO: 3367976 - RNA, 17 nt, Human
agggcagcgccaggcug

SEQ ID NO: 3367977 - RNA, 23 nt, Human
agggcagcgggagccucccugcc

SEQ ID NO: 3367978 - RNA, 12 nt, Human
agggcagcugcu

SEQ ID NO: 3367979 - RNA, 17 nt, Human
agggcagcuugccccgg

SEQ ID NO: 3367980 - RNA, 23 nt, Human
agggcagcuugccccggccccgg

SEQ ID NO: 3367981 - RNA, 17 nt, Human
agggcagcuuugcucau

SEQ ID NO: 3367982 - RNA, 21 nt, Human
agggcaggaaggagagccugc

SEQ ID NO: 3367983 - RNA, 13 nt, Human
agggcaggaccag

SEQ ID NO: 3367984 - RNA, 14 nt, Human
agggcaggaccagc

SEQ ID NO: 3367985 - RNA, 20 nt, Human
agggcaggcccaaauuauca

SEQ ID NO: 3367986 - RNA, 17 nt, Human
agggcagggcaucuccu

SEQ ID NO: 3367987 - RNA, 12 nt, Human
agggcagggcca

SEQ ID NO: 3367988 - RNA, 15 nt, Human
agggcagggcucuga

SEQ ID NO: 3367989 - RNA, 16 nt, Human
agggcaggugcuucag

SEQ ID NO: 3367990 - RNA, 12 nt, Human
agggcagguggg

SEQ ID NO: 3367991 - RNA, 15 nt, Human
agggcagguggggug

SEQ ID NO: 3367992 - RNA, 19 nt, Human
agggcagguggggugagaa

SEQ ID NO: 3367993 - RNA, 18 nt, Human
agggcaguaccugagggu

SEQ ID NO: 3367994 - RNA, 22 nt, Human
agggcaguaccugagggucugu

SEQ ID NO: 3367995 - RNA, 19 nt, Human
agggcagugcaaggaggga

SEQ ID NO: 3367996 - RNA, 14 nt, Human
agggcaguggaggu

SEQ ID NO: 3367997 - RNA, 15 nt, Human
agggcaguguuuccu

SEQ ID NO: 3367998 - RNA, 14 nt, Human
agggcaguucgcag

SEQ ID NO: 3367999 - RNA, 18 nt, Human
agggcaguucgcagccac

SEQ ID NO: 3368000 - RNA, 19 nt, Human
agggcaguucgcagccacc

SEQ ID NO: 3368001 - RNA, 22 nt, Human
agggcaguucgcagccacccug

SEQ ID NO: 3368002 - RNA, 16 nt, Human
agggcauaaaacagcu

SEQ ID NO: 3368003 - RNA, 13 nt, Human
agggcauaaagua

SEQ ID NO: 3368004 - RNA, 20 nt, Human
agggcauaaaguaaauacau

SEQ ID NO: 3368005 - RNA, 16 nt, Human
agggcauaaauuauug

SEQ ID NO: 3368006 - RNA, 22 nt, Human
agggcauaaugaugaugggaau

SEQ ID NO: 3368007 - RNA, 17 nt, Human
agggcaucaugcaucuu

SEQ ID NO: 3368008 - RNA, 14 nt, Human
agggcauccauacc

SEQ ID NO: 3368009 - RNA, 14 nt, Human
agggcaucuccagg

SEQ ID NO: 3368010 - RNA, 19 nt, Human
agggcaucuccaggaaggc

SEQ ID NO: 3368011 - RNA, 12 nt, Human
agggcaucuccu

SEQ ID NO: 3368012 - RNA, 13 nt, Human
agggcaucuccug

SEQ ID NO: 3368013 - RNA, 14 nt, Human
agggcaucucuggg

SEQ ID NO: 3368014 - RNA, 13 nt, Human
agggcaucuugcu

SEQ ID NO: 3368015 - RNA, 12 nt, Human
agggcaugaaau

SEQ ID NO: 3368016 - RNA, 15 nt, Human
agggcaugccccggc

SEQ ID NO: 3368017 - RNA, 23 nt, Human
agggcaugccccggccaccucug

SEQ ID NO: 3368018 - RNA, 13 nt, Human
agggcaugccuug

SEQ ID NO: 3368019 - RNA, 17 nt, Human
agggcauggccaggugg

SEQ ID NO: 3368020 - RNA, 13 nt, Human
agggcauuggcca

SEQ ID NO: 3368021 - RNA, 23 nt, Human
agggcauuguaucugucuuucca

SEQ ID NO: 3368022 - RNA, 14 nt, Human
agggccaaaagcuu

SEQ ID NO: 3368023 - RNA, 21 nt, Human
agggccaaaagcuucccuccc

SEQ ID NO: 3368024 - RNA, 16 nt, Human
agggccaaagaaccaa

SEQ ID NO: 3368025 - RNA, 24 nt, Human
agggccacacuauuaccaugagaa

SEQ ID NO: 3368026 - RNA, 18 nt, Human
agggccacauagaugcug

SEQ ID NO: 3368027 - RNA, 20 nt, Human
agggccacaugggaggcuca

SEQ ID NO: 3368028 - RNA, 21 nt, Human
agggccacaugggaggcucac

SEQ ID NO: 3368029 - RNA, 15 nt, Human
agggccacgugccag

SEQ ID NO: 3368030 - RNA, 14 nt, Human
agggcugucaucug

SEQ ID NO: 3368031 - RNA, 19 nt, Human
agggcugucaucugugcac

SEQ ID NO: 3368032 - RNA, 21 nt, Human
agggcugugcuugaaggcccu

SEQ ID NO: 3368033 - RNA, 18 nt, Human
agggcuuacggcccuggc

SEQ ID NO: 3368034 - RNA, 20 nt, Human
agggcuuacggcccuggccu

SEQ ID NO: 3368035 - RNA, 13 nt, Human
agggcuucugcac

SEQ ID NO: 3368036 - RNA, 18 nt, Human
agggcuucugcacccucc

SEQ ID NO: 3368037 - RNA, 23 nt, Human
agggcuucugccauuucugagau

SEQ ID NO: 3368038 - RNA, 16 nt, Human
agggcuuguaguucuu

SEQ ID NO: 3368039 - RNA, 16 nt, Human
agggcuuuaaaauucu

SEQ ID NO: 3368040 - RNA, 15 nt, Human
aggggaaaaaaaugu

SEQ ID NO: 3368041 - RNA, 18 nt, Human
aggggaaaaucagccugc

SEQ ID NO: 3368042 - RNA, 13 nt, Human
aggggaaaaugaa

SEQ ID NO: 3368043 - RNA, 17 nt, Human
aggggaacacugcccuc

SEQ ID NO: 3368044 - RNA, 18 nt, Human
aggggaacacugcccucg

SEQ ID NO: 3368045 - RNA, 14 nt, Human
aggggaacagacug

SEQ ID NO: 3368046 - RNA, 22 nt, Human
aggggaagaaacacuuucucuu

SEQ ID NO: 3368047 - RNA, 16 nt, Human
aggggaagaauaauuu

SEQ ID NO: 3368048 - RNA, 14 nt, Human
aggggaagaggccu

SEQ ID NO: 3368049 - RNA, 23 nt, Human
aggggaagggccagucugggcug

SEQ ID NO: 3368050 - RNA, 18 nt, Human
aggggaauaauagaagaa

SEQ ID NO: 3368051 - RNA, 19 nt, Human
aggggaauaauagaagaac

SEQ ID NO: 3368052 - RNA, 16 nt, Human
aggggaauauuuuauu

SEQ ID NO: 3368053 - RNA, 22 nt, Human
aggggaauauuuuauucaaggu

SEQ ID NO: 3368054 - RNA, 16 nt, Human
aggggaaucagaacuc

SEQ ID NO: 3368055 - RNA, 14 nt, Human
aggggaaugagggg

SEQ ID NO: 3368056 - RNA, 19 nt, Human
aggggaaugagggggcuca

SEQ ID NO: 3368057 - RNA, 19 nt, Human
aggggaauguuugccucug

SEQ ID NO: 3368058 - RNA, 21 nt, Human
aggggaauguuugccucugcc

SEQ ID NO: 3368059 - RNA, 17 nt, Human
aggggaccaggaguggg

SEQ ID NO: 3368060 - RNA, 14 nt, Human
aggggacccccgcc

SEQ ID NO: 3368061 - RNA, 14 nt, Human
aggggacgcuggua

SEQ ID NO: 3368062 - RNA, 23 nt, Human
aggggacgcugguagagauggag

SEQ ID NO: 3368063 - RNA, 17 nt, Human
aggggacucagcccuga

SEQ ID NO: 3368064 - RNA, 23 nt, Human
aggggacucugggcuauggacac

SEQ ID NO: 3368065 - RNA, 15 nt, Human
aggggagacagagca

SEQ ID NO: 3368066 - RNA, 13 nt, Human
aggggagacuuug

SEQ ID NO: 3368067 - RNA, 15 nt, Human
aggggagacuuugau

SEQ ID NO: 3368068 - RNA, 10 nt, Human
aggggagagg

SEQ ID NO: 3368069 - RNA, 23 nt, Human
aggggagcaaaaucgaugcagug

SEQ ID NO: 3368070 - RNA, 16 nt, Human
aggggagcagaggggc

SEQ ID NO: 3368071 - RNA, 12 nt, Human
aggggagccagg

SEQ ID NO: 3368072 - RNA, 17 nt, Human
aggggagcccacugucc

SEQ ID NO: 3368073 - RNA, 21 nt, Human
aggggagcccacuguccuggg

SEQ ID NO: 3368074 - RNA, 17 nt, Human
aggggagcucugucugu

SEQ ID NO: 3368075 - RNA, 15 nt, Human
aggggaggccaucug

SEQ ID NO: 3368076 - RNA, 20 nt, Human
aggggaggggcuccuuucca

SEQ ID NO: 3368077 - RNA, 22 nt, Human
aggggagucaccuucccuugcc

SEQ ID NO: 3368078 - RNA, 21 nt, Human
aggggauagagagagaccacu

SEQ ID NO: 3368079 - RNA, 18 nt, Human
aggggauauaggagagga

SEQ ID NO: 3368080 - RNA, 19 nt, Human
aggggaucauaaaguuaga

SEQ ID NO: 3368081 - RNA, 20 nt, Human
aggggaucauaaaguuagaa

SEQ ID NO: 3368082 - RNA, 18 nt, Human
aggggauuaauaugaaaa

SEQ ID NO: 3368083 - RNA, 15 nt, Human
aggggauuacaguuc

SEQ ID NO: 3368084 - RNA, 19 nt, Human
aggggauugaagcccucca

SEQ ID NO: 3368085 - RNA, 18 nt, Human
aggggauuuuuaugucug

SEQ ID NO: 3368086 - RNA, 18 nt, Human
aggggcaacgaagaaaaa

SEQ ID NO: 3368087 - RNA, 17 nt, Human
aggggcagaaaaacucu

SEQ ID NO: 3368088 - RNA, 14 nt, Human
aggggcagaacagc

SEQ ID NO: 3368089 - RNA, 13 nt, Human
aggggcagagcca

SEQ ID NO: 3368090 - RNA, 12 nt, Human
aggggcagcccu

SEQ ID NO: 3368091 - RNA, 15 nt, Human
aggugcauuuuuacu

SEQ ID NO: 3368092 - RNA, 13 nt, Human
aggugccacugga

SEQ ID NO: 3368093 - RNA, 23 nt, Human
aggugccacuuuacccaccuaga

SEQ ID NO: 3368094 - RNA, 18 nt, Human
aggugccagcaaagcccc

SEQ ID NO: 3368095 - RNA, 20 nt, Human
aggugccagcaaagccccau

SEQ ID NO: 3368096 - RNA, 14 nt, Human
aggugccagcaacu

SEQ ID NO: 3368097 - RNA, 18 nt, Human
aggugccagcaacugaau

SEQ ID NO: 3368098 - RNA, 19 nt, Human
aggugccagcaacugaaua

SEQ ID NO: 3368099 - RNA, 20 nt, Human
aggugccagcaacugaauaa

SEQ ID NO: 3368100 - RNA, 21 nt, Human
aggugcccagaauaaguuauu

SEQ ID NO: 3368101 - RNA, 22 nt, Human
aggugcccagaaugaggcugcu

SEQ ID NO: 3368102 - RNA, 17 nt, Human
aggugccccaaaaugca

SEQ ID NO: 3368103 - RNA, 12 nt, Human
aggugccuccag

SEQ ID NO: 3368104 - RNA, 11 nt, Human
aggugccugug

SEQ ID NO: 3368105 - RNA, 22 nt, Human
aggugccugugaggcaggggcg

SEQ ID NO: 3368106 - RNA, 13 nt, Human
aggugccuucuua

SEQ ID NO: 3368107 - RNA, 22 nt, Human
aggugccuucuucagggccugg

SEQ ID NO: 3368108 - RNA, 23 nt, Human
aggugccuucuucagggccuggu

SEQ ID NO: 3368109 - RNA, 21 nt, Human
aggugccuuggagggucccaa

SEQ ID NO: 3368110 - RNA, 23 nt, Human
aggugccuuggagggucccaagc

SEQ ID NO: 3368111 - RNA, 15 nt, Human
aggugccuuucaaau

SEQ ID NO: 3368112 - RNA, 15 nt, Human
aggugcuaaaucugc

SEQ ID NO: 3368113 - RNA, 20 nt, Human
aggugcuaauuuguuuugga

SEQ ID NO: 3368114 - RNA, 23 nt, Human
aggugcuaauuuguuuuggauau

SEQ ID NO: 3368115 - RNA, 23 nt, Human
aggugcuacaaaaacacagcaag

SEQ ID NO: 3368116 - RNA, 23 nt, Human
aggugcuaggaacacuccuucac

SEQ ID NO: 3368117 - RNA, 15 nt, Human
aggugcucauuggcu

SEQ ID NO: 3368118 - RNA, 20 nt, Human
aggugcugacggccagggag

SEQ ID NO: 3368119 - RNA, 21 nt, Human
aggugcuggagcacugggcuc

SEQ ID NO: 3368120 - RNA, 19 nt, Human
aggugcuggaggugggagc

SEQ ID NO: 3368121 - RNA, 23 nt, Human
aggugcuguugucauugcuuuac

SEQ ID NO: 3368122 - RNA, 20 nt, Human
aggugcuuaagcagaagcau

SEQ ID NO: 3368123 - RNA, 21 nt, Human
aggugcuucuaguucugccag

SEQ ID NO: 3368124 - RNA, 15 nt, Human
agguggaagaaggga

SEQ ID NO: 3368125 - RNA, 16 nt, Human
agguggaagaagggag

SEQ ID NO: 3368126 - RNA, 19 nt, Human
agguggaagaagggagaag

SEQ ID NO: 3368127 - RNA, 11 nt, Human
agguggaagcc

SEQ ID NO: 3368128 - RNA, 15 nt, Human
agguggaagcccucc

SEQ ID NO: 3368129 - RNA, 17 nt, Human
agguggaagcccuccuu

SEQ ID NO: 3368130 - RNA, 16 nt, Human
agguggaaggcagaca

SEQ ID NO: 3368131 - RNA, 17 nt, Human
agguggaaggcagacag

SEQ ID NO: 3368132 - RNA, 14 nt, Human
agguggacacacaa

SEQ ID NO: 3368133 - RNA, 23 nt, Human
agguggaccuuuuaaaguguuuc

SEQ ID NO: 3368134 - RNA, 11 nt, Human
agguggagcaa

SEQ ID NO: 3368135 - RNA, 20 nt, Human
agguggaggcugcagugagc

SEQ ID NO: 3368136 - RNA, 23 nt, Human
agguggauggccccagcacagcu

SEQ ID NO: 3368137 - RNA, 23 nt, Human
agguggauuuuguuuaaaaaauc

SEQ ID NO: 3368138 - RNA, 15 nt, Human
agguggcaaggcugu

SEQ ID NO: 3368139 - RNA, 16 nt, Human
agguggcaaggcugug

SEQ ID NO: 3368140 - RNA, 13 nt, Human
agguggcagcccu

SEQ ID NO: 3368141 - RNA, 14 nt, Human
agguggcaggacca

SEQ ID NO: 3368142 - RNA, 17 nt, Human
agguggcaggaccagga

SEQ ID NO: 3368143 - RNA, 19 nt, Human
agguggcaggaccaggacu

SEQ ID NO: 3368144 - RNA, 16 nt, Human
agguggccaaguuccu

SEQ ID NO: 3368145 - RNA, 19 nt, Human
agguggccaaguuccucua

SEQ ID NO: 3368146 - RNA, 14 nt, Human
agguggccacucca

SEQ ID NO: 3368147 - RNA, 23 nt, Human
agguggccucuccuuguggccug

SEQ ID NO: 3368148 - RNA, 15 nt, Human
agguggcucuccagu

SEQ ID NO: 3368149 - RNA, 23 nt, Human
agguggcucuggaaugacaugug

SEQ ID NO: 3368150 - RNA, 14 nt, Human
agguggcugagccc

SEQ ID NO: 3368151 - RNA, 17 nt, Human
agguggcugccuggagc

SEQ ID NO: 3368152 - RNA, 23 nt, Human
aggugggaaaugguaugagcuga

SEQ ID NO: 3368153 - RNA, 16 nt, Human
aggugggagcaggaga

SEQ ID NO: 3368154 - RNA, 20 nt, Human
aggugggagcaggagauuga

SEQ ID NO: 3368155 - RNA, 22 nt, Human
aggugggaggaucucuugagcc

SEQ ID NO: 3368156 - RNA, 22 nt, Human
aggugggauaucacuuccauga

SEQ ID NO: 3368157 - RNA, 20 nt, Human
aggugggauccuccaggugc

SEQ ID NO: 3368158 - RNA, 16 nt, Human
aggugggccagccccu

SEQ ID NO: 3368159 - RNA, 12 nt, Human
aggugggcccag

SEQ ID NO: 3368160 - RNA, 14 nt, Human
aggugggcccagga

SEQ ID NO: 3368161 - RNA, 16 nt, Human
aggugggcgggcagca

SEQ ID NO: 3368162 - RNA, 15 nt, Human
aggugggcuggacuu

SEQ ID NO: 3368163 - RNA, 22 nt, Human
agguggggaggggguuuggggg

SEQ ID NO: 3368164 - RNA, 23 nt, Human
agguggggaggggguuugggggc

SEQ ID NO: 3368165 - RNA, 13 nt, Human
agguggggaguca

SEQ ID NO: 3368166 - RNA, 13 nt, Human
agguggggcagcu

SEQ ID NO: 3368167 - RNA, 14 nt, Human
agguggggcagcuu

SEQ ID NO: 3368168 - RNA, 23 nt, Human
agguggggcagcuugaggguugg

SEQ ID NO: 3368169 - RNA, 17 nt, Human
agguggggcgggaaagc

SEQ ID NO: 3368170 - RNA, 21 nt, Human
agguggggcgggaaagccagu

SEQ ID NO: 3368171 - RNA, 15 nt, Human
agguggggguugcug

SEQ ID NO: 3368172 - RNA, 19 nt, Human
agguggggucacucuggca

SEQ ID NO: 3368173 - RNA, 15 nt, Human
agguggggugagaau

SEQ ID NO: 3368174 - RNA, 18 nt, Human
agguggaagaagggagaa

SEQ ID NO: 3368175 - RNA, 14 nt, Human
agguggaagcccuc

SEQ ID NO: 3368176 - RNA, 16 nt, Human
agguggaagcccuccu

SEQ ID NO: 3368177 - RNA, 16 nt, Human
agguggaccuuuuaaa

SEQ ID NO: 3368178 - RNA, 18 nt, Human
agguggaccuuuuaaagu

SEQ ID NO: 3368179 - RNA, 22 nt, Human
agguggaccuuuuaaaguguuu

SEQ ID NO: 3368180 - RNA, 13 nt, Human
agguggagguggg

SEQ ID NO: 3368181 - RNA, 17 nt, Human
agguggaucaccugagg

SEQ ID NO: 3368182 - RNA, 15 nt, Human
agguggaucuauuuc

SEQ ID NO: 3368183 - RNA, 16 nt, Human
agguggaucuauuuca

SEQ ID NO: 3368184 - RNA, 16 nt, Human
agguggauggccccag

SEQ ID NO: 3368185 - RNA, 14 nt, Human
agguggcaaggcug

SEQ ID NO: 3368186 - RNA, 18 nt, Human
agguggcacuuuuucauu

SEQ ID NO: 3368187 - RNA, 19 nt, Human
agguggcacuuuuucauuu

SEQ ID NO: 3368188 - RNA, 15 nt, Human
agguggcaucucuaa

SEQ ID NO: 3368189 - RNA, 17 nt, Human
agguggccacuccagac

SEQ ID NO: 3368190 - RNA, 21 nt, Human
agguggccacuuuaagagaga

SEQ ID NO: 3368191 - RNA, 18 nt, Human
agguggccaugccucagc

SEQ ID NO: 3368192 - RNA, 14 nt, Human
agguggcccuacug

SEQ ID NO: 3368193 - RNA, 22 nt, Human
agguggcugacccagucccugg

SEQ ID NO: 3368194 - RNA, 19 nt, Human
agguggcugagccccuguc

SEQ ID NO: 3368195 - RNA, 12 nt, Human
agguggcugccu

SEQ ID NO: 3368196 - RNA, 13 nt, Human
aggugggagcagg

SEQ ID NO: 3368197 - RNA, 11 nt, Human
aggugggagga

SEQ ID NO: 3368198 - RNA, 23 nt, Human
aggugggauaucccuaugcugcc

SEQ ID NO: 3368199 - RNA, 15 nt, Human
aggugggauccucca

SEQ ID NO: 3368200 - RNA, 18 nt, Human
aggugggauccuccaggu

SEQ ID NO: 3368201 - RNA, 14 nt, Human
aggugggccagccc

SEQ ID NO: 3368202 - RNA, 15 nt, Human
aggugggccagcccc

SEQ ID NO: 3368203 - RNA, 18 nt, Human
aggugggccagccccucc

SEQ ID NO: 3368204 - RNA, 16 nt, Human
aggugggcccaggacc

SEQ ID NO: 3368205 - RNA, 15 nt, Human
aggugggccuugcua

SEQ ID NO: 3368206 - RNA, 16 nt, Human
aggugggcgggcaggg

SEQ ID NO: 3368207 - RNA, 22 nt, Human
aggugggcguggucacugcugu

SEQ ID NO: 3368208 - RNA, 20 nt, Human
aggugggcugagcccuggca

SEQ ID NO: 3368209 - RNA, 22 nt, Human
aggugggcugggcccucucuuc

SEQ ID NO: 3368210 - RNA, 11 nt, Human
agguggggagg

SEQ ID NO: 3368211 - RNA, 16 nt, Human
agguggggcagcuuga

SEQ ID NO: 3368212 - RNA, 18 nt, Human
agguggggcgaggcaggc

SEQ ID NO: 3368213 - RNA, 18 nt, Human
aggugggggcggggagua

SEQ ID NO: 3368214 - RNA, 18 nt, Human
agguggggguuggcuggg

SEQ ID NO: 3368215 - RNA, 23 nt, Human
agguggggucacucuggcagcuc

SEQ ID NO: 3368216 - RNA, 21 nt, Human
agguggggucuuugugagagu

SEQ ID NO: 3368217 - RNA, 16 nt, Human
aggugggucccggcuc

SEQ ID NO: 3368218 - RNA, 18 nt, Human
agguggguugaaagccaa

SEQ ID NO: 3368219 - RNA, 17 nt, Human
aggugguagauauugag

SEQ ID NO: 3368220 - RNA, 16 nt, Human
aggugguaggaggagg

SEQ ID NO: 3368221 - RNA, 15 nt, Human
agguggucaguaaau

SEQ ID NO: 3368222 - RNA, 18 nt, Human
agguggucugaauguucu

SEQ ID NO: 3368223 - RNA, 20 nt, Human
agguggucugaauguucuga

SEQ ID NO: 3368224 - RNA, 22 nt, Human
agguggucugaauguucugaca

SEQ ID NO: 3368225 - RNA, 20 nt, Human
agguggucugcucgggccca

SEQ ID NO: 3368226 - RNA, 21 nt, Human
agguggucugcucgggcccag

SEQ ID NO: 3368227 - RNA, 22 nt, Human
agguggucugcucgggcccagg

SEQ ID NO: 3368228 - RNA, 21 nt, Human
agguggugagaaauuucugug

SEQ ID NO: 3368229 - RNA, 21 nt, Human
agguggugguagagaagcaag

SEQ ID NO: 3368230 - RNA, 23 nt, Human
agguggugucacugucccuccug

SEQ ID NO: 3368231 - RNA, 18 nt, Human
agguggugucgggcccuu

SEQ ID NO: 3368232 - RNA, 13 nt, Human
aggugguguuucu

SEQ ID NO: 3368233 - RNA, 20 nt, Human
agguguagccacaccaggau

SEQ ID NO: 3368234 - RNA, 20 nt, Human
agguguauggagagaaaaca

SEQ ID NO: 3368235 - RNA, 23 nt, Human
agguguccagcauugcuggacuc

SEQ ID NO: 3368236 - RNA, 16 nt, Human
agguguccccagccca

SEQ ID NO: 3368237 - RNA, 15 nt, Human
agguguccuacagaa

SEQ ID NO: 3368238 - RNA, 19 nt, Human
agguguccuacagaaaaac

SEQ ID NO: 3368239 - RNA, 13 nt, Human
aggugucucaggc

SEQ ID NO: 3368240 - RNA, 19 nt, Human
aggugucucaggcugccug

SEQ ID NO: 3368241 - RNA, 20 nt, Human
aggugucucaggcugccuga

SEQ ID NO: 3368242 - RNA, 22 nt, Human
aggugucucaggcugccugagu

SEQ ID NO: 3368243 - RNA, 17 nt, Human
aggugucugcacccagg

SEQ ID NO: 3368244 - RNA, 21 nt, Human
aggugucugcacccaggggug

SEQ ID NO: 3368245 - RNA, 15 nt, Human
aggugucuuccuccc

SEQ ID NO: 3368246 - RNA, 18 nt, Human
aggugugacugaauuucu

SEQ ID NO: 3368247 - RNA, 20 nt, Human
aggugugacugaauuucuuu

SEQ ID NO: 3368248 - RNA, 14 nt, Human
aggugugagacugg

SEQ ID NO: 3368249 - RNA, 15 nt, Human
aggugugagacuggg

SEQ ID NO: 3368250 - RNA, 17 nt, Human
aggugugaggaggaggc

SEQ ID NO: 3368251 - RNA, 14 nt, Human
aggugugagucacc

SEQ ID NO: 3368252 - RNA, 20 nt, Human
aggugugagucaccaagccc

SEQ ID NO: 3368253 - RNA, 12 nt, Human
aggugugcucug

SEQ ID NO: 3368254 - RNA, 15 nt, Human
aggugugcucugauc

SEQ ID NO: 3368255 - RNA, 20 nt, Human
agguguggagccgaggccua

SEQ ID NO: 3368256 - RNA, 24 nt, Human
agguguggcagaagcuugcagaug

SEQ ID NO: 3368257 - RNA, 17 nt, Human
aggugugggggcugcag

SEQ ID NO: 3368258 - RNA, 15 nt, Human
agguguguugcagug

SEQ ID NO: 3368259 - RNA, 17 nt, Human
agguguuaacauuccaa

SEQ ID NO: 3368260 - RNA, 23 nt, Human
agguguuauuuggaaccuuguuu

SEQ ID NO: 3368261 - RNA, 22 nt, Human
agguguucaagaccagccugac

SEQ ID NO: 3368262 - RNA, 17 nt, Human
agguguucuacacucau

SEQ ID NO: 3368263 - RNA, 20 nt, Human
agguguucuacacucaucuu

SEQ ID NO: 3368264 - RNA, 23 nt, Human
agguguugccaaauauguccugg

SEQ ID NO: 3368265 - RNA, 15 nt, Human
agguguuggugacaa

SEQ ID NO: 3368266 - RNA, 18 nt, Human
agguguugguuuuggggg

SEQ ID NO: 3368267 - RNA, 17 nt, Human
agguguuuaaagagagg

SEQ ID NO: 3368268 - RNA, 23 nt, Human
agguguuuaacggcacuguggcc

SEQ ID NO: 3368269 - RNA, 12 nt, Human
agguguuuauac

SEQ ID NO: 3368270 - RNA, 13 nt, Human
agguguuugaaaa

SEQ ID NO: 3368271 - RNA, 12 nt, Human
agguuaaaaaaa

SEQ ID NO: 3368272 - RNA, 17 nt, Human
agguuaaauguuuugua

SEQ ID NO: 3368273 - RNA, 17 nt, Human
agguuaaggcugaggaa

SEQ ID NO: 3368274 - RNA, 24 nt, Human
agguuaaggcugaggaaaggccag

SEQ ID NO: 3368275 - RNA, 15 nt, Human
agguuaauaaaguaa

SEQ ID NO: 3368276 - RNA, 14 nt, Human
agguuaauguucau

SEQ ID NO: 3368277 - RNA, 22 nt, Human
agguuaauuccaauuauaugag

SEQ ID NO: 3368278 - RNA, 23 nt, Human
agguuacaacagauuugugaacu

SEQ ID NO: 3368279 - RNA, 16 nt, Human
agguuaccaagaagcc

SEQ ID NO: 3368280 - RNA, 20 nt, Human
agguuagaaauaaugucaaa

SEQ ID NO: 3368281 - RNA, 21 nt, Human
agguuaggcaguauaaagaau

SEQ ID NO: 3368282 - RNA, 20 nt, Human
agguuauaauuuuuuuuaaa

SEQ ID NO: 3368283 - RNA, 17 nt, Human
agguuauaggucacucc

SEQ ID NO: 3368284 - RNA, 18 nt, Human
agguuaucgaaauaacaa

SEQ ID NO: 3368285 - RNA, 19 nt, Human
agguuaucgaaauaacaau

SEQ ID NO: 3368286 - RNA, 16 nt, Human
agguuauugcaauaaa

SEQ ID NO: 3368287 - RNA, 20 nt, Human
agguuauuuuaguuucuguu

SEQ ID NO: 3368288 - RNA, 14 nt, Human
agguucaaagauau

SEQ ID NO: 3368289 - RNA, 14 nt, Human
agguucaacuuauu

SEQ ID NO: 3368290 - RNA, 19 nt, Human
agguucaagcaauccuccc

SEQ ID NO: 3368291 - RNA, 19 nt, Human
agguucagccaagguuuua

SEQ ID NO: 3368292 - RNA, 13 nt, Human
agguucagcuugu

SEQ ID NO: 3368293 - RNA, 13 nt, Human
agucaguauuguu

SEQ ID NO: 3368294 - RNA, 14 nt, Human
agucaguauuguuu

SEQ ID NO: 3368295 - RNA, 15 nt, Human
agucagucauucaga

SEQ ID NO: 3368296 - RNA, 16 nt, Human
agucagugcaaauguc

SEQ ID NO: 3368297 - RNA, 23 nt, Human
agucagugcaaaugucagauaca

SEQ ID NO: 3368298 - RNA, 20 nt, Human
agucagugcccaacuguuau

SEQ ID NO: 3368299 - RNA, 22 nt, Human
agucagugggaacgugacugcc

SEQ ID NO: 3368300 - RNA, 15 nt, Human
agucaguuucuacac

SEQ ID NO: 3368301 - RNA, 18 nt, Human
agucauaaaccuuaagua

SEQ ID NO: 3368302 - RNA, 17 nt, Human
agucauaccaacuuuag

SEQ ID NO: 3368303 - RNA, 16 nt, Human
agucauagguuaauau

SEQ ID NO: 3368304 - RNA, 22 nt, Human
agucauagguuaauauuuaaga

SEQ ID NO: 3368305 - RNA, 20 nt, Human
agucauauauaucacccaga

SEQ ID NO: 3368306 - RNA, 15 nt, Human
agucauauuuugauu

SEQ ID NO: 3368307 - RNA, 14 nt, Human
agucaucaucaggg

SEQ ID NO: 3368308 - RNA, 17 nt, Human
agucaucaucagggccu

SEQ ID NO: 3368309 - RNA, 21 nt, Human
agucaucaucagggccugggg

SEQ ID NO: 3368310 - RNA, 13 nt, Human
agucauccaaucu

SEQ ID NO: 3368311 - RNA, 14 nt, Human
agucaucuauaguu

SEQ ID NO: 3368312 - RNA, 22 nt, Human
agucaucuauaguugauauguu

SEQ ID NO: 3368313 - RNA, 20 nt, Human
agucaucuccaucagcugua

SEQ ID NO: 3368314 - RNA, 22 nt, Human
agucaugaacacaucagcuagc

SEQ ID NO: 3368315 - RNA, 16 nt, Human
agucaugagcugagca

SEQ ID NO: 3368316 - RNA, 19 nt, Human
agucaugauguuuuuaaaa

SEQ ID NO: 3368317 - RNA, 21 nt, Human
agucaugauguuuuuaaaauc

SEQ ID NO: 3368318 - RNA, 18 nt, Human
agcauuuucugcaucucc

SEQ ID NO: 3368319 - RNA, 20 nt, Human
agcauuuucugcaucuccac

SEQ ID NO: 3368320 - RNA, 22 nt, Human
agcauuuugcuaaaugugaaug

SEQ ID NO: 3368321 - RNA, 15 nt, Human
agcauuuuguauuug

SEQ ID NO: 3368322 - RNA, 20 nt, Human
agcauuuuucaauauauuga

SEQ ID NO: 3368323 - RNA, 18 nt, Human
agcauuuuugauuuaugc

SEQ ID NO: 3368324 - RNA, 15 nt, Human
agccaaaaauagcua

SEQ ID NO: 3368325 - RNA, 18 nt, Human
agccaaacacacagaagg

SEQ ID NO: 3368326 - RNA, 21 nt, Human
agccaaacauauauauacuau

SEQ ID NO: 3368327 - RNA, 18 nt, Human
agccaaacauccuacaag

SEQ ID NO: 3368328 - RNA, 17 nt, Human
agccaaaccucaccaac

SEQ ID NO: 3368329 - RNA, 16 nt, Human
agccaaaccucuguga

SEQ ID NO: 3368330 - RNA, 12 nt, Human
agccaaagaaaa

SEQ ID NO: 3368331 - RNA, 16 nt, Human
agccaaagaaaugaac

SEQ ID NO: 3368332 - RNA, 18 nt, Human
agccaaagaaaugaacau

SEQ ID NO: 3368333 - RNA, 22 nt, Human
agccaaagaaaugaacauucca

SEQ ID NO: 3368334 - RNA, 15 nt, Human
agccaaagagaaugc

SEQ ID NO: 3368335 - RNA, 19 nt, Human
agccaaagcuaggccuggc

SEQ ID NO: 3368336 - RNA, 20 nt, Human
agccaaagcuaggccuggcc

SEQ ID NO: 3368337 - RNA, 23 nt, Human
agccaaauguggcauuugugauc

SEQ ID NO: 3368338 - RNA, 13 nt, Human
agccaaauuuaaa

SEQ ID NO: 3368339 - RNA, 22 nt, Human
agccaacacgcaccugccucag

SEQ ID NO: 3368340 - RNA, 14 nt, Human
agccaaccccugug

SEQ ID NO: 3368341 - RNA, 16 nt, Human
agccaaccccugugga

SEQ ID NO: 3368342 - RNA, 23 nt, Human
agccaaccuuacuuacagcauaa

SEQ ID NO: 3368343 - RNA, 14 nt, Human
agccaacugcugcu

SEQ ID NO: 3368344 - RNA, 15 nt, Human
agccaacuuguaaau

SEQ ID NO: 3368345 - RNA, 22 nt, Human
agccaagaccucacacacacaa

SEQ ID NO: 3368346 - RNA, 14 nt, Human
agccaagaggcugc

SEQ ID NO: 3368347 - RNA, 15 nt, Human
agccaagaggcugca

SEQ ID NO: 3368348 - RNA, 18 nt, Human
agccaagcacaguggugg

SEQ ID NO: 3368349 - RNA, 13 nt, Human
agccaagcagcca

SEQ ID NO: 3368350 - RNA, 17 nt, Human
agccaagcuccuuggga

SEQ ID NO: 3368351 - RNA, 20 nt, Human
agccaaggagucacugagac

SEQ ID NO: 3368352 - RNA, 17 nt, Human
agccaaggauagaagcu

SEQ ID NO: 3368353 - RNA, 16 nt, Human
agccaagggaaagggg

SEQ ID NO: 3368354 - RNA, 20 nt, Human
agccaagggaaaggggugcu

SEQ ID NO: 3368355 - RNA, 23 nt, Human
agccaagggaaaggggugcuuuu

SEQ ID NO: 3368356 - RNA, 16 nt, Human
agccaagggaaccugu

SEQ ID NO: 3368357 - RNA, 15 nt, Human
agccaagggccucuu

SEQ ID NO: 3368358 - RNA, 19 nt, Human
agccaaggugggcugagcc

SEQ ID NO: 3368359 - RNA, 18 nt, Human
agccaaggugucauuuau

SEQ ID NO: 3368360 - RNA, 22 nt, Human
agccaagguuuuauaaggcuga

SEQ ID NO: 3368361 - RNA, 14 nt, Human
agccaaguagccuc

SEQ ID NO: 3368362 - RNA, 17 nt, Human
agccaaguagccucucc

SEQ ID NO: 3368363 - RNA, 14 nt, Human
agccaauccccucc

SEQ ID NO: 3368364 - RNA, 23 nt, Human
agccaaucccucaccuucugagu

SEQ ID NO: 3368365 - RNA, 19 nt, Human
agccaaucuacaaucucuu

SEQ ID NO: 3368366 - RNA, 22 nt, Human
agccaaucuacaaucucuuuuu

SEQ ID NO: 3368367 - RNA, 15 nt, Human
agccaauuauguuaa

SEQ ID NO: 3368368 - RNA, 18 nt, Human
agccaauucagacaggca

SEQ ID NO: 3368369 - RNA, 14 nt, Human
agccaauuuuucug

SEQ ID NO: 3368370 - RNA, 17 nt, Human
agccaauuuuucugcac

SEQ ID NO: 3368371 - RNA, 19 nt, Human
agccacaagaaauuugauu

SEQ ID NO: 3368372 - RNA, 14 nt, Human
agccacacacacag

SEQ ID NO: 3368373 - RNA, 18 nt, Human
agccacacacacagaaaa

SEQ ID NO: 3368374 - RNA, 14 nt, Human
agccacaccaggau

SEQ ID NO: 3368375 - RNA, 21 nt, Human
agccacacugugggacucuuc

SEQ ID NO: 3368376 - RNA, 23 nt, Human
agccacacuucucaggacacagg

SEQ ID NO: 3368377 - RNA, 17 nt, Human
agccacagaagccagga

SEQ ID NO: 3368378 - RNA, 18 nt, Human
agccacagaagccaggag

SEQ ID NO: 3368379 - RNA, 22 nt, Human
agccacagaagccaggagcaaa

SEQ ID NO: 3368380 - RNA, 13 nt, Human
agccacagcccag

SEQ ID NO: 3368381 - RNA, 18 nt, Human
agccacagcccaggccuc

SEQ ID NO: 3368382 - RNA, 19 nt, Human
agccacagcccaggccucc

SEQ ID NO: 3368383 - RNA, 13 nt, Human
agccacagcuggu

SEQ ID NO: 3368384 - RNA, 13 nt, Human
agccacaggccug

SEQ ID NO: 3368385 - RNA, 16 nt, Human
agccacaggccugaga

SEQ ID NO: 3368386 - RNA, 17 nt, Human
agccacaggccugagau

SEQ ID NO: 3368387 - RNA, 23 nt, Human
agccacaggccugagauuucauc

SEQ ID NO: 3368388 - RNA, 22 nt, Human
agccacagugagggagauccca

SEQ ID NO: 3368389 - RNA, 21 nt, Human
agccacauagagugacuccaa

SEQ ID NO: 3368390 - RNA, 17 nt, Human
agccacauauugagaug

SEQ ID NO: 3368391 - RNA, 21 nt, Human
agccacaugggaaacuuccaa

SEQ ID NO: 3368392 - RNA, 14 nt, Human
agccacauuccuga

SEQ ID NO: 3368393 - RNA, 23 nt, Human
agccacauuuggaauacuuuuug

SEQ ID NO: 3368394 - RNA, 13 nt, Human
agccaccaacucu

SEQ ID NO: 3368395 - RNA, 17 nt, Human
agccaccaacucuugca

SEQ ID NO: 3368396 - RNA, 13 nt, Human
agccaccacgccc

SEQ ID NO: 3368397 - RNA, 22 nt, Human
agccaccagaugugacaguguu

SEQ ID NO: 3368398 - RNA, 12 nt, Human
agccaccaguuc

SEQ ID NO: 3368399 - RNA, 14 nt, Human
agccaccaguucuc

SEQ ID NO: 3368400 - RNA, 13 nt, Human
agccaccaucuuu

SEQ ID NO: 3368401 - RNA, 14 nt, Human
agccacccaaagca

SEQ ID NO: 3368402 - RNA, 18 nt, Human
agccacccaaagcagugg

SEQ ID NO: 3368403 - RNA, 20 nt, Human
agccaccccagaaaugguga

SEQ ID NO: 3368404 - RNA, 16 nt, Human
agccaccccaugcugg

SEQ ID NO: 3368405 - RNA, 21 nt, Human
agccaccccgggcucucugcu

SEQ ID NO: 3368406 - RNA, 14 nt, Human
agccacccugagga

SEQ ID NO: 3368407 - RNA, 15 nt, Human
agccaccgaagccgc

SEQ ID NO: 3368408 - RNA, 21 nt, Human
agccaccgaagccgccugugg

SEQ ID NO: 3368409 - RNA, 21 nt, Human
agccaccuaaacgguucaguu

SEQ ID NO: 3368410 - RNA, 15 nt, Human
agccaccucucccuc

SEQ ID NO: 3368411 - RNA, 18 nt, Human
agccaccucucuuuuuca

SEQ ID NO: 3368412 - RNA, 19 nt, Human
agccaccugaguuccugag

SEQ ID NO: 3368413 - RNA, 15 nt, Human
agccaccugucccac

SEQ ID NO: 3368414 - RNA, 16 nt, Human
agccaccugucccacc

SEQ ID NO: 3368415 - RNA, 19 nt, Human
agccaccugucccaccuca

SEQ ID NO: 3368416 - RNA, 22 nt, Human
agccaccuuuugggaauguuuu

SEQ ID NO: 3368417 - RNA, 19 nt, Human
agccacggacgcuggcucc

SEQ ID NO: 3368418 - RNA, 14 nt, Human
agccacggccaggc

SEQ ID NO: 3368419 - RNA, 17 nt, Human
agccacggccaggccag

SEQ ID NO: 3368420 - RNA, 18 nt, Human
agccacggccaggccaga

SEQ ID NO: 3368421 - RNA, 22 nt, Human
agccacuaaccuugccugguac

SEQ ID NO: 3368422 - RNA, 14 nt, Human
agccacuagacucu

SEQ ID NO: 3368423 - RNA, 22 nt, Human
agccacuagacucuucacuguu

SEQ ID NO: 3368424 - RNA, 22 nt, Human
agccacucaggaggcugaggca

SEQ ID NO: 3368425 - RNA, 14 nt, Human
agccacuccccucc

SEQ ID NO: 3368426 - RNA, 15 nt, Human
agccacuccccucca

SEQ ID NO: 3368427 - RNA, 12 nt, Human
agccacuccucu

SEQ ID NO: 3368428 - RNA, 13 nt, Human
agccacuccucug

SEQ ID NO: 3368429 - RNA, 14 nt, Human
agccacuccucuga

SEQ ID NO: 3368430 - RNA, 15 nt, Human
agccacucgggaggc

SEQ ID NO: 3368431 - RNA, 19 nt, Human
agccacucgggaggcugag

SEQ ID NO: 3368432 - RNA, 22 nt, Human
agccacucuaccagugcaggcu

SEQ ID NO: 3368433 - RNA, 19 nt, Human
agccacucucuucccuuuc

SEQ ID NO: 3368434 - RNA, 15 nt, Human
agccacugagcaaug

SEQ ID NO: 3368435 - RNA, 21 nt, Human
agccacugcaccgggccacag

SEQ ID NO: 3368436 - RNA, 22 nt, Human
agccacugcaccgggccacaga

SEQ ID NO: 3368437 - RNA, 12 nt, Human
agccacugccau

SEQ ID NO: 3368438 - RNA, 18 nt, Human
agccacugugcugaauuc

SEQ ID NO: 3368439 - RNA, 17 nt, Human
agccacuuaaaauguuc

SEQ ID NO: 3368440 - RNA, 17 nt, Human
agccacuucggccaggu

SEQ ID NO: 3368441 - RNA, 15 nt, Human
agccacuugccugug

SEQ ID NO: 3368442 - RNA, 20 nt, Human
agccacuuucaaucuucaau

SEQ ID NO: 3368443 - RNA, 23 nt, Human
agccagaaauaaaguuggugaca

SEQ ID NO: 3368444 - RNA, 20 nt, Human
agccagaacguggcucugcu

SEQ ID NO: 3368445 - RNA, 16 nt, Human
agccagaacucugugu

SEQ ID NO: 3368446 - RNA, 15 nt, Human
agccagaagcugagc

SEQ ID NO: 3368447 - RNA, 20 nt, Human
agguucaguauuauguaguu

SEQ ID NO: 3368448 - RNA, 17 nt, Human
agguucaugcaaacuuu

SEQ ID NO: 3368449 - RNA, 15 nt, Human
agguucccaagcuca

SEQ ID NO: 3368450 - RNA, 22 nt, Human
agguucccugccuuguuuggau

SEQ ID NO: 3368451 - RNA, 11 nt, Human
agguucccugu

SEQ ID NO: 3368452 - RNA, 19 nt, Human
agguucccuguucuuccuc

SEQ ID NO: 3368453 - RNA, 11 nt, Human
agguucuaaaa

SEQ ID NO: 3368454 - RNA, 18 nt, Human
agguucuaaaguucuaag

SEQ ID NO: 3368455 - RNA, 15 nt, Human
agguucuaaggccua

SEQ ID NO: 3368456 - RNA, 22 nt, Human
agguucuccaacaucacagccc

SEQ ID NO: 3368457 - RNA, 14 nt, Human
agguucucuccucc

SEQ ID NO: 3368458 - RNA, 22 nt, Human
agguucucuccuccccaaggag

SEQ ID NO: 3368459 - RNA, 12 nt, Human
agguucucucua

SEQ ID NO: 3368460 - RNA, 17 nt, Human
agguucugccugcuuug

SEQ ID NO: 3368461 - RNA, 20 nt, Human
agguucugguuagcucagcc

SEQ ID NO: 3368462 - RNA, 15 nt, Human
agccagaccagcagg

SEQ ID NO: 3368463 - RNA, 13 nt, Human
agccagacucugc

SEQ ID NO: 3368464 - RNA, 14 nt, Human
agccagacucuggu

SEQ ID NO: 3368465 - RNA, 14 nt, Human
agccagacuggcac

SEQ ID NO: 3368466 - RNA, 18 nt, Human
agccagagaagugacagg

SEQ ID NO: 3368467 - RNA, 10 nt, Human
agccagagga

SEQ ID NO: 3368468 - RNA, 18 nt, Human
agccagaggcuggguuca

SEQ ID NO: 3368469 - RNA, 22 nt, Human
agccagauggacuccagccugc

SEQ ID NO: 3368470 - RNA, 17 nt, Human
agccagauuucacucuc

SEQ ID NO: 3368471 - RNA, 19 nt, Human
agccagauuuuccugaaaa

SEQ ID NO: 3368472 - RNA, 23 nt, Human
agccagcaaugauguccagaaga

SEQ ID NO: 3368473 - RNA, 24 nt, Human
agccagcaaugauguccagaagaa

SEQ ID NO: 3368474 - RNA, 13 nt, Human
agccagcacacag

SEQ ID NO: 3368475 - RNA, 17 nt, Human
agccagcacacagggca

SEQ ID NO: 3368476 - RNA, 18 nt, Human
agccagcacacagggcag

SEQ ID NO: 3368477 - RNA, 19 nt, Human
agccagcacacagggcagu

SEQ ID NO: 3368478 - RNA, 14 nt, Human
agccagcaccuggc

SEQ ID NO: 3368479 - RNA, 15 nt, Human
agccagcaccuggca

SEQ ID NO: 3368480 - RNA, 15 nt, Human
agccagcacuuguau

SEQ ID NO: 3368481 - RNA, 16 nt, Human
agccagcagcagccca

SEQ ID NO: 3368482 - RNA, 21 nt, Human
agccagcagcagcccaagcuu

SEQ ID NO: 3368483 - RNA, 13 nt, Human
agccagcagccag

SEQ ID NO: 3368484 - RNA, 16 nt, Human
agccagcagccagcuc

SEQ ID NO: 3368485 - RNA, 18 nt, Human
agccagcaggcucucagg

SEQ ID NO: 3368486 - RNA, 20 nt, Human
agccagcaggcucucaggcc

SEQ ID NO: 3368487 - RNA, 23 nt, Human
agccagcaggcucucaggccagc

SEQ ID NO: 3368488 - RNA, 20 nt, Human
agccagcaguucagagcugc

SEQ ID NO: 3368489 - RNA, 12 nt, Human
agccagcaucug

SEQ ID NO: 3368490 - RNA, 16 nt, Human
agccagcaucugggcc

SEQ ID NO: 3368491 - RNA, 22 nt, Human
agccagccaaacacacagaagg

SEQ ID NO: 3368492 - RNA, 21 nt, Human
agccagccacucuaccagugc

SEQ ID NO: 3368493 - RNA, 12 nt, Human
agccagcccagc

SEQ ID NO: 3368494 - RNA, 16 nt, Human
agccagcccucccugu

SEQ ID NO: 3368495 - RNA, 18 nt, Human
agccagcccucccugucc

SEQ ID NO: 3368496 - RNA, 21 nt, Human
agccagccgagcaggaggccu

SEQ ID NO: 3368497 - RNA, 18 nt, Human
agccagccugaccuuccu

SEQ ID NO: 3368498 - RNA, 17 nt, Human
agccagccuggcuggga

SEQ ID NO: 3368499 - RNA, 22 nt, Human
agccagccuggcugggacuggg

SEQ ID NO: 3368500 - RNA, 21 nt, Human
agccagcgccucccuccaccc

SEQ ID NO: 3368501 - RNA, 16 nt, Human
agccagcguccuccuc

SEQ ID NO: 3368502 - RNA, 19 nt, Human
agccagcguccuccucugu

SEQ ID NO: 3368503 - RNA, 21 nt, Human
agccagcguccuccucuguga

SEQ ID NO: 3368504 - RNA, 23 nt, Human
agccagcguccuccucugugacc

SEQ ID NO: 3368505 - RNA, 20 nt, Human
agccagcgucggucugugcc

SEQ ID NO: 3368506 - RNA, 22 nt, Human
agccagcgucggucugugcccc

SEQ ID NO: 3368507 - RNA, 23 nt, Human
agccagcuaagggguggggcugc

SEQ ID NO: 3368508 - RNA, 17 nt, Human
agccagcucccucuauu

SEQ ID NO: 3368509 - RNA, 22 nt, Human
agccagcucccucuauuuaugu

SEQ ID NO: 3368510 - RNA, 15 nt, Human
agccagcucucagcc

SEQ ID NO: 3368511 - RNA, 18 nt, Human
agccagcugcaggaauca

SEQ ID NO: 3368512 - RNA, 13 nt, Human
agccagcugcccc

SEQ ID NO: 3368513 - RNA, 19 nt, Human
agccagcugcccccagagc

SEQ ID NO: 3368514 - RNA, 20 nt, Human
agccagcugccgaccagagc

SEQ ID NO: 3368515 - RNA, 12 nt, Human
agccagcuuggg

SEQ ID NO: 3368516 - RNA, 19 nt, Human
agccagcuuguuuacaugc

SEQ ID NO: 3368517 - RNA, 21 nt, Human
agccagcuuguuuacaugcuu

SEQ ID NO: 3368518 - RNA, 16 nt, Human
agccagcuuucccugc

SEQ ID NO: 3368519 - RNA, 22 nt, Human
agccagcuuucccugccucuca

SEQ ID NO: 3368520 - RNA, 20 nt, Human
agccaggaaguacuuccacc

SEQ ID NO: 3368521 - RNA, 21 nt, Human
agccaggaauuucccaggacc

SEQ ID NO: 3368522 - RNA, 23 nt, Human
agccaggaauuucccaggacccu

SEQ ID NO: 3368523 - RNA, 13 nt, Human
agccaggagaagc

SEQ ID NO: 3368524 - RNA, 23 nt, Human
agccaggagagcuuagggucuca

SEQ ID NO: 3368525 - RNA, 13 nt, Human
agccaggagcaaa

SEQ ID NO: 3368526 - RNA, 23 nt, Human
agccaggagcaaauguuucugca

SEQ ID NO: 3368527 - RNA, 14 nt, Human
agccaggaggccug

SEQ ID NO: 3368528 - RNA, 12 nt, Human
agccaggcacac

SEQ ID NO: 3368529 - RNA, 21 nt, Human
agccaggcagguagccagggg

SEQ ID NO: 3368530 - RNA, 12 nt, Human
agccaggccaca

SEQ ID NO: 3368531 - RNA, 14 nt, Human
agccaggccacaag

SEQ ID NO: 3368532 - RNA, 22 nt, Human
agccaggccacaagacccuugu

SEQ ID NO: 3368533 - RNA, 15 nt, Human
agccaggccacuggc

SEQ ID NO: 3368534 - RNA, 22 nt, Human
agccaggcccuugucggcccca

SEQ ID NO: 3368535 - RNA, 13 nt, Human
agccaggcgggcu

SEQ ID NO: 3368536 - RNA, 14 nt, Human
agccaggcucugug

SEQ ID NO: 3368537 - RNA, 21 nt, Human
agccaggcugccaaggccaga

SEQ ID NO: 3368538 - RNA, 21 nt, Human
agccagggaaagacuggcaag

SEQ ID NO: 3368539 - RNA, 15 nt, Human
agccagggagagccc

SEQ ID NO: 3368540 - RNA, 18 nt, Human
agccagggagagcccagg

SEQ ID NO: 3368541 - RNA, 20 nt, Human
agccagggagagcccaggag

SEQ ID NO: 3368542 - RNA, 22 nt, Human
agccagggauggggccacagcc

SEQ ID NO: 3368543 - RNA, 23 nt, Human
agccagggauggggccacagcca

SEQ ID NO: 3368544 - RNA, 13 nt, Human
agccagggccagg

SEQ ID NO: 3368545 - RNA, 14 nt, Human
agccagggccaggg

SEQ ID NO: 3368546 - RNA, 17 nt, Human
agccagggccagggguc

SEQ ID NO: 3368547 - RNA, 21 nt, Human
agccagggcccgggaagcaaa

SEQ ID NO: 3368548 - RNA, 15 nt, Human
agccagggccugcga

SEQ ID NO: 3368549 - RNA, 22 nt, Human
agccagggcuaugggagcagcu

SEQ ID NO: 3368550 - RNA, 12 nt, Human
agccagggcugg

SEQ ID NO: 3368551 - RNA, 13 nt, Human
agccagggcugga

SEQ ID NO: 3368552 - RNA, 15 nt, Human
agccagggcuggaga

SEQ ID NO: 3368553 - RNA, 23 nt, Human
agccaggggagcagaggggcaga

SEQ ID NO: 3368554 - RNA, 21 nt, Human
agccagggggacuagccccug

SEQ ID NO: 3368555 - RNA, 19 nt, Human
agccagggggagcugggcc

SEQ ID NO: 3368556 - RNA, 20 nt, Human
agccagggggaugccacucc

SEQ ID NO: 3368557 - RNA, 18 nt, Human
agccagggucucucccuc

SEQ ID NO: 3368558 - RNA, 23 nt, Human
agccagguaaugagggacuggaa

SEQ ID NO: 3368559 - RNA, 17 nt, Human
agccagguauggcucug

SEQ ID NO: 3368560 - RNA, 19 nt, Human
agccaggucccccugcagc

SEQ ID NO: 3368561 - RNA, 20 nt, Human
agccaggucccccugcagcu

SEQ ID NO: 3368562 - RNA, 13 nt, Human
agccaggugccuu

SEQ ID NO: 3368563 - RNA, 17 nt, Human
agccaggugccuuggag

SEQ ID NO: 3368564 - RNA, 18 nt, Human
agccaggugccuuggagg

SEQ ID NO: 3368565 - RNA, 13 nt, Human
agccaguaaaugg

SEQ ID NO: 3368566 - RNA, 22 nt, Human
agccaguaaaugggggugcauu

SEQ ID NO: 3368567 - RNA, 23 nt, Human
agccaguaaaugggggugcauuu

SEQ ID NO: 3368568 - RNA, 13 nt, Human
agccaguaauccu

SEQ ID NO: 3368569 - RNA, 12 nt, Human
agccagucuuaa

SEQ ID NO: 3368570 - RNA, 23 nt, Human
agccagugaacauaauucuuauu

SEQ ID NO: 3368571 - RNA, 17 nt, Human
agccagugaccugagga

SEQ ID NO: 3368572 - RNA, 13 nt, Human
agccagugagaug

SEQ ID NO: 3368573 - RNA, 16 nt, Human
agccagugcccugagc

SEQ ID NO: 3368574 - RNA, 23 nt, Human
agccaguuuggguaaaauacuuu

SEQ ID NO: 3368575 - RNA, 22 nt, Human
agccauacauaaaagaaauaaa

SEQ ID NO: 3368576 - RNA, 22 nt, Human
agccauacuuaucucucugugc

SEQ ID NO: 3368577 - RNA, 10 nt, Human
agccauagug

SEQ ID NO: 3368578 - RNA, 14 nt, Human
agccaucaaaaugc

SEQ ID NO: 3368579 - RNA, 15 nt, Human
agccaucaaaaugcu

SEQ ID NO: 3368580 - RNA, 18 nt, Human
agccaucaaaaugcuuuu

SEQ ID NO: 3368581 - RNA, 18 nt, Human
agccaucaacaagaguug

SEQ ID NO: 3368582 - RNA, 17 nt, Human
agccaucaagagacuga

SEQ ID NO: 3368583 - RNA, 18 nt, Human
agccaucaccucagaugg

SEQ ID NO: 3368584 - RNA, 14 nt, Human
agccaucaccuuag

SEQ ID NO: 3368585 - RNA, 18 nt, Human
agccaucauaggaaggga

SEQ ID NO: 3368586 - RNA, 17 nt, Human
agccaucccagccuugg

SEQ ID NO: 3368587 - RNA, 19 nt, Human
agccaucccaugaacacac

SEQ ID NO: 3368588 - RNA, 23 nt, Human
agccaucuaaaguaaaaagggaa

SEQ ID NO: 3368589 - RNA, 22 nt, Human
agccaucucucuacuccuaccu

SEQ ID NO: 3368590 - RNA, 18 nt, Human
agccaucugcccaggggu

SEQ ID NO: 3368591 - RNA, 18 nt, Human
agccaugaccuuacauuu

SEQ ID NO: 3368592 - RNA, 21 nt, Human
agccaugagaugauacaucca

SEQ ID NO: 3368593 - RNA, 23 nt, Human
agccaugauguggaguggggcag

SEQ ID NO: 3368594 - RNA, 16 nt, Human
agccaugccagcuggc

SEQ ID NO: 3368595 - RNA, 15 nt, Human
agccaugcccgcauu

SEQ ID NO: 3368596 - RNA, 16 nt, Human
agccaugcgcccccuc

SEQ ID NO: 3368597 - RNA, 18 nt, Human
agccaugcuggaaaauaa

SEQ ID NO: 3368598 - RNA, 19 nt, Human
agccaugcugggaagacgc

SEQ ID NO: 3368599 - RNA, 19 nt, Human
agccauggagauucucaua

SEQ ID NO: 3368600 - RNA, 17 nt, Human
agccaugggaccaaacc

SEQ ID NO: 3368601 - RNA, 14 nt, Human
agccauguacagac

SEQ ID NO: 3368602 - RNA, 22 nt, Human
agccauguagaagcugcaucuu

SEQ ID NO: 3368603 - RNA, 16 nt, Human
agccauguauaaaugu

SEQ ID NO: 3368604 - RNA, 16 nt, Human
agccauguuuaagauu

SEQ ID NO: 3368605 - RNA, 12 nt, Human
agccgggcgugg

SEQ ID NO: 3368606 - RNA, 23 nt, Human
agccggggaagagauccaaagac

SEQ ID NO: 3368607 - RNA, 20 nt, Human
agccggggaguuucuuuccu

SEQ ID NO: 3368608 - RNA, 18 nt, Human
agccggggccugccuagc

SEQ ID NO: 3368609 - RNA, 23 nt, Human
agccggggccuuaucgggcucca

SEQ ID NO: 3368610 - RNA, 19 nt, Human
agccggggugggguggcug

SEQ ID NO: 3368611 - RNA, 16 nt, Human
agccggguguccccaa

SEQ ID NO: 3368612 - RNA, 17 nt, Human
agccgguaacuguccug

SEQ ID NO: 3368613 - RNA, 17 nt, Human
agccguaaaaacugaag

SEQ ID NO: 3368614 - RNA, 23 nt, Human
agccguccuggcgccuggcaguc

SEQ ID NO: 3368615 - RNA, 14 nt, Human
agccgugagugcag

SEQ ID NO: 3368616 - RNA, 17 nt, Human
agccgugaugcucaggc

SEQ ID NO: 3368617 - RNA, 19 nt, Human
agccgugaugcucaggcuu

SEQ ID NO: 3368618 - RNA, 15 nt, Human
agccgugccuucagc

SEQ ID NO: 3368619 - RNA, 13 nt, Human
agccguggcuucc

SEQ ID NO: 3368620 - RNA, 19 nt, Human
agccguuuguuccccaaga

SEQ ID NO: 3368621 - RNA, 17 nt, Human
agccuaaaaauaaagca

SEQ ID NO: 3368622 - RNA, 23 nt, Human
agccuaaaaauaaagcacaaacc

SEQ ID NO: 3368623 - RNA, 20 nt, Human
agccuaaagauuuugaucuc

SEQ ID NO: 3368624 - RNA, 18 nt, Human
agccuaagauauacuugu

SEQ ID NO: 3368625 - RNA, 21 nt, Human
agccuaagauauacuuguuuu

SEQ ID NO: 3368626 - RNA, 22 nt, Human
agccuaaucccugggcauugcu

SEQ ID NO: 3368627 - RNA, 23 nt, Human
agccuaaucccugggcauugcuu

SEQ ID NO: 3368628 - RNA, 22 nt, Human
agccuaccggcaauuuccggcc

SEQ ID NO: 3368629 - RNA, 19 nt, Human
agccuacuagggaccuggg

SEQ ID NO: 3368630 - RNA, 22 nt, Human
agccuacuagggaccuggggaa

SEQ ID NO: 3368631 - RNA, 14 nt, Human
agccuagaagcugg

SEQ ID NO: 3368632 - RNA, 15 nt, Human
agccuagacccuccu

SEQ ID NO: 3368633 - RNA, 13 nt, Human
agccuaggccagg

SEQ ID NO: 3368634 - RNA, 14 nt, Human
agccuaggggucag

SEQ ID NO: 3368635 - RNA, 16 nt, Human
agccuaugagcauccu

SEQ ID NO: 3368636 - RNA, 18 nt, Human
agccuaugagcauccuga

SEQ ID NO: 3368637 - RNA, 19 nt, Human
agccuaugagcauccugag

SEQ ID NO: 3368638 - RNA, 21 nt, Human
agccuaugagcauccugagcc

SEQ ID NO: 3368639 - RNA, 23 nt, Human
agccuaugagcauccugagcccc

SEQ ID NO: 3368640 - RNA, 16 nt, Human
agccuauggcagaaaa

SEQ ID NO: 3368641 - RNA, 13 nt, Human
agccuauguugug

SEQ ID NO: 3368642 - RNA, 13 nt, Human
agccuauuccuga

SEQ ID NO: 3368643 - RNA, 16 nt, Human
agccuauuuaccugca

SEQ ID NO: 3368644 - RNA, 17 nt, Human
agccuauuuuuuuagau

SEQ ID NO: 3368645 - RNA, 16 nt, Human
agccucaaauccagga

SEQ ID NO: 3368646 - RNA, 17 nt, Human
agccucaaccuccuggg

SEQ ID NO: 3368647 - RNA, 21 nt, Human
agccucaagucuuauuuccuc

SEQ ID NO: 3368648 - RNA, 20 nt, Human
agccucaauaagccuugucg

SEQ ID NO: 3368649 - RNA, 18 nt, Human
agccucacaguccuuacc

SEQ ID NO: 3368650 - RNA, 14 nt, Human
agccucacccuugc

SEQ ID NO: 3368651 - RNA, 21 nt, Human
agccucacuucuaggguaugg

SEQ ID NO: 3368652 - RNA, 20 nt, Human
agccucacuuggucugccag

SEQ ID NO: 3368653 - RNA, 21 nt, Human
agccucacuuggucugccagg

SEQ ID NO: 3368654 - RNA, 14 nt, Human
agccucagauuccu

SEQ ID NO: 3368655 - RNA, 16 nt, Human
agccucagcauccugg

SEQ ID NO: 3368656 - RNA, 17 nt, Human
agccucagcauccuggc

SEQ ID NO: 3368657 - RNA, 21 nt, Human
agccucagcauccuggcaccc

SEQ ID NO: 3368658 - RNA, 22 nt, Human
agccucagcauccuggcacccg

SEQ ID NO: 3368659 - RNA, 23 nt, Human
agccucagcauccuggcacccgg

SEQ ID NO: 3368660 - RNA, 12 nt, Human
agccucagccau

SEQ ID NO: 3368661 - RNA, 15 nt, Human
agccucagccauuca

SEQ ID NO: 3368662 - RNA, 15 nt, Human
aguccucacucccag

SEQ ID NO: 3368663 - RNA, 17 nt, Human
aguccucacucccaguc

SEQ ID NO: 3368664 - RNA, 12 nt, Human
aguccuccagaa

SEQ ID NO: 3368665 - RNA, 21 nt, Human
aguccuccagaacucuuccuc

SEQ ID NO: 3368666 - RNA, 14 nt, Human
aguccucccaucuc

SEQ ID NO: 3368667 - RNA, 16 nt, Human
aguccucccaucucac

SEQ ID NO: 3368668 - RNA, 14 nt, Human
aguccuccccucac

SEQ ID NO: 3368669 - RNA, 18 nt, Human
aguccuccccucacagcc

SEQ ID NO: 3368670 - RNA, 20 nt, Human
aguccuccccucacagccuc

SEQ ID NO: 3368671 - RNA, 17 nt, Human
aguccucccugacuuuu

SEQ ID NO: 3368672 - RNA, 19 nt, Human
aguccucccugacuuuucu

SEQ ID NO: 3368673 - RNA, 15 nt, Human
aguccucguagccau

SEQ ID NO: 3368674 - RNA, 17 nt, Human
aguccucguagccaucu

SEQ ID NO: 3368675 - RNA, 21 nt, Human
aguccucguagccaucucucu

SEQ ID NO: 3368676 - RNA, 12 nt, Human
aguccucugaau

SEQ ID NO: 3368677 - RNA, 12 nt, Human
aguccugaagag

SEQ ID NO: 3368678 - RNA, 14 nt, Human
aguccugaagaggc

SEQ ID NO: 3368679 - RNA, 14 nt, Human
aguccugaaggaca

SEQ ID NO: 3368680 - RNA, 20 nt, Human
aguccugaucagagccgugg

SEQ ID NO: 3368681 - RNA, 23 nt, Human
aguccugcacaguuuucuggcug

SEQ ID NO: 3368682 - RNA, 16 nt, Human
aguccugccucagccu

SEQ ID NO: 3368683 - RNA, 13 nt, Human
aguccugccuggc

SEQ ID NO: 3368684 - RNA, 15 nt, Human
aguccugccuggcca

SEQ ID NO: 3368685 - RNA, 19 nt, Human
aguccugcuaccucccuug

SEQ ID NO: 3368686 - RNA, 21 nt, Human
aguccugcuaccucccuugcc

SEQ ID NO: 3368687 - RNA, 13 nt, Human
aguccugcuccag

SEQ ID NO: 3368688 - RNA, 14 nt, Human
aguccugcuccaga

SEQ ID NO: 3368689 - RNA, 23 nt, Human
aguccugcuccagaauuuggaaa

SEQ ID NO: 3368690 - RNA, 14 nt, Human
aguccuggaagcca

SEQ ID NO: 3368691 - RNA, 22 nt, Human
aguccuggaagccagcuuuccc

SEQ ID NO: 3368692 - RNA, 17 nt, Human
aguccuggauguugugu

SEQ ID NO: 3368693 - RNA, 13 nt, Human
aguccuggccugg

SEQ ID NO: 3368694 - RNA, 16 nt, Human
aguccugggagaccca

SEQ ID NO: 3368695 - RNA, 19 nt, Human
aguccuguaugucugucau

SEQ ID NO: 3368696 - RNA, 21 nt, Human
aguccuguaugucugucauug

SEQ ID NO: 3368697 - RNA, 19 nt, Human
aguccugugaaugccacug

SEQ ID NO: 3368698 - RNA, 17 nt, Human
aguccuuaaacagggca

SEQ ID NO: 3368699 - RNA, 18 nt, Human
aguccuuaaacagggcau

SEQ ID NO: 3368700 - RNA, 20 nt, Human
aguccuuaccagcagagcac

SEQ ID NO: 3368701 - RNA, 15 nt, Human
aguccuuaccucuuc

SEQ ID NO: 3368702 - RNA, 17 nt, Human
aguccuuaccucuuccg

SEQ ID NO: 3368703 - RNA, 18 nt, Human
aguccuuaucuagcugca

SEQ ID NO: 3368704 - RNA, 14 nt, Human
aguccuugaaaaua

SEQ ID NO: 3368705 - RNA, 16 nt, Human
aguccuugaaaauauu

SEQ ID NO: 3368706 - RNA, 22 nt, Human
aguccuugaaaauauuuuuuau

SEQ ID NO: 3368707 - RNA, 14 nt, Human
aguccuuuaugugg

SEQ ID NO: 3368708 - RNA, 17 nt, Human
aguccuuugagcuccug

SEQ ID NO: 3368709 - RNA, 12 nt, Human
aguccuuuucuu

SEQ ID NO: 3368710 - RNA, 15 nt, Human
agucgaugaacuauu

SEQ ID NO: 3368711 - RNA, 22 nt, Human
agucgccuuucagcaggcagcc

SEQ ID NO: 3368712 - RNA, 15 nt, Human
agucgcugaggaaaa

SEQ ID NO: 3368713 - RNA, 16 nt, Human
agucggcacagccugg

SEQ ID NO: 3368714 - RNA, 16 nt, Human
agucgggggcuggccu

SEQ ID NO: 3368715 - RNA, 22 nt, Human
agucgucaucacuuuucaguga

SEQ ID NO: 3368716 - RNA, 21 nt, Human
agucgugaccugcuaggccag

SEQ ID NO: 3368717 - RNA, 12 nt, Human
agucgugccugu

SEQ ID NO: 3368718 - RNA, 13 nt, Human
agucgugccugug

SEQ ID NO: 3368719 - RNA, 19 nt, Human
agucguggagaugucuucg

SEQ ID NO: 3368720 - RNA, 21 nt, Human
agucguggagaugucuucgua

SEQ ID NO: 3368721 - RNA, 14 nt, Human
agucguugugaggg

SEQ ID NO: 3368722 - RNA, 13 nt, Human
agucguuuuccaa

SEQ ID NO: 3368723 - RNA, 12 nt, Human
agucuaaaguuu

SEQ ID NO: 3368724 - RNA, 20 nt, Human
agucuaaaguuuacaguaaa

SEQ ID NO: 3368725 - RNA, 23 nt, Human
agucuaaaguuuacaguaaauaa

SEQ ID NO: 3368726 - RNA, 23 nt, Human
agucuaaauauucagaaucuuug

SEQ ID NO: 3368727 - RNA, 17 nt, Human
agucuaaauauuuccuu

SEQ ID NO: 3368728 - RNA, 23 nt, Human
agucuaaauauuuccuuaaacug

SEQ ID NO: 3368729 - RNA, 23 nt, Human
agucuaacaacugcccaguuucc

SEQ ID NO: 3368730 - RNA, 12 nt, Human
agucuaaccaaa

SEQ ID NO: 3368731 - RNA, 16 nt, Human
agucuaaccaaaugca

SEQ ID NO: 3368732 - RNA, 17 nt, Human
agucuaaccaaaugcau

SEQ ID NO: 3368733 - RNA, 20 nt, Human
agucuaaccaaaugcaucaa

SEQ ID NO: 3368734 - RNA, 20 nt, Human
agucuaauuuuuauucauaa

SEQ ID NO: 3368735 - RNA, 11 nt, Human
agucuaccaau

SEQ ID NO: 3368736 - RNA, 13 nt, Human
agucuacccagag

SEQ ID NO: 3368737 - RNA, 18 nt, Human
agucuacccgacauaagu

SEQ ID NO: 3368738 - RNA, 17 nt, Human
agucuacgcucuccuuu

SEQ ID NO: 3368739 - RNA, 20 nt, Human
agucuacgcucuccuuucuu

SEQ ID NO: 3368740 - RNA, 18 nt, Human
agucuacucuuaagccau

SEQ ID NO: 3368741 - RNA, 14 nt, Human
agucuagaaguugu

SEQ ID NO: 3368742 - RNA, 17 nt, Human
agucuagauggcuccuc

SEQ ID NO: 3368743 - RNA, 20 nt, Human
agucuagauggcuccucuca

SEQ ID NO: 3368744 - RNA, 23 nt, Human
agucuagauguuuauucuucuag

SEQ ID NO: 3368745 - RNA, 21 nt, Human
agucuagauucaaagguucua

SEQ ID NO: 3368746 - RNA, 22 nt, Human
agucuagauucaaagguucuag

SEQ ID NO: 3368747 - RNA, 20 nt, Human
agucuagauucucuggcugu

SEQ ID NO: 3368748 - RNA, 18 nt, Human
agucuaggagcugggagg

SEQ ID NO: 3368749 - RNA, 22 nt, Human
agccucugggggguggccaggc

SEQ ID NO: 3368750 - RNA, 22 nt, Human
agccucugggucagugguccac

SEQ ID NO: 3368751 - RNA, 14 nt, Human
agccucugucacug

SEQ ID NO: 3368752 - RNA, 21 nt, Human
agccucugucacugcaggcac

SEQ ID NO: 3368753 - RNA, 11 nt, Human
agccucugugu

SEQ ID NO: 3368754 - RNA, 15 nt, Human
agccucugugucacu

SEQ ID NO: 3368755 - RNA, 21 nt, Human
agccucugugucacuggcugc

SEQ ID NO: 3368756 - RNA, 14 nt, Human
agccucuguuuuga

SEQ ID NO: 3368757 - RNA, 20 nt, Human
agccucuuaaagcugccugu

SEQ ID NO: 3368758 - RNA, 23 nt, Human
agccucuuaaagcugccuguagu

SEQ ID NO: 3368759 - RNA, 20 nt, Human
agccucuuucccuuccaguu

SEQ ID NO: 3368760 - RNA, 18 nt, Human
agccucuuucugucccuu

SEQ ID NO: 3368761 - RNA, 21 nt, Human
agccucuuucugucccuucug

SEQ ID NO: 3368762 - RNA, 16 nt, Human
agccucuuuuugauac

SEQ ID NO: 3368763 - RNA, 20 nt, Human
agccugaaauagugguucuu

SEQ ID NO: 3368764 - RNA, 16 nt, Human
agccugaacagaagcu

SEQ ID NO: 3368765 - RNA, 19 nt, Human
agccugaaccccagggcug

SEQ ID NO: 3368766 - RNA, 22 nt, Human
agccugaaggggcgucuguucc

SEQ ID NO: 3368767 - RNA, 15 nt, Human
agccugacagccaga

SEQ ID NO: 3368768 - RNA, 13 nt, Human
agccugagagucu

SEQ ID NO: 3368769 - RNA, 21 nt, Human
agccugagcaacucuugauua

SEQ ID NO: 3368770 - RNA, 16 nt, Human
agccugaggcagccac

SEQ ID NO: 3368771 - RNA, 21 nt, Human
agccugaggcagccacuucgg

SEQ ID NO: 3368772 - RNA, 13 nt, Human
agccugaguagaa

SEQ ID NO: 3368773 - RNA, 17 nt, Human
agccugaguagaaaggc

SEQ ID NO: 3368774 - RNA, 22 nt, Human
agccugaguagaaaggccuuua

SEQ ID NO: 3368775 - RNA, 16 nt, Human
agccugagucaccugc

SEQ ID NO: 3368776 - RNA, 18 nt, Human
agccugagucagggccca

SEQ ID NO: 3368777 - RNA, 18 nt, Human
agccugagucuccugugc

SEQ ID NO: 3368778 - RNA, 16 nt, Human
agccugauauugauau

SEQ ID NO: 3368779 - RNA, 18 nt, Human
agccugcaaacucacugc

SEQ ID NO: 3368780 - RNA, 19 nt, Human
agccugcaaacucacugcu

SEQ ID NO: 3368781 - RNA, 19 nt, Human
agccugcaauuucauaugc

SEQ ID NO: 3368782 - RNA, 21 nt, Human
agccugcaauuucauaugcug

SEQ ID NO: 3368783 - RNA, 12 nt, Human
agccugcagagc

SEQ ID NO: 3368784 - RNA, 13 nt, Human
agccugcagagcu

SEQ ID NO: 3368785 - RNA, 14 nt, Human
agccugcagagcug

SEQ ID NO: 3368786 - RNA, 22 nt, Human
agccugcaggaucucaccaggc

SEQ ID NO: 3368787 - RNA, 18 nt, Human
agccugcaggguggugcu

SEQ ID NO: 3368788 - RNA, 21 nt, Human
agccugcaggguggugcuggg

SEQ ID NO: 3368789 - RNA, 23 nt, Human
agccugcauugagcuugcaugcu

SEQ ID NO: 3368790 - RNA, 18 nt, Human
agccugccacucaggccc

SEQ ID NO: 3368791 - RNA, 23 nt, Human
agccugcccagcccccuggucuu

SEQ ID NO: 3368792 - RNA, 17 nt, Human
agccugcccuugucuga

SEQ ID NO: 3368793 - RNA, 16 nt, Human
agccugccucuucucu

SEQ ID NO: 3368794 - RNA, 19 nt, Human
agccugccucuucucuacu

SEQ ID NO: 3368795 - RNA, 13 nt, Human
agccugccuggag

SEQ ID NO: 3368796 - RNA, 15 nt, Human
agccugcgccugcug

SEQ ID NO: 3368797 - RNA, 18 nt, Human
agccugcggccugcugga

SEQ ID NO: 3368798 - RNA, 15 nt, Human
agccugcguggcuga

SEQ ID NO: 3368799 - RNA, 16 nt, Human
agccugcguggcugac

SEQ ID NO: 3368800 - RNA, 17 nt, Human
agccugcguggcugacc

SEQ ID NO: 3368801 - RNA, 23 nt, Human
agccugcguggcugaccccccuc

SEQ ID NO: 3368802 - RNA, 17 nt, Human
agccugcuagcuagcuc

SEQ ID NO: 3368803 - RNA, 10 nt, Human
agccugcuca

SEQ ID NO: 3368804 - RNA, 11 nt, Human
agccugcuccu

SEQ ID NO: 3368805 - RNA, 14 nt, Human
agccugcuccuucc

SEQ ID NO: 3368806 - RNA, 15 nt, Human
agccugcuccuuccc

SEQ ID NO: 3368807 - RNA, 20 nt, Human
agccugcuccuucccaggag

SEQ ID NO: 3368808 - RNA, 16 nt, Human
agccugcuccuucccu

SEQ ID NO: 3368809 - RNA, 17 nt, Human
agccugcuccuucccuu

SEQ ID NO: 3368810 - RNA, 11 nt, Human
agccugcugca

SEQ ID NO: 3368811 - RNA, 17 nt, Human
agccugcugcccaggcu

SEQ ID NO: 3368812 - RNA, 17 nt, Human
agccugcugccugcuuu

SEQ ID NO: 3368813 - RNA, 11 nt, Human
agccugcugga

SEQ ID NO: 3368814 - RNA, 18 nt, Human
agccugcuggcacccacc

SEQ ID NO: 3368815 - RNA, 20 nt, Human
agccugcuggucacagccuc

SEQ ID NO: 3368816 - RNA, 22 nt, Human
agccugcuggucacagccuccu

SEQ ID NO: 3368817 - RNA, 14 nt, Human
agccugcuucccac

SEQ ID NO: 3368818 - RNA, 18 nt, Human
agccuggaaaccugucug

SEQ ID NO: 3368819 - RNA, 10 nt, Human
agccuggacc

SEQ ID NO: 3368820 - RNA, 18 nt, Human
agccuggacccccagcuu

SEQ ID NO: 3368821 - RNA, 16 nt, Human
agccuggaccucugac

SEQ ID NO: 3368822 - RNA, 18 nt, Human
agccuggaccucugacag

SEQ ID NO: 3368823 - RNA, 18 nt, Human
aguuaggcuauucacaac

SEQ ID NO: 3368824 - RNA, 17 nt, Human
aguuagggaauggcaca

SEQ ID NO: 3368825 - RNA, 15 nt, Human
aguuaguagcauguu

SEQ ID NO: 3368826 - RNA, 16 nt, Human
aguuaguagcauguug

SEQ ID NO: 3368827 - RNA, 17 nt, Human
aguuaguagcauguuga

SEQ ID NO: 3368828 - RNA, 20 nt, Human
aguuaguaucuuuugauaug

SEQ ID NO: 3368829 - RNA, 17 nt, Human
aguuaguggaaaucuga

SEQ ID NO: 3368830 - RNA, 23 nt, Human
aguuaguucucucguaacugguu

SEQ ID NO: 3368831 - RNA, 14 nt, Human
aguuauaaaauuaa

SEQ ID NO: 3368832 - RNA, 20 nt, Human
aguuauaaaauuaaaaguuu

SEQ ID NO: 3368833 - RNA, 12 nt, Human
aguuauaagaag

SEQ ID NO: 3368834 - RNA, 21 nt, Human
aguuauaaguagcaggccaag

SEQ ID NO: 3368835 - RNA, 19 nt, Human
aguuauaguauaucuggac

SEQ ID NO: 3368836 - RNA, 15 nt, Human
aguuauagugaauac

SEQ ID NO: 3368837 - RNA, 19 nt, Human
aguuauauaaagagaaaau

SEQ ID NO: 3368838 - RNA, 21 nt, Human
aguuauauaaagagaaaauug

SEQ ID NO: 3368839 - RNA, 22 nt, Human
aguuauauagguuuuguuugcu

SEQ ID NO: 3368840 - RNA, 19 nt, Human
aguuauauuucagauguaa

SEQ ID NO: 3368841 - RNA, 22 nt, Human
aguuauauuucagauguaaugu

SEQ ID NO: 3368842 - RNA, 23 nt, Human
aguuaucagacacucuggcuggu

SEQ ID NO: 3368843 - RNA, 15 nt, Human
aguuaucaugaauuu

SEQ ID NO: 3368844 - RNA, 12 nt, Human
aguuaucauguu

SEQ ID NO: 3368845 - RNA, 17 nt, Human
aguuaucauguuaguaa

SEQ ID NO: 3368846 - RNA, 22 nt, Human
aguuaucauguuaguaauaccu

SEQ ID NO: 3368847 - RNA, 21 nt, Human
aguuauccagaggguugugau

SEQ ID NO: 3368848 - RNA, 17 nt, Human
aguuaucuaagaauaca

SEQ ID NO: 3368849 - RNA, 21 nt, Human
aguuaucuguucuuuugacuu

SEQ ID NO: 3368850 - RNA, 14 nt, Human
aguuaugaaauauu

SEQ ID NO: 3368851 - RNA, 12 nt, Human
aguuaugaauca

SEQ ID NO: 3368852 - RNA, 18 nt, Human
aguuauguaaauaauucu

SEQ ID NO: 3368853 - RNA, 20 nt, Human
aguuauguaaauaauucuuu

SEQ ID NO: 3368854 - RNA, 14 nt, Human
aguuaugugaauga

SEQ ID NO: 3368855 - RNA, 14 nt, Human
aguuauguguaugu

SEQ ID NO: 3368856 - RNA, 14 nt, Human
aguuauguuaaaau

SEQ ID NO: 3368857 - RNA, 14 nt, Human
aguuauuaacuuua

SEQ ID NO: 3368858 - RNA, 18 nt, Human
aguuauuaaguucuuuaa

SEQ ID NO: 3368859 - RNA, 22 nt, Human
aguuauuaauuuuuaaggaugu

SEQ ID NO: 3368860 - RNA, 20 nt, Human
aguuauuacauguaauuuga

SEQ ID NO: 3368861 - RNA, 14 nt, Human
aguuauugaagcag

SEQ ID NO: 3368862 - RNA, 16 nt, Human
aguuauugaagcagag

SEQ ID NO: 3368863 - RNA, 18 nt, Human
aguuauugaagcagagug

SEQ ID NO: 3368864 - RNA, 19 nt, Human
aguuauugaagcagagugg

SEQ ID NO: 3368865 - RNA, 18 nt, Human
aguuauugacaaacucuc

SEQ ID NO: 3368866 - RNA, 21 nt, Human
aguuauugauaaguucauaca

SEQ ID NO: 3368867 - RNA, 22 nt, Human
aguuauugcaguuuaucauuca

SEQ ID NO: 3368868 - RNA, 12 nt, Human
aguuauuggugg

SEQ ID NO: 3368869 - RNA, 19 nt, Human
aguuauuguacagcuguuu

SEQ ID NO: 3368870 - RNA, 21 nt, Human
aguuauuguacagcuguuuaa

SEQ ID NO: 3368871 - RNA, 17 nt, Human
aguuauuuuuguacaug

SEQ ID NO: 3368872 - RNA, 12 nt, Human
aguucaaaaaca

SEQ ID NO: 3368873 - RNA, 20 nt, Human
aguucaaaauucuaaaugua

SEQ ID NO: 3368874 - RNA, 20 nt, Human
aguucaaagucaugauguuu

SEQ ID NO: 3368875 - RNA, 13 nt, Human
aguucaacauguu

SEQ ID NO: 3368876 - RNA, 13 nt, Human
aguucaagaaaug

SEQ ID NO: 3368877 - RNA, 14 nt, Human
aguucaagaaauga

SEQ ID NO: 3368878 - RNA, 23 nt, Human
aguucaauaaacuuaacuuuaac

SEQ ID NO: 3368879 - RNA, 18 nt, Human
aguucaauaaaugucugu

SEQ ID NO: 3368880 - RNA, 19 nt, Human
aguucaauaaaugucuguu

SEQ ID NO: 3368881 - RNA, 13 nt, Human
aguucaaugaucu

SEQ ID NO: 3368882 - RNA, 14 nt, Human
aguucacacccugc

SEQ ID NO: 3368883 - RNA, 17 nt, Human
aguucacacccugcaag

SEQ ID NO: 3368884 - RNA, 22 nt, Human
aguucaccuauuucaaaaauuu

SEQ ID NO: 3368885 - RNA, 16 nt, Human
aguucacuauaaaugg

SEQ ID NO: 3368886 - RNA, 21 nt, Human
aguucacuauaaaugguguuu

SEQ ID NO: 3368887 - RNA, 24 nt, Human
aguucacucuccauuuaauaauua

SEQ ID NO: 3368888 - RNA, 14 nt, Human
aguucagagcugcc

SEQ ID NO: 3368889 - RNA, 15 nt, Human
aguucagagcugccc

SEQ ID NO: 3368890 - RNA, 16 nt, Human
aguucagaguuuucug

SEQ ID NO: 3368891 - RNA, 11 nt, Human
aguucagaucu

SEQ ID NO: 3368892 - RNA, 20 nt, Human
aguucagguagcugccccug

SEQ ID NO: 3368893 - RNA, 15 nt, Human
aguucaguaccugga

SEQ ID NO: 3368894 - RNA, 20 nt, Human
agugucaaguugugcuuguu

SEQ ID NO: 3368895 - RNA, 16 nt, Human
agugucaccuuuucuu

SEQ ID NO: 3368896 - RNA, 14 nt, Human
agugucaggaggaa

SEQ ID NO: 3368897 - RNA, 14 nt, Human
agugucaggcacug

SEQ ID NO: 3368898 - RNA, 15 nt, Human
agugucaggcacugg

SEQ ID NO: 3368899 - RNA, 20 nt, Human
agugucaucagaagauaacu

SEQ ID NO: 3368900 - RNA, 13 nt, Human
aguguccauuuug

SEQ ID NO: 3368901 - RNA, 17 nt, Human
aguguccauuuugugaa

SEQ ID NO: 3368902 - RNA, 20 nt, Human
aguguccauuuugugaagcc

SEQ ID NO: 3368903 - RNA, 14 nt, Human
aguguccccuccac

SEQ ID NO: 3368904 - RNA, 15 nt, Human
aguguccccuccacu

SEQ ID NO: 3368905 - RNA, 21 nt, Human
aguguccccuccacugucaca

SEQ ID NO: 3368906 - RNA, 13 nt, Human
aguguccugagcu

SEQ ID NO: 3368907 - RNA, 21 nt, Human
aguguccugagcucagcgugg

SEQ ID NO: 3368908 - RNA, 14 nt, Human
aguguccuuagaac

SEQ ID NO: 3368909 - RNA, 17 nt, Human
aguguccuucuugcucc

SEQ ID NO: 3368910 - RNA, 20 nt, Human
agugucuggaucaguaaaau

SEQ ID NO: 3368911 - RNA, 23 nt, Human
agugucuggaucaguaaaauuau

SEQ ID NO: 3368912 - RNA, 14 nt, Human
agugucuggcugca

SEQ ID NO: 3368913 - RNA, 22 nt, Human
agugucugugugcaagugugug

SEQ ID NO: 3368914 - RNA, 22 nt, Human
agugucuguguuuugaaagaau

SEQ ID NO: 3368915 - RNA, 15 nt, Human
agugucuuaauuaaa

SEQ ID NO: 3368916 - RNA, 17 nt, Human
agugucuuaauuaaaag

SEQ ID NO: 3368917 - RNA, 13 nt, Human
agugucuuccaua

SEQ ID NO: 3368918 - RNA, 15 nt, Human
agugucuuucuuugg

SEQ ID NO: 3368919 - RNA, 16 nt, Human
agugucuuuuuuugua

SEQ ID NO: 3368920 - RNA, 13 nt, Human
agugugaacaaaa

SEQ ID NO: 3368921 - RNA, 22 nt, Human
agugugaacuggacccuguugc

SEQ ID NO: 3368922 - RNA, 16 nt, Human
agugugaaguacaaua

SEQ ID NO: 3368923 - RNA, 15 nt, Human
agugugaaguuagaa

SEQ ID NO: 3368924 - RNA, 16 nt, Human
agugugaauacugcuu

SEQ ID NO: 3368925 - RNA, 19 nt, Human
agugugaccaaaaguuaca

SEQ ID NO: 3368926 - RNA, 20 nt, Human
agugugacugaucucucgug

SEQ ID NO: 3368927 - RNA, 15 nt, Human
agugugaggccaggg

SEQ ID NO: 3368928 - RNA, 19 nt, Human
agugugaggguccugcagc

SEQ ID NO: 3368929 - RNA, 18 nt, Human
agugugaguaagagcugg

SEQ ID NO: 3368930 - RNA, 19 nt, Human
agugugauugggaauaaau

SEQ ID NO: 3368931 - RNA, 17 nt, Human
agugugcauauuguaca

SEQ ID NO: 3368932 - RNA, 18 nt, Human
agugugcauauuguacac

SEQ ID NO: 3368933 - RNA, 19 nt, Human
agugugcauauuguacacu

SEQ ID NO: 3368934 - RNA, 13 nt, Human
agugugcccccca

SEQ ID NO: 3368935 - RNA, 19 nt, Human
agugugccccccauccugg

SEQ ID NO: 3368936 - RNA, 17 nt, Human
agugugcggcugugugu

SEQ ID NO: 3368937 - RNA, 19 nt, Human
agugugcugcuguaagaaa

SEQ ID NO: 3368938 - RNA, 12 nt, Human
agugugcuggag

SEQ ID NO: 3368939 - RNA, 12 nt, Human
agugugcuuuau

SEQ ID NO: 3368940 - RNA, 21 nt, Human
agugugcuuuaugcugaaaca

SEQ ID NO: 3368941 - RNA, 20 nt, Human
aguguggaagccggagggug

SEQ ID NO: 3368942 - RNA, 15 nt, Human
aguguggaggccacu

SEQ ID NO: 3368943 - RNA, 20 nt, Human
aguguggagucauucucauu

SEQ ID NO: 3368944 - RNA, 12 nt, Human
aguguggagugg

SEQ ID NO: 3368945 - RNA, 18 nt, Human
aguguggccucuucugag

SEQ ID NO: 3368946 - RNA, 20 nt, Human
aguguggcugaggaggccuc

SEQ ID NO: 3368947 - RNA, 15 nt, Human
agugugggaagggag

SEQ ID NO: 3368948 - RNA, 18 nt, Human
agugugggaggcuccugu

SEQ ID NO: 3368949 - RNA, 16 nt, Human
agugugggcuugacca

SEQ ID NO: 3368950 - RNA, 15 nt, Human
agugugggggguccu

SEQ ID NO: 3368951 - RNA, 23 nt, Human
agugugggucuguguguguguau

SEQ ID NO: 3368952 - RNA, 13 nt, Human
agugugguuucuu

SEQ ID NO: 3368953 - RNA, 14 nt, Human
agugugguuucuuu

SEQ ID NO: 3368954 - RNA, 22 nt, Human
agugugguuucuuuuugaaucu

SEQ ID NO: 3368955 - RNA, 16 nt, Human
agugugguuuucuguu

SEQ ID NO: 3368956 - RNA, 18 nt, Human
aguguguauauauuuugu

SEQ ID NO: 3368957 - RNA, 16 nt, Human
aguguguaugugcgug

SEQ ID NO: 3368958 - RNA, 14 nt, Human
aguguguauuaaaa

SEQ ID NO: 3368959 - RNA, 19 nt, Human
aguguguauuaaaaaaaac

SEQ ID NO: 3368960 - RNA, 20 nt, Human
agugugugcacaugugugcg

SEQ ID NO: 3368961 - RNA, 17 nt, Human
agugugugcaugugugu

SEQ ID NO: 3368962 - RNA, 14 nt, Human
agugugugggucua

SEQ ID NO: 3368963 - RNA, 11 nt, Human
agugugugucu

SEQ ID NO: 3368964 - RNA, 12 nt, Human
agugugugucuu

SEQ ID NO: 3368965 - RNA, 14 nt, Human
agugugugugugca

SEQ ID NO: 3368966 - RNA, 19 nt, Human
aguguguguuuuucauaaa

SEQ ID NO: 3368967 - RNA, 19 nt, Human
aguguguuuccuucagugc

SEQ ID NO: 3368968 - RNA, 20 nt, Human
aguguguuuccuucagugca

SEQ ID NO: 3368969 - RNA, 19 nt, Human
aguguuaauacuaguugug

SEQ ID NO: 3368970 - RNA, 22 nt, Human
aguguuacuacagccuuaauau

SEQ ID NO: 3368971 - RNA, 17 nt, Human
aguguuacuuuuuguaa

SEQ ID NO: 3368972 - RNA, 20 nt, Human
aguguuaggccuggcacagu

SEQ ID NO: 3368973 - RNA, 23 nt, Human
aguguuagggaagggccugccac

SEQ ID NO: 3368974 - RNA, 13 nt, Human
aguguuauaugaa

SEQ ID NO: 3368975 - RNA, 13 nt, Human
aguguuauguauu

SEQ ID NO: 3368976 - RNA, 15 nt, Human
aguguuauguauuuc

SEQ ID NO: 3368977 - RNA, 20 nt, Human
aguguuauugagagagaugu

SEQ ID NO: 3368978 - RNA, 17 nt, Human
aguguuauuuucauuca

SEQ ID NO: 3368979 - RNA, 20 nt, Human
aguguuauuuuucaaggaag

SEQ ID NO: 3368980 - RNA, 21 nt, Human
aguguuauuuuucaaggaagg

SEQ ID NO: 3368981 - RNA, 23 nt, Human
aguguucacaaccuggaagugcu

SEQ ID NO: 3368982 - RNA, 21 nt, Human
aguguuccccuuccacugagg

SEQ ID NO: 3368983 - RNA, 15 nt, Human
aguguucccuaucca

SEQ ID NO: 3368984 - RNA, 22 nt, Human
aguguucccuauccaaucaauc

SEQ ID NO: 3368985 - RNA, 23 nt, Human
aguguucccuauccaaucaaucu

SEQ ID NO: 3368986 - RNA, 21 nt, Human
aguguuccgugguuaaacucg

SEQ ID NO: 3368987 - RNA, 20 nt, Human
aguguuccuauuuggggcuu

SEQ ID NO: 3368988 - RNA, 15 nt, Human
aguguucgcuuggcu

SEQ ID NO: 3368989 - RNA, 17 nt, Human
aguguucugcaaaaaua

SEQ ID NO: 3368990 - RNA, 16 nt, Human
aguguucuguuacaaa

SEQ ID NO: 3368991 - RNA, 17 nt, Human
aguguucuguuacaaaa

SEQ ID NO: 3368992 - RNA, 21 nt, Human
aguguucuguuacaaaaugua

SEQ ID NO: 3368993 - RNA, 22 nt, Human
aguguucuguuacaaaauguaa

SEQ ID NO: 3368994 - RNA, 23 nt, Human
aguguucuguuacaaaauguaac

SEQ ID NO: 3368995 - RNA, 15 nt, Human
aguguucuguuuaau

SEQ ID NO: 3368996 - RNA, 22 nt, Human
aguguucuguuuguuauuguuu

SEQ ID NO: 3368997 - RNA, 19 nt, Human
aguguugaagggagguggc

SEQ ID NO: 3368998 - RNA, 17 nt, Human
aguguugagccuuuucc

SEQ ID NO: 3368999 - RNA, 16 nt, Human
aguguugcauggaugu

SEQ ID NO: 3369000 - RNA, 14 nt, Human
aguguugccuaagu

SEQ ID NO: 3369001 - RNA, 23 nt, Human
aguguugccuaaguauuaaaaca

SEQ ID NO: 3369002 - RNA, 18 nt, Human
aguguuggagaagaacug

SEQ ID NO: 3369003 - RNA, 22 nt, Human
aguguugggguuugguuuuguu

SEQ ID NO: 3369004 - RNA, 13 nt, Human
aguguuguuugua

SEQ ID NO: 3369005 - RNA, 14 nt, Human
aguguuguuuguaa

SEQ ID NO: 3369006 - RNA, 19 nt, Human
aguguuguuuguaaauaag

SEQ ID NO: 3369007 - RNA, 15 nt, Human
aguguuuaaaacuuc

SEQ ID NO: 3369008 - RNA, 17 nt, Human
aguguuuaacuugucaa

SEQ ID NO: 3369009 - RNA, 22 nt, Human
aguguuuauuuuucauauugug

SEQ ID NO: 3369010 - RNA, 18 nt, Human
aguguuucagcuaaggga

SEQ ID NO: 3369011 - RNA, 21 nt, Human
aguguuucgcggguaacuggg

SEQ ID NO: 3369012 - RNA, 13 nt, Human
aguguuucuauga

SEQ ID NO: 3369013 - RNA, 12 nt, Human
aguguuuggggg

SEQ ID NO: 3369014 - RNA, 23 nt, Human
aguguuugggggacguuucucau

SEQ ID NO: 3369015 - RNA, 21 nt, Human
aguguuuggguauauucauuu

SEQ ID NO: 3369016 - RNA, 17 nt, Human
aguguuuuaaauucuga

SEQ ID NO: 3369017 - RNA, 17 nt, Human
aguguuuuaagaaaugu

SEQ ID NO: 3369018 - RNA, 20 nt, Human
aguguuuuaagauaaauuau

SEQ ID NO: 3369019 - RNA, 18 nt, Human
aguguuuucaauuuuaaa

SEQ ID NO: 3369020 - RNA, 12 nt, Human
aguguuuucaga

SEQ ID NO: 3369021 - RNA, 18 nt, Human
aguguuuuggaauaaaau

SEQ ID NO: 3369022 - RNA, 14 nt, Human
aguguuuuggacuc

SEQ ID NO: 3369023 - RNA, 21 nt, Human
aguguuuuggacuccaucucu

SEQ ID NO: 3369024 - RNA, 14 nt, Human
aguguuuuguacca

SEQ ID NO: 3369025 - RNA, 16 nt, Human
aguguuuuuaccucug

SEQ ID NO: 3369026 - RNA, 15 nt, Human
aguguuuuuguaaag

SEQ ID NO: 3369027 - RNA, 18 nt, Human
aguguuuuuguaaagugu

SEQ ID NO: 3369028 - RNA, 20 nt, Human
auaaaaggucggaccagcuu

SEQ ID NO: 3369029 - RNA, 16 nt, Human
auaaaaggucuaugcu

SEQ ID NO: 3369030 - RNA, 15 nt, Human
auaaaaguacauguu

SEQ ID NO: 3369031 - RNA, 14 nt, Human
auaaaagugauugu

SEQ ID NO: 3369032 - RNA, 18 nt, Human
auaaaagugauuguuggc

SEQ ID NO: 3369033 - RNA, 16 nt, Human
auaaaagugcacaccu

SEQ ID NO: 3369034 - RNA, 13 nt, Human
auaaaauaaauau

SEQ ID NO: 3369035 - RNA, 16 nt, Human
auaaaauaaauauaua

SEQ ID NO: 3369036 - RNA, 17 nt, Human
auaaaauaacuaaaaug

SEQ ID NO: 3369037 - RNA, 17 nt, Human
auaaaauaauucuaaag

SEQ ID NO: 3369038 - RNA, 15 nt, Human
auaaaauaauuuuua

SEQ ID NO: 3369039 - RNA, 23 nt, Human
aguucagagcugcccucuccugg

SEQ ID NO: 3369040 - RNA, 12 nt, Human
aguucagaguuu

SEQ ID NO: 3369041 - RNA, 15 nt, Human
aguucagaguuuucu

SEQ ID NO: 3369042 - RNA, 13 nt, Human
aguucagaucuua

SEQ ID NO: 3369043 - RNA, 22 nt, Human
aguucagaucuuaauauaaauu

SEQ ID NO: 3369044 - RNA, 18 nt, Human
auaaauaccucuuagcug

SEQ ID NO: 3369045 - RNA, 23 nt, Human
auaaauaccucuuagcugagugg

SEQ ID NO: 3369046 - RNA, 18 nt, Human
auaaauacugcaaaucag

SEQ ID NO: 3369047 - RNA, 14 nt, Human
auaaauagaaugua

SEQ ID NO: 3369048 - RNA, 16 nt, Human
auaaauagaauguaaa

SEQ ID NO: 3369049 - RNA, 19 nt, Human
auaaauagaauguaaaugu

SEQ ID NO: 3369050 - RNA, 13 nt, Human
auaaauagagcaa

SEQ ID NO: 3369051 - RNA, 22 nt, Human
auaaauagcuagacuggugacu

SEQ ID NO: 3369052 - RNA, 14 nt, Human
auaaauagcuauau

SEQ ID NO: 3369053 - RNA, 16 nt, Human
auaaauaggagaggau

SEQ ID NO: 3369054 - RNA, 15 nt, Human
auaaauaguguuauu

SEQ ID NO: 3369055 - RNA, 15 nt, Human
auaaauaguuuauga

SEQ ID NO: 3369056 - RNA, 23 nt, Human
auaaauauauaaaaagaaaagau

SEQ ID NO: 3369057 - RNA, 15 nt, Human
auaaauauauacauu

SEQ ID NO: 3369058 - RNA, 12 nt, Human
auaaauauauau

SEQ ID NO: 3369059 - RNA, 16 nt, Human
auaaauauauauaaag

SEQ ID NO: 3369060 - RNA, 19 nt, Human
auaaauauauauaaagaau

SEQ ID NO: 3369061 - RNA, 21 nt, Human
auaaauauauauaaagaauau

SEQ ID NO: 3369062 - RNA, 22 nt, Human
auaaauauauauauauauaaaa

SEQ ID NO: 3369063 - RNA, 21 nt, Human
auaaauauccuuuaauugauc

SEQ ID NO: 3369064 - RNA, 15 nt, Human
auaaauaugagugcc

SEQ ID NO: 3369065 - RNA, 22 nt, Human
auaaauauuauauuauauauau

SEQ ID NO: 3369066 - RNA, 14 nt, Human
auaaaucaauguca

SEQ ID NO: 3369067 - RNA, 15 nt, Human
auaaaucaaugucac

SEQ ID NO: 3369068 - RNA, 21 nt, Human
auaaaucagugggauuuggua

SEQ ID NO: 3369069 - RNA, 15 nt, Human
auaaaucauauugau

SEQ ID NO: 3369070 - RNA, 21 nt, Human
auaaaucauucuuacuaaaaa

SEQ ID NO: 3369071 - RNA, 15 nt, Human
auaaaucauuuuaug

SEQ ID NO: 3369072 - RNA, 16 nt, Human
auaaaucauuuuaugu

SEQ ID NO: 3369073 - RNA, 14 nt, Human
auaaauccagugac

SEQ ID NO: 3369074 - RNA, 15 nt, Human
auaaaucugugaacu

SEQ ID NO: 3369075 - RNA, 14 nt, Human
auaaaucuuaaaaa

SEQ ID NO: 3369076 - RNA, 11 nt, Human
auaaaugaagc

SEQ ID NO: 3369077 - RNA, 17 nt, Human
auaaaugaagcagcuuu

SEQ ID NO: 3369078 - RNA, 21 nt, Human
auaaaugaaguuuauacagua

SEQ ID NO: 3369079 - RNA, 11 nt, Human
auaaaugaaug

SEQ ID NO: 3369080 - RNA, 17 nt, Human
auaaaugagcuauguau

SEQ ID NO: 3369081 - RNA, 15 nt, Human
auaaaugauucaaaa

SEQ ID NO: 3369082 - RNA, 13 nt, Human
auaaaugcaaaua

SEQ ID NO: 3369083 - RNA, 23 nt, Human
auaaaugcaauauuaaugccuuu

SEQ ID NO: 3369084 - RNA, 15 nt, Human
auaaaugcagcccau

SEQ ID NO: 3369085 - RNA, 18 nt, Human
auaaaugcagcccauuuc

SEQ ID NO: 3369086 - RNA, 17 nt, Human
auaaaugccaucaauaa

SEQ ID NO: 3369087 - RNA, 19 nt, Human
auaaaugcuauuuuuuauu

SEQ ID NO: 3369088 - RNA, 13 nt, Human
auaaaugggaaca

SEQ ID NO: 3369089 - RNA, 19 nt, Human
auaaaugggaacauuuauu

SEQ ID NO: 3369090 - RNA, 22 nt, Human
auaaaugguuaaaagagguuuu

SEQ ID NO: 3369091 - RNA, 21 nt, Human
auaaaugguuuggugcuuuuu

SEQ ID NO: 3369092 - RNA, 19 nt, Human
auaaauguaaaaauaauaa

SEQ ID NO: 3369093 - RNA, 18 nt, Human
auaaauguaccagagaga

SEQ ID NO: 3369094 - RNA, 19 nt, Human
auaaauguauaaauauaca

SEQ ID NO: 3369095 - RNA, 20 nt, Human
auaaauguauaaauauacag

SEQ ID NO: 3369096 - RNA, 20 nt, Human
auaaauguauauacacauau

SEQ ID NO: 3369097 - RNA, 15 nt, Human
auaaauguaucuuau

SEQ ID NO: 3369098 - RNA, 12 nt, Human
auaaaugucacu

SEQ ID NO: 3369099 - RNA, 19 nt, Human
auaaaugucacuuuuugag

SEQ ID NO: 3369100 - RNA, 23 nt, Human
auaaaugucacuuuuugaggcaa

SEQ ID NO: 3369101 - RNA, 21 nt, Human
auaaaugucauuaaaauaaau

SEQ ID NO: 3369102 - RNA, 15 nt, Human
auaaaugucuguuga

SEQ ID NO: 3369103 - RNA, 12 nt, Human
auaaaugucuuu

SEQ ID NO: 3369104 - RNA, 19 nt, Human
auaaaugugccuucauuuu

SEQ ID NO: 3369105 - RNA, 14 nt, Human
auaaauguguguau

SEQ ID NO: 3369106 - RNA, 14 nt, Human
auaaauguguuggg

SEQ ID NO: 3369107 - RNA, 16 nt, Human
auaaauguuaagaaaa

SEQ ID NO: 3369108 - RNA, 15 nt, Human
auaaauuauacaaau

SEQ ID NO: 3369109 - RNA, 14 nt, Human
auaaauuauauucc

SEQ ID NO: 3369110 - RNA, 13 nt, Human
auaaauuauggua

SEQ ID NO: 3369111 - RNA, 21 nt, Human
auaaauuaugguaaaauuuug

SEQ ID NO: 3369112 - RNA, 19 nt, Human
auaaauuauuguuuuucuu

SEQ ID NO: 3369113 - RNA, 14 nt, Human
auaaauuauuuauu

SEQ ID NO: 3369114 - RNA, 15 nt, Human
auaaauucaacuuug

SEQ ID NO: 3369115 - RNA, 15 nt, Human
auaaauucaccuagu

SEQ ID NO: 3369116 - RNA, 14 nt, Human
auaaauucacuuuc

SEQ ID NO: 3369117 - RNA, 15 nt, Human
auaaauucacuuuca

SEQ ID NO: 3369118 - RNA, 22 nt, Human
auaaauucccuggccuuucaua

SEQ ID NO: 3369119 - RNA, 22 nt, Human
auaaauugaaauauaaugcaaa

SEQ ID NO: 3369120 - RNA, 13 nt, Human
auaaauugcucaa

SEQ ID NO: 3369121 - RNA, 16 nt, Human
auaaauugcuccuuga

SEQ ID NO: 3369122 - RNA, 17 nt, Human
auaaauuguacagccgg

SEQ ID NO: 3369123 - RNA, 14 nt, Human
auaaauuguauauu

SEQ ID NO: 3369124 - RNA, 16 nt, Human
auaaauuguauauuca

SEQ ID NO: 3369125 - RNA, 15 nt, Human
auaaauuguuugacc

SEQ ID NO: 3369126 - RNA, 15 nt, Human
auaaauuuauaugaa

SEQ ID NO: 3369127 - RNA, 15 nt, Human
auaaauuuauuuacu

SEQ ID NO: 3369128 - RNA, 20 nt, Human
auaaauuugguucuaauaga

SEQ ID NO: 3369129 - RNA, 15 nt, Human
auaaauuuugaaaag

SEQ ID NO: 3369130 - RNA, 21 nt, Human
auaaauuuugaaaaguaauau

SEQ ID NO: 3369131 - RNA, 19 nt, Human
auaaauuuuuuuuguuuca

SEQ ID NO: 3369132 - RNA, 22 nt, Human
auaaauuuuuuuuguuucauau

SEQ ID NO: 3369133 - RNA, 23 nt, Human
auaacaaagauaucuuuucuuua

SEQ ID NO: 3369134 - RNA, 17 nt, Human
auaacaaaugccaaauu

SEQ ID NO: 3369135 - RNA, 20 nt, Human
auaacaaaugccaaauuaaa

SEQ ID NO: 3369136 - RNA, 13 nt, Human
auaacaaauucug

SEQ ID NO: 3369137 - RNA, 12 nt, Human
auaacaagaaaa

SEQ ID NO: 3369138 - RNA, 22 nt, Human
auaacaagacuuugacuugggg

SEQ ID NO: 3369139 - RNA, 14 nt, Human
auaacaagaucuuu

SEQ ID NO: 3369140 - RNA, 17 nt, Human
auaacaagguccaagau

SEQ ID NO: 3369141 - RNA, 17 nt, Human
auaacaaugcuguauuu

SEQ ID NO: 3369142 - RNA, 20 nt, Human
auaacaaugcuguauuuuaa

SEQ ID NO: 3369143 - RNA, 13 nt, Human
auaacaauguuaa

SEQ ID NO: 3369144 - RNA, 16 nt, Human
auaacaauguuaagga

SEQ ID NO: 3369145 - RNA, 13 nt, Human
auaacacagagag

SEQ ID NO: 3369146 - RNA, 14 nt, Human
auaacacagagaga

SEQ ID NO: 3369147 - RNA, 18 nt, Human
auaacaccaccauucaca

SEQ ID NO: 3369148 - RNA, 17 nt, Human
auaacacccuuccuucu

SEQ ID NO: 3369149 - RNA, 21 nt, Human
auaacacccuuccuucuguaa

SEQ ID NO: 3369150 - RNA, 23 nt, Human
auaacacucuaggauguauauuu

SEQ ID NO: 3369151 - RNA, 21 nt, Human
auaacagaagaaaauagaauu

SEQ ID NO: 3369152 - RNA, 16 nt, Human
auaacagauacauuuc

SEQ ID NO: 3369153 - RNA, 20 nt, Human
auaacagcuaccaugacaac

SEQ ID NO: 3369154 - RNA, 19 nt, Human
auaacagcugcaauucccu

SEQ ID NO: 3369155 - RNA, 21 nt, Human
auaacagcugcaauucccugg

SEQ ID NO: 3369156 - RNA, 19 nt, Human
auaacagggauugauuuua

SEQ ID NO: 3369157 - RNA, 20 nt, Human
auaacaggguaaauuauuca

SEQ ID NO: 3369158 - RNA, 22 nt, Human
auaacaggguaaauuauucagu

SEQ ID NO: 3369159 - RNA, 13 nt, Human
auaacagguuauu

SEQ ID NO: 3369160 - RNA, 14 nt, Human
auaacagguuauuu

SEQ ID NO: 3369161 - RNA, 22 nt, Human
auaacagguuauuuuaguuucu

SEQ ID NO: 3369162 - RNA, 19 nt, Human
auaacauaaaucugugaac

SEQ ID NO: 3369163 - RNA, 16 nt, Human
auaacauaaauuuuuu

SEQ ID NO: 3369164 - RNA, 12 nt, Human
auaacauagaau

SEQ ID NO: 3369165 - RNA, 14 nt, Human
auaacaucuuuauu

SEQ ID NO: 3369166 - RNA, 20 nt, Human
auaacauguaauuaaguacu

SEQ ID NO: 3369167 - RNA, 19 nt, Human
auaacaugugaaaagaaua

SEQ ID NO: 3369168 - RNA, 14 nt, Human
auaaccaauguuua

SEQ ID NO: 3369169 - RNA, 14 nt, Human
auaaccacugaagg

SEQ ID NO: 3369170 - RNA, 13 nt, Human
auaaccacuuaaa

SEQ ID NO: 3369171 - RNA, 16 nt, Human
auaaccagacacaaac

SEQ ID NO: 3369172 - RNA, 18 nt, Human
auaaccccauucuuugcu

SEQ ID NO: 3369173 - RNA, 13 nt, Human
auaacccuguuac

SEQ ID NO: 3369174 - RNA, 13 nt, Human
auaacccuucaac

SEQ ID NO: 3369175 - RNA, 19 nt, Human
auaaccuaguuaaagaaag

SEQ ID NO: 3369176 - RNA, 23 nt, Human
auaaccucaagucacaugagaau

SEQ ID NO: 3369177 - RNA, 14 nt, Human
auaacgaaguuggg

SEQ ID NO: 3369178 - RNA, 13 nt, Human
auaacgccccaga

SEQ ID NO: 3369179 - RNA, 21 nt, Human
auaacgccccagauaccagcc

SEQ ID NO: 3369180 - RNA, 16 nt, Human
auaacgcuuaaaggaa

SEQ ID NO: 3369181 - RNA, 20 nt, Human
auaacguuuaagccaaaaca

SEQ ID NO: 3369182 - RNA, 22 nt, Human
auaacguuuaagccaaaacaau

SEQ ID NO: 3369183 - RNA, 13 nt, Human
auaacguuuuucc

SEQ ID NO: 3369184 - RNA, 15 nt, Human
agcuucagccaggag

SEQ ID NO: 3369185 - RNA, 19 nt, Human
agcuucagccaggagcugg

SEQ ID NO: 3369186 - RNA, 13 nt, Human
agcuucaggaggg

SEQ ID NO: 3369187 - RNA, 16 nt, Human
agcuucaguugcuugu

SEQ ID NO: 3369188 - RNA, 23 nt, Human
agcuucaguugcuugucuucugg

SEQ ID NO: 3369189 - RNA, 17 nt, Human
agcuucaugccuuugua

SEQ ID NO: 3369190 - RNA, 20 nt, Human
agcuucauguggcuucccuu

SEQ ID NO: 3369191 - RNA, 16 nt, Human
agcuucauucuccuug

SEQ ID NO: 3369192 - RNA, 17 nt, Human
agcuucauuugugucaa

SEQ ID NO: 3369193 - RNA, 22 nt, Human
agcuuccaggaaaaaggacagg

SEQ ID NO: 3369194 - RNA, 17 nt, Human
agcuuccaguccaaucu

SEQ ID NO: 3369195 - RNA, 18 nt, Human
agcuuccauagcugcugc

SEQ ID NO: 3369196 - RNA, 19 nt, Human
agcuuccauagcugcugcc

SEQ ID NO: 3369197 - RNA, 21 nt, Human
agcuuccauagcugcugcccu

SEQ ID NO: 3369198 - RNA, 15 nt, Human
agcuuccauuuuaau

SEQ ID NO: 3369199 - RNA, 17 nt, Human
agcuuccccucucuccu

SEQ ID NO: 3369200 - RNA, 21 nt, Human
agcuucccuccccucuaguuu

SEQ ID NO: 3369201 - RNA, 23 nt, Human
agcuucccucccguguguucucc

SEQ ID NO: 3369202 - RNA, 22 nt, Human
agcuuccuacccacaccucugc

SEQ ID NO: 3369203 - RNA, 16 nt, Human
agcuuccuucagagag

SEQ ID NO: 3369204 - RNA, 23 nt, Human
agcuuccuucagagagcagugcu

SEQ ID NO: 3369205 - RNA, 17 nt, Human
agcuucuaauaaauuau

SEQ ID NO: 3369206 - RNA, 17 nt, Human
agcuucuaccaugaaca

SEQ ID NO: 3369207 - RNA, 23 nt, Human
agcuucuauuauagccacauccc

SEQ ID NO: 3369208 - RNA, 15 nt, Human
agcuucuccaggcuc

SEQ ID NO: 3369209 - RNA, 23 nt, Human
agcuucuccaggcucuuuggggu

SEQ ID NO: 3369210 - RNA, 16 nt, Human
agcuucucuuuaacuc

SEQ ID NO: 3369211 - RNA, 23 nt, Human
agcuucucuuuaacucaggacuc

SEQ ID NO: 3369212 - RNA, 17 nt, Human
agcuucugaccucagca

SEQ ID NO: 3369213 - RNA, 13 nt, Human
agcuucugagacg

SEQ ID NO: 3369214 - RNA, 19 nt, Human
agcuucugagacgucauga

SEQ ID NO: 3369215 - RNA, 17 nt, Human
agcuucugcccccugca

SEQ ID NO: 3369216 - RNA, 15 nt, Human
agcuucugcugggcu

SEQ ID NO: 3369217 - RNA, 12 nt, Human
agcuucugcuuu

SEQ ID NO: 3369218 - RNA, 21 nt, Human
agcuucugcuuuucugcccug

SEQ ID NO: 3369219 - RNA, 22 nt, Human
agcuucugcuuuucugcccugg

SEQ ID NO: 3369220 - RNA, 22 nt, Human
agcuucugggagauuuuuuuga

SEQ ID NO: 3369221 - RNA, 18 nt, Human
agcuucugggguccccag

SEQ ID NO: 3369222 - RNA, 19 nt, Human
agcuucugguacucuccua

SEQ ID NO: 3369223 - RNA, 23 nt, Human
agcuucugguacucuccuagaga

SEQ ID NO: 3369224 - RNA, 12 nt, Human
agcuucuguccu

SEQ ID NO: 3369225 - RNA, 20 nt, Human
agcuucuguugcugccucau

SEQ ID NO: 3369226 - RNA, 21 nt, Human
agcuucuguugcugccucaug

SEQ ID NO: 3369227 - RNA, 14 nt, Human
agcuucuuaauuaa

SEQ ID NO: 3369228 - RNA, 21 nt, Human
agcuucuuaauuaauuugauu

SEQ ID NO: 3369229 - RNA, 12 nt, Human
agcuucuuccag

SEQ ID NO: 3369230 - RNA, 13 nt, Human
agcuucuuguuuc

SEQ ID NO: 3369231 - RNA, 19 nt, Human
agcuucuuguuuccuuguu

SEQ ID NO: 3369232 - RNA, 14 nt, Human
agcuucuuugccaa

SEQ ID NO: 3369233 - RNA, 17 nt, Human
agcuugaaacugagaug

SEQ ID NO: 3369234 - RNA, 22 nt, Human
agcuugaagaucguuaguaucu

SEQ ID NO: 3369235 - RNA, 22 nt, Human
agcuugaccgugaggccagaga

SEQ ID NO: 3369236 - RNA, 14 nt, Human
agcuugaccugagg

SEQ ID NO: 3369237 - RNA, 22 nt, Human
agcuugaggguugggcuggugu

SEQ ID NO: 3369238 - RNA, 15 nt, Human
agcuugauuaaauca

SEQ ID NO: 3369239 - RNA, 19 nt, Human
agcuugccagaugcugcag

SEQ ID NO: 3369240 - RNA, 18 nt, Human
agcuugcccuguuaaaag

SEQ ID NO: 3369241 - RNA, 15 nt, Human
agcuugcucacaucu

SEQ ID NO: 3369242 - RNA, 17 nt, Human
agcuugcucccuguguc

SEQ ID NO: 3369243 - RNA, 14 nt, Human
agcuugcucuucag

SEQ ID NO: 3369244 - RNA, 22 nt, Human
agcuugcucuucagugggagaa

SEQ ID NO: 3369245 - RNA, 16 nt, Human
agcuugcugcacccca

SEQ ID NO: 3369246 - RNA, 20 nt, Human
agcuugcugcaccccaaguc

SEQ ID NO: 3369247 - RNA, 12 nt, Human
agcuugcuuuga

SEQ ID NO: 3369248 - RNA, 13 nt, Human
agcuuggcagccg

SEQ ID NO: 3369249 - RNA, 16 nt, Human
agcuuggcucaggcug

SEQ ID NO: 3369250 - RNA, 16 nt, Human
agcuuggcuguagaag

SEQ ID NO: 3369251 - RNA, 16 nt, Human
agcuugggacaaauca

SEQ ID NO: 3369252 - RNA, 16 nt, Human
auaaaauuauuugcag

SEQ ID NO: 3369253 - RNA, 17 nt, Human
auaaaauucccuaaagc

SEQ ID NO: 3369254 - RNA, 11 nt, Human
auaaaauugua

SEQ ID NO: 3369255 - RNA, 23 nt, Human
auaaaauuguaaaauuguauaga

SEQ ID NO: 3369256 - RNA, 12 nt, Human
auaaaauuuaaa

SEQ ID NO: 3369257 - RNA, 20 nt, Human
auaaaauuuaaaaaauaaau

SEQ ID NO: 3369258 - RNA, 16 nt, Human
auaaaauuuguugcau

SEQ ID NO: 3369259 - RNA, 15 nt, Human
auaaacaaaguuacu

SEQ ID NO: 3369260 - RNA, 16 nt, Human
auaaacaacuuaaugu

SEQ ID NO: 3369261 - RNA, 16 nt, Human
auaaacaagaaaaaua

SEQ ID NO: 3369262 - RNA, 19 nt, Human
auaaacaagaaaaauaaag

SEQ ID NO: 3369263 - RNA, 21 nt, Human
auaaacaagaaaaauaaagaa

SEQ ID NO: 3369264 - RNA, 14 nt, Human
auaaacaagaauga

SEQ ID NO: 3369265 - RNA, 15 nt, Human
auaaacaagaaugaa

SEQ ID NO: 3369266 - RNA, 22 nt, Human
auaaacaagaccacguuucuaa

SEQ ID NO: 3369267 - RNA, 17 nt, Human
auaaacacccaugaauc

SEQ ID NO: 3369268 - RNA, 12 nt, Human
auaaacacugug

SEQ ID NO: 3369269 - RNA, 12 nt, Human
auaaacacuguu

SEQ ID NO: 3369270 - RNA, 19 nt, Human
auaaacagacaauauguga

SEQ ID NO: 3369271 - RNA, 15 nt, Human
auaaacagaugaaua

SEQ ID NO: 3369272 - RNA, 22 nt, Human
auaaacagcuucaugccuuugu

SEQ ID NO: 3369273 - RNA, 16 nt, Human
auaaacaucacacaca

SEQ ID NO: 3369274 - RNA, 21 nt, Human
auaaacauccuucaagaacuc

SEQ ID NO: 3369275 - RNA, 13 nt, Human
auaaaccaaagga

SEQ ID NO: 3369276 - RNA, 17 nt, Human
auaaaccaaugaacgaa

SEQ ID NO: 3369277 - RNA, 21 nt, Human
auaaacccaguugccaucugc

SEQ ID NO: 3369278 - RNA, 18 nt, Human
auaaaccucuaauuuauu

SEQ ID NO: 3369279 - RNA, 18 nt, Human
auaaacgauuuaauucuc

SEQ ID NO: 3369280 - RNA, 15 nt, Human
auaaacgcaagcuga

SEQ ID NO: 3369281 - RNA, 20 nt, Human
auaaacgcgggaaaaaagau

SEQ ID NO: 3369282 - RNA, 15 nt, Human
auaaacgucuuaaau

SEQ ID NO: 3369283 - RNA, 16 nt, Human
auaaacgucuuaaaua

SEQ ID NO: 3369284 - RNA, 17 nt, Human
auaaacguggauguuac

SEQ ID NO: 3369285 - RNA, 17 nt, Human
auaaacuaaagaaaaau

SEQ ID NO: 3369286 - RNA, 19 nt, Human
auaaacuacucuuugauuu

SEQ ID NO: 3369287 - RNA, 17 nt, Human
auaaacuagauuacauu

SEQ ID NO: 3369288 - RNA, 14 nt, Human
auaaacuaucaguu

SEQ ID NO: 3369289 - RNA, 13 nt, Human
auaaacucuuuua

SEQ ID NO: 3369290 - RNA, 15 nt, Human
auaaacugacuuuau

SEQ ID NO: 3369291 - RNA, 18 nt, Human
auaaacugacuuuauccu

SEQ ID NO: 3369292 - RNA, 23 nt, Human
auaaacuuagugcggacaaguuu

SEQ ID NO: 3369293 - RNA, 11 nt, Human
auaaacuucag

SEQ ID NO: 3369294 - RNA, 12 nt, Human
auaaacuucagc

SEQ ID NO: 3369295 - RNA, 16 nt, Human
auaaacuuuaauauaa

SEQ ID NO: 3369296 - RNA, 13 nt, Human
auaaacuuuaccu

SEQ ID NO: 3369297 - RNA, 16 nt, Human
auaaacuuuaccuuuu

SEQ ID NO: 3369298 - RNA, 24 nt, Human
auaaacuuuaccuuuuuuauacau

SEQ ID NO: 3369299 - RNA, 14 nt, Human
auaaacuuuuagaa

SEQ ID NO: 3369300 - RNA, 20 nt, Human
auaaacuuuuuucuuacugu

SEQ ID NO: 3369301 - RNA, 19 nt, Human
auaaagaaaacuuccauag

SEQ ID NO: 3369302 - RNA, 17 nt, Human
auaaagaaaagaugcac

SEQ ID NO: 3369303 - RNA, 13 nt, Human
auaaagaaaauga

SEQ ID NO: 3369304 - RNA, 17 nt, Human
auaaagaaauugcaaua

SEQ ID NO: 3369305 - RNA, 15 nt, Human
auaaagaacaaggua

SEQ ID NO: 3369306 - RNA, 23 nt, Human
auaaagaagcaauaaagaagagu

SEQ ID NO: 3369307 - RNA, 16 nt, Human
auaaagaauacuugaa

SEQ ID NO: 3369308 - RNA, 15 nt, Human
auaaagaauaggacu

SEQ ID NO: 3369309 - RNA, 19 nt, Human
auaaagaauaggacuuguu

SEQ ID NO: 3369310 - RNA, 19 nt, Human
auaaagacaaccauauuua

SEQ ID NO: 3369311 - RNA, 11 nt, Human
auaaagacagg

SEQ ID NO: 3369312 - RNA, 17 nt, Human
auaaagaccagaaauuc

SEQ ID NO: 3369313 - RNA, 16 nt, Human
auaaagacguuuuaua

SEQ ID NO: 3369314 - RNA, 16 nt, Human
auaaagagaaaauuga

SEQ ID NO: 3369315 - RNA, 21 nt, Human
auaaagagagaaaaacaaauu

SEQ ID NO: 3369316 - RNA, 20 nt, Human
auaaagagagaacaggacua

SEQ ID NO: 3369317 - RNA, 13 nt, Human
auaaagaguuaga

SEQ ID NO: 3369318 - RNA, 18 nt, Human
auaaagaucgcccccacc

SEQ ID NO: 3369319 - RNA, 15 nt, Human
auaaagaugcucuuu

SEQ ID NO: 3369320 - RNA, 18 nt, Human
auaaagauuauauaaaga

SEQ ID NO: 3369321 - RNA, 20 nt, Human
auaaagauuucuugaguuuu

SEQ ID NO: 3369322 - RNA, 18 nt, Human
auaaagauuuuuuaauaa

SEQ ID NO: 3369323 - RNA, 21 nt, Human
auaaagauuuuuuaauaauuu

SEQ ID NO: 3369324 - RNA, 12 nt, Human
auaaagcaaaua

SEQ ID NO: 3369325 - RNA, 10 nt, Human
auaaagcaau

SEQ ID NO: 3369326 - RNA, 14 nt, Human
auaaagcaauaaga

SEQ ID NO: 3369327 - RNA, 13 nt, Human
auaaagcaauuuu

SEQ ID NO: 3369328 - RNA, 18 nt, Human
auaaagcaauuuuccuug

SEQ ID NO: 3369329 - RNA, 16 nt, Human
agcuuugcuaccaaag

SEQ ID NO: 3369330 - RNA, 10 nt, Human
agcuuugcuc

SEQ ID NO: 3369331 - RNA, 20 nt, Human
agcuuugcucauauuuccca

SEQ ID NO: 3369332 - RNA, 21 nt, Human
agcuuugcucuuugguagaaa

SEQ ID NO: 3369333 - RNA, 16 nt, Human
agcuuuggaaacagga

SEQ ID NO: 3369334 - RNA, 18 nt, Human
agcuuuggaaguuuagcu

SEQ ID NO: 3369335 - RNA, 20 nt, Human
agcuuuggacacacacagcu

SEQ ID NO: 3369336 - RNA, 19 nt, Human
agcuuuggaccuaauccaa

SEQ ID NO: 3369337 - RNA, 20 nt, Human
agcuuuggacgcacacagcu

SEQ ID NO: 3369338 - RNA, 18 nt, Human
agcuuuguccccugcuuc

SEQ ID NO: 3369339 - RNA, 17 nt, Human
agcuuuguguuugguuu

SEQ ID NO: 3369340 - RNA, 16 nt, Human
agcuuuguuuguucuu

SEQ ID NO: 3369341 - RNA, 17 nt, Human
agcuuuguuuguucuug

SEQ ID NO: 3369342 - RNA, 23 nt, Human
agcuuuguuuguugucagcugaa

SEQ ID NO: 3369343 - RNA, 16 nt, Human
agcuuuuaaacccuau

SEQ ID NO: 3369344 - RNA, 16 nt, Human
agcuuuuacucccuga

SEQ ID NO: 3369345 - RNA, 23 nt, Human
agcuuuuaguacccaccugagcu

SEQ ID NO: 3369346 - RNA, 22 nt, Human
agcuuuucaccuuuacuuuaga

SEQ ID NO: 3369347 - RNA, 15 nt, Human
agcuuuucccuuuuu

SEQ ID NO: 3369348 - RNA, 21 nt, Human
agcuuuucccuuuuuuuaagu

SEQ ID NO: 3369349 - RNA, 21 nt, Human
agcuuuugugggggacuguaa

SEQ ID NO: 3369350 - RNA, 12 nt, Human
agcuuuuuaauu

SEQ ID NO: 3369351 - RNA, 17 nt, Human
agcuuuuugucuuuucu

SEQ ID NO: 3369352 - RNA, 18 nt, Human
agcuuuuuuacacaaaug

SEQ ID NO: 3369353 - RNA, 21 nt, Human
agcuuuuuuccuuaauccagc

SEQ ID NO: 3369354 - RNA, 24 nt, Human
aggaaaaaaacuauuaaggaugua

SEQ ID NO: 3369355 - RNA, 15 nt, Human
aggaaaaaaacuuuu

SEQ ID NO: 3369356 - RNA, 17 nt, Human
aggaaaaaaacuuuuau

SEQ ID NO: 3369357 - RNA, 15 nt, Human
aggaaaaaaagcaug

SEQ ID NO: 3369358 - RNA, 14 nt, Human
aggaaaaaaaugac

SEQ ID NO: 3369359 - RNA, 15 nt, Human
aggaaaaaaaugacu

SEQ ID NO: 3369360 - RNA, 18 nt, Human
aggaaaaaauaacaauga

SEQ ID NO: 3369361 - RNA, 16 nt, Human
aggaaaaaauugcuuu

SEQ ID NO: 3369362 - RNA, 12 nt, Human
aggaaaaagaac

SEQ ID NO: 3369363 - RNA, 17 nt, Human
aggaaaaagcacaagaa

SEQ ID NO: 3369364 - RNA, 20 nt, Human
aggaaaaaggacaggcagaa

SEQ ID NO: 3369365 - RNA, 23 nt, Human
aggaaaaaguaucauggaaauau

SEQ ID NO: 3369366 - RNA, 13 nt, Human
aggaaaaauaugu

SEQ ID NO: 3369367 - RNA, 13 nt, Human
aggaaaaaugugu

SEQ ID NO: 3369368 - RNA, 15 nt, Human
aggaaaaauguguaa

SEQ ID NO: 3369369 - RNA, 12 nt, Human
aggaaaaauuca

SEQ ID NO: 3369370 - RNA, 23 nt, Human
aggaaaaccaagccguggcuucc

SEQ ID NO: 3369371 - RNA, 24 nt, Human
aggaaaacugcauggagacgcauu

SEQ ID NO: 3369372 - RNA, 13 nt, Human
aggaaaagaaaag

SEQ ID NO: 3369373 - RNA, 14 nt, Human
aggaaaagaaaucu

SEQ ID NO: 3369374 - RNA, 17 nt, Human
aggaaaagaaaucuaua

SEQ ID NO: 3369375 - RNA, 15 nt, Human
aggaaaagccucugu

SEQ ID NO: 3369376 - RNA, 19 nt, Human
aggaaaagccucuguguca

SEQ ID NO: 3369377 - RNA, 14 nt, Human
aggaaaagcugcug

SEQ ID NO: 3369378 - RNA, 18 nt, Human
aggaaaaggugauaucca

SEQ ID NO: 3369379 - RNA, 19 nt, Human
aggaaaaguacauuuaaua

SEQ ID NO: 3369380 - RNA, 22 nt, Human
aggaaaaguacauuuaauacag

SEQ ID NO: 3369381 - RNA, 15 nt, Human
aggaaaauauuuuga

SEQ ID NO: 3369382 - RNA, 20 nt, Human
aggaaaaugucuguaauaau

SEQ ID NO: 3369383 - RNA, 16 nt, Human
aggaaaauucuuaaaa

SEQ ID NO: 3369384 - RNA, 16 nt, Human
aggaaaauugaaugca

SEQ ID NO: 3369385 - RNA, 12 nt, Human
aggaaaauugga

SEQ ID NO: 3369386 - RNA, 14 nt, Human
aggaaacaacagcu

SEQ ID NO: 3369387 - RNA, 13 nt, Human
aggaaacaaguga

SEQ ID NO: 3369388 - RNA, 17 nt, Human
aggaaacaguugcaugu

SEQ ID NO: 3369389 - RNA, 22 nt, Human
aggaaacaguugcauguaguaa

SEQ ID NO: 3369390 - RNA, 20 nt, Human
aggaaacccagcucuggucc

SEQ ID NO: 3369391 - RNA, 20 nt, Human
aggaaaccgccuaguuuacu

SEQ ID NO: 3369392 - RNA, 21 nt, Human
aggaaaccgccuaguuuacug

SEQ ID NO: 3369393 - RNA, 15 nt, Human
aggaaacgagacuuu

SEQ ID NO: 3369394 - RNA, 21 nt, Human
aggaaacucaccugcuggccc

SEQ ID NO: 3369395 - RNA, 22 nt, Human
aggaaacucaccugcuggcccc

SEQ ID NO: 3369396 - RNA, 20 nt, Human
aggaaacuccugacagucuu

SEQ ID NO: 3369397 - RNA, 22 nt, Human
aggaaacuccugugaccacaac

SEQ ID NO: 3369398 - RNA, 12 nt, Human
aggaaacucuua

SEQ ID NO: 3369399 - RNA, 19 nt, Human
aggaaacuggguuccugca

SEQ ID NO: 3369400 - RNA, 12 nt, Human
aggaaagaaaac

SEQ ID NO: 3369401 - RNA, 17 nt, Human
aggaaagaaagaaggaa

SEQ ID NO: 3369402 - RNA, 20 nt, Human
aggaaagaaugaaagaguaa

SEQ ID NO: 3369403 - RNA, 15 nt, Human
aggaaagacaacaca

SEQ ID NO: 3369404 - RNA, 12 nt, Human
aggaaagaggcu

SEQ ID NO: 3369405 - RNA, 16 nt, Human
aggaaagaggcucugg

SEQ ID NO: 3369406 - RNA, 19 nt, Human
aggaaagcaauaaaugaau

SEQ ID NO: 3369407 - RNA, 22 nt, Human
aggaaagcaauaaaugaauggg

SEQ ID NO: 3369408 - RNA, 16 nt, Human
aggaaagccucacuga

SEQ ID NO: 3369409 - RNA, 20 nt, Human
aggaaaggagaguacuuugg

SEQ ID NO: 3369410 - RNA, 13 nt, Human
aggaaaggccagc

SEQ ID NO: 3369411 - RNA, 14 nt, Human
aggaaaggccagcu

SEQ ID NO: 3369412 - RNA, 18 nt, Human
aggaaaggccagcuggca

SEQ ID NO: 3369413 - RNA, 21 nt, Human
aggaaaggccagcuggcagca

SEQ ID NO: 3369414 - RNA, 24 nt, Human
aggaaaggccagcuggcagcagag

SEQ ID NO: 3369415 - RNA, 22 nt, Human
aggaaaggcuccaggagcagcc

SEQ ID NO: 3369416 - RNA, 14 nt, Human
aggaaaguacauuu

SEQ ID NO: 3369417 - RNA, 19 nt, Human
auagauuaauggcacugau

SEQ ID NO: 3369418 - RNA, 21 nt, Human
auagauuauaacuugucuaaa

SEQ ID NO: 3369419 - RNA, 21 nt, Human
auagauucaccuguaaaacuu

SEQ ID NO: 3369420 - RNA, 22 nt, Human
auagauucaccuguaaaacuuu

SEQ ID NO: 3369421 - RNA, 12 nt, Human
auagauucuaaa

SEQ ID NO: 3369422 - RNA, 16 nt, Human
auagauucuaaagauu

SEQ ID NO: 3369423 - RNA, 19 nt, Human
auagauucucuuguauaag

SEQ ID NO: 3369424 - RNA, 23 nt, Human
auagauuggagccaccaugccca

SEQ ID NO: 3369425 - RNA, 21 nt, Human
auagauuguccuuuugcaaag

SEQ ID NO: 3369426 - RNA, 13 nt, Human
auagauuugaccu

SEQ ID NO: 3369427 - RNA, 15 nt, Human
auagauuugaccucc

SEQ ID NO: 3369428 - RNA, 13 nt, Human
auagauuuggaau

SEQ ID NO: 3369429 - RNA, 16 nt, Human
auagcaaaagaagaag

SEQ ID NO: 3369430 - RNA, 14 nt, Human
auagcaaagaauug

SEQ ID NO: 3369431 - RNA, 14 nt, Human
auagcaaaguagua

SEQ ID NO: 3369432 - RNA, 14 nt, Human
auagcaaauucaaa

SEQ ID NO: 3369433 - RNA, 19 nt, Human
auagcaagacacaucccua

SEQ ID NO: 3369434 - RNA, 19 nt, Human
auagcaagugaauuuuucu

SEQ ID NO: 3369435 - RNA, 18 nt, Human
auagcaccccuacucaca

SEQ ID NO: 3369436 - RNA, 16 nt, Human
auagcaccuccacaua

SEQ ID NO: 3369437 - RNA, 15 nt, Human
auagcacuuugaaau

SEQ ID NO: 3369438 - RNA, 21 nt, Human
auagcagaaaaaccaacaucu

SEQ ID NO: 3369439 - RNA, 17 nt, Human
auagcagccaguucaaa

SEQ ID NO: 3369440 - RNA, 21 nt, Human
auagcagcccucaauugugaa

SEQ ID NO: 3369441 - RNA, 22 nt, Human
auagcagcccucaauugugaaa

SEQ ID NO: 3369442 - RNA, 15 nt, Human
auagcagccuggcuc

SEQ ID NO: 3369443 - RNA, 21 nt, Human
auagcagccuggcuccccugg

SEQ ID NO: 3369444 - RNA, 21 nt, Human
auagcaguaaaaaaugguguu

SEQ ID NO: 3369445 - RNA, 17 nt, Human
auagcauaugacaaaug

SEQ ID NO: 3369446 - RNA, 18 nt, Human
auagcauaugacaaaugu

SEQ ID NO: 3369447 - RNA, 19 nt, Human
auagcauaugacaaauguu

SEQ ID NO: 3369448 - RNA, 20 nt, Human
auagcauaugacaaauguuu

SEQ ID NO: 3369449 - RNA, 16 nt, Human
auagcaucacuuaaaa

SEQ ID NO: 3369450 - RNA, 14 nt, Human
auagcaucuguaca

SEQ ID NO: 3369451 - RNA, 19 nt, Human
auagcaucuguacaaaggg

SEQ ID NO: 3369452 - RNA, 22 nt, Human
auagcaucuuguggcuuugcaa

SEQ ID NO: 3369453 - RNA, 19 nt, Human
auagcaugacauuucuuug

SEQ ID NO: 3369454 - RNA, 13 nt, Human
auagcaugcaucu

SEQ ID NO: 3369455 - RNA, 13 nt, Human
auagcauguaaug

SEQ ID NO: 3369456 - RNA, 14 nt, Human
auagcauguauugu

SEQ ID NO: 3369457 - RNA, 16 nt, Human
auagcauguauugugu

SEQ ID NO: 3369458 - RNA, 18 nt, Human
auagcauguauugugucu

SEQ ID NO: 3369459 - RNA, 16 nt, Human
auagcauguccuaaug

SEQ ID NO: 3369460 - RNA, 19 nt, Human
auagcauguccuaaugcuu

SEQ ID NO: 3369461 - RNA, 21 nt, Human
auagcauuaacuaaucuauug

SEQ ID NO: 3369462 - RNA, 13 nt, Human
auagcauucauaa

SEQ ID NO: 3369463 - RNA, 17 nt, Human
auagcauugucuauuuu

SEQ ID NO: 3369464 - RNA, 16 nt, Human
auagccaaaaauagcu

SEQ ID NO: 3369465 - RNA, 18 nt, Human
auagccaaaaauagcuaa

SEQ ID NO: 3369466 - RNA, 22 nt, Human
auagccacaucccuuugaaaca

SEQ ID NO: 3369467 - RNA, 13 nt, Human
auagccacauuug

SEQ ID NO: 3369468 - RNA, 16 nt, Human
auagccaccccagaaa

SEQ ID NO: 3369469 - RNA, 20 nt, Human
auagccacuaaccuugccug

SEQ ID NO: 3369470 - RNA, 12 nt, Human
auagccauauuu

SEQ ID NO: 3369471 - RNA, 16 nt, Human
auagccauauuuguaa

SEQ ID NO: 3369472 - RNA, 19 nt, Human
auagcccacuuacauuuac

SEQ ID NO: 3369473 - RNA, 20 nt, Human
acauuuuuugaaaugcugaa

SEQ ID NO: 3369474 - RNA, 20 nt, Human
acauuuuuuucuaccuauaa

SEQ ID NO: 3369475 - RNA, 18 nt, Human
acauuuuuuuuuuaaauc

SEQ ID NO: 3369476 - RNA, 18 nt, Human
acauuuuuuuuuuuaauu

SEQ ID NO: 3369477 - RNA, 20 nt, Human
acauuuuuuuuuuuaauuuu

SEQ ID NO: 3369478 - RNA, 15 nt, Human
accaaaaaaguuaca

SEQ ID NO: 3369479 - RNA, 13 nt, Human
accaaaaaccagu

SEQ ID NO: 3369480 - RNA, 19 nt, Human
accaaaaacugaaagugaa

SEQ ID NO: 3369481 - RNA, 17 nt, Human
accaaaaagaccagacu

SEQ ID NO: 3369482 - RNA, 16 nt, Human
accaaaacaguuaauc

SEQ ID NO: 3369483 - RNA, 12 nt, Human
accaaaacugug

SEQ ID NO: 3369484 - RNA, 17 nt, Human
accaaaacugugcagag

SEQ ID NO: 3369485 - RNA, 17 nt, Human
accaaaagaauuugcac

SEQ ID NO: 3369486 - RNA, 21 nt, Human
accaaaagcuuaccaagggga

SEQ ID NO: 3369487 - RNA, 16 nt, Human
accaaaaguuauuaaa

SEQ ID NO: 3369488 - RNA, 16 nt, Human
accaaaauaagaaaag

SEQ ID NO: 3369489 - RNA, 18 nt, Human
accaaaauaagaaaagau

SEQ ID NO: 3369490 - RNA, 12 nt, Human
accaaaaugaca

SEQ ID NO: 3369491 - RNA, 13 nt, Human
accaaacaauuau

SEQ ID NO: 3369492 - RNA, 19 nt, Human
accaaacccacccuuucua

SEQ ID NO: 3369493 - RNA, 22 nt, Human
accaaacccacccuuucuacuu

SEQ ID NO: 3369494 - RNA, 14 nt, Human
accaaaccuagccc

SEQ ID NO: 3369495 - RNA, 12 nt, Human
accaaagaagaa

SEQ ID NO: 3369496 - RNA, 13 nt, Human
accaaagaagaaa

SEQ ID NO: 3369497 - RNA, 15 nt, Human
accaaagaagaaagu

SEQ ID NO: 3369498 - RNA, 17 nt, Human
accaaagagacuggagc

SEQ ID NO: 3369499 - RNA, 21 nt, Human
accaaagagacuggagcaucu

SEQ ID NO: 3369500 - RNA, 22 nt, Human
accaaagagacuggagcaucug

SEQ ID NO: 3369501 - RNA, 18 nt, Human
accaaagaugaaugaagc

SEQ ID NO: 3369502 - RNA, 14 nt, Human
accaaagccaccag

SEQ ID NO: 3369503 - RNA, 16 nt, Human
accaaagcgaauuuua

SEQ ID NO: 3369504 - RNA, 11 nt, Human
accaaagcuga

SEQ ID NO: 3369505 - RNA, 14 nt, Human
accaaagcugccca

SEQ ID NO: 3369506 - RNA, 19 nt, Human
accaaagcugcccacuguu

SEQ ID NO: 3369507 - RNA, 17 nt, Human
accaaaggacauuaugu

SEQ ID NO: 3369508 - RNA, 20 nt, Human
accaaaggacauuaugugug

SEQ ID NO: 3369509 - RNA, 17 nt, Human
accaaaggugaaggaau

SEQ ID NO: 3369510 - RNA, 19 nt, Human
accaaaggugaaggaauau

SEQ ID NO: 3369511 - RNA, 15 nt, Human
accaaaguauuuuuu

SEQ ID NO: 3369512 - RNA, 18 nt, Human
accaaaguauuuuuuuau

SEQ ID NO: 3369513 - RNA, 11 nt, Human
accaaaguucu

SEQ ID NO: 3369514 - RNA, 15 nt, Human
accaaaguucuaaua

SEQ ID NO: 3369515 - RNA, 15 nt, Human
accaaaucaaaaucu

SEQ ID NO: 3369516 - RNA, 22 nt, Human
accaaaucaaaaucucuccacu

SEQ ID NO: 3369517 - RNA, 23 nt, Human
accaaaucaaaaucucuccacuu

SEQ ID NO: 3369518 - RNA, 20 nt, Human
accaaaugugcuuugagaag

SEQ ID NO: 3369519 - RNA, 18 nt, Human
accaaauguuuauuuucu

SEQ ID NO: 3369520 - RNA, 16 nt, Human
accaaauuaucuugau

SEQ ID NO: 3369521 - RNA, 14 nt, Human
accaaauuuuaauu

SEQ ID NO: 3369522 - RNA, 11 nt, Human
accaacaccau

SEQ ID NO: 3369523 - RNA, 22 nt, Human
accaacaccaucacagcuuguu

SEQ ID NO: 3369524 - RNA, 15 nt, Human
accaacauaaaaaug

SEQ ID NO: 3369525 - RNA, 21 nt, Human
accaacauacucccaucugug

SEQ ID NO: 3369526 - RNA, 22 nt, Human
accaacauacucccaucuguga

SEQ ID NO: 3369527 - RNA, 21 nt, Human
accaacaucccauugcccugg

SEQ ID NO: 3369528 - RNA, 24 nt, Human
accaacauggagaaacccugucuc

SEQ ID NO: 3369529 - RNA, 19 nt, Human
accaacccagccgcugccc

SEQ ID NO: 3369530 - RNA, 15 nt, Human
accaacccucagagc

SEQ ID NO: 3369531 - RNA, 15 nt, Human
accaacccucagggc

SEQ ID NO: 3369532 - RNA, 16 nt, Human
accaacccucagggca

SEQ ID NO: 3369533 - RNA, 14 nt, Human
accaacccuguuuc

SEQ ID NO: 3369534 - RNA, 15 nt, Human
acuggggcauccugu

SEQ ID NO: 3369535 - RNA, 13 nt, Human
acuggggccucca

SEQ ID NO: 3369536 - RNA, 21 nt, Human
acuggggcuggggaaggaagc

SEQ ID NO: 3369537 - RNA, 15 nt, Human
acugggggaaaagau

SEQ ID NO: 3369538 - RNA, 15 nt, Human
acugggggcagacau

SEQ ID NO: 3369539 - RNA, 17 nt, Human
acuggggugggaggucu

SEQ ID NO: 3369540 - RNA, 19 nt, Human
acuggguacuuguggacac

SEQ ID NO: 3369541 - RNA, 20 nt, Human
acuggguacuuguggacaca

SEQ ID NO: 3369542 - RNA, 23 nt, Human
acuggguacuuguggacacagcu

SEQ ID NO: 3369543 - RNA, 20 nt, Human
acuggguggggugaggacca

SEQ ID NO: 3369544 - RNA, 16 nt, Human
acuggguguaaacaca

SEQ ID NO: 3369545 - RNA, 20 nt, Human
acugggugucauuucauucc

SEQ ID NO: 3369546 - RNA, 15 nt, Human
acuggguuucuagcc

SEQ ID NO: 3369547 - RNA, 21 nt, Human
acuggguuuggaccccagcug

SEQ ID NO: 3369548 - RNA, 22 nt, Human
acuggguuuggaccccagcugg

SEQ ID NO: 3369549 - RNA, 23 nt, Human
acuggguuuggaccccagcuggg

SEQ ID NO: 3369550 - RNA, 16 nt, Human
acugguaagauuguua

SEQ ID NO: 3369551 - RNA, 18 nt, Human
acugguaagauuguuauu

SEQ ID NO: 3369552 - RNA, 16 nt, Human
acugguacuuagaguu

SEQ ID NO: 3369553 - RNA, 20 nt, Human
acugguccugugugcaguga

SEQ ID NO: 3369554 - RNA, 12 nt, Human
acuggucucucu

SEQ ID NO: 3369555 - RNA, 14 nt, Human
acuggugacugauu

SEQ ID NO: 3369556 - RNA, 19 nt, Human
acuggugacugauucuuca

SEQ ID NO: 3369557 - RNA, 20 nt, Human
acuggugacugauucuucag

SEQ ID NO: 3369558 - RNA, 21 nt, Human
acuggugacugcgaucuucag

SEQ ID NO: 3369559 - RNA, 14 nt, Human
acuggugagcagac

SEQ ID NO: 3369560 - RNA, 16 nt, Human
acuggugcacuuugua

SEQ ID NO: 3369561 - RNA, 21 nt, Human
acuggugcacuuuguaaauuc

SEQ ID NO: 3369562 - RNA, 22 nt, Human
acugguggggauaggccagccg

SEQ ID NO: 3369563 - RNA, 22 nt, Human
acugguguuaucaccgugggcu

SEQ ID NO: 3369564 - RNA, 14 nt, Human
acugguugcaugga

SEQ ID NO: 3369565 - RNA, 19 nt, Human
acugguugcauggaaauca

SEQ ID NO: 3369566 - RNA, 19 nt, Human
acugguugguuuugccauu

SEQ ID NO: 3369567 - RNA, 22 nt, Human
acugguuuacaggcccugcucc

SEQ ID NO: 3369568 - RNA, 20 nt, Human
acugguuuauccacccacaa

SEQ ID NO: 3369569 - RNA, 22 nt, Human
acugguuuauccacccacaaca

SEQ ID NO: 3369570 - RNA, 22 nt, Human
acugguuuguugcagccaaaga

SEQ ID NO: 3369571 - RNA, 18 nt, Human
acuguaaaaaaugugugu

SEQ ID NO: 3369572 - RNA, 12 nt, Human
acuguaaaaugc

SEQ ID NO: 3369573 - RNA, 13 nt, Human
acuguaaacacag

SEQ ID NO: 3369574 - RNA, 14 nt, Human
acuguaaacacaga

SEQ ID NO: 3369575 - RNA, 17 nt, Human
acuguaaagagaccuac

SEQ ID NO: 3369576 - RNA, 23 nt, Human
acuguaaagagaccuaccucagg

SEQ ID NO: 3369577 - RNA, 18 nt, Human
acuguaaauaaaaagaaa

SEQ ID NO: 3369578 - RNA, 22 nt, Human
acuguaaauauuuauuuaugug

SEQ ID NO: 3369579 - RNA, 12 nt, Human
acuguaaaucau

SEQ ID NO: 3369580 - RNA, 10 nt, Human
acuguaacac

SEQ ID NO: 3369581 - RNA, 13 nt, Human
acuguaacacuuu

SEQ ID NO: 3369582 - RNA, 16 nt, Human
acuguaacugauuaca

SEQ ID NO: 3369583 - RNA, 22 nt, Human
acuguaacuuccaaauaaauaa

SEQ ID NO: 3369584 - RNA, 22 nt, Human
acuguaagaaaauaucacuugu

SEQ ID NO: 3369585 - RNA, 23 nt, Human
acuguaagaauaauuuauaguaa

SEQ ID NO: 3369586 - RNA, 16 nt, Human
acuguaaguugggcuu

SEQ ID NO: 3369587 - RNA, 13 nt, Human
acuguaauaauac

SEQ ID NO: 3369588 - RNA, 23 nt, Human
acuguaauaauaccucaauguuu

SEQ ID NO: 3369589 - RNA, 19 nt, Human
acuguaaucuuauuuagga

SEQ ID NO: 3369590 - RNA, 22 nt, Human
acuguaaucuuauuuaggaagu

SEQ ID NO: 3369591 - RNA, 17 nt, Human
acuguaauuauuugaau

SEQ ID NO: 3369592 - RNA, 18 nt, Human
acuguaauuauuugaaug

SEQ ID NO: 3369593 - RNA, 20 nt, Human
acuguaauuauuugaaugac

SEQ ID NO: 3369594 - RNA, 22 nt, Human
acuguacaaaaaaaucuuccaa

SEQ ID NO: 3369595 - RNA, 14 nt, Human
acuguacaaaguag

SEQ ID NO: 3369596 - RNA, 16 nt, Human
acuguacaaaguagaa

SEQ ID NO: 3369597 - RNA, 22 nt, Human
acuguacaaaguagaagucuua

SEQ ID NO: 3369598 - RNA, 22 nt, Human
acuguacaaugacuuuauugca

SEQ ID NO: 3369599 - RNA, 13 nt, Human
acuguacacacuu

SEQ ID NO: 3369600 - RNA, 23 nt, Human
acuguacacacuuuauuuacuuc

SEQ ID NO: 3369601 - RNA, 21 nt, Human
acuguacaugaaaacacauuu

SEQ ID NO: 3369602 - RNA, 19 nt, Human
acuguaccauauagcaaaa

SEQ ID NO: 3369603 - RNA, 17 nt, Human
acuguacccaaauggaa

SEQ ID NO: 3369604 - RNA, 14 nt, Human
acuguacuaauucu

SEQ ID NO: 3369605 - RNA, 15 nt, Human
acuguacuccuccca

SEQ ID NO: 3369606 - RNA, 20 nt, Human
acuguacuccucccaggcgc

SEQ ID NO: 3369607 - RNA, 17 nt, Human
acuguacuuaauaaauu

SEQ ID NO: 3369608 - RNA, 16 nt, Human
acuguacuucacuguc

SEQ ID NO: 3369609 - RNA, 13 nt, Human
acuguacuuugau

SEQ ID NO: 3369610 - RNA, 20 nt, Human
acuguacuuugauucacaug

SEQ ID NO: 3369611 - RNA, 22 nt, Human
acuguacuuugauucacauguu

SEQ ID NO: 3369612 - RNA, 19 nt, Human
acuguagaaugauuucaug

SEQ ID NO: 3369613 - RNA, 15 nt, Human
acuguagauauguau

SEQ ID NO: 3369614 - RNA, 16 nt, Human
acuguagauugcuucu

SEQ ID NO: 3369615 - RNA, 22 nt, Human
acuguagccucgccgucuguga

SEQ ID NO: 3369616 - RNA, 14 nt, Human
acuguagcucuaaa

SEQ ID NO: 3369617 - RNA, 22 nt, Human
acugaggccaaaagaggccuga

SEQ ID NO: 3369618 - RNA, 14 nt, Human
acugaggccugagc

SEQ ID NO: 3369619 - RNA, 17 nt, Human
acugagggacucugaag

SEQ ID NO: 3369620 - RNA, 18 nt, Human
acugagggacucugaagc

SEQ ID NO: 3369621 - RNA, 18 nt, Human
acugaguacguugugcau

SEQ ID NO: 3369622 - RNA, 19 nt, Human
acugaguauuaauaucuga

SEQ ID NO: 3369623 - RNA, 16 nt, Human
acugaguccuuaaaca

SEQ ID NO: 3369624 - RNA, 16 nt, Human
acugagugccuuuugg

SEQ ID NO: 3369625 - RNA, 13 nt, Human
acugagugggaag

SEQ ID NO: 3369626 - RNA, 21 nt, Human
acugaguuaaauuauacugga

SEQ ID NO: 3369627 - RNA, 22 nt, Human
acugauauaucaugagugaaua

SEQ ID NO: 3369628 - RNA, 19 nt, Human
acugauauauuuaaaaaca

SEQ ID NO: 3369629 - RNA, 14 nt, Human
acugauauauuuuc

SEQ ID NO: 3369630 - RNA, 18 nt, Human
acugaucaugcauuguug

SEQ ID NO: 3369631 - RNA, 20 nt, Human
acugaucuuuguauauuaca

SEQ ID NO: 3369632 - RNA, 14 nt, Human
acugaugcugcccc

SEQ ID NO: 3369633 - RNA, 15 nt, Human
acugaugcugccccu

SEQ ID NO: 3369634 - RNA, 15 nt, Human
acugaugcuuagaug

SEQ ID NO: 3369635 - RNA, 14 nt, Human
acugauggaaacaa

SEQ ID NO: 3369636 - RNA, 19 nt, Human
acugauggaaacaaagugg

SEQ ID NO: 3369637 - RNA, 22 nt, Human
acugaugggcaacccccagccu

SEQ ID NO: 3369638 - RNA, 13 nt, Human
acugaugucuccu

SEQ ID NO: 3369639 - RNA, 19 nt, Human
acugauguguugugccuua

SEQ ID NO: 3369640 - RNA, 22 nt, Human
acugauguuacaucacaguguu

SEQ ID NO: 3369641 - RNA, 22 nt, Human
acugauguuaggcugggcccag

SEQ ID NO: 3369642 - RNA, 15 nt, Human
acugauucuucagca

SEQ ID NO: 3369643 - RNA, 15 nt, Human
acugauugagaaguu

SEQ ID NO: 3369644 - RNA, 20 nt, Human
acugauuucacaacagauca

SEQ ID NO: 3369645 - RNA, 20 nt, Human
acugauuuccccuuuugcau

SEQ ID NO: 3369646 - RNA, 20 nt, Human
acugauuuuguacauaaaca

SEQ ID NO: 3369647 - RNA, 15 nt, Human
acugauuuuuguaag

SEQ ID NO: 3369648 - RNA, 19 nt, Human
acugauuuuuguaagacaa

SEQ ID NO: 3369649 - RNA, 17 nt, Human
acugauuuuuuuuuccu

SEQ ID NO: 3369650 - RNA, 19 nt, Human
acugauuuuuuuuuccuuc

SEQ ID NO: 3369651 - RNA, 22 nt, Human
acugauuuuuuuuuccuucagu

SEQ ID NO: 3369652 - RNA, 15 nt, Human
acugcaacaggaacu

SEQ ID NO: 3369653 - RNA, 16 nt, Human
acugcaaccuccaccu

SEQ ID NO: 3369654 - RNA, 18 nt, Human
acugcaaccuccaccucc

SEQ ID NO: 3369655 - RNA, 20 nt, Human
acugcaaccuccaccucgca

SEQ ID NO: 3369656 - RNA, 15 nt, Human
acugcaaccucugcc

SEQ ID NO: 3369657 - RNA, 17 nt, Human
acugcaaccuuguuuau

SEQ ID NO: 3369658 - RNA, 14 nt, Human
acugcaacuucugc

SEQ ID NO: 3369659 - RNA, 15 nt, Human
acugcaagagccuug

SEQ ID NO: 3369660 - RNA, 18 nt, Human
acugcaagagccuuggug

SEQ ID NO: 3369661 - RNA, 18 nt, Human
acugcaagaggcuccugu

SEQ ID NO: 3369662 - RNA, 19 nt, Human
acugcaagucacaaaggaa

SEQ ID NO: 3369663 - RNA, 21 nt, Human
acugcaagucacaaaggaaug

SEQ ID NO: 3369664 - RNA, 22 nt, Human
acugcaaguccuuuuguaaagu

SEQ ID NO: 3369665 - RNA, 20 nt, Human
acugcaauaacuucugaccu

SEQ ID NO: 3369666 - RNA, 16 nt, Human
acugcaauagagacug

SEQ ID NO: 3369667 - RNA, 18 nt, Human
acugcaauagagacugua

SEQ ID NO: 3369668 - RNA, 21 nt, Human
acugcaauagagacuguagau

SEQ ID NO: 3369669 - RNA, 17 nt, Human
acugcaaucauauguga

SEQ ID NO: 3369670 - RNA, 21 nt, Human
acugcacaauaacuccuccca

SEQ ID NO: 3369671 - RNA, 15 nt, Human
acugcacagagcucu

SEQ ID NO: 3369672 - RNA, 16 nt, Human
acugcacagagcucuc

SEQ ID NO: 3369673 - RNA, 16 nt, Human
acugcacagcguccug

SEQ ID NO: 3369674 - RNA, 18 nt, Human
acugcacagugcaucuca

SEQ ID NO: 3369675 - RNA, 23 nt, Human
acugcacagugcaucucagccca

SEQ ID NO: 3369676 - RNA, 15 nt, Human
acugcacaugauuuc

SEQ ID NO: 3369677 - RNA, 22 nt, Human
acugcacaugauuucacaaaua

SEQ ID NO: 3369678 - RNA, 19 nt, Human
acugcaccaguugcugcuu

SEQ ID NO: 3369679 - RNA, 18 nt, Human
acugcaccauuuaaaaac

SEQ ID NO: 3369680 - RNA, 13 nt, Human
acugcacccagga

SEQ ID NO: 3369681 - RNA, 18 nt, Human
acugcacccccuccugcu

SEQ ID NO: 3369682 - RNA, 16 nt, Human
acugcacguggcuucu

SEQ ID NO: 3369683 - RNA, 20 nt, Human
acugcacuauagccuaggug

SEQ ID NO: 3369684 - RNA, 16 nt, Human
acugcacuccagccug

SEQ ID NO: 3369685 - RNA, 20 nt, Human
acugcacuccagccugggcg

SEQ ID NO: 3369686 - RNA, 20 nt, Human
acugcacuccagccuggggg

SEQ ID NO: 3369687 - RNA, 19 nt, Human
acugcacuccagccugggu

SEQ ID NO: 3369688 - RNA, 18 nt, Human
acugcacucuagccggag

SEQ ID NO: 3369689 - RNA, 19 nt, Human
acugcagaaacccugagca

SEQ ID NO: 3369690 - RNA, 20 nt, Human
acugcagaccuguccuccug

SEQ ID NO: 3369691 - RNA, 23 nt, Human
acugcagaccuguccuccuggug

SEQ ID NO: 3369692 - RNA, 16 nt, Human
acugcagcaccuccag

SEQ ID NO: 3369693 - RNA, 18 nt, Human
acugcagcaccuccaggc

SEQ ID NO: 3369694 - RNA, 21 nt, Human
acugcagccucgaacuccugg

SEQ ID NO: 3369695 - RNA, 23 nt, Human
acugcagccucgaacuccugggc

SEQ ID NO: 3369696 - RNA, 15 nt, Human
acugcagcuuuacau

SEQ ID NO: 3369697 - RNA, 15 nt, Human
acugcaggccccgcu

SEQ ID NO: 3369698 - RNA, 21 nt, Human
acugcaggccccgcuugucca

SEQ ID NO: 3369699 - RNA, 21 nt, Human
acuuaaaaaugguuuaaaugg

SEQ ID NO: 3369700 - RNA, 17 nt, Human
acuuaaaaauguaaaua

SEQ ID NO: 3369701 - RNA, 23 nt, Human
acuuaaaaauguaaauauucuau

SEQ ID NO: 3369702 - RNA, 22 nt, Human
acuuaaaauauuccugcauuug

SEQ ID NO: 3369703 - RNA, 13 nt, Human
acuuaaaauauuu

SEQ ID NO: 3369704 - RNA, 22 nt, Human
acuuaaagaaguauuuuuagaa

SEQ ID NO: 3369705 - RNA, 15 nt, Human
acuuaaagauuuauc

SEQ ID NO: 3369706 - RNA, 14 nt, Human
acuuaaauaaugug

SEQ ID NO: 3369707 - RNA, 13 nt, Human
acuuaaaugaaag

SEQ ID NO: 3369708 - RNA, 19 nt, Human
acuuaaauggaaaaaauga

SEQ ID NO: 3369709 - RNA, 14 nt, Human
acuuaaauguuaug

SEQ ID NO: 3369710 - RNA, 16 nt, Human
acuuaaauguuaugua

SEQ ID NO: 3369711 - RNA, 15 nt, Human
acuuaacaagcuccc

SEQ ID NO: 3369712 - RNA, 23 nt, Human
acuuaacccugacaaauuuuaau

SEQ ID NO: 3369713 - RNA, 22 nt, Human
acuuaacuaucaucuuauucag

SEQ ID NO: 3369714 - RNA, 22 nt, Human
acuuaacugaaaugccugcuuu

SEQ ID NO: 3369715 - RNA, 16 nt, Human
acuuaacuguuucaaa

SEQ ID NO: 3369716 - RNA, 16 nt, Human
acuuaacuuuaacuga

SEQ ID NO: 3369717 - RNA, 12 nt, Human
acuuaagagaaa

SEQ ID NO: 3369718 - RNA, 17 nt, Human
acuuaagagaaauggca

SEQ ID NO: 3369719 - RNA, 20 nt, Human
acuuaagcaaaagaaaaaga

SEQ ID NO: 3369720 - RNA, 13 nt, Human
acuuaagcacacu

SEQ ID NO: 3369721 - RNA, 17 nt, Human
acuuaagggagaaaaaa

SEQ ID NO: 3369722 - RNA, 15 nt, Human
acuuaaguuaaacau

SEQ ID NO: 3369723 - RNA, 13 nt, Human
acuuaauaaucaa

SEQ ID NO: 3369724 - RNA, 22 nt, Human
acuuaauaaucaagagccuuaa

SEQ ID NO: 3369725 - RNA, 18 nt, Human
acuuaauacuaccuugaa

SEQ ID NO: 3369726 - RNA, 16 nt, Human
acuuaaucaaaacuca

SEQ ID NO: 3369727 - RNA, 18 nt, Human
acuuaaucaauuaauuuu

SEQ ID NO: 3369728 - RNA, 15 nt, Human
acuuaaucuaaaugg

SEQ ID NO: 3369729 - RNA, 16 nt, Human
acuuaaucuaaaugga

SEQ ID NO: 3369730 - RNA, 22 nt, Human
acuuaauuucuuuauguaaucu

SEQ ID NO: 3369731 - RNA, 18 nt, Human
acuuacacaucuuccaca

SEQ ID NO: 3369732 - RNA, 23 nt, Human
acuuacagauaggccuucuugug

SEQ ID NO: 3369733 - RNA, 19 nt, Human
acuuacauauuuauuuuua

SEQ ID NO: 3369734 - RNA, 12 nt, Human
acuuacaugauu

SEQ ID NO: 3369735 - RNA, 18 nt, Human
acuuacaugauucauuuu

SEQ ID NO: 3369736 - RNA, 14 nt, Human
acuuacauuuacaa

SEQ ID NO: 3369737 - RNA, 16 nt, Human
acuuaccauaugugcu

SEQ ID NO: 3369738 - RNA, 14 nt, Human
acuuaccauuugcu

SEQ ID NO: 3369739 - RNA, 21 nt, Human
acuuaccgugagcgacaaaga

SEQ ID NO: 3369740 - RNA, 17 nt, Human
acuuaccuagauuuaca

SEQ ID NO: 3369741 - RNA, 16 nt, Human
acuuaccuucaauaaa

SEQ ID NO: 3369742 - RNA, 13 nt, Human
acuuacucuaaga

SEQ ID NO: 3369743 - RNA, 16 nt, Human
acuuacucuaagaucu

SEQ ID NO: 3369744 - RNA, 14 nt, Human
acuuacuguacaug

SEQ ID NO: 3369745 - RNA, 13 nt, Human
acuuacuguuucu

SEQ ID NO: 3369746 - RNA, 20 nt, Human
acuuacuguuucugucagga

SEQ ID NO: 3369747 - RNA, 21 nt, Human
acuuacuguuucugucaggag

SEQ ID NO: 3369748 - RNA, 14 nt, Human
acuuacuugcuuau

SEQ ID NO: 3369749 - RNA, 20 nt, Human
acuuagaaaaccagcucagc

SEQ ID NO: 3369750 - RNA, 16 nt, Human
acuuagaauaaaauug

SEQ ID NO: 3369751 - RNA, 18 nt, Human
acuuagaauaaaauugua

SEQ ID NO: 3369752 - RNA, 19 nt, Human
acuuagaaucccuguguua

SEQ ID NO: 3369753 - RNA, 22 nt, Human
acuuagagcuuuuuuuuuuuaa

SEQ ID NO: 3369754 - RNA, 17 nt, Human
acuuagaguuucuguuu

SEQ ID NO: 3369755 - RNA, 17 nt, Human
acuuagauuuuacauga

SEQ ID NO: 3369756 - RNA, 22 nt, Human
acuuagcacuucagggcagauu

SEQ ID NO: 3369757 - RNA, 18 nt, Human
acuuagcauccuaagaaa

SEQ ID NO: 3369758 - RNA, 22 nt, Human
acuuagccauuuuucaaagcaa

SEQ ID NO: 3369759 - RNA, 16 nt, Human
acuuagcuaguuuuau

SEQ ID NO: 3369760 - RNA, 14 nt, Human
acuuagcugggaga

SEQ ID NO: 3369761 - RNA, 13 nt, Human
acugugcuuucua

SEQ ID NO: 3369762 - RNA, 22 nt, Human
acugugcuuucuauuguacaga

SEQ ID NO: 3369763 - RNA, 12 nt, Human
acuguggaggaa

SEQ ID NO: 3369764 - RNA, 22 nt, Human
acuguggaggaaggauuguaaa

SEQ ID NO: 3369765 - RNA, 15 nt, Human
acuguggauauuguu

SEQ ID NO: 3369766 - RNA, 15 nt, Human
acuguggcacacgcc

SEQ ID NO: 3369767 - RNA, 21 nt, Human
acuguggccaugguccccaag

SEQ ID NO: 3369768 - RNA, 17 nt, Human
acuguggccguuaucug

SEQ ID NO: 3369769 - RNA, 20 nt, Human
acugugggaaggccagcugc

SEQ ID NO: 3369770 - RNA, 15 nt, Human
acugugggcaauuua

SEQ ID NO: 3369771 - RNA, 21 nt, Human
acuguggguuuguggggggag

SEQ ID NO: 3369772 - RNA, 18 nt, Human
acugugguaaaugccaca

SEQ ID NO: 3369773 - RNA, 14 nt, Human
acugugguccuaug

SEQ ID NO: 3369774 - RNA, 18 nt, Human
acuguggugacuuuggau

SEQ ID NO: 3369775 - RNA, 14 nt, Human
acuguguaaacuca

SEQ ID NO: 3369776 - RNA, 14 nt, Human
acuguguaacugcc

SEQ ID NO: 3369777 - RNA, 19 nt, Human
acuguguaagggccagaaa

SEQ ID NO: 3369778 - RNA, 18 nt, Human
acuguguacauaacugaa

SEQ ID NO: 3369779 - RNA, 22 nt, Human
acuguguacuguauagacaguu

SEQ ID NO: 3369780 - RNA, 14 nt, Human
acuguguacuguuc

SEQ ID NO: 3369781 - RNA, 19 nt, Human
acugugucccucucucugg

SEQ ID NO: 3369782 - RNA, 21 nt, Human
acuguguccuggugcucucug

SEQ ID NO: 3369783 - RNA, 19 nt, Human
acugugugcucaggagccc

SEQ ID NO: 3369784 - RNA, 18 nt, Human
acuguguggacugugaug

SEQ ID NO: 3369785 - RNA, 10 nt, Human
acugugugug

SEQ ID NO: 3369786 - RNA, 19 nt, Human
acugugugugcccucuggg

SEQ ID NO: 3369787 - RNA, 20 nt, Human
acuguguguggaggagucca

SEQ ID NO: 3369788 - RNA, 15 nt, Human
acugugugugugaau

SEQ ID NO: 3369789 - RNA, 16 nt, Human
acugugugugugaaug

SEQ ID NO: 3369790 - RNA, 14 nt, Human
acuguguuccuucc

SEQ ID NO: 3369791 - RNA, 14 nt, Human
acuguguugccaca

SEQ ID NO: 3369792 - RNA, 14 nt, Human
acuguguuguauua

SEQ ID NO: 3369793 - RNA, 16 nt, Human
acuguuaaaggaaaaa

SEQ ID NO: 3369794 - RNA, 21 nt, Human
acuguuaauaguucagguaac

SEQ ID NO: 3369795 - RNA, 21 nt, Human
acuguuaccauuggaaauuuc

SEQ ID NO: 3369796 - RNA, 15 nt, Human
acuguuacugggccc

SEQ ID NO: 3369797 - RNA, 18 nt, Human
acuguuacugggcccuga

SEQ ID NO: 3369798 - RNA, 14 nt, Human
acuguuacuugaua

SEQ ID NO: 3369799 - RNA, 23 nt, Human
acuguuaugaaauaaagaaauug

SEQ ID NO: 3369800 - RNA, 17 nt, Human
acuguuauuuucagcau

SEQ ID NO: 3369801 - RNA, 14 nt, Human
acuguuccagccug

SEQ ID NO: 3369802 - RNA, 15 nt, Human
acuguucccucugcu

SEQ ID NO: 3369803 - RNA, 18 nt, Human
acuguucccucugcuccu

SEQ ID NO: 3369804 - RNA, 22 nt, Human
acuguucccucugcuccuggag

SEQ ID NO: 3369805 - RNA, 16 nt, Human
acuguucccugaggug

SEQ ID NO: 3369806 - RNA, 14 nt, Human
acuguucuaaagcu

SEQ ID NO: 3369807 - RNA, 16 nt, Human
acuguucuaaagcucu

SEQ ID NO: 3369808 - RNA, 21 nt, Human
acuguucucuauuagacuuua

SEQ ID NO: 3369809 - RNA, 15 nt, Human
acuguucucugcccu

SEQ ID NO: 3369810 - RNA, 19 nt, Human
acuguucucugcccuccaa

SEQ ID NO: 3369811 - RNA, 17 nt, Human
acuguucugugucuuuc

SEQ ID NO: 3369812 - RNA, 20 nt, Human
acuguucuuagcucaaugag

SEQ ID NO: 3369813 - RNA, 11 nt, Human
acuguucuugc

SEQ ID NO: 3369814 - RNA, 12 nt, Human
acuguucuugcu

SEQ ID NO: 3369815 - RNA, 13 nt, Human
acuguucuugcug

SEQ ID NO: 3369816 - RNA, 15 nt, Human
acuguucuugcugcu

SEQ ID NO: 3369817 - RNA, 18 nt, Human
acuguucuugcugcuaga

SEQ ID NO: 3369818 - RNA, 19 nt, Human
acuguucuugcugcuagaa

SEQ ID NO: 3369819 - RNA, 22 nt, Human
acuguucuugcugcuagaacuu

SEQ ID NO: 3369820 - RNA, 15 nt, Human
acuguucuuuccagg

SEQ ID NO: 3369821 - RNA, 22 nt, Human
acuguugauaauucuuauuuug

SEQ ID NO: 3369822 - RNA, 23 nt, Human
acuguugauaauucuuauuuugu

SEQ ID NO: 3369823 - RNA, 15 nt, Human
acuguugcacgugug

SEQ ID NO: 3369824 - RNA, 18 nt, Human
acuguugcacguguguuu

SEQ ID NO: 3369825 - RNA, 18 nt, Human
acuguugccagagaugga

SEQ ID NO: 3369826 - RNA, 17 nt, Human
acuguugcccaggcugg

SEQ ID NO: 3369827 - RNA, 21 nt, Human
acuguuggaauggauuuuucu

SEQ ID NO: 3369828 - RNA, 18 nt, Human
acuguugggguggguaua

SEQ ID NO: 3369829 - RNA, 22 nt, Human
acuguugggguggguauaaaag

SEQ ID NO: 3369830 - RNA, 13 nt, Human
acuguuguauaaa

SEQ ID NO: 3369831 - RNA, 19 nt, Human
acuguugugaccugaaguu

SEQ ID NO: 3369832 - RNA, 20 nt, Human
acuguuuacaagaaaaaaug

SEQ ID NO: 3369833 - RNA, 13 nt, Human
acuguuuagauuu

SEQ ID NO: 3369834 - RNA, 18 nt, Human
acuguuuauacacugugu

SEQ ID NO: 3369835 - RNA, 20 nt, Human
acuguuuauugaaagaauua

SEQ ID NO: 3369836 - RNA, 22 nt, Human
acuguuuauuucuguuucucau

SEQ ID NO: 3369837 - RNA, 11 nt, Human
acuguuucaaa

SEQ ID NO: 3369838 - RNA, 13 nt, Human
acuguuucaaacu

SEQ ID NO: 3369839 - RNA, 16 nt, Human
acuguuucaucuaagu

SEQ ID NO: 3369840 - RNA, 14 nt, Human
acuguuuccacauu

SEQ ID NO: 3369841 - RNA, 13 nt, Human
acuguuuccuggg

SEQ ID NO: 3369842 - RNA, 13 nt, Human
acuguuucucugc

SEQ ID NO: 3369843 - RNA, 14 nt, Human
acuguuucucugcu

SEQ ID NO: 3369844 - RNA, 17 nt, Human
acuguuucucuugagcu

SEQ ID NO: 3369845 - RNA, 18 nt, Human
acuguuucucuugagcug

SEQ ID NO: 3369846 - RNA, 14 nt, Human
acuguuucugucag

SEQ ID NO: 3369847 - RNA, 15 nt, Human
acuguuucugucagg

SEQ ID NO: 3369848 - RNA, 14 nt, Human
acuguuucuugcuu

SEQ ID NO: 3369849 - RNA, 22 nt, Human
acuguuugccuucuacuuuuaa

SEQ ID NO: 3369850 - RNA, 18 nt, Human
acuguuugucuucucccc

SEQ ID NO: 3369851 - RNA, 19 nt, Human
acuguuugucuucucccca

SEQ ID NO: 3369852 - RNA, 20 nt, Human
acuguuugucuucuccccag

SEQ ID NO: 3369853 - RNA, 19 nt, Human
acuguuuguuuacaaaauc

SEQ ID NO: 3369854 - RNA, 13 nt, Human
acuguuuucuagu

SEQ ID NO: 3369855 - RNA, 19 nt, Human
acuguuuucuaguguauca

SEQ ID NO: 3369856 - RNA, 21 nt, Human
acuguuuucuaguguaucaaa

SEQ ID NO: 3369857 - RNA, 15 nt, Human
acuguuuuuacccau

SEQ ID NO: 3369858 - RNA, 16 nt, Human
acuguuuuuacccaua

SEQ ID NO: 3369859 - RNA, 23 nt, Human
acuguuuuucagggagguggcug

SEQ ID NO: 3369860 - RNA, 18 nt, Human
acuguuuuucggacaguu

SEQ ID NO: 3369861 - RNA, 15 nt, Human
acuguuuuuuaaguc

SEQ ID NO: 3369862 - RNA, 14 nt, Human
acuguuuuuuccug

SEQ ID NO: 3369863 - RNA, 22 nt, Human
acuuaaaaaaaaaaaaaagcuu

SEQ ID NO: 3369864 - RNA, 17 nt, Human
acuuaaaaaaaugacag

SEQ ID NO: 3369865 - RNA, 22 nt, Human
acuuaaaaaaaugacagauguu

SEQ ID NO: 3369866 - RNA, 16 nt, Human
acuuaaaaauguaaau

SEQ ID NO: 3369867 - RNA, 16 nt, Human
acuuaaaaauuuauua

SEQ ID NO: 3369868 - RNA, 22 nt, Human
acuuaaaauaggggauauuuaa

SEQ ID NO: 3369869 - RNA, 23 nt, Human
acuuaaaauaggggauauuuaag

SEQ ID NO: 3369870 - RNA, 20 nt, Human
acuuaaaauauuccugcauu

SEQ ID NO: 3369871 - RNA, 19 nt, Human
acuuaaacuugcaucacuu

SEQ ID NO: 3369872 - RNA, 11 nt, Human
acuuaaagauu

SEQ ID NO: 3369873 - RNA, 13 nt, Human
acuuaaagauuua

SEQ ID NO: 3369874 - RNA, 22 nt, Human
acuuaaagcccgccugacagaa

SEQ ID NO: 3369875 - RNA, 16 nt, Human
acuuaaagcuuucaga

SEQ ID NO: 3369876 - RNA, 22 nt, Human
acuuaaagcuuucagaauaugu

SEQ ID NO: 3369877 - RNA, 14 nt, Human
acuuaaauguuacc

SEQ ID NO: 3369878 - RNA, 22 nt, Human
acuuaaauguuauguauauggu

SEQ ID NO: 3369879 - RNA, 18 nt, Human
acuuaaauguuauuaucu

SEQ ID NO: 3369880 - RNA, 13 nt, Human
acuuaaauuuuag

SEQ ID NO: 3369881 - RNA, 21 nt, Human
acuuaacagaugcaaugugcu

SEQ ID NO: 3369882 - RNA, 14 nt, Human
acuuaacauauuua

SEQ ID NO: 3369883 - RNA, 15 nt, Human
acuuaacaugcugug

SEQ ID NO: 3369884 - RNA, 18 nt, Human
acuuaacaugcuguguaa

SEQ ID NO: 3369885 - RNA, 16 nt, Human
acuuaaccgcaucaga

SEQ ID NO: 3369886 - RNA, 17 nt, Human
acuuaaccgcaucagaa

SEQ ID NO: 3369887 - RNA, 17 nt, Human
acuuaacggcuccagga

SEQ ID NO: 3369888 - RNA, 19 nt, Human
acuuaacggcuccaggauu

SEQ ID NO: 3369889 - RNA, 13 nt, Human
acuuaacugaaau

SEQ ID NO: 3369890 - RNA, 21 nt, Human
acuuaacuguccguaagcagu

SEQ ID NO: 3369891 - RNA, 19 nt, Human
acuuaacuuuaacugaaca

SEQ ID NO: 3369892 - RNA, 16 nt, Human
acuuaagaaacacuga

SEQ ID NO: 3369893 - RNA, 13 nt, Human
acuuaagagaaau

SEQ ID NO: 3369894 - RNA, 15 nt, Human
acuuaagagaaaugg

SEQ ID NO: 3369895 - RNA, 13 nt, Human
acuuaagcaaaag

SEQ ID NO: 3369896 - RNA, 19 nt, Human
acuuaagcaaaagaaaaag

SEQ ID NO: 3369897 - RNA, 17 nt, Human
acuuaagcaucuggcuc

SEQ ID NO: 3369898 - RNA, 17 nt, Human
acuuaauaaauucagau

SEQ ID NO: 3369899 - RNA, 13 nt, Human
acuuuguucugcu

SEQ ID NO: 3369900 - RNA, 19 nt, Human
acuuuguucuggcucuucc

SEQ ID NO: 3369901 - RNA, 15 nt, Human
acuuuguugcaagau

SEQ ID NO: 3369902 - RNA, 17 nt, Human
acuuuguugcaagaugu

SEQ ID NO: 3369903 - RNA, 21 nt, Human
acuuuguugcaagaugugaau

SEQ ID NO: 3369904 - RNA, 22 nt, Human
acuuuguugcaagaugugaauu

SEQ ID NO: 3369905 - RNA, 17 nt, Human
acuuuguuuuauuuuca

SEQ ID NO: 3369906 - RNA, 15 nt, Human
acuuccaaagaaagu

SEQ ID NO: 3369907 - RNA, 17 nt, Human
acuuccaaagaaaguuc

SEQ ID NO: 3369908 - RNA, 19 nt, Human
acuuccaaauccccuaagc

SEQ ID NO: 3369909 - RNA, 15 nt, Human
acuuccacugaugga

SEQ ID NO: 3369910 - RNA, 17 nt, Human
acuuccacugccauccu

SEQ ID NO: 3369911 - RNA, 18 nt, Human
acuuccaggggaaccugc

SEQ ID NO: 3369912 - RNA, 14 nt, Human
acuuccaugaauuu

SEQ ID NO: 3369913 - RNA, 17 nt, Human
acuuccauggcccucau

SEQ ID NO: 3369914 - RNA, 17 nt, Human
agaaaaguauuuugaag

SEQ ID NO: 3369915 - RNA, 19 nt, Human
agaaaaguauuuugaaguu

SEQ ID NO: 3369916 - RNA, 23 nt, Human
agaaaaguauuuugaaguuuaca

SEQ ID NO: 3369917 - RNA, 21 nt, Human
agaaaagugcauauuuaucca

SEQ ID NO: 3369918 - RNA, 12 nt, Human
agaaaaguuauu

SEQ ID NO: 3369919 - RNA, 13 nt, Human
agaaaaguuauua

SEQ ID NO: 3369920 - RNA, 22 nt, Human
agaaaaguugacaccugagaaa

SEQ ID NO: 3369921 - RNA, 16 nt, Human
agaaaauaaaaaaaag

SEQ ID NO: 3369922 - RNA, 20 nt, Human
agaaaauaaaaaaaagaaaa

SEQ ID NO: 3369923 - RNA, 13 nt, Human
agaaaauaaaaag

SEQ ID NO: 3369924 - RNA, 17 nt, Human
agaaaauaaaaaguuaa

SEQ ID NO: 3369925 - RNA, 18 nt, Human
agaaaauaaaaaguuaaa

SEQ ID NO: 3369926 - RNA, 19 nt, Human
agaaaauaaaauuaagaau

SEQ ID NO: 3369927 - RNA, 15 nt, Human
agaaaauacaauaaa

SEQ ID NO: 3369928 - RNA, 16 nt, Human
agaaaauacaauaaac

SEQ ID NO: 3369929 - RNA, 12 nt, Human
agaaaauauaag

SEQ ID NO: 3369930 - RNA, 11 nt, Human
agaaaauauac

SEQ ID NO: 3369931 - RNA, 19 nt, Human
agaaaauauacuguaaaga

SEQ ID NO: 3369932 - RNA, 21 nt, Human
agaaaauauacuguaaagaaa

SEQ ID NO: 3369933 - RNA, 23 nt, Human
agaaaauauacuguaaagaaaga

SEQ ID NO: 3369934 - RNA, 19 nt, Human
agaaaauauauucuuucaa

SEQ ID NO: 3369935 - RNA, 14 nt, Human
agaaaauauguauu

SEQ ID NO: 3369936 - RNA, 23 nt, Human
agaaaauauuauguguuuccaua

SEQ ID NO: 3369937 - RNA, 11 nt, Human
agaaaauauuc

SEQ ID NO: 3369938 - RNA, 18 nt, Human
agaaaauauuuugucuaa

SEQ ID NO: 3369939 - RNA, 20 nt, Human
agaaaauauuuugucuaaaa

SEQ ID NO: 3369940 - RNA, 21 nt, Human
agaaaauauuuugucuaaaau

SEQ ID NO: 3369941 - RNA, 13 nt, Human
agaaaaucacuua

SEQ ID NO: 3369942 - RNA, 12 nt, Human
agaaaaucauca

SEQ ID NO: 3369943 - RNA, 13 nt, Human
agaaaaucaucaa

SEQ ID NO: 3369944 - RNA, 23 nt, Human
agaaaaucugaauuggaaugcac

SEQ ID NO: 3369945 - RNA, 23 nt, Human
agaaaaucuucauggaauucaca

SEQ ID NO: 3369946 - RNA, 22 nt, Human
agaaaaugcgguuauaaaaaau

SEQ ID NO: 3369947 - RNA, 23 nt, Human
agaaaauggaagacagcucuuau

SEQ ID NO: 3369948 - RNA, 21 nt, Human
agaaaaugguuuauuuuguau

SEQ ID NO: 3369949 - RNA, 19 nt, Human
agaaaauguaaauaaagga

SEQ ID NO: 3369950 - RNA, 11 nt, Human
agaaaauguga

SEQ ID NO: 3369951 - RNA, 19 nt, Human
agaaaaugugacccuccaa

SEQ ID NO: 3369952 - RNA, 13 nt, Human
agaaaauguuauu

SEQ ID NO: 3369953 - RNA, 16 nt, Human
agaaaauguuauuuaa

SEQ ID NO: 3369954 - RNA, 16 nt, Human
agaaaauguucuucca

SEQ ID NO: 3369955 - RNA, 15 nt, Human
agaaaauuagacugu

SEQ ID NO: 3369956 - RNA, 12 nt, Human
agaaaauucaau

SEQ ID NO: 3369957 - RNA, 14 nt, Human
agaaaauuccuaua

SEQ ID NO: 3369958 - RNA, 16 nt, Human
agaaaauugaauuuaa

SEQ ID NO: 3369959 - RNA, 20 nt, Human
agaaaauugaauuuaacaau

SEQ ID NO: 3369960 - RNA, 22 nt, Human
agaaaauugaauuuaacaaugc

SEQ ID NO: 3369961 - RNA, 21 nt, Human
agaaaauuuaauaacuuuuua

SEQ ID NO: 3369962 - RNA, 16 nt, Human
agaaaauuuuuguagu

SEQ ID NO: 3369963 - RNA, 20 nt, Human
agaaaauuuuuguaguagcg

SEQ ID NO: 3369964 - RNA, 17 nt, Human
agaaaauuuuuguuuau

SEQ ID NO: 3369965 - RNA, 21 nt, Human
agaaacaaacccguuuuauga

SEQ ID NO: 3369966 - RNA, 18 nt, Human
agaaacaacaauuucuac

SEQ ID NO: 3369967 - RNA, 17 nt, Human
agaaacaacucuuugag

SEQ ID NO: 3369968 - RNA, 20 nt, Human
agaaacaacucuuugagaaa

SEQ ID NO: 3369969 - RNA, 14 nt, Human
agaaacaauaaaga

SEQ ID NO: 3369970 - RNA, 14 nt, Human
agaaacacaauauu

SEQ ID NO: 3369971 - RNA, 19 nt, Human
agaaacaccuagaucagaa

SEQ ID NO: 3369972 - RNA, 17 nt, Human
agaaacacugaaaagaa

SEQ ID NO: 3369973 - RNA, 13 nt, Human
agaaacacugccu

SEQ ID NO: 3369974 - RNA, 15 nt, Human
agaaacagagacagg

SEQ ID NO: 3369975 - RNA, 19 nt, Human
agaaacagagacaggccca

SEQ ID NO: 3369976 - RNA, 14 nt, Human
agaaacagauacca

SEQ ID NO: 3369977 - RNA, 21 nt, Human
agaaacagauaccauacucau

SEQ ID NO: 3369978 - RNA, 11 nt, Human
agaaacagauu

SEQ ID NO: 3369979 - RNA, 15 nt, Human
agaaacagccagcaa

SEQ ID NO: 3369980 - RNA, 16 nt, Human
agaaacagcuaugaga

SEQ ID NO: 3369981 - RNA, 17 nt, Human
agaaacagcuuucaagu

SEQ ID NO: 3369982 - RNA, 19 nt, Human
agaaacagcuuucaagugc

SEQ ID NO: 3369983 - RNA, 20 nt, Human
agaaacaguuaacuuucaga

SEQ ID NO: 3369984 - RNA, 19 nt, Human
agaaacaguugguaacuuu

SEQ ID NO: 3369985 - RNA, 15 nt, Human
agaaacauaaauaaa

SEQ ID NO: 3369986 - RNA, 23 nt, Human
agaaacauaaauaaaaugaccag

SEQ ID NO: 3369987 - RNA, 12 nt, Human
agaaacaugaca

SEQ ID NO: 3369988 - RNA, 18 nt, Human
agaaacaugacacugacc

SEQ ID NO: 3369989 - RNA, 18 nt, Human
agaaaccaaucaagauaa

SEQ ID NO: 3369990 - RNA, 19 nt, Human
agaaaccagcuuccuucag

SEQ ID NO: 3369991 - RNA, 13 nt, Human
agaaacccugucu

SEQ ID NO: 3369992 - RNA, 14 nt, Human
agaaacccugucuc

SEQ ID NO: 3369993 - RNA, 16 nt, Human
agaaaccuacugccca

SEQ ID NO: 3369994 - RNA, 12 nt, Human
agaaaccuguau

SEQ ID NO: 3369995 - RNA, 13 nt, Human
agaaaccuguauc

SEQ ID NO: 3369996 - RNA, 15 nt, Human
agaaaccuguaucuu

SEQ ID NO: 3369997 - RNA, 16 nt, Human
agaaaccuguaucuuu

SEQ ID NO: 3369998 - RNA, 17 nt, Human
agaaaccuuaauaugug

SEQ ID NO: 3369999 - RNA, 16 nt, Human
agaaaccuuauuguac

SEQ ID NO: 3370000 - RNA, 18 nt, Human
agaaaccuuauuguaccu

SEQ ID NO: 3370001 - RNA, 20 nt, Human
agaaacgaagccaucuuucu

SEQ ID NO: 3370002 - RNA, 20 nt, Human
agaaacgaucagacagaucu

SEQ ID NO: 3370003 - RNA, 18 nt, Human
agaaacgucuucuaaacu

SEQ ID NO: 3370004 - RNA, 20 nt, Human
agaaacguuuggaacaaucu

SEQ ID NO: 3370005 - RNA, 17 nt, Human
agaaacuaaaacaaaua

SEQ ID NO: 3370006 - RNA, 17 nt, Human
agaaacuaauugacuuu

SEQ ID NO: 3370007 - RNA, 19 nt, Human
agaaacucaaugcacaaca

SEQ ID NO: 3370008 - RNA, 15 nt, Human
agaaacucaccccca

SEQ ID NO: 3370009 - RNA, 15 nt, Human
agaaacuccaugaug

SEQ ID NO: 3370010 - RNA, 16 nt, Human
agaaacucuacauaau

SEQ ID NO: 3370011 - RNA, 15 nt, Human
agaaacugcagggaa

SEQ ID NO: 3370012 - RNA, 15 nt, Human
agaaacuggcaaagc

SEQ ID NO: 3370013 - RNA, 16 nt, Human
agaaacuggcaaagca

SEQ ID NO: 3370014 - RNA, 14 nt, Human
agaaacuguagucu

SEQ ID NO: 3370015 - RNA, 15 nt, Human
agaaacuguucccac

SEQ ID NO: 3370016 - RNA, 22 nt, Human
agaaacuguucccaccugcugg

SEQ ID NO: 3370017 - RNA, 17 nt, Human
agaaacuuaaauguuau

SEQ ID NO: 3370018 - RNA, 20 nt, Human
agaaacuuaaauguuauuau

SEQ ID NO: 3370019 - RNA, 23 nt, Human
agaaacuuaaauguuauuaucug

SEQ ID NO: 3370020 - RNA, 21 nt, Human
agaaacuuaaauuuuaguucu

SEQ ID NO: 3370021 - RNA, 16 nt, Human
agaaacuuaagcaaag

SEQ ID NO: 3370022 - RNA, 23 nt, Human
agaaacuuaagguuaccuuuguu

SEQ ID NO: 3370023 - RNA, 16 nt, Human
agaaacuuaucuuaca

SEQ ID NO: 3370024 - RNA, 18 nt, Human
agaaacuuaucuuacaaa

SEQ ID NO: 3370025 - RNA, 21 nt, Human
agaaacuuauuucucauauca

SEQ ID NO: 3370026 - RNA, 22 nt, Human
agaaacuuauuucucauaucaa

SEQ ID NO: 3370027 - RNA, 14 nt, Human
agaaacuuccaaau

SEQ ID NO: 3370028 - RNA, 19 nt, Human
agaaacuuccaaauccccu

SEQ ID NO: 3370029 - RNA, 13 nt, Human
agaaacuucgccu

SEQ ID NO: 3370030 - RNA, 15 nt, Human
agaaacuuuauacau

SEQ ID NO: 3370031 - RNA, 12 nt, Human
agaaacuuuauu

SEQ ID NO: 3370032 - RNA, 22 nt, Human
agaaacuuuuaucuauucugag

SEQ ID NO: 3370033 - RNA, 16 nt, Human
agaaacuuuuguaaag

SEQ ID NO: 3370034 - RNA, 20 nt, Human
agaaagaacggaagaagaga

SEQ ID NO: 3370035 - RNA, 21 nt, Human
agaaagaauguuacugccuua

SEQ ID NO: 3370036 - RNA, 18 nt, Human
agaaagacaucuuucucu

SEQ ID NO: 3370037 - RNA, 20 nt, Human
agaaagacuaucuaaauguu

SEQ ID NO: 3370038 - RNA, 20 nt, Human
agaaagacuauucaaacagu

SEQ ID NO: 3370039 - RNA, 12 nt, Human
agaaagacugag

SEQ ID NO: 3370040 - RNA, 11 nt, Human
agaaagagaga

SEQ ID NO: 3370041 - RNA, 15 nt, Human
agaaagagagaaaau

SEQ ID NO: 3370042 - RNA, 22 nt, Human
agaaagagcacuuaagagaaua

SEQ ID NO: 3370043 - RNA, 12 nt, Human
agaaagagcuac

SEQ ID NO: 3370044 - RNA, 15 nt, Human
agaaagagcuaccug

SEQ ID NO: 3370045 - RNA, 16 nt, Human
agaaagaggagugcuu

SEQ ID NO: 3370046 - RNA, 18 nt, Human
agaaagaucauugaaauu

SEQ ID NO: 3370047 - RNA, 19 nt, Human
agaaagcaucccucaccca

SEQ ID NO: 3370048 - RNA, 17 nt, Human
agaaagccccacccagg

SEQ ID NO: 3370049 - RNA, 21 nt, Human
agaaagccugggugacauuug

SEQ ID NO: 3370050 - RNA, 18 nt, Human
agaaagccuguuguuuaa

SEQ ID NO: 3370051 - RNA, 18 nt, Human
agaaacuuaagcaaaggg

SEQ ID NO: 3370052 - RNA, 14 nt, Human
agaaacuuguuaga

SEQ ID NO: 3370053 - RNA, 12 nt, Human
agaaacuuuugu

SEQ ID NO: 3370054 - RNA, 13 nt, Human
agaaacuuuugua

SEQ ID NO: 3370055 - RNA, 15 nt, Human
agaaacuuuuguaaa

SEQ ID NO: 3370056 - RNA, 22 nt, Human
agaaagaaacccgacagaggga

SEQ ID NO: 3370057 - RNA, 14 nt, Human
agaaagaacuaucu

SEQ ID NO: 3370058 - RNA, 22 nt, Human
agaaagaagacaaacuuugcau

SEQ ID NO: 3370059 - RNA, 14 nt, Human
agaaagaaggaagu

SEQ ID NO: 3370060 - RNA, 18 nt, Human
agaaagaaggaagugaag

SEQ ID NO: 3370061 - RNA, 22 nt, Human
agaaagaauuuaguauuaucaa

SEQ ID NO: 3370062 - RNA, 18 nt, Human
agaaagacagagcuggga

SEQ ID NO: 3370063 - RNA, 16 nt, Human
agaaagacuauucaaa

SEQ ID NO: 3370064 - RNA, 12 nt, Human
agaaagacuugg

SEQ ID NO: 3370065 - RNA, 10 nt, Human
agaaagagag

SEQ ID NO: 3370066 - RNA, 14 nt, Human
agaaagagagaaaa

SEQ ID NO: 3370067 - RNA, 18 nt, Human
agaaagagagaaaauaaa

SEQ ID NO: 3370068 - RNA, 19 nt, Human
agaaagagcacuuaagaga

SEQ ID NO: 3370069 - RNA, 22 nt, Human
agaaagaggcaccaggaagccg

SEQ ID NO: 3370070 - RNA, 20 nt, Human
agaaagaggugaccccaggg

SEQ ID NO: 3370071 - RNA, 21 nt, Human
agaaagaggugaccccagggc

SEQ ID NO: 3370072 - RNA, 23 nt, Human
agaaagaggugaccccagggcac

SEQ ID NO: 3370073 - RNA, 19 nt, Human
agaaagauggaugugcuuu

SEQ ID NO: 3370074 - RNA, 14 nt, Human
agaaagauguauau

SEQ ID NO: 3370075 - RNA, 20 nt, Human
agaaagauguauauaggugu

SEQ ID NO: 3370076 - RNA, 20 nt, Human
agaaagauuacuuagaggaa

SEQ ID NO: 3370077 - RNA, 17 nt, Human
agaaagcaaaauuaugu

SEQ ID NO: 3370078 - RNA, 17 nt, Human
agaaagcagaacaguga

SEQ ID NO: 3370079 - RNA, 14 nt, Human
agaaagcagagauu

SEQ ID NO: 3370080 - RNA, 14 nt, Human
agaaagcagaggcu

SEQ ID NO: 3370081 - RNA, 12 nt, Human
agaaagcagggg

SEQ ID NO: 3370082 - RNA, 14 nt, Human
agaaagcaggggcu

SEQ ID NO: 3370083 - RNA, 20 nt, Human
agaaagcaggggcuacaaga

SEQ ID NO: 3370084 - RNA, 14 nt, Human
agaaagcauaaaau

SEQ ID NO: 3370085 - RNA, 15 nt, Human
agaaagcauauugac

SEQ ID NO: 3370086 - RNA, 16 nt, Human
agaaagcauauugacu

SEQ ID NO: 3370087 - RNA, 17 nt, Human
agaaagcauauugacuu

SEQ ID NO: 3370088 - RNA, 22 nt, Human
agaaagcaucccucacccaucc

SEQ ID NO: 3370089 - RNA, 13 nt, Human
agaaagcauuuga

SEQ ID NO: 3370090 - RNA, 15 nt, Human
agaaagcauuugaau

SEQ ID NO: 3370091 - RNA, 17 nt, Human
agaaagcauuugaaugc

SEQ ID NO: 3370092 - RNA, 22 nt, Human
agaaagcauuugaaugcauuuu

SEQ ID NO: 3370093 - RNA, 21 nt, Human
agaaagccaaaucaaaauaug

SEQ ID NO: 3370094 - RNA, 20 nt, Human
agaaagcccuuaggaagaau

SEQ ID NO: 3370095 - RNA, 21 nt, Human
agaaagccucagagaauugcu

SEQ ID NO: 3370096 - RNA, 11 nt, Human
agaaagccuga

SEQ ID NO: 3370097 - RNA, 12 nt, Human
agaaagccugag

SEQ ID NO: 3370098 - RNA, 18 nt, Human
agaaagccugggugacau

SEQ ID NO: 3370099 - RNA, 20 nt, Human
agaaagccuguuccccucac

SEQ ID NO: 3370100 - RNA, 20 nt, Human
agaaagccuuucauuuugcu

SEQ ID NO: 3370101 - RNA, 21 nt, Human
agaaagcugacuuggcuggug

SEQ ID NO: 3370102 - RNA, 23 nt, Human
agaaagcugacuuggcuggugug

SEQ ID NO: 3370103 - RNA, 22 nt, Human
agaaagcugugaacaggcuggg

SEQ ID NO: 3370104 - RNA, 20 nt, Human
agaaagcuuuguugaaagaa

SEQ ID NO: 3370105 - RNA, 15 nt, Human
agaaaggaaaccuuu

SEQ ID NO: 3370106 - RNA, 15 nt, Human
agaaaggacucuggg

SEQ ID NO: 3370107 - RNA, 12 nt, Human
agaaaggagagu

SEQ ID NO: 3370108 - RNA, 20 nt, Human
agaaaggaggggauagagag

SEQ ID NO: 3370109 - RNA, 23 nt, Human
agaaaggaggggauagagagaga

SEQ ID NO: 3370110 - RNA, 14 nt, Human
agaaaggauauuua

SEQ ID NO: 3370111 - RNA, 18 nt, Human
agaaaggauauuuaagaa

SEQ ID NO: 3370112 - RNA, 14 nt, Human
agaaaggccuuuaa

SEQ ID NO: 3370113 - RNA, 19 nt, Human
agaaaggccuuuaaaauuu

SEQ ID NO: 3370114 - RNA, 17 nt, Human
agaaaggcucuauucca

SEQ ID NO: 3370115 - RNA, 22 nt, Human
agaaaggcuguuaaauacagga

SEQ ID NO: 3370116 - RNA, 20 nt, Human
agaaagggagggcucugagg

SEQ ID NO: 3370117 - RNA, 16 nt, Human
agaaagggcccugggc

SEQ ID NO: 3370118 - RNA, 20 nt, Human
agaaagggcccugggccugc

SEQ ID NO: 3370119 - RNA, 23 nt, Human
agaaaggggcaggagcucagaug
